United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 211

SEQ ID NO: 8754329 - DNA, 19 bp, Homo sapiens
cacaacttcgcttgattcc

SEQ ID NO: 8754330 - DNA, 22 bp, Homo sapiens
cacaacttagcagcttgaaaca

SEQ ID NO: 8754331 - DNA, 20 bp, Homo sapiens
cacaactgtccacatgctcc

SEQ ID NO: 8754332 - DNA, 20 bp, Homo sapiens
cacaactgtccacatgctcc

SEQ ID NO: 8754333 - DNA, 22 bp, Homo sapiens
cacaacttagcaatgttttaga

SEQ ID NO: 8754334 - DNA, 22 bp, Homo sapiens
cacaactgccatctgagcagca

SEQ ID NO: 8754335 - DNA, 22 bp, Homo sapiens
cacaactgccagccaggaaagg

SEQ ID NO: 8754336 - DNA, 23 bp, Homo sapiens
cacaactaatcagaatctctagg

SEQ ID NO: 8754337 - DNA, 22 bp, Homo sapiens
cacaaatgtagtagcttaaaac

SEQ ID NO: 8754338 - DNA, 22 bp, Homo sapiens
cacaaatgtgcagaaatgtgag

SEQ ID NO: 8754339 - DNA, 22 bp, Homo sapiens
cacaaatggccgtgttcaaaga

SEQ ID NO: 8754340 - DNA, 22 bp, Homo sapiens
cacaaatggttgtagacattaa

SEQ ID NO: 8754341 - DNA, 22 bp, Homo sapiens
cacaaatggttgtagacattaa

SEQ ID NO: 8754342 - DNA, 22 bp, Homo sapiens
gctggaagggaggcccagccgg

SEQ ID NO: 8754343 - DNA, 22 bp, Homo sapiens
gctggaaggctaggctcagttg

SEQ ID NO: 8754344 - DNA, 22 bp, Homo sapiens
gctggaaggctaggctcagttg

SEQ ID NO: 8754345 - DNA, 22 bp, Homo sapiens
gctggaacagtctttaagcagg

SEQ ID NO: 8754346 - DNA, 22 bp, Homo sapiens
gctggaagaatgagtgcctcgt

SEQ ID NO: 8754347 - DNA, 22 bp, Homo sapiens
gctggaaaaggaggcaaaatat

SEQ ID NO: 8754348 - DNA, 22 bp, Homo sapiens
gctggaaatgaatggagaggtg

SEQ ID NO: 8754349 - DNA, 22 bp, Homo sapiens
gctgctttttggatttggcaca

SEQ ID NO: 8754350 - DNA, 22 bp, Homo sapiens
gctgctttctgttaggaattgg

SEQ ID NO: 8754351 - DNA, 22 bp, Homo sapiens
gctgctttgcagtagagtaata

SEQ ID NO: 8754352 - DNA, 22 bp, Homo sapiens
gctgctttgacagtgggaacag

SEQ ID NO: 8754353 - DNA, 22 bp, Homo sapiens
gctgctttgcagtagagtaata

SEQ ID NO: 8754354 - DNA, 22 bp, Homo sapiens
gctgctttggggatgaatgaga

SEQ ID NO: 8754355 - DNA, 22 bp, Homo sapiens
gctgctttgtgaaaatcattca

SEQ ID NO: 8754356 - DNA, 22 bp, Homo sapiens
gctgctttgtctgtaaaatgga

SEQ ID NO: 8754357 - DNA, 22 bp, Homo sapiens
gctgcctgccctgggtcatctg

SEQ ID NO: 8754358 - DNA, 18 bp, Homo sapiens
gctgcctgcattcctcac

SEQ ID NO: 8754359 - DNA, 21 bp, Homo sapiens
gctgcctgcccctcgggggct

SEQ ID NO: 8754360 - DNA, 22 bp, Homo sapiens
gctgcctgcacagagctgcttt

SEQ ID NO: 8754361 - DNA, 22 bp, Homo sapiens
gctgcctgcagtgttttcccag

SEQ ID NO: 8754362 - DNA, 22 bp, Homo sapiens
gctgcctgccttgcctggagga

SEQ ID NO: 8754363 - DNA, 22 bp, Homo sapiens
gctgctggccgcccagcttctc

SEQ ID NO: 8754364 - DNA, 22 bp, Homo sapiens
gctgcctgcctgcatttaatcc

SEQ ID NO: 8754365 - DNA, 22 bp, Homo sapiens
gctgcctgcctagttccacagt

SEQ ID NO: 8754366 - DNA, 22 bp, Homo sapiens
gctgcctgccctgggtcatctg

SEQ ID NO: 8754367 - DNA, 22 bp, Homo sapiens
caagaatataaatactttcaaa

SEQ ID NO: 8754368 - DNA, 22 bp, Homo sapiens
caagaatataaatactttcaaa

SEQ ID NO: 8754369 - DNA, 22 bp, Homo sapiens
caagaatcaacattatttagtg

SEQ ID NO: 8754370 - DNA, 22 bp, Homo sapiens
caagaatataaatactttcaaa

SEQ ID NO: 8754371 - DNA, 22 bp, Homo sapiens
caagaataaccagacaatagca

SEQ ID NO: 8754372 - DNA, 22 bp, Homo sapiens
caagaatgaattcaatgtgtgg

SEQ ID NO: 8754373 - DNA, 22 bp, Homo sapiens
caagaatcttgcagcttagact

SEQ ID NO: 8754374 - DNA, 22 bp, Homo sapiens
caagaatcttgcagcttagact

SEQ ID NO: 8754375 - DNA, 18 bp, Homo sapiens
caagaatctctaaagaag

SEQ ID NO: 8754376 - DNA, 22 bp, Homo sapiens
caagaatcctgttcttgaagat

SEQ ID NO: 8754377 - DNA, 22 bp, Homo sapiens
caagacaagatctaagcatgct

SEQ ID NO: 8754378 - DNA, 19 bp, Homo sapiens
caagacaaagcccatcttc

SEQ ID NO: 8754379 - DNA, 22 bp, Homo sapiens
caagaattaagaattttgatgt

SEQ ID NO: 8754380 - DNA, 22 bp, Homo sapiens
gctggagaaacaggaggaggaa

SEQ ID NO: 8754381 - DNA, 22 bp, Homo sapiens
caagaagaggtgattggtaagt

SEQ ID NO: 8754382 - DNA, 22 bp, Homo sapiens
gctggaagtaaaaacttactag

SEQ ID NO: 8754383 - DNA, 20 bp, Homo sapiens
gctggaagggctagagggct

SEQ ID NO: 8754384 - DNA, 22 bp, Homo sapiens
gctggacaggccacatggagga

SEQ ID NO: 8754385 - DNA, 22 bp, Homo sapiens
gctggactagaagcagggctca

SEQ ID NO: 8754386 - DNA, 22 bp, Homo sapiens
gctggaccaggtgtgcacaggc

SEQ ID NO: 8754387 - DNA, 22 bp, Homo sapiens
gctggactcaggggactcaggg

SEQ ID NO: 8754388 - DNA, 22 bp, Homo sapiens
gctggctgacagagatttaaaa

SEQ ID NO: 8754389 - DNA, 22 bp, Homo sapiens
gctggctgacagatttggggtg

SEQ ID NO: 8754390 - DNA, 17 bp, Homo sapiens
gctggctgacccatgcc

SEQ ID NO: 8754391 - DNA, 20 bp, Homo sapiens
gctggctgaactgaaagcaa

SEQ ID NO: 8754392 - DNA, 20 bp, Homo sapiens
gctggctgaactgaaagcaa

SEQ ID NO: 8754393 - DNA, 22 bp, Homo sapiens
gctggctctttttgccgggctc

SEQ ID NO: 8754394 - DNA, 22 bp, Homo sapiens
gctggctctttttgccgggctc

SEQ ID NO: 8754395 - DNA, 22 bp, Homo sapiens
gctggctctttttgccgggctc

SEQ ID NO: 8754396 - DNA, 22 bp, Homo sapiens
gctggcccagggtcacctagga

SEQ ID NO: 8754397 - DNA, 22 bp, Homo sapiens
gctggctgaggtctagctcttt

SEQ ID NO: 8754398 - DNA, 22 bp, Homo sapiens
gctggctgaggtctagctcttt

SEQ ID NO: 8754399 - DNA, 22 bp, Homo sapiens
gctggctgaggtctagctcttt

SEQ ID NO: 8754400 - DNA, 22 bp, Homo sapiens
gctggctgagatctgttttcct

SEQ ID NO: 8754401 - DNA, 22 bp, Homo sapiens
gctggctgagcactggtttata

SEQ ID NO: 8754402 - DNA, 22 bp, Homo sapiens
gctggctgagttctgtcgtctg

SEQ ID NO: 8754403 - DNA, 22 bp, Homo sapiens
gctggctgagttctgtcgtctg

SEQ ID NO: 8754404 - DNA, 22 bp, Homo sapiens
gctggctgagttctgtcgtctg

SEQ ID NO: 8754405 - DNA, 22 bp, Homo sapiens
gctggctgaggtctagctcttt

SEQ ID NO: 8754406 - DNA, 22 bp, Homo sapiens
gctggctgagttctgtcgtctg

SEQ ID NO: 8754407 - DNA, 22 bp, Homo sapiens
caagccatactgggtgaaatca

SEQ ID NO: 8754408 - DNA, 22 bp, Homo sapiens
caagccatattttgaagaatga

SEQ ID NO: 8754409 - DNA, 20 bp, Homo sapiens
caagccctctttagcctgcc

SEQ ID NO: 8754410 - DNA, 22 bp, Homo sapiens
caagcccttccgggaacagttg

SEQ ID NO: 8754411 - DNA, 22 bp, Homo sapiens
gctgggcttgtggccagctggg

SEQ ID NO: 8754412 - DNA, 22 bp, Homo sapiens
gctgggcttgtggccagctggg

SEQ ID NO: 8754413 - DNA, 22 bp, Homo sapiens
gctgggcttgtggccagctggg

SEQ ID NO: 8754414 - DNA, 20 bp, Homo sapiens
gctgggctttgactgacaca

SEQ ID NO: 8754415 - DNA, 20 bp, Homo sapiens
gctgggctttgactgacaca

SEQ ID NO: 8754416 - DNA, 19 bp, Homo sapiens
gctggggaatggatattga

SEQ ID NO: 8754417 - DNA, 19 bp, Homo sapiens
gctggggaatggatattga

SEQ ID NO: 8754418 - DNA, 22 bp, Homo sapiens
gctggggaccagctgtctctga

SEQ ID NO: 8754419 - DNA, 22 bp, Homo sapiens
gctggggaccagctgtctctga

SEQ ID NO: 8754420 - DNA, 22 bp, Homo sapiens
gctggggaccagctgtctctga

SEQ ID NO: 8754421 - DNA, 22 bp, Homo sapiens
gctggggagaattgggttatct

SEQ ID NO: 8754422 - DNA, 22 bp, Homo sapiens
gctggggactccccaccatagc

SEQ ID NO: 8754423 - DNA, 22 bp, Homo sapiens
gctggggagcaagagtagtgag

SEQ ID NO: 8754424 - DNA, 22 bp, Homo sapiens
gctggggagaattgggttatct

SEQ ID NO: 8754425 - DNA, 22 bp, Homo sapiens
gctggggagcaagagtagtgag

SEQ ID NO: 8754426 - DNA, 22 bp, Homo sapiens
gctggggagcaagagtagtgag

SEQ ID NO: 8754427 - DNA, 22 bp, Homo sapiens
gctggggagcaagagtagtgag

SEQ ID NO: 8754428 - DNA, 22 bp, Homo sapiens
caagctgaacactgtcttcaag

SEQ ID NO: 8754429 - DNA, 22 bp, Homo sapiens
caagctctgggatagcagagag

SEQ ID NO: 8754430 - DNA, 22 bp, Homo sapiens
gctgggctcaccaggccactag

SEQ ID NO: 8754431 - DNA, 22 bp, Homo sapiens
caagctctgggatagcagagag

SEQ ID NO: 8754432 - DNA, 22 bp, Homo sapiens
caaagtgagttataaacatctt

SEQ ID NO: 8754433 - DNA, 22 bp, Homo sapiens
caaagtgagttataaacatctt

SEQ ID NO: 8754434 - DNA, 22 bp, Homo sapiens
caaagtgagagaatggcagaaa

SEQ ID NO: 8754435 - DNA, 22 bp, Homo sapiens
caaagtgagagaatggcagaaa

SEQ ID NO: 8754436 - DNA, 22 bp, Homo sapiens
caaagtgagttataaacatctt

SEQ ID NO: 8754437 - DNA, 22 bp, Homo sapiens
gctgccctcccagggcaagctt

SEQ ID NO: 8754438 - DNA, 22 bp, Homo sapiens
gctgccctctgtgacccggccc

SEQ ID NO: 8754439 - DNA, 21 bp, Homo sapiens
gctgccctggctcagcattca

SEQ ID NO: 8754440 - DNA, 22 bp, Homo sapiens
gctgccctgcatctgtgccttc

SEQ ID NO: 8754441 - DNA, 22 bp, Homo sapiens
gctgccctgcctcagactcctc

SEQ ID NO: 8754442 - DNA, 22 bp, Homo sapiens
gctgccctgactccagcagcct

SEQ ID NO: 8754443 - DNA, 22 bp, Homo sapiens
caaagtcccagctgcttagaga

SEQ ID NO: 8754444 - DNA, 22 bp, Homo sapiens
caaagtcatggggatgcaggtc

SEQ ID NO: 8754445 - DNA, 22 bp, Homo sapiens
caaagtcatggggatgcaggtc

SEQ ID NO: 8754446 - DNA, 22 bp, Homo sapiens
caaagtcataaaacttgtaagt

SEQ ID NO: 8754447 - DNA, 22 bp, Homo sapiens
gctctggaggctggaagaccat

SEQ ID NO: 8754448 - DNA, 23 bp, Homo sapiens
gctctggagctgggcctggcagg

SEQ ID NO: 8754449 - DNA, 17 bp, Homo sapiens
gctctggcacaggattg

SEQ ID NO: 8754450 - DNA, 17 bp, Homo sapiens
gctctggcacaggattg

SEQ ID NO: 8754451 - DNA, 22 bp, Homo sapiens
caaagtcagctgccagtcccaa

SEQ ID NO: 8754452 - DNA, 22 bp, Homo sapiens
caaagtcagccagctagtaggt

SEQ ID NO: 8754453 - DNA, 17 bp, Homo sapiens
gctctggcacaggattg

SEQ ID NO: 8754454 - DNA, 22 bp, Homo sapiens
gctctggaccctggagtggctg

SEQ ID NO: 8754455 - DNA, 22 bp, Homo sapiens
gctctggactggggcctgagaa

SEQ ID NO: 8754456 - DNA, 22 bp, Homo sapiens
gctctggagcactggaaacact

SEQ ID NO: 8754457 - DNA, 22 bp, Homo sapiens
gctctggagatggagccttgag

SEQ ID NO: 8754458 - DNA, 22 bp, Homo sapiens
gctctggaagcatctgagagga

SEQ ID NO: 8754459 - DNA, 22 bp, Homo sapiens
gctctggaagcatctgagagga

SEQ ID NO: 8754460 - DNA, 22 bp, Homo sapiens
gctctgctgtgtttgttcagca

SEQ ID NO: 8754461 - DNA, 22 bp, Homo sapiens
gctctgcttgcatcatgactgc

SEQ ID NO: 8754462 - DNA, 22 bp, Homo sapiens
gctctgcttgcatcatgactgc

SEQ ID NO: 8754463 - DNA, 22 bp, Homo sapiens
gctctgctttctggggggatcc

SEQ ID NO: 8754464 - DNA, 22 bp, Homo sapiens
caacaatatgctgagtttttca

SEQ ID NO: 8754465 - DNA, 22 bp, Homo sapiens
caacacaggggttatgccatgg

SEQ ID NO: 8754466 - DNA, 22 bp, Homo sapiens
caacacaggggttatgccatgg

SEQ ID NO: 8754467 - DNA, 22 bp, Homo sapiens
caacacaggttctgcaaaggaa

SEQ ID NO: 8754468 - DNA, 22 bp, Homo sapiens
caacacaggttctgcaaaggaa

SEQ ID NO: 8754469 - DNA, 22 bp, Homo sapiens
caacactgacaatggactgatt

SEQ ID NO: 8754470 - DNA, 22 bp, Homo sapiens
caactttagcaatgttagtata

SEQ ID NO: 8754471 - DNA, 22 bp, Homo sapiens
caactttatgattggtttgtca

SEQ ID NO: 8754472 - DNA, 22 bp, Homo sapiens
caaattttgtgtgttctctagt

SEQ ID NO: 8754473 - DNA, 22 bp, Homo sapiens
caaattttgtgtgttctctagt

SEQ ID NO: 8754474 - DNA, 22 bp, Homo sapiens
caaattttgtgtgttctctagt

SEQ ID NO: 8754475 - DNA, 22 bp, Homo sapiens
caacaagcgctcagagcaaagc

SEQ ID NO: 8754476 - DNA, 22 bp, Homo sapiens
caacaatatgctgagtttttca

SEQ ID NO: 8754477 - DNA, 22 bp, Homo sapiens
caacaagggacagtgttctaaa

SEQ ID NO: 8754478 - DNA, 22 bp, Homo sapiens
caacaagggacagtgttctaaa

SEQ ID NO: 8754479 - DNA, 22 bp, Homo sapiens
caacaagtgttcgtaaagtgcc

SEQ ID NO: 8754480 - DNA, 22 bp, Homo sapiens
caacaatatgccagactcaatt

SEQ ID NO: 8754481 - DNA, 22 bp, Homo sapiens
gctgccctgtccggctctcctg

SEQ ID NO: 8754482 - DNA, 22 bp, Homo sapiens
gctgccctgtctgcagcaggac

SEQ ID NO: 8754483 - DNA, 22 bp, Homo sapiens
gctgccctgtctgcagcaggac

SEQ ID NO: 8754484 - DNA, 22 bp, Homo sapiens
gctgccctgtctgcagcaggac

SEQ ID NO: 8754485 - DNA, 22 bp, Homo sapiens
caaattttgtgtgttctctagt

SEQ ID NO: 8754486 - DNA, 22 bp, Homo sapiens
caaattttgtgtgttctctagt

SEQ ID NO: 8754487 - DNA, 22 bp, Homo sapiens
caagaaactttattctgccata

SEQ ID NO: 8754488 - DNA, 22 bp, Homo sapiens
caagaaactttattctgccata

SEQ ID NO: 8754489 - DNA, 22 bp, Homo sapiens
caagaaacaccaatgactgctg

SEQ ID NO: 8754490 - DNA, 22 bp, Homo sapiens
caagaaatgggatttgactgcc

SEQ ID NO: 8754491 - DNA, 22 bp, Homo sapiens
caagaaatgggatttgactgcc

SEQ ID NO: 8754492 - DNA, 22 bp, Homo sapiens
caagaaatgggatttgactgcc

SEQ ID NO: 8754493 - DNA, 22 bp, Homo sapiens
caagaaatctagaagtcagtgg

SEQ ID NO: 8754494 - DNA, 22 bp, Homo sapiens
caagaaattctgttcagatagc

SEQ ID NO: 8754495 - DNA, 22 bp, Homo sapiens
caagaaatgtttactgagcatc

SEQ ID NO: 8754496 - DNA, 22 bp, Homo sapiens
caagaaattctgttcagatagc

SEQ ID NO: 8754497 - DNA, 22 bp, Homo sapiens
caagaaatgtttactgagcatc

SEQ ID NO: 8754498 - DNA, 22 bp, Homo sapiens
caactttctgttaaatgttagt

SEQ ID NO: 8754499 - DNA, 23 bp, Homo sapiens
caacttttggctacatgcttagc

SEQ ID NO: 8754500 - DNA, 22 bp, Homo sapiens
caagaaacaccaatgactgctg

SEQ ID NO: 8754501 - DNA, 22 bp, Homo sapiens
caacttttgacacgtgtgctaa

SEQ ID NO: 8754502 - DNA, 22 bp, Homo sapiens
caacttttctgtgaatttaagt

SEQ ID NO: 8754503 - DNA, 22 bp, Homo sapiens
caacttttctgtgaatttaagt

SEQ ID NO: 8754504 - DNA, 22 bp, Homo sapiens
caagaaattctgttcagatagc

SEQ ID NO: 8754505 - DNA, 22 bp, Homo sapiens
caagaaatttcttaagaactaa

SEQ ID NO: 8754506 - DNA, 22 bp, Homo sapiens
caagaaatttcttaagaactaa

SEQ ID NO: 8754507 - DNA, 22 bp, Homo sapiens
gctgcctgatttacatagtgaa

SEQ ID NO: 8754508 - DNA, 17 bp, Homo sapiens
gctgcctgcaactgact

SEQ ID NO: 8754509 - DNA, 22 bp, Homo sapiens
gctgcctgcacagagctgcttt

SEQ ID NO: 8754510 - DNA, 22 bp, Homo sapiens
gctgcctgcacagagctgcttt

SEQ ID NO: 8754511 - DNA, 22 bp, Homo sapiens
gctgcctgatgtccagcaggac

SEQ ID NO: 8754512 - DNA, 22 bp, Homo sapiens
gctgcctgatttacatagtgaa

SEQ ID NO: 8754513 - DNA, 22 bp, Homo sapiens
cacaggcacccctgactgctca

SEQ ID NO: 8754514 - DNA, 23 bp, Homo sapiens
cacaggcagaaatcaagacggta

SEQ ID NO: 8754515 - DNA, 23 bp, Homo sapiens
cacaggcagaaatcaagacggta

SEQ ID NO: 8754516 - DNA, 23 bp, Homo sapiens
cacaggcagaaatcaagacggta

SEQ ID NO: 8754517 - DNA, 22 bp, Homo sapiens
cacaggcacgcctctggccagg

SEQ ID NO: 8754518 - DNA, 22 bp, Homo sapiens
cacaggcacgcctctggccagg

SEQ ID NO: 8754519 - DNA, 22 bp, Homo sapiens
cacaggcacgcctctggccagg

SEQ ID NO: 8754520 - DNA, 22 bp, Homo sapiens
cacaggcagccttgtagaagaa

SEQ ID NO: 8754521 - DNA, 22 bp, Homo sapiens
cacaggcagccttgtagaagaa

SEQ ID NO: 8754522 - DNA, 22 bp, Homo sapiens
cacaggcagccttgtagaagaa

SEQ ID NO: 8754523 - DNA, 18 bp, Homo sapiens
cacaggcaggtgataggt

SEQ ID NO: 8754524 - DNA, 18 bp, Homo sapiens
cacaggcaggtgataggt

SEQ ID NO: 8754525 - DNA, 22 bp, Homo sapiens
cacaggcaggaggttctccagt

SEQ ID NO: 8754526 - DNA, 22 bp, Homo sapiens
cacaggcaggaggttctccagt

SEQ ID NO: 8754527 - DNA, 22 bp, Homo sapiens
cacaggcaggaggttctccagt

SEQ ID NO: 8754528 - DNA, 22 bp, Homo sapiens
ggagagctagtgcctgccagta

SEQ ID NO: 8754529 - DNA, 20 bp, Homo sapiens
ggagagccacatagtctccc

SEQ ID NO: 8754530 - DNA, 20 bp, Homo sapiens
ggagagccacatagtctccc

SEQ ID NO: 8754531 - DNA, 22 bp, Homo sapiens
ggagagcctccacggcttctgt

SEQ ID NO: 8754532 - DNA, 18 bp, Homo sapiens
cacaggagccacactcac

SEQ ID NO: 8754533 - DNA, 23 bp, Homo sapiens
ggagagctcctcgtgactcactg

SEQ ID NO: 8754534 - DNA, 22 bp, Homo sapiens
ggagagctagtgcctgccagta

SEQ ID NO: 8754535 - DNA, 22 bp, Homo sapiens
cacaggaggttaggaagtggtc

SEQ ID NO: 8754536 - DNA, 22 bp, Homo sapiens
cacaggaggttaggaagtggtc

SEQ ID NO: 8754537 - DNA, 18 bp, Homo sapiens
cacaggcaggtgataggt

SEQ ID NO: 8754538 - DNA, 18 bp, Homo sapiens
cacaggcaggtgataggt

SEQ ID NO: 8754539 - DNA, 18 bp, Homo sapiens
cacaggcaggtgataggt

SEQ ID NO: 8754540 - DNA, 22 bp, Homo sapiens
cacaggccagtaagactgtgtt

SEQ ID NO: 8754541 - DNA, 22 bp, Homo sapiens
cacaggccaataccctctctct

SEQ ID NO: 8754542 - DNA, 22 bp, Homo sapiens
cacaggccaataccctctctct

SEQ ID NO: 8754543 - DNA, 22 bp, Homo sapiens
cacaggccaataccctctctct

SEQ ID NO: 8754544 - DNA, 22 bp, Homo sapiens
cacaggccagtaagactgtgtt

SEQ ID NO: 8754545 - DNA, 20 bp, Homo sapiens
cacaggccccaagacctgta

SEQ ID NO: 8754546 - DNA, 20 bp, Homo sapiens
cacaggccccaagacctgta

SEQ ID NO: 8754547 - DNA, 22 bp, Homo sapiens
cacaggcctgtctctttctaac

SEQ ID NO: 8754548 - DNA, 20 bp, Homo sapiens
cacaggccttgtgagcagac

SEQ ID NO: 8754549 - DNA, 20 bp, Homo sapiens
cacaggccttgtgagcagac

SEQ ID NO: 8754550 - DNA, 20 bp, Homo sapiens
cacaggccttgtgagcagac

SEQ ID NO: 8754551 - DNA, 22 bp, Homo sapiens
cacagggcaggtactctcagag

SEQ ID NO: 8754552 - DNA, 22 bp, Homo sapiens
cacagggcaggtactctcagag

SEQ ID NO: 8754553 - DNA, 22 bp, Homo sapiens
cacagggcaggtactctcagag

SEQ ID NO: 8754554 - DNA, 22 bp, Homo sapiens
cacagggctttgatggctgagt

SEQ ID NO: 8754555 - DNA, 22 bp, Homo sapiens
cacaggggcaaactgtagggga

SEQ ID NO: 8754556 - DNA, 22 bp, Homo sapiens
cacaggtgcaagaagttgcagt

SEQ ID NO: 8754557 - DNA, 22 bp, Homo sapiens
cacaggtgccatctcttcatgg

SEQ ID NO: 8754558 - DNA, 22 bp, Homo sapiens
cacaggtccttcctgccctggg

SEQ ID NO: 8754559 - DNA, 22 bp, Homo sapiens
cacaggtccttcctgccctggg

SEQ ID NO: 8754560 - DNA, 22 bp, Homo sapiens
cacaggtccttcctgccctggg

SEQ ID NO: 8754561 - DNA, 22 bp, Homo sapiens
cacaggtatatgtgtatatact

SEQ ID NO: 8754562 - DNA, 22 bp, Homo sapiens
cacaggtatatgtgtatatact

SEQ ID NO: 8754563 - DNA, 22 bp, Homo sapiens
cacaggtagatgccatgcagca

SEQ ID NO: 8754564 - DNA, 22 bp, Homo sapiens
cacaggtatatgtgtatatact

SEQ ID NO: 8754565 - DNA, 22 bp, Homo sapiens
cacaggtaatagcctaggctat

SEQ ID NO: 8754566 - DNA, 22 bp, Homo sapiens
cacaggtgttcttgcagtgaaa

SEQ ID NO: 8754567 - DNA, 23 bp, Homo sapiens
cacaggtgtttcatcttctcagt

SEQ ID NO: 8754568 - DNA, 23 bp, Homo sapiens
cacaggtgtttcatcttctcagt

SEQ ID NO: 8754569 - DNA, 23 bp, Homo sapiens
cacaggtgtttcatcttctcagt

SEQ ID NO: 8754570 - DNA, 22 bp, Homo sapiens
cacaggtgctcctcggggagct

SEQ ID NO: 8754571 - DNA, 22 bp, Homo sapiens
cacaggtgtctctagtagcgtt

SEQ ID NO: 8754572 - DNA, 22 bp, Homo sapiens
cacaggtgtctctagtagcgtt

SEQ ID NO: 8754573 - DNA, 22 bp, Homo sapiens
cacaggtgtatgaatatgtcca

SEQ ID NO: 8754574 - DNA, 22 bp, Homo sapiens
cacaggtgtatgaatatgtcca

SEQ ID NO: 8754575 - DNA, 22 bp, Homo sapiens
cacagtgaacattctgtcaggg

SEQ ID NO: 8754576 - DNA, 22 bp, Homo sapiens
cacagtgaagcatgcagacatc

SEQ ID NO: 8754577 - DNA, 22 bp, Homo sapiens
cacagtgaattacatagacgtg

SEQ ID NO: 8754578 - DNA, 22 bp, Homo sapiens
cacaggtttgacaaggataaaa

SEQ ID NO: 8754579 - DNA, 22 bp, Homo sapiens
cacaggtttcaaggataagatg

SEQ ID NO: 8754580 - DNA, 22 bp, Homo sapiens
cacaggtttcaaggataagatg

SEQ ID NO: 8754581 - DNA, 22 bp, Homo sapiens
cacaggttcaaattcaggtcgc

SEQ ID NO: 8754582 - DNA, 22 bp, Homo sapiens
cacaggttcacctcaggtaggt

SEQ ID NO: 8754583 - DNA, 22 bp, Homo sapiens
cacaggttgggggagttgataa

SEQ ID NO: 8754584 - DNA, 22 bp, Homo sapiens
cacaggttaggtattatactat

SEQ ID NO: 8754585 - DNA, 22 bp, Homo sapiens
cacaggttagcagcttgaaact

SEQ ID NO: 8754586 - DNA, 22 bp, Homo sapiens
cacaggttaggtattatactat

SEQ ID NO: 8754587 - DNA, 22 bp, Homo sapiens
cacagtgaatttcaagtgttgt

SEQ ID NO: 8754588 - DNA, 22 bp, Homo sapiens
cacagtgactggcacatagtaa

SEQ ID NO: 8754589 - DNA, 22 bp, Homo sapiens
cacagtgactggcacatagtaa

SEQ ID NO: 8754590 - DNA, 22 bp, Homo sapiens
cacagtgacattagtgagaaaa

SEQ ID NO: 8754591 - DNA, 22 bp, Homo sapiens
cacagtgagctgggcatcagtt

SEQ ID NO: 8754592 - DNA, 22 bp, Homo sapiens
cacagtgagtatttagtaccta

SEQ ID NO: 8754593 - DNA, 22 bp, Homo sapiens
cacagtgactggcacctagtat

SEQ ID NO: 8754594 - DNA, 18 bp, Homo sapiens
cacagtgacttctgatac

SEQ ID NO: 8754595 - DNA, 18 bp, Homo sapiens
cacagtgacttctgatac

SEQ ID NO: 8754596 - DNA, 22 bp, Homo sapiens
cacagtgcatgatgggcagaag

SEQ ID NO: 8754597 - DNA, 22 bp, Homo sapiens
ggcaaggggtcaggctgagaca

SEQ ID NO: 8754598 - DNA, 22 bp, Homo sapiens
ggcaaggggtcaggctgagaca

SEQ ID NO: 8754599 - DNA, 22 bp, Homo sapiens
ggcaaggggtcaggctgagaca

SEQ ID NO: 8754600 - DNA, 22 bp, Homo sapiens
ggcaaggggtcaggctgagaca

SEQ ID NO: 8754601 - DNA, 22 bp, Homo sapiens
cacagtgcgaaagaaacccagc

SEQ ID NO: 8754602 - DNA, 22 bp, Homo sapiens
ggcaagtggaggtgttcatcag

SEQ ID NO: 8754603 - DNA, 22 bp, Homo sapiens
ggcaagtcaggaagttgacatt

SEQ ID NO: 8754604 - DNA, 22 bp, Homo sapiens
ggcaagggttgaagataaggta

SEQ ID NO: 8754605 - DNA, 22 bp, Homo sapiens
ggcaaggtactctagagcacat

SEQ ID NO: 8754606 - DNA, 22 bp, Homo sapiens
ggcaaggtactctagagcacat

SEQ ID NO: 8754607 - DNA, 22 bp, Homo sapiens
ggcaaggtactctagagcacat

SEQ ID NO: 8754608 - DNA, 20 bp, Homo sapiens
ggcaatgccagatgacagga

SEQ ID NO: 8754609 - DNA, 22 bp, Homo sapiens
ggcaatgtagattctgtagatt

SEQ ID NO: 8754610 - DNA, 22 bp, Homo sapiens
ggcaatgaagtgaagagattaa

SEQ ID NO: 8754611 - DNA, 22 bp, Homo sapiens
ggcaatatattctgaattcagt

SEQ ID NO: 8754612 - DNA, 22 bp, Homo sapiens
ggcaatatggtgaaaccccatc

SEQ ID NO: 8754613 - DNA, 22 bp, Homo sapiens
ggcaatagttgtgggttcttta

SEQ ID NO: 8754614 - DNA, 22 bp, Homo sapiens
ggcaataatctactctgccact

SEQ ID NO: 8754615 - DNA, 23 bp, Homo sapiens
ggcaataacgagcttgtctctga

SEQ ID NO: 8754616 - DNA, 22 bp, Homo sapiens
ggcaatagttgtgggttcttta

SEQ ID NO: 8754617 - DNA, 22 bp, Homo sapiens
ggcaataatgacattttaaaaa

SEQ ID NO: 8754618 - DNA, 22 bp, Homo sapiens
ggcaataaatgacttctgcatt

SEQ ID NO: 8754619 - DNA, 23 bp, Homo sapiens
ggcaataacgagcttgtctctga

SEQ ID NO: 8754620 - DNA, 22 bp, Homo sapiens
ggcaataaaagtatccagtttc

SEQ ID NO: 8754621 - DNA, 22 bp, Homo sapiens
ggcaatttgcagtttgtcttat

SEQ ID NO: 8754622 - DNA, 22 bp, Homo sapiens
ggcaatttggtcatttgtattg

SEQ ID NO: 8754623 - DNA, 22 bp, Homo sapiens
ggcaattttaggcatgaatgaa

SEQ ID NO: 8754624 - DNA, 16 bp, Homo sapiens
cacatatatttatatg

SEQ ID NO: 8754625 - DNA, 16 bp, Homo sapiens
cacatatatttatatg

SEQ ID NO: 8754626 - DNA, 22 bp, Homo sapiens
ggcacaaaggaataaagagaac

SEQ ID NO: 8754627 - DNA, 22 bp, Homo sapiens
cacatgaaggctggggtcgtga

SEQ ID NO: 8754628 - DNA, 22 bp, Homo sapiens
cacatgaaggctggggtcgtga

SEQ ID NO: 8754629 - DNA, 22 bp, Homo sapiens
cacatgaaggctggggtcgtga

SEQ ID NO: 8754630 - DNA, 22 bp, Homo sapiens
cacatgaaggctggggtcgtga

SEQ ID NO: 8754631 - DNA, 22 bp, Homo sapiens
cacatgaagattcaactggatg

SEQ ID NO: 8754632 - DNA, 22 bp, Homo sapiens
cacatgaagattcaactggatg

SEQ ID NO: 8754633 - DNA, 22 bp, Homo sapiens
cacatgaagattcaactggatg

SEQ ID NO: 8754634 - DNA, 22 bp, Homo sapiens
cacatgaattcacatgtatttt

SEQ ID NO: 8754635 - DNA, 22 bp, Homo sapiens
cacatgaataaggctttattgt

SEQ ID NO: 8754636 - DNA, 22 bp, Homo sapiens
cacatgaattcacatgtatttt

SEQ ID NO: 8754637 - DNA, 22 bp, Homo sapiens
cacatgaggtggagatgaatga

SEQ ID NO: 8754638 - DNA, 22 bp, Homo sapiens
cacatgaggtggagatgaatga

SEQ ID NO: 8754639 - DNA, 19 bp, Homo sapiens
cacatgagggctgagggac

SEQ ID NO: 8754640 - DNA, 22 bp, Homo sapiens
cacatgagagcccccaagagca

SEQ ID NO: 8754641 - DNA, 23 bp, Homo sapiens
cacatgacctgacctaggctagg

SEQ ID NO: 8754642 - DNA, 22 bp, Homo sapiens
cacatgacactattttgttcta

SEQ ID NO: 8754643 - DNA, 22 bp, Homo sapiens
cacatgaccactctttacttct

SEQ ID NO: 8754644 - DNA, 22 bp, Homo sapiens
cacatgagacaattaaagactt

SEQ ID NO: 8754645 - DNA, 22 bp, Homo sapiens
cacatgatcgtcatgtgaaagt

SEQ ID NO: 8754646 - DNA, 22 bp, Homo sapiens
cacatgatcgtcatgtgaaagt

SEQ ID NO: 8754647 - DNA, 22 bp, Homo sapiens
cacatgatcacttcttgaaaat

SEQ ID NO: 8754648 - DNA, 22 bp, Homo sapiens
cacatgatcacttcttgaaaat

SEQ ID NO: 8754649 - DNA, 22 bp, Homo sapiens
cacatgatcacttcttgaaaat

SEQ ID NO: 8754650 - DNA, 22 bp, Homo sapiens
cacatgatcgtcatgtgaaagt

SEQ ID NO: 8754651 - DNA, 22 bp, Homo sapiens
cacatgagtgagaacatgcagt

SEQ ID NO: 8754652 - DNA, 22 bp, Homo sapiens
cacatgagtgagaacatgcagt

SEQ ID NO: 8754653 - DNA, 22 bp, Homo sapiens
cacatgagtgtaggaagaggga

SEQ ID NO: 8754654 - DNA, 22 bp, Homo sapiens
cacatgagtgagaacatgcagt

SEQ ID NO: 8754655 - DNA, 22 bp, Homo sapiens
cacatgcaccagaaatcaacat

SEQ ID NO: 8754656 - DNA, 22 bp, Homo sapiens
cacatgcaccagaaatcaacat

SEQ ID NO: 8754657 - DNA, 22 bp, Homo sapiens
cacatgcaccagaaatcaacat

SEQ ID NO: 8754658 - DNA, 22 bp, Homo sapiens
cacatgcaccagaaatcaacat

SEQ ID NO: 8754659 - DNA, 22 bp, Homo sapiens
ggcagagtgctctgggcagggg

SEQ ID NO: 8754660 - DNA, 22 bp, Homo sapiens
ggcagagtcagaggtggttctg

SEQ ID NO: 8754661 - DNA, 22 bp, Homo sapiens
ggcagaggtgacagtgtctttt

SEQ ID NO: 8754662 - DNA, 22 bp, Homo sapiens
ggcagaggtgacagtgtctttt

SEQ ID NO: 8754663 - DNA, 22 bp, Homo sapiens
ggcagaggtgacagtgtctttt

SEQ ID NO: 8754664 - DNA, 22 bp, Homo sapiens
cacatgcaggagccaatgtaca

SEQ ID NO: 8754665 - DNA, 22 bp, Homo sapiens
cacatgcaggagccaatgtaca

SEQ ID NO: 8754666 - DNA, 22 bp, Homo sapiens
ggcagaggtgacagtgtctttt

SEQ ID NO: 8754667 - DNA, 22 bp, Homo sapiens
cacatgcaggagccaatgtaca

SEQ ID NO: 8754668 - DNA, 18 bp, Homo sapiens
ggcagatgacaggagaga

SEQ ID NO: 8754669 - DNA, 18 bp, Homo sapiens
ggcagatgacaggagaga

SEQ ID NO: 8754670 - DNA, 18 bp, Homo sapiens
ggcagatgacaggagaga

SEQ ID NO: 8754671 - DNA, 20 bp, Homo sapiens
ggcagatgcagagctatgca

SEQ ID NO: 8754672 - DNA, 18 bp, Homo sapiens
ggcagatgacaggagaga

SEQ ID NO: 8754673 - DNA, 22 bp, Homo sapiens
cacatgctccatacagaatggg

SEQ ID NO: 8754674 - DNA, 22 bp, Homo sapiens
ggcagagtgctctgggcagggg

SEQ ID NO: 8754675 - DNA, 22 bp, Homo sapiens
ggcagagtgctctgggcagggg

SEQ ID NO: 8754676 - DNA, 22 bp, Homo sapiens
ggcagagtggagtgcggcctcc

SEQ ID NO: 8754677 - DNA, 22 bp, Homo sapiens
ggcagagttggtggagtcagtt

SEQ ID NO: 8754678 - DNA, 22 bp, Homo sapiens
ggcagagttggtggagtcagtt

SEQ ID NO: 8754679 - DNA, 22 bp, Homo sapiens
ggcagagttggtggagtcagtt

SEQ ID NO: 8754680 - DNA, 22 bp, Homo sapiens
cacatgtttggcatgtcaccaa

SEQ ID NO: 8754681 - DNA, 22 bp, Homo sapiens
cacatgtttttggccatcatgg

SEQ ID NO: 8754682 - DNA, 22 bp, Homo sapiens
cacattaaatagtagggatgct

SEQ ID NO: 8754683 - DNA, 22 bp, Homo sapiens
cacattaaaatcctaacttcca

SEQ ID NO: 8754684 - DNA, 22 bp, Homo sapiens
cacattaaaatcctaacttcca

SEQ ID NO: 8754685 - DNA, 22 bp, Homo sapiens
cacattaaaatcctaacttcca

SEQ ID NO: 8754686 - DNA, 22 bp, Homo sapiens
cacattaagaataatgagacta

SEQ ID NO: 8754687 - DNA, 22 bp, Homo sapiens
cacattaagaataatgagacta

SEQ ID NO: 8754688 - DNA, 20 bp, Homo sapiens
cacattaaggaaaacaactg

SEQ ID NO: 8754689 - DNA, 20 bp, Homo sapiens
cacattaaggaaaacaactg

SEQ ID NO: 8754690 - DNA, 20 bp, Homo sapiens
cacattaaggaaaacaactg

SEQ ID NO: 8754691 - DNA, 22 bp, Homo sapiens
cacattattctaaagaggtact

SEQ ID NO: 8754692 - DNA, 22 bp, Homo sapiens
cacattatgctactaccaaatg

SEQ ID NO: 8754693 - DNA, 22 bp, Homo sapiens
cacatgtgtgctgaggactgtg

SEQ ID NO: 8754694 - DNA, 22 bp, Homo sapiens
cacatgtgtgctgaggactgtg

SEQ ID NO: 8754695 - DNA, 22 bp, Homo sapiens
cacatgtgtgctgaggactgtg

SEQ ID NO: 8754696 - DNA, 22 bp, Homo sapiens
cacatgttaacttcctacagtg

SEQ ID NO: 8754697 - DNA, 22 bp, Homo sapiens
cacatgtgtgctgaggactgtg

SEQ ID NO: 8754698 - DNA, 22 bp, Homo sapiens
cacatgttcttaacttctgttt

SEQ ID NO: 8754699 - DNA, 22 bp, Homo sapiens
cacatgttcttgaagccaactc

SEQ ID NO: 8754700 - DNA, 22 bp, Homo sapiens
cacatgtttcaggccatatttg

SEQ ID NO: 8754701 - DNA, 22 bp, Homo sapiens
cacatgtttcaggccatatttg

SEQ ID NO: 8754702 - DNA, 22 bp, Homo sapiens
cacatgttcttgaagccaactc

SEQ ID NO: 8754703 - DNA, 22 bp, Homo sapiens
cacatgtttgctacatttttct

SEQ ID NO: 8754704 - DNA, 22 bp, Homo sapiens
cacatgtttgctacatttttct

SEQ ID NO: 8754705 - DNA, 22 bp, Homo sapiens
cacatgtttgctacatttttct

SEQ ID NO: 8754706 - DNA, 21 bp, Homo sapiens
cacatgtgaattactgaactg

SEQ ID NO: 8754707 - DNA, 22 bp, Homo sapiens
cacatgtgcaaatactgaggct

SEQ ID NO: 8754708 - DNA, 22 bp, Homo sapiens
cacatgtgggaaatggtgctta

SEQ ID NO: 8754709 - DNA, 22 bp, Homo sapiens
cacatgtgtatatgtgaggggg

SEQ ID NO: 8754710 - DNA, 22 bp, Homo sapiens
cacatgtgcagttacatgaatt

SEQ ID NO: 8754711 - DNA, 22 bp, Homo sapiens
caccagctttgcccactgccca

SEQ ID NO: 8754712 - DNA, 22 bp, Homo sapiens
caccagctccaccagggcaggt

SEQ ID NO: 8754713 - DNA, 22 bp, Homo sapiens
caccagcttacagtctcacccc

SEQ ID NO: 8754714 - DNA, 22 bp, Homo sapiens
caccagcttacagtctcacccc

SEQ ID NO: 8754715 - DNA, 22 bp, Homo sapiens
caccagctgcaacaccatctcc

SEQ ID NO: 8754716 - DNA, 22 bp, Homo sapiens
caccagctctccaccaggtttc

SEQ ID NO: 8754717 - DNA, 22 bp, Homo sapiens
caccagcttctcattgcgggtc

SEQ ID NO: 8754718 - DNA, 22 bp, Homo sapiens
caccagcttctcattgcgggtc

SEQ ID NO: 8754719 - DNA, 22 bp, Homo sapiens
caccagcttcccatcgcgggtc

SEQ ID NO: 8754720 - DNA, 22 bp, Homo sapiens
caccagctgcaacaccatctcc

SEQ ID NO: 8754721 - DNA, 22 bp, Homo sapiens
caccagcttgggctgtggaaat

SEQ ID NO: 8754722 - DNA, 22 bp, Homo sapiens
caccagcttgggctgtggaaat

SEQ ID NO: 8754723 - DNA, 22 bp, Homo sapiens
caccagcttgcagtcttaaccc

SEQ ID NO: 8754724 - DNA, 22 bp, Homo sapiens
cacattcatggagtttgcctgt

SEQ ID NO: 8754725 - DNA, 22 bp, Homo sapiens
cacattcaggtggcatgttaga

SEQ ID NO: 8754726 - DNA, 22 bp, Homo sapiens
cacattcagggaacattggagg

SEQ ID NO: 8754727 - DNA, 22 bp, Homo sapiens
caccactgcttcctgccatctg

SEQ ID NO: 8754728 - DNA, 22 bp, Homo sapiens
caccactgcttcctgccatctg

SEQ ID NO: 8754729 - DNA, 22 bp, Homo sapiens
cacattccttacattcatagag

SEQ ID NO: 8754730 - DNA, 22 bp, Homo sapiens
caccagctactcgggtttcctg

SEQ ID NO: 8754731 - DNA, 22 bp, Homo sapiens
caccagctccaccagggcaggt

SEQ ID NO: 8754732 - DNA, 22 bp, Homo sapiens
caccagctactccagggccgtg

SEQ ID NO: 8754733 - DNA, 22 bp, Homo sapiens
caccactggaggtcttggcttt

SEQ ID NO: 8754734 - DNA, 22 bp, Homo sapiens
caccactggaggtcttggcttt

SEQ ID NO: 8754735 - DNA, 22 bp, Homo sapiens
cactttaactcacatttcagct

SEQ ID NO: 8754736 - DNA, 22 bp, Homo sapiens
cactttaactcacatttcagct

SEQ ID NO: 8754737 - DNA, 22 bp, Homo sapiens
cactttaaaactgacagccctt

SEQ ID NO: 8754738 - DNA, 17 bp, Homo sapiens
ggctgctgtgctggtgc

SEQ ID NO: 8754739 - DNA, 21 bp, Homo sapiens
cactttaaaaatatctttata

SEQ ID NO: 8754740 - DNA, 21 bp, Homo sapiens
cactttaaaaatatctttata

SEQ ID NO: 8754741 - DNA, 22 bp, Homo sapiens
cacttgttggtggtgaaatcac

SEQ ID NO: 8754742 - DNA, 22 bp, Homo sapiens
cacttgttggtggtgaaatcac

SEQ ID NO: 8754743 - DNA, 22 bp, Homo sapiens
cacttgtagaggcattattcca

SEQ ID NO: 8754744 - DNA, 22 bp, Homo sapiens
cacttggtttgggagtacataa

SEQ ID NO: 8754745 - DNA, 22 bp, Homo sapiens
cacttgggagcattgcacatgt

SEQ ID NO: 8754746 - DNA, 22 bp, Homo sapiens
cacttgggacaaagcttctgct

SEQ ID NO: 8754747 - DNA, 22 bp, Homo sapiens
cacttgggattaggggctaggt

SEQ ID NO: 8754748 - DNA, 22 bp, Homo sapiens
cacttggtgagaaaagcacagg

SEQ ID NO: 8754749 - DNA, 22 bp, Homo sapiens
cacttgaatgagaatttcctgg

SEQ ID NO: 8754750 - DNA, 22 bp, Homo sapiens
cacttgaatgaaagagactcct

SEQ ID NO: 8754751 - DNA, 22 bp, Homo sapiens
cacttgaatggcattgttcctt

SEQ ID NO: 8754752 - DNA, 21 bp, Homo sapiens
cacttgaatggtgttttacaa

SEQ ID NO: 8754753 - DNA, 22 bp, Homo sapiens
cacttgatatcttatatttaat

SEQ ID NO: 8754754 - DNA, 22 bp, Homo sapiens
cacttgggacaaagcttctgct

SEQ ID NO: 8754755 - DNA, 17 bp, Homo sapiens
cacttgctggtctacct

SEQ ID NO: 8754756 - DNA, 22 bp, Homo sapiens
cacttgcagactttgcctggtt

SEQ ID NO: 8754757 - DNA, 22 bp, Homo sapiens
cacttgctggatggtggctcag

SEQ ID NO: 8754758 - DNA, 22 bp, Homo sapiens
cacttctgttgccttgtgcaat

SEQ ID NO: 8754759 - DNA, 22 bp, Homo sapiens
cacttgaaagtaatggttgtgc

SEQ ID NO: 8754760 - DNA, 22 bp, Homo sapiens
cacttgaaaatcagaggaaatt

SEQ ID NO: 8754761 - DNA, 22 bp, Homo sapiens
cacttctcacaaagtgacattc

SEQ ID NO: 8754762 - DNA, 22 bp, Homo sapiens
cacttctcacaaagtgacattc

SEQ ID NO: 8754763 - DNA, 22 bp, Homo sapiens
cacttccagagtctgggctggg

SEQ ID NO: 8754764 - DNA, 22 bp, Homo sapiens
cacttccgcacagtgagagcca

SEQ ID NO: 8754765 - DNA, 22 bp, Homo sapiens
cacttgaactgtttgaatgaga

SEQ ID NO: 8754766 - DNA, 22 bp, Homo sapiens
cacttgaagtttgggggactct

SEQ ID NO: 8754767 - DNA, 22 bp, Homo sapiens
cacttgaagtgaattgctcacc

SEQ ID NO: 8754768 - DNA, 22 bp, Homo sapiens
cacttgaaatattaggggtgat

SEQ ID NO: 8754769 - DNA, 22 bp, Homo sapiens
cacttgaacccgggaggctgag

SEQ ID NO: 8754770 - DNA, 22 bp, Homo sapiens
cacttcaattaacttcagcatt

SEQ ID NO: 8754771 - DNA, 22 bp, Homo sapiens
cacttcagctacaatcacatga

SEQ ID NO: 8754772 - DNA, 22 bp, Homo sapiens
cacttcaccactaggctatact

SEQ ID NO: 8754773 - DNA, 22 bp, Homo sapiens
cacttcacttggatgccttttc

SEQ ID NO: 8754774 - DNA, 22 bp, Homo sapiens
cacttcattgggaccagggctg

SEQ ID NO: 8754775 - DNA, 22 bp, Homo sapiens
cacttcattgggaccagggctg

SEQ ID NO: 8754776 - DNA, 22 bp, Homo sapiens
cacttcattgggaccagggctg

SEQ ID NO: 8754777 - DNA, 22 bp, Homo sapiens
cacttcaggttctggcagggcg

SEQ ID NO: 8754778 - DNA, 22 bp, Homo sapiens
cacttccagagtctgggctggg

SEQ ID NO: 8754779 - DNA, 22 bp, Homo sapiens
cacttcaaggaatatctagaaa

SEQ ID NO: 8754780 - DNA, 22 bp, Homo sapiens
cacttcaaggaatatctagaaa

SEQ ID NO: 8754781 - DNA, 22 bp, Homo sapiens
cacttcaattaacttcagcatt

SEQ ID NO: 8754782 - DNA, 19 bp, Homo sapiens
cacttcacatggtgaaagc

SEQ ID NO: 8754783 - DNA, 22 bp, Homo sapiens
cacttagagccagatgcatagt

SEQ ID NO: 8754784 - DNA, 22 bp, Homo sapiens
cacttagaaaacttgagcaagt

SEQ ID NO: 8754785 - DNA, 22 bp, Homo sapiens
cacttcaaatatggcttcatga

SEQ ID NO: 8754786 - DNA, 20 bp, Homo sapiens
ggctctggaatctggtgggc

SEQ ID NO: 8754787 - DNA, 22 bp, Homo sapiens
cactgtggatacagaaattagt

SEQ ID NO: 8754788 - DNA, 22 bp, Homo sapiens
cacttaaatgttcctacagcag

SEQ ID NO: 8754789 - DNA, 20 bp, Homo sapiens
ggctctggaatctggtgggc

SEQ ID NO: 8754790 - DNA, 20 bp, Homo sapiens
ggctctggaatctggtgggc

SEQ ID NO: 8754791 - DNA, 20 bp, Homo sapiens
ggctctggaatctggtgggc

SEQ ID NO: 8754792 - DNA, 22 bp, Homo sapiens
ggctctggaaagtgtccttgat

SEQ ID NO: 8754793 - DNA, 22 bp, Homo sapiens
ggctctggaaagtgtccttgat

SEQ ID NO: 8754794 - DNA, 22 bp, Homo sapiens
ggctctggaaagtgtccttgat

SEQ ID NO: 8754795 - DNA, 20 bp, Homo sapiens
ggctctgcttgtgagcagcc

SEQ ID NO: 8754796 - DNA, 22 bp, Homo sapiens
cactggtgtacaggaggtaaaa

SEQ ID NO: 8754797 - DNA, 22 bp, Homo sapiens
cactggtgtacaggaggtaaaa

SEQ ID NO: 8754798 - DNA, 23 bp, Homo sapiens
cactggtggggtttaaaagaagc

SEQ ID NO: 8754799 - DNA, 22 bp, Homo sapiens
cactggtgccagagaacagaat

SEQ ID NO: 8754800 - DNA, 22 bp, Homo sapiens
cactgggagtcgtaagacacgg

SEQ ID NO: 8754801 - DNA, 22 bp, Homo sapiens
cactgggcaattctgagcctaa

SEQ ID NO: 8754802 - DNA, 22 bp, Homo sapiens
cactgggatttggggtgtctta

SEQ ID NO: 8754803 - DNA, 22 bp, Homo sapiens
cactgtaagatgagctttttta

SEQ ID NO: 8754804 - DNA, 22 bp, Homo sapiens
cactggttttaatttccatttc

SEQ ID NO: 8754805 - DNA, 22 bp, Homo sapiens
ggctctgctggtaagatgcctc

SEQ ID NO: 8754806 - DNA, 22 bp, Homo sapiens
ggctctgcttctcacctgttcc

SEQ ID NO: 8754807 - DNA, 22 bp, Homo sapiens
ggctctgcttgaggccagcctg

SEQ ID NO: 8754808 - DNA, 21 bp, Homo sapiens
cactgtatagcaggagaaaac

SEQ ID NO: 8754809 - DNA, 22 bp, Homo sapiens
cactgtccaatagatacataat

SEQ ID NO: 8754810 - DNA, 22 bp, Homo sapiens
cactgtcacgttctgaaactgt

SEQ ID NO: 8754811 - DNA, 22 bp, Homo sapiens
cactgcactccagcctgggtca

SEQ ID NO: 8754812 - DNA, 22 bp, Homo sapiens
cactgcactccagcctgggtca

SEQ ID NO: 8754813 - DNA, 22 bp, Homo sapiens
cactgcactccagcctgggtca

SEQ ID NO: 8754814 - DNA, 22 bp, Homo sapiens
cactgcactccagcctgggcaa

SEQ ID NO: 8754815 - DNA, 22 bp, Homo sapiens
cactgcactccagcctgggcga

SEQ ID NO: 8754816 - DNA, 22 bp, Homo sapiens
cactgcactccagcctgggcca

SEQ ID NO: 8754817 - DNA, 22 bp, Homo sapiens
cactgcactccagcctgggcaa

SEQ ID NO: 8754818 - DNA, 22 bp, Homo sapiens
cactgcactccagcctgggaga

SEQ ID NO: 8754819 - DNA, 22 bp, Homo sapiens
cactgcactccagcctgggtca

SEQ ID NO: 8754820 - DNA, 22 bp, Homo sapiens
cactgcactccagcctgggtca

SEQ ID NO: 8754821 - DNA, 22 bp, Homo sapiens
cactgcactccagcctgggtca

SEQ ID NO: 8754822 - DNA, 22 bp, Homo sapiens
cactgcactccagcctgggtca

SEQ ID NO: 8754823 - DNA, 22 bp, Homo sapiens
cactgcactccagcctgggtca

SEQ ID NO: 8754824 - DNA, 22 bp, Homo sapiens
cactgcactccagcctgggtca

SEQ ID NO: 8754825 - DNA, 22 bp, Homo sapiens
cactgcactccagcctgggtca

SEQ ID NO: 8754826 - DNA, 22 bp, Homo sapiens
cactgcactccagcctgggtga

SEQ ID NO: 8754827 - DNA, 22 bp, Homo sapiens
cactgcactccagcttgggtga

SEQ ID NO: 8754828 - DNA, 22 bp, Homo sapiens
cactgcactccagcttgggtga

SEQ ID NO: 8754829 - DNA, 22 bp, Homo sapiens
cactgcactccagcttgggtga

SEQ ID NO: 8754830 - DNA, 22 bp, Homo sapiens
cactgcactccagcttgggtga

SEQ ID NO: 8754831 - DNA, 22 bp, Homo sapiens
cactgcactccagcttgggtga

SEQ ID NO: 8754832 - DNA, 22 bp, Homo sapiens
cactgcactccagcttgggcaa

SEQ ID NO: 8754833 - DNA, 22 bp, Homo sapiens
cactgcactccagcctgggtga

SEQ ID NO: 8754834 - DNA, 22 bp, Homo sapiens
cactgcactccagcctgggtga

SEQ ID NO: 8754835 - DNA, 22 bp, Homo sapiens
cactgcactccagcctgggtga

SEQ ID NO: 8754836 - DNA, 22 bp, Homo sapiens
cactgcactccagcctgggtga

SEQ ID NO: 8754837 - DNA, 22 bp, Homo sapiens
cactgcactccagcctgggtga

SEQ ID NO: 8754838 - DNA, 22 bp, Homo sapiens
cactgcactccagcctgggtga

SEQ ID NO: 8754839 - DNA, 22 bp, Homo sapiens
cactgcactccagcctgggtga

SEQ ID NO: 8754840 - DNA, 22 bp, Homo sapiens
cactgcactccagcctgggtga

SEQ ID NO: 8754841 - DNA, 22 bp, Homo sapiens
cactgcactccagcctgggtga

SEQ ID NO: 8754842 - DNA, 22 bp, Homo sapiens
ggccaggctgccctgggagcag

SEQ ID NO: 8754843 - DNA, 22 bp, Homo sapiens
ggccaggctgctgggaccccgc

SEQ ID NO: 8754844 - DNA, 22 bp, Homo sapiens
ggccaggctgctgggaccccgc

SEQ ID NO: 8754845 - DNA, 22 bp, Homo sapiens
ggccaggctgccctgggagcag

SEQ ID NO: 8754846 - DNA, 22 bp, Homo sapiens
ggccaggctgccctgggagcag

SEQ ID NO: 8754847 - DNA, 22 bp, Homo sapiens
cacctgggctttctctgggact

SEQ ID NO: 8754848 - DNA, 22 bp, Homo sapiens
ggccaggctgccctgggagcag

SEQ ID NO: 8754849 - DNA, 22 bp, Homo sapiens
ggccaggctggtctcagacttc

SEQ ID NO: 8754850 - DNA, 22 bp, Homo sapiens
ggccaggctggtctcagacttc

SEQ ID NO: 8754851 - DNA, 22 bp, Homo sapiens
ggccaggctggtctcagacttc

SEQ ID NO: 8754852 - DNA, 22 bp, Homo sapiens
ggccaggctgctgggaccccgc

SEQ ID NO: 8754853 - DNA, 22 bp, Homo sapiens
ggccaggctggttccttgacct

SEQ ID NO: 8754854 - DNA, 22 bp, Homo sapiens
ggccaggctggttccttgacct

SEQ ID NO: 8754855 - DNA, 22 bp, Homo sapiens
ggccagggaggagaggcccctg

SEQ ID NO: 8754856 - DNA, 22 bp, Homo sapiens
ggccaggctggtctcagacttc

SEQ ID NO: 8754857 - DNA, 22 bp, Homo sapiens
ggccagggaggagaggcccctg

SEQ ID NO: 8754858 - DNA, 22 bp, Homo sapiens
cacctgcctggtccttagggct

SEQ ID NO: 8754859 - DNA, 20 bp, Homo sapiens
cacctggatatgacccagct

SEQ ID NO: 8754860 - DNA, 22 bp, Homo sapiens
cacctggctggaagtgctccgg

SEQ ID NO: 8754861 - DNA, 22 bp, Homo sapiens
cacctggctggaagtgctccgg

SEQ ID NO: 8754862 - DNA, 20 bp, Homo sapiens
cacctggctgactgtctcca

SEQ ID NO: 8754863 - DNA, 23 bp, Homo sapiens
cacctggcttgagttggtgggtc

SEQ ID NO: 8754864 - DNA, 22 bp, Homo sapiens
cacctggctgtgaagcctgggt

SEQ ID NO: 8754865 - DNA, 22 bp, Homo sapiens
cacctggctggaagtgctccgg

SEQ ID NO: 8754866 - DNA, 22 bp, Homo sapiens
cacctgggctttctctggaact

SEQ ID NO: 8754867 - DNA, 22 bp, Homo sapiens
caccaggcacagctctcctgct

SEQ ID NO: 8754868 - DNA, 22 bp, Homo sapiens
caccaggcacatagtaggcact

SEQ ID NO: 8754869 - DNA, 22 bp, Homo sapiens
caccaggcacatagtaggcact

SEQ ID NO: 8754870 - DNA, 20 bp, Homo sapiens
caccaggcgctctgagaaca

SEQ ID NO: 8754871 - DNA, 22 bp, Homo sapiens
caccaggctgcccaggacaggg

SEQ ID NO: 8754872 - DNA, 22 bp, Homo sapiens
caccaggctgcccaggacaggg

SEQ ID NO: 8754873 - DNA, 22 bp, Homo sapiens
caccaggctgcccaggacaggg

SEQ ID NO: 8754874 - DNA, 22 bp, Homo sapiens
caccaggctgcccaggacaggg

SEQ ID NO: 8754875 - DNA, 22 bp, Homo sapiens
caccaggctgaaccagagggga

SEQ ID NO: 8754876 - DNA, 22 bp, Homo sapiens
caccaggctgaaccagagggga

SEQ ID NO: 8754877 - DNA, 22 bp, Homo sapiens
cacctgccctttcttgctccac

SEQ ID NO: 8754878 - DNA, 22 bp, Homo sapiens
cacctgccctttcttgctccac

SEQ ID NO: 8754879 - DNA, 22 bp, Homo sapiens
cacctgccctttcttgctccac

SEQ ID NO: 8754880 - DNA, 22 bp, Homo sapiens
cacctgcctcatttgtccctgc

SEQ ID NO: 8754881 - DNA, 22 bp, Homo sapiens
cacctgcctcatttgtccctgc

SEQ ID NO: 8754882 - DNA, 22 bp, Homo sapiens
cacctgcctgcaggggctccac

SEQ ID NO: 8754883 - DNA, 22 bp, Homo sapiens
cacctgcctgcaggggctccac

SEQ ID NO: 8754884 - DNA, 22 bp, Homo sapiens
cacctgcctgctagagcctgac

SEQ ID NO: 8754885 - DNA, 22 bp, Homo sapiens
cacctgcctgctagagcctgac

SEQ ID NO: 8754886 - DNA, 22 bp, Homo sapiens
caccaggctggagtgcagaggt

SEQ ID NO: 8754887 - DNA, 22 bp, Homo sapiens
caccaggctggagtgcagaggt

SEQ ID NO: 8754888 - DNA, 22 bp, Homo sapiens
caccaggctggagtgcagaggt

SEQ ID NO: 8754889 - DNA, 22 bp, Homo sapiens
caccctgtacaaatggacatct

SEQ ID NO: 8754890 - DNA, 22 bp, Homo sapiens
cactctgactggccctgcagga

SEQ ID NO: 8754891 - DNA, 22 bp, Homo sapiens
cactctgaactattaacttggg

SEQ ID NO: 8754892 - DNA, 22 bp, Homo sapiens
cactctgacacatgaacttgat

SEQ ID NO: 8754893 - DNA, 22 bp, Homo sapiens
cactgcactccagcctggcctg

SEQ ID NO: 8754894 - DNA, 22 bp, Homo sapiens
cactgcactccagcctggcgac

SEQ ID NO: 8754895 - DNA, 22 bp, Homo sapiens
cactgcactccagcctgggaga

SEQ ID NO: 8754896 - DNA, 22 bp, Homo sapiens
cactgcactccagcctgggaga

SEQ ID NO: 8754897 - DNA, 22 bp, Homo sapiens
cactgcactccagcctgggaga

SEQ ID NO: 8754898 - DNA, 22 bp, Homo sapiens
cactgcactccagcctgggaga

SEQ ID NO: 8754899 - DNA, 22 bp, Homo sapiens
cactgcactccagcctgggaga

SEQ ID NO: 8754900 - DNA, 22 bp, Homo sapiens
cactgcactccagcctgggaga

SEQ ID NO: 8754901 - DNA, 22 bp, Homo sapiens
cactgcactccagcctgggaga

SEQ ID NO: 8754902 - DNA, 22 bp, Homo sapiens
cactgcactccagcctgggaga

SEQ ID NO: 8754903 - DNA, 22 bp, Homo sapiens
cactgcactccagcctgggaga

SEQ ID NO: 8754904 - DNA, 22 bp, Homo sapiens
cactgcactccagcctgggaga

SEQ ID NO: 8754905 - DNA, 21 bp, Homo sapiens
cactccacttagaacagggtt

SEQ ID NO: 8754906 - DNA, 22 bp, Homo sapiens
cactccctctagttgcattctg

SEQ ID NO: 8754907 - DNA, 22 bp, Homo sapiens
cactctcactgagctcatgcca

SEQ ID NO: 8754908 - DNA, 22 bp, Homo sapiens
cactctcagcataatgaatgtg

SEQ ID NO: 8754909 - DNA, 22 bp, Homo sapiens
cactctccagcacaccccattt

SEQ ID NO: 8754910 - DNA, 22 bp, Homo sapiens
cactcctgttccactaaatgag

SEQ ID NO: 8754911 - DNA, 22 bp, Homo sapiens
cactcccttcaggagcctagga

SEQ ID NO: 8754912 - DNA, 21 bp, Homo sapiens
cactccacttagaacagggtt

SEQ ID NO: 8754913 - DNA, 21 bp, Homo sapiens
cactccacttagaacagggtt

SEQ ID NO: 8754914 - DNA, 21 bp, Homo sapiens
cactccacttagaacagggtt

SEQ ID NO: 8754915 - DNA, 21 bp, Homo sapiens
cactccacttagaacagggtt

SEQ ID NO: 8754916 - DNA, 22 bp, Homo sapiens
cactccaagacctactttctct

SEQ ID NO: 8754917 - DNA, 22 bp, Homo sapiens
cactcaggctgtgtcaggagga

SEQ ID NO: 8754918 - DNA, 22 bp, Homo sapiens
cactcagctgagccctcagccc

SEQ ID NO: 8754919 - DNA, 22 bp, Homo sapiens
cactcagctgagccctcagccc

SEQ ID NO: 8754920 - DNA, 21 bp, Homo sapiens
cactcaataaatgtcatatgc

SEQ ID NO: 8754921 - DNA, 23 bp, Homo sapiens
cacggcagcctccgagggtgctg

SEQ ID NO: 8754922 - DNA, 22 bp, Homo sapiens
cacgccagccggacactgggcc

SEQ ID NO: 8754923 - DNA, 22 bp, Homo sapiens
cactagtaattcttgtgctgga

SEQ ID NO: 8754924 - DNA, 22 bp, Homo sapiens
cactatccaataaatatttatt

SEQ ID NO: 8754925 - DNA, 22 bp, Homo sapiens
cactatatctctttcatctttt

SEQ ID NO: 8754926 - DNA, 22 bp, Homo sapiens
cactatatctctttcatctttt

SEQ ID NO: 8754927 - DNA, 22 bp, Homo sapiens
cactatatctgttcttgtttat

SEQ ID NO: 8754928 - DNA, 22 bp, Homo sapiens
gtgagcagaataagggttgaga

SEQ ID NO: 8754929 - DNA, 22 bp, Homo sapiens
cagccctcatcccgcctgcgtt

SEQ ID NO: 8754930 - DNA, 22 bp, Homo sapiens
cagccctcatctcagcttcttt

SEQ ID NO: 8754931 - DNA, 22 bp, Homo sapiens
cagccctcatctcagcttcttt

SEQ ID NO: 8754932 - DNA, 22 bp, Homo sapiens
cagccctcatctcagcttcttt

SEQ ID NO: 8754933 - DNA, 22 bp, Homo sapiens
cagccctctgaagaggcgcttg

SEQ ID NO: 8754934 - DNA, 22 bp, Homo sapiens
cagccctctgaagaggcgcttg

SEQ ID NO: 8754935 - DNA, 22 bp, Homo sapiens
cagccctcctttcactcccagg

SEQ ID NO: 8754936 - DNA, 22 bp, Homo sapiens
cagccctctctgggccccaagg

SEQ ID NO: 8754937 - DNA, 22 bp, Homo sapiens
cagccctctctgggccccaagg

SEQ ID NO: 8754938 - DNA, 19 bp, Homo sapiens
cagccctcttaccactgtg

SEQ ID NO: 8754939 - DNA, 19 bp, Homo sapiens
cagccctcttaccactgtg

SEQ ID NO: 8754940 - DNA, 19 bp, Homo sapiens
cagccctcttaccactgtg

SEQ ID NO: 8754941 - DNA, 22 bp, Homo sapiens
cagccctctgaagaggcgcttg

SEQ ID NO: 8754942 - DNA, 22 bp, Homo sapiens
cagccctctgaagaggcgcttg

SEQ ID NO: 8754943 - DNA, 22 bp, Homo sapiens
cagccctcctaccctgccaggc

SEQ ID NO: 8754944 - DNA, 22 bp, Homo sapiens
cagccctcctttcactcccagg

SEQ ID NO: 8754945 - DNA, 22 bp, Homo sapiens
cagccctcctttcactcccagg

SEQ ID NO: 8754946 - DNA, 22 bp, Homo sapiens
cagccctcctttcactcccagg

SEQ ID NO: 8754947 - DNA, 20 bp, Homo sapiens
cagccctccagtggaggcag

SEQ ID NO: 8754948 - DNA, 20 bp, Homo sapiens
cagccctccagtggaggcag

SEQ ID NO: 8754949 - DNA, 20 bp, Homo sapiens
cagccctccagtggaggcag

SEQ ID NO: 8754950 - DNA, 22 bp, Homo sapiens
cagccctcctaccctgccaggc

SEQ ID NO: 8754951 - DNA, 22 bp, Homo sapiens
cagccctcctaccctgccaggc

SEQ ID NO: 8754952 - DNA, 20 bp, Homo sapiens
cagccctccagtggaggcag

SEQ ID NO: 8754953 - DNA, 22 bp, Homo sapiens
gtcctgtgccgaggtgggaagc

SEQ ID NO: 8754954 - DNA, 22 bp, Homo sapiens
gtcctgtgctcagacatggggg

SEQ ID NO: 8754955 - DNA, 22 bp, Homo sapiens
gtcctgtgctcagacatggggg

SEQ ID NO: 8754956 - DNA, 22 bp, Homo sapiens
gtcctgtgccctgggtggcgct

SEQ ID NO: 8754957 - DNA, 22 bp, Homo sapiens
gtcctgtgacctgcatcctgag

SEQ ID NO: 8754958 - DNA, 22 bp, Homo sapiens
gtcctgtgcaccgtgggatgtt

SEQ ID NO: 8754959 - DNA, 22 bp, Homo sapiens
gtgagagggctgggctcatgat

SEQ ID NO: 8754960 - DNA, 22 bp, Homo sapiens
gtgagagggctgggctcatgat

SEQ ID NO: 8754961 - DNA, 22 bp, Homo sapiens
gtgagagggctgggctcatgat

SEQ ID NO: 8754962 - DNA, 22 bp, Homo sapiens
gtgagagggctgggctcatgat

SEQ ID NO: 8754963 - DNA, 22 bp, Homo sapiens
gtgagagatgctttcttaacgc

SEQ ID NO: 8754964 - DNA, 22 bp, Homo sapiens
gtcctgtgcaccgtgggatgtt

SEQ ID NO: 8754965 - DNA, 22 bp, Homo sapiens
gtcctgtgatgagtaccaggtg

SEQ ID NO: 8754966 - DNA, 22 bp, Homo sapiens
gtcctgtgagattcatgctcaa

SEQ ID NO: 8754967 - DNA, 22 bp, Homo sapiens
gtcctgtgagattcatgctcaa

SEQ ID NO: 8754968 - DNA, 22 bp, Homo sapiens
gtcctgtgacctgcatcctgag

SEQ ID NO: 8754969 - DNA, 22 bp, Homo sapiens
gtcctgtcccccaaggctgtgg

SEQ ID NO: 8754970 - DNA, 22 bp, Homo sapiens
gtcctggttttcacagaccttt

SEQ ID NO: 8754971 - DNA, 22 bp, Homo sapiens
gtcctggtcctgcctccccatg

SEQ ID NO: 8754972 - DNA, 22 bp, Homo sapiens
gtcctggtgccacctgcgggat

SEQ ID NO: 8754973 - DNA, 17 bp, Homo sapiens
gtcctggtgtgtgagga

SEQ ID NO: 8754974 - DNA, 22 bp, Homo sapiens
gtcctggtggagtctctgggga

SEQ ID NO: 8754975 - DNA, 22 bp, Homo sapiens
cagccctgtccaatgtctgctc

SEQ ID NO: 8754976 - DNA, 22 bp, Homo sapiens
cagccctgtccaatgtctgctc

SEQ ID NO: 8754977 - DNA, 22 bp, Homo sapiens
cagccctgtccagcagagggtg

SEQ ID NO: 8754978 - DNA, 22 bp, Homo sapiens
cagccctgtccagcagagggtg

SEQ ID NO: 8754979 - DNA, 22 bp, Homo sapiens
cagccctgtccctgagggacct

SEQ ID NO: 8754980 - DNA, 22 bp, Homo sapiens
cagccctgtccctgagggacct

SEQ ID NO: 8754981 - DNA, 22 bp, Homo sapiens
cagccctgtccagcagagggtg

SEQ ID NO: 8754982 - DNA, 22 bp, Homo sapiens
cagccctgtccaatgtctgctc

SEQ ID NO: 8754983 - DNA, 22 bp, Homo sapiens
cagccctgtccaatgtctgctc

SEQ ID NO: 8754984 - DNA, 22 bp, Homo sapiens
cagccctggtgccaaggttccc

SEQ ID NO: 8754985 - DNA, 22 bp, Homo sapiens
cagccctggtgccaaggttccc

SEQ ID NO: 8754986 - DNA, 22 bp, Homo sapiens
cagccctggcccaggtgcctta

SEQ ID NO: 8754987 - DNA, 22 bp, Homo sapiens
cagccctgaaacaacctcctct

SEQ ID NO: 8754988 - DNA, 22 bp, Homo sapiens
cagccctgtctatgactgatga

SEQ ID NO: 8754989 - DNA, 22 bp, Homo sapiens
cagccctgtctatgactgatga

SEQ ID NO: 8754990 - DNA, 22 bp, Homo sapiens
cagccctgtccctgagggacct

SEQ ID NO: 8754991 - DNA, 22 bp, Homo sapiens
cagccctgtctatgactgatga

SEQ ID NO: 8754992 - DNA, 22 bp, Homo sapiens
gtcagcagggtccccttgagtg

SEQ ID NO: 8754993 - DNA, 17 bp, Homo sapiens
gtcagcagcttgcttgt

SEQ ID NO: 8754994 - DNA, 17 bp, Homo sapiens
gtcagcagcttgcttgt

SEQ ID NO: 8754995 - DNA, 22 bp, Homo sapiens
gtcagatgtttgcgtagggtat

SEQ ID NO: 8754996 - DNA, 22 bp, Homo sapiens
gtcagatgatacactgttgtca

SEQ ID NO: 8754997 - DNA, 22 bp, Homo sapiens
gtcagattaatagcaataataa

SEQ ID NO: 8754998 - DNA, 22 bp, Homo sapiens
gtcagattaatagcaataataa

SEQ ID NO: 8754999 - DNA, 22 bp, Homo sapiens
cagcatctcctgtgcagaggga

SEQ ID NO: 8755000 - DNA, 22 bp, Homo sapiens
cagcatctcctgtgcagaggga

SEQ ID NO: 8755001 - DNA, 22 bp, Homo sapiens
cagcatctcccaggcatttgcc

SEQ ID NO: 8755002 - DNA, 22 bp, Homo sapiens
cagcatctcccaggcatttgcc

SEQ ID NO: 8755003 - DNA, 22 bp, Homo sapiens
cagcatctccatggctttggag

SEQ ID NO: 8755004 - DNA, 22 bp, Homo sapiens
cagcatctcccaggcatttgcc

SEQ ID NO: 8755005 - DNA, 22 bp, Homo sapiens
cagcatctccatggctttggag

SEQ ID NO: 8755006 - DNA, 22 bp, Homo sapiens
cagcatctccatggctttggag

SEQ ID NO: 8755007 - DNA, 22 bp, Homo sapiens
cagcatctcatttgacttctgc

SEQ ID NO: 8755008 - DNA, 22 bp, Homo sapiens
cagcatctccatggctttggag

SEQ ID NO: 8755009 - DNA, 20 bp, Homo sapiens
cagcatctagtgagatttgc

SEQ ID NO: 8755010 - DNA, 22 bp, Homo sapiens
cagcatctcacttcccagaagg

SEQ ID NO: 8755011 - DNA, 22 bp, Homo sapiens
cagcatctcattcattcatgtt

SEQ ID NO: 8755012 - DNA, 22 bp, Homo sapiens
cagcagtgtctccagcatcaca

SEQ ID NO: 8755013 - DNA, 22 bp, Homo sapiens
gtcagcagtgtcagctctgggg

SEQ ID NO: 8755014 - DNA, 22 bp, Homo sapiens
cagcatcattcatctggggtaa

SEQ ID NO: 8755015 - DNA, 22 bp, Homo sapiens
cagcatcctttgctggtttccc

SEQ ID NO: 8755016 - DNA, 22 bp, Homo sapiens
cagcatctaatcttcatgccgg

SEQ ID NO: 8755017 - DNA, 22 bp, Homo sapiens
gtcagatctttggggatgctgt

SEQ ID NO: 8755018 - DNA, 22 bp, Homo sapiens
gtcacagggtccccatatggag

SEQ ID NO: 8755019 - DNA, 22 bp, Homo sapiens
gtcagatctttggggatgctgt

SEQ ID NO: 8755020 - DNA, 22 bp, Homo sapiens
gtcacaggcctggatgaggggc

SEQ ID NO: 8755021 - DNA, 22 bp, Homo sapiens
gtcacaggcctggatgaggggc

SEQ ID NO: 8755022 - DNA, 22 bp, Homo sapiens
gtcacaggcagtaactaggacc

SEQ ID NO: 8755023 - DNA, 22 bp, Homo sapiens
gtcacaggcagtaactaggacc

SEQ ID NO: 8755024 - DNA, 22 bp, Homo sapiens
gtcacagatctcttgagtcaag

SEQ ID NO: 8755025 - DNA, 22 bp, Homo sapiens
gtcacagatctcttgagtcaag

SEQ ID NO: 8755026 - DNA, 22 bp, Homo sapiens
gtcacactcttccctccacatg

SEQ ID NO: 8755027 - DNA, 22 bp, Homo sapiens
gtcacagatggggaaacggagg

SEQ ID NO: 8755028 - DNA, 22 bp, Homo sapiens
gtcacaggaaagggtgtaaggg

SEQ ID NO: 8755029 - DNA, 22 bp, Homo sapiens
gtcacaaatcccctcagcaact

SEQ ID NO: 8755030 - DNA, 22 bp, Homo sapiens
gtattttacttacgcatgactt

SEQ ID NO: 8755031 - DNA, 22 bp, Homo sapiens
gtagggaagggagcactggaca

SEQ ID NO: 8755032 - DNA, 22 bp, Homo sapiens
gtagggacttgttttactagta

SEQ ID NO: 8755033 - DNA, 22 bp, Homo sapiens
gtcacacagagccctgtgctca

SEQ ID NO: 8755034 - DNA, 22 bp, Homo sapiens
gtcacacacatttctttggtgc

SEQ ID NO: 8755035 - DNA, 22 bp, Homo sapiens
gtcacaattataggaactcaga

SEQ ID NO: 8755036 - DNA, 21 bp, Homo sapiens
gtcacacaggcctggagctga

SEQ ID NO: 8755037 - DNA, 22 bp, Homo sapiens
cagccaggcccccgagtcgttg

SEQ ID NO: 8755038 - DNA, 22 bp, Homo sapiens
cagccaggatggagaactgttg

SEQ ID NO: 8755039 - DNA, 22 bp, Homo sapiens
cagccaggatggagaactgttg

SEQ ID NO: 8755040 - DNA, 22 bp, Homo sapiens
cagccaggagcctctgcaacta

SEQ ID NO: 8755041 - DNA, 22 bp, Homo sapiens
cagccaggagcctctgcaacta

SEQ ID NO: 8755042 - DNA, 22 bp, Homo sapiens
cagccagctgtcccaagtgcct

SEQ ID NO: 8755043 - DNA, 22 bp, Homo sapiens
cagccagctgtcccaagtgcct

SEQ ID NO: 8755044 - DNA, 22 bp, Homo sapiens
cagccagaacctaggatgagct

SEQ ID NO: 8755045 - DNA, 22 bp, Homo sapiens
gtccagccaccctggaggcacg

SEQ ID NO: 8755046 - DNA, 22 bp, Homo sapiens
gtccagccaccctggaggcacg

SEQ ID NO: 8755047 - DNA, 22 bp, Homo sapiens
gtccagcatttaggcttgctga

SEQ ID NO: 8755048 - DNA, 22 bp, Homo sapiens
gtccagagaggcaggaggctac

SEQ ID NO: 8755049 - DNA, 22 bp, Homo sapiens
gtccagagaggcaggaggctac

SEQ ID NO: 8755050 - DNA, 22 bp, Homo sapiens
gtccagagaggcaggaggctac

SEQ ID NO: 8755051 - DNA, 22 bp, Homo sapiens
gtccagagagtaaagggggtaa

SEQ ID NO: 8755052 - DNA, 22 bp, Homo sapiens
gtccagagagtaaagggggtaa

SEQ ID NO: 8755053 - DNA, 22 bp, Homo sapiens
gtccagagagtaaagggggtaa

SEQ ID NO: 8755054 - DNA, 22 bp, Homo sapiens
gtccagagctggcacactgtca

SEQ ID NO: 8755055 - DNA, 22 bp, Homo sapiens
gtccagagatggacgagcagat

SEQ ID NO: 8755056 - DNA, 22 bp, Homo sapiens
gtccagagatggacgagcagat

SEQ ID NO: 8755057 - DNA, 22 bp, Homo sapiens
gtccagagatggacgagcagat

SEQ ID NO: 8755058 - DNA, 22 bp, Homo sapiens
gtccagagctggcacactgtca

SEQ ID NO: 8755059 - DNA, 22 bp, Homo sapiens
gtccagagggctgcaggatgct

SEQ ID NO: 8755060 - DNA, 20 bp, Homo sapiens
gtccagagtaatgtgctgac

SEQ ID NO: 8755061 - DNA, 22 bp, Homo sapiens
cagcatctggggaacattcaag

SEQ ID NO: 8755062 - DNA, 22 bp, Homo sapiens
cagcatctgtaggactcctctt

SEQ ID NO: 8755063 - DNA, 19 bp, Homo sapiens
cagcatctgagccgtgtcc

SEQ ID NO: 8755064 - DNA, 22 bp, Homo sapiens
cagcatctggatttcctccact

SEQ ID NO: 8755065 - DNA, 22 bp, Homo sapiens
cagcatctgtatcctaggctga

SEQ ID NO: 8755066 - DNA, 22 bp, Homo sapiens
cagcatctgtatcctaggctga

SEQ ID NO: 8755067 - DNA, 22 bp, Homo sapiens
cagcatctgttggatggataag

SEQ ID NO: 8755068 - DNA, 22 bp, Homo sapiens
cagcatctgttggatggataag

SEQ ID NO: 8755069 - DNA, 22 bp, Homo sapiens
cagcatctgttggatggataag

SEQ ID NO: 8755070 - DNA, 22 bp, Homo sapiens
cagcatctgttcccaacgagat

SEQ ID NO: 8755071 - DNA, 22 bp, Homo sapiens
cagcatctgaccaatatctaca

SEQ ID NO: 8755072 - DNA, 22 bp, Homo sapiens
cagcatctctttttgcattcct

SEQ ID NO: 8755073 - DNA, 22 bp, Homo sapiens
cagcatctctttttgcattcct

SEQ ID NO: 8755074 - DNA, 22 bp, Homo sapiens
cagcatctctgggagaagcatc

SEQ ID NO: 8755075 - DNA, 22 bp, Homo sapiens
cagcatctctgggagaagcatc

SEQ ID NO: 8755076 - DNA, 22 bp, Homo sapiens
cagcatctctgggagaagcatc

SEQ ID NO: 8755077 - DNA, 22 bp, Homo sapiens
cagcatctcgtggctggataga

SEQ ID NO: 8755078 - DNA, 22 bp, Homo sapiens
cagcatctcctgtgcagaggga

SEQ ID NO: 8755079 - DNA, 22 bp, Homo sapiens
cagcatctcctgtgcagaggga

SEQ ID NO: 8755080 - DNA, 22 bp, Homo sapiens
cagcatctctgcctgcctgcaa

SEQ ID NO: 8755081 - DNA, 22 bp, Homo sapiens
cagcatctctgcaccctccccc

SEQ ID NO: 8755082 - DNA, 22 bp, Homo sapiens
cagcatctcgtggctggataga

SEQ ID NO: 8755083 - DNA, 22 bp, Homo sapiens
cagatttattttacatccttca

SEQ ID NO: 8755084 - DNA, 22 bp, Homo sapiens
cagatttatgcaaaaaggaaga

SEQ ID NO: 8755085 - DNA, 22 bp, Homo sapiens
cagatttaggtcactagaattt

SEQ ID NO: 8755086 - DNA, 22 bp, Homo sapiens
cagatttctatttcaaatacat

SEQ ID NO: 8755087 - DNA, 22 bp, Homo sapiens
cagatttaggcttagtccaagc

SEQ ID NO: 8755088 - DNA, 22 bp, Homo sapiens
cagatttaagatatttgtattg

SEQ ID NO: 8755089 - DNA, 22 bp, Homo sapiens
cagatttactccctgctgctgc

SEQ ID NO: 8755090 - DNA, 20 bp, Homo sapiens
cagcaaaatgaaaatggatt

SEQ ID NO: 8755091 - DNA, 20 bp, Homo sapiens
cagcaaaatgaaaatggatt

SEQ ID NO: 8755092 - DNA, 22 bp, Homo sapiens
cagatttggggtctcctgttag

SEQ ID NO: 8755093 - DNA, 22 bp, Homo sapiens
cagatttgccacttactcgttg

SEQ ID NO: 8755094 - DNA, 22 bp, Homo sapiens
cagattttgatgaatgtggaaa

SEQ ID NO: 8755095 - DNA, 22 bp, Homo sapiens
cagattggattaaatagctgcc

SEQ ID NO: 8755096 - DNA, 22 bp, Homo sapiens
cagattggattaaatagctgcc

SEQ ID NO: 8755097 - DNA, 22 bp, Homo sapiens
cagattggagagagttaaagca

SEQ ID NO: 8755098 - DNA, 22 bp, Homo sapiens
cagattgggtgagatgatttca

SEQ ID NO: 8755099 - DNA, 22 bp, Homo sapiens
cagattcttcattgccccattc

SEQ ID NO: 8755100 - DNA, 22 bp, Homo sapiens
cagatttaagagataaacagtg

SEQ ID NO: 8755101 - DNA, 22 bp, Homo sapiens
cagattgagtctgggaaaaggc

SEQ ID NO: 8755102 - DNA, 22 bp, Homo sapiens
cagattctccaggggctgcaga

SEQ ID NO: 8755103 - DNA, 22 bp, Homo sapiens
cagattctgaagtctagctgct

SEQ ID NO: 8755104 - DNA, 22 bp, Homo sapiens
cagattctgggcccagcttgtc

SEQ ID NO: 8755105 - DNA, 22 bp, Homo sapiens
cagattcttaatttatgggatt

SEQ ID NO: 8755106 - DNA, 22 bp, Homo sapiens
cagattcttcattcattctaca

SEQ ID NO: 8755107 - DNA, 22 bp, Homo sapiens
cagattaacacggagcttaaca

SEQ ID NO: 8755108 - DNA, 22 bp, Homo sapiens
cagattaacacggagcttaaca

SEQ ID NO: 8755109 - DNA, 22 bp, Homo sapiens
cagattccggtcatctctcctt

SEQ ID NO: 8755110 - DNA, 22 bp, Homo sapiens
cagcagcccacgcgtgctgtcc

SEQ ID NO: 8755111 - DNA, 22 bp, Homo sapiens
cagcagcctagaagctctacca

SEQ ID NO: 8755112 - DNA, 22 bp, Homo sapiens
cagcagcctacaatgcacagaa

SEQ ID NO: 8755113 - DNA, 22 bp, Homo sapiens
cagcagcctacaatgcacagaa

SEQ ID NO: 8755114 - DNA, 22 bp, Homo sapiens
cagcagcctacaatgcacagaa

SEQ ID NO: 8755115 - DNA, 22 bp, Homo sapiens
cagcagccgagagggggctctg

SEQ ID NO: 8755116 - DNA, 22 bp, Homo sapiens
cagcagccatgtaccacactca

SEQ ID NO: 8755117 - DNA, 22 bp, Homo sapiens
cagcagccagacaagatacatc

SEQ ID NO: 8755118 - DNA, 22 bp, Homo sapiens
cagcagccactagagggctcac

SEQ ID NO: 8755119 - DNA, 20 bp, Homo sapiens
cagcagccattctagtagta

SEQ ID NO: 8755120 - DNA, 20 bp, Homo sapiens
cagcagccattctagtagta

SEQ ID NO: 8755121 - DNA, 22 bp, Homo sapiens
cagcagccactagagggctcac

SEQ ID NO: 8755122 - DNA, 22 bp, Homo sapiens
cagcagcagccccaggaaggtt

SEQ ID NO: 8755123 - DNA, 22 bp, Homo sapiens
cagcagccactagagggctcac

SEQ ID NO: 8755124 - DNA, 22 bp, Homo sapiens
cagcagccactagagggctcac

SEQ ID NO: 8755125 - DNA, 22 bp, Homo sapiens
cagcaaaggtagaagcacagga

SEQ ID NO: 8755126 - DNA, 19 bp, Homo sapiens
cagcaaacactgtaaatgg

SEQ ID NO: 8755127 - DNA, 19 bp, Homo sapiens
cagcaaacactgtaaatgg

SEQ ID NO: 8755128 - DNA, 22 bp, Homo sapiens
cagcaaagcaggctcctagaac

SEQ ID NO: 8755129 - DNA, 22 bp, Homo sapiens
cagcaaaatttgaggattgcct

SEQ ID NO: 8755130 - DNA, 22 bp, Homo sapiens
cagcaaagcttaatttatatct

SEQ ID NO: 8755131 - DNA, 22 bp, Homo sapiens
cagcaaaggtagaagcacagga

SEQ ID NO: 8755132 - DNA, 22 bp, Homo sapiens
gtacttcttaaattaggatcaa

SEQ ID NO: 8755133 - DNA, 22 bp, Homo sapiens
gtacttctggccaggctggcca

SEQ ID NO: 8755134 - DNA, 22 bp, Homo sapiens
gtactttagagtaaaatagacc

SEQ ID NO: 8755135 - DNA, 22 bp, Homo sapiens
gtactttaaatcaatgtagatt

SEQ ID NO: 8755136 - DNA, 22 bp, Homo sapiens
gtacttctttagtcaatatgta

SEQ ID NO: 8755137 - DNA, 22 bp, Homo sapiens
gtactttaaatcaatgtagatt

SEQ ID NO: 8755138 - DNA, 22 bp, Homo sapiens
gtagaaatagtggttgacagga

SEQ ID NO: 8755139 - DNA, 22 bp, Homo sapiens
gtagaaaattaggatgaggctt

SEQ ID NO: 8755140 - DNA, 22 bp, Homo sapiens
gtagaaaaagcagtaagtctca

SEQ ID NO: 8755141 - DNA, 22 bp, Homo sapiens
gtagaaaaagcagtaagtctca

SEQ ID NO: 8755142 - DNA, 22 bp, Homo sapiens
gtactttgttaccatagctcca

SEQ ID NO: 8755143 - DNA, 22 bp, Homo sapiens
gtactttgttaccatagctcca

SEQ ID NO: 8755144 - DNA, 22 bp, Homo sapiens
gtagaaatatttatctctgaga

SEQ ID NO: 8755145 - DNA, 22 bp, Homo sapiens
gtaggcagataggagtgcagcc

SEQ ID NO: 8755146 - DNA, 22 bp, Homo sapiens
gtaggcagggctgtggggagaa

SEQ ID NO: 8755147 - DNA, 22 bp, Homo sapiens
gtaggcagggctgtggggagaa

SEQ ID NO: 8755148 - DNA, 22 bp, Homo sapiens
gtaggcagataggagtgcagcc

SEQ ID NO: 8755149 - DNA, 22 bp, Homo sapiens
gtaggcagataggagtgcagcc

SEQ ID NO: 8755150 - DNA, 22 bp, Homo sapiens
gtaggcaggtggaggagtgaag

SEQ ID NO: 8755151 - DNA, 22 bp, Homo sapiens
gtaggcagggctgtggggagaa

SEQ ID NO: 8755152 - DNA, 22 bp, Homo sapiens
gtaggcagtctctcaggtgatc

SEQ ID NO: 8755153 - DNA, 22 bp, Homo sapiens
gtaggcaggtggaggagtgaag

SEQ ID NO: 8755154 - DNA, 22 bp, Homo sapiens
gtaggcaggtggaggagtgaag

SEQ ID NO: 8755155 - DNA, 22 bp, Homo sapiens
gtaggccatggtggttgtctct

SEQ ID NO: 8755156 - DNA, 20 bp, Homo sapiens
gtaggcatatgaccaattac

SEQ ID NO: 8755157 - DNA, 22 bp, Homo sapiens
gtaggcagtggttggaagagaa

SEQ ID NO: 8755158 - DNA, 22 bp, Homo sapiens
gtaggcagtggttggaagagaa

SEQ ID NO: 8755159 - DNA, 22 bp, Homo sapiens
gtaggcagtggttggaagagaa

SEQ ID NO: 8755160 - DNA, 22 bp, Homo sapiens
gtaggcagtggttggaagagaa

SEQ ID NO: 8755161 - DNA, 22 bp, Homo sapiens
gtaggcagtgcttgattttcca

SEQ ID NO: 8755162 - DNA, 22 bp, Homo sapiens
gtaggcagtctctcaggtgatc

SEQ ID NO: 8755163 - DNA, 22 bp, Homo sapiens
gtaggcagtctctcaggtgatc

SEQ ID NO: 8755164 - DNA, 22 bp, Homo sapiens
gtacacagatgcttgagaatct

SEQ ID NO: 8755165 - DNA, 22 bp, Homo sapiens
gtacacagagtggtggaagaaa

SEQ ID NO: 8755166 - DNA, 22 bp, Homo sapiens
gtacacataggttactgattaa

SEQ ID NO: 8755167 - DNA, 21 bp, Homo sapiens
gtacacagtggttctgaggga

SEQ ID NO: 8755168 - DNA, 22 bp, Homo sapiens
cagcagcctagggttccatcat

SEQ ID NO: 8755169 - DNA, 22 bp, Homo sapiens
cagcagcctagaagctctacca

SEQ ID NO: 8755170 - DNA, 22 bp, Homo sapiens
cagcagcctagaagctctacca

SEQ ID NO: 8755171 - DNA, 22 bp, Homo sapiens
gtacacactgtttgatcatttc

SEQ ID NO: 8755172 - DNA, 22 bp, Homo sapiens
gtacacactgtttgatcatttc

SEQ ID NO: 8755173 - DNA, 22 bp, Homo sapiens
gtactaaaaaatgatcagtttg

SEQ ID NO: 8755174 - DNA, 22 bp, Homo sapiens
gtactaaacagagaaccaatat

SEQ ID NO: 8755175 - DNA, 22 bp, Homo sapiens
gtactaaaaaatgatcagtttg

SEQ ID NO: 8755176 - DNA, 22 bp, Homo sapiens
gtactaaacagagaaccaatat

SEQ ID NO: 8755177 - DNA, 22 bp, Homo sapiens
gtactacaatgttcacaacatt

SEQ ID NO: 8755178 - DNA, 20 bp, Homo sapiens
gtactcagatcaagtcagct

SEQ ID NO: 8755179 - DNA, 22 bp, Homo sapiens
gtacacatatttccaagggtaa

SEQ ID NO: 8755180 - DNA, 23 bp, Homo sapiens
gtacacatagtgtagttatattt

SEQ ID NO: 8755181 - DNA, 20 bp, Homo sapiens
gtacacatatatgtatgtgt

SEQ ID NO: 8755182 - DNA, 20 bp, Homo sapiens
gtacacatatatgtatgtgt

SEQ ID NO: 8755183 - DNA, 22 bp, Homo sapiens
gtacacataggttactgattaa

SEQ ID NO: 8755184 - DNA, 22 bp, Homo sapiens
gtacacattgtctgtttacttc

SEQ ID NO: 8755185 - DNA, 18 bp, Homo sapiens
gtacactacatgtctaac

SEQ ID NO: 8755186 - DNA, 22 bp, Homo sapiens
ggggccttggatctgtgccccg

SEQ ID NO: 8755187 - DNA, 22 bp, Homo sapiens
ggggccttggatctgtgccccg

SEQ ID NO: 8755188 - DNA, 22 bp, Homo sapiens
ggggccttggatctgtgccccg

SEQ ID NO: 8755189 - DNA, 22 bp, Homo sapiens
ggggccttttctgaatgtggaa

SEQ ID NO: 8755190 - DNA, 22 bp, Homo sapiens
ggggccttttctgaatgtggaa

SEQ ID NO: 8755191 - DNA, 22 bp, Homo sapiens
ggggtgaggtttatgttctggg

SEQ ID NO: 8755192 - DNA, 22 bp, Homo sapiens
ggggccttttctgaatgtggaa

SEQ ID NO: 8755193 - DNA, 22 bp, Homo sapiens
ggggcctgtagagcttcaggga

SEQ ID NO: 8755194 - DNA, 22 bp, Homo sapiens
ggggcctgtagagcttcaggga

SEQ ID NO: 8755195 - DNA, 22 bp, Homo sapiens
ggggcctgcgaggttcaacttc

SEQ ID NO: 8755196 - DNA, 19 bp, Homo sapiens
ggggcctgtgatggtcaca

SEQ ID NO: 8755197 - DNA, 19 bp, Homo sapiens
ggggcctgtgatggtcaca

SEQ ID NO: 8755198 - DNA, 19 bp, Homo sapiens
ggggcctgtgatggtcaca

SEQ ID NO: 8755199 - DNA, 22 bp, Homo sapiens
ggggccttggatctgtgccccg

SEQ ID NO: 8755200 - DNA, 22 bp, Homo sapiens
ggggccttggatctgtgccccg

SEQ ID NO: 8755201 - DNA, 22 bp, Homo sapiens
ggggccttggatctgtgccccg

SEQ ID NO: 8755202 - DNA, 20 bp, Homo sapiens
ggggttggctggcacaggga

SEQ ID NO: 8755203 - DNA, 22 bp, Homo sapiens
gggtaaatctcttttcatggct

SEQ ID NO: 8755204 - DNA, 20 bp, Homo sapiens
gggtacagatatgcagtgaa

SEQ ID NO: 8755205 - DNA, 22 bp, Homo sapiens
gggtacagaaactgaggcttag

SEQ ID NO: 8755206 - DNA, 22 bp, Homo sapiens
gggtaaggtcagccagaagttc

SEQ ID NO: 8755207 - DNA, 22 bp, Homo sapiens
gggtaacgttggaatttttgtg

SEQ ID NO: 8755208 - DNA, 22 bp, Homo sapiens
gggtaattggaaatattaatag

SEQ ID NO: 8755209 - DNA, 22 bp, Homo sapiens
ggggcagagagaaggaagcttg

SEQ ID NO: 8755210 - DNA, 22 bp, Homo sapiens
ggggcagagtagctggggtgtg

SEQ ID NO: 8755211 - DNA, 22 bp, Homo sapiens
ggggcagagtagctggggtgtg

SEQ ID NO: 8755212 - DNA, 21 bp, Homo sapiens
ggggcagagctaggccctgca

SEQ ID NO: 8755213 - DNA, 22 bp, Homo sapiens
ggggcagagagaaggaagcttg

SEQ ID NO: 8755214 - DNA, 21 bp, Homo sapiens
ggggcagagctaggccctgca

SEQ ID NO: 8755215 - DNA, 21 bp, Homo sapiens
ggggcagagctaggccctgca

SEQ ID NO: 8755216 - DNA, 22 bp, Homo sapiens
ggggcagatggaacagagcaca

SEQ ID NO: 8755217 - DNA, 22 bp, Homo sapiens
ggggcagatggaacagagcaca

SEQ ID NO: 8755218 - DNA, 23 bp, Homo sapiens
ggggcctgcaccggtctgcgcgg

SEQ ID NO: 8755219 - DNA, 22 bp, Homo sapiens
ggggcctctgcagtcacgctgg

SEQ ID NO: 8755220 - DNA, 23 bp, Homo sapiens
ggggcctgcaccggtctgcgcgg

SEQ ID NO: 8755221 - DNA, 23 bp, Homo sapiens
ggggcctgcaccggtctgcgcgg

SEQ ID NO: 8755222 - DNA, 23 bp, Homo sapiens
ggggcctgcaccggtctgcgcgg

SEQ ID NO: 8755223 - DNA, 21 bp, Homo sapiens
ggggcctctccacacagccgg

SEQ ID NO: 8755224 - DNA, 22 bp, Homo sapiens
ggggcctcgccgccgcctctgc

SEQ ID NO: 8755225 - DNA, 22 bp, Homo sapiens
gggctgtcatgtgtcagtgacc

SEQ ID NO: 8755226 - DNA, 22 bp, Homo sapiens
gggctgtaggagctggaatggg

SEQ ID NO: 8755227 - DNA, 22 bp, Homo sapiens
gggctgtaggagctggaatggg

SEQ ID NO: 8755228 - DNA, 22 bp, Homo sapiens
gggctgtaggagctggaatggg

SEQ ID NO: 8755229 - DNA, 22 bp, Homo sapiens
gggctgtgagagtggggctgct

SEQ ID NO: 8755230 - DNA, 18 bp, Homo sapiens
gggctgtgagatgggaag

SEQ ID NO: 8755231 - DNA, 22 bp, Homo sapiens
gggctgtgagagtggggctgct

SEQ ID NO: 8755232 - DNA, 22 bp, Homo sapiens
gggctgtgagagtggggctgct

SEQ ID NO: 8755233 - DNA, 22 bp, Homo sapiens
gggctggatctcacgtgagacc

SEQ ID NO: 8755234 - DNA, 22 bp, Homo sapiens
gggctggatctcacgtgagacc

SEQ ID NO: 8755235 - DNA, 22 bp, Homo sapiens
gggctggagttgggaagacaaa

SEQ ID NO: 8755236 - DNA, 22 bp, Homo sapiens
gggctggagttgggaagacaaa

SEQ ID NO: 8755237 - DNA, 22 bp, Homo sapiens
gggctggagtcttctgaaagcc

SEQ ID NO: 8755238 - DNA, 22 bp, Homo sapiens
gggctgtggagccgcgagggct

SEQ ID NO: 8755239 - DNA, 22 bp, Homo sapiens
gggctgtggagccgcgagggct

SEQ ID NO: 8755240 - DNA, 22 bp, Homo sapiens
gggctgtggagccgcgagggct

SEQ ID NO: 8755241 - DNA, 22 bp, Homo sapiens
gggctgtggagccgcgagggct

SEQ ID NO: 8755242 - DNA, 22 bp, Homo sapiens
gggctgtggagccgcgagggct

SEQ ID NO: 8755243 - DNA, 22 bp, Homo sapiens
gggctgtgggacccggcacttt

SEQ ID NO: 8755244 - DNA, 22 bp, Homo sapiens
gggctgtgggacccggcacttt

SEQ ID NO: 8755245 - DNA, 22 bp, Homo sapiens
gggctgtgtaatgtgctctttt

SEQ ID NO: 8755246 - DNA, 22 bp, Homo sapiens
gggctgtgaggtgagaacttac

SEQ ID NO: 8755247 - DNA, 22 bp, Homo sapiens
gggctgtgcctcaggtggggtc

SEQ ID NO: 8755248 - DNA, 18 bp, Homo sapiens
gggctgtgagatgggaag

SEQ ID NO: 8755249 - DNA, 22 bp, Homo sapiens
gggctgtgaggtgagaacttac

SEQ ID NO: 8755250 - DNA, 22 bp, Homo sapiens
gggctgtgctgagtaggaggtg

SEQ ID NO: 8755251 - DNA, 22 bp, Homo sapiens
gggctgtgctgagtaggaggtg

SEQ ID NO: 8755252 - DNA, 22 bp, Homo sapiens
gggctgtgctgagtaggaggtg

SEQ ID NO: 8755253 - DNA, 20 bp, Homo sapiens
gggctgtgcctcctcgtggt

SEQ ID NO: 8755254 - DNA, 20 bp, Homo sapiens
gggctgtgcctcctcgtggt

SEQ ID NO: 8755255 - DNA, 22 bp, Homo sapiens
cagagccactgtctgccaggca

SEQ ID NO: 8755256 - DNA, 22 bp, Homo sapiens
cagagccacttggagatgagaa

SEQ ID NO: 8755257 - DNA, 22 bp, Homo sapiens
cagagccacttggagatgagaa

SEQ ID NO: 8755258 - DNA, 22 bp, Homo sapiens
cagagccactgtctgccaggca

SEQ ID NO: 8755259 - DNA, 22 bp, Homo sapiens
cagagccactgtctgccaggca

SEQ ID NO: 8755260 - DNA, 22 bp, Homo sapiens
cagagccagaactagaccttgt

SEQ ID NO: 8755261 - DNA, 21 bp, Homo sapiens
cagagccagactgctgaattt

SEQ ID NO: 8755262 - DNA, 22 bp, Homo sapiens
cagagccagagacctgctgtgc

SEQ ID NO: 8755263 - DNA, 22 bp, Homo sapiens
cagagccagagacctgctgtgc

SEQ ID NO: 8755264 - DNA, 22 bp, Homo sapiens
cagagccagcagtggggacagg

SEQ ID NO: 8755265 - DNA, 22 bp, Homo sapiens
cagagccagcagtggggacagg

SEQ ID NO: 8755266 - DNA, 22 bp, Homo sapiens
cagagccagagacctgctgtgc

SEQ ID NO: 8755267 - DNA, 22 bp, Homo sapiens
gggctgagtgggcctcttactt

SEQ ID NO: 8755268 - DNA, 22 bp, Homo sapiens
gggctggaggaccggcctcgga

SEQ ID NO: 8755269 - DNA, 22 bp, Homo sapiens
gggctggaggagatccagaggc

SEQ ID NO: 8755270 - DNA, 22 bp, Homo sapiens
gggctggaggcctgcctggtta

SEQ ID NO: 8755271 - DNA, 22 bp, Homo sapiens
gggctggaggcctgcctggtta

SEQ ID NO: 8755272 - DNA, 19 bp, Homo sapiens
gggctggagggatagagcc

SEQ ID NO: 8755273 - DNA, 22 bp, Homo sapiens
gggctggaggtgagcaggacag

SEQ ID NO: 8755274 - DNA, 22 bp, Homo sapiens
gggctggaggtgagcaggacag

SEQ ID NO: 8755275 - DNA, 22 bp, Homo sapiens
gggctggaggtgagcaggacag

SEQ ID NO: 8755276 - DNA, 19 bp, Homo sapiens
gggctggagggatagagcc

SEQ ID NO: 8755277 - DNA, 22 bp, Homo sapiens
gggctggagtcttctgaaagcc

SEQ ID NO: 8755278 - DNA, 22 bp, Homo sapiens
gggttcagtccctcttgctact

SEQ ID NO: 8755279 - DNA, 22 bp, Homo sapiens
gggttcagtccctcttgctact

SEQ ID NO: 8755280 - DNA, 22 bp, Homo sapiens
gggttccaaacatagtcttcct

SEQ ID NO: 8755281 - DNA, 22 bp, Homo sapiens
gggttcagagtcaggtgtgata

SEQ ID NO: 8755282 - DNA, 22 bp, Homo sapiens
gggttcaggttggcctgagcac

SEQ ID NO: 8755283 - DNA, 22 bp, Homo sapiens
gggttccaatgatgagcaagag

SEQ ID NO: 8755284 - DNA, 22 bp, Homo sapiens
gggttcttatagtatcagagct

SEQ ID NO: 8755285 - DNA, 22 bp, Homo sapiens
gggttccagtctgaaactacag

SEQ ID NO: 8755286 - DNA, 22 bp, Homo sapiens
gggttccaatgatgagcaagag

SEQ ID NO: 8755287 - DNA, 22 bp, Homo sapiens
ggtagtcggccttgccctgggc

SEQ ID NO: 8755288 - DNA, 22 bp, Homo sapiens
ggtagttcttcatgggtttcat

SEQ ID NO: 8755289 - DNA, 22 bp, Homo sapiens
ggtatactgcatgacattgggg

SEQ ID NO: 8755290 - DNA, 22 bp, Homo sapiens
ggtatactgcatgacattgggg

SEQ ID NO: 8755291 - DNA, 22 bp, Homo sapiens
ggtatgaaatgattccatgtta

SEQ ID NO: 8755292 - DNA, 22 bp, Homo sapiens
ggtatgaattcactacttccaa

SEQ ID NO: 8755293 - DNA, 22 bp, Homo sapiens
gggtgtttatgtattatgatgt

SEQ ID NO: 8755294 - DNA, 22 bp, Homo sapiens
gggtgtgtcttttgctcctgga

SEQ ID NO: 8755295 - DNA, 20 bp, Homo sapiens
gggtgtgtgcagggcctggt

SEQ ID NO: 8755296 - DNA, 22 bp, Homo sapiens
gggttcagactaaagctatgca

SEQ ID NO: 8755297 - DNA, 22 bp, Homo sapiens
gggttaggtccctcccttctgg

SEQ ID NO: 8755298 - DNA, 22 bp, Homo sapiens
gggtgtttatgtattatgatgt

SEQ ID NO: 8755299 - DNA, 22 bp, Homo sapiens
gggtgtggctgcgtgccaataa

SEQ ID NO: 8755300 - DNA, 20 bp, Homo sapiens
gggtgtggcctgggaatttg

SEQ ID NO: 8755301 - DNA, 22 bp, Homo sapiens
gggtaggaaatccagaggtggc

SEQ ID NO: 8755302 - DNA, 22 bp, Homo sapiens
gggtaggaaatccagaggtggc

SEQ ID NO: 8755303 - DNA, 22 bp, Homo sapiens
gggtaggaaatccagaggtggc

SEQ ID NO: 8755304 - DNA, 22 bp, Homo sapiens
gggtacagttcttccagtgtca

SEQ ID NO: 8755305 - DNA, 22 bp, Homo sapiens
gggtacagttcttccagtgtca

SEQ ID NO: 8755306 - DNA, 19 bp, Homo sapiens
gggtcccaaaagatgtgct

SEQ ID NO: 8755307 - DNA, 22 bp, Homo sapiens
gggtcccagcataggggaagca

SEQ ID NO: 8755308 - DNA, 22 bp, Homo sapiens
gggtccagtagttggtggccgt

SEQ ID NO: 8755309 - DNA, 22 bp, Homo sapiens
gggtccaggtcttcaggcagag

SEQ ID NO: 8755310 - DNA, 22 bp, Homo sapiens
gggtccaggtcttcaggcagag

SEQ ID NO: 8755311 - DNA, 22 bp, Homo sapiens
gggtccaggtcttcaggcagag

SEQ ID NO: 8755312 - DNA, 22 bp, Homo sapiens
gggtgggatctgtggagcctca

SEQ ID NO: 8755313 - DNA, 18 bp, Homo sapiens
gggtcctgtgggagacag

SEQ ID NO: 8755314 - DNA, 18 bp, Homo sapiens
gggtcctgttcttggaag

SEQ ID NO: 8755315 - DNA, 22 bp, Homo sapiens
gggtcctggaatctgcatttta

SEQ ID NO: 8755316 - DNA, 21 bp, Homo sapiens
gggtcctgggatgggatccag

SEQ ID NO: 8755317 - DNA, 22 bp, Homo sapiens
gggtcctggaatctgcatttta

SEQ ID NO: 8755318 - DNA, 22 bp, Homo sapiens
gggtcctgcgtgggcccaggac

SEQ ID NO: 8755319 - DNA, 20 bp, Homo sapiens
gggtcctgacttggtctcct

SEQ ID NO: 8755320 - DNA, 22 bp, Homo sapiens
gggtccctggaattacttgaca

SEQ ID NO: 8755321 - DNA, 22 bp, Homo sapiens
gggtccctggaattacttgaca

SEQ ID NO: 8755322 - DNA, 22 bp, Homo sapiens
gggtccctcgcaggcgtcgccg

SEQ ID NO: 8755323 - DNA, 22 bp, Homo sapiens
gggtcccctcatcatggagact

SEQ ID NO: 8755324 - DNA, 18 bp, Homo sapiens
gggtccccagctgcaggg

SEQ ID NO: 8755325 - DNA, 20 bp, Homo sapiens
gggtccctccggcctgctat

SEQ ID NO: 8755326 - DNA, 22 bp, Homo sapiens
gggtcccctcatcatggagact

SEQ ID NO: 8755327 - DNA, 22 bp, Homo sapiens
cagatgctaaacaaaggacttt

SEQ ID NO: 8755328 - DNA, 22 bp, Homo sapiens
cagatgctaagttatcagcagg

SEQ ID NO: 8755329 - DNA, 22 bp, Homo sapiens
cagatgctaggccaattcctga

SEQ ID NO: 8755330 - DNA, 22 bp, Homo sapiens
cagatgctaagttatcagcagg

SEQ ID NO: 8755331 - DNA, 23 bp, Homo sapiens
cagatgaggttggcagcatggtc

SEQ ID NO: 8755332 - DNA, 22 bp, Homo sapiens
ggtcctctccagcgccacagtg

SEQ ID NO: 8755333 - DNA, 22 bp, Homo sapiens
ggtcctgaggggagctgaaggt

SEQ ID NO: 8755334 - DNA, 22 bp, Homo sapiens
ggtcctctgagcacgccaggca

SEQ ID NO: 8755335 - DNA, 22 bp, Homo sapiens
ggtcctgcattgccagcaagct

SEQ ID NO: 8755336 - DNA, 23 bp, Homo sapiens
ggtcctgcccccggtcgcccaaa

SEQ ID NO: 8755337 - DNA, 23 bp, Homo sapiens
ggtcctgcccccggtcgcccaaa

SEQ ID NO: 8755338 - DNA, 22 bp, Homo sapiens
ggtcctgcctgctgtccttcaa

SEQ ID NO: 8755339 - DNA, 20 bp, Homo sapiens
ggtcctgccttcatcacttc

SEQ ID NO: 8755340 - DNA, 22 bp, Homo sapiens
ggtcctggatgagacaggtagt

SEQ ID NO: 8755341 - DNA, 22 bp, Homo sapiens
ggtcctggcagctctgtgtcca

SEQ ID NO: 8755342 - DNA, 22 bp, Homo sapiens
ggtcctgcgtctggctcgcccg

SEQ ID NO: 8755343 - DNA, 22 bp, Homo sapiens
ggtcctgcgtctggctcgcccg

SEQ ID NO: 8755344 - DNA, 22 bp, Homo sapiens
ggtcctggaaattgacggaaag

SEQ ID NO: 8755345 - DNA, 22 bp, Homo sapiens
ggtcctggaagtgtaagtggca

SEQ ID NO: 8755346 - DNA, 22 bp, Homo sapiens
cagatgtttgtctatatgcttt

SEQ ID NO: 8755347 - DNA, 22 bp, Homo sapiens
cagatgtttgtctatatgcttt

SEQ ID NO: 8755348 - DNA, 22 bp, Homo sapiens
cagatgtttgtctatatgcttt

SEQ ID NO: 8755349 - DNA, 19 bp, Homo sapiens
cagatgttttcagttcatt

SEQ ID NO: 8755350 - DNA, 19 bp, Homo sapiens
cagatgttttcagttcatt

SEQ ID NO: 8755351 - DNA, 19 bp, Homo sapiens
cagatgttttcagttcatt

SEQ ID NO: 8755352 - DNA, 22 bp, Homo sapiens
cagatgttgttcctgcctgtag

SEQ ID NO: 8755353 - DNA, 22 bp, Homo sapiens
cagatgttgttcctgcctgtag

SEQ ID NO: 8755354 - DNA, 22 bp, Homo sapiens
cagatggcacagatttagagtg

SEQ ID NO: 8755355 - DNA, 22 bp, Homo sapiens
ggtcaacagaatttgtactcag

SEQ ID NO: 8755356 - DNA, 22 bp, Homo sapiens
ggtcaacagaggtaatggtaac

SEQ ID NO: 8755357 - DNA, 22 bp, Homo sapiens
ggtattgaggtaatcctatttt

SEQ ID NO: 8755358 - DNA, 22 bp, Homo sapiens
ggtcacagctttttcagcagca

SEQ ID NO: 8755359 - DNA, 20 bp, Homo sapiens
cagatatcagaagcacagcc

SEQ ID NO: 8755360 - DNA, 22 bp, Homo sapiens
ggtcacaaggtactgtaagaaa

SEQ ID NO: 8755361 - DNA, 22 bp, Homo sapiens
ggtcacaaggtactgtaagaaa

SEQ ID NO: 8755362 - DNA, 19 bp, Homo sapiens
ggtcacaaggagttgtgaa

SEQ ID NO: 8755363 - DNA, 22 bp, Homo sapiens
cagatgaggacagatgactggg

SEQ ID NO: 8755364 - DNA, 22 bp, Homo sapiens
cagatgaggacagatgactggg

SEQ ID NO: 8755365 - DNA, 22 bp, Homo sapiens
cagatgagcatgggcacaagca

SEQ ID NO: 8755366 - DNA, 22 bp, Homo sapiens
cagatgagcatgggcacaagca

SEQ ID NO: 8755367 - DNA, 23 bp, Homo sapiens
cagatgaggttggcagcatggtc

SEQ ID NO: 8755368 - DNA, 22 bp, Homo sapiens
cagatgaggggcatataacaat

SEQ ID NO: 8755369 - DNA, 19 bp, Homo sapiens
cagatgagaaaagtgaggt

SEQ ID NO: 8755370 - DNA, 22 bp, Homo sapiens
cagatgaagtttgcctagagct

SEQ ID NO: 8755371 - DNA, 22 bp, Homo sapiens
cagatgaataaatgatgaggta

SEQ ID NO: 8755372 - DNA, 22 bp, Homo sapiens
cagatgaataaatgatgaggta

SEQ ID NO: 8755373 - DNA, 22 bp, Homo sapiens
cagatgaagtattacagacatt

SEQ ID NO: 8755374 - DNA, 22 bp, Homo sapiens
cagatgaagtattacagacatt

SEQ ID NO: 8755375 - DNA, 22 bp, Homo sapiens
cagatgaagtattacagacatt

SEQ ID NO: 8755376 - DNA, 19 bp, Homo sapiens
cagatgagaaaagtgaggt

SEQ ID NO: 8755377 - DNA, 20 bp, Homo sapiens
cagagcagtgcccaggcggc

SEQ ID NO: 8755378 - DNA, 22 bp, Homo sapiens
cagagcagtgaggagttgtgta

SEQ ID NO: 8755379 - DNA, 22 bp, Homo sapiens
cagagcagtggagagtaggtct

SEQ ID NO: 8755380 - DNA, 20 bp, Homo sapiens
cagagcagtgcccaggcggc

SEQ ID NO: 8755381 - DNA, 20 bp, Homo sapiens
cagagcagtgcccaggcggc

SEQ ID NO: 8755382 - DNA, 20 bp, Homo sapiens
cagagcagtgcccaggcggc

SEQ ID NO: 8755383 - DNA, 19 bp, Homo sapiens
cagagcagtggttcctgaa

SEQ ID NO: 8755384 - DNA, 19 bp, Homo sapiens
cagagcagtggttcctgaa

SEQ ID NO: 8755385 - DNA, 22 bp, Homo sapiens
cagagcatcgcgcagagagcct

SEQ ID NO: 8755386 - DNA, 22 bp, Homo sapiens
cagagcagtggggttggtcaga

SEQ ID NO: 8755387 - DNA, 22 bp, Homo sapiens
cagagccaaatgctgtggttat

SEQ ID NO: 8755388 - DNA, 22 bp, Homo sapiens
cagagccaaacctcagggcccg

SEQ ID NO: 8755389 - DNA, 22 bp, Homo sapiens
cagagcatgtcaactagcttta

SEQ ID NO: 8755390 - DNA, 22 bp, Homo sapiens
cagagcattgagggtctgccaa

SEQ ID NO: 8755391 - DNA, 22 bp, Homo sapiens
cagagccaacgccacctgccca

SEQ ID NO: 8755392 - DNA, 22 bp, Homo sapiens
cagagccaaatgctgtggttat

SEQ ID NO: 8755393 - DNA, 22 bp, Homo sapiens
cagagccaaatgctgtggttat

SEQ ID NO: 8755394 - DNA, 22 bp, Homo sapiens
cagagccacagcctccagattt

SEQ ID NO: 8755395 - DNA, 22 bp, Homo sapiens
cagagccacagcctccagattt

SEQ ID NO: 8755396 - DNA, 22 bp, Homo sapiens
cagagccactgcattttacagc

SEQ ID NO: 8755397 - DNA, 22 bp, Homo sapiens
cagagccactgcattttacagc

SEQ ID NO: 8755398 - DNA, 20 bp, Homo sapiens
cagagccaagagcagcatct

SEQ ID NO: 8755399 - DNA, 20 bp, Homo sapiens
cagagccaagagcagcatct

SEQ ID NO: 8755400 - DNA, 22 bp, Homo sapiens
cagagcagacgttgagattaag

SEQ ID NO: 8755401 - DNA, 22 bp, Homo sapiens
cagagcagacgttgagattaag

SEQ ID NO: 8755402 - DNA, 22 bp, Homo sapiens
cagagcagacgttgagattaag

SEQ ID NO: 8755403 - DNA, 22 bp, Homo sapiens
cagagcagaaggtccaagcctg

SEQ ID NO: 8755404 - DNA, 22 bp, Homo sapiens
gggcaggggtcagtggccccaa

SEQ ID NO: 8755405 - DNA, 22 bp, Homo sapiens
gggcaggggtagcattccaagt

SEQ ID NO: 8755406 - DNA, 22 bp, Homo sapiens
gggcaggggtagcattccaagt

SEQ ID NO: 8755407 - DNA, 22 bp, Homo sapiens
gggcaggtactgggtggtgagc

SEQ ID NO: 8755408 - DNA, 22 bp, Homo sapiens
gggcaggtactgggtggtgagc

SEQ ID NO: 8755409 - DNA, 22 bp, Homo sapiens
gggcaggtacaagatgcttctt

SEQ ID NO: 8755410 - DNA, 22 bp, Homo sapiens
gggcaggtacaagatgcttctt

SEQ ID NO: 8755411 - DNA, 22 bp, Homo sapiens
gggcaggggtcagtggccccaa

SEQ ID NO: 8755412 - DNA, 22 bp, Homo sapiens
gggcaggggtcagtggccccaa

SEQ ID NO: 8755413 - DNA, 22 bp, Homo sapiens
gggcaggggtcagtggccccaa

SEQ ID NO: 8755414 - DNA, 22 bp, Homo sapiens
cagagacaacctggtagagaaa

SEQ ID NO: 8755415 - DNA, 22 bp, Homo sapiens
cagagacaacctggtagagaaa

SEQ ID NO: 8755416 - DNA, 22 bp, Homo sapiens
cagagacaacctggtagagaaa

SEQ ID NO: 8755417 - DNA, 22 bp, Homo sapiens
cagagacaacctggtagagaaa

SEQ ID NO: 8755418 - DNA, 22 bp, Homo sapiens
cagagacaacctggtagagaaa

SEQ ID NO: 8755419 - DNA, 22 bp, Homo sapiens
cagagacaatgtctctgcttgt

SEQ ID NO: 8755420 - DNA, 22 bp, Homo sapiens
cagagacaatgtctctgcttgt

SEQ ID NO: 8755421 - DNA, 22 bp, Homo sapiens
cagagacaccccagaaaataag

SEQ ID NO: 8755422 - DNA, 22 bp, Homo sapiens
cagagacaccccagaaaataag

SEQ ID NO: 8755423 - DNA, 22 bp, Homo sapiens
cagagacacttaacaggaatgg

SEQ ID NO: 8755424 - DNA, 22 bp, Homo sapiens
cagagacaacctggtagagaaa

SEQ ID NO: 8755425 - DNA, 22 bp, Homo sapiens
cagagacacttaacaggaatgg

SEQ ID NO: 8755426 - DNA, 22 bp, Homo sapiens
cagagacacttaacaggaatgg

SEQ ID NO: 8755427 - DNA, 22 bp, Homo sapiens
gggatctgatttaggatgggag

SEQ ID NO: 8755428 - DNA, 22 bp, Homo sapiens
cagagacagaaaatggatctag

SEQ ID NO: 8755429 - DNA, 22 bp, Homo sapiens
gggatctgatttaggatgggag

SEQ ID NO: 8755430 - DNA, 22 bp, Homo sapiens
gggatctgctccagagggaaaa

SEQ ID NO: 8755431 - DNA, 22 bp, Homo sapiens
cagagacacttaacaggaatgg

SEQ ID NO: 8755432 - DNA, 22 bp, Homo sapiens
cagagacaccccagaaaataag

SEQ ID NO: 8755433 - DNA, 22 bp, Homo sapiens
cagagacaccccagaaaataag

SEQ ID NO: 8755434 - DNA, 22 bp, Homo sapiens
cagagacacttaacaggaatgg

SEQ ID NO: 8755435 - DNA, 22 bp, Homo sapiens
cagagacacttaacaggaatgg

SEQ ID NO: 8755436 - DNA, 22 bp, Homo sapiens
cagagaataaaagggcattcct

SEQ ID NO: 8755437 - DNA, 22 bp, Homo sapiens
cagagaagagtctggcctctct

SEQ ID NO: 8755438 - DNA, 22 bp, Homo sapiens
cagagacaacaagtttaactat

SEQ ID NO: 8755439 - DNA, 22 bp, Homo sapiens
cagagaattaattgtggctaag

SEQ ID NO: 8755440 - DNA, 22 bp, Homo sapiens
cagagacaacctggtagagaaa

SEQ ID NO: 8755441 - DNA, 22 bp, Homo sapiens
cagagacaacaagtttaactat

SEQ ID NO: 8755442 - DNA, 22 bp, Homo sapiens
cagagaagagtctggcctctct

SEQ ID NO: 8755443 - DNA, 22 bp, Homo sapiens
cagagaagaaagtgactataat

SEQ ID NO: 8755444 - DNA, 22 bp, Homo sapiens
cagagaagaaagtgactataat

SEQ ID NO: 8755445 - DNA, 22 bp, Homo sapiens
cagacttgacggcagctgcttt

SEQ ID NO: 8755446 - DNA, 22 bp, Homo sapiens
cagacttgacggcagctgcttt

SEQ ID NO: 8755447 - DNA, 22 bp, Homo sapiens
cagactgtggcttcttggaggg

SEQ ID NO: 8755448 - DNA, 22 bp, Homo sapiens
cagactgtggcttcttggaggg

SEQ ID NO: 8755449 - DNA, 22 bp, Homo sapiens
cagactgtgagctccttgaggg

SEQ ID NO: 8755450 - DNA, 22 bp, Homo sapiens
cagactgtggcttcttggaggg

SEQ ID NO: 8755451 - DNA, 22 bp, Homo sapiens
cagacttgaaagagactcagtt

SEQ ID NO: 8755452 - DNA, 22 bp, Homo sapiens
cagactgtgtctgaacctggtc

SEQ ID NO: 8755453 - DNA, 20 bp, Homo sapiens
gggaggcattggtccctcac

SEQ ID NO: 8755454 - DNA, 22 bp, Homo sapiens
cagactgtagagtttgagaagt

SEQ ID NO: 8755455 - DNA, 22 bp, Homo sapiens
cagactgtagagtttgagaagt

SEQ ID NO: 8755456 - DNA, 22 bp, Homo sapiens
cagactgtgagctccttgaggg

SEQ ID NO: 8755457 - DNA, 22 bp, Homo sapiens
cagactgtgagctccttgaggg

SEQ ID NO: 8755458 - DNA, 20 bp, Homo sapiens
gggaggcattggtccctcac

SEQ ID NO: 8755459 - DNA, 20 bp, Homo sapiens
gggaggcattggtccctcac

SEQ ID NO: 8755460 - DNA, 20 bp, Homo sapiens
gggaggcattggtccctcac

SEQ ID NO: 8755461 - DNA, 20 bp, Homo sapiens
gggaggcattggtccctcac

SEQ ID NO: 8755462 - DNA, 22 bp, Homo sapiens
cagagcagaagcggtcctcaca

SEQ ID NO: 8755463 - DNA, 22 bp, Homo sapiens
cagagcagaagcggtcctcaca

SEQ ID NO: 8755464 - DNA, 22 bp, Homo sapiens
gggatgagagtagggtgtgaaa

SEQ ID NO: 8755465 - DNA, 22 bp, Homo sapiens
cagagaggaggctatatgcaaa

SEQ ID NO: 8755466 - DNA, 22 bp, Homo sapiens
cagagaggaggctatatgcaaa

SEQ ID NO: 8755467 - DNA, 22 bp, Homo sapiens
cagagaggaggctatatgcaaa

SEQ ID NO: 8755468 - DNA, 22 bp, Homo sapiens
cagagcactgcttggaggattt

SEQ ID NO: 8755469 - DNA, 22 bp, Homo sapiens
cagagcacccaaggagcatttg

SEQ ID NO: 8755470 - DNA, 22 bp, Homo sapiens
gggatgagagctgggacagaag

SEQ ID NO: 8755471 - DNA, 22 bp, Homo sapiens
gggatgagagctgggacagaag

SEQ ID NO: 8755472 - DNA, 22 bp, Homo sapiens
gggatgagagctgggacagaag

SEQ ID NO: 8755473 - DNA, 22 bp, Homo sapiens
gggatgagagctgggacagaag

SEQ ID NO: 8755474 - DNA, 22 bp, Homo sapiens
gggatgagagtagggtgtgaaa

SEQ ID NO: 8755475 - DNA, 23 bp, Homo sapiens
gggatctgtaagttgaagacaaa

SEQ ID NO: 8755476 - DNA, 23 bp, Homo sapiens
gggatctgtaaacctggagaacc

SEQ ID NO: 8755477 - DNA, 22 bp, Homo sapiens
gggatctggaattttggtatgt

SEQ ID NO: 8755478 - DNA, 22 bp, Homo sapiens
gggatctgggacaacaggtggt

SEQ ID NO: 8755479 - DNA, 22 bp, Homo sapiens
gggatctgtgttgcgatggatt

SEQ ID NO: 8755480 - DNA, 22 bp, Homo sapiens
ggctggcactctgtccagtgtc

SEQ ID NO: 8755481 - DNA, 22 bp, Homo sapiens
ggctggcactctgtccagtgtc

SEQ ID NO: 8755482 - DNA, 22 bp, Homo sapiens
ggctggcacgaagccctgctgg

SEQ ID NO: 8755483 - DNA, 22 bp, Homo sapiens
ggctggcacgaagccctgctgg

SEQ ID NO: 8755484 - DNA, 22 bp, Homo sapiens
ggctggcacccttggggatagg

SEQ ID NO: 8755485 - DNA, 22 bp, Homo sapiens
ggctggcacctgccctccgctg

SEQ ID NO: 8755486 - DNA, 22 bp, Homo sapiens
ggctggcacgaagccctgctgg

SEQ ID NO: 8755487 - DNA, 22 bp, Homo sapiens
ggctggcacctgccctccgctg

SEQ ID NO: 8755488 - DNA, 22 bp, Homo sapiens
ggctggcaagtgtctgctcatg

SEQ ID NO: 8755489 - DNA, 22 bp, Homo sapiens
ggctggcaagtgtctgctcatg

SEQ ID NO: 8755490 - DNA, 22 bp, Homo sapiens
ggctggcacaaagctccaaatc

SEQ ID NO: 8755491 - DNA, 22 bp, Homo sapiens
ggctggcacagagggctggtgt

SEQ ID NO: 8755492 - DNA, 22 bp, Homo sapiens
ggctggcacaaagctccaaatc

SEQ ID NO: 8755493 - DNA, 22 bp, Homo sapiens
ggctggcacagagggctggtgt

SEQ ID NO: 8755494 - DNA, 22 bp, Homo sapiens
ggctggcaagtcagtgctgatg

SEQ ID NO: 8755495 - DNA, 19 bp, Homo sapiens
ggctggcaagtgacagtgt

SEQ ID NO: 8755496 - DNA, 22 bp, Homo sapiens
ggctggcactgaggagagctct

SEQ ID NO: 8755497 - DNA, 22 bp, Homo sapiens
ggctggcactctgtccagtgtc

SEQ ID NO: 8755498 - DNA, 22 bp, Homo sapiens
ggctggcactgaggagagctct

SEQ ID NO: 8755499 - DNA, 22 bp, Homo sapiens
cagaaaatagagtttctctgag

SEQ ID NO: 8755500 - DNA, 22 bp, Homo sapiens
cagaaaatagagtttctctgag

SEQ ID NO: 8755501 - DNA, 22 bp, Homo sapiens
cagaaaatagagtttctctgag

SEQ ID NO: 8755502 - DNA, 22 bp, Homo sapiens
cagaaaataaagtttctacgca

SEQ ID NO: 8755503 - DNA, 22 bp, Homo sapiens
ggctggcactgaggagagctct

SEQ ID NO: 8755504 - DNA, 22 bp, Homo sapiens
cagaaaatagagtttctctgag

SEQ ID NO: 8755505 - DNA, 22 bp, Homo sapiens
cagaaacactgtatttagggaa

SEQ ID NO: 8755506 - DNA, 22 bp, Homo sapiens
cagaaacacttgtagagaagtt

SEQ ID NO: 8755507 - DNA, 22 bp, Homo sapiens
cagaaacacttgtagagaagtt

SEQ ID NO: 8755508 - DNA, 22 bp, Homo sapiens
cagaaacacttgtagagaagtt

SEQ ID NO: 8755509 - DNA, 22 bp, Homo sapiens
cagaaacacttgtagagaagtt

SEQ ID NO: 8755510 - DNA, 22 bp, Homo sapiens
cagaattgagagaggctgttct

SEQ ID NO: 8755511 - DNA, 22 bp, Homo sapiens
cagaattcgaatgagcagaatc

SEQ ID NO: 8755512 - DNA, 22 bp, Homo sapiens
cagaatttaagtggattattct

SEQ ID NO: 8755513 - DNA, 22 bp, Homo sapiens
cagaatttaagtggattattct

SEQ ID NO: 8755514 - DNA, 22 bp, Homo sapiens
cagaatttaagtggattattct

SEQ ID NO: 8755515 - DNA, 22 bp, Homo sapiens
cagaataaaggtacaattgagt

SEQ ID NO: 8755516 - DNA, 22 bp, Homo sapiens
cagaataaaagtcccaaggcat

SEQ ID NO: 8755517 - DNA, 22 bp, Homo sapiens
cagaataagctgtgttgtcaag

SEQ ID NO: 8755518 - DNA, 22 bp, Homo sapiens
cagaaacagacatgacgcagta

SEQ ID NO: 8755519 - DNA, 22 bp, Homo sapiens
cagaaacagacatgacgcagta

SEQ ID NO: 8755520 - DNA, 22 bp, Homo sapiens
cagaaacagacatgacgcagta

SEQ ID NO: 8755521 - DNA, 22 bp, Homo sapiens
cagaaacagacatgacgcagta

SEQ ID NO: 8755522 - DNA, 22 bp, Homo sapiens
cagaaacagacatgacgcagta

SEQ ID NO: 8755523 - DNA, 22 bp, Homo sapiens
cagaaacagacatgacgcagta

SEQ ID NO: 8755524 - DNA, 22 bp, Homo sapiens
cagaaacagagaaatattggct

SEQ ID NO: 8755525 - DNA, 22 bp, Homo sapiens
cagaaacagagaaatattggct

SEQ ID NO: 8755526 - DNA, 22 bp, Homo sapiens
cagaataaaagtcccaaggcat

SEQ ID NO: 8755527 - DNA, 22 bp, Homo sapiens
cagaaacaggcaacgtgtgcac

SEQ ID NO: 8755528 - DNA, 22 bp, Homo sapiens
cagaaacaggcaacgtgtgcac

SEQ ID NO: 8755529 - DNA, 22 bp, Homo sapiens
cagaaacaggcaacgtgtgcac

SEQ ID NO: 8755530 - DNA, 22 bp, Homo sapiens
cagaatttttcactcaatcttc

SEQ ID NO: 8755531 - DNA, 22 bp, Homo sapiens
cagaatttttcgaatgtactgt

SEQ ID NO: 8755532 - DNA, 22 bp, Homo sapiens
cagaatttttcgaatgtactgt

SEQ ID NO: 8755533 - DNA, 22 bp, Homo sapiens
cagacaaagcggaaactgttta

SEQ ID NO: 8755534 - DNA, 22 bp, Homo sapiens
cagacaaagcggaaactgttta

SEQ ID NO: 8755535 - DNA, 22 bp, Homo sapiens
cagacaaagcggaaactgttta

SEQ ID NO: 8755536 - DNA, 22 bp, Homo sapiens
cagacaaagcggaaactgttta

SEQ ID NO: 8755537 - DNA, 22 bp, Homo sapiens
cagacaactggactaagatcac

SEQ ID NO: 8755538 - DNA, 22 bp, Homo sapiens
cagacaagaaagaatcaagcca

SEQ ID NO: 8755539 - DNA, 22 bp, Homo sapiens
cagacaaggccatctttcattt

SEQ ID NO: 8755540 - DNA, 22 bp, Homo sapiens
cagaatttgaagtaatattcca

SEQ ID NO: 8755541 - DNA, 22 bp, Homo sapiens
cagaatttgaagtaatattcca

SEQ ID NO: 8755542 - DNA, 22 bp, Homo sapiens
cagaatttcccacactgggact

SEQ ID NO: 8755543 - DNA, 22 bp, Homo sapiens
cagaatttcagtgatgttttct

SEQ ID NO: 8755544 - DNA, 22 bp, Homo sapiens
cagaatttcagtgatgttttct

SEQ ID NO: 8755545 - DNA, 22 bp, Homo sapiens
cagaatttagcacaatgtatgg

SEQ ID NO: 8755546 - DNA, 22 bp, Homo sapiens
cagaatttagaaaacaacataa

SEQ ID NO: 8755547 - DNA, 22 bp, Homo sapiens
cagaatttcagtgatgttttct

SEQ ID NO: 8755548 - DNA, 22 bp, Homo sapiens
cagaatttcagtgatgttttct

SEQ ID NO: 8755549 - DNA, 22 bp, Homo sapiens
cagaatttagcacaatgtatgg

SEQ ID NO: 8755550 - DNA, 22 bp, Homo sapiens
cagaatttagcacaatgtatgg

SEQ ID NO: 8755551 - DNA, 22 bp, Homo sapiens
cagacacacaagcaatctaagt

SEQ ID NO: 8755552 - DNA, 22 bp, Homo sapiens
cagacacacaccctggcctagc

SEQ ID NO: 8755553 - DNA, 22 bp, Homo sapiens
cagacacacaccctggcctagc

SEQ ID NO: 8755554 - DNA, 22 bp, Homo sapiens
cagacacaccaggcccattctg

SEQ ID NO: 8755555 - DNA, 22 bp, Homo sapiens
cagacacaccaggcccattctg

SEQ ID NO: 8755556 - DNA, 22 bp, Homo sapiens
cagacacagatatgcatatggc

SEQ ID NO: 8755557 - DNA, 22 bp, Homo sapiens
cagacacagatatgcatatggc

SEQ ID NO: 8755558 - DNA, 22 bp, Homo sapiens
cagacacagatatgcatatggc

SEQ ID NO: 8755559 - DNA, 22 bp, Homo sapiens
cagacacagatatgcatatggc

SEQ ID NO: 8755560 - DNA, 22 bp, Homo sapiens
cagacacagatatgcatatggc

SEQ ID NO: 8755561 - DNA, 18 bp, Homo sapiens
cagacactctgctctgca

SEQ ID NO: 8755562 - DNA, 22 bp, Homo sapiens
cagacacagcaattctgtgttg

SEQ ID NO: 8755563 - DNA, 22 bp, Homo sapiens
cagacacagatatgcatatggc

SEQ ID NO: 8755564 - DNA, 22 bp, Homo sapiens
cagacacacaagcaatctaagt

SEQ ID NO: 8755565 - DNA, 22 bp, Homo sapiens
cagacacagatatgcatatggc

SEQ ID NO: 8755566 - DNA, 22 bp, Homo sapiens
cagacacagcaattctgtgttg

SEQ ID NO: 8755567 - DNA, 22 bp, Homo sapiens
cagacagaaggaaggccaacat

SEQ ID NO: 8755568 - DNA, 22 bp, Homo sapiens
cagacagaaggaaggccaacat

SEQ ID NO: 8755569 - DNA, 18 bp, Homo sapiens
cagacactctgctctgca

SEQ ID NO: 8755570 - DNA, 22 bp, Homo sapiens
gggaggcagtgctggaggctgg

SEQ ID NO: 8755571 - DNA, 22 bp, Homo sapiens
gggaggcagtgctggaggctgg

SEQ ID NO: 8755572 - DNA, 22 bp, Homo sapiens
gggaggcagtgctggaggctgg

SEQ ID NO: 8755573 - DNA, 22 bp, Homo sapiens
gggaggcagtgctggaggctgg

SEQ ID NO: 8755574 - DNA, 22 bp, Homo sapiens
gggaggcagtgctggaggctgg

SEQ ID NO: 8755575 - DNA, 22 bp, Homo sapiens
gggaggcatgtgttatccactt

SEQ ID NO: 8755576 - DNA, 22 bp, Homo sapiens
gggaggcatgtgttatccactt

SEQ ID NO: 8755577 - DNA, 22 bp, Homo sapiens
gggaggcatgtgttatccactt

SEQ ID NO: 8755578 - DNA, 22 bp, Homo sapiens
gggaggcatgtgttatccactt

SEQ ID NO: 8755579 - DNA, 22 bp, Homo sapiens
gggaggcatgtgttatccactt

SEQ ID NO: 8755580 - DNA, 22 bp, Homo sapiens
gggaggagggtgctggctaaac

SEQ ID NO: 8755581 - DNA, 22 bp, Homo sapiens
gggaggcacgaggcgcgcagtg

SEQ ID NO: 8755582 - DNA, 22 bp, Homo sapiens
gggaggcacgaggcgcgcagtg

SEQ ID NO: 8755583 - DNA, 22 bp, Homo sapiens
gggaggcacgaggcgcgcagtg

SEQ ID NO: 8755584 - DNA, 22 bp, Homo sapiens
gggaggcagtgctggaggctgg

SEQ ID NO: 8755585 - DNA, 22 bp, Homo sapiens
gggaggcacgaggcgcgcagtg

SEQ ID NO: 8755586 - DNA, 22 bp, Homo sapiens
gggaggcacgaggcgcgcagtg

SEQ ID NO: 8755587 - DNA, 22 bp, Homo sapiens
gggagctgccaccacccctggg

SEQ ID NO: 8755588 - DNA, 22 bp, Homo sapiens
gggagctgccaccacccctggg

SEQ ID NO: 8755589 - DNA, 22 bp, Homo sapiens
gggagctgcggtcttgcgaaga

SEQ ID NO: 8755590 - DNA, 21 bp, Homo sapiens
gggagctggaaactgggtgac

SEQ ID NO: 8755591 - DNA, 21 bp, Homo sapiens
gggagctggaaactgggtgac

SEQ ID NO: 8755592 - DNA, 22 bp, Homo sapiens
gggaggagggtgctggctaaac

SEQ ID NO: 8755593 - DNA, 22 bp, Homo sapiens
atgacaaaagaagacatgaggt

SEQ ID NO: 8755594 - DNA, 22 bp, Homo sapiens
atgacacataaaacaaggactg

SEQ ID NO: 8755595 - DNA, 22 bp, Homo sapiens
atgacacaattttagagctgaa

SEQ ID NO: 8755596 - DNA, 22 bp, Homo sapiens
atgacacatttgtgctgttgaa

SEQ ID NO: 8755597 - DNA, 22 bp, Homo sapiens
atgacactgtcctagtaaggaa

SEQ ID NO: 8755598 - DNA, 22 bp, Homo sapiens
atgacacttggtgatactttgt

SEQ ID NO: 8755599 - DNA, 22 bp, Homo sapiens
atgacactgtcctagtaaggaa

SEQ ID NO: 8755600 - DNA, 22 bp, Homo sapiens
atgacactgagaataacaggta

SEQ ID NO: 8755601 - DNA, 22 bp, Homo sapiens
atgacactgagaataacaggta

SEQ ID NO: 8755602 - DNA, 22 bp, Homo sapiens
atgacagacagaagggattttt

SEQ ID NO: 8755603 - DNA, 22 bp, Homo sapiens
atgacactctgcagggtgaatg

SEQ ID NO: 8755604 - DNA, 22 bp, Homo sapiens
atgacactcgaaaaattgatgc

SEQ ID NO: 8755605 - DNA, 22 bp, Homo sapiens
ctttgggcactgaagtatgggt

SEQ ID NO: 8755606 - DNA, 22 bp, Homo sapiens
ctttgggatttcatgagagcta

SEQ ID NO: 8755607 - DNA, 22 bp, Homo sapiens
ctttgggtattctcccttgggg

SEQ ID NO: 8755608 - DNA, 22 bp, Homo sapiens
ctttgggatttcatgagagcta

SEQ ID NO: 8755609 - DNA, 22 bp, Homo sapiens
atgaattgtaaattccttgaaa

SEQ ID NO: 8755610 - DNA, 22 bp, Homo sapiens
atgaattgaggaaaacagtcgt

SEQ ID NO: 8755611 - DNA, 22 bp, Homo sapiens
atgaattgtccgatgttgtgca

SEQ ID NO: 8755612 - DNA, 21 bp, Homo sapiens
ctttggtatttcactcacata

SEQ ID NO: 8755613 - DNA, 22 bp, Homo sapiens
ctttggtccagaagtggcctct

SEQ ID NO: 8755614 - DNA, 22 bp, Homo sapiens
ctttggcttgccctggcagtac

SEQ ID NO: 8755615 - DNA, 22 bp, Homo sapiens
ctttggcttgccctggcagtac

SEQ ID NO: 8755616 - DNA, 22 bp, Homo sapiens
ctttgctgccagaacccagcag

SEQ ID NO: 8755617 - DNA, 22 bp, Homo sapiens
ctttgctgatctctggtttaaa

SEQ ID NO: 8755618 - DNA, 22 bp, Homo sapiens
ctttgctgttataatgatagct

SEQ ID NO: 8755619 - DNA, 22 bp, Homo sapiens
ctttgctagtgtttcagtagac

SEQ ID NO: 8755620 - DNA, 20 bp, Homo sapiens
ctttgcctattctctgcctg

SEQ ID NO: 8755621 - DNA, 22 bp, Homo sapiens
ctttgcctcctagagcacgttc

SEQ ID NO: 8755622 - DNA, 20 bp, Homo sapiens
ctttgcctattctctgcctg

SEQ ID NO: 8755623 - DNA, 22 bp, Homo sapiens
ctttcaaaacgctctgtatgca

SEQ ID NO: 8755624 - DNA, 22 bp, Homo sapiens
ctttctttcgaagacgtgatta

SEQ ID NO: 8755625 - DNA, 19 bp, Homo sapiens
ctttgccactgataggagt

SEQ ID NO: 8755626 - DNA, 22 bp, Homo sapiens
ctttgccatgttgcctgcagaa

SEQ ID NO: 8755627 - DNA, 22 bp, Homo sapiens
ctttggctcatggttttatcca

SEQ ID NO: 8755628 - DNA, 22 bp, Homo sapiens
ctttggctaacaaatcagcttg

SEQ ID NO: 8755629 - DNA, 22 bp, Homo sapiens
ctttggctacaagcgctgcaat

SEQ ID NO: 8755630 - DNA, 22 bp, Homo sapiens
ctttggctgacaggtttctggt

SEQ ID NO: 8755631 - DNA, 22 bp, Homo sapiens
ctttggaaaagcataccaagga

SEQ ID NO: 8755632 - DNA, 22 bp, Homo sapiens
ctttggaaagtaagcagctaga

SEQ ID NO: 8755633 - DNA, 22 bp, Homo sapiens
ctttggaaaagcataccaagga

SEQ ID NO: 8755634 - DNA, 22 bp, Homo sapiens
ctttggaaagtggttcaggtga

SEQ ID NO: 8755635 - DNA, 22 bp, Homo sapiens
ctttgcttgacactgtgattgt

SEQ ID NO: 8755636 - DNA, 22 bp, Homo sapiens
ctttgcttctccaacctgctca

SEQ ID NO: 8755637 - DNA, 22 bp, Homo sapiens
ctttgcttctccaacctgctca

SEQ ID NO: 8755638 - DNA, 22 bp, Homo sapiens
ctttgcttctccaacctgctca

SEQ ID NO: 8755639 - DNA, 22 bp, Homo sapiens
ctttggaaaaatacctggcata

SEQ ID NO: 8755640 - DNA, 22 bp, Homo sapiens
ctttggaaaaatacctggcata

SEQ ID NO: 8755641 - DNA, 22 bp, Homo sapiens
ctttggaaaaatacctggcata

SEQ ID NO: 8755642 - DNA, 22 bp, Homo sapiens
ctttggaaaaatacctggcata

SEQ ID NO: 8755643 - DNA, 22 bp, Homo sapiens
atgagacttgagggcctcaagt

SEQ ID NO: 8755644 - DNA, 22 bp, Homo sapiens
atgagacattgcaagtccagaa

SEQ ID NO: 8755645 - DNA, 22 bp, Homo sapiens
atgagacacatgtgacttcttt

SEQ ID NO: 8755646 - DNA, 22 bp, Homo sapiens
atgagacaggactgtatgcagg

SEQ ID NO: 8755647 - DNA, 22 bp, Homo sapiens
atgagaatgcattcatgttttg

SEQ ID NO: 8755648 - DNA, 22 bp, Homo sapiens
atgagaataaaggtgatttcga

SEQ ID NO: 8755649 - DNA, 22 bp, Homo sapiens
atgagaaatttattacaagcta

SEQ ID NO: 8755650 - DNA, 22 bp, Homo sapiens
atgagaaggacataaattatag

SEQ ID NO: 8755651 - DNA, 22 bp, Homo sapiens
atgagaaagagttgtatctaga

SEQ ID NO: 8755652 - DNA, 22 bp, Homo sapiens
atgagaaagagttgtatctaga

SEQ ID NO: 8755653 - DNA, 22 bp, Homo sapiens
atgagaaagagttgtatctaga

SEQ ID NO: 8755654 - DNA, 22 bp, Homo sapiens
atgagaaagagttgtatctaga

SEQ ID NO: 8755655 - DNA, 22 bp, Homo sapiens
atgagaaagttaatcatcatga

SEQ ID NO: 8755656 - DNA, 22 bp, Homo sapiens
atgagaaagttaatcatcatga

SEQ ID NO: 8755657 - DNA, 22 bp, Homo sapiens
atgagaaatttattacaagcta

SEQ ID NO: 8755658 - DNA, 22 bp, Homo sapiens
atgagaaatttattacaagcta

SEQ ID NO: 8755659 - DNA, 22 bp, Homo sapiens
atgagaaagttaatcatcatga

SEQ ID NO: 8755660 - DNA, 22 bp, Homo sapiens
atgagaaagttaatcatcatga

SEQ ID NO: 8755661 - DNA, 22 bp, Homo sapiens
atgagatgtgtctaatggaacc

SEQ ID NO: 8755662 - DNA, 22 bp, Homo sapiens
atgagataggaacaaacttaca

SEQ ID NO: 8755663 - DNA, 22 bp, Homo sapiens
atgagatagactatgtcataca

SEQ ID NO: 8755664 - DNA, 22 bp, Homo sapiens
atgagataattcatgtggaatg

SEQ ID NO: 8755665 - DNA, 18 bp, Homo sapiens
atgagaggtgtcagaaga

SEQ ID NO: 8755666 - DNA, 22 bp, Homo sapiens
atgagaggtttcgtcagaggaa

SEQ ID NO: 8755667 - DNA, 22 bp, Homo sapiens
atgagcaaccttctcctccagc

SEQ ID NO: 8755668 - DNA, 22 bp, Homo sapiens
atgagcaagagctatgtacaga

SEQ ID NO: 8755669 - DNA, 22 bp, Homo sapiens
atgagatgtgtctaatggaacc

SEQ ID NO: 8755670 - DNA, 22 bp, Homo sapiens
atgagattttaaaacttcactt

SEQ ID NO: 8755671 - DNA, 22 bp, Homo sapiens
atgagcagatgctcctgcctct

SEQ ID NO: 8755672 - DNA, 22 bp, Homo sapiens
atgacagacagaagggattttt

SEQ ID NO: 8755673 - DNA, 22 bp, Homo sapiens
atgacagaggagtgcaggtgat

SEQ ID NO: 8755674 - DNA, 22 bp, Homo sapiens
atgacagaggagtgcaggtgat

SEQ ID NO: 8755675 - DNA, 22 bp, Homo sapiens
atgacagaccctctaaagacaa

SEQ ID NO: 8755676 - DNA, 22 bp, Homo sapiens
atgacagaccctctaaagacaa

SEQ ID NO: 8755677 - DNA, 19 bp, Homo sapiens
atgacagagttgataagtg

SEQ ID NO: 8755678 - DNA, 22 bp, Homo sapiens
atgacagaggattgtaaagagg

SEQ ID NO: 8755679 - DNA, 22 bp, Homo sapiens
cttttgttgcccttgtcgcagg

SEQ ID NO: 8755680 - DNA, 22 bp, Homo sapiens
atgacagaggattgtaaagagg

SEQ ID NO: 8755681 - DNA, 19 bp, Homo sapiens
atgacagagttgataagtg

SEQ ID NO: 8755682 - DNA, 19 bp, Homo sapiens
atgacagagttgataagtg

SEQ ID NO: 8755683 - DNA, 22 bp, Homo sapiens
cttttgttgcccttgtcgcagg

SEQ ID NO: 8755684 - DNA, 18 bp, Homo sapiens
cttttgttttccctcctc

SEQ ID NO: 8755685 - DNA, 22 bp, Homo sapiens
ctttttacaaagcctgtcttct

SEQ ID NO: 8755686 - DNA, 21 bp, Homo sapiens
ctttttactcgttcatatgca

SEQ ID NO: 8755687 - DNA, 22 bp, Homo sapiens
ctttttactctgttgtctcagc

SEQ ID NO: 8755688 - DNA, 22 bp, Homo sapiens
ctttttacaaagcctgtcttct

SEQ ID NO: 8755689 - DNA, 22 bp, Homo sapiens
ctttttactctgttgtctcagc

SEQ ID NO: 8755690 - DNA, 22 bp, Homo sapiens
ctttttataccgtgccagttga

SEQ ID NO: 8755691 - DNA, 22 bp, Homo sapiens
ctttttataccgtgccagttga

SEQ ID NO: 8755692 - DNA, 22 bp, Homo sapiens
ctttttataccgtgccagttga

SEQ ID NO: 8755693 - DNA, 22 bp, Homo sapiens
atgacatgattgccatttgata

SEQ ID NO: 8755694 - DNA, 22 bp, Homo sapiens
ctttttcattggctttaggaca

SEQ ID NO: 8755695 - DNA, 22 bp, Homo sapiens
ctttttcactgtgtcctcacac

SEQ ID NO: 8755696 - DNA, 22 bp, Homo sapiens
ctttttcactgtgtcctcacac

SEQ ID NO: 8755697 - DNA, 19 bp, Homo sapiens
ctttttcaccttctagaag

SEQ ID NO: 8755698 - DNA, 19 bp, Homo sapiens
ctttttcaccttctagaag

SEQ ID NO: 8755699 - DNA, 19 bp, Homo sapiens
ctttttcaccttctagaag

SEQ ID NO: 8755700 - DNA, 22 bp, Homo sapiens
ctttttatctcttaatgatgtt

SEQ ID NO: 8755701 - DNA, 22 bp, Homo sapiens
ctttttcaagtcaaagagggta

SEQ ID NO: 8755702 - DNA, 22 bp, Homo sapiens
ctttttatctcttaatgatgtt

SEQ ID NO: 8755703 - DNA, 22 bp, Homo sapiens
ctttttatctcttaatgatgtt

SEQ ID NO: 8755704 - DNA, 22 bp, Homo sapiens
ctttttatagctatgtcctatg

SEQ ID NO: 8755705 - DNA, 22 bp, Homo sapiens
ctttttatagctatgtcctatg

SEQ ID NO: 8755706 - DNA, 22 bp, Homo sapiens
ctttttatagctatgtcctatg

SEQ ID NO: 8755707 - DNA, 22 bp, Homo sapiens
ctttttatagctatgtcctatg

SEQ ID NO: 8755708 - DNA, 22 bp, Homo sapiens
ctttacattaatttctactgat

SEQ ID NO: 8755709 - DNA, 22 bp, Homo sapiens
ctttaccacaaggacagaactt

SEQ ID NO: 8755710 - DNA, 17 bp, Homo sapiens
cttgttttccactggga

SEQ ID NO: 8755711 - DNA, 22 bp, Homo sapiens
ctttaccagattccattgcaag

SEQ ID NO: 8755712 - DNA, 22 bp, Homo sapiens
ctttactatcaggaataaacaa

SEQ ID NO: 8755713 - DNA, 22 bp, Homo sapiens
ctttacattaatttctactgat

SEQ ID NO: 8755714 - DNA, 22 bp, Homo sapiens
ctttactgccatgcatttataa

SEQ ID NO: 8755715 - DNA, 22 bp, Homo sapiens
ctttactgttcttctgtgggaa

SEQ ID NO: 8755716 - DNA, 22 bp, Homo sapiens
ctttatgtgtactttccatttt

SEQ ID NO: 8755717 - DNA, 22 bp, Homo sapiens
ctttagaaatctggatgtattt

SEQ ID NO: 8755718 - DNA, 22 bp, Homo sapiens
ctttatgttcagtacaatgctt

SEQ ID NO: 8755719 - DNA, 22 bp, Homo sapiens
ctttagaaatctggatgtattt

SEQ ID NO: 8755720 - DNA, 22 bp, Homo sapiens
ctttattctgcaaattgccttg

SEQ ID NO: 8755721 - DNA, 22 bp, Homo sapiens
ctttattctgcaaattgccttg

SEQ ID NO: 8755722 - DNA, 22 bp, Homo sapiens
ctttattctgcaaattgccttg

SEQ ID NO: 8755723 - DNA, 22 bp, Homo sapiens
ctttattcctacaagattttct

SEQ ID NO: 8755724 - DNA, 22 bp, Homo sapiens
ctttattctgcaaattgccttg

SEQ ID NO: 8755725 - DNA, 22 bp, Homo sapiens
ctttattcctacaagattttct

SEQ ID NO: 8755726 - DNA, 22 bp, Homo sapiens
ctttattcctacaagattttct

SEQ ID NO: 8755727 - DNA, 22 bp, Homo sapiens
ctttattcctacaagattttct

SEQ ID NO: 8755728 - DNA, 22 bp, Homo sapiens
ctttattagatgtagactttct

SEQ ID NO: 8755729 - DNA, 22 bp, Homo sapiens
ctttattagatgtagactttct

SEQ ID NO: 8755730 - DNA, 22 bp, Homo sapiens
ctttacagcttagtggtatgga

SEQ ID NO: 8755731 - DNA, 22 bp, Homo sapiens
ctttacagcctccagaaggaac

SEQ ID NO: 8755732 - DNA, 22 bp, Homo sapiens
ctttacagcctccagaaggaac

SEQ ID NO: 8755733 - DNA, 22 bp, Homo sapiens
ctttacagccccacttccgggc

SEQ ID NO: 8755734 - DNA, 22 bp, Homo sapiens
ctttacagatggataattgttt

SEQ ID NO: 8755735 - DNA, 22 bp, Homo sapiens
ctttacagatggataattgttt

SEQ ID NO: 8755736 - DNA, 22 bp, Homo sapiens
ctttacagataggaactactca

SEQ ID NO: 8755737 - DNA, 22 bp, Homo sapiens
ctttacagataggaactactca

SEQ ID NO: 8755738 - DNA, 22 bp, Homo sapiens
ctttacagtgctgctaatggct

SEQ ID NO: 8755739 - DNA, 22 bp, Homo sapiens
ctttacagtgctgctaatggct

SEQ ID NO: 8755740 - DNA, 22 bp, Homo sapiens
ctttacatcctgtttcccgttt

SEQ ID NO: 8755741 - DNA, 22 bp, Homo sapiens
ctttacagtgaacttgcttgtc

SEQ ID NO: 8755742 - DNA, 22 bp, Homo sapiens
ctttacagtgctgctaatggct

SEQ ID NO: 8755743 - DNA, 22 bp, Homo sapiens
ctttacaggaaaaggtggctgt

SEQ ID NO: 8755744 - DNA, 22 bp, Homo sapiens
ctttacagaataagaatactgg

SEQ ID NO: 8755745 - DNA, 22 bp, Homo sapiens
ctttacagaaagagaactctgg

SEQ ID NO: 8755746 - DNA, 22 bp, Homo sapiens
ctttacagaataagaatactgg

SEQ ID NO: 8755747 - DNA, 22 bp, Homo sapiens
ctttacagataggaactactca

SEQ ID NO: 8755748 - DNA, 22 bp, Homo sapiens
ctttacacttggacccacactt

SEQ ID NO: 8755749 - DNA, 22 bp, Homo sapiens
ctttacagaaagagaactctgg

SEQ ID NO: 8755750 - DNA, 22 bp, Homo sapiens
ctttacagaaagagaactctgg

SEQ ID NO: 8755751 - DNA, 22 bp, Homo sapiens
ctttacaccaagcagatctttc

SEQ ID NO: 8755752 - DNA, 22 bp, Homo sapiens
ctttacacatgagacctgcaat

SEQ ID NO: 8755753 - DNA, 22 bp, Homo sapiens
ctttacacaatgattttcttta

SEQ ID NO: 8755754 - DNA, 22 bp, Homo sapiens
ctttacacatcctaaccagtgt

SEQ ID NO: 8755755 - DNA, 22 bp, Homo sapiens
ctttacacaatgattttcttta

SEQ ID NO: 8755756 - DNA, 22 bp, Homo sapiens
cttgttttaaactgttgtggct

SEQ ID NO: 8755757 - DNA, 22 bp, Homo sapiens
atctttgggatcctgatttact

SEQ ID NO: 8755758 - DNA, 20 bp, Homo sapiens
atctttggctcagaagcctt

SEQ ID NO: 8755759 - DNA, 22 bp, Homo sapiens
atctttgggatatttgtgatta

SEQ ID NO: 8755760 - DNA, 22 bp, Homo sapiens
atctttggccacttgtgctgca

SEQ ID NO: 8755761 - DNA, 22 bp, Homo sapiens
atctttggatcgctcccccttc

SEQ ID NO: 8755762 - DNA, 22 bp, Homo sapiens
atctttggacggtcccaactga

SEQ ID NO: 8755763 - DNA, 22 bp, Homo sapiens
atctttgctattgtaaatcacg

SEQ ID NO: 8755764 - DNA, 22 bp, Homo sapiens
atctttgcccagagactcagcc

SEQ ID NO: 8755765 - DNA, 22 bp, Homo sapiens
atctttgattgaagggaccctg

SEQ ID NO: 8755766 - DNA, 22 bp, Homo sapiens
atctttggaaagccaagcacag

SEQ ID NO: 8755767 - DNA, 22 bp, Homo sapiens
atctttgaatcaatgaatcagt

SEQ ID NO: 8755768 - DNA, 22 bp, Homo sapiens
atctttgaatcaatgaatcagt

SEQ ID NO: 8755769 - DNA, 22 bp, Homo sapiens
atctttgaatcaatgaatcagt

SEQ ID NO: 8755770 - DNA, 22 bp, Homo sapiens
atctttgaagaggacttgaagt

SEQ ID NO: 8755771 - DNA, 21 bp, Homo sapiens
atctttgaagcatgcagtgag

SEQ ID NO: 8755772 - DNA, 22 bp, Homo sapiens
atctttgatgactaatgctttg

SEQ ID NO: 8755773 - DNA, 22 bp, Homo sapiens
atctttgatctttattgctaag

SEQ ID NO: 8755774 - DNA, 22 bp, Homo sapiens
atctttgatgactaatgctttg

SEQ ID NO: 8755775 - DNA, 22 bp, Homo sapiens
atctttgactgccattcttgac

SEQ ID NO: 8755776 - DNA, 22 bp, Homo sapiens
atctttgatctttattgctaag

SEQ ID NO: 8755777 - DNA, 22 bp, Homo sapiens
atctggaatccttgtggacaat

SEQ ID NO: 8755778 - DNA, 22 bp, Homo sapiens
atctggaatccttgtggacaat

SEQ ID NO: 8755779 - DNA, 22 bp, Homo sapiens
cttctccctgggggctctttat

SEQ ID NO: 8755780 - DNA, 22 bp, Homo sapiens
cttctcctaaggtcagaattgc

SEQ ID NO: 8755781 - DNA, 22 bp, Homo sapiens
cttctcctaaggtcagaattgc

SEQ ID NO: 8755782 - DNA, 22 bp, Homo sapiens
cttctcctctgagtcctgggag

SEQ ID NO: 8755783 - DNA, 22 bp, Homo sapiens
cttctcctctgagtcctgggag

SEQ ID NO: 8755784 - DNA, 22 bp, Homo sapiens
cttctcctgtaagaagatcaaa

SEQ ID NO: 8755785 - DNA, 22 bp, Homo sapiens
cttctcctctgagtcctgggag

SEQ ID NO: 8755786 - DNA, 22 bp, Homo sapiens
cttctccctggcttctgcacac

SEQ ID NO: 8755787 - DNA, 22 bp, Homo sapiens
cttctccctggcttctgcacac

SEQ ID NO: 8755788 - DNA, 22 bp, Homo sapiens
cttctccctggcttctgcacac

SEQ ID NO: 8755789 - DNA, 19 bp, Homo sapiens
cttctccagcttctagaag

SEQ ID NO: 8755790 - DNA, 19 bp, Homo sapiens
cttctccagcttctagaag

SEQ ID NO: 8755791 - DNA, 22 bp, Homo sapiens
cttctcccaagtatgcagtttg

SEQ ID NO: 8755792 - DNA, 20 bp, Homo sapiens
atcttgggacagggcacatg

SEQ ID NO: 8755793 - DNA, 22 bp, Homo sapiens
atcttgggaattttccaggagt

SEQ ID NO: 8755794 - DNA, 22 bp, Homo sapiens
atcttgggaattttccaggagt

SEQ ID NO: 8755795 - DNA, 22 bp, Homo sapiens
cttctcctgtaagaagatcaaa

SEQ ID NO: 8755796 - DNA, 19 bp, Homo sapiens
atcttgggaaatggtaact

SEQ ID NO: 8755797 - DNA, 21 bp, Homo sapiens
atctttattacgcagagaaga

SEQ ID NO: 8755798 - DNA, 21 bp, Homo sapiens
atctttattacgcagagaaga

SEQ ID NO: 8755799 - DNA, 22 bp, Homo sapiens
atctttcaatcaggaaaaatct

SEQ ID NO: 8755800 - DNA, 22 bp, Homo sapiens
atctttcaatcaggaaaaatct

SEQ ID NO: 8755801 - DNA, 22 bp, Homo sapiens
atctttcaatcaggaaaaatct

SEQ ID NO: 8755802 - DNA, 22 bp, Homo sapiens
atctttcaggcctagtgtttaa

SEQ ID NO: 8755803 - DNA, 22 bp, Homo sapiens
atctttcactttttgtggatga

SEQ ID NO: 8755804 - DNA, 22 bp, Homo sapiens
atctttcagggccatttgtatt

SEQ ID NO: 8755805 - DNA, 22 bp, Homo sapiens
atctttcagggccatttgtatt

SEQ ID NO: 8755806 - DNA, 22 bp, Homo sapiens
atctttcagtttcataccaatt

SEQ ID NO: 8755807 - DNA, 22 bp, Homo sapiens
atctttcatctctattatttga

SEQ ID NO: 8755808 - DNA, 18 bp, Homo sapiens
atctttccatagcatgtt

SEQ ID NO: 8755809 - DNA, 22 bp, Homo sapiens
atctttcatctctattatttga

SEQ ID NO: 8755810 - DNA, 22 bp, Homo sapiens
atctttctatggtactttctcc

SEQ ID NO: 8755811 - DNA, 22 bp, Homo sapiens
atctttctatggtactttctcc

SEQ ID NO: 8755812 - DNA, 18 bp, Homo sapiens
atctttccatagcatgtt

SEQ ID NO: 8755813 - DNA, 22 bp, Homo sapiens
atctttctatggtactttctcc

SEQ ID NO: 8755814 - DNA, 22 bp, Homo sapiens
atctttctatttctaaaaacta

SEQ ID NO: 8755815 - DNA, 22 bp, Homo sapiens
atctttctctgcactatacaat

SEQ ID NO: 8755816 - DNA, 22 bp, Homo sapiens
atctttctctgcactatacaat

SEQ ID NO: 8755817 - DNA, 22 bp, Homo sapiens
atctttctctgcactatacaat

SEQ ID NO: 8755818 - DNA, 22 bp, Homo sapiens
atctttcttatttgaagaaaga

SEQ ID NO: 8755819 - DNA, 22 bp, Homo sapiens
atctttctctgcactatacaat

SEQ ID NO: 8755820 - DNA, 22 bp, Homo sapiens
atctttctccatatacatcttt

SEQ ID NO: 8755821 - DNA, 22 bp, Homo sapiens
atgccactgcacttcagcctgg

SEQ ID NO: 8755822 - DNA, 22 bp, Homo sapiens
atgccactgcacttcagcttgg

SEQ ID NO: 8755823 - DNA, 22 bp, Homo sapiens
atgccactgcacttcagcctgg

SEQ ID NO: 8755824 - DNA, 22 bp, Homo sapiens
atgccactgcacttcagcctgg

SEQ ID NO: 8755825 - DNA, 19 bp, Homo sapiens
gaatttatctcttcagtcc

SEQ ID NO: 8755826 - DNA, 22 bp, Homo sapiens
gaatttcaaaagccagaacggg

SEQ ID NO: 8755827 - DNA, 22 bp, Homo sapiens
gaatttcaagcagtgcaatgtt

SEQ ID NO: 8755828 - DNA, 22 bp, Homo sapiens
gaatttcaacagtcctcaaatg

SEQ ID NO: 8755829 - DNA, 22 bp, Homo sapiens
gaatttcaaagaggttaagagg

SEQ ID NO: 8755830 - DNA, 22 bp, Homo sapiens
gaatttcaaagaggttaagagg

SEQ ID NO: 8755831 - DNA, 22 bp, Homo sapiens
gaatttcacaaggtgaggataa

SEQ ID NO: 8755832 - DNA, 22 bp, Homo sapiens
gaatttcaagcagtgcaatgtt

SEQ ID NO: 8755833 - DNA, 22 bp, Homo sapiens
gaatttcaagcagtgcaatgtt

SEQ ID NO: 8755834 - DNA, 22 bp, Homo sapiens
gaatttcagaggtaacatcatc

SEQ ID NO: 8755835 - DNA, 22 bp, Homo sapiens
gaatttcagatcagagaccatt

SEQ ID NO: 8755836 - DNA, 22 bp, Homo sapiens
gaatttcagatcagagaccatt

SEQ ID NO: 8755837 - DNA, 22 bp, Homo sapiens
gaatttcagaggtaacatcatc

SEQ ID NO: 8755838 - DNA, 22 bp, Homo sapiens
gaatttcagaggtaacatcatc

SEQ ID NO: 8755839 - DNA, 22 bp, Homo sapiens
atgccactgcactccagcctgg

SEQ ID NO: 8755840 - DNA, 22 bp, Homo sapiens
atgccactgcactccagcctgg

SEQ ID NO: 8755841 - DNA, 22 bp, Homo sapiens
atgccactgcactccagcctgg

SEQ ID NO: 8755842 - DNA, 22 bp, Homo sapiens
atgccactgcactccagcctgg

SEQ ID NO: 8755843 - DNA, 22 bp, Homo sapiens
atgccactgcactccagcctag

SEQ ID NO: 8755844 - DNA, 22 bp, Homo sapiens
atgccactgcactccagcctag

SEQ ID NO: 8755845 - DNA, 22 bp, Homo sapiens
atgccactgcactccagcctag

SEQ ID NO: 8755846 - DNA, 22 bp, Homo sapiens
atgccactgcactccagcctag

SEQ ID NO: 8755847 - DNA, 22 bp, Homo sapiens
gaagtccagaatactgctctga

SEQ ID NO: 8755848 - DNA, 22 bp, Homo sapiens
gaagtccagaatactgctctga

SEQ ID NO: 8755849 - DNA, 22 bp, Homo sapiens
gaagtagaaagcctcgtaaata

SEQ ID NO: 8755850 - DNA, 22 bp, Homo sapiens
gaagtctgagtgggggccaggc

SEQ ID NO: 8755851 - DNA, 22 bp, Homo sapiens
atgcatttgacgggatatattt

SEQ ID NO: 8755852 - DNA, 22 bp, Homo sapiens
gaagtctgagtgggggccaggc

SEQ ID NO: 8755853 - DNA, 22 bp, Homo sapiens
gaagtctgagtgggggccaggc

SEQ ID NO: 8755854 - DNA, 22 bp, Homo sapiens
gaagtctctctgggctcagttc

SEQ ID NO: 8755855 - DNA, 22 bp, Homo sapiens
gaagtctctctggagagtagaa

SEQ ID NO: 8755856 - DNA, 22 bp, Homo sapiens
gaagtctcatttggtgtcagtt

SEQ ID NO: 8755857 - DNA, 22 bp, Homo sapiens
gaagtctcacagacagatcaga

SEQ ID NO: 8755858 - DNA, 22 bp, Homo sapiens
gaagtctcatagttaaaattct

SEQ ID NO: 8755859 - DNA, 18 bp, Homo sapiens
atgcagttggtactctca

SEQ ID NO: 8755860 - DNA, 22 bp, Homo sapiens
atgcagttttaaatcatttcag

SEQ ID NO: 8755861 - DNA, 22 bp, Homo sapiens
gaagtagaaaactcagtttcaa

SEQ ID NO: 8755862 - DNA, 22 bp, Homo sapiens
gaagtagattcgttgcatcttg

SEQ ID NO: 8755863 - DNA, 22 bp, Homo sapiens
gaagtagattcgttgcatcttg

SEQ ID NO: 8755864 - DNA, 22 bp, Homo sapiens
gaagtattatagcatattagcc

SEQ ID NO: 8755865 - DNA, 22 bp, Homo sapiens
gaagtatttctgagttgcccag

SEQ ID NO: 8755866 - DNA, 22 bp, Homo sapiens
gaagtattactctgaatgtatt

SEQ ID NO: 8755867 - DNA, 22 bp, Homo sapiens
gaagtattactctgaatgtatt

SEQ ID NO: 8755868 - DNA, 22 bp, Homo sapiens
gacaggaaacaagaaggcagga

SEQ ID NO: 8755869 - DNA, 22 bp, Homo sapiens
gacaggaaaggggtctgttttc

SEQ ID NO: 8755870 - DNA, 20 bp, Homo sapiens
gacagcttggggtgtcacct

SEQ ID NO: 8755871 - DNA, 20 bp, Homo sapiens
gacagcttggggtgtcacct

SEQ ID NO: 8755872 - DNA, 22 bp, Homo sapiens
gacagcttctatgtgacgagca

SEQ ID NO: 8755873 - DNA, 22 bp, Homo sapiens
gacagcttctagaggaattggt

SEQ ID NO: 8755874 - DNA, 22 bp, Homo sapiens
gacagcttcttgggccgggcct

SEQ ID NO: 8755875 - DNA, 22 bp, Homo sapiens
gacagcttgcctggtactgcaa

SEQ ID NO: 8755876 - DNA, 22 bp, Homo sapiens
gacagcttctatgtgacgagca

SEQ ID NO: 8755877 - DNA, 22 bp, Homo sapiens
gacagcttctatgtgacgagca

SEQ ID NO: 8755878 - DNA, 22 bp, Homo sapiens
gacagcttctagaaatggtcac

SEQ ID NO: 8755879 - DNA, 22 bp, Homo sapiens
atgctctgggcttttgaagtgg

SEQ ID NO: 8755880 - DNA, 22 bp, Homo sapiens
atgctatgtaactggcagatag

SEQ ID NO: 8755881 - DNA, 22 bp, Homo sapiens
atgctatgtaactggcagatag

SEQ ID NO: 8755882 - DNA, 22 bp, Homo sapiens
gacagcttcgaggaggtgagct

SEQ ID NO: 8755883 - DNA, 22 bp, Homo sapiens
gacagcttcgaggaggtgagct

SEQ ID NO: 8755884 - DNA, 22 bp, Homo sapiens
gacagcttagtgaaaatgtaaa

SEQ ID NO: 8755885 - DNA, 22 bp, Homo sapiens
gacagcttagtgaaaatgtaaa

SEQ ID NO: 8755886 - DNA, 22 bp, Homo sapiens
gacagcttaggaagtttctatt

SEQ ID NO: 8755887 - DNA, 22 bp, Homo sapiens
atgctatgtaactggcagatag

SEQ ID NO: 8755888 - DNA, 22 bp, Homo sapiens
atgctagaagggagcactatgt

SEQ ID NO: 8755889 - DNA, 22 bp, Homo sapiens
atgctacattttggtttataaa

SEQ ID NO: 8755890 - DNA, 22 bp, Homo sapiens
atgctacagccctctttgcata

SEQ ID NO: 8755891 - DNA, 22 bp, Homo sapiens
atgctacaggaagacgtcaggc

SEQ ID NO: 8755892 - DNA, 22 bp, Homo sapiens
atgctacaggaagacgtcaggc

SEQ ID NO: 8755893 - DNA, 22 bp, Homo sapiens
atgctacagccctctttgcata

SEQ ID NO: 8755894 - DNA, 22 bp, Homo sapiens
atgctacaggagccccacttag

SEQ ID NO: 8755895 - DNA, 22 bp, Homo sapiens
atgctacaggattctccttatc

SEQ ID NO: 8755896 - DNA, 18 bp, Homo sapiens
atgctacaggcaggtgtc

SEQ ID NO: 8755897 - DNA, 18 bp, Homo sapiens
atgctacaggcaggtgtc

SEQ ID NO: 8755898 - DNA, 22 bp, Homo sapiens
gaatttgctttcgtgacagggt

SEQ ID NO: 8755899 - DNA, 22 bp, Homo sapiens
gaatttgcaggtgtgctgtgta

SEQ ID NO: 8755900 - DNA, 22 bp, Homo sapiens
gaatttggggtgtgttatttca

SEQ ID NO: 8755901 - DNA, 22 bp, Homo sapiens
gaatttggggtgtgttatttca

SEQ ID NO: 8755902 - DNA, 22 bp, Homo sapiens
gaatttggatctttgatagagt

SEQ ID NO: 8755903 - DNA, 22 bp, Homo sapiens
gaatttggatctttgatagagt

SEQ ID NO: 8755904 - DNA, 22 bp, Homo sapiens
gaatttcatttgtttcctacca

SEQ ID NO: 8755905 - DNA, 22 bp, Homo sapiens
gaatttcattgctctgctgtgt

SEQ ID NO: 8755906 - DNA, 22 bp, Homo sapiens
gaatttcagggtctggtaggaa

SEQ ID NO: 8755907 - DNA, 22 bp, Homo sapiens
gaatttcaggacaactggaagg

SEQ ID NO: 8755908 - DNA, 22 bp, Homo sapiens
gaatttcagatcagagaccatt

SEQ ID NO: 8755909 - DNA, 22 bp, Homo sapiens
gaatttcaggacaactggaagg

SEQ ID NO: 8755910 - DNA, 22 bp, Homo sapiens
gaattttaagtgttcgcctctt

SEQ ID NO: 8755911 - DNA, 22 bp, Homo sapiens
gaatttgtgctcaggaagatta

SEQ ID NO: 8755912 - DNA, 22 bp, Homo sapiens
gaattttaataaaggtttatca

SEQ ID NO: 8755913 - DNA, 22 bp, Homo sapiens
gaattttaataaaggtttatca

SEQ ID NO: 8755914 - DNA, 19 bp, Homo sapiens
gaattttaggacttcagca

SEQ ID NO: 8755915 - DNA, 19 bp, Homo sapiens
gaattttaggacttcagca

SEQ ID NO: 8755916 - DNA, 19 bp, Homo sapiens
gaattttaggacttcagca

SEQ ID NO: 8755917 - DNA, 22 bp, Homo sapiens
gaattttagaatatgtgggctt

SEQ ID NO: 8755918 - DNA, 22 bp, Homo sapiens
atgctaaggcccaggagaaaat

SEQ ID NO: 8755919 - DNA, 22 bp, Homo sapiens
atgctaaatgttaatgttacct

SEQ ID NO: 8755920 - DNA, 22 bp, Homo sapiens
atgctacaacattatctggggt

SEQ ID NO: 8755921 - DNA, 22 bp, Homo sapiens
atgctacactatttgctgagca

SEQ ID NO: 8755922 - DNA, 22 bp, Homo sapiens
atgctacagcatctctcatcag

SEQ ID NO: 8755923 - DNA, 22 bp, Homo sapiens
atgctacagagtttgaatatgt

SEQ ID NO: 8755924 - DNA, 22 bp, Homo sapiens
atgctacagagataggttgggt

SEQ ID NO: 8755925 - DNA, 22 bp, Homo sapiens
atgcctggactgtatcccagat

SEQ ID NO: 8755926 - DNA, 22 bp, Homo sapiens
atgctaaactatgatcattttc

SEQ ID NO: 8755927 - DNA, 22 bp, Homo sapiens
atgctaaactatgatcattttc

SEQ ID NO: 8755928 - DNA, 22 bp, Homo sapiens
atgctaaatgttaatgttacct

SEQ ID NO: 8755929 - DNA, 22 bp, Homo sapiens
atgcaggagttcgaggctgtat

SEQ ID NO: 8755930 - DNA, 22 bp, Homo sapiens
atgcaggagccctcttgagggc

SEQ ID NO: 8755931 - DNA, 22 bp, Homo sapiens
atgcaggagccctcttgagggc

SEQ ID NO: 8755932 - DNA, 22 bp, Homo sapiens
gaaggaggtgtcagttggactg

SEQ ID NO: 8755933 - DNA, 22 bp, Homo sapiens
gaaggaggtgtcagttggactg

SEQ ID NO: 8755934 - DNA, 22 bp, Homo sapiens
gaaggaggtgtcagttggactg

SEQ ID NO: 8755935 - DNA, 22 bp, Homo sapiens
gaaggagggtgcggatctgagc

SEQ ID NO: 8755936 - DNA, 22 bp, Homo sapiens
gaaggagggtgcggatctgagc

SEQ ID NO: 8755937 - DNA, 22 bp, Homo sapiens
gaaggagggagcggcgcggatt

SEQ ID NO: 8755938 - DNA, 22 bp, Homo sapiens
gaaggaggcgttagccctagga

SEQ ID NO: 8755939 - DNA, 22 bp, Homo sapiens
atgcagtggcttcagtgtcagt

SEQ ID NO: 8755940 - DNA, 22 bp, Homo sapiens
atgcagtggcttcagtgtcagt

SEQ ID NO: 8755941 - DNA, 22 bp, Homo sapiens
atgcagttagcagtagctcccc

SEQ ID NO: 8755942 - DNA, 22 bp, Homo sapiens
atgcagttagtatacttccagt

SEQ ID NO: 8755943 - DNA, 22 bp, Homo sapiens
atgcagtataaatcatttctgg

SEQ ID NO: 8755944 - DNA, 22 bp, Homo sapiens
gaagcctggttcgctggccacc

SEQ ID NO: 8755945 - DNA, 22 bp, Homo sapiens
gaagcctgggagggctgggcta

SEQ ID NO: 8755946 - DNA, 22 bp, Homo sapiens
gaagcctgacactggccatcag

SEQ ID NO: 8755947 - DNA, 22 bp, Homo sapiens
gaagcctgctgtgcagccaaat

SEQ ID NO: 8755948 - DNA, 22 bp, Homo sapiens
gaagccttgaactgcaaacccc

SEQ ID NO: 8755949 - DNA, 22 bp, Homo sapiens
gaagccttgaactgcaaacccc

SEQ ID NO: 8755950 - DNA, 22 bp, Homo sapiens
gaagctaaaccacagctaagaa

SEQ ID NO: 8755951 - DNA, 22 bp, Homo sapiens
gaagctaatgagataaatgcca

SEQ ID NO: 8755952 - DNA, 22 bp, Homo sapiens
gaagctaatgatttattttctg

SEQ ID NO: 8755953 - DNA, 22 bp, Homo sapiens
gaagctaaaccacagctaagaa

SEQ ID NO: 8755954 - DNA, 22 bp, Homo sapiens
gaagctaaaagagatgtggttt

SEQ ID NO: 8755955 - DNA, 22 bp, Homo sapiens
gaagcggcatcaggaggctgcc

SEQ ID NO: 8755956 - DNA, 22 bp, Homo sapiens
gaagcctttgcctaaaacatta

SEQ ID NO: 8755957 - DNA, 22 bp, Homo sapiens
gaagctccgtactatgactttt

SEQ ID NO: 8755958 - DNA, 22 bp, Homo sapiens
gaagctccgtactatgactttt

SEQ ID NO: 8755959 - DNA, 22 bp, Homo sapiens
gaagctgacccaggagcgtgtg

SEQ ID NO: 8755960 - DNA, 22 bp, Homo sapiens
gaagctgacccaggagcgtgtg

SEQ ID NO: 8755961 - DNA, 22 bp, Homo sapiens
gaagctgatgaggaccagattg

SEQ ID NO: 8755962 - DNA, 22 bp, Homo sapiens
gaagctgatgaggaccagattg

SEQ ID NO: 8755963 - DNA, 22 bp, Homo sapiens
gaagctgatgaggaccagattg

SEQ ID NO: 8755964 - DNA, 22 bp, Homo sapiens
gaagctgaggtcaggtgggtgg

SEQ ID NO: 8755965 - DNA, 22 bp, Homo sapiens
gaagctgaggtcaggtgggtgg

SEQ ID NO: 8755966 - DNA, 22 bp, Homo sapiens
gaagctgagtggactctggcca

SEQ ID NO: 8755967 - DNA, 22 bp, Homo sapiens
gaagctgatgaggaccagattg

SEQ ID NO: 8755968 - DNA, 22 bp, Homo sapiens
gaagctgagctgaggcatgttg

SEQ ID NO: 8755969 - DNA, 22 bp, Homo sapiens
gaagctgagctgaggcatgttg

SEQ ID NO: 8755970 - DNA, 22 bp, Homo sapiens
gaagctgaggtcaggtgggtgg

SEQ ID NO: 8755971 - DNA, 22 bp, Homo sapiens
gaaggaggcgttagccctagga

SEQ ID NO: 8755972 - DNA, 22 bp, Homo sapiens
gaagctggagaatgggtctagg

SEQ ID NO: 8755973 - DNA, 22 bp, Homo sapiens
gaagctgtgaacaagctacgtg

SEQ ID NO: 8755974 - DNA, 22 bp, Homo sapiens
atgagcatccagaacagtgcct

SEQ ID NO: 8755975 - DNA, 22 bp, Homo sapiens
atgagcatctgacatttaaaac

SEQ ID NO: 8755976 - DNA, 22 bp, Homo sapiens
atgagctcttttcgtggcttct

SEQ ID NO: 8755977 - DNA, 22 bp, Homo sapiens
atgagctcttttcgtggcttct

SEQ ID NO: 8755978 - DNA, 22 bp, Homo sapiens
atgagctcatccgagtcacact

SEQ ID NO: 8755979 - DNA, 23 bp, Homo sapiens
atgagcatttttaatttctgtgg

SEQ ID NO: 8755980 - DNA, 22 bp, Homo sapiens
atgagcatgtgactcaaaccaa

SEQ ID NO: 8755981 - DNA, 22 bp, Homo sapiens
atgagctagaaaaccatgtgga

SEQ ID NO: 8755982 - DNA, 22 bp, Homo sapiens
atgagctgggccatccagtgat

SEQ ID NO: 8755983 - DNA, 22 bp, Homo sapiens
atgagctgggccatccagtgat

SEQ ID NO: 8755984 - DNA, 22 bp, Homo sapiens
atgagctgtaaggtggcttcct

SEQ ID NO: 8755985 - DNA, 22 bp, Homo sapiens
gaagagagcagcaaactggagt

SEQ ID NO: 8755986 - DNA, 22 bp, Homo sapiens
gaagagagccgcgggacatcag

SEQ ID NO: 8755987 - DNA, 22 bp, Homo sapiens
gaagagagccgcgggacatcag

SEQ ID NO: 8755988 - DNA, 22 bp, Homo sapiens
gaagagagcagcaaactggagt

SEQ ID NO: 8755989 - DNA, 22 bp, Homo sapiens
gaagagagcagcaaactggagt

SEQ ID NO: 8755990 - DNA, 22 bp, Homo sapiens
gaagagagagtggggttctgcg

SEQ ID NO: 8755991 - DNA, 22 bp, Homo sapiens
gaagaaagggaattaacttgag

SEQ ID NO: 8755992 - DNA, 22 bp, Homo sapiens
gaagaaagggaattaacttgag

SEQ ID NO: 8755993 - DNA, 22 bp, Homo sapiens
gaagagagagccctggggtccg

SEQ ID NO: 8755994 - DNA, 22 bp, Homo sapiens
gaagagagagccctggggtccg

SEQ ID NO: 8755995 - DNA, 22 bp, Homo sapiens
gaagagatgacaaaggagcatg

SEQ ID NO: 8755996 - DNA, 21 bp, Homo sapiens
gaagagagtcctcatcctgag

SEQ ID NO: 8755997 - DNA, 21 bp, Homo sapiens
gaagagagtcctcatcctgag

SEQ ID NO: 8755998 - DNA, 21 bp, Homo sapiens
gaagagagtcctcatcctgag

SEQ ID NO: 8755999 - DNA, 22 bp, Homo sapiens
gaagagcatatgaagagcatat

SEQ ID NO: 8756000 - DNA, 22 bp, Homo sapiens
atgatggaggccgtgatggacg

SEQ ID NO: 8756001 - DNA, 22 bp, Homo sapiens
gaagagctaaaggcacaggctt

SEQ ID NO: 8756002 - DNA, 22 bp, Homo sapiens
atgatggaggccgtgatggacg

SEQ ID NO: 8756003 - DNA, 22 bp, Homo sapiens
atgatggaggtgtcctggattt

SEQ ID NO: 8756004 - DNA, 22 bp, Homo sapiens
atgatggatatgtaaagtgttg

SEQ ID NO: 8756005 - DNA, 22 bp, Homo sapiens
atgatggaggggtggctttaga

SEQ ID NO: 8756006 - DNA, 22 bp, Homo sapiens
atgatggctaggctggttttga

SEQ ID NO: 8756007 - DNA, 22 bp, Homo sapiens
atgatggctaggctggttttga

SEQ ID NO: 8756008 - DNA, 22 bp, Homo sapiens
atgatggctaggctggttttga

SEQ ID NO: 8756009 - DNA, 22 bp, Homo sapiens
atgatgtaatggaaagaacaga

SEQ ID NO: 8756010 - DNA, 22 bp, Homo sapiens
atgatgtaaatagagcctaggt

SEQ ID NO: 8756011 - DNA, 22 bp, Homo sapiens
atgatgtgtgctgatcaagctt

SEQ ID NO: 8756012 - DNA, 23 bp, Homo sapiens
atgatgtttttggtagtcaaatg

SEQ ID NO: 8756013 - DNA, 23 bp, Homo sapiens
atgatgtttttggtagtcaaatg

SEQ ID NO: 8756014 - DNA, 23 bp, Homo sapiens
gaagcagatgtctgagtaggcag

SEQ ID NO: 8756015 - DNA, 22 bp, Homo sapiens
atgatgttaccagtacttagag

SEQ ID NO: 8756016 - DNA, 22 bp, Homo sapiens
atgatgttattttcagaaacat

SEQ ID NO: 8756017 - DNA, 22 bp, Homo sapiens
gagaatctacaggaaaccgaag

SEQ ID NO: 8756018 - DNA, 22 bp, Homo sapiens
gagaatcatttacagaatgatt

SEQ ID NO: 8756019 - DNA, 22 bp, Homo sapiens
gagacagcctactccagtctca

SEQ ID NO: 8756020 - DNA, 22 bp, Homo sapiens
gagacaggatttaaccaaagct

SEQ ID NO: 8756021 - DNA, 22 bp, Homo sapiens
gagacaggatttaaccaaagct

SEQ ID NO: 8756022 - DNA, 22 bp, Homo sapiens
gagacagcttaattggtggtca

SEQ ID NO: 8756023 - DNA, 22 bp, Homo sapiens
gagacagcctactccagtctca

SEQ ID NO: 8756024 - DNA, 22 bp, Homo sapiens
gagacagcagggccagggcctg

SEQ ID NO: 8756025 - DNA, 21 bp, Homo sapiens
gagacagcccagtgccagggc

SEQ ID NO: 8756026 - DNA, 22 bp, Homo sapiens
gagacagcacaggccactggga

SEQ ID NO: 8756027 - DNA, 22 bp, Homo sapiens
gagaatctcaggcacccagaag

SEQ ID NO: 8756028 - DNA, 17 bp, Homo sapiens
gagacagcaggagcccc

SEQ ID NO: 8756029 - DNA, 22 bp, Homo sapiens
gagacagcagggccagggcctg

SEQ ID NO: 8756030 - DNA, 22 bp, Homo sapiens
gagacagcagggccagggcctg

SEQ ID NO: 8756031 - DNA, 22 bp, Homo sapiens
gagacagcagggccagggcctg

SEQ ID NO: 8756032 - DNA, 22 bp, Homo sapiens
gagacagtgaggaaggctaggt

SEQ ID NO: 8756033 - DNA, 22 bp, Homo sapiens
atggataatggtgatagttgca

SEQ ID NO: 8756034 - DNA, 22 bp, Homo sapiens
atggatcacagtgccgtgggtg

SEQ ID NO: 8756035 - DNA, 22 bp, Homo sapiens
atggatctgctaatgggaagca

SEQ ID NO: 8756036 - DNA, 22 bp, Homo sapiens
atggatcttccctcatttctga

SEQ ID NO: 8756037 - DNA, 22 bp, Homo sapiens
atggatctaccttcaggctctg

SEQ ID NO: 8756038 - DNA, 22 bp, Homo sapiens
atggatctaccttcaggctctg

SEQ ID NO: 8756039 - DNA, 22 bp, Homo sapiens
gagacaggccaggtggtactta

SEQ ID NO: 8756040 - DNA, 22 bp, Homo sapiens
gagacaggcagctagtgggtca

SEQ ID NO: 8756041 - DNA, 22 bp, Homo sapiens
gagacaggcagctagtgggtca

SEQ ID NO: 8756042 - DNA, 22 bp, Homo sapiens
gagacaggatttaaccaaagct

SEQ ID NO: 8756043 - DNA, 22 bp, Homo sapiens
atggattggatttttatggacc

SEQ ID NO: 8756044 - DNA, 21 bp, Homo sapiens
atggatttaaacaggccacaa

SEQ ID NO: 8756045 - DNA, 22 bp, Homo sapiens
atggatttggatgagattactt

SEQ ID NO: 8756046 - DNA, 22 bp, Homo sapiens
atggatgagtccttgagacaca

SEQ ID NO: 8756047 - DNA, 22 bp, Homo sapiens
atggatggcctgagcacagctg

SEQ ID NO: 8756048 - DNA, 22 bp, Homo sapiens
atggatgaaggcgaggatgagg

SEQ ID NO: 8756049 - DNA, 20 bp, Homo sapiens
atggatgaccttggccaggg

SEQ ID NO: 8756050 - DNA, 22 bp, Homo sapiens
atggatgaaggcgaggatgagg

SEQ ID NO: 8756051 - DNA, 22 bp, Homo sapiens
atggatgagtccttgagacaca

SEQ ID NO: 8756052 - DNA, 18 bp, Homo sapiens
atggcacagtctttccct

SEQ ID NO: 8756053 - DNA, 22 bp, Homo sapiens
atggcacacaggtctgcaaggg

SEQ ID NO: 8756054 - DNA, 22 bp, Homo sapiens
atggcacagatgttctgattat

SEQ ID NO: 8756055 - DNA, 22 bp, Homo sapiens
atggcaaaaactgcagttacct

SEQ ID NO: 8756056 - DNA, 22 bp, Homo sapiens
atggcaaaaattaacagatcaa

SEQ ID NO: 8756057 - DNA, 22 bp, Homo sapiens
atggcaagcaagctgaagagat

SEQ ID NO: 8756058 - DNA, 22 bp, Homo sapiens
atggcaagcaagctgaagagat

SEQ ID NO: 8756059 - DNA, 22 bp, Homo sapiens
atggcagaatcaagccgacagc

SEQ ID NO: 8756060 - DNA, 22 bp, Homo sapiens
atggcagaatcaagccgacagc

SEQ ID NO: 8756061 - DNA, 22 bp, Homo sapiens
atggcagaatatctgcatcgca

SEQ ID NO: 8756062 - DNA, 22 bp, Homo sapiens
atggcagaattaggatttcaag

SEQ ID NO: 8756063 - DNA, 22 bp, Homo sapiens
atggcagaattaggatttcaag

SEQ ID NO: 8756064 - DNA, 22 bp, Homo sapiens
atggcagaagtcaagatgagtt

SEQ ID NO: 8756065 - DNA, 22 bp, Homo sapiens
atggcagaaagaatagaggcta

SEQ ID NO: 8756066 - DNA, 22 bp, Homo sapiens
atggcaccttccccagagctca

SEQ ID NO: 8756067 - DNA, 22 bp, Homo sapiens
gagaaggtggacctgaaggagc

SEQ ID NO: 8756068 - DNA, 22 bp, Homo sapiens
gagaaggtggacctgaaggagc

SEQ ID NO: 8756069 - DNA, 22 bp, Homo sapiens
gagaaggtggacctgaaggagc

SEQ ID NO: 8756070 - DNA, 22 bp, Homo sapiens
gagaaggggtgatgtgggtaat

SEQ ID NO: 8756071 - DNA, 22 bp, Homo sapiens
gagaaggggtgatgtgggtaat

SEQ ID NO: 8756072 - DNA, 22 bp, Homo sapiens
gagaaggggtgatgtgggtaat

SEQ ID NO: 8756073 - DNA, 22 bp, Homo sapiens
gagaagtttctggtttgcatag

SEQ ID NO: 8756074 - DNA, 22 bp, Homo sapiens
atgctgtgtggccacctccatg

SEQ ID NO: 8756075 - DNA, 22 bp, Homo sapiens
atgctgttaagataatgggttc

SEQ ID NO: 8756076 - DNA, 22 bp, Homo sapiens
atgctgttaagaatctcttcct

SEQ ID NO: 8756077 - DNA, 22 bp, Homo sapiens
atgctgttaagaatctcttcct

SEQ ID NO: 8756078 - DNA, 22 bp, Homo sapiens
atgctgttattctaatgtgtga

SEQ ID NO: 8756079 - DNA, 22 bp, Homo sapiens
atgctgttattctaatgtgtga

SEQ ID NO: 8756080 - DNA, 23 bp, Homo sapiens
gagaacagccacagagagctgtg

SEQ ID NO: 8756081 - DNA, 23 bp, Homo sapiens
gagaacagccacagagagctgtg

SEQ ID NO: 8756082 - DNA, 22 bp, Homo sapiens
atgctgtggggagtgagggtag

SEQ ID NO: 8756083 - DNA, 22 bp, Homo sapiens
atgctgtggggagtgagggtag

SEQ ID NO: 8756084 - DNA, 22 bp, Homo sapiens
atgctgtgaaaaagaaggctga

SEQ ID NO: 8756085 - DNA, 22 bp, Homo sapiens
atgctgtgccttctctgtgcca

SEQ ID NO: 8756086 - DNA, 22 bp, Homo sapiens
atgctgtgccttctctgtgcca

SEQ ID NO: 8756087 - DNA, 22 bp, Homo sapiens
atgctggattgagagcaagggg

SEQ ID NO: 8756088 - DNA, 22 bp, Homo sapiens
atgctggattgagagcaagggg

SEQ ID NO: 8756089 - DNA, 22 bp, Homo sapiens
atgctgggaagacaaggtggag

SEQ ID NO: 8756090 - DNA, 22 bp, Homo sapiens
atgctgggacgtacttgttcat

SEQ ID NO: 8756091 - DNA, 22 bp, Homo sapiens
atgctgggagtgaagcccctgg

SEQ ID NO: 8756092 - DNA, 22 bp, Homo sapiens
atgctgtccattaactaggatg

SEQ ID NO: 8756093 - DNA, 22 bp, Homo sapiens
atgctgtccattaactaggatg

SEQ ID NO: 8756094 - DNA, 22 bp, Homo sapiens
atgctgtcgaaaccaaacatct

SEQ ID NO: 8756095 - DNA, 22 bp, Homo sapiens
atgctgtatacatatgaaatta

SEQ ID NO: 8756096 - DNA, 22 bp, Homo sapiens
atgctggtctgcagagttggga

SEQ ID NO: 8756097 - DNA, 22 bp, Homo sapiens
atgctggtggttgatggcagga

SEQ ID NO: 8756098 - DNA, 22 bp, Homo sapiens
atgctggtaagttgcaaatgtt

SEQ ID NO: 8756099 - DNA, 22 bp, Homo sapiens
atgctggtttcatgataacata

SEQ ID NO: 8756100 - DNA, 22 bp, Homo sapiens
atgctggtctcattgggttagg

SEQ ID NO: 8756101 - DNA, 22 bp, Homo sapiens
atgctggtctgcagagttggga

SEQ ID NO: 8756102 - DNA, 22 bp, Homo sapiens
atgctggggcctcagaccagaa

SEQ ID NO: 8756103 - DNA, 18 bp, Homo sapiens
atggctccagtgtcttcc

SEQ ID NO: 8756104 - DNA, 22 bp, Homo sapiens
atggctccatcctgttgctagt

SEQ ID NO: 8756105 - DNA, 22 bp, Homo sapiens
atggctccagctggtagagatt

SEQ ID NO: 8756106 - DNA, 22 bp, Homo sapiens
atggctccaagatggagagcca

SEQ ID NO: 8756107 - DNA, 22 bp, Homo sapiens
atggccgcctgtccttcccgcc

SEQ ID NO: 8756108 - DNA, 21 bp, Homo sapiens
atggctcaggccatcaatgga

SEQ ID NO: 8756109 - DNA, 22 bp, Homo sapiens
atggcagacctgggctggagaa

SEQ ID NO: 8756110 - DNA, 22 bp, Homo sapiens
atggcagacctgggctggagaa

SEQ ID NO: 8756111 - DNA, 22 bp, Homo sapiens
atggcagacgaggcagcagggg

SEQ ID NO: 8756112 - DNA, 22 bp, Homo sapiens
atggcagacgaggcagcagggg

SEQ ID NO: 8756113 - DNA, 22 bp, Homo sapiens
atggctctgctgggcaaagcaa

SEQ ID NO: 8756114 - DNA, 22 bp, Homo sapiens
atggctctgctgggcaaagcaa

SEQ ID NO: 8756115 - DNA, 19 bp, Homo sapiens
atggctctgggatcactgc

SEQ ID NO: 8756116 - DNA, 19 bp, Homo sapiens
atggctctgggatcactgc

SEQ ID NO: 8756117 - DNA, 22 bp, Homo sapiens
atggctctcttgacctaggcac

SEQ ID NO: 8756118 - DNA, 22 bp, Homo sapiens
atggctctgagaacctgagcta

SEQ ID NO: 8756119 - DNA, 22 bp, Homo sapiens
atggctctgagaacctgagcta

SEQ ID NO: 8756120 - DNA, 22 bp, Homo sapiens
atggctctctccttactgctgc

SEQ ID NO: 8756121 - DNA, 22 bp, Homo sapiens
atggctctctagggcccaggtt

SEQ ID NO: 8756122 - DNA, 22 bp, Homo sapiens
atggctcttgaattgatactct

SEQ ID NO: 8756123 - DNA, 21 bp, Homo sapiens
atggctgatgatattgaacat

SEQ ID NO: 8756124 - DNA, 21 bp, Homo sapiens
atggctgatgatattgaacat

SEQ ID NO: 8756125 - DNA, 22 bp, Homo sapiens
atggctgaggctggaggtggca

SEQ ID NO: 8756126 - DNA, 22 bp, Homo sapiens
atggctgagatgggctccaggc

SEQ ID NO: 8756127 - DNA, 22 bp, Homo sapiens
atggctgaggctggaggtggca

SEQ ID NO: 8756128 - DNA, 22 bp, Homo sapiens
atggctgcagtccgtgccctgg

SEQ ID NO: 8756129 - DNA, 22 bp, Homo sapiens
atggctgcagccggccctgcgc

SEQ ID NO: 8756130 - DNA, 22 bp, Homo sapiens
atggctgcagagacctgaagaa

SEQ ID NO: 8756131 - DNA, 22 bp, Homo sapiens
atggctgcagccggccctgcgc

SEQ ID NO: 8756132 - DNA, 22 bp, Homo sapiens
atggctgcagagacctgaagaa

SEQ ID NO: 8756133 - DNA, 22 bp, Homo sapiens
gagcacaggctgctgtgaactg

SEQ ID NO: 8756134 - DNA, 22 bp, Homo sapiens
gagcacaggctgctgtgaactg

SEQ ID NO: 8756135 - DNA, 22 bp, Homo sapiens
gagcacaggctttggtggacac

SEQ ID NO: 8756136 - DNA, 22 bp, Homo sapiens
gagcacagctgtcttgcaagct

SEQ ID NO: 8756137 - DNA, 22 bp, Homo sapiens
gagcacagctgtcttgcaagct

SEQ ID NO: 8756138 - DNA, 22 bp, Homo sapiens
gagcacagctggaggtagcatt

SEQ ID NO: 8756139 - DNA, 22 bp, Homo sapiens
gagcacagctggaggtagcatt

SEQ ID NO: 8756140 - DNA, 22 bp, Homo sapiens
gagcacagctggaggtagcatt

SEQ ID NO: 8756141 - DNA, 22 bp, Homo sapiens
gagcacagctggaggtagcatt

SEQ ID NO: 8756142 - DNA, 22 bp, Homo sapiens
gagcacagcagggctctgggtg

SEQ ID NO: 8756143 - DNA, 22 bp, Homo sapiens
gagcacagcagggctctgggtg

SEQ ID NO: 8756144 - DNA, 22 bp, Homo sapiens
gagcacagccaaagtaagaagg

SEQ ID NO: 8756145 - DNA, 22 bp, Homo sapiens
gagcacagccaaagtaagaagg

SEQ ID NO: 8756146 - DNA, 22 bp, Homo sapiens
gagcacagccaaagtaagaagg

SEQ ID NO: 8756147 - DNA, 22 bp, Homo sapiens
atggctgcagtccgtgccctgg

SEQ ID NO: 8756148 - DNA, 22 bp, Homo sapiens
gagcacagctggaggtagcatt

SEQ ID NO: 8756149 - DNA, 22 bp, Homo sapiens
gagcacagcgcagtttgtaatt

SEQ ID NO: 8756150 - DNA, 19 bp, Homo sapiens
gagcacagcggcatttggt

SEQ ID NO: 8756151 - DNA, 22 bp, Homo sapiens
gagcacaggctttggtggacac

SEQ ID NO: 8756152 - DNA, 22 bp, Homo sapiens
gagcacaggctttggtggacac

SEQ ID NO: 8756153 - DNA, 22 bp, Homo sapiens
gagcacagggaatagacagata

SEQ ID NO: 8756154 - DNA, 22 bp, Homo sapiens
gagcacagggaatagacagata

SEQ ID NO: 8756155 - DNA, 22 bp, Homo sapiens
atgggagtgtgcttgaggagtt

SEQ ID NO: 8756156 - DNA, 22 bp, Homo sapiens
atgggagggtggaaaggctctg

SEQ ID NO: 8756157 - DNA, 22 bp, Homo sapiens
atgggagggtggaaaggctctg

SEQ ID NO: 8756158 - DNA, 22 bp, Homo sapiens
atgggagggtggaaaggctctg

SEQ ID NO: 8756159 - DNA, 22 bp, Homo sapiens
gagccccttctgcagtcaggtt

SEQ ID NO: 8756160 - DNA, 22 bp, Homo sapiens
gagcccgagcgcgtacccggcg

SEQ ID NO: 8756161 - DNA, 22 bp, Homo sapiens
gagccctcaatgaatctgcatt

SEQ ID NO: 8756162 - DNA, 22 bp, Homo sapiens
gagccccaggacagctctagtt

SEQ ID NO: 8756163 - DNA, 22 bp, Homo sapiens
gagccctcaccgcctgaccagg

SEQ ID NO: 8756164 - DNA, 22 bp, Homo sapiens
gagccctcaccgcctgaccagg

SEQ ID NO: 8756165 - DNA, 22 bp, Homo sapiens
gagccctcaatgaatctgcatt

SEQ ID NO: 8756166 - DNA, 22 bp, Homo sapiens
gagccctcaccgcctgaccagg

SEQ ID NO: 8756167 - DNA, 22 bp, Homo sapiens
gagccctcattgaatctgcatt

SEQ ID NO: 8756168 - DNA, 22 bp, Homo sapiens
gagccctcattgaatctgcatt

SEQ ID NO: 8756169 - DNA, 22 bp, Homo sapiens
gagccctcgggcgagcccgcgc

SEQ ID NO: 8756170 - DNA, 22 bp, Homo sapiens
gagccctcgggcgagcccgcgc

SEQ ID NO: 8756171 - DNA, 22 bp, Homo sapiens
gagccctcgggcgagcccgcgc

SEQ ID NO: 8756172 - DNA, 22 bp, Homo sapiens
gagccctccatggagccaggca

SEQ ID NO: 8756173 - DNA, 22 bp, Homo sapiens
gagccctccatggagccaggca

SEQ ID NO: 8756174 - DNA, 19 bp, Homo sapiens
gagccctctccatggccac

SEQ ID NO: 8756175 - DNA, 22 bp, Homo sapiens
gagccctctctgtaggcaagta

SEQ ID NO: 8756176 - DNA, 19 bp, Homo sapiens
gagccctctccatggccac

SEQ ID NO: 8756177 - DNA, 22 bp, Homo sapiens
atgggcagacagggagctcacg

SEQ ID NO: 8756178 - DNA, 22 bp, Homo sapiens
atgggcaaggggtaaggacact

SEQ ID NO: 8756179 - DNA, 22 bp, Homo sapiens
atgggcagacagggagctcacg

SEQ ID NO: 8756180 - DNA, 22 bp, Homo sapiens
atgggcagacagggagctcacg

SEQ ID NO: 8756181 - DNA, 22 bp, Homo sapiens
atgggcagacagggagctcacg

SEQ ID NO: 8756182 - DNA, 22 bp, Homo sapiens
atgggcagacagggagctcacg

SEQ ID NO: 8756183 - DNA, 22 bp, Homo sapiens
gagcccagtctgctcctgcgcc

SEQ ID NO: 8756184 - DNA, 21 bp, Homo sapiens
atgggcagaggcagagaggct

SEQ ID NO: 8756185 - DNA, 22 bp, Homo sapiens
atgggcagagctggtgggaggc

SEQ ID NO: 8756186 - DNA, 22 bp, Homo sapiens
atgggcagagctggtgggaggc

SEQ ID NO: 8756187 - DNA, 22 bp, Homo sapiens
atgggcagagctggtgggaggc

SEQ ID NO: 8756188 - DNA, 17 bp, Homo sapiens
gagctctgtggcacaag

SEQ ID NO: 8756189 - DNA, 17 bp, Homo sapiens
gagctctgtggcacaag

SEQ ID NO: 8756190 - DNA, 20 bp, Homo sapiens
gagctgagtgtggtcatggg

SEQ ID NO: 8756191 - DNA, 22 bp, Homo sapiens
gagctgagtgtcctaggcatgg

SEQ ID NO: 8756192 - DNA, 22 bp, Homo sapiens
gagctgagtgtcctaggcatgg

SEQ ID NO: 8756193 - DNA, 22 bp, Homo sapiens
gagctgagtgtcctaggcatgg

SEQ ID NO: 8756194 - DNA, 22 bp, Homo sapiens
gagctgcagacatagataagcg

SEQ ID NO: 8756195 - DNA, 22 bp, Homo sapiens
gagctgcagacatagataagcg

SEQ ID NO: 8756196 - DNA, 22 bp, Homo sapiens
gagctgcagacttgatacagga

SEQ ID NO: 8756197 - DNA, 22 bp, Homo sapiens
gagctgcagagctcgaaggaac

SEQ ID NO: 8756198 - DNA, 22 bp, Homo sapiens
gagctgcagagctcgaaggaac

SEQ ID NO: 8756199 - DNA, 22 bp, Homo sapiens
gagctgcacatctgaggctaat

SEQ ID NO: 8756200 - DNA, 22 bp, Homo sapiens
gagctgcacatctgaggctaat

SEQ ID NO: 8756201 - DNA, 20 bp, Homo sapiens
gagctgagtgtggtcatggg

SEQ ID NO: 8756202 - DNA, 22 bp, Homo sapiens
gagctgcactgggggtggaatg

SEQ ID NO: 8756203 - DNA, 22 bp, Homo sapiens
gagctgcacgcagcatccaaga

SEQ ID NO: 8756204 - DNA, 21 bp, Homo sapiens
gagctgcaccttgacctgttt

SEQ ID NO: 8756205 - DNA, 22 bp, Homo sapiens
gagctgcatagctgggatcctc

SEQ ID NO: 8756206 - DNA, 22 bp, Homo sapiens
gagctgcagagtaacctttgca

SEQ ID NO: 8756207 - DNA, 22 bp, Homo sapiens
gagctgcagcggctgacgcaac

SEQ ID NO: 8756208 - DNA, 22 bp, Homo sapiens
gagctgccagacatgggaatga

SEQ ID NO: 8756209 - DNA, 21 bp, Homo sapiens
atgggcagaggcagagaggct

SEQ ID NO: 8756210 - DNA, 21 bp, Homo sapiens
atgggcagaggcagagaggct

SEQ ID NO: 8756211 - DNA, 22 bp, Homo sapiens
gaggagggagctggaagctctt

SEQ ID NO: 8756212 - DNA, 22 bp, Homo sapiens
gaggagggagctggaagctctt

SEQ ID NO: 8756213 - DNA, 22 bp, Homo sapiens
gaggagctgtcaccgtgactca

SEQ ID NO: 8756214 - DNA, 22 bp, Homo sapiens
gaggagggcagttcctctttta

SEQ ID NO: 8756215 - DNA, 22 bp, Homo sapiens
gaggagggagctggaagctctt

SEQ ID NO: 8756216 - DNA, 22 bp, Homo sapiens
gaggagggagctggaagctctt

SEQ ID NO: 8756217 - DNA, 22 bp, Homo sapiens
gaggagggagctggaagctctt

SEQ ID NO: 8756218 - DNA, 22 bp, Homo sapiens
gaggagggcctggtgtcccttc

SEQ ID NO: 8756219 - DNA, 22 bp, Homo sapiens
gaggagggcagttcctctttta

SEQ ID NO: 8756220 - DNA, 22 bp, Homo sapiens
gaggagggcctggtgtcccttc

SEQ ID NO: 8756221 - DNA, 22 bp, Homo sapiens
gaggagggcctggtgtcccttc

SEQ ID NO: 8756222 - DNA, 22 bp, Homo sapiens
gaggagggctttgttgatgtta

SEQ ID NO: 8756223 - DNA, 22 bp, Homo sapiens
gaggaggggacagtacttgtgc

SEQ ID NO: 8756224 - DNA, 22 bp, Homo sapiens
gaggagggctttgttgatgtta

SEQ ID NO: 8756225 - DNA, 22 bp, Homo sapiens
gaggagctgggtcagggagaca

SEQ ID NO: 8756226 - DNA, 22 bp, Homo sapiens
atgggcaggcactggctctcag

SEQ ID NO: 8756227 - DNA, 22 bp, Homo sapiens
atgggcaggcactggctctcag

SEQ ID NO: 8756228 - DNA, 22 bp, Homo sapiens
atgggcaggcactggctctcag

SEQ ID NO: 8756229 - DNA, 22 bp, Homo sapiens
atgggcaggcactggctctcag

SEQ ID NO: 8756230 - DNA, 22 bp, Homo sapiens
atgggcaggcactggctctcag

SEQ ID NO: 8756231 - DNA, 22 bp, Homo sapiens
atgggcaggcaaggtggcgagt

SEQ ID NO: 8756232 - DNA, 22 bp, Homo sapiens
atgggcagctgcagcagtggtg

SEQ ID NO: 8756233 - DNA, 22 bp, Homo sapiens
atgggcagcagctgccattcat

SEQ ID NO: 8756234 - DNA, 22 bp, Homo sapiens
atgggcagagtggggacaggaa

SEQ ID NO: 8756235 - DNA, 22 bp, Homo sapiens
atgggcagagtggggacaggaa

SEQ ID NO: 8756236 - DNA, 22 bp, Homo sapiens
atgggcagcagctgtcattttc

SEQ ID NO: 8756237 - DNA, 22 bp, Homo sapiens
atgggcagctgcagcagtggtg

SEQ ID NO: 8756238 - DNA, 22 bp, Homo sapiens
gaggcacagagccctaggagct

SEQ ID NO: 8756239 - DNA, 22 bp, Homo sapiens
gaggcacagagtaggtgcacac

SEQ ID NO: 8756240 - DNA, 22 bp, Homo sapiens
gaggcacagagtaggtgcacac

SEQ ID NO: 8756241 - DNA, 22 bp, Homo sapiens
gaggcacaatacatgtctcaag

SEQ ID NO: 8756242 - DNA, 22 bp, Homo sapiens
gaggcacagagccctaggagct

SEQ ID NO: 8756243 - DNA, 22 bp, Homo sapiens
gaggcacagagccctaggagct

SEQ ID NO: 8756244 - DNA, 22 bp, Homo sapiens
gaggcacagagccctaggagct

SEQ ID NO: 8756245 - DNA, 22 bp, Homo sapiens
gaggcacagagccctaggagct

SEQ ID NO: 8756246 - DNA, 22 bp, Homo sapiens
gaggaggggcacttgtctccta

SEQ ID NO: 8756247 - DNA, 23 bp, Homo sapiens
gaggagggtcgtgctgtgttcct

SEQ ID NO: 8756248 - DNA, 22 bp, Homo sapiens
gaggaggggcacttgtctccta

SEQ ID NO: 8756249 - DNA, 22 bp, Homo sapiens
gaggaggggacagtacttgtgc

SEQ ID NO: 8756250 - DNA, 22 bp, Homo sapiens
gaggaggggcacttgtctccta

SEQ ID NO: 8756251 - DNA, 22 bp, Homo sapiens
gaggcacagtcccgaggcaagg

SEQ ID NO: 8756252 - DNA, 22 bp, Homo sapiens
gaggcacagtcccgaggcaagg

SEQ ID NO: 8756253 - DNA, 22 bp, Homo sapiens
gaggcacagtcccgaggcaagg

SEQ ID NO: 8756254 - DNA, 22 bp, Homo sapiens
gaggcacagtcccgaggcaagg

SEQ ID NO: 8756255 - DNA, 22 bp, Homo sapiens
gaggcacagagtaggtgcacac

SEQ ID NO: 8756256 - DNA, 22 bp, Homo sapiens
gaggcacagtgtttggtcagtg

SEQ ID NO: 8756257 - DNA, 22 bp, Homo sapiens
gaggcacagtgtttggtcagtg

SEQ ID NO: 8756258 - DNA, 22 bp, Homo sapiens
gaggcacagtgtttggtcagtg

SEQ ID NO: 8756259 - DNA, 18 bp, Homo sapiens
gaggcacatagttggggc

SEQ ID NO: 8756260 - DNA, 18 bp, Homo sapiens
gaggcacatagttggggc

SEQ ID NO: 8756261 - DNA, 22 bp, Homo sapiens
gaggcacagttcttcctccaga

SEQ ID NO: 8756262 - DNA, 22 bp, Homo sapiens
gaggcacatatatacagagccc

SEQ ID NO: 8756263 - DNA, 22 bp, Homo sapiens
gaggcacatatatacagagccc

SEQ ID NO: 8756264 - DNA, 18 bp, Homo sapiens
gaggcacatagttggggc

SEQ ID NO: 8756265 - DNA, 22 bp, Homo sapiens
atgtatcaactgcaggcaagtt

SEQ ID NO: 8756266 - DNA, 22 bp, Homo sapiens
gaggctccctttaggtccagat

SEQ ID NO: 8756267 - DNA, 22 bp, Homo sapiens
gaggctccgtgctgctgccctg

SEQ ID NO: 8756268 - DNA, 22 bp, Homo sapiens
gaggctccctcaactctgggtg

SEQ ID NO: 8756269 - DNA, 22 bp, Homo sapiens
gaggctccatggaggagtatgg

SEQ ID NO: 8756270 - DNA, 22 bp, Homo sapiens
gaggctccccatgaggccccag

SEQ ID NO: 8756271 - DNA, 22 bp, Homo sapiens
gaggctcccaaggggctaggcc

SEQ ID NO: 8756272 - DNA, 22 bp, Homo sapiens
gaggctctttaaatcttttgga

SEQ ID NO: 8756273 - DNA, 22 bp, Homo sapiens
gaggctctgtgatgtgccaggc

SEQ ID NO: 8756274 - DNA, 20 bp, Homo sapiens
gaggctctgggcatggcgcc

SEQ ID NO: 8756275 - DNA, 22 bp, Homo sapiens
gaggctctggagtaggtacaca

SEQ ID NO: 8756276 - DNA, 22 bp, Homo sapiens
atgtattgaccatactactaaa

SEQ ID NO: 8756277 - DNA, 22 bp, Homo sapiens
atgtattgtctcttttccttaa

SEQ ID NO: 8756278 - DNA, 23 bp, Homo sapiens
atgtatttaaatttcagtgatga

SEQ ID NO: 8756279 - DNA, 23 bp, Homo sapiens
atgtatttaaatttcagtgatga

SEQ ID NO: 8756280 - DNA, 23 bp, Homo sapiens
atgtatttaaatttcagtgatga

SEQ ID NO: 8756281 - DNA, 22 bp, Homo sapiens
gaggcctgggttggaggtgcat

SEQ ID NO: 8756282 - DNA, 22 bp, Homo sapiens
gaggcctgggttggaggtgcat

SEQ ID NO: 8756283 - DNA, 22 bp, Homo sapiens
gaggcctgggttggaggtgcat

SEQ ID NO: 8756284 - DNA, 22 bp, Homo sapiens
atgtatttctatgtagtgaaga

SEQ ID NO: 8756285 - DNA, 22 bp, Homo sapiens
atgtatttctatgtagtgaaga

SEQ ID NO: 8756286 - DNA, 22 bp, Homo sapiens
atgtatgttagtgtattatcta

SEQ ID NO: 8756287 - DNA, 22 bp, Homo sapiens
atgtatgttagtgtattatcta

SEQ ID NO: 8756288 - DNA, 22 bp, Homo sapiens
atgtatgttcaagcaatgatta

SEQ ID NO: 8756289 - DNA, 22 bp, Homo sapiens
atgtatgttcaagcaatgatta

SEQ ID NO: 8756290 - DNA, 22 bp, Homo sapiens
atgtatgttagtgtattatcta

SEQ ID NO: 8756291 - DNA, 22 bp, Homo sapiens
atgtatgtctgcatacacatac

SEQ ID NO: 8756292 - DNA, 22 bp, Homo sapiens
atgtatgtctgcatacacatac

SEQ ID NO: 8756293 - DNA, 22 bp, Homo sapiens
atgtatgtgcacgcatgtacat

SEQ ID NO: 8756294 - DNA, 22 bp, Homo sapiens
atgtatgtttctatatatgaca

SEQ ID NO: 8756295 - DNA, 22 bp, Homo sapiens
atgtattatggttttccttaag

SEQ ID NO: 8756296 - DNA, 22 bp, Homo sapiens
atgtatgtttttgcagatacat

SEQ ID NO: 8756297 - DNA, 22 bp, Homo sapiens
atgtatgttttcagttgtatta

SEQ ID NO: 8756298 - DNA, 22 bp, Homo sapiens
atgtatcagaaatagcattggc

SEQ ID NO: 8756299 - DNA, 22 bp, Homo sapiens
atgtatcagataaagcatgtgg

SEQ ID NO: 8756300 - DNA, 22 bp, Homo sapiens
atgtatcagataaagcatgtgg

SEQ ID NO: 8756301 - DNA, 22 bp, Homo sapiens
atgtatcagataaagcatgtgg

SEQ ID NO: 8756302 - DNA, 22 bp, Homo sapiens
atgtatgaagctttgtttggga

SEQ ID NO: 8756303 - DNA, 22 bp, Homo sapiens
atgtatgatgctaggctctcag

SEQ ID NO: 8756304 - DNA, 22 bp, Homo sapiens
atgtatgatatttccagtatca

SEQ ID NO: 8756305 - DNA, 19 bp, Homo sapiens
atgtatgaggtcttctgct

SEQ ID NO: 8756306 - DNA, 22 bp, Homo sapiens
atgtatgagagattcttttatt

SEQ ID NO: 8756307 - DNA, 22 bp, Homo sapiens
atgtatgtagtgtacatataca

SEQ ID NO: 8756308 - DNA, 22 bp, Homo sapiens
atgtatgtagtgtacatataca

SEQ ID NO: 8756309 - DNA, 22 bp, Homo sapiens
atgtatgtatgctgtgcttgca

SEQ ID NO: 8756310 - DNA, 18 bp, Homo sapiens
atgtatgtacatatttat

SEQ ID NO: 8756311 - DNA, 18 bp, Homo sapiens
atgtatgtacatatttat

SEQ ID NO: 8756312 - DNA, 20 bp, Homo sapiens
atgtatgcaaatgtcttcca

SEQ ID NO: 8756313 - DNA, 22 bp, Homo sapiens
atgtatgcatagtgagtaaatg

SEQ ID NO: 8756314 - DNA, 22 bp, Homo sapiens
atgtatgcatgctacagttttc

SEQ ID NO: 8756315 - DNA, 22 bp, Homo sapiens
atgtatgcatgtatgtatcgct

SEQ ID NO: 8756316 - DNA, 22 bp, Homo sapiens
atgtatgcatgtatgtatcgct

SEQ ID NO: 8756317 - DNA, 22 bp, Homo sapiens
atgtatgctttgattttagatg

SEQ ID NO: 8756318 - DNA, 22 bp, Homo sapiens
gaggctcttttctgctgtgtct

SEQ ID NO: 8756319 - DNA, 22 bp, Homo sapiens
gaggctgaacaggttctcatga

SEQ ID NO: 8756320 - DNA, 19 bp, Homo sapiens
atgtcactcatgttccctg

SEQ ID NO: 8756321 - DNA, 22 bp, Homo sapiens
atgtcaccttcggtggcacggt

SEQ ID NO: 8756322 - DNA, 22 bp, Homo sapiens
atgtcactccagggacacaggt

SEQ ID NO: 8756323 - DNA, 22 bp, Homo sapiens
gaggctcttttctgctgtgtct

SEQ ID NO: 8756324 - DNA, 22 bp, Homo sapiens
atgtcactgtgaggcagctgtc

SEQ ID NO: 8756325 - DNA, 22 bp, Homo sapiens
atgtcactgtttaccagctcca

SEQ ID NO: 8756326 - DNA, 22 bp, Homo sapiens
atgtcactgttgttattgttat

SEQ ID NO: 8756327 - DNA, 22 bp, Homo sapiens
atgtcactgttgttattgttat

SEQ ID NO: 8756328 - DNA, 22 bp, Homo sapiens
atgtcacttttgagactaggtt

SEQ ID NO: 8756329 - DNA, 22 bp, Homo sapiens
atgtcacttttgagactaggtt

SEQ ID NO: 8756330 - DNA, 22 bp, Homo sapiens
atgtcactgtgaggcagctgtc

SEQ ID NO: 8756331 - DNA, 22 bp, Homo sapiens
atgtcagattcctaaatatctt

SEQ ID NO: 8756332 - DNA, 22 bp, Homo sapiens
atgtcagatgtttatctgattt

SEQ ID NO: 8756333 - DNA, 22 bp, Homo sapiens
atgtcagatcctcagaaagtct

SEQ ID NO: 8756334 - DNA, 22 bp, Homo sapiens
atgtcagatcctcagaaagtct

SEQ ID NO: 8756335 - DNA, 22 bp, Homo sapiens
atgtcagatattttttggttgc

SEQ ID NO: 8756336 - DNA, 22 bp, Homo sapiens
atgtcagaagctggatgacagc

SEQ ID NO: 8756337 - DNA, 22 bp, Homo sapiens
atgtcagagcttccacaatagt

SEQ ID NO: 8756338 - DNA, 22 bp, Homo sapiens
atgtcagaatctacattctact

SEQ ID NO: 8756339 - DNA, 22 bp, Homo sapiens
atgtcagagcttccacaatagt

SEQ ID NO: 8756340 - DNA, 22 bp, Homo sapiens
atgtcagtagtttctttgagtt

SEQ ID NO: 8756341 - DNA, 22 bp, Homo sapiens
atgtcagtctttctgtctcaga

SEQ ID NO: 8756342 - DNA, 20 bp, Homo sapiens
atgtcaggaagggagtcagg

SEQ ID NO: 8756343 - DNA, 20 bp, Homo sapiens
atgtcaggaagggagtcagg

SEQ ID NO: 8756344 - DNA, 22 bp, Homo sapiens
atgtcagtttcattttaagtca

SEQ ID NO: 8756345 - DNA, 22 bp, Homo sapiens
atgtcagtttcattttaagtca

SEQ ID NO: 8756346 - DNA, 22 bp, Homo sapiens
atgtcagttgctgcttgaggta

SEQ ID NO: 8756347 - DNA, 22 bp, Homo sapiens
atgtgaggtagataggatgcag

SEQ ID NO: 8756348 - DNA, 22 bp, Homo sapiens
atgtgccaatttatagaggctc

SEQ ID NO: 8756349 - DNA, 22 bp, Homo sapiens
atgtgccaatttatagaggctc

SEQ ID NO: 8756350 - DNA, 22 bp, Homo sapiens
atgtgccacatgatattgtctc

SEQ ID NO: 8756351 - DNA, 22 bp, Homo sapiens
atgtgccacatgatattgtctc

SEQ ID NO: 8756352 - DNA, 22 bp, Homo sapiens
atgtgccatctactgtcccaag

SEQ ID NO: 8756353 - DNA, 22 bp, Homo sapiens
atgtgccagtgccaggtctcta

SEQ ID NO: 8756354 - DNA, 22 bp, Homo sapiens
atgtgccaacgtgcaggtttgt

SEQ ID NO: 8756355 - DNA, 22 bp, Homo sapiens
atgtgcgaggtgcttgtcagca

SEQ ID NO: 8756356 - DNA, 19 bp, Homo sapiens
atgtgcccaggggaaagaa

SEQ ID NO: 8756357 - DNA, 22 bp, Homo sapiens
atgtgcttttactccccagagt

SEQ ID NO: 8756358 - DNA, 22 bp, Homo sapiens
atgtggaatgaacaaaggaggc

SEQ ID NO: 8756359 - DNA, 22 bp, Homo sapiens
atgtggatttgggagtgatcag

SEQ ID NO: 8756360 - DNA, 22 bp, Homo sapiens
atgtgctttccaatgctgtagg

SEQ ID NO: 8756361 - DNA, 22 bp, Homo sapiens
atgtgctttctttccaaggggc

SEQ ID NO: 8756362 - DNA, 22 bp, Homo sapiens
atgtgcttttactccccagagt

SEQ ID NO: 8756363 - DNA, 22 bp, Homo sapiens
atgtggcaatggttagcactgt

SEQ ID NO: 8756364 - DNA, 22 bp, Homo sapiens
atgtggccagtcatgtagtaac

SEQ ID NO: 8756365 - DNA, 22 bp, Homo sapiens
atgtggccagtcatgtagtaac

SEQ ID NO: 8756366 - DNA, 22 bp, Homo sapiens
atgtggccagtcatgtagtaac

SEQ ID NO: 8756367 - DNA, 22 bp, Homo sapiens
atgtgcttcaggatgtcagtgt

SEQ ID NO: 8756368 - DNA, 22 bp, Homo sapiens
atgtgcttcaggatgtcagtgt

SEQ ID NO: 8756369 - DNA, 22 bp, Homo sapiens
atgtgcttatggtctctggttg

SEQ ID NO: 8756370 - DNA, 21 bp, Homo sapiens
atgtgcttagctgctggtagt

SEQ ID NO: 8756371 - DNA, 22 bp, Homo sapiens
atgtgctgtaatccattgaagg

SEQ ID NO: 8756372 - DNA, 22 bp, Homo sapiens
atgtgctggctaactggatggg

SEQ ID NO: 8756373 - DNA, 22 bp, Homo sapiens
atgtgctgagtgtgtatataca

SEQ ID NO: 8756374 - DNA, 22 bp, Homo sapiens
atgtgctgagtgtgtatataca

SEQ ID NO: 8756375 - DNA, 22 bp, Homo sapiens
atgtgctcttattaccctgtcg

SEQ ID NO: 8756376 - DNA, 22 bp, Homo sapiens
atgtgctcttattaccctgtcg

SEQ ID NO: 8756377 - DNA, 22 bp, Homo sapiens
atgtgctcaccctatttatgga

SEQ ID NO: 8756378 - DNA, 19 bp, Homo sapiens
atgtgcttgggccatgcta

SEQ ID NO: 8756379 - DNA, 22 bp, Homo sapiens
atgtgcttggacattctaggaa

SEQ ID NO: 8756380 - DNA, 22 bp, Homo sapiens
atgtgctttaaagaagccagct

SEQ ID NO: 8756381 - DNA, 22 bp, Homo sapiens
atgtgcttgtaatgttaaatgt

SEQ ID NO: 8756382 - DNA, 22 bp, Homo sapiens
atgtgctttattaagtaaaaat

SEQ ID NO: 8756383 - DNA, 22 bp, Homo sapiens
atgtgctttaaagaagccagct

SEQ ID NO: 8756384 - DNA, 22 bp, Homo sapiens
atgtgctttaggtttgtttaca

SEQ ID NO: 8756385 - DNA, 22 bp, Homo sapiens
atgtgcttgactactctctatt

SEQ ID NO: 8756386 - DNA, 22 bp, Homo sapiens
atgtgcttgagggaaatcagtt

SEQ ID NO: 8756387 - DNA, 22 bp, Homo sapiens
atgtgcttgaagcctcagagaa

SEQ ID NO: 8756388 - DNA, 22 bp, Homo sapiens
atgtgcttgaagcctcagagaa

SEQ ID NO: 8756389 - DNA, 22 bp, Homo sapiens
atgtgcttccctggatgggtgt

SEQ ID NO: 8756390 - DNA, 22 bp, Homo sapiens
atgtgcttggaaaagcagtggt

SEQ ID NO: 8756391 - DNA, 22 bp, Homo sapiens
atgtgcttgcagatgagcctca

SEQ ID NO: 8756392 - DNA, 22 bp, Homo sapiens
atgttactgtgatcatgatact

SEQ ID NO: 8756393 - DNA, 22 bp, Homo sapiens
atgttacggaatgtcaaggact

SEQ ID NO: 8756394 - DNA, 22 bp, Homo sapiens
atgttagtgaagttgctcaaat

SEQ ID NO: 8756395 - DNA, 22 bp, Homo sapiens
atgttagaaggaatgttaaaag

SEQ ID NO: 8756396 - DNA, 23 bp, Homo sapiens
atgttaaacataactgaagagcc

SEQ ID NO: 8756397 - DNA, 22 bp, Homo sapiens
atgtggctggtgactgccgtac

SEQ ID NO: 8756398 - DNA, 22 bp, Homo sapiens
atgtggctggtagttgacaact

SEQ ID NO: 8756399 - DNA, 22 bp, Homo sapiens
atgtggctggtagttgacaact

SEQ ID NO: 8756400 - DNA, 22 bp, Homo sapiens
atgtggctggtagttgacaact

SEQ ID NO: 8756401 - DNA, 22 bp, Homo sapiens
atgttaaaagtctgagtgggag

SEQ ID NO: 8756402 - DNA, 22 bp, Homo sapiens
atgttaaaagtgaggatggcca

SEQ ID NO: 8756403 - DNA, 23 bp, Homo sapiens
atgttaaacataactgaagagcc

SEQ ID NO: 8756404 - DNA, 22 bp, Homo sapiens
atgtggctgccacctgcctgaa

SEQ ID NO: 8756405 - DNA, 22 bp, Homo sapiens
atgtggctgccacctgcctgaa

SEQ ID NO: 8756406 - DNA, 22 bp, Homo sapiens
atgtggctgatcgcagagctct

SEQ ID NO: 8756407 - DNA, 22 bp, Homo sapiens
atgtggctccttactcatcagc

SEQ ID NO: 8756408 - DNA, 21 bp, Homo sapiens
atgtggctcccttcctcagga

SEQ ID NO: 8756409 - DNA, 22 bp, Homo sapiens
atgtggctcattgtttgcttac

SEQ ID NO: 8756410 - DNA, 22 bp, Homo sapiens
atgtggctcacatagctggaaa

SEQ ID NO: 8756411 - DNA, 22 bp, Homo sapiens
atgtggctcagcaggctcccgt

SEQ ID NO: 8756412 - DNA, 22 bp, Homo sapiens
atgtggctcagcaggctcccgt

SEQ ID NO: 8756413 - DNA, 22 bp, Homo sapiens
atgtggctattttaatgttaat

SEQ ID NO: 8756414 - DNA, 22 bp, Homo sapiens
atgtggctcattgtttgcttac

SEQ ID NO: 8756415 - DNA, 22 bp, Homo sapiens
atgtggctagtggctatgatct

SEQ ID NO: 8756416 - DNA, 22 bp, Homo sapiens
atgtggctattttaatgttaat

SEQ ID NO: 8756417 - DNA, 22 bp, Homo sapiens
atgtggctagtggctatgatct

SEQ ID NO: 8756418 - DNA, 22 bp, Homo sapiens
atgtggctagtggacacagtat

SEQ ID NO: 8756419 - DNA, 18 bp, Homo sapiens
atgtggctagtgctactg

SEQ ID NO: 8756420 - DNA, 18 bp, Homo sapiens
atgtggctagtgcaactg

SEQ ID NO: 8756421 - DNA, 23 bp, Homo sapiens
atgtggctagtgagaccaagaaa

SEQ ID NO: 8756422 - DNA, 22 bp, Homo sapiens
atgtggctagtcctctgcggca

SEQ ID NO: 8756423 - DNA, 22 bp, Homo sapiens
atgtggctagtgcagatgaata

SEQ ID NO: 8756424 - DNA, 22 bp, Homo sapiens
atgtggctagtgcaactgagaa

SEQ ID NO: 8756425 - DNA, 22 bp, Homo sapiens
atgtggctagtgcagatgaata

SEQ ID NO: 8756426 - DNA, 18 bp, Homo sapiens
atgtggctagtgcaactg

SEQ ID NO: 8756427 - DNA, 21 bp, Homo sapiens
atgtggccattgtagtccacg

SEQ ID NO: 8756428 - DNA, 22 bp, Homo sapiens
atgtggcctagtatagaaatga

SEQ ID NO: 8756429 - DNA, 22 bp, Homo sapiens
atgtggctagtcctctgcggca

SEQ ID NO: 8756430 - DNA, 22 bp, Homo sapiens
atgtggctagtcctctgcggca

SEQ ID NO: 8756431 - DNA, 22 bp, Homo sapiens
atgtggctagtccaattaatga

SEQ ID NO: 8756432 - DNA, 22 bp, Homo sapiens
atgtggctagggaataaaatat

SEQ ID NO: 8756433 - DNA, 17 bp, Homo sapiens
atgtggctaagctgctg

SEQ ID NO: 8756434 - DNA, 22 bp, Homo sapiens
atgtggccttaggttctagtgg

SEQ ID NO: 8756435 - DNA, 22 bp, Homo sapiens
atgtggctagtccaattaatga

SEQ ID NO: 8756436 - DNA, 22 bp, Homo sapiens
gagtgcagtatcttctgtgtcc

SEQ ID NO: 8756437 - DNA, 22 bp, Homo sapiens
gaggttcagtaaggaatactga

SEQ ID NO: 8756438 - DNA, 22 bp, Homo sapiens
gaggttcattcagctctgtcac

SEQ ID NO: 8756439 - DNA, 22 bp, Homo sapiens
gaggttcagtcctgctctgtca

SEQ ID NO: 8756440 - DNA, 22 bp, Homo sapiens
gaggttctgggggtctgcctgg

SEQ ID NO: 8756441 - DNA, 22 bp, Homo sapiens
gaggttcgatacagcgtattta

SEQ ID NO: 8756442 - DNA, 22 bp, Homo sapiens
gaggttctgggggtctgcctgg

SEQ ID NO: 8756443 - DNA, 22 bp, Homo sapiens
gaggttccagacagcttaggga

SEQ ID NO: 8756444 - DNA, 22 bp, Homo sapiens
gaggttagaggtcagtgcagtc

SEQ ID NO: 8756445 - DNA, 22 bp, Homo sapiens
atgttatgacaagcatgacaga

SEQ ID NO: 8756446 - DNA, 22 bp, Homo sapiens
atgttataaatagagacactgg

SEQ ID NO: 8756447 - DNA, 22 bp, Homo sapiens
atgttatagttataaaatgagg

SEQ ID NO: 8756448 - DNA, 22 bp, Homo sapiens
gccatcatatcccctgtgacct

SEQ ID NO: 8756449 - DNA, 22 bp, Homo sapiens
gccatcatatcccctgtgacct

SEQ ID NO: 8756450 - DNA, 22 bp, Homo sapiens
gccatcatatcccctgtgacct

SEQ ID NO: 8756451 - DNA, 22 bp, Homo sapiens
gccatcatatcccctgtgacct

SEQ ID NO: 8756452 - DNA, 22 bp, Homo sapiens
gccaggtggctgagcagctgca

SEQ ID NO: 8756453 - DNA, 22 bp, Homo sapiens
gccaggtggctgagcagctgca

SEQ ID NO: 8756454 - DNA, 22 bp, Homo sapiens
atttatgcatcccagcatgtga

SEQ ID NO: 8756455 - DNA, 22 bp, Homo sapiens
atttatgcatcccagcatgtga

SEQ ID NO: 8756456 - DNA, 22 bp, Homo sapiens
atttatgagctgaaccatgaaa

SEQ ID NO: 8756457 - DNA, 22 bp, Homo sapiens
atttatgactggtgaatagaac

SEQ ID NO: 8756458 - DNA, 22 bp, Homo sapiens
atttatgactggtgaatagaac

SEQ ID NO: 8756459 - DNA, 22 bp, Homo sapiens
atttatgatagctgcattaaag

SEQ ID NO: 8756460 - DNA, 22 bp, Homo sapiens
atttatgtatctgtgtagatca

SEQ ID NO: 8756461 - DNA, 20 bp, Homo sapiens
atttatgtatagcttgttgt

SEQ ID NO: 8756462 - DNA, 22 bp, Homo sapiens
atttattaagcatctgctatgt

SEQ ID NO: 8756463 - DNA, 22 bp, Homo sapiens
atttataacgtgcagccagggt

SEQ ID NO: 8756464 - DNA, 21 bp, Homo sapiens
atttagaaggaaattttgcaa

SEQ ID NO: 8756465 - DNA, 22 bp, Homo sapiens
atttagaagttggagggcaaga

SEQ ID NO: 8756466 - DNA, 22 bp, Homo sapiens
gccagctggagactggcagggg

SEQ ID NO: 8756467 - DNA, 22 bp, Homo sapiens
gccagctggagactggcagggg

SEQ ID NO: 8756468 - DNA, 22 bp, Homo sapiens
gccagctgcttctccagaattt

SEQ ID NO: 8756469 - DNA, 22 bp, Homo sapiens
atttatgacagaagatatgctg

SEQ ID NO: 8756470 - DNA, 18 bp, Homo sapiens
atttatcctttgtattac

SEQ ID NO: 8756471 - DNA, 18 bp, Homo sapiens
atttatcctttgtattac

SEQ ID NO: 8756472 - DNA, 22 bp, Homo sapiens
atttatgacaaccaaagagtga

SEQ ID NO: 8756473 - DNA, 22 bp, Homo sapiens
atttatcaccagttagctgact

SEQ ID NO: 8756474 - DNA, 22 bp, Homo sapiens
atttatcaccagttagctgact

SEQ ID NO: 8756475 - DNA, 22 bp, Homo sapiens
atttatcaccagttagctgact

SEQ ID NO: 8756476 - DNA, 22 bp, Homo sapiens
atttatcaccagttagctgact

SEQ ID NO: 8756477 - DNA, 22 bp, Homo sapiens
atttatagggcattgaaaactg

SEQ ID NO: 8756478 - DNA, 22 bp, Homo sapiens
atttatattttgggagctcctg

SEQ ID NO: 8756479 - DNA, 20 bp, Homo sapiens
attgtacttctgttgatggt

SEQ ID NO: 8756480 - DNA, 19 bp, Homo sapiens
attgtacattgagtttggc

SEQ ID NO: 8756481 - DNA, 22 bp, Homo sapiens
attgtacatgcagtgagtcatc

SEQ ID NO: 8756482 - DNA, 22 bp, Homo sapiens
gccagagtgatgtaacatatat

SEQ ID NO: 8756483 - DNA, 20 bp, Homo sapiens
gccagagttatgatgagagg

SEQ ID NO: 8756484 - DNA, 22 bp, Homo sapiens
gccagccaagattgagaaggta

SEQ ID NO: 8756485 - DNA, 22 bp, Homo sapiens
gccagccaagattgagaaggta

SEQ ID NO: 8756486 - DNA, 22 bp, Homo sapiens
gccagccacaagggaggcttgt

SEQ ID NO: 8756487 - DNA, 22 bp, Homo sapiens
gccagccacaagggaggcttgt

SEQ ID NO: 8756488 - DNA, 22 bp, Homo sapiens
gccagccacgttagactggccc

SEQ ID NO: 8756489 - DNA, 22 bp, Homo sapiens
gccagccacgttagactggccc

SEQ ID NO: 8756490 - DNA, 22 bp, Homo sapiens
gccagccacaagggaggcttgt

SEQ ID NO: 8756491 - DNA, 22 bp, Homo sapiens
attgtacatatgatgtatgtaa

SEQ ID NO: 8756492 - DNA, 22 bp, Homo sapiens
attgtacatgcagtgagtcatc

SEQ ID NO: 8756493 - DNA, 22 bp, Homo sapiens
attgtacataaaatgtatgtct

SEQ ID NO: 8756494 - DNA, 22 bp, Homo sapiens
attgtacaggttggaggaagtg

SEQ ID NO: 8756495 - DNA, 20 bp, Homo sapiens
gcatggcatgtagtgaagtg

SEQ ID NO: 8756496 - DNA, 22 bp, Homo sapiens
gcatggcagtgaggatggtgct

SEQ ID NO: 8756497 - DNA, 22 bp, Homo sapiens
gcatggcatttgaaggtagaag

SEQ ID NO: 8756498 - DNA, 22 bp, Homo sapiens
attgtacactagtggcagcagt

SEQ ID NO: 8756499 - DNA, 22 bp, Homo sapiens
attgtacagacatgggaaacaa

SEQ ID NO: 8756500 - DNA, 22 bp, Homo sapiens
attgtacagatgaacctcactc

SEQ ID NO: 8756501 - DNA, 22 bp, Homo sapiens
gccagccagaaacgtcacactg

SEQ ID NO: 8756502 - DNA, 22 bp, Homo sapiens
gccagccacttcccagactggc

SEQ ID NO: 8756503 - DNA, 22 bp, Homo sapiens
gccagccacttcccagactggc

SEQ ID NO: 8756504 - DNA, 23 bp, Homo sapiens
gccagccagaatttctccactgt

SEQ ID NO: 8756505 - DNA, 22 bp, Homo sapiens
gccagccacttcccagactggc

SEQ ID NO: 8756506 - DNA, 22 bp, Homo sapiens
gccagccacttcagctatggct

SEQ ID NO: 8756507 - DNA, 22 bp, Homo sapiens
gccagccacgttagactggccc

SEQ ID NO: 8756508 - DNA, 22 bp, Homo sapiens
gccagccacgttagactggccc

SEQ ID NO: 8756509 - DNA, 22 bp, Homo sapiens
gccagccacttcagctatggct

SEQ ID NO: 8756510 - DNA, 22 bp, Homo sapiens
gccagccagagaggcatggtta

SEQ ID NO: 8756511 - DNA, 22 bp, Homo sapiens
gccagccagagaggcatggtta

SEQ ID NO: 8756512 - DNA, 22 bp, Homo sapiens
gccagccagagaggcatggtta

SEQ ID NO: 8756513 - DNA, 22 bp, Homo sapiens
gccagccagagaggcatggtta

SEQ ID NO: 8756514 - DNA, 22 bp, Homo sapiens
gccagccagagtggctgtgtgt

SEQ ID NO: 8756515 - DNA, 22 bp, Homo sapiens
gccagccagggaagggagagac

SEQ ID NO: 8756516 - DNA, 22 bp, Homo sapiens
gccagccagggaagggagagac

SEQ ID NO: 8756517 - DNA, 22 bp, Homo sapiens
gccagccagggaagggagagac

SEQ ID NO: 8756518 - DNA, 22 bp, Homo sapiens
gccagctgctggaacagcgcga

SEQ ID NO: 8756519 - DNA, 22 bp, Homo sapiens
gccagctgctcgcgtagggtag

SEQ ID NO: 8756520 - DNA, 20 bp, Homo sapiens
gccagctgcccttccaccct

SEQ ID NO: 8756521 - DNA, 22 bp, Homo sapiens
gccagctgccctctgctggtcc

SEQ ID NO: 8756522 - DNA, 22 bp, Homo sapiens
gccagctgccctctgctggtcc

SEQ ID NO: 8756523 - DNA, 22 bp, Homo sapiens
gccagctgccaagttgtgagat

SEQ ID NO: 8756524 - DNA, 22 bp, Homo sapiens
gccagctgcatctcctgggctg

SEQ ID NO: 8756525 - DNA, 21 bp, Homo sapiens
gccagctgcagggcttccttg

SEQ ID NO: 8756526 - DNA, 22 bp, Homo sapiens
gccagccagtttgctgatggct

SEQ ID NO: 8756527 - DNA, 22 bp, Homo sapiens
gccagccagtttgctgatggct

SEQ ID NO: 8756528 - DNA, 22 bp, Homo sapiens
gccagccagggaagggagagac

SEQ ID NO: 8756529 - DNA, 22 bp, Homo sapiens
gccagccagtttgctgatggct

SEQ ID NO: 8756530 - DNA, 22 bp, Homo sapiens
gccagccagtttgctgatggct

SEQ ID NO: 8756531 - DNA, 22 bp, Homo sapiens
atttcttccattgcctcttcaa

SEQ ID NO: 8756532 - DNA, 22 bp, Homo sapiens
atttcttcaggtcagaaataga

SEQ ID NO: 8756533 - DNA, 22 bp, Homo sapiens
atttcttcaggtcagaaataga

SEQ ID NO: 8756534 - DNA, 22 bp, Homo sapiens
atttcttatgaatattgactgt

SEQ ID NO: 8756535 - DNA, 22 bp, Homo sapiens
atttcttatgaatattgactgt

SEQ ID NO: 8756536 - DNA, 22 bp, Homo sapiens
atttcttatgaatattgactgt

SEQ ID NO: 8756537 - DNA, 22 bp, Homo sapiens
atttctgtttgctactataagt

SEQ ID NO: 8756538 - DNA, 22 bp, Homo sapiens
atttcttaaaacttcagggaga

SEQ ID NO: 8756539 - DNA, 22 bp, Homo sapiens
atttcttaaaacttcagggaga

SEQ ID NO: 8756540 - DNA, 22 bp, Homo sapiens
atttctgtttgctactataagt

SEQ ID NO: 8756541 - DNA, 22 bp, Homo sapiens
atttcttatctgaggtctacat

SEQ ID NO: 8756542 - DNA, 22 bp, Homo sapiens
atttcttatctgaggtctacat

SEQ ID NO: 8756543 - DNA, 22 bp, Homo sapiens
atttcttacataacaaattgtt

SEQ ID NO: 8756544 - DNA, 22 bp, Homo sapiens
atttcttacataacaaattgtt

SEQ ID NO: 8756545 - DNA, 22 bp, Homo sapiens
atttctgttgcttataaattac

SEQ ID NO: 8756546 - DNA, 22 bp, Homo sapiens
gccctgtgcaggtgtgcagcag

SEQ ID NO: 8756547 - DNA, 22 bp, Homo sapiens
gccctgtgcaggtgtgcagcag

SEQ ID NO: 8756548 - DNA, 22 bp, Homo sapiens
gccctgtgcaggtgtgcagcag

SEQ ID NO: 8756549 - DNA, 22 bp, Homo sapiens
gccctgtgccagtcacgctgtg

SEQ ID NO: 8756550 - DNA, 22 bp, Homo sapiens
gccctgtgagtcatgcggcaga

SEQ ID NO: 8756551 - DNA, 22 bp, Homo sapiens
gccctgtgagtcatgcggcaga

SEQ ID NO: 8756552 - DNA, 22 bp, Homo sapiens
gccctggttttagaggagcagg

SEQ ID NO: 8756553 - DNA, 22 bp, Homo sapiens
gccctgtcctcctgactgagtg

SEQ ID NO: 8756554 - DNA, 22 bp, Homo sapiens
gccctgtcggaactgcgacctc

SEQ ID NO: 8756555 - DNA, 22 bp, Homo sapiens
gccctgtgagattagaacagca

SEQ ID NO: 8756556 - DNA, 22 bp, Homo sapiens
gccctggtgtgcccagcatggg

SEQ ID NO: 8756557 - DNA, 23 bp, Homo sapiens
atttcctaaaagataatcattac

SEQ ID NO: 8756558 - DNA, 23 bp, Homo sapiens
atttcccattgtgtcagcagagc

SEQ ID NO: 8756559 - DNA, 22 bp, Homo sapiens
atttcccatgtgaatcaattgg

SEQ ID NO: 8756560 - DNA, 22 bp, Homo sapiens
atttccctccagggaaagctta

SEQ ID NO: 8756561 - DNA, 22 bp, Homo sapiens
gccctgggctccctgctccaca

SEQ ID NO: 8756562 - DNA, 17 bp, Homo sapiens
gccctgcctgctgccct

SEQ ID NO: 8756563 - DNA, 17 bp, Homo sapiens
gccctgcctgctgccct

SEQ ID NO: 8756564 - DNA, 22 bp, Homo sapiens
atttcccactctactacatgct

SEQ ID NO: 8756565 - DNA, 22 bp, Homo sapiens
atttcccactcaggccgcggcg

SEQ ID NO: 8756566 - DNA, 22 bp, Homo sapiens
atttcccaatacgctaagtgga

SEQ ID NO: 8756567 - DNA, 22 bp, Homo sapiens
atttcccagataaacagctgga

SEQ ID NO: 8756568 - DNA, 22 bp, Homo sapiens
gcccagtggcatcttcactgct

SEQ ID NO: 8756569 - DNA, 22 bp, Homo sapiens
gcccagtgctgagggtgctgct

SEQ ID NO: 8756570 - DNA, 22 bp, Homo sapiens
gcccagtgctgagggtgctgct

SEQ ID NO: 8756571 - DNA, 22 bp, Homo sapiens
gcccagtgggaagctaaggtgg

SEQ ID NO: 8756572 - DNA, 22 bp, Homo sapiens
atttcccaatacgctaagtgga

SEQ ID NO: 8756573 - DNA, 22 bp, Homo sapiens
atttcccaatacgctaagtgga

SEQ ID NO: 8756574 - DNA, 22 bp, Homo sapiens
atttcccagggcctgggatttg

SEQ ID NO: 8756575 - DNA, 22 bp, Homo sapiens
atttcccagggccctcatagtt

SEQ ID NO: 8756576 - DNA, 22 bp, Homo sapiens
atttcccaggactagaaatata

SEQ ID NO: 8756577 - DNA, 22 bp, Homo sapiens
atttcccaggactagaaatata

SEQ ID NO: 8756578 - DNA, 22 bp, Homo sapiens
atttcccagggccctcatagtt

SEQ ID NO: 8756579 - DNA, 17 bp, Homo sapiens
atttcccagcagtgcta

SEQ ID NO: 8756580 - DNA, 17 bp, Homo sapiens
atttcccagcagtgcta

SEQ ID NO: 8756581 - DNA, 22 bp, Homo sapiens
atttcccaggactagaaatata

SEQ ID NO: 8756582 - DNA, 22 bp, Homo sapiens
atttcccaggactagaaatata

SEQ ID NO: 8756583 - DNA, 22 bp, Homo sapiens
atttcccagctttgatcagttt

SEQ ID NO: 8756584 - DNA, 22 bp, Homo sapiens
atttcccagctttgatcagttt

SEQ ID NO: 8756585 - DNA, 22 bp, Homo sapiens
atttcaacgttagatgtaatag

SEQ ID NO: 8756586 - DNA, 22 bp, Homo sapiens
atttcaacgttagatgtaatag

SEQ ID NO: 8756587 - DNA, 22 bp, Homo sapiens
atttcaacattctcagttgtag

SEQ ID NO: 8756588 - DNA, 19 bp, Homo sapiens
atttcaagaggtttattgg

SEQ ID NO: 8756589 - DNA, 19 bp, Homo sapiens
atttcaagaggtttattgg

SEQ ID NO: 8756590 - DNA, 22 bp, Homo sapiens
atttcaagaaggcagcagtggt

SEQ ID NO: 8756591 - DNA, 22 bp, Homo sapiens
atttcaaggctattaatataaa

SEQ ID NO: 8756592 - DNA, 22 bp, Homo sapiens
atttcaaggctattaatataaa

SEQ ID NO: 8756593 - DNA, 22 bp, Homo sapiens
atttcaaggctacagaaacctt

SEQ ID NO: 8756594 - DNA, 22 bp, Homo sapiens
atttcaaggctacagaaacctt

SEQ ID NO: 8756595 - DNA, 22 bp, Homo sapiens
atttcaaggctacagaaacctt

SEQ ID NO: 8756596 - DNA, 22 bp, Homo sapiens
atttcaaggactacttttcaat

SEQ ID NO: 8756597 - DNA, 19 bp, Homo sapiens
atttcaagaggtttattgg

SEQ ID NO: 8756598 - DNA, 22 bp, Homo sapiens
atttcaaggactacttttcaat

SEQ ID NO: 8756599 - DNA, 22 bp, Homo sapiens
atttcaaggactacttttcaat

SEQ ID NO: 8756600 - DNA, 22 bp, Homo sapiens
atttcaagtgttgagctcataa

SEQ ID NO: 8756601 - DNA, 22 bp, Homo sapiens
atttcaaggggtccttgcttgg

SEQ ID NO: 8756602 - DNA, 22 bp, Homo sapiens
atttcaaggggtccttgcttgg

SEQ ID NO: 8756603 - DNA, 22 bp, Homo sapiens
atttcaagtccaagtcttgggt

SEQ ID NO: 8756604 - DNA, 22 bp, Homo sapiens
gcccaggagttgaatgcagcag

SEQ ID NO: 8756605 - DNA, 19 bp, Homo sapiens
gcccaggggcccgatgctg

SEQ ID NO: 8756606 - DNA, 19 bp, Homo sapiens
gcccaggggcccgatgctg

SEQ ID NO: 8756607 - DNA, 22 bp, Homo sapiens
gcccagtgccctagaatgcact

SEQ ID NO: 8756608 - DNA, 21 bp, Homo sapiens
gcccagtgatttcttcacagt

SEQ ID NO: 8756609 - DNA, 22 bp, Homo sapiens
gcccagtagttcaaggttgcag

SEQ ID NO: 8756610 - DNA, 22 bp, Homo sapiens
gcccagtagttcaaggttgcag

SEQ ID NO: 8756611 - DNA, 22 bp, Homo sapiens
gcccagggtgcttagaacccat

SEQ ID NO: 8756612 - DNA, 22 bp, Homo sapiens
gcccaggtgccctctgccttac

SEQ ID NO: 8756613 - DNA, 22 bp, Homo sapiens
gcccaggtgccctctgccttac

SEQ ID NO: 8756614 - DNA, 22 bp, Homo sapiens
gcccaggttggagagcagtggc

SEQ ID NO: 8756615 - DNA, 22 bp, Homo sapiens
gcccaggtttcatctgctccgt

SEQ ID NO: 8756616 - DNA, 22 bp, Homo sapiens
gcccaggttggagagcagtggc

SEQ ID NO: 8756617 - DNA, 22 bp, Homo sapiens
gcccagggtgcttagaacccat

SEQ ID NO: 8756618 - DNA, 22 bp, Homo sapiens
gcccagggtgaagtgcagttgt

SEQ ID NO: 8756619 - DNA, 22 bp, Homo sapiens
gcccagggtgaagtgcagttgt

SEQ ID NO: 8756620 - DNA, 22 bp, Homo sapiens
gcccagggtgaagtgcagttgt

SEQ ID NO: 8756621 - DNA, 22 bp, Homo sapiens
gcccagggtctacaaaaatatt

SEQ ID NO: 8756622 - DNA, 22 bp, Homo sapiens
gccatcctgtatcacaagatgt

SEQ ID NO: 8756623 - DNA, 22 bp, Homo sapiens
gccatctgcgcggtgtccagct

SEQ ID NO: 8756624 - DNA, 22 bp, Homo sapiens
gccatcctggattcagaccaaa

SEQ ID NO: 8756625 - DNA, 22 bp, Homo sapiens
gccatcatatcccctgtgacct

SEQ ID NO: 8756626 - DNA, 20 bp, Homo sapiens
gccatccagcctcccaggag

SEQ ID NO: 8756627 - DNA, 22 bp, Homo sapiens
gccatcatcaagaatgtacagc

SEQ ID NO: 8756628 - DNA, 19 bp, Homo sapiens
gccatcccaagcattttgg

SEQ ID NO: 8756629 - DNA, 23 bp, Homo sapiens
gccatcctaaaacccctgtctgt

SEQ ID NO: 8756630 - DNA, 19 bp, Homo sapiens
gccatcctgcccttgacat

SEQ ID NO: 8756631 - DNA, 22 bp, Homo sapiens
gccatcttgagccaggaagtga

SEQ ID NO: 8756632 - DNA, 22 bp, Homo sapiens
gccatcttcaacatcagaagtt

SEQ ID NO: 8756633 - DNA, 22 bp, Homo sapiens
gccatgaaggatgttgtttcag

SEQ ID NO: 8756634 - DNA, 22 bp, Homo sapiens
gccatgactctccataccaaag

SEQ ID NO: 8756635 - DNA, 22 bp, Homo sapiens
gccatgactctccataccaaag

SEQ ID NO: 8756636 - DNA, 19 bp, Homo sapiens
atttattgtatgattccat

SEQ ID NO: 8756637 - DNA, 19 bp, Homo sapiens
atttattgtatgattccat

SEQ ID NO: 8756638 - DNA, 22 bp, Homo sapiens
atttcaacagagtttgaaggca

SEQ ID NO: 8756639 - DNA, 22 bp, Homo sapiens
atttcaacacttttggaattag

SEQ ID NO: 8756640 - DNA, 22 bp, Homo sapiens
atttcaacacttttggaattag

SEQ ID NO: 8756641 - DNA, 19 bp, Homo sapiens
atttattgtatgattccat

SEQ ID NO: 8756642 - DNA, 22 bp, Homo sapiens
atttattggtttgcatggtgaa

SEQ ID NO: 8756643 - DNA, 22 bp, Homo sapiens
gccatggcccataccaggtgca

SEQ ID NO: 8756644 - DNA, 22 bp, Homo sapiens
gccatggcccataccaggtgca

SEQ ID NO: 8756645 - DNA, 22 bp, Homo sapiens
gccatgcttggtatgctgtgag

SEQ ID NO: 8756646 - DNA, 22 bp, Homo sapiens
gccatgctggaggcttcgattt

SEQ ID NO: 8756647 - DNA, 22 bp, Homo sapiens
gccatgcagcttattaaagtgg

SEQ ID NO: 8756648 - DNA, 22 bp, Homo sapiens
gccatgcagcttattaaagtgg

SEQ ID NO: 8756649 - DNA, 22 bp, Homo sapiens
gccatgcaatggaataaaatca

SEQ ID NO: 8756650 - DNA, 22 bp, Homo sapiens
caaagaagagatttacagagct

SEQ ID NO: 8756651 - DNA, 22 bp, Homo sapiens
caaagaagagatttacagagct

SEQ ID NO: 8756652 - DNA, 22 bp, Homo sapiens
caaagaaggaactataatccca

SEQ ID NO: 8756653 - DNA, 22 bp, Homo sapiens
caaagaaggaactataatccca

SEQ ID NO: 8756654 - DNA, 22 bp, Homo sapiens
caaagaatagtgagaagatgta

SEQ ID NO: 8756655 - DNA, 22 bp, Homo sapiens
caaagaatagcatggcatttgt

SEQ ID NO: 8756656 - DNA, 22 bp, Homo sapiens
caaagaatcactcatctttagc

SEQ ID NO: 8756657 - DNA, 22 bp, Homo sapiens
caaagaatcactcatctttagc

SEQ ID NO: 8756658 - DNA, 22 bp, Homo sapiens
caaagaatgagtgagtacataa

SEQ ID NO: 8756659 - DNA, 22 bp, Homo sapiens
caaagaatgagtgagtacataa

SEQ ID NO: 8756660 - DNA, 22 bp, Homo sapiens
caaagaatgagtgagtacataa

SEQ ID NO: 8756661 - DNA, 22 bp, Homo sapiens
caaagacacgggaaacaacgtt

SEQ ID NO: 8756662 - DNA, 22 bp, Homo sapiens
caaagacacgggaaacaacgtt

SEQ ID NO: 8756663 - DNA, 22 bp, Homo sapiens
gctctgctgtcttcttgcaggc

SEQ ID NO: 8756664 - DNA, 22 bp, Homo sapiens
gctctgctgtgtttgttcagca

SEQ ID NO: 8756665 - DNA, 22 bp, Homo sapiens
gctctgctgtggaatcctctcc

SEQ ID NO: 8756666 - DNA, 22 bp, Homo sapiens
gctctgctgggtgggcagttat

SEQ ID NO: 8756667 - DNA, 22 bp, Homo sapiens
gctctgagattgagcctttggt

SEQ ID NO: 8756668 - DNA, 22 bp, Homo sapiens
gctctgagagtgggtgattctg

SEQ ID NO: 8756669 - DNA, 22 bp, Homo sapiens
gctctgagagtgggtgattctg

SEQ ID NO: 8756670 - DNA, 22 bp, Homo sapiens
caaagaccatgtggcctgaaaa

SEQ ID NO: 8756671 - DNA, 22 bp, Homo sapiens
caaagactgcataacacatgaa

SEQ ID NO: 8756672 - DNA, 20 bp, Homo sapiens
caaagacatgctaggggtgg

SEQ ID NO: 8756673 - DNA, 22 bp, Homo sapiens
gctcccaggatgaggagccagg

SEQ ID NO: 8756674 - DNA, 22 bp, Homo sapiens
gctcccaggatgaggagccagg

SEQ ID NO: 8756675 - DNA, 22 bp, Homo sapiens
gctccagggaacagaatgtact

SEQ ID NO: 8756676 - DNA, 22 bp, Homo sapiens
caaaagcagttctatctgagtt

SEQ ID NO: 8756677 - DNA, 22 bp, Homo sapiens
caaaagcagcaagtttatatgt

SEQ ID NO: 8756678 - DNA, 22 bp, Homo sapiens
gctcccaggcatggaggtaatt

SEQ ID NO: 8756679 - DNA, 22 bp, Homo sapiens
gctcccaggatgaggagccagg

SEQ ID NO: 8756680 - DNA, 22 bp, Homo sapiens
gctcccagggacactggccact

SEQ ID NO: 8756681 - DNA, 22 bp, Homo sapiens
gctcccagggacactggccact

SEQ ID NO: 8756682 - DNA, 22 bp, Homo sapiens
gctcccagggacactggccact

SEQ ID NO: 8756683 - DNA, 22 bp, Homo sapiens
gctccccaggctggtcccctcg

SEQ ID NO: 8756684 - DNA, 22 bp, Homo sapiens
gctccccagcttagccctggct

SEQ ID NO: 8756685 - DNA, 22 bp, Homo sapiens
gctccccagcttagccctggct

SEQ ID NO: 8756686 - DNA, 22 bp, Homo sapiens
gctccccaaaagctccaggaaa

SEQ ID NO: 8756687 - DNA, 22 bp, Homo sapiens
gctccccaaaagctccaggaaa

SEQ ID NO: 8756688 - DNA, 22 bp, Homo sapiens
gctcccagtctgatggaggaga

SEQ ID NO: 8756689 - DNA, 22 bp, Homo sapiens
gctcccagggcagcgcagaaga

SEQ ID NO: 8756690 - DNA, 22 bp, Homo sapiens
gctcccagggcagcgcagaaga

SEQ ID NO: 8756691 - DNA, 22 bp, Homo sapiens
gctcccagggaccgcagggcag

SEQ ID NO: 8756692 - DNA, 22 bp, Homo sapiens
gctcccagtctgatggaggaga

SEQ ID NO: 8756693 - DNA, 22 bp, Homo sapiens
gctcccaggttcttgggccttg

SEQ ID NO: 8756694 - DNA, 22 bp, Homo sapiens
gctcccaggttcttgggccttg

SEQ ID NO: 8756695 - DNA, 22 bp, Homo sapiens
gctcaaatttcagactcatgaa

SEQ ID NO: 8756696 - DNA, 22 bp, Homo sapiens
gctcaaatgtcatggggagcct

SEQ ID NO: 8756697 - DNA, 22 bp, Homo sapiens
gctcaaatcccagcgggctcct

SEQ ID NO: 8756698 - DNA, 22 bp, Homo sapiens
gctcagagaaattataggaatt

SEQ ID NO: 8756699 - DNA, 22 bp, Homo sapiens
gctcagagaaattataggaatt

SEQ ID NO: 8756700 - DNA, 22 bp, Homo sapiens
gctcagagaaaactggggcttg

SEQ ID NO: 8756701 - DNA, 22 bp, Homo sapiens
gctcagagaaaactggggcttg

SEQ ID NO: 8756702 - DNA, 22 bp, Homo sapiens
attttgctggtctgaattactt

SEQ ID NO: 8756703 - DNA, 22 bp, Homo sapiens
attttgctgtggtacattagga

SEQ ID NO: 8756704 - DNA, 22 bp, Homo sapiens
attttgctacagttggtggaaa

SEQ ID NO: 8756705 - DNA, 22 bp, Homo sapiens
attttgctacagttggtggaaa

SEQ ID NO: 8756706 - DNA, 22 bp, Homo sapiens
attttgctgctatgccttgcaa

SEQ ID NO: 8756707 - DNA, 22 bp, Homo sapiens
attttgatgtatctttgtagct

SEQ ID NO: 8756708 - DNA, 22 bp, Homo sapiens
attttgaatcaccttggaagaa

SEQ ID NO: 8756709 - DNA, 22 bp, Homo sapiens
attttgaatcaccttggaagaa

SEQ ID NO: 8756710 - DNA, 22 bp, Homo sapiens
attttgaagggaattgaagttc

SEQ ID NO: 8756711 - DNA, 22 bp, Homo sapiens
gccttctccctaaccaaatcct

SEQ ID NO: 8756712 - DNA, 17 bp, Homo sapiens
gccttccttcctccaca

SEQ ID NO: 8756713 - DNA, 17 bp, Homo sapiens
gccttccttcctccaca

SEQ ID NO: 8756714 - DNA, 17 bp, Homo sapiens
gccttccttcctccaca

SEQ ID NO: 8756715 - DNA, 17 bp, Homo sapiens
gccttccttcctccaca

SEQ ID NO: 8756716 - DNA, 22 bp, Homo sapiens
gccttccttttaccaccagcca

SEQ ID NO: 8756717 - DNA, 22 bp, Homo sapiens
gccttccttttaccaccagcca

SEQ ID NO: 8756718 - DNA, 22 bp, Homo sapiens
gccttccttttaccaccagcca

SEQ ID NO: 8756719 - DNA, 22 bp, Homo sapiens
attttgatgctatctaatgaat

SEQ ID NO: 8756720 - DNA, 22 bp, Homo sapiens
attttgatgctatctaatgaat

SEQ ID NO: 8756721 - DNA, 22 bp, Homo sapiens
attttgatgctatctaatgaat

SEQ ID NO: 8756722 - DNA, 22 bp, Homo sapiens
attttgatgctatctaatgaat

SEQ ID NO: 8756723 - DNA, 22 bp, Homo sapiens
gctcagagaatttactgctgcc

SEQ ID NO: 8756724 - DNA, 22 bp, Homo sapiens
gctcagagaatttactgctgcc

SEQ ID NO: 8756725 - DNA, 22 bp, Homo sapiens
gctcagagaatcagcagacacc

SEQ ID NO: 8756726 - DNA, 22 bp, Homo sapiens
gctcagagaagttaaggaattt

SEQ ID NO: 8756727 - DNA, 22 bp, Homo sapiens
gctcagagaagttaaggaattt

SEQ ID NO: 8756728 - DNA, 22 bp, Homo sapiens
gctcagagaaattataggaatt

SEQ ID NO: 8756729 - DNA, 22 bp, Homo sapiens
gctcagagaagttgtgcctggc

SEQ ID NO: 8756730 - DNA, 22 bp, Homo sapiens
gctcagagaagttgtgcctggc

SEQ ID NO: 8756731 - DNA, 19 bp, Homo sapiens
gctcagagacacctgttgc

SEQ ID NO: 8756732 - DNA, 22 bp, Homo sapiens
gctcagagagaggatatgttat

SEQ ID NO: 8756733 - DNA, 22 bp, Homo sapiens
gctcagagagaggctcaccatt

SEQ ID NO: 8756734 - DNA, 19 bp, Homo sapiens
gctcagagacacctgttgc

SEQ ID NO: 8756735 - DNA, 19 bp, Homo sapiens
gctcagagacacctgttgc

SEQ ID NO: 8756736 - DNA, 22 bp, Homo sapiens
caaaagcagcaagtttatatgt

SEQ ID NO: 8756737 - DNA, 20 bp, Homo sapiens
caaaagcaatgaagttatga

SEQ ID NO: 8756738 - DNA, 20 bp, Homo sapiens
caaaagcaatgaagttatga

SEQ ID NO: 8756739 - DNA, 20 bp, Homo sapiens
caaaagcaatgaagttatga

SEQ ID NO: 8756740 - DNA, 22 bp, Homo sapiens
caaaagcaaagtccctgaatgt

SEQ ID NO: 8756741 - DNA, 22 bp, Homo sapiens
caaaagcaaagtccctgaatgt

SEQ ID NO: 8756742 - DNA, 22 bp, Homo sapiens
caaaagaagctcttggggctag

SEQ ID NO: 8756743 - DNA, 22 bp, Homo sapiens
caaaagaagctcttggggctag

SEQ ID NO: 8756744 - DNA, 22 bp, Homo sapiens
caaaagaagctcttggggctag

SEQ ID NO: 8756745 - DNA, 22 bp, Homo sapiens
caaaagaagctcttggggctag

SEQ ID NO: 8756746 - DNA, 21 bp, Homo sapiens
caaaagagactgattcttgga

SEQ ID NO: 8756747 - DNA, 21 bp, Homo sapiens
caaaagagactgattcttgga

SEQ ID NO: 8756748 - DNA, 21 bp, Homo sapiens
caaaagagactgattcttgga

SEQ ID NO: 8756749 - DNA, 21 bp, Homo sapiens
caaaagagactgattcttgga

SEQ ID NO: 8756750 - DNA, 22 bp, Homo sapiens
caaaagatacttgcatctaact

SEQ ID NO: 8756751 - DNA, 22 bp, Homo sapiens
caaaagatacttgcatctaact

SEQ ID NO: 8756752 - DNA, 22 bp, Homo sapiens
atttggcttacacgatattttc

SEQ ID NO: 8756753 - DNA, 22 bp, Homo sapiens
atttcttcctctgtcagtaact

SEQ ID NO: 8756754 - DNA, 22 bp, Homo sapiens
atttcttcctctgtcagtaact

SEQ ID NO: 8756755 - DNA, 22 bp, Homo sapiens
atttcttcaggttcttctagga

SEQ ID NO: 8756756 - DNA, 22 bp, Homo sapiens
atttcttcctctgtcagtaact

SEQ ID NO: 8756757 - DNA, 22 bp, Homo sapiens
atttgggaatgtgcattatact

SEQ ID NO: 8756758 - DNA, 22 bp, Homo sapiens
atttggtagtcctgataagatt

SEQ ID NO: 8756759 - DNA, 22 bp, Homo sapiens
atttggtctacattttccaaat

SEQ ID NO: 8756760 - DNA, 22 bp, Homo sapiens
atttggtcagaactctctttag

SEQ ID NO: 8756761 - DNA, 22 bp, Homo sapiens
atttgtacaaatttatgttagt

SEQ ID NO: 8756762 - DNA, 22 bp, Homo sapiens
atttgtaatttcttatctgtgt

SEQ ID NO: 8756763 - DNA, 22 bp, Homo sapiens
atttgtaacacgtgacaggttg

SEQ ID NO: 8756764 - DNA, 17 bp, Homo sapiens
atttgtaactagctctt

SEQ ID NO: 8756765 - DNA, 22 bp, Homo sapiens
atttgtaagctagagccatgat

SEQ ID NO: 8756766 - DNA, 22 bp, Homo sapiens
atttgtaaagtgcttaaaagta

SEQ ID NO: 8756767 - DNA, 22 bp, Homo sapiens
atttgtaaagtgcttaaaagta

SEQ ID NO: 8756768 - DNA, 22 bp, Homo sapiens
atttggttcccaagctacgtgt

SEQ ID NO: 8756769 - DNA, 22 bp, Homo sapiens
atttggttatggtcatggacac

SEQ ID NO: 8756770 - DNA, 22 bp, Homo sapiens
atttggttcccaagctacgtgt

SEQ ID NO: 8756771 - DNA, 22 bp, Homo sapiens
atttggttcccaagctacgtgt

SEQ ID NO: 8756772 - DNA, 22 bp, Homo sapiens
atttggtttcaggattctcagg

SEQ ID NO: 8756773 - DNA, 22 bp, Homo sapiens
atttggtttcaggattctcagg

SEQ ID NO: 8756774 - DNA, 22 bp, Homo sapiens
atttggttactcagttgtctga

SEQ ID NO: 8756775 - DNA, 22 bp, Homo sapiens
atttggttactcagttgtctga

SEQ ID NO: 8756776 - DNA, 22 bp, Homo sapiens
atttggttatggtcatggacac

SEQ ID NO: 8756777 - DNA, 22 bp, Homo sapiens
atttggtctgtaattacatgga

SEQ ID NO: 8756778 - DNA, 22 bp, Homo sapiens
attttagatttaagaataaggt

SEQ ID NO: 8756779 - DNA, 22 bp, Homo sapiens
attttcagcccccactcgtggc

SEQ ID NO: 8756780 - DNA, 22 bp, Homo sapiens
attttagagctccaagtacagc

SEQ ID NO: 8756781 - DNA, 22 bp, Homo sapiens
attttagagctccaagtacagc

SEQ ID NO: 8756782 - DNA, 22 bp, Homo sapiens
atttgtctctctgggtttactt

SEQ ID NO: 8756783 - DNA, 22 bp, Homo sapiens
atttgtctctgcactttactca

SEQ ID NO: 8756784 - DNA, 22 bp, Homo sapiens
atttgtctctgcactttactca

SEQ ID NO: 8756785 - DNA, 22 bp, Homo sapiens
atttgtctaatgagtgtgtact

SEQ ID NO: 8756786 - DNA, 22 bp, Homo sapiens
atttgtctagtggtattcacgt

SEQ ID NO: 8756787 - DNA, 22 bp, Homo sapiens
atttgtcaataagatgaacata

SEQ ID NO: 8756788 - DNA, 22 bp, Homo sapiens
atttgtatcaatctcaatatat

SEQ ID NO: 8756789 - DNA, 22 bp, Homo sapiens
atttgtatcaatctcaatatat

SEQ ID NO: 8756790 - DNA, 22 bp, Homo sapiens
atttgtatatttaagagggtag

SEQ ID NO: 8756791 - DNA, 22 bp, Homo sapiens
atttgtaccatctggtatacag

SEQ ID NO: 8756792 - DNA, 22 bp, Homo sapiens
atttgtagtgaagtgaaaataa

SEQ ID NO: 8756793 - DNA, 22 bp, Homo sapiens
atttgtatcttctaatattatc

SEQ ID NO: 8756794 - DNA, 22 bp, Homo sapiens
attttcattttgcagggtgaga

SEQ ID NO: 8756795 - DNA, 21 bp, Homo sapiens
attttcattaattcagtgtgg

SEQ ID NO: 8756796 - DNA, 21 bp, Homo sapiens
attttcattaattcagtgtgg

SEQ ID NO: 8756797 - DNA, 22 bp, Homo sapiens
attttccagcctttctagaact

SEQ ID NO: 8756798 - DNA, 22 bp, Homo sapiens
attttccaaaataattgttact

SEQ ID NO: 8756799 - DNA, 22 bp, Homo sapiens
attttcatggcttctgctcagt

SEQ ID NO: 8756800 - DNA, 22 bp, Homo sapiens
attttcatgactaccttaaata

SEQ ID NO: 8756801 - DNA, 22 bp, Homo sapiens
attttcatcgctaggttggcct

SEQ ID NO: 8756802 - DNA, 22 bp, Homo sapiens
attttcatgactaccttaaata

SEQ ID NO: 8756803 - DNA, 22 bp, Homo sapiens
attttcatgactaccttaaata

SEQ ID NO: 8756804 - DNA, 22 bp, Homo sapiens
attttcagtgtaaatgttttat

SEQ ID NO: 8756805 - DNA, 22 bp, Homo sapiens
attttcagttgaaaaagttggt

SEQ ID NO: 8756806 - DNA, 22 bp, Homo sapiens
attttcatcatgggtttaacat

SEQ ID NO: 8756807 - DNA, 22 bp, Homo sapiens
gccttccttacacctgctcagc

SEQ ID NO: 8756808 - DNA, 17 bp, Homo sapiens
gccttccttcctccaca

SEQ ID NO: 8756809 - DNA, 22 bp, Homo sapiens
gccttccttacacctgctcagc

SEQ ID NO: 8756810 - DNA, 22 bp, Homo sapiens
gccttccttacacctgctcagc

SEQ ID NO: 8756811 - DNA, 22 bp, Homo sapiens
gccttccttacacctgctcagc

SEQ ID NO: 8756812 - DNA, 22 bp, Homo sapiens
gccttcctgcagctctgagcgt

SEQ ID NO: 8756813 - DNA, 22 bp, Homo sapiens
gccttcctgcagctctgagcgt

SEQ ID NO: 8756814 - DNA, 22 bp, Homo sapiens
gccttcctgcagctctgagcgt

SEQ ID NO: 8756815 - DNA, 22 bp, Homo sapiens
gccttccctggctaggcaagca

SEQ ID NO: 8756816 - DNA, 22 bp, Homo sapiens
gccttccctggctaggcaagca

SEQ ID NO: 8756817 - DNA, 22 bp, Homo sapiens
gccttccctggctaggcaagca

SEQ ID NO: 8756818 - DNA, 22 bp, Homo sapiens
gccttccctctcatcctgctgg

SEQ ID NO: 8756819 - DNA, 19 bp, Homo sapiens
gccttcccaccacccgtcc

SEQ ID NO: 8756820 - DNA, 22 bp, Homo sapiens
gccttcccaccctgcgaggctg

SEQ ID NO: 8756821 - DNA, 22 bp, Homo sapiens
gccttcccaccctgcgaggctg

SEQ ID NO: 8756822 - DNA, 22 bp, Homo sapiens
gccttcccaagacgcctgagtt

SEQ ID NO: 8756823 - DNA, 22 bp, Homo sapiens
gccttcccaagacgcctgagtt

SEQ ID NO: 8756824 - DNA, 22 bp, Homo sapiens
attttcctccatgtgagcagtt

SEQ ID NO: 8756825 - DNA, 22 bp, Homo sapiens
attttcctcaagcctctggaag

SEQ ID NO: 8756826 - DNA, 22 bp, Homo sapiens
attttcctagtcatgtgcttct

SEQ ID NO: 8756827 - DNA, 22 bp, Homo sapiens
attttccaaaataattgttact

SEQ ID NO: 8756828 - DNA, 22 bp, Homo sapiens
attttcctagtcatgtgcttct

SEQ ID NO: 8756829 - DNA, 22 bp, Homo sapiens
attttcctagtcatgtgcttct

SEQ ID NO: 8756830 - DNA, 22 bp, Homo sapiens
attttcccttctaaagggctga

SEQ ID NO: 8756831 - DNA, 22 bp, Homo sapiens
attttccttctaagaggaaggt

SEQ ID NO: 8756832 - DNA, 22 bp, Homo sapiens
attttcctctggtttccccaga

SEQ ID NO: 8756833 - DNA, 22 bp, Homo sapiens
attttcctccatgtgagcagtt

SEQ ID NO: 8756834 - DNA, 22 bp, Homo sapiens
attttcctccatgtgagcagtt

SEQ ID NO: 8756835 - DNA, 22 bp, Homo sapiens
gcctgtgctgttccctctgcca

SEQ ID NO: 8756836 - DNA, 22 bp, Homo sapiens
gcctgtgcttaactgacgtgag

SEQ ID NO: 8756837 - DNA, 17 bp, Homo sapiens
gccttccagcatgtggg

SEQ ID NO: 8756838 - DNA, 17 bp, Homo sapiens
gccttccagcatgtggg

SEQ ID NO: 8756839 - DNA, 22 bp, Homo sapiens
gccttccagaatacacatagca

SEQ ID NO: 8756840 - DNA, 22 bp, Homo sapiens
attttccttgtgggttagcgaa

SEQ ID NO: 8756841 - DNA, 22 bp, Homo sapiens
gcctgtgctgttccctctgcca

SEQ ID NO: 8756842 - DNA, 17 bp, Homo sapiens
attccacagggaatctg

SEQ ID NO: 8756843 - DNA, 22 bp, Homo sapiens
attccacaggagctggttttct

SEQ ID NO: 8756844 - DNA, 22 bp, Homo sapiens
attccacagctacgttttgagc

SEQ ID NO: 8756845 - DNA, 22 bp, Homo sapiens
attccacgagtgtctgtcaagt

SEQ ID NO: 8756846 - DNA, 22 bp, Homo sapiens
attccactccaataagtgtcaa

SEQ ID NO: 8756847 - DNA, 22 bp, Homo sapiens
attccacatgaaaggagctgaa

SEQ ID NO: 8756848 - DNA, 22 bp, Homo sapiens
attccacataggccttcatgac

SEQ ID NO: 8756849 - DNA, 22 bp, Homo sapiens
attccaaagcacatcagaacta

SEQ ID NO: 8756850 - DNA, 22 bp, Homo sapiens
attccaaagcacatcagaacta

SEQ ID NO: 8756851 - DNA, 22 bp, Homo sapiens
attccaaagcacatcagaacta

SEQ ID NO: 8756852 - DNA, 22 bp, Homo sapiens
attccaaagacagaagcagctg

SEQ ID NO: 8756853 - DNA, 22 bp, Homo sapiens
attccaaagcctgaataatgga

SEQ ID NO: 8756854 - DNA, 22 bp, Homo sapiens
attccaaagcctgaataatgga

SEQ ID NO: 8756855 - DNA, 22 bp, Homo sapiens
attccaaaggctggcctggagg

SEQ ID NO: 8756856 - DNA, 22 bp, Homo sapiens
attccaaaggttaatgcccatt

SEQ ID NO: 8756857 - DNA, 22 bp, Homo sapiens
attccaaaggttaatgcccatt

SEQ ID NO: 8756858 - DNA, 22 bp, Homo sapiens
attccaattgtacttgctttta

SEQ ID NO: 8756859 - DNA, 22 bp, Homo sapiens
attccaattgtacttgctttta

SEQ ID NO: 8756860 - DNA, 22 bp, Homo sapiens
attccaaagcacatcagaacta

SEQ ID NO: 8756861 - DNA, 22 bp, Homo sapiens
attccacacagtaatactcaat

SEQ ID NO: 8756862 - DNA, 22 bp, Homo sapiens
attccacacagtaatactcaat

SEQ ID NO: 8756863 - DNA, 22 bp, Homo sapiens
attcacaactgatccttgctca

SEQ ID NO: 8756864 - DNA, 22 bp, Homo sapiens
attcacaacaaaaggatatgag

SEQ ID NO: 8756865 - DNA, 22 bp, Homo sapiens
attcacaacaaaaggatatgag

SEQ ID NO: 8756866 - DNA, 16 bp, Homo sapiens
attcacaaggcatcgg

SEQ ID NO: 8756867 - DNA, 22 bp, Homo sapiens
attcacaagttctagggattag

SEQ ID NO: 8756868 - DNA, 16 bp, Homo sapiens
attcacaaggcatcgg

SEQ ID NO: 8756869 - DNA, 22 bp, Homo sapiens
attcacaactgatccttgctca

SEQ ID NO: 8756870 - DNA, 22 bp, Homo sapiens
attcacaaatgctgccccattc

SEQ ID NO: 8756871 - DNA, 22 bp, Homo sapiens
attcacaaatgctgccccattc

SEQ ID NO: 8756872 - DNA, 22 bp, Homo sapiens
attcacaaatgctgccccattc

SEQ ID NO: 8756873 - DNA, 22 bp, Homo sapiens
attcacaaagtcacccttacac

SEQ ID NO: 8756874 - DNA, 22 bp, Homo sapiens
attcacaaagtcacccttacac

SEQ ID NO: 8756875 - DNA, 22 bp, Homo sapiens
attcacaaataacaggtgcaga

SEQ ID NO: 8756876 - DNA, 20 bp, Homo sapiens
attcacaaagccagtgttgc

SEQ ID NO: 8756877 - DNA, 20 bp, Homo sapiens
attcacaaagccagtgttgc

SEQ ID NO: 8756878 - DNA, 22 bp, Homo sapiens
attcacaaagaagggaagtaca

SEQ ID NO: 8756879 - DNA, 20 bp, Homo sapiens
attcacaaagccagtgttgc

SEQ ID NO: 8756880 - DNA, 22 bp, Homo sapiens
attcaatgggggtttctagttg

SEQ ID NO: 8756881 - DNA, 22 bp, Homo sapiens
attcaatcccagaaagaaactg

SEQ ID NO: 8756882 - DNA, 22 bp, Homo sapiens
attcaataagtcactgtggaat

SEQ ID NO: 8756883 - DNA, 22 bp, Homo sapiens
attcacaaaatgatatagatac

SEQ ID NO: 8756884 - DNA, 22 bp, Homo sapiens
attcacaaaatgatatagatac

SEQ ID NO: 8756885 - DNA, 22 bp, Homo sapiens
attccaaaaggatgttagaatg

SEQ ID NO: 8756886 - DNA, 22 bp, Homo sapiens
attccaaacagtgctgcagact

SEQ ID NO: 8756887 - DNA, 22 bp, Homo sapiens
attccaaaaggatgttagaatg

SEQ ID NO: 8756888 - DNA, 22 bp, Homo sapiens
attccaaagacagaagcagctg

SEQ ID NO: 8756889 - DNA, 22 bp, Homo sapiens
attccaaacttaccccagagga

SEQ ID NO: 8756890 - DNA, 22 bp, Homo sapiens
attccaaacttaccccagagga

SEQ ID NO: 8756891 - DNA, 22 bp, Homo sapiens
attccaaactctttccctgtcg

SEQ ID NO: 8756892 - DNA, 19 bp, Homo sapiens
attcatttttgccttctaa

SEQ ID NO: 8756893 - DNA, 22 bp, Homo sapiens
attccaaaaggatgttagaatg

SEQ ID NO: 8756894 - DNA, 19 bp, Homo sapiens
attcatttttgccttctaa

SEQ ID NO: 8756895 - DNA, 19 bp, Homo sapiens
attcatttttgccttctaa

SEQ ID NO: 8756896 - DNA, 22 bp, Homo sapiens
attcacaagttgatggatattt

SEQ ID NO: 8756897 - DNA, 22 bp, Homo sapiens
attcacaagttgatggatattt

SEQ ID NO: 8756898 - DNA, 22 bp, Homo sapiens
attcatctgtacttcaatatct

SEQ ID NO: 8756899 - DNA, 22 bp, Homo sapiens
gcaggcaggagcccaactgcct

SEQ ID NO: 8756900 - DNA, 22 bp, Homo sapiens
gcaggcaggagcccaactgcct

SEQ ID NO: 8756901 - DNA, 22 bp, Homo sapiens
gcaggcaggagcccaactgcct

SEQ ID NO: 8756902 - DNA, 22 bp, Homo sapiens
gcaggcaggagcccaactgcct

SEQ ID NO: 8756903 - DNA, 22 bp, Homo sapiens
gcaggcaggaaggactaagtaa

SEQ ID NO: 8756904 - DNA, 19 bp, Homo sapiens
gcaggcagctggggtatcc

SEQ ID NO: 8756905 - DNA, 19 bp, Homo sapiens
gcaggcagctggggtatcc

SEQ ID NO: 8756906 - DNA, 22 bp, Homo sapiens
gcaggcaggaaggactaagtaa

SEQ ID NO: 8756907 - DNA, 22 bp, Homo sapiens
gcaggcaggaaggactaagtaa

SEQ ID NO: 8756908 - DNA, 22 bp, Homo sapiens
gcaggcaggagcccaactgcct

SEQ ID NO: 8756909 - DNA, 22 bp, Homo sapiens
gcaggcaggagcccaactgcct

SEQ ID NO: 8756910 - DNA, 22 bp, Homo sapiens
gcaggcaggcttccttgaactg

SEQ ID NO: 8756911 - DNA, 22 bp, Homo sapiens
gcaggcaggcttccttgaactg

SEQ ID NO: 8756912 - DNA, 20 bp, Homo sapiens
gcaggcagggaatgggggtg

SEQ ID NO: 8756913 - DNA, 20 bp, Homo sapiens
gcaggcagggaatgggggtg

SEQ ID NO: 8756914 - DNA, 22 bp, Homo sapiens
gcaggcaaggaacagagactgt

SEQ ID NO: 8756915 - DNA, 22 bp, Homo sapiens
gcaggcaagaatttgggtctga

SEQ ID NO: 8756916 - DNA, 22 bp, Homo sapiens
gcaggcaagaatttgggtctga

SEQ ID NO: 8756917 - DNA, 22 bp, Homo sapiens
gcaggcaaggtagacagaggaa

SEQ ID NO: 8756918 - DNA, 22 bp, Homo sapiens
gcaggcaattttggaaggtcag

SEQ ID NO: 8756919 - DNA, 22 bp, Homo sapiens
gcagcttggtgaaaggtgatgg

SEQ ID NO: 8756920 - DNA, 22 bp, Homo sapiens
gcagcttggatttctgtagttt

SEQ ID NO: 8756921 - DNA, 22 bp, Homo sapiens
gcagcttggggacatgaaaaga

SEQ ID NO: 8756922 - DNA, 23 bp, Homo sapiens
gcagcttgtggtttagtagaggg

SEQ ID NO: 8756923 - DNA, 22 bp, Homo sapiens
gcagcttgtcagacctttactg

SEQ ID NO: 8756924 - DNA, 23 bp, Homo sapiens
gcagcttgtggtttagtagaggg

SEQ ID NO: 8756925 - DNA, 22 bp, Homo sapiens
gcagctgttcagctggccagat

SEQ ID NO: 8756926 - DNA, 22 bp, Homo sapiens
gcagctgttcagctggccagat

SEQ ID NO: 8756927 - DNA, 22 bp, Homo sapiens
gcagcttcctgagtgtggacag

SEQ ID NO: 8756928 - DNA, 22 bp, Homo sapiens
gcagcttgaagctcggaggagc

SEQ ID NO: 8756929 - DNA, 22 bp, Homo sapiens
gcagcttgaagctcggaggagc

SEQ ID NO: 8756930 - DNA, 22 bp, Homo sapiens
attctgaattctgagcctttca

SEQ ID NO: 8756931 - DNA, 22 bp, Homo sapiens
attctgagtacaacaagatgtt

SEQ ID NO: 8756932 - DNA, 22 bp, Homo sapiens
attctgagaggcacaatgtgga

SEQ ID NO: 8756933 - DNA, 22 bp, Homo sapiens
attctctttgtataacatcttg

SEQ ID NO: 8756934 - DNA, 22 bp, Homo sapiens
attctcttctgatgtcttgcca

SEQ ID NO: 8756935 - DNA, 22 bp, Homo sapiens
attctcatttttatagatgaga

SEQ ID NO: 8756936 - DNA, 22 bp, Homo sapiens
attctcatttgctggctatatg

SEQ ID NO: 8756937 - DNA, 22 bp, Homo sapiens
gcagctgtgtaatgagcccaca

SEQ ID NO: 8756938 - DNA, 22 bp, Homo sapiens
gcagctgtgggttccaagtcta

SEQ ID NO: 8756939 - DNA, 22 bp, Homo sapiens
gcagctgtgggttccaagtcta

SEQ ID NO: 8756940 - DNA, 22 bp, Homo sapiens
gcagctgtggtgctgagatagg

SEQ ID NO: 8756941 - DNA, 22 bp, Homo sapiens
gcagctgtgggcctcggagagc

SEQ ID NO: 8756942 - DNA, 19 bp, Homo sapiens
gcagctgtgggaagagcca

SEQ ID NO: 8756943 - DNA, 22 bp, Homo sapiens
attctgatcattcaagatgtca

SEQ ID NO: 8756944 - DNA, 22 bp, Homo sapiens
attctgataaataagcagcaag

SEQ ID NO: 8756945 - DNA, 22 bp, Homo sapiens
attctgatatgaacacacatat

SEQ ID NO: 8756946 - DNA, 21 bp, Homo sapiens
attctgagttgtcagtcttca

SEQ ID NO: 8756947 - DNA, 22 bp, Homo sapiens
attctgagtccatgggggcagg

SEQ ID NO: 8756948 - DNA, 22 bp, Homo sapiens
attctgagttagagtcagccag

SEQ ID NO: 8756949 - DNA, 22 bp, Homo sapiens
gcagggcagtgtgtctgtgggg

SEQ ID NO: 8756950 - DNA, 22 bp, Homo sapiens
gcagggcatagaggcacggagg

SEQ ID NO: 8756951 - DNA, 22 bp, Homo sapiens
gcagggcatagaggcacggagg

SEQ ID NO: 8756952 - DNA, 22 bp, Homo sapiens
gcagggcatccctgagcgggtg

SEQ ID NO: 8756953 - DNA, 22 bp, Homo sapiens
gcagggcatccctgagcgggtg

SEQ ID NO: 8756954 - DNA, 20 bp, Homo sapiens
gcagggcatcttggccccca

SEQ ID NO: 8756955 - DNA, 22 bp, Homo sapiens
attcttttttaaggaatagaac

SEQ ID NO: 8756956 - DNA, 22 bp, Homo sapiens
attcttttgtcctagcttgata

SEQ ID NO: 8756957 - DNA, 22 bp, Homo sapiens
attcttttaagccccagggatt

SEQ ID NO: 8756958 - DNA, 22 bp, Homo sapiens
attcttttgtcctagcttgata

SEQ ID NO: 8756959 - DNA, 22 bp, Homo sapiens
attcttttcccaactgctttaa

SEQ ID NO: 8756960 - DNA, 22 bp, Homo sapiens
attcttttcccaactgctttaa

SEQ ID NO: 8756961 - DNA, 22 bp, Homo sapiens
attcttttcccaactgctttaa

SEQ ID NO: 8756962 - DNA, 22 bp, Homo sapiens
attcttttaaatggcagtagta

SEQ ID NO: 8756963 - DNA, 19 bp, Homo sapiens
attctttggtgtccatttc

SEQ ID NO: 8756964 - DNA, 22 bp, Homo sapiens
attctttggacaataagtggtg

SEQ ID NO: 8756965 - DNA, 22 bp, Homo sapiens
attcttttaaatggcagtagta

SEQ ID NO: 8756966 - DNA, 22 bp, Homo sapiens
attctttgcatctctgggtggc

SEQ ID NO: 8756967 - DNA, 17 bp, Homo sapiens
attctttgatgtctctg

SEQ ID NO: 8756968 - DNA, 22 bp, Homo sapiens
attctttgaacagttttcctgt

SEQ ID NO: 8756969 - DNA, 21 bp, Homo sapiens
attctttgatgtgcaataagt

SEQ ID NO: 8756970 - DNA, 17 bp, Homo sapiens
attctttgatgtctctg

SEQ ID NO: 8756971 - DNA, 22 bp, Homo sapiens
attctttgaacagttttcctgt

SEQ ID NO: 8756972 - DNA, 22 bp, Homo sapiens
attctttgaacagttttcctgt

SEQ ID NO: 8756973 - DNA, 22 bp, Homo sapiens
gcagggcagtgtgtctgtgggg

SEQ ID NO: 8756974 - DNA, 22 bp, Homo sapiens
gcagggattgtgcagggggcta

SEQ ID NO: 8756975 - DNA, 22 bp, Homo sapiens
gcagggcaaacccaggtgttca

SEQ ID NO: 8756976 - DNA, 22 bp, Homo sapiens
attctgctcattttatttccag

SEQ ID NO: 8756977 - DNA, 22 bp, Homo sapiens
attctgctcattttatttccag

SEQ ID NO: 8756978 - DNA, 22 bp, Homo sapiens
attctgctcccaggtgatgctg

SEQ ID NO: 8756979 - DNA, 22 bp, Homo sapiens
attctgctccacactgattcat

SEQ ID NO: 8756980 - DNA, 22 bp, Homo sapiens
attctgctcattttatttccag

SEQ ID NO: 8756981 - DNA, 22 bp, Homo sapiens
attctgctgcctagtttatgaa

SEQ ID NO: 8756982 - DNA, 16 bp, Homo sapiens
attctgctgcctgctc

SEQ ID NO: 8756983 - DNA, 22 bp, Homo sapiens
attctgctgcacaccttccccc

SEQ ID NO: 8756984 - DNA, 22 bp, Homo sapiens
attctgcttaagggaggctgtc

SEQ ID NO: 8756985 - DNA, 22 bp, Homo sapiens
attctgcaactgttgttggtgg

SEQ ID NO: 8756986 - DNA, 22 bp, Homo sapiens
attctgattcattaggtctagg

SEQ ID NO: 8756987 - DNA, 22 bp, Homo sapiens
attctgcacatccaagaacagg

SEQ ID NO: 8756988 - DNA, 22 bp, Homo sapiens
attctgatgcttcacaaaggta

SEQ ID NO: 8756989 - DNA, 22 bp, Homo sapiens
attctgatgcctgggtactgcc

SEQ ID NO: 8756990 - DNA, 22 bp, Homo sapiens
gcaggcaggtggcatcttgtga

SEQ ID NO: 8756991 - DNA, 15 bp, Homo sapiens
gcaggcaggtcacct

SEQ ID NO: 8756992 - DNA, 15 bp, Homo sapiens
gcaggcaggtcacct

SEQ ID NO: 8756993 - DNA, 22 bp, Homo sapiens
gcaggcaggtggcatcttgtga

SEQ ID NO: 8756994 - DNA, 20 bp, Homo sapiens
gcaggcagggaatgggggtg

SEQ ID NO: 8756995 - DNA, 22 bp, Homo sapiens
attctgcatggtggtgtctctg

SEQ ID NO: 8756996 - DNA, 22 bp, Homo sapiens
attctgcataatttcctggcag

SEQ ID NO: 8756997 - DNA, 22 bp, Homo sapiens
attctgcaggtggaggatggca

SEQ ID NO: 8756998 - DNA, 22 bp, Homo sapiens
attctgcacttcctttgcttcc

SEQ ID NO: 8756999 - DNA, 22 bp, Homo sapiens
attctgcacttcctttgcttcc

SEQ ID NO: 8757000 - DNA, 22 bp, Homo sapiens
attctgcatgtaggtttgctca

SEQ ID NO: 8757001 - DNA, 22 bp, Homo sapiens
attctgcatggtggtgtctctg

SEQ ID NO: 8757002 - DNA, 22 bp, Homo sapiens
attctgcatgtaggtttgctca

SEQ ID NO: 8757003 - DNA, 22 bp, Homo sapiens
attctgctagttaatatctctc

SEQ ID NO: 8757004 - DNA, 22 bp, Homo sapiens
attctgctagtaacagatgaag

SEQ ID NO: 8757005 - DNA, 22 bp, Homo sapiens
attctgctagtaacagatgaag

SEQ ID NO: 8757006 - DNA, 22 bp, Homo sapiens
gcatcagttactaggagggaaa

SEQ ID NO: 8757007 - DNA, 22 bp, Homo sapiens
gcatcagtagctatagttacaa

SEQ ID NO: 8757008 - DNA, 22 bp, Homo sapiens
attgcactccagcctgggtgac

SEQ ID NO: 8757009 - DNA, 22 bp, Homo sapiens
attgcactccagcctgggtgac

SEQ ID NO: 8757010 - DNA, 22 bp, Homo sapiens
attgcactccggcctgggtgac

SEQ ID NO: 8757011 - DNA, 22 bp, Homo sapiens
attgcactccggcctgggtgac

SEQ ID NO: 8757012 - DNA, 22 bp, Homo sapiens
attgcactccggcctgggtgac

SEQ ID NO: 8757013 - DNA, 22 bp, Homo sapiens
attgcactccggcctgggtgac

SEQ ID NO: 8757014 - DNA, 22 bp, Homo sapiens
attgcactccggcctgggtgac

SEQ ID NO: 8757015 - DNA, 22 bp, Homo sapiens
attgcacagctgaatattttgg

SEQ ID NO: 8757016 - DNA, 22 bp, Homo sapiens
attgcacagctgaatattttgg

SEQ ID NO: 8757017 - DNA, 22 bp, Homo sapiens
attgcacagctgaatattttgg

SEQ ID NO: 8757018 - DNA, 18 bp, Homo sapiens
attgcacaccagcctggg

SEQ ID NO: 8757019 - DNA, 22 bp, Homo sapiens
attgcacaaagagggaaactga

SEQ ID NO: 8757020 - DNA, 22 bp, Homo sapiens
attgcaccttgggttttgaaag

SEQ ID NO: 8757021 - DNA, 22 bp, Homo sapiens
attgcacatctgcactacagcc

SEQ ID NO: 8757022 - DNA, 22 bp, Homo sapiens
attgcacatctgcactacagcc

SEQ ID NO: 8757023 - DNA, 22 bp, Homo sapiens
attgcactccagcctgggggac

SEQ ID NO: 8757024 - DNA, 22 bp, Homo sapiens
attgcactccagcctgggggac

SEQ ID NO: 8757025 - DNA, 22 bp, Homo sapiens
attgcactccagcctgggggac

SEQ ID NO: 8757026 - DNA, 22 bp, Homo sapiens
attgcactccagcctgggggac

SEQ ID NO: 8757027 - DNA, 22 bp, Homo sapiens
attgcactccagcctgggggac

SEQ ID NO: 8757028 - DNA, 22 bp, Homo sapiens
attgcactccagcctgggtgac

SEQ ID NO: 8757029 - DNA, 22 bp, Homo sapiens
attgcactccagcctgggtgac

SEQ ID NO: 8757030 - DNA, 22 bp, Homo sapiens
attgcactccagcctgggtgac

SEQ ID NO: 8757031 - DNA, 22 bp, Homo sapiens
gcatggagaagtgggaacaggt

SEQ ID NO: 8757032 - DNA, 22 bp, Homo sapiens
gcatggagaagtgggaacaggt

SEQ ID NO: 8757033 - DNA, 22 bp, Homo sapiens
gcatggcaaatatcgagggcag

SEQ ID NO: 8757034 - DNA, 22 bp, Homo sapiens
gcatggatgggagtggacagat

SEQ ID NO: 8757035 - DNA, 22 bp, Homo sapiens
gcatggcaaatatcgagggcag

SEQ ID NO: 8757036 - DNA, 22 bp, Homo sapiens
gcatggcaagaccctgtctcta

SEQ ID NO: 8757037 - DNA, 22 bp, Homo sapiens
gcatggcaagaccctgtctcta

SEQ ID NO: 8757038 - DNA, 22 bp, Homo sapiens
gcatggcaaatatcgagggcag

SEQ ID NO: 8757039 - DNA, 22 bp, Homo sapiens
gcatggcaaatatcgagggcag

SEQ ID NO: 8757040 - DNA, 22 bp, Homo sapiens
gcatggcagccagtacatggtg

SEQ ID NO: 8757041 - DNA, 22 bp, Homo sapiens
gcatggcaagatcaggagacca

SEQ ID NO: 8757042 - DNA, 22 bp, Homo sapiens
gcatggcaagatcaggagacca

SEQ ID NO: 8757043 - DNA, 22 bp, Homo sapiens
gcatggcaagatcaggagacca

SEQ ID NO: 8757044 - DNA, 22 bp, Homo sapiens
gcatggcaagatcaggagacca

SEQ ID NO: 8757045 - DNA, 22 bp, Homo sapiens
gcatggcagaacacctcgcccg

SEQ ID NO: 8757046 - DNA, 22 bp, Homo sapiens
gcatggcagaacacctcgcccg

SEQ ID NO: 8757047 - DNA, 22 bp, Homo sapiens
attgcaaaggtcccattcaaga

SEQ ID NO: 8757048 - DNA, 22 bp, Homo sapiens
attgcaaagcgtagactctaaa

SEQ ID NO: 8757049 - DNA, 22 bp, Homo sapiens
attgcaaaggtcccattcaaga

SEQ ID NO: 8757050 - DNA, 22 bp, Homo sapiens
attgcaaaggtcccattcaaga

SEQ ID NO: 8757051 - DNA, 22 bp, Homo sapiens
attgcaaaggtcccattcaaga

SEQ ID NO: 8757052 - DNA, 22 bp, Homo sapiens
attgcaaatgagtcttaatata

SEQ ID NO: 8757053 - DNA, 22 bp, Homo sapiens
attgcaaatgagtcttaatata

SEQ ID NO: 8757054 - DNA, 22 bp, Homo sapiens
attgcaaatggtttggtcatct

SEQ ID NO: 8757055 - DNA, 22 bp, Homo sapiens
attgcaaggtgtagttatggtt

SEQ ID NO: 8757056 - DNA, 22 bp, Homo sapiens
attgcaaataactgtactgaat

SEQ ID NO: 8757057 - DNA, 22 bp, Homo sapiens
attgcaaatgagtcttaatata

SEQ ID NO: 8757058 - DNA, 22 bp, Homo sapiens
attgcaaataatgcgagccagt

SEQ ID NO: 8757059 - DNA, 22 bp, Homo sapiens
attgcaaagcattgtgagcgca

SEQ ID NO: 8757060 - DNA, 22 bp, Homo sapiens
attgcaaagcattgtgagcgca

SEQ ID NO: 8757061 - DNA, 22 bp, Homo sapiens
gcagtaagaaagtcaagcagtt

SEQ ID NO: 8757062 - DNA, 22 bp, Homo sapiens
gcagtaaaggtgacaatatagg

SEQ ID NO: 8757063 - DNA, 22 bp, Homo sapiens
gcagtaaagcctgagatatatg

SEQ ID NO: 8757064 - DNA, 22 bp, Homo sapiens
gcagtaaagcctgagatatatg

SEQ ID NO: 8757065 - DNA, 22 bp, Homo sapiens
gcaggtgtgggtggctgccagg

SEQ ID NO: 8757066 - DNA, 19 bp, Homo sapiens
gcaggtggatgtggtcagc

SEQ ID NO: 8757067 - DNA, 22 bp, Homo sapiens
attcttttttaaggaatagaac

SEQ ID NO: 8757068 - DNA, 22 bp, Homo sapiens
attcttttttaaggaatagaac

SEQ ID NO: 8757069 - DNA, 22 bp, Homo sapiens
attcttttttaaggaatagaac

SEQ ID NO: 8757070 - DNA, 20 bp, Homo sapiens
gatggatttcaacacctttc

SEQ ID NO: 8757071 - DNA, 22 bp, Homo sapiens
gatggcacacagacatccccgc

SEQ ID NO: 8757072 - DNA, 22 bp, Homo sapiens
gatggcaccttgaacgctgcgt

SEQ ID NO: 8757073 - DNA, 22 bp, Homo sapiens
gatggagtctgaagctgggaac

SEQ ID NO: 8757074 - DNA, 22 bp, Homo sapiens
gatgatgggatccagcaatgta

SEQ ID NO: 8757075 - DNA, 21 bp, Homo sapiens
gatgatggcaggcagcactgg

SEQ ID NO: 8757076 - DNA, 21 bp, Homo sapiens
gatgatggcaggcagcactgg

SEQ ID NO: 8757077 - DNA, 22 bp, Homo sapiens
atgttatttctgaaagatcatt

SEQ ID NO: 8757078 - DNA, 22 bp, Homo sapiens
atgttatttattgaaacacttt

SEQ ID NO: 8757079 - DNA, 21 bp, Homo sapiens
atgttattctgttcctccagc

SEQ ID NO: 8757080 - DNA, 22 bp, Homo sapiens
gatggcaggtagtggtctcatc

SEQ ID NO: 8757081 - DNA, 22 bp, Homo sapiens
gatggcaggtgatagccgagtc

SEQ ID NO: 8757082 - DNA, 22 bp, Homo sapiens
gatggcaggtgatagccgagtc

SEQ ID NO: 8757083 - DNA, 22 bp, Homo sapiens
gatggccacatacatggctggg

SEQ ID NO: 8757084 - DNA, 22 bp, Homo sapiens
gatggcagtcaaccaggtgagg

SEQ ID NO: 8757085 - DNA, 22 bp, Homo sapiens
gatggcagtgggcctcgagtcc

SEQ ID NO: 8757086 - DNA, 22 bp, Homo sapiens
gatggcagtggagttagtgatt

SEQ ID NO: 8757087 - DNA, 22 bp, Homo sapiens
gatggcagcatattgacagcat

SEQ ID NO: 8757088 - DNA, 22 bp, Homo sapiens
gatggcagcagcagccagggat

SEQ ID NO: 8757089 - DNA, 22 bp, Homo sapiens
gatggcagcatattgacagcat

SEQ ID NO: 8757090 - DNA, 22 bp, Homo sapiens
gatggcagcatattgacagcat

SEQ ID NO: 8757091 - DNA, 22 bp, Homo sapiens
gatggcaggtagtggtctcatc

SEQ ID NO: 8757092 - DNA, 23 bp, Homo sapiens
atgttattattagcagtcttgcc

SEQ ID NO: 8757093 - DNA, 22 bp, Homo sapiens
atgttattaaagtacagattct

SEQ ID NO: 8757094 - DNA, 22 bp, Homo sapiens
atgttattaaagtacagattct

SEQ ID NO: 8757095 - DNA, 22 bp, Homo sapiens
gagtggggcgaagtcggcgagt

SEQ ID NO: 8757096 - DNA, 22 bp, Homo sapiens
gagtggggcccactgctgggtg

SEQ ID NO: 8757097 - DNA, 22 bp, Homo sapiens
atgttatgtctgggaaggggta

SEQ ID NO: 8757098 - DNA, 22 bp, Homo sapiens
atgttatgtctgggaaggggta

SEQ ID NO: 8757099 - DNA, 22 bp, Homo sapiens
gagtggggcgtggatccagcgt

SEQ ID NO: 8757100 - DNA, 22 bp, Homo sapiens
gagtggggaaagccaggacaga

SEQ ID NO: 8757101 - DNA, 22 bp, Homo sapiens
gagtggggaaagccaggacaga

SEQ ID NO: 8757102 - DNA, 20 bp, Homo sapiens
gagtgggccatggagtgaga

SEQ ID NO: 8757103 - DNA, 22 bp, Homo sapiens
gagtggggcccactgctgggtg

SEQ ID NO: 8757104 - DNA, 22 bp, Homo sapiens
gagtggggcccactgctgggtg

SEQ ID NO: 8757105 - DNA, 23 bp, Homo sapiens
gagtggggagaaattggttaaac

SEQ ID NO: 8757106 - DNA, 23 bp, Homo sapiens
gagtggggagaaattggttaaac

SEQ ID NO: 8757107 - DNA, 23 bp, Homo sapiens
gagtggggagaaattggttaaac

SEQ ID NO: 8757108 - DNA, 23 bp, Homo sapiens
gagtggggagaaattggttaaac

SEQ ID NO: 8757109 - DNA, 22 bp, Homo sapiens
gagtggggaaagccaggacaga

SEQ ID NO: 8757110 - DNA, 22 bp, Homo sapiens
gagtggggaaagccaggacaga

SEQ ID NO: 8757111 - DNA, 22 bp, Homo sapiens
gatgtgactaacttggtaccag

SEQ ID NO: 8757112 - DNA, 22 bp, Homo sapiens
gatgtctttctgtgtgcctaga

SEQ ID NO: 8757113 - DNA, 22 bp, Homo sapiens
gatgtgacaaaccaagaggact

SEQ ID NO: 8757114 - DNA, 22 bp, Homo sapiens
gatgtgacaaaccaagaggact

SEQ ID NO: 8757115 - DNA, 22 bp, Homo sapiens
gatgtgaggtggtaaacaggga

SEQ ID NO: 8757116 - DNA, 22 bp, Homo sapiens
gatgtctttgctgttatccact

SEQ ID NO: 8757117 - DNA, 22 bp, Homo sapiens
gatgtctttgccatgcatgtgt

SEQ ID NO: 8757118 - DNA, 22 bp, Homo sapiens
gatgtctttgaggctcactgct

SEQ ID NO: 8757119 - DNA, 22 bp, Homo sapiens
gatgtctttctgtgtgcctaga

SEQ ID NO: 8757120 - DNA, 22 bp, Homo sapiens
gatgtctttagggcaaaatatt

SEQ ID NO: 8757121 - DNA, 20 bp, Homo sapiens
gatgtcttggtcacagtggc

SEQ ID NO: 8757122 - DNA, 22 bp, Homo sapiens
gatgtcttgttgatttcattct

SEQ ID NO: 8757123 - DNA, 22 bp, Homo sapiens
gatgtcttcccatgttcatgtg

SEQ ID NO: 8757124 - DNA, 22 bp, Homo sapiens
gatgtcttctcaactgtagacc

SEQ ID NO: 8757125 - DNA, 22 bp, Homo sapiens
gatgtcttctcaactgtagacc

SEQ ID NO: 8757126 - DNA, 22 bp, Homo sapiens
gatgtcttctcaactgtagacc

SEQ ID NO: 8757127 - DNA, 22 bp, Homo sapiens
gattcactcatattttacgttt

SEQ ID NO: 8757128 - DNA, 22 bp, Homo sapiens
gattcactcatattttacgttt

SEQ ID NO: 8757129 - DNA, 22 bp, Homo sapiens
gattcatgttatagagagtcag

SEQ ID NO: 8757130 - DNA, 22 bp, Homo sapiens
gattccaaatggagatgtccac

SEQ ID NO: 8757131 - DNA, 22 bp, Homo sapiens
gattcattctcagtttctagag

SEQ ID NO: 8757132 - DNA, 22 bp, Homo sapiens
gattcattctcagtttctagag

SEQ ID NO: 8757133 - DNA, 22 bp, Homo sapiens
gatgtgtaacatgctgtgacat

SEQ ID NO: 8757134 - DNA, 22 bp, Homo sapiens
gatgtgggtgtcttcagctggt

SEQ ID NO: 8757135 - DNA, 22 bp, Homo sapiens
gatgtggggttgagggaccagc

SEQ ID NO: 8757136 - DNA, 22 bp, Homo sapiens
gatgtggctgccatggagcctg

SEQ ID NO: 8757137 - DNA, 22 bp, Homo sapiens
gatgtggctgccatggagcctg

SEQ ID NO: 8757138 - DNA, 22 bp, Homo sapiens
gatgtggctgctctaaagccca

SEQ ID NO: 8757139 - DNA, 22 bp, Homo sapiens
gatgtggatgatcttagatggt

SEQ ID NO: 8757140 - DNA, 22 bp, Homo sapiens
gattctgagacagaaacgtatt

SEQ ID NO: 8757141 - DNA, 22 bp, Homo sapiens
gattctgagctggtgttttacg

SEQ ID NO: 8757142 - DNA, 22 bp, Homo sapiens
gattcctaacagcaacaggtga

SEQ ID NO: 8757143 - DNA, 22 bp, Homo sapiens
gattcttgggccttctgaagtt

SEQ ID NO: 8757144 - DNA, 22 bp, Homo sapiens
attaaattggacgctgggggaa

SEQ ID NO: 8757145 - DNA, 22 bp, Homo sapiens
gattcttatgagtgaactttac

SEQ ID NO: 8757146 - DNA, 22 bp, Homo sapiens
gattcttgggccttctgaagtt

SEQ ID NO: 8757147 - DNA, 22 bp, Homo sapiens
attaaattggatctgcatagtt

SEQ ID NO: 8757148 - DNA, 22 bp, Homo sapiens
attaacatgcagccagacacac

SEQ ID NO: 8757149 - DNA, 22 bp, Homo sapiens
attaacatgcagccagacacac

SEQ ID NO: 8757150 - DNA, 22 bp, Homo sapiens
attaacagtttatgatgtgcct

SEQ ID NO: 8757151 - DNA, 20 bp, Homo sapiens
attaacactgagctatgggt

SEQ ID NO: 8757152 - DNA, 20 bp, Homo sapiens
attaacactgagctatgggt

SEQ ID NO: 8757153 - DNA, 22 bp, Homo sapiens
attaacactttggagtctgctc

SEQ ID NO: 8757154 - DNA, 22 bp, Homo sapiens
attaacagaattttacatgctt

SEQ ID NO: 8757155 - DNA, 22 bp, Homo sapiens
attaaattttcactaggctccc

SEQ ID NO: 8757156 - DNA, 22 bp, Homo sapiens
attaaattttcactaggctccc

SEQ ID NO: 8757157 - DNA, 22 bp, Homo sapiens
attaagaatcacacggctgtgt

SEQ ID NO: 8757158 - DNA, 21 bp, Homo sapiens
attaacttgttaacctaaagt

SEQ ID NO: 8757159 - DNA, 22 bp, Homo sapiens
attaacttttgatcagtgtggt

SEQ ID NO: 8757160 - DNA, 22 bp, Homo sapiens
attaagatcattgtagaagatt

SEQ ID NO: 8757161 - DNA, 22 bp, Homo sapiens
attagttgtacagttcattttg

SEQ ID NO: 8757162 - DNA, 22 bp, Homo sapiens
attaagagttacaaatagagta

SEQ ID NO: 8757163 - DNA, 22 bp, Homo sapiens
attaagagcctactatgtgccg

SEQ ID NO: 8757164 - DNA, 22 bp, Homo sapiens
attaagagttacaaatagagta

SEQ ID NO: 8757165 - DNA, 22 bp, Homo sapiens
attataggcttgagccaccgtg

SEQ ID NO: 8757166 - DNA, 22 bp, Homo sapiens
attataggcttgagccaccgtg

SEQ ID NO: 8757167 - DNA, 22 bp, Homo sapiens
attataggcttgagccaccgtg

SEQ ID NO: 8757168 - DNA, 22 bp, Homo sapiens
attataggcttgagccaccgtg

SEQ ID NO: 8757169 - DNA, 22 bp, Homo sapiens
attataggcttgagccaccgtg

SEQ ID NO: 8757170 - DNA, 22 bp, Homo sapiens
gcacacagaattgattcactgt

SEQ ID NO: 8757171 - DNA, 22 bp, Homo sapiens
gcacacagaatcagtgggcata

SEQ ID NO: 8757172 - DNA, 22 bp, Homo sapiens
attatcagccgtcccactacat

SEQ ID NO: 8757173 - DNA, 22 bp, Homo sapiens
attatcagaaattcaaagggtg

SEQ ID NO: 8757174 - DNA, 22 bp, Homo sapiens
attatcacaggtgagtctcact

SEQ ID NO: 8757175 - DNA, 22 bp, Homo sapiens
attatcacatggactttgcttt

SEQ ID NO: 8757176 - DNA, 22 bp, Homo sapiens
attatcaagtttactgtgtgga

SEQ ID NO: 8757177 - DNA, 22 bp, Homo sapiens
attatcaagtttactgtgtgga

SEQ ID NO: 8757178 - DNA, 22 bp, Homo sapiens
attatattgagtataaccagag

SEQ ID NO: 8757179 - DNA, 22 bp, Homo sapiens
attatattgagtataaccagag

SEQ ID NO: 8757180 - DNA, 22 bp, Homo sapiens
attatattgagtataaccagag

SEQ ID NO: 8757181 - DNA, 22 bp, Homo sapiens
attatatgtgggatagaattta

SEQ ID NO: 8757182 - DNA, 22 bp, Homo sapiens
attatataggacttgcccttcc

SEQ ID NO: 8757183 - DNA, 22 bp, Homo sapiens
attatataaaattctggaagct

SEQ ID NO: 8757184 - DNA, 22 bp, Homo sapiens
attatataggacttgcccttcc

SEQ ID NO: 8757185 - DNA, 22 bp, Homo sapiens
gcacacagactaaccatatttc

SEQ ID NO: 8757186 - DNA, 22 bp, Homo sapiens
gcacacagattaggaaacagaa

SEQ ID NO: 8757187 - DNA, 22 bp, Homo sapiens
gcacacagccagctgagggcta

SEQ ID NO: 8757188 - DNA, 22 bp, Homo sapiens
gcacacaggcagtttccagcca

SEQ ID NO: 8757189 - DNA, 22 bp, Homo sapiens
gcacacagctagattaccattc

SEQ ID NO: 8757190 - DNA, 22 bp, Homo sapiens
gcacacagctagattaccattc

SEQ ID NO: 8757191 - DNA, 22 bp, Homo sapiens
gcaccaggcagctgagcaggcc

SEQ ID NO: 8757192 - DNA, 22 bp, Homo sapiens
gcaccaggcttagagccccagg

SEQ ID NO: 8757193 - DNA, 22 bp, Homo sapiens
gcaccaggcttagagccccagg

SEQ ID NO: 8757194 - DNA, 22 bp, Homo sapiens
gcaccagggtgctgtgttctgg

SEQ ID NO: 8757195 - DNA, 22 bp, Homo sapiens
gcaccagggagggtgtgcttca

SEQ ID NO: 8757196 - DNA, 22 bp, Homo sapiens
gcaccatgacagtgaggagaac

SEQ ID NO: 8757197 - DNA, 22 bp, Homo sapiens
gcaccaggtgcagccgggcccc

SEQ ID NO: 8757198 - DNA, 22 bp, Homo sapiens
gcaccaggtgcagccgggcccc

SEQ ID NO: 8757199 - DNA, 22 bp, Homo sapiens
gcaccaggtgcagccgggcccc

SEQ ID NO: 8757200 - DNA, 22 bp, Homo sapiens
gcaccaggcagctgagcaggcc

SEQ ID NO: 8757201 - DNA, 22 bp, Homo sapiens
gcaccaggcagctgagcaggcc

SEQ ID NO: 8757202 - DNA, 22 bp, Homo sapiens
gcacagggccctgtgcgtaggt

SEQ ID NO: 8757203 - DNA, 22 bp, Homo sapiens
gcaccaggaggcccttctcatc

SEQ ID NO: 8757204 - DNA, 22 bp, Homo sapiens
gcacagggcctggcacataaga

SEQ ID NO: 8757205 - DNA, 22 bp, Homo sapiens
gcacagggcctggcacataaga

SEQ ID NO: 8757206 - DNA, 22 bp, Homo sapiens
gcagagaggatattattgtcca

SEQ ID NO: 8757207 - DNA, 22 bp, Homo sapiens
gcagagaggatattattgtcca

SEQ ID NO: 8757208 - DNA, 22 bp, Homo sapiens
gcagagagttgggctgcgccag

SEQ ID NO: 8757209 - DNA, 22 bp, Homo sapiens
gcagagagttgggctgcgccag

SEQ ID NO: 8757210 - DNA, 22 bp, Homo sapiens
gcagagaggaatgaagccatcc

SEQ ID NO: 8757211 - DNA, 22 bp, Homo sapiens
gcagagactccactgtcttgtg

SEQ ID NO: 8757212 - DNA, 22 bp, Homo sapiens
gcagagactagtagtgcagact

SEQ ID NO: 8757213 - DNA, 22 bp, Homo sapiens
gcagagaggaatgaagccatcc

SEQ ID NO: 8757214 - DNA, 22 bp, Homo sapiens
gcagagaggaatgaagccatcc

SEQ ID NO: 8757215 - DNA, 22 bp, Homo sapiens
gcagagaggaatgaagccatcc

SEQ ID NO: 8757216 - DNA, 22 bp, Homo sapiens
gcagagacagactaatgaaaag

SEQ ID NO: 8757217 - DNA, 22 bp, Homo sapiens
gcagagacagactaatgaaaag

SEQ ID NO: 8757218 - DNA, 22 bp, Homo sapiens
gcagagacagactaatgaaaag

SEQ ID NO: 8757219 - DNA, 22 bp, Homo sapiens
gcagagactagtagtgcagact

SEQ ID NO: 8757220 - DNA, 22 bp, Homo sapiens
gcagagaccccgcagtgaggcc

SEQ ID NO: 8757221 - DNA, 22 bp, Homo sapiens
gcagagactagtagtgcagact

SEQ ID NO: 8757222 - DNA, 22 bp, Homo sapiens
gcagagacaggataatgggttc

SEQ ID NO: 8757223 - DNA, 22 bp, Homo sapiens
gcagagaccccgcagtgaggcc

SEQ ID NO: 8757224 - DNA, 22 bp, Homo sapiens
gcagagattatgccatggaaag

SEQ ID NO: 8757225 - DNA, 22 bp, Homo sapiens
gcagagattatgccatggaaag

SEQ ID NO: 8757226 - DNA, 22 bp, Homo sapiens
attcaagtacagttttcttctt

SEQ ID NO: 8757227 - DNA, 22 bp, Homo sapiens
attcaagtccagcttctctaca

SEQ ID NO: 8757228 - DNA, 22 bp, Homo sapiens
attcaagtacagttttcttctt

SEQ ID NO: 8757229 - DNA, 22 bp, Homo sapiens
attcaagtacagttttcttctt

SEQ ID NO: 8757230 - DNA, 22 bp, Homo sapiens
attcaataaatatgctacatgg

SEQ ID NO: 8757231 - DNA, 22 bp, Homo sapiens
attcaagttcttctgtctttgc

SEQ ID NO: 8757232 - DNA, 22 bp, Homo sapiens
attcaagttcttctgtctttgc

SEQ ID NO: 8757233 - DNA, 22 bp, Homo sapiens
attcaagttcttctgtctttgc

SEQ ID NO: 8757234 - DNA, 22 bp, Homo sapiens
attcaagtccagcttctctaca

SEQ ID NO: 8757235 - DNA, 22 bp, Homo sapiens
attcaagtccagcttctctaca

SEQ ID NO: 8757236 - DNA, 22 bp, Homo sapiens
attcaagtggctgctatgttaa

SEQ ID NO: 8757237 - DNA, 22 bp, Homo sapiens
gcagagatgggccagtgacgca

SEQ ID NO: 8757238 - DNA, 22 bp, Homo sapiens
gcagagatgggccagtgacgca

SEQ ID NO: 8757239 - DNA, 22 bp, Homo sapiens
gcagagataagtagacaggatg

SEQ ID NO: 8757240 - DNA, 22 bp, Homo sapiens
gcagagatctgagaaggctgcc

SEQ ID NO: 8757241 - DNA, 22 bp, Homo sapiens
attatctcaagggatagcagat

SEQ ID NO: 8757242 - DNA, 22 bp, Homo sapiens
attatctcaagggatagcagat

SEQ ID NO: 8757243 - DNA, 22 bp, Homo sapiens
attatgcatatacatttgacta

SEQ ID NO: 8757244 - DNA, 22 bp, Homo sapiens
attatgcatatacatttgacta

SEQ ID NO: 8757245 - DNA, 22 bp, Homo sapiens
attatgctcacctggcaacttg

SEQ ID NO: 8757246 - DNA, 22 bp, Homo sapiens
gcacccagaataaggacaggac

SEQ ID NO: 8757247 - DNA, 22 bp, Homo sapiens
gcaccatgatggagcctcatta

SEQ ID NO: 8757248 - DNA, 22 bp, Homo sapiens
attatgtctttagatatttggt

SEQ ID NO: 8757249 - DNA, 22 bp, Homo sapiens
attatgtctttagatatttggt

SEQ ID NO: 8757250 - DNA, 21 bp, Homo sapiens
attatgttcccatctgtttgg

SEQ ID NO: 8757251 - DNA, 21 bp, Homo sapiens
attatgttcccatctgtttgg

SEQ ID NO: 8757252 - DNA, 22 bp, Homo sapiens
gcagagaaggattgaaaccaga

SEQ ID NO: 8757253 - DNA, 22 bp, Homo sapiens
gcagacaaagcagcatgcctat

SEQ ID NO: 8757254 - DNA, 22 bp, Homo sapiens
attatgtatttggtatagtttg

SEQ ID NO: 8757255 - DNA, 22 bp, Homo sapiens
aaaatagttaacgttcagagta

SEQ ID NO: 8757256 - DNA, 22 bp, Homo sapiens
aaaatagttaacgttcagagta

SEQ ID NO: 8757257 - DNA, 22 bp, Homo sapiens
aaaatagttaacgttcagagta

SEQ ID NO: 8757258 - DNA, 22 bp, Homo sapiens
aaaatagttaacgttcagagta

SEQ ID NO: 8757259 - DNA, 22 bp, Homo sapiens
aaaaacctttcccatactaaga

SEQ ID NO: 8757260 - DNA, 22 bp, Homo sapiens
aaaaacctttcattgcaaatgt

SEQ ID NO: 8757261 - DNA, 22 bp, Homo sapiens
aaaaacctttcccatactaaga

SEQ ID NO: 8757262 - DNA, 22 bp, Homo sapiens
aaaaaccattgtcttcagtctc

SEQ ID NO: 8757263 - DNA, 22 bp, Homo sapiens
aaaaaccattgtcttcagtctc

SEQ ID NO: 8757264 - DNA, 22 bp, Homo sapiens
aaaaacctcaattacttttgca

SEQ ID NO: 8757265 - DNA, 22 bp, Homo sapiens
aaaaaccattgtcttcagtctc

SEQ ID NO: 8757266 - DNA, 22 bp, Homo sapiens
aaaaaccattgtcttcagtctc

SEQ ID NO: 8757267 - DNA, 23 bp, Homo sapiens
aaaatcttctgcctatgaagaaa

SEQ ID NO: 8757268 - DNA, 23 bp, Homo sapiens
aaaatcttctgcctatgaagaaa

SEQ ID NO: 8757269 - DNA, 23 bp, Homo sapiens
aaaatcttctgcctatgaagaaa

SEQ ID NO: 8757270 - DNA, 23 bp, Homo sapiens
aaaatcttctgcctatgaagaaa

SEQ ID NO: 8757271 - DNA, 22 bp, Homo sapiens
aaaatcttgactgtttttagaa

SEQ ID NO: 8757272 - DNA, 22 bp, Homo sapiens
aaaatcttgactgtttttagaa

SEQ ID NO: 8757273 - DNA, 22 bp, Homo sapiens
aaaatcttgactgtttttagaa

SEQ ID NO: 8757274 - DNA, 22 bp, Homo sapiens
aaaatcttgactgtttttagaa

SEQ ID NO: 8757275 - DNA, 22 bp, Homo sapiens
aaaatcttgactgtttttagaa

SEQ ID NO: 8757276 - DNA, 22 bp, Homo sapiens
aaaatgaacagaacaatgggga

SEQ ID NO: 8757277 - DNA, 22 bp, Homo sapiens
aaaatgaagcaaaggcattcag

SEQ ID NO: 8757278 - DNA, 22 bp, Homo sapiens
aaaatgaagcaaaggcattcag

SEQ ID NO: 8757279 - DNA, 22 bp, Homo sapiens
aaaatgaacagaacaatgggga

SEQ ID NO: 8757280 - DNA, 22 bp, Homo sapiens
aaaatgaagcaaaggcattcag

SEQ ID NO: 8757281 - DNA, 22 bp, Homo sapiens
aaaatcttgtgacttaggaagg

SEQ ID NO: 8757282 - DNA, 22 bp, Homo sapiens
aaaatcttgtgacttaggaagg

SEQ ID NO: 8757283 - DNA, 22 bp, Homo sapiens
aaaatcttgtgacttaggaagg

SEQ ID NO: 8757284 - DNA, 22 bp, Homo sapiens
aaaaacacaagtggcttggtct

SEQ ID NO: 8757285 - DNA, 22 bp, Homo sapiens
aaaaacacaactgtctttctct

SEQ ID NO: 8757286 - DNA, 22 bp, Homo sapiens
aaaaacacaactgtctttctct

SEQ ID NO: 8757287 - DNA, 22 bp, Homo sapiens
aaaaacacaactgtctttctct

SEQ ID NO: 8757288 - DNA, 22 bp, Homo sapiens
aaaaacacaactgtctttctct

SEQ ID NO: 8757289 - DNA, 20 bp, Homo sapiens
aaaaacagtaatgctgaaga

SEQ ID NO: 8757290 - DNA, 20 bp, Homo sapiens
aaaaacagtaatgctgaaga

SEQ ID NO: 8757291 - DNA, 22 bp, Homo sapiens
aaaaacactgggctgggagtca

SEQ ID NO: 8757292 - DNA, 22 bp, Homo sapiens
aaaaacacaagtggcttggtct

SEQ ID NO: 8757293 - DNA, 22 bp, Homo sapiens
aaaaacactgggctgggagtca

SEQ ID NO: 8757294 - DNA, 22 bp, Homo sapiens
aaaaaattatcatagttcctga

SEQ ID NO: 8757295 - DNA, 22 bp, Homo sapiens
aaaaaatcagatctttggttaa

SEQ ID NO: 8757296 - DNA, 22 bp, Homo sapiens
aaaaaatcagatctttggttaa

SEQ ID NO: 8757297 - DNA, 22 bp, Homo sapiens
aaaaaattatcatagttcctga

SEQ ID NO: 8757298 - DNA, 22 bp, Homo sapiens
aaaaaagattgatggtggatgc

SEQ ID NO: 8757299 - DNA, 22 bp, Homo sapiens
aaaaaagattgatggtggatgc

SEQ ID NO: 8757300 - DNA, 22 bp, Homo sapiens
aaaaaagattgatggtggatgc

SEQ ID NO: 8757301 - DNA, 23 bp, Homo sapiens
aaaaaaccatgtaggcactcagt

SEQ ID NO: 8757302 - DNA, 23 bp, Homo sapiens
aaaaaaccatgtaggcactcagt

SEQ ID NO: 8757303 - DNA, 22 bp, Homo sapiens
aaaaaagattgatggtggatgc

SEQ ID NO: 8757304 - DNA, 22 bp, Homo sapiens
aaaaatctatgactgcttctcc

SEQ ID NO: 8757305 - DNA, 22 bp, Homo sapiens
aaaaatctatgactgcttctcc

SEQ ID NO: 8757306 - DNA, 22 bp, Homo sapiens
aaacacaggtactgcagaagtg

SEQ ID NO: 8757307 - DNA, 22 bp, Homo sapiens
aaaaatcacttttataggcagc

SEQ ID NO: 8757308 - DNA, 22 bp, Homo sapiens
aaaaatcacttttataggcagc

SEQ ID NO: 8757309 - DNA, 22 bp, Homo sapiens
aaaaatcacttttataggcagc

SEQ ID NO: 8757310 - DNA, 22 bp, Homo sapiens
aaaaatcacttttataggcagc

SEQ ID NO: 8757311 - DNA, 22 bp, Homo sapiens
aaaaatcacttttataggcagc

SEQ ID NO: 8757312 - DNA, 22 bp, Homo sapiens
aaaaatcacttttataggcagc

SEQ ID NO: 8757313 - DNA, 22 bp, Homo sapiens
aaaaatcacttttataggcagc

SEQ ID NO: 8757314 - DNA, 22 bp, Homo sapiens
aaaaatcacttttataggcagc

SEQ ID NO: 8757315 - DNA, 22 bp, Homo sapiens
aaaatgaataagttaacccagg

SEQ ID NO: 8757316 - DNA, 22 bp, Homo sapiens
aaaatgaataagttaacccagg

SEQ ID NO: 8757317 - DNA, 22 bp, Homo sapiens
aaaatgaataagttaacccagg

SEQ ID NO: 8757318 - DNA, 22 bp, Homo sapiens
aaaatgaataagttaacccagg

SEQ ID NO: 8757319 - DNA, 22 bp, Homo sapiens
aaaatgacattccagtgatatt

SEQ ID NO: 8757320 - DNA, 22 bp, Homo sapiens
aaaatgacattccagtgatatt

SEQ ID NO: 8757321 - DNA, 22 bp, Homo sapiens
aaaatgacattccagtgatatt

SEQ ID NO: 8757322 - DNA, 22 bp, Homo sapiens
aaaatgaataagttaacccagg

SEQ ID NO: 8757323 - DNA, 22 bp, Homo sapiens
aaaaataggtcaaccgtgtatg

SEQ ID NO: 8757324 - DNA, 22 bp, Homo sapiens
aaaaatagcttctcttgtccct

SEQ ID NO: 8757325 - DNA, 22 bp, Homo sapiens
aaaaatagcttctcttgtccct

SEQ ID NO: 8757326 - DNA, 22 bp, Homo sapiens
aaaaatagaaggattgactgag

SEQ ID NO: 8757327 - DNA, 22 bp, Homo sapiens
aaaaatagaaggattgactgag

SEQ ID NO: 8757328 - DNA, 22 bp, Homo sapiens
aaaagacatctatttcaggcag

SEQ ID NO: 8757329 - DNA, 22 bp, Homo sapiens
aaaagacatctatttcaggcag

SEQ ID NO: 8757330 - DNA, 22 bp, Homo sapiens
aaaagacatctatttcaggcag

SEQ ID NO: 8757331 - DNA, 22 bp, Homo sapiens
aaaagacatctatttcaggcag

SEQ ID NO: 8757332 - DNA, 22 bp, Homo sapiens
aaaagacatctatttcaggcag

SEQ ID NO: 8757333 - DNA, 22 bp, Homo sapiens
aaaagacatatgtgggcattct

SEQ ID NO: 8757334 - DNA, 22 bp, Homo sapiens
aaaagacatatgtgggcattct

SEQ ID NO: 8757335 - DNA, 22 bp, Homo sapiens
aaaagacatatgtgggcattct

SEQ ID NO: 8757336 - DNA, 22 bp, Homo sapiens
aaaagacaggtgtctgcggccc

SEQ ID NO: 8757337 - DNA, 22 bp, Homo sapiens
aaaagacaggtgtctgcggccc

SEQ ID NO: 8757338 - DNA, 22 bp, Homo sapiens
aaacagagagatgtatgtggag

SEQ ID NO: 8757339 - DNA, 21 bp, Homo sapiens
aaacagagctgagtaatagat

SEQ ID NO: 8757340 - DNA, 22 bp, Homo sapiens
aaacagagggccactgaggctc

SEQ ID NO: 8757341 - DNA, 22 bp, Homo sapiens
aaacagagggccactgaggctc

SEQ ID NO: 8757342 - DNA, 22 bp, Homo sapiens
aaacagagggccactgaggctc

SEQ ID NO: 8757343 - DNA, 22 bp, Homo sapiens
aaacagaagggtaggtaaacat

SEQ ID NO: 8757344 - DNA, 22 bp, Homo sapiens
aaacagaagggtaggtaaacat

SEQ ID NO: 8757345 - DNA, 22 bp, Homo sapiens
aaacagactgcactgccagtca

SEQ ID NO: 8757346 - DNA, 22 bp, Homo sapiens
aaacagactgaagagttgaagc

SEQ ID NO: 8757347 - DNA, 22 bp, Homo sapiens
aaacagagagatgtatgtggag

SEQ ID NO: 8757348 - DNA, 22 bp, Homo sapiens
aaacacttcaaggacttctgtc

SEQ ID NO: 8757349 - DNA, 22 bp, Homo sapiens
aaacactgtgtcaaactggggc

SEQ ID NO: 8757350 - DNA, 22 bp, Homo sapiens
aaacactgtgtcaaactggggc

SEQ ID NO: 8757351 - DNA, 22 bp, Homo sapiens
aaacacttcaaggacttctgtc

SEQ ID NO: 8757352 - DNA, 22 bp, Homo sapiens
aaacacttcaaggacttctgtc

SEQ ID NO: 8757353 - DNA, 22 bp, Homo sapiens
aaacacttcaaggacttctgtc

SEQ ID NO: 8757354 - DNA, 22 bp, Homo sapiens
aaacacttcaaggacttctgtc

SEQ ID NO: 8757355 - DNA, 22 bp, Homo sapiens
aaacacttcaaggacttctgtc

SEQ ID NO: 8757356 - DNA, 22 bp, Homo sapiens
aaacacttcctgtaacatgaca

SEQ ID NO: 8757357 - DNA, 22 bp, Homo sapiens
aaacacttcctgtaacatgaca

SEQ ID NO: 8757358 - DNA, 22 bp, Homo sapiens
aaacacttcctgtaacatgaca

SEQ ID NO: 8757359 - DNA, 22 bp, Homo sapiens
aaacacttcctgtaacatgaca

SEQ ID NO: 8757360 - DNA, 22 bp, Homo sapiens
aaacagaaatttcctcatgctc

SEQ ID NO: 8757361 - DNA, 22 bp, Homo sapiens
aaacagaaatttcctcatgctc

SEQ ID NO: 8757362 - DNA, 22 bp, Homo sapiens
aaacagaaatttcctcatgctc

SEQ ID NO: 8757363 - DNA, 22 bp, Homo sapiens
aaacactttagaaagggacttg

SEQ ID NO: 8757364 - DNA, 22 bp, Homo sapiens
aaacactttagaaagggacttg

SEQ ID NO: 8757365 - DNA, 22 bp, Homo sapiens
aaacactttaagtgaggaggat

SEQ ID NO: 8757366 - DNA, 22 bp, Homo sapiens
aaacactttaagtgaggaggat

SEQ ID NO: 8757367 - DNA, 22 bp, Homo sapiens
aaacacttgcaaaatggttcct

SEQ ID NO: 8757368 - DNA, 22 bp, Homo sapiens
aaacacttgcaaaatggttcct

SEQ ID NO: 8757369 - DNA, 22 bp, Homo sapiens
aaacacttcttaggtcttaagt

SEQ ID NO: 8757370 - DNA, 22 bp, Homo sapiens
aaacacttcttaggtcttaagt

SEQ ID NO: 8757371 - DNA, 22 bp, Homo sapiens
aaacacttcttaggtcttaagt

SEQ ID NO: 8757372 - DNA, 22 bp, Homo sapiens
aaaatcctgctgactcgagatg

SEQ ID NO: 8757373 - DNA, 22 bp, Homo sapiens
aaaatccttagccgagtgaggt

SEQ ID NO: 8757374 - DNA, 22 bp, Homo sapiens
aaaatctaagtagcgagtaagg

SEQ ID NO: 8757375 - DNA, 22 bp, Homo sapiens
aaaatctaagtagcgagtaagg

SEQ ID NO: 8757376 - DNA, 22 bp, Homo sapiens
aaaatctgcacaggtcagtttt

SEQ ID NO: 8757377 - DNA, 22 bp, Homo sapiens
aaaatctgcacaggtcagtttt

SEQ ID NO: 8757378 - DNA, 22 bp, Homo sapiens
aaaatctgcacaggtcagtttt

SEQ ID NO: 8757379 - DNA, 20 bp, Homo sapiens
aaaatctcccagaaacttat

SEQ ID NO: 8757380 - DNA, 22 bp, Homo sapiens
aaacaagagtcttgctccacct

SEQ ID NO: 8757381 - DNA, 23 bp, Homo sapiens
aaacaagccctaatgaagagtcc

SEQ ID NO: 8757382 - DNA, 22 bp, Homo sapiens
aaacaagagtcttgctccacct

SEQ ID NO: 8757383 - DNA, 22 bp, Homo sapiens
aaacaaacaattagttgtgtgg

SEQ ID NO: 8757384 - DNA, 20 bp, Homo sapiens
aaacaaggttgctctgagga

SEQ ID NO: 8757385 - DNA, 20 bp, Homo sapiens
aaacaaggttgctctgagga

SEQ ID NO: 8757386 - DNA, 20 bp, Homo sapiens
aaacaaggttgctctgagga

SEQ ID NO: 8757387 - DNA, 22 bp, Homo sapiens
aaacaaggtccttctgtgacat

SEQ ID NO: 8757388 - DNA, 20 bp, Homo sapiens
aaacaaggttgctctgagga

SEQ ID NO: 8757389 - DNA, 22 bp, Homo sapiens
aaacaaggtccttctgtgacat

SEQ ID NO: 8757390 - DNA, 22 bp, Homo sapiens
aaacaaggtccttctgtgacat

SEQ ID NO: 8757391 - DNA, 22 bp, Homo sapiens
aaacaagctgcagacaagccat

SEQ ID NO: 8757392 - DNA, 22 bp, Homo sapiens
aaacaaggtacacagtaatggt

SEQ ID NO: 8757393 - DNA, 22 bp, Homo sapiens
aaacaaggtacacagtaatggt

SEQ ID NO: 8757394 - DNA, 22 bp, Homo sapiens
aaacaaggtacacagtaatggt

SEQ ID NO: 8757395 - DNA, 22 bp, Homo sapiens
aaacaaggaaatgtttggttgc

SEQ ID NO: 8757396 - DNA, 22 bp, Homo sapiens
aaacaaggcacaattcaggatt

SEQ ID NO: 8757397 - DNA, 22 bp, Homo sapiens
aaacaagtttagaataatgaat

SEQ ID NO: 8757398 - DNA, 22 bp, Homo sapiens
aaacaagtttagaataatgaat

SEQ ID NO: 8757399 - DNA, 23 bp, Homo sapiens
aaacaagtctctcaatggcttgc

SEQ ID NO: 8757400 - DNA, 22 bp, Homo sapiens
aaacaatgaaattcattcttca

SEQ ID NO: 8757401 - DNA, 22 bp, Homo sapiens
aaacaatgaaatatttttatgg

SEQ ID NO: 8757402 - DNA, 22 bp, Homo sapiens
aaacaatgaaatatttttatgg

SEQ ID NO: 8757403 - DNA, 22 bp, Homo sapiens
aaacaatgaaatatttttatgg

SEQ ID NO: 8757404 - DNA, 22 bp, Homo sapiens
aaacaagtttgtagactagcca

SEQ ID NO: 8757405 - DNA, 22 bp, Homo sapiens
aaacaagtttgtagactagcca

SEQ ID NO: 8757406 - DNA, 22 bp, Homo sapiens
aaagactaaatgaatgagctca

SEQ ID NO: 8757407 - DNA, 22 bp, Homo sapiens
aaagactaaccagttgtcaaaa

SEQ ID NO: 8757408 - DNA, 22 bp, Homo sapiens
aaaatcacaagcttgggtcact

SEQ ID NO: 8757409 - DNA, 22 bp, Homo sapiens
aaaatattttagggccaggaga

SEQ ID NO: 8757410 - DNA, 21 bp, Homo sapiens
aaaatcaccttaggtcactgg

SEQ ID NO: 8757411 - DNA, 22 bp, Homo sapiens
aaaatcacacaagtagatgggg

SEQ ID NO: 8757412 - DNA, 22 bp, Homo sapiens
aaaatcacaagcttgggtcact

SEQ ID NO: 8757413 - DNA, 22 bp, Homo sapiens
aaaatcacacaagtagatgggg

SEQ ID NO: 8757414 - DNA, 22 bp, Homo sapiens
aaaatcagtacactttattttg

SEQ ID NO: 8757415 - DNA, 22 bp, Homo sapiens
aaaatcagtacactttattttg

SEQ ID NO: 8757416 - DNA, 21 bp, Homo sapiens
aaaatcaccttaggtcactgg

SEQ ID NO: 8757417 - DNA, 22 bp, Homo sapiens
aaaatcctctaattctagaata

SEQ ID NO: 8757418 - DNA, 23 bp, Homo sapiens
aaaatcattaatttaccctgaaa

SEQ ID NO: 8757419 - DNA, 22 bp, Homo sapiens
aaaatccacaacgctcatttca

SEQ ID NO: 8757420 - DNA, 22 bp, Homo sapiens
aaaatccacaacgctcatttca

SEQ ID NO: 8757421 - DNA, 22 bp, Homo sapiens
aaagacattagattaacgtaca

SEQ ID NO: 8757422 - DNA, 22 bp, Homo sapiens
aaagacattagattaacgtaca

SEQ ID NO: 8757423 - DNA, 22 bp, Homo sapiens
aaagacatggcaagagatgggg

SEQ ID NO: 8757424 - DNA, 22 bp, Homo sapiens
aaagacatggcaagagatgggg

SEQ ID NO: 8757425 - DNA, 22 bp, Homo sapiens
aaagacattagcttagatgtca

SEQ ID NO: 8757426 - DNA, 22 bp, Homo sapiens
aaagacattagcttagatgtca

SEQ ID NO: 8757427 - DNA, 22 bp, Homo sapiens
aaagacattagcttagatgtca

SEQ ID NO: 8757428 - DNA, 22 bp, Homo sapiens
aaagacattagcttagatgtca

SEQ ID NO: 8757429 - DNA, 22 bp, Homo sapiens
aaagacattagattaacgtaca

SEQ ID NO: 8757430 - DNA, 22 bp, Homo sapiens
aaagaccatgtttacagctagg

SEQ ID NO: 8757431 - DNA, 22 bp, Homo sapiens
aaagaccatgtttacagctagg

SEQ ID NO: 8757432 - DNA, 22 bp, Homo sapiens
aaagacctgaaatataatctag

SEQ ID NO: 8757433 - DNA, 23 bp, Homo sapiens
aaagacctaggatgagggagacg

SEQ ID NO: 8757434 - DNA, 22 bp, Homo sapiens
aaagactaaacaaccaatatct

SEQ ID NO: 8757435 - DNA, 22 bp, Homo sapiens
aaagacctgtggtagctctaaa

SEQ ID NO: 8757436 - DNA, 22 bp, Homo sapiens
aaagacattgaagaaggactta

SEQ ID NO: 8757437 - DNA, 22 bp, Homo sapiens
aaagacattgaagaaggactta

SEQ ID NO: 8757438 - DNA, 22 bp, Homo sapiens
aaagacattgaagaaggactta

SEQ ID NO: 8757439 - DNA, 22 bp, Homo sapiens
aaagacattgaagaaggactta

SEQ ID NO: 8757440 - DNA, 22 bp, Homo sapiens
aaagaccatgtttacagctagg

SEQ ID NO: 8757441 - DNA, 22 bp, Homo sapiens
aaaagagaatcctgtacagaga

SEQ ID NO: 8757442 - DNA, 22 bp, Homo sapiens
aaaagagaaagtggcaggcttt

SEQ ID NO: 8757443 - DNA, 22 bp, Homo sapiens
aaaagagaatcctgtacagaga

SEQ ID NO: 8757444 - DNA, 22 bp, Homo sapiens
aaaagagaatcctgtacagaga

SEQ ID NO: 8757445 - DNA, 22 bp, Homo sapiens
aaaagagaatcctgtacagaga

SEQ ID NO: 8757446 - DNA, 22 bp, Homo sapiens
aaaagagaatcctgtacagaga

SEQ ID NO: 8757447 - DNA, 22 bp, Homo sapiens
aaaagagaatcctgtacagaga

SEQ ID NO: 8757448 - DNA, 22 bp, Homo sapiens
aaaagagagttgccagtctgta

SEQ ID NO: 8757449 - DNA, 22 bp, Homo sapiens
aaaagagagttgccagtctgta

SEQ ID NO: 8757450 - DNA, 22 bp, Homo sapiens
aaactcagacacagtatctgtt

SEQ ID NO: 8757451 - DNA, 22 bp, Homo sapiens
aaactcaagtttcttaatgtca

SEQ ID NO: 8757452 - DNA, 22 bp, Homo sapiens
aaactcaaattaaactagctta

SEQ ID NO: 8757453 - DNA, 22 bp, Homo sapiens
aaactcaaggatttagacgaag

SEQ ID NO: 8757454 - DNA, 22 bp, Homo sapiens
aaactcaaagtcagatcagaga

SEQ ID NO: 8757455 - DNA, 22 bp, Homo sapiens
aaactcaaagtcagatcagaga

SEQ ID NO: 8757456 - DNA, 22 bp, Homo sapiens
aaactcaagtctatgaacaagg

SEQ ID NO: 8757457 - DNA, 22 bp, Homo sapiens
aaactcaaggatttagacgaag

SEQ ID NO: 8757458 - DNA, 22 bp, Homo sapiens
aaactcaaggatttagacgaag

SEQ ID NO: 8757459 - DNA, 22 bp, Homo sapiens
aaactcaagtctatgaacaagg

SEQ ID NO: 8757460 - DNA, 21 bp, Homo sapiens
aaactagcagcaaccatgatc

SEQ ID NO: 8757461 - DNA, 20 bp, Homo sapiens
aaactagattagcagggcag

SEQ ID NO: 8757462 - DNA, 22 bp, Homo sapiens
aaactatccctgccataatttt

SEQ ID NO: 8757463 - DNA, 22 bp, Homo sapiens
aaactcaaagtcagatcagaga

SEQ ID NO: 8757464 - DNA, 22 bp, Homo sapiens
aaactcaaagtcagatcagaga

SEQ ID NO: 8757465 - DNA, 22 bp, Homo sapiens
aaactatccctgccataatttt

SEQ ID NO: 8757466 - DNA, 22 bp, Homo sapiens
aaagacatggaactagagatgg

SEQ ID NO: 8757467 - DNA, 22 bp, Homo sapiens
aaagacatggaactagagatgg

SEQ ID NO: 8757468 - DNA, 22 bp, Homo sapiens
aaagacatggaactagagatgg

SEQ ID NO: 8757469 - DNA, 22 bp, Homo sapiens
aaagaaggggtctacatccaat

SEQ ID NO: 8757470 - DNA, 22 bp, Homo sapiens
aaaagtattggccaccatttct

SEQ ID NO: 8757471 - DNA, 22 bp, Homo sapiens
aaaagtattggccaccatttct

SEQ ID NO: 8757472 - DNA, 22 bp, Homo sapiens
aaaagtatggtggtccttttta

SEQ ID NO: 8757473 - DNA, 22 bp, Homo sapiens
aaaagtatccacagctcaggag

SEQ ID NO: 8757474 - DNA, 22 bp, Homo sapiens
aaaagtatccacagctcaggag

SEQ ID NO: 8757475 - DNA, 22 bp, Homo sapiens
aaaagtactattttaacaaagt

SEQ ID NO: 8757476 - DNA, 22 bp, Homo sapiens
aaaagtactattttaacaaagt

SEQ ID NO: 8757477 - DNA, 22 bp, Homo sapiens
aaaagtactattttaacaaagt

SEQ ID NO: 8757478 - DNA, 22 bp, Homo sapiens
aaaagtactattttaacaaagt

SEQ ID NO: 8757479 - DNA, 22 bp, Homo sapiens
aaaagtatagggtttggagtca

SEQ ID NO: 8757480 - DNA, 22 bp, Homo sapiens
aaaagtatagggtttggagtca

SEQ ID NO: 8757481 - DNA, 22 bp, Homo sapiens
aaaagtactattttaacaaagt

SEQ ID NO: 8757482 - DNA, 22 bp, Homo sapiens
aaaagtactattttaacaaagt

SEQ ID NO: 8757483 - DNA, 22 bp, Homo sapiens
aaactctagggctccacattcc

SEQ ID NO: 8757484 - DNA, 22 bp, Homo sapiens
aaactctaggacgatgggatag

SEQ ID NO: 8757485 - DNA, 22 bp, Homo sapiens
aaactccagtgaatactagaat

SEQ ID NO: 8757486 - DNA, 22 bp, Homo sapiens
aaactccagtgaatactagaat

SEQ ID NO: 8757487 - DNA, 22 bp, Homo sapiens
aaactcctgcatactcagaagc

SEQ ID NO: 8757488 - DNA, 22 bp, Homo sapiens
aaactcctgggctcaagcagtt

SEQ ID NO: 8757489 - DNA, 22 bp, Homo sapiens
aaactctaagacactgtacaat

SEQ ID NO: 8757490 - DNA, 22 bp, Homo sapiens
aaactctaagacactgtacaat

SEQ ID NO: 8757491 - DNA, 22 bp, Homo sapiens
aaactctaattatgcagttctt

SEQ ID NO: 8757492 - DNA, 22 bp, Homo sapiens
aaactctaattatgcagttctt

SEQ ID NO: 8757493 - DNA, 22 bp, Homo sapiens
aaactctacatggtcgcaaaaa

SEQ ID NO: 8757494 - DNA, 20 bp, Homo sapiens
aaactctacctcaatcgtca

SEQ ID NO: 8757495 - DNA, 22 bp, Homo sapiens
aaactctaatcaaatatagcat

SEQ ID NO: 8757496 - DNA, 22 bp, Homo sapiens
aaactctaatcaaatatagcat

SEQ ID NO: 8757497 - DNA, 22 bp, Homo sapiens
aaactctagctactaggataac

SEQ ID NO: 8757498 - DNA, 22 bp, Homo sapiens
aaactctactgaggaaataaga

SEQ ID NO: 8757499 - DNA, 22 bp, Homo sapiens
aaactctactgaggaaataaga

SEQ ID NO: 8757500 - DNA, 22 bp, Homo sapiens
aaactctactgaggaaataaga

SEQ ID NO: 8757501 - DNA, 20 bp, Homo sapiens
aaactctacctcaatcgtca

SEQ ID NO: 8757502 - DNA, 22 bp, Homo sapiens
aaacagtgatgttgagtgtaaa

SEQ ID NO: 8757503 - DNA, 22 bp, Homo sapiens
aaacagtgcaggaagttaagca

SEQ ID NO: 8757504 - DNA, 17 bp, Homo sapiens
aaacagtgagtgttatg

SEQ ID NO: 8757505 - DNA, 22 bp, Homo sapiens
aaacagtgccaggcagatgcca

SEQ ID NO: 8757506 - DNA, 18 bp, Homo sapiens
aaacagtgcctaagtgtc

SEQ ID NO: 8757507 - DNA, 22 bp, Homo sapiens
aaacagtgccaggcagatgcca

SEQ ID NO: 8757508 - DNA, 22 bp, Homo sapiens
aaacagctgtcattgttttaaa

SEQ ID NO: 8757509 - DNA, 22 bp, Homo sapiens
aaacagctgtcattgttttaaa

SEQ ID NO: 8757510 - DNA, 22 bp, Homo sapiens
aaacagcttgtaaggtgtaatt

SEQ ID NO: 8757511 - DNA, 22 bp, Homo sapiens
aaacaatgttcctatattagag

SEQ ID NO: 8757512 - DNA, 22 bp, Homo sapiens
aaacaatgttcctatattagag

SEQ ID NO: 8757513 - DNA, 22 bp, Homo sapiens
aaacaatgttcctatattagag

SEQ ID NO: 8757514 - DNA, 22 bp, Homo sapiens
aaacaatgtagattaccattta

SEQ ID NO: 8757515 - DNA, 22 bp, Homo sapiens
aaacaatgtagattaccattta

SEQ ID NO: 8757516 - DNA, 22 bp, Homo sapiens
aaacaatttccacctctcctga

SEQ ID NO: 8757517 - DNA, 22 bp, Homo sapiens
aaacaatgttgtctccaagagg

SEQ ID NO: 8757518 - DNA, 22 bp, Homo sapiens
aaacaatgttgtctccaagagg

SEQ ID NO: 8757519 - DNA, 22 bp, Homo sapiens
aaacaatgtagattaccattta

SEQ ID NO: 8757520 - DNA, 22 bp, Homo sapiens
aaacaatgtacatttataatgc

SEQ ID NO: 8757521 - DNA, 22 bp, Homo sapiens
aaacaatgtacatttataatgc

SEQ ID NO: 8757522 - DNA, 22 bp, Homo sapiens
aaacaatgtacatttataatgc

SEQ ID NO: 8757523 - DNA, 22 bp, Homo sapiens
aaacaatgtacatttataatgc

SEQ ID NO: 8757524 - DNA, 22 bp, Homo sapiens
aaacaatgtacatttataatgc

SEQ ID NO: 8757525 - DNA, 22 bp, Homo sapiens
aaacaatgtacacatgaatgtt

SEQ ID NO: 8757526 - DNA, 17 bp, Homo sapiens
aaacaatgcagacaagc

SEQ ID NO: 8757527 - DNA, 17 bp, Homo sapiens
aaacaatgcagacaagc

SEQ ID NO: 8757528 - DNA, 22 bp, Homo sapiens
aaacaatgagcttttacacact

SEQ ID NO: 8757529 - DNA, 22 bp, Homo sapiens
aaacaatgagcttttacacact

SEQ ID NO: 8757530 - DNA, 22 bp, Homo sapiens
aaacaatgagcttttacacact

SEQ ID NO: 8757531 - DNA, 22 bp, Homo sapiens
aaacaatgaaattcattcttca

SEQ ID NO: 8757532 - DNA, 22 bp, Homo sapiens
aaacaatgaaattcattcttca

SEQ ID NO: 8757533 - DNA, 22 bp, Homo sapiens
aaacaatgaaattcattcttca

SEQ ID NO: 8757534 - DNA, 22 bp, Homo sapiens
aaacaatgaaattcattcttca

SEQ ID NO: 8757535 - DNA, 22 bp, Homo sapiens
aaacaatgacaacacagctgcg

SEQ ID NO: 8757536 - DNA, 22 bp, Homo sapiens
aaacaatgagcttttacacact

SEQ ID NO: 8757537 - DNA, 22 bp, Homo sapiens
aaaggtcaaaatcgtgacattg

SEQ ID NO: 8757538 - DNA, 22 bp, Homo sapiens
aaaggtatcatgtccatacagt

SEQ ID NO: 8757539 - DNA, 22 bp, Homo sapiens
aaaggtagtacttctagaaggg

SEQ ID NO: 8757540 - DNA, 22 bp, Homo sapiens
aaaggtctacatcactgaaaga

SEQ ID NO: 8757541 - DNA, 17 bp, Homo sapiens
aaaggtcgataaggtgg

SEQ ID NO: 8757542 - DNA, 22 bp, Homo sapiens
aaaggtcagctgccatcgttct

SEQ ID NO: 8757543 - DNA, 22 bp, Homo sapiens
aaagggtcagattctgctagtg

SEQ ID NO: 8757544 - DNA, 22 bp, Homo sapiens
aaagggtccagatacttggaaa

SEQ ID NO: 8757545 - DNA, 22 bp, Homo sapiens
aaagggttgttgtaaggattat

SEQ ID NO: 8757546 - DNA, 22 bp, Homo sapiens
aaacagttctcatttgtttaga

SEQ ID NO: 8757547 - DNA, 22 bp, Homo sapiens
aaacagttgttatttttatatg

SEQ ID NO: 8757548 - DNA, 22 bp, Homo sapiens
aaacagtgtttttatgatttat

SEQ ID NO: 8757549 - DNA, 22 bp, Homo sapiens
aaacagtgtttttatgatttat

SEQ ID NO: 8757550 - DNA, 22 bp, Homo sapiens
aaacagtggccaattctggaga

SEQ ID NO: 8757551 - DNA, 22 bp, Homo sapiens
aaacagtggccaattctggaga

SEQ ID NO: 8757552 - DNA, 22 bp, Homo sapiens
aaacagtggccaattctggaga

SEQ ID NO: 8757553 - DNA, 22 bp, Homo sapiens
aaacagtgtgtttcagagaggc

SEQ ID NO: 8757554 - DNA, 22 bp, Homo sapiens
aaacagtgtaggtggccaggca

SEQ ID NO: 8757555 - DNA, 22 bp, Homo sapiens
aaacagtggccaattctggaga

SEQ ID NO: 8757556 - DNA, 22 bp, Homo sapiens
aaacagtgcctggcatggagga

SEQ ID NO: 8757557 - DNA, 22 bp, Homo sapiens
aaacagtgcctggcatggagga

SEQ ID NO: 8757558 - DNA, 22 bp, Homo sapiens
aaagttacccaatctctatgaa

SEQ ID NO: 8757559 - DNA, 22 bp, Homo sapiens
aaagttagcattctctcttgct

SEQ ID NO: 8757560 - DNA, 22 bp, Homo sapiens
aaagttagtcagaaccagccat

SEQ ID NO: 8757561 - DNA, 22 bp, Homo sapiens
aaagttcactgaccagcactgg

SEQ ID NO: 8757562 - DNA, 22 bp, Homo sapiens
aaagttcactgaccagcactgg

SEQ ID NO: 8757563 - DNA, 22 bp, Homo sapiens
aaagttcactgaccagcactgg

SEQ ID NO: 8757564 - DNA, 22 bp, Homo sapiens
aaagttcagattagactcaaga

SEQ ID NO: 8757565 - DNA, 22 bp, Homo sapiens
aaagttcactgaccagcactgg

SEQ ID NO: 8757566 - DNA, 22 bp, Homo sapiens
aaagttcactatgtagcagcgt

SEQ ID NO: 8757567 - DNA, 22 bp, Homo sapiens
aaagttcactatgtagcagcgt

SEQ ID NO: 8757568 - DNA, 22 bp, Homo sapiens
aaagttcactatgtagcagcgt

SEQ ID NO: 8757569 - DNA, 18 bp, Homo sapiens
aaagttcagggagagttg

SEQ ID NO: 8757570 - DNA, 18 bp, Homo sapiens
aaagttcagggagagttg

SEQ ID NO: 8757571 - DNA, 22 bp, Homo sapiens
aaagttcagtgccttctataca

SEQ ID NO: 8757572 - DNA, 22 bp, Homo sapiens
aaagttcagtgccttctataca

SEQ ID NO: 8757573 - DNA, 20 bp, Homo sapiens
aaagttcatgtttgcacttt

SEQ ID NO: 8757574 - DNA, 20 bp, Homo sapiens
aaagttcatgtttgcacttt

SEQ ID NO: 8757575 - DNA, 20 bp, Homo sapiens
aaagttcatgtttgcacttt

SEQ ID NO: 8757576 - DNA, 22 bp, Homo sapiens
aaagttcatggtgttatagaaa

SEQ ID NO: 8757577 - DNA, 22 bp, Homo sapiens
aaagttcattgatgactgaggt

SEQ ID NO: 8757578 - DNA, 22 bp, Homo sapiens
aaactagaaatcagcaagatag

SEQ ID NO: 8757579 - DNA, 20 bp, Homo sapiens
aaagttcatgtttgcacttt

SEQ ID NO: 8757580 - DNA, 22 bp, Homo sapiens
aaactagaaatcagcaagatag

SEQ ID NO: 8757581 - DNA, 21 bp, Homo sapiens
aaactagagtgtggcaaagct

SEQ ID NO: 8757582 - DNA, 21 bp, Homo sapiens
aaactagagtgtggcaaagct

SEQ ID NO: 8757583 - DNA, 22 bp, Homo sapiens
aaactagagcatgtgagtggga

SEQ ID NO: 8757584 - DNA, 22 bp, Homo sapiens
aaagttcatggtgttatagaaa

SEQ ID NO: 8757585 - DNA, 21 bp, Homo sapiens
aaagttcatgctttaatattc

SEQ ID NO: 8757586 - DNA, 21 bp, Homo sapiens
aaagttcatgctttaatattc

SEQ ID NO: 8757587 - DNA, 21 bp, Homo sapiens
aaagttcatgctttaatattc

SEQ ID NO: 8757588 - DNA, 21 bp, Homo sapiens
aaagttcatgctttaatattc

SEQ ID NO: 8757589 - DNA, 22 bp, Homo sapiens
aaactctagttatgaagtttgt

SEQ ID NO: 8757590 - DNA, 22 bp, Homo sapiens
aaactctagtaaaatgtattca

SEQ ID NO: 8757591 - DNA, 22 bp, Homo sapiens
aaactagatgaaacgagtaaag

SEQ ID NO: 8757592 - DNA, 22 bp, Homo sapiens
aaactctagggctccacattcc

SEQ ID NO: 8757593 - DNA, 22 bp, Homo sapiens
aaactctatgaaccttctacca

SEQ ID NO: 8757594 - DNA, 22 bp, Homo sapiens
aaactctataggcagaagcaat

SEQ ID NO: 8757595 - DNA, 22 bp, Homo sapiens
aaactctataggcagaagcaat

SEQ ID NO: 8757596 - DNA, 22 bp, Homo sapiens
aaactctataggcagaagcaat

SEQ ID NO: 8757597 - DNA, 22 bp, Homo sapiens
aaactctataaataagggctat

SEQ ID NO: 8757598 - DNA, 22 bp, Homo sapiens
aaactctagttatgaagtttgt

SEQ ID NO: 8757599 - DNA, 19 bp, Homo sapiens
aaactctgaaggccactgg

SEQ ID NO: 8757600 - DNA, 22 bp, Homo sapiens
aaactctataggcagaagcaat

SEQ ID NO: 8757601 - DNA, 22 bp, Homo sapiens
aaactctcttttcttcagtagg

SEQ ID NO: 8757602 - DNA, 22 bp, Homo sapiens
aaactctatttctgttggctta

SEQ ID NO: 8757603 - DNA, 22 bp, Homo sapiens
aaaggtcttttttctaacacca

SEQ ID NO: 8757604 - DNA, 22 bp, Homo sapiens
aaaggtcttctcaaacatccca

SEQ ID NO: 8757605 - DNA, 22 bp, Homo sapiens
aaaggtgcctcttacaaggctt

SEQ ID NO: 8757606 - DNA, 22 bp, Homo sapiens
aaaggtgctactgtgttcctca

SEQ ID NO: 8757607 - DNA, 22 bp, Homo sapiens
aaaggtgttctcactgggggtc

SEQ ID NO: 8757608 - DNA, 22 bp, Homo sapiens
aaaggtgttgccttggagacct

SEQ ID NO: 8757609 - DNA, 22 bp, Homo sapiens
aaacattgtacattctgtagct

SEQ ID NO: 8757610 - DNA, 22 bp, Homo sapiens
aaacccagggttttgtcttccc

SEQ ID NO: 8757611 - DNA, 22 bp, Homo sapiens
aaacccagggttttgtcttccc

SEQ ID NO: 8757612 - DNA, 22 bp, Homo sapiens
aaacccatggctgatatcacta

SEQ ID NO: 8757613 - DNA, 22 bp, Homo sapiens
aaacctagaaggaagggtctct

SEQ ID NO: 8757614 - DNA, 22 bp, Homo sapiens
aaacctattggcaagaataata

SEQ ID NO: 8757615 - DNA, 22 bp, Homo sapiens
aaacctttaccagactagcaag

SEQ ID NO: 8757616 - DNA, 22 bp, Homo sapiens
aaacctttctcagtgctaaaat

SEQ ID NO: 8757617 - DNA, 22 bp, Homo sapiens
aaacctttctcagtgctaaaat

SEQ ID NO: 8757618 - DNA, 22 bp, Homo sapiens
aaacctttgcctggaagggagt

SEQ ID NO: 8757619 - DNA, 19 bp, Homo sapiens
aaacctgttagtagagcac

SEQ ID NO: 8757620 - DNA, 22 bp, Homo sapiens
aaacctgttaatagagcgatgc

SEQ ID NO: 8757621 - DNA, 22 bp, Homo sapiens
aaacctgtagcagtttgttaca

SEQ ID NO: 8757622 - DNA, 22 bp, Homo sapiens
aaacctgtctgattatggagac

SEQ ID NO: 8757623 - DNA, 22 bp, Homo sapiens
aaacctgtggccactaaatttg

SEQ ID NO: 8757624 - DNA, 22 bp, Homo sapiens
aaagagcaccctcaatgtctga

SEQ ID NO: 8757625 - DNA, 22 bp, Homo sapiens
aaagaggcaggtgttactggaa

SEQ ID NO: 8757626 - DNA, 22 bp, Homo sapiens
aaagaggcaatcaatgtagcaa

SEQ ID NO: 8757627 - DNA, 22 bp, Homo sapiens
aaagaggaaccaagagcacgtg

SEQ ID NO: 8757628 - DNA, 22 bp, Homo sapiens
aaagaggaaccaagagcacgtg

SEQ ID NO: 8757629 - DNA, 22 bp, Homo sapiens
aaagaggaaccaagagcacgtg

SEQ ID NO: 8757630 - DNA, 22 bp, Homo sapiens
aaagaggatggagtagtcagct

SEQ ID NO: 8757631 - DNA, 22 bp, Homo sapiens
aaagaggatggagtagtcagct

SEQ ID NO: 8757632 - DNA, 22 bp, Homo sapiens
aaatgcagattcatgagcccca

SEQ ID NO: 8757633 - DNA, 22 bp, Homo sapiens
aaatgcagattgtcattcagga

SEQ ID NO: 8757634 - DNA, 22 bp, Homo sapiens
aaatgcactctgcttctgtgac

SEQ ID NO: 8757635 - DNA, 22 bp, Homo sapiens
aaatgcagaatgatttcatcta

SEQ ID NO: 8757636 - DNA, 22 bp, Homo sapiens
aaatgcagaatgatttcatcta

SEQ ID NO: 8757637 - DNA, 22 bp, Homo sapiens
aaatgcagacagcttcacacac

SEQ ID NO: 8757638 - DNA, 22 bp, Homo sapiens
aaatgcactgaatattccaaat

SEQ ID NO: 8757639 - DNA, 22 bp, Homo sapiens
aaatgcactgaacacatgttgt

SEQ ID NO: 8757640 - DNA, 22 bp, Homo sapiens
aaattacagccttgggtagctt

SEQ ID NO: 8757641 - DNA, 22 bp, Homo sapiens
aaattacagatcaccaatgcat

SEQ ID NO: 8757642 - DNA, 22 bp, Homo sapiens
aaattacagccttgggtagctt

SEQ ID NO: 8757643 - DNA, 22 bp, Homo sapiens
aaattaagggtgagaagagttg

SEQ ID NO: 8757644 - DNA, 22 bp, Homo sapiens
aaattacagatcaccaatgcat

SEQ ID NO: 8757645 - DNA, 22 bp, Homo sapiens
aaattacagatcaccaatgcat

SEQ ID NO: 8757646 - DNA, 22 bp, Homo sapiens
aaattagaaatactttcaaagc

SEQ ID NO: 8757647 - DNA, 22 bp, Homo sapiens
aaattagaagtgctcaggaata

SEQ ID NO: 8757648 - DNA, 22 bp, Homo sapiens
aaattgtctttaatcaggtcat

SEQ ID NO: 8757649 - DNA, 22 bp, Homo sapiens
aaattgtctttaatcaggtcat

SEQ ID NO: 8757650 - DNA, 22 bp, Homo sapiens
aaattgtctctattttgattcg

SEQ ID NO: 8757651 - DNA, 22 bp, Homo sapiens
aaattagaaatactttcaaagc

SEQ ID NO: 8757652 - DNA, 22 bp, Homo sapiens
aaagagttctatgatctttcca

SEQ ID NO: 8757653 - DNA, 22 bp, Homo sapiens
aaagagttctatgatctttcca

SEQ ID NO: 8757654 - DNA, 22 bp, Homo sapiens
aaagagtctggcactgtaccag

SEQ ID NO: 8757655 - DNA, 22 bp, Homo sapiens
aaagagttacacagtttcagaa

SEQ ID NO: 8757656 - DNA, 21 bp, Homo sapiens
aaagaggttaatattgtaagt

SEQ ID NO: 8757657 - DNA, 22 bp, Homo sapiens
aaagagtcgtgttccaggtttg

SEQ ID NO: 8757658 - DNA, 22 bp, Homo sapiens
aaagagtcaaaggcatgtctct

SEQ ID NO: 8757659 - DNA, 22 bp, Homo sapiens
aaagagggacaggcgcagacac

SEQ ID NO: 8757660 - DNA, 22 bp, Homo sapiens
aaagagttgttgtataacagga

SEQ ID NO: 8757661 - DNA, 22 bp, Homo sapiens
aaagagttggactttctcaggc

SEQ ID NO: 8757662 - DNA, 22 bp, Homo sapiens
aaagagttgttgtataacagga

SEQ ID NO: 8757663 - DNA, 22 bp, Homo sapiens
aaagaagtgttgaatttgcaag

SEQ ID NO: 8757664 - DNA, 22 bp, Homo sapiens
aaagaagtgttgaatttgcaag

SEQ ID NO: 8757665 - DNA, 22 bp, Homo sapiens
aaagaaggtagggctggtgact

SEQ ID NO: 8757666 - DNA, 22 bp, Homo sapiens
aaagaataccctgggtcataaa

SEQ ID NO: 8757667 - DNA, 22 bp, Homo sapiens
aaagaataccctgggtcataaa

SEQ ID NO: 8757668 - DNA, 22 bp, Homo sapiens
aaactgataaaataagtacatt

SEQ ID NO: 8757669 - DNA, 22 bp, Homo sapiens
aaactgcaatgacaggtaggag

SEQ ID NO: 8757670 - DNA, 22 bp, Homo sapiens
aaactgataaaataagtacatt

SEQ ID NO: 8757671 - DNA, 22 bp, Homo sapiens
aaactgataaaataagtacatt

SEQ ID NO: 8757672 - DNA, 22 bp, Homo sapiens
aaagaacatcggagtgggcggg

SEQ ID NO: 8757673 - DNA, 22 bp, Homo sapiens
aaagaatactccttttgccttg

SEQ ID NO: 8757674 - DNA, 22 bp, Homo sapiens
aaagaatcagaagtctcaaaca

SEQ ID NO: 8757675 - DNA, 22 bp, Homo sapiens
aaagaatagttaagtttagggc

SEQ ID NO: 8757676 - DNA, 22 bp, Homo sapiens
aaagaatagcctttgtccaaat

SEQ ID NO: 8757677 - DNA, 22 bp, Homo sapiens
aaagaatgtctgaacagctggc

SEQ ID NO: 8757678 - DNA, 22 bp, Homo sapiens
aaagaatgtctgaacagctggc

SEQ ID NO: 8757679 - DNA, 22 bp, Homo sapiens
aaagaatgtctgaacagctggc

SEQ ID NO: 8757680 - DNA, 22 bp, Homo sapiens
aaagaatctatatatcaccacc

SEQ ID NO: 8757681 - DNA, 22 bp, Homo sapiens
aaagaatgcagtgccttccagc

SEQ ID NO: 8757682 - DNA, 22 bp, Homo sapiens
aaactctgtatttgctgtgggt

SEQ ID NO: 8757683 - DNA, 22 bp, Homo sapiens
aaactctgttgagataatattt

SEQ ID NO: 8757684 - DNA, 22 bp, Homo sapiens
aaactctgtagctaaacataat

SEQ ID NO: 8757685 - DNA, 22 bp, Homo sapiens
aaactctgtagctaaacataat

SEQ ID NO: 8757686 - DNA, 22 bp, Homo sapiens
aaactctgggggtggagcccag

SEQ ID NO: 8757687 - DNA, 22 bp, Homo sapiens
aaactctggattggagtccagc

SEQ ID NO: 8757688 - DNA, 22 bp, Homo sapiens
aaactctgatgcttattgggaa

SEQ ID NO: 8757689 - DNA, 22 bp, Homo sapiens
aaactctgcactgcggtaaggt

SEQ ID NO: 8757690 - DNA, 22 bp, Homo sapiens
aaactctgccatttttggcctg

SEQ ID NO: 8757691 - DNA, 22 bp, Homo sapiens
aaactctggagatgtttatgca

SEQ ID NO: 8757692 - DNA, 22 bp, Homo sapiens
aaactctgccatttttggcctg

SEQ ID NO: 8757693 - DNA, 22 bp, Homo sapiens
aaactgaaacatcatcatgttg

SEQ ID NO: 8757694 - DNA, 21 bp, Homo sapiens
aaactgaagagacaggaactt

SEQ ID NO: 8757695 - DNA, 22 bp, Homo sapiens
aaactgaaacatcatcatgttg

SEQ ID NO: 8757696 - DNA, 21 bp, Homo sapiens
aaactgaagagacaggaactt

SEQ ID NO: 8757697 - DNA, 22 bp, Homo sapiens
aaactgaaacatcatcatgttg

SEQ ID NO: 8757698 - DNA, 17 bp, Homo sapiens
aaactgaaaaattcact

SEQ ID NO: 8757699 - DNA, 17 bp, Homo sapiens
aaactgaaaaattcact

SEQ ID NO: 8757700 - DNA, 17 bp, Homo sapiens
aaactgaaaaattcact

SEQ ID NO: 8757701 - DNA, 22 bp, Homo sapiens
aaactctttccacgattacttt

SEQ ID NO: 8757702 - DNA, 17 bp, Homo sapiens
aaactgaaaaattcact

SEQ ID NO: 8757703 - DNA, 21 bp, Homo sapiens
aaactgaggcttcaagcagtg

SEQ ID NO: 8757704 - DNA, 22 bp, Homo sapiens
aaactgaggagttagactaggg

SEQ ID NO: 8757705 - DNA, 22 bp, Homo sapiens
aaactgaggagttagactaggg

SEQ ID NO: 8757706 - DNA, 22 bp, Homo sapiens
aaactgaggaacaaggaaggat

SEQ ID NO: 8757707 - DNA, 21 bp, Homo sapiens
aaactgaccttgcctgagaca

SEQ ID NO: 8757708 - DNA, 21 bp, Homo sapiens
aaactgaccttgcctgagaca

SEQ ID NO: 8757709 - DNA, 22 bp, Homo sapiens
aaactgacaatctcagtcctat

SEQ ID NO: 8757710 - DNA, 22 bp, Homo sapiens
aaactgaattcccaagggcatg

SEQ ID NO: 8757711 - DNA, 22 bp, Homo sapiens
aaactgaattcaagtatccagt

SEQ ID NO: 8757712 - DNA, 22 bp, Homo sapiens
aaactgaattcccaagggcatg

SEQ ID NO: 8757713 - DNA, 22 bp, Homo sapiens
aaactgaagtagattctgaaat

SEQ ID NO: 8757714 - DNA, 22 bp, Homo sapiens
aaactgaagttctggaggggta

SEQ ID NO: 8757715 - DNA, 22 bp, Homo sapiens
aaactgaagagctttttgacac

SEQ ID NO: 8757716 - DNA, 22 bp, Homo sapiens
aaactgaagagctttttgacac

SEQ ID NO: 8757717 - DNA, 21 bp, Homo sapiens
aaactgaagagacaggaactt

SEQ ID NO: 8757718 - DNA, 22 bp, Homo sapiens
aaactgaagccttggagtgaca

SEQ ID NO: 8757719 - DNA, 22 bp, Homo sapiens
aaactgaagtagattctgaaat

SEQ ID NO: 8757720 - DNA, 22 bp, Homo sapiens
aaataagttaaactagaatgat

SEQ ID NO: 8757721 - DNA, 22 bp, Homo sapiens
aaataagttagcagattccagt

SEQ ID NO: 8757722 - DNA, 22 bp, Homo sapiens
aaataagttaaactagaatgat

SEQ ID NO: 8757723 - DNA, 22 bp, Homo sapiens
aaataagttaaactagaatgat

SEQ ID NO: 8757724 - DNA, 22 bp, Homo sapiens
aaataagttaaactagaatgat

SEQ ID NO: 8757725 - DNA, 22 bp, Homo sapiens
aaataagtgtgggccagtcaaa

SEQ ID NO: 8757726 - DNA, 22 bp, Homo sapiens
aaataactttctgtgtatagtc

SEQ ID NO: 8757727 - DNA, 22 bp, Homo sapiens
aaataacttggtttcatcagag

SEQ ID NO: 8757728 - DNA, 22 bp, Homo sapiens
aaataacttggtttcatcagag

SEQ ID NO: 8757729 - DNA, 22 bp, Homo sapiens
aaataacttggtttcatcagag

SEQ ID NO: 8757730 - DNA, 22 bp, Homo sapiens
aaataacttggtttcatcagag

SEQ ID NO: 8757731 - DNA, 22 bp, Homo sapiens
aaataacttggtttcatcagag

SEQ ID NO: 8757732 - DNA, 22 bp, Homo sapiens
aaataactttctgtgtatagtc

SEQ ID NO: 8757733 - DNA, 22 bp, Homo sapiens
aaataagaaattcttctttgca

SEQ ID NO: 8757734 - DNA, 22 bp, Homo sapiens
aaataagaaattcttctttgca

SEQ ID NO: 8757735 - DNA, 22 bp, Homo sapiens
aaataagaaattcttctttgca

SEQ ID NO: 8757736 - DNA, 22 bp, Homo sapiens
aaataagaaattcttctttgca

SEQ ID NO: 8757737 - DNA, 22 bp, Homo sapiens
aaataagaaattcttctttgca

SEQ ID NO: 8757738 - DNA, 22 bp, Homo sapiens
aaataagaggacagatgtttgg

SEQ ID NO: 8757739 - DNA, 22 bp, Homo sapiens
aaataagcacttaactgtatca

SEQ ID NO: 8757740 - DNA, 22 bp, Homo sapiens
aaagtgttatgcaaaactctgt

SEQ ID NO: 8757741 - DNA, 21 bp, Homo sapiens
aaagtgttcagaccagttctg

SEQ ID NO: 8757742 - DNA, 22 bp, Homo sapiens
aaagtgttgaagaaaatgttca

SEQ ID NO: 8757743 - DNA, 22 bp, Homo sapiens
aaagtgttgaagaaaatgttca

SEQ ID NO: 8757744 - DNA, 22 bp, Homo sapiens
aaagtgttgaagaaaatgttca

SEQ ID NO: 8757745 - DNA, 22 bp, Homo sapiens
aaagtgttgaagaaaatgttca

SEQ ID NO: 8757746 - DNA, 22 bp, Homo sapiens
aaagtgttgattttatagtgca

SEQ ID NO: 8757747 - DNA, 22 bp, Homo sapiens
aaagtgttgatatgtgacatcc

SEQ ID NO: 8757748 - DNA, 22 bp, Homo sapiens
aaagtgttgggaagaaagtgca

SEQ ID NO: 8757749 - DNA, 22 bp, Homo sapiens
aaagtgttgggaagaaagtgca

SEQ ID NO: 8757750 - DNA, 22 bp, Homo sapiens
aaagtgtaggcttcaaagaggg

SEQ ID NO: 8757751 - DNA, 22 bp, Homo sapiens
aaagtgtagagtgcctcaaaat

SEQ ID NO: 8757752 - DNA, 23 bp, Homo sapiens
aaagtgtagccaggttaagaacc

SEQ ID NO: 8757753 - DNA, 23 bp, Homo sapiens
aaagtgtagccaggttaagaacc

SEQ ID NO: 8757754 - DNA, 23 bp, Homo sapiens
aaagtgtagccaggttaagaacc

SEQ ID NO: 8757755 - DNA, 22 bp, Homo sapiens
aaagtgttatgagaactaagtg

SEQ ID NO: 8757756 - DNA, 22 bp, Homo sapiens
aaagtgttatgagaactaagtg

SEQ ID NO: 8757757 - DNA, 21 bp, Homo sapiens
aaagtgtgtggggaagaagga

SEQ ID NO: 8757758 - DNA, 22 bp, Homo sapiens
aaagtgttaacactggctactt

SEQ ID NO: 8757759 - DNA, 22 bp, Homo sapiens
aaagtgttatgagaactaagtg

SEQ ID NO: 8757760 - DNA, 22 bp, Homo sapiens
aaagtgtggtcgttcattttgt

SEQ ID NO: 8757761 - DNA, 22 bp, Homo sapiens
aaagtgtggcacaagtcacatc

SEQ ID NO: 8757762 - DNA, 22 bp, Homo sapiens
aaagtgtggtcgttcattttgt

SEQ ID NO: 8757763 - DNA, 22 bp, Homo sapiens
aaagttttatatgctgcagcga

SEQ ID NO: 8757764 - DNA, 19 bp, Homo sapiens
aaagtgttttcttttctgt

SEQ ID NO: 8757765 - DNA, 19 bp, Homo sapiens
aaagtgttttcttttctgt

SEQ ID NO: 8757766 - DNA, 22 bp, Homo sapiens
aaagtgttttgatttagtggta

SEQ ID NO: 8757767 - DNA, 22 bp, Homo sapiens
aaagtgtttacattgctataag

SEQ ID NO: 8757768 - DNA, 22 bp, Homo sapiens
aaagtgttgggattacaggtgt

SEQ ID NO: 8757769 - DNA, 22 bp, Homo sapiens
aaagtgttttctgatgtgttct

SEQ ID NO: 8757770 - DNA, 22 bp, Homo sapiens
aaagtgttttccatgcaatgaa

SEQ ID NO: 8757771 - DNA, 22 bp, Homo sapiens
aaagtgtttacattgctataag

SEQ ID NO: 8757772 - DNA, 19 bp, Homo sapiens
aaagtgttttaaagaggat

SEQ ID NO: 8757773 - DNA, 22 bp, Homo sapiens
aaatagctacatgatctctagg

SEQ ID NO: 8757774 - DNA, 22 bp, Homo sapiens
aaataggaatgtggtcctggga

SEQ ID NO: 8757775 - DNA, 22 bp, Homo sapiens
aaatagcttttcataattctca

SEQ ID NO: 8757776 - DNA, 22 bp, Homo sapiens
aaatagcttctaagccttttga

SEQ ID NO: 8757777 - DNA, 22 bp, Homo sapiens
aaatagcagcctttagttaaca

SEQ ID NO: 8757778 - DNA, 22 bp, Homo sapiens
aaatagcagctttgacagcaca

SEQ ID NO: 8757779 - DNA, 22 bp, Homo sapiens
aaatagcagctttgacagcaca

SEQ ID NO: 8757780 - DNA, 22 bp, Homo sapiens
aaatagcagctttgacagcaca

SEQ ID NO: 8757781 - DNA, 22 bp, Homo sapiens
aaatagcattgtatttagctga

SEQ ID NO: 8757782 - DNA, 22 bp, Homo sapiens
aaatagcataaaataggaagct

SEQ ID NO: 8757783 - DNA, 22 bp, Homo sapiens
aaatagcataaaataggaagct

SEQ ID NO: 8757784 - DNA, 22 bp, Homo sapiens
aaatagcattgtatttagctga

SEQ ID NO: 8757785 - DNA, 23 bp, Homo sapiens
aaataggagtatctggatcatga

SEQ ID NO: 8757786 - DNA, 23 bp, Homo sapiens
aaataggagtatctggatcatga

SEQ ID NO: 8757787 - DNA, 22 bp, Homo sapiens
aaataggagcttaagcacttct

SEQ ID NO: 8757788 - DNA, 22 bp, Homo sapiens
aaatcagagtggttggtcatcc

SEQ ID NO: 8757789 - DNA, 22 bp, Homo sapiens
aaatcagatcttacacaattgt

SEQ ID NO: 8757790 - DNA, 22 bp, Homo sapiens
aaatcagatcttacacaattgt

SEQ ID NO: 8757791 - DNA, 22 bp, Homo sapiens
aaatcagatcttacacaattgt

SEQ ID NO: 8757792 - DNA, 22 bp, Homo sapiens
aaatcagatgcttcctagttgg

SEQ ID NO: 8757793 - DNA, 22 bp, Homo sapiens
aaatcagatgcttcctagttgg

SEQ ID NO: 8757794 - DNA, 22 bp, Homo sapiens
aaatcagtaaatgttcattaac

SEQ ID NO: 8757795 - DNA, 22 bp, Homo sapiens
aaatcagtaaatgttcattaac

SEQ ID NO: 8757796 - DNA, 22 bp, Homo sapiens
aaatccatcaaatcttctagaa

SEQ ID NO: 8757797 - DNA, 22 bp, Homo sapiens
aaatccatggtaatctgttaca

SEQ ID NO: 8757798 - DNA, 22 bp, Homo sapiens
aaatccatggtaatctgttaca

SEQ ID NO: 8757799 - DNA, 22 bp, Homo sapiens
aaatccattctgttttaaaagt

SEQ ID NO: 8757800 - DNA, 22 bp, Homo sapiens
aaatccattctgttttaaaagt

SEQ ID NO: 8757801 - DNA, 22 bp, Homo sapiens
aaatccattctgttttaaaagt

SEQ ID NO: 8757802 - DNA, 22 bp, Homo sapiens
aaatagacacatgcgttcatat

SEQ ID NO: 8757803 - DNA, 22 bp, Homo sapiens
aaatagacaggcttaaatagga

SEQ ID NO: 8757804 - DNA, 22 bp, Homo sapiens
aaatagacacttggacagacaa

SEQ ID NO: 8757805 - DNA, 22 bp, Homo sapiens
aaataattatagcgagtctatc

SEQ ID NO: 8757806 - DNA, 22 bp, Homo sapiens
aaatagattgctgaggcattac

SEQ ID NO: 8757807 - DNA, 22 bp, Homo sapiens
aaatagattgctgaggcattac

SEQ ID NO: 8757808 - DNA, 23 bp, Homo sapiens
aaatagagataggccagctttgc

SEQ ID NO: 8757809 - DNA, 22 bp, Homo sapiens
aaatagatttaacatccatccc

SEQ ID NO: 8757810 - DNA, 22 bp, Homo sapiens
aaatagattgctgaggcattac

SEQ ID NO: 8757811 - DNA, 22 bp, Homo sapiens
aaatagatttcctagcattgga

SEQ ID NO: 8757812 - DNA, 22 bp, Homo sapiens
aaatagatttcctagcattgga

SEQ ID NO: 8757813 - DNA, 22 bp, Homo sapiens
aaatagatttcctagcattgga

SEQ ID NO: 8757814 - DNA, 22 bp, Homo sapiens
aaatagcaatgtgaaaagagga

SEQ ID NO: 8757815 - DNA, 22 bp, Homo sapiens
aaatagatttctctgggtttgt

SEQ ID NO: 8757816 - DNA, 22 bp, Homo sapiens
aaatagcaatgtgaaaagagga

SEQ ID NO: 8757817 - DNA, 22 bp, Homo sapiens
aaatgcatatcaaagacttgaa

SEQ ID NO: 8757818 - DNA, 22 bp, Homo sapiens
aaatgcagtttcctgagaccca

SEQ ID NO: 8757819 - DNA, 22 bp, Homo sapiens
aaatgcaggtagtatttatttt

SEQ ID NO: 8757820 - DNA, 22 bp, Homo sapiens
aaatgcaggttcttgagccaag

SEQ ID NO: 8757821 - DNA, 22 bp, Homo sapiens
aagcacagatgcaagggggacc

SEQ ID NO: 8757822 - DNA, 22 bp, Homo sapiens
aagcacagataaaacaggattc

SEQ ID NO: 8757823 - DNA, 22 bp, Homo sapiens
aagcacagatgcaagggggacc

SEQ ID NO: 8757824 - DNA, 22 bp, Homo sapiens
aaatgcacaggttttaaatcct

SEQ ID NO: 8757825 - DNA, 22 bp, Homo sapiens
aagcacagctggaacagcagga

SEQ ID NO: 8757826 - DNA, 22 bp, Homo sapiens
aagcacagctggaacagcagga

SEQ ID NO: 8757827 - DNA, 22 bp, Homo sapiens
aagcacagccaggttaggggct

SEQ ID NO: 8757828 - DNA, 22 bp, Homo sapiens
aagcacagcagagccttgcttg

SEQ ID NO: 8757829 - DNA, 23 bp, Homo sapiens
aaatgcacagtattgatttttaa

SEQ ID NO: 8757830 - DNA, 23 bp, Homo sapiens
aaatgcacagtattgatttttaa

SEQ ID NO: 8757831 - DNA, 22 bp, Homo sapiens
aaatgcacaggttttaaatcct

SEQ ID NO: 8757832 - DNA, 22 bp, Homo sapiens
aaatcctaataatgcactagtg

SEQ ID NO: 8757833 - DNA, 22 bp, Homo sapiens
aaatcctaatgacaagtttagt

SEQ ID NO: 8757834 - DNA, 22 bp, Homo sapiens
aaatcctaatgacaagtttagt

SEQ ID NO: 8757835 - DNA, 22 bp, Homo sapiens
aaatcctaccaagaaattccct

SEQ ID NO: 8757836 - DNA, 22 bp, Homo sapiens
aaatcctaaggagaatatgatt

SEQ ID NO: 8757837 - DNA, 22 bp, Homo sapiens
aaatcctaagcagaggaattta

SEQ ID NO: 8757838 - DNA, 22 bp, Homo sapiens
aaatcctttggaggacatgatg

SEQ ID NO: 8757839 - DNA, 22 bp, Homo sapiens
aaatcgcttgaacccaggaagt

SEQ ID NO: 8757840 - DNA, 22 bp, Homo sapiens
aaatctagtacctttttgatta

SEQ ID NO: 8757841 - DNA, 22 bp, Homo sapiens
aaatctaggctcatcctggtcc

SEQ ID NO: 8757842 - DNA, 22 bp, Homo sapiens
aaatcgtttcgttcctggtttt

SEQ ID NO: 8757843 - DNA, 22 bp, Homo sapiens
aaatctagaagtttaaaaggat

SEQ ID NO: 8757844 - DNA, 22 bp, Homo sapiens
aaatctaggccgggtgcggtgg

SEQ ID NO: 8757845 - DNA, 22 bp, Homo sapiens
aaatcgtggaagacaccagtgg

SEQ ID NO: 8757846 - DNA, 22 bp, Homo sapiens
aaatcgttataatgttaagcct

SEQ ID NO: 8757847 - DNA, 22 bp, Homo sapiens
aaatcgtggaagacaccagtgg

SEQ ID NO: 8757848 - DNA, 22 bp, Homo sapiens
aaatcggttggttcaaggtaat

SEQ ID NO: 8757849 - DNA, 22 bp, Homo sapiens
aaatcggttggttcaaggtaat

SEQ ID NO: 8757850 - DNA, 22 bp, Homo sapiens
aagcacagagatgggcacgcct

SEQ ID NO: 8757851 - DNA, 22 bp, Homo sapiens
aagcacagagatgggcacgcct

SEQ ID NO: 8757852 - DNA, 22 bp, Homo sapiens
aagcacagagaggtaaagtaac

SEQ ID NO: 8757853 - DNA, 22 bp, Homo sapiens
aagcacagataaaacaggattc

SEQ ID NO: 8757854 - DNA, 22 bp, Homo sapiens
aagcacagataaaacaggattc

SEQ ID NO: 8757855 - DNA, 22 bp, Homo sapiens
aagcacagagaggtaaagtaac

SEQ ID NO: 8757856 - DNA, 22 bp, Homo sapiens
aagcacagactccctctgagtg

SEQ ID NO: 8757857 - DNA, 22 bp, Homo sapiens
aagcacagactccctctgagtg

SEQ ID NO: 8757858 - DNA, 22 bp, Homo sapiens
aagcacagagaggtaaagtaac

SEQ ID NO: 8757859 - DNA, 22 bp, Homo sapiens
aagcacagaaaaggagcatgga

SEQ ID NO: 8757860 - DNA, 23 bp, Homo sapiens
aagcacagaatggtttaggagtt

SEQ ID NO: 8757861 - DNA, 22 bp, Homo sapiens
aagcacagacacaaaaggcttt

SEQ ID NO: 8757862 - DNA, 22 bp, Homo sapiens
aagcacagaccagatctccagg

SEQ ID NO: 8757863 - DNA, 22 bp, Homo sapiens
aagcacagaccagatctccagg

SEQ ID NO: 8757864 - DNA, 22 bp, Homo sapiens
aaatgtagtatgttgcatgtat

SEQ ID NO: 8757865 - DNA, 18 bp, Homo sapiens
aaatgtactgtccatggc

SEQ ID NO: 8757866 - DNA, 18 bp, Homo sapiens
aaatgtactgtccatggc

SEQ ID NO: 8757867 - DNA, 22 bp, Homo sapiens
aaatgtactgatacttatttta

SEQ ID NO: 8757868 - DNA, 18 bp, Homo sapiens
aaatgtactgtccatggc

SEQ ID NO: 8757869 - DNA, 18 bp, Homo sapiens
aaatgtactgtccatggc

SEQ ID NO: 8757870 - DNA, 22 bp, Homo sapiens
aaatgtacgggagtagaattag

SEQ ID NO: 8757871 - DNA, 22 bp, Homo sapiens
aaatgtaccttgatagtttggt

SEQ ID NO: 8757872 - DNA, 22 bp, Homo sapiens
aaatgtactgatacttatttta

SEQ ID NO: 8757873 - DNA, 22 bp, Homo sapiens
aaatgtacgggagtagaattag

SEQ ID NO: 8757874 - DNA, 22 bp, Homo sapiens
aaatgtattgcataggatattt

SEQ ID NO: 8757875 - DNA, 22 bp, Homo sapiens
aaatgtattgcataggatattt

SEQ ID NO: 8757876 - DNA, 22 bp, Homo sapiens
aaatgtattgcataggatattt

SEQ ID NO: 8757877 - DNA, 22 bp, Homo sapiens
aaatgtatcctacttcctgagt

SEQ ID NO: 8757878 - DNA, 22 bp, Homo sapiens
aaatgtattgcataggatattt

SEQ ID NO: 8757879 - DNA, 22 bp, Homo sapiens
aaatgtagtatgttgcatgtat

SEQ ID NO: 8757880 - DNA, 22 bp, Homo sapiens
aaatgtattgcataggatattt

SEQ ID NO: 8757881 - DNA, 22 bp, Homo sapiens
aagctgaaataatatctatgtt

SEQ ID NO: 8757882 - DNA, 22 bp, Homo sapiens
aagctgaagacacagctccagt

SEQ ID NO: 8757883 - DNA, 22 bp, Homo sapiens
aagctgaagacacagctccagt

SEQ ID NO: 8757884 - DNA, 22 bp, Homo sapiens
aagctgaaattcctcctgaaat

SEQ ID NO: 8757885 - DNA, 22 bp, Homo sapiens
aagctgaaaatgagactctaca

SEQ ID NO: 8757886 - DNA, 22 bp, Homo sapiens
aagctgaaacattagcctaaac

SEQ ID NO: 8757887 - DNA, 22 bp, Homo sapiens
aagctgaagatgccagtgggag

SEQ ID NO: 8757888 - DNA, 22 bp, Homo sapiens
aagctgaatctgaaatagaatt

SEQ ID NO: 8757889 - DNA, 22 bp, Homo sapiens
aagcatcaacctgtatgctgca

SEQ ID NO: 8757890 - DNA, 22 bp, Homo sapiens
aagcatcctatatgtaaactgt

SEQ ID NO: 8757891 - DNA, 22 bp, Homo sapiens
aagcatccggggctccaggtgc

SEQ ID NO: 8757892 - DNA, 22 bp, Homo sapiens
aagcatctaggtgactgacata

SEQ ID NO: 8757893 - DNA, 22 bp, Homo sapiens
aagcatctataggttctaggag

SEQ ID NO: 8757894 - DNA, 22 bp, Homo sapiens
aagcatctataggttctaggag

SEQ ID NO: 8757895 - DNA, 22 bp, Homo sapiens
aagcatctatattccactgtga

SEQ ID NO: 8757896 - DNA, 22 bp, Homo sapiens
aagcatctcattcttgcctgtc

SEQ ID NO: 8757897 - DNA, 22 bp, Homo sapiens
aagcatctatattccactgtga

SEQ ID NO: 8757898 - DNA, 22 bp, Homo sapiens
aagcatctcacctgcccccacg

SEQ ID NO: 8757899 - DNA, 22 bp, Homo sapiens
aagcatctcctcatcatttggg

SEQ ID NO: 8757900 - DNA, 22 bp, Homo sapiens
aagcatctcctcatcatttggg

SEQ ID NO: 8757901 - DNA, 22 bp, Homo sapiens
aagcatctcctcatcatttggg

SEQ ID NO: 8757902 - DNA, 22 bp, Homo sapiens
aagcatctcctcatcatttggg

SEQ ID NO: 8757903 - DNA, 22 bp, Homo sapiens
aagcatctctatgtggagagtg

SEQ ID NO: 8757904 - DNA, 20 bp, Homo sapiens
aagcatctggatgtagcaat

SEQ ID NO: 8757905 - DNA, 22 bp, Homo sapiens
aagcatgcaatctgtgataagg

SEQ ID NO: 8757906 - DNA, 22 bp, Homo sapiens
aagcatgcactccaaacagctt

SEQ ID NO: 8757907 - DNA, 22 bp, Homo sapiens
aagcatgaatcgactcggcaac

SEQ ID NO: 8757908 - DNA, 23 bp, Homo sapiens
aagcatcttttcctagctccatc

SEQ ID NO: 8757909 - DNA, 23 bp, Homo sapiens
aagcatcttttcctagctccatc

SEQ ID NO: 8757910 - DNA, 22 bp, Homo sapiens
aagcatcttaaaaagtatcaga

SEQ ID NO: 8757911 - DNA, 19 bp, Homo sapiens
aagcatctttgaaactggg

SEQ ID NO: 8757912 - DNA, 22 bp, Homo sapiens
aagcatcttaaaaagtatcaga

SEQ ID NO: 8757913 - DNA, 22 bp, Homo sapiens
aagcatcttctatcagttagac

SEQ ID NO: 8757914 - DNA, 22 bp, Homo sapiens
aagcatcttagacctgagttcc

SEQ ID NO: 8757915 - DNA, 22 bp, Homo sapiens
aagcatcttctatcagttagac

SEQ ID NO: 8757916 - DNA, 22 bp, Homo sapiens
aagcatctgtaaagacccttat

SEQ ID NO: 8757917 - DNA, 22 bp, Homo sapiens
aagcatctgtaaagacccttat

SEQ ID NO: 8757918 - DNA, 20 bp, Homo sapiens
aagcatctggatgtagcaat

SEQ ID NO: 8757919 - DNA, 20 bp, Homo sapiens
aagcatctggatgtagcaat

SEQ ID NO: 8757920 - DNA, 20 bp, Homo sapiens
aagcatctggatgtagcaat

SEQ ID NO: 8757921 - DNA, 22 bp, Homo sapiens
aaatgtaagtctttgtttctta

SEQ ID NO: 8757922 - DNA, 22 bp, Homo sapiens
aaatgtaagtctttgtttctta

SEQ ID NO: 8757923 - DNA, 22 bp, Homo sapiens
aaatgtaagtctttgtttctta

SEQ ID NO: 8757924 - DNA, 22 bp, Homo sapiens
aaatggcaggctctttgctagt

SEQ ID NO: 8757925 - DNA, 22 bp, Homo sapiens
aaatgtacactttgcatcttga

SEQ ID NO: 8757926 - DNA, 22 bp, Homo sapiens
aaatgtacactttgcatcttga

SEQ ID NO: 8757927 - DNA, 22 bp, Homo sapiens
aaatgtacaacatccatatata

SEQ ID NO: 8757928 - DNA, 22 bp, Homo sapiens
aaatgtacaacatccatatata

SEQ ID NO: 8757929 - DNA, 22 bp, Homo sapiens
aagcatgggaatcccacagggt

SEQ ID NO: 8757930 - DNA, 22 bp, Homo sapiens
aagcatgggaatcccacagggt

SEQ ID NO: 8757931 - DNA, 22 bp, Homo sapiens
aagcatggctgttctagctata

SEQ ID NO: 8757932 - DNA, 22 bp, Homo sapiens
aagcatggagcaatagaatgac

SEQ ID NO: 8757933 - DNA, 22 bp, Homo sapiens
aagcatgggaggcctggaggag

SEQ ID NO: 8757934 - DNA, 22 bp, Homo sapiens
aagcatgggaggcctggaggag

SEQ ID NO: 8757935 - DNA, 20 bp, Homo sapiens
aagcatggtcaaaacttatg

SEQ ID NO: 8757936 - DNA, 19 bp, Homo sapiens
aagcatggtgcctcacctc

SEQ ID NO: 8757937 - DNA, 22 bp, Homo sapiens
aaagcgcatagggggcagcaag

SEQ ID NO: 8757938 - DNA, 22 bp, Homo sapiens
aacagcagcaagtaagcaggtc

SEQ ID NO: 8757939 - DNA, 22 bp, Homo sapiens
aaagctcttggattttagactc

SEQ ID NO: 8757940 - DNA, 22 bp, Homo sapiens
aaagctcttatgtaaacagaaa

SEQ ID NO: 8757941 - DNA, 22 bp, Homo sapiens
aaagctacctttgtgttcatag

SEQ ID NO: 8757942 - DNA, 22 bp, Homo sapiens
aacagcagaaactgcaagctac

SEQ ID NO: 8757943 - DNA, 22 bp, Homo sapiens
aacagcagaaactgcaagctac

SEQ ID NO: 8757944 - DNA, 20 bp, Homo sapiens
aacagcacacattcgcatta

SEQ ID NO: 8757945 - DNA, 22 bp, Homo sapiens
aacagcaatagcactattcatt

SEQ ID NO: 8757946 - DNA, 22 bp, Homo sapiens
aacagcaatagcactattcatt

SEQ ID NO: 8757947 - DNA, 22 bp, Homo sapiens
aacagcaatagcactattcatt

SEQ ID NO: 8757948 - DNA, 22 bp, Homo sapiens
aacagcaatagcactattcatt

SEQ ID NO: 8757949 - DNA, 22 bp, Homo sapiens
aacagatggccaagtgcatggg

SEQ ID NO: 8757950 - DNA, 22 bp, Homo sapiens
aacagatggccaagtgcatggg

SEQ ID NO: 8757951 - DNA, 22 bp, Homo sapiens
aacagatataggcagaactttg

SEQ ID NO: 8757952 - DNA, 22 bp, Homo sapiens
aacagattgtaacctgatagcc

SEQ ID NO: 8757953 - DNA, 22 bp, Homo sapiens
aacagattgtaacctgatagcc

SEQ ID NO: 8757954 - DNA, 19 bp, Homo sapiens
aacagcaacttcctagtca

SEQ ID NO: 8757955 - DNA, 19 bp, Homo sapiens
aacagcaacttcctagtca

SEQ ID NO: 8757956 - DNA, 22 bp, Homo sapiens
aacagatttgtgaagctactca

SEQ ID NO: 8757957 - DNA, 22 bp, Homo sapiens
aaagccatgaatgttatagagg

SEQ ID NO: 8757958 - DNA, 22 bp, Homo sapiens
aacagagtggagccaaactttg

SEQ ID NO: 8757959 - DNA, 22 bp, Homo sapiens
aaagccatgaatgttatagagg

SEQ ID NO: 8757960 - DNA, 22 bp, Homo sapiens
aaagccatctgtattaagtgaa

SEQ ID NO: 8757961 - DNA, 22 bp, Homo sapiens
aacagataatttctaagttact

SEQ ID NO: 8757962 - DNA, 22 bp, Homo sapiens
aacagataatttctaagttact

SEQ ID NO: 8757963 - DNA, 22 bp, Homo sapiens
aacagagtttcaaataacatct

SEQ ID NO: 8757964 - DNA, 22 bp, Homo sapiens
aacagagtttcaaataacatct

SEQ ID NO: 8757965 - DNA, 22 bp, Homo sapiens
aacagagtttcaaataacatct

SEQ ID NO: 8757966 - DNA, 22 bp, Homo sapiens
aaagctcttggattttagactc

SEQ ID NO: 8757967 - DNA, 22 bp, Homo sapiens
aaagctgatgtctactagagaa

SEQ ID NO: 8757968 - DNA, 22 bp, Homo sapiens
aaagctgattgcaggaagagag

SEQ ID NO: 8757969 - DNA, 22 bp, Homo sapiens
aaagctgccaaggagaatacta

SEQ ID NO: 8757970 - DNA, 22 bp, Homo sapiens
aaagctgcaagctcctgaggaa

SEQ ID NO: 8757971 - DNA, 22 bp, Homo sapiens
aaagctgctgccaatcaggctt

SEQ ID NO: 8757972 - DNA, 22 bp, Homo sapiens
aaagctggcttttacaggggct

SEQ ID NO: 8757973 - DNA, 22 bp, Homo sapiens
aaagcttctattcacttacttg

SEQ ID NO: 8757974 - DNA, 22 bp, Homo sapiens
aaagctttctagctatgttcta

SEQ ID NO: 8757975 - DNA, 22 bp, Homo sapiens
aaagctttctagctatgttcta

SEQ ID NO: 8757976 - DNA, 22 bp, Homo sapiens
aaagcttagcattttcaaaatg

SEQ ID NO: 8757977 - DNA, 22 bp, Homo sapiens
aaagctgggggccctggtctag

SEQ ID NO: 8757978 - DNA, 22 bp, Homo sapiens
aaagctggttattctgaggcag

SEQ ID NO: 8757979 - DNA, 22 bp, Homo sapiens
aaagctgtaatgcatgctttct

SEQ ID NO: 8757980 - DNA, 22 bp, Homo sapiens
aaagctgtaatgcatgctttct

SEQ ID NO: 8757981 - DNA, 22 bp, Homo sapiens
aaagctgtagaatcatcttaat

SEQ ID NO: 8757982 - DNA, 22 bp, Homo sapiens
aaagctgtagaatcatcttaat

SEQ ID NO: 8757983 - DNA, 23 bp, Homo sapiens
aaagcttaactgggtaataaagc

SEQ ID NO: 8757984 - DNA, 23 bp, Homo sapiens
aaagcttaactgggtaataaagc

SEQ ID NO: 8757985 - DNA, 22 bp, Homo sapiens
aaattttgtattctagttctag

SEQ ID NO: 8757986 - DNA, 22 bp, Homo sapiens
aaattttgtattctagttctag

SEQ ID NO: 8757987 - DNA, 21 bp, Homo sapiens
aaattttcttggctgtagtgt

SEQ ID NO: 8757988 - DNA, 21 bp, Homo sapiens
aaattttcttggctgtagtgt

SEQ ID NO: 8757989 - DNA, 22 bp, Homo sapiens
aaattttagactcctgggtcta

SEQ ID NO: 8757990 - DNA, 22 bp, Homo sapiens
aaattttagactcctgggtcta

SEQ ID NO: 8757991 - DNA, 22 bp, Homo sapiens
aaattgtggcgtctgtaagagt

SEQ ID NO: 8757992 - DNA, 22 bp, Homo sapiens
aaattttagactcctgggtcta

SEQ ID NO: 8757993 - DNA, 22 bp, Homo sapiens
aaattttagactcctgggtcta

SEQ ID NO: 8757994 - DNA, 22 bp, Homo sapiens
aaattttagtaaggaagttgag

SEQ ID NO: 8757995 - DNA, 22 bp, Homo sapiens
aaattttagtaaggaagttgag

SEQ ID NO: 8757996 - DNA, 22 bp, Homo sapiens
aacaaaagccgaagtaggtgtc

SEQ ID NO: 8757997 - DNA, 22 bp, Homo sapiens
aacaaaagccgaagtaggtgtc

SEQ ID NO: 8757998 - DNA, 22 bp, Homo sapiens
aacaaacaaacattttgtcatc

SEQ ID NO: 8757999 - DNA, 22 bp, Homo sapiens
aacaaacaaacattttgtcatc

SEQ ID NO: 8758000 - DNA, 22 bp, Homo sapiens
aacaaaacatttgtcttgtttc

SEQ ID NO: 8758001 - DNA, 22 bp, Homo sapiens
aacaaaacatttgtcttgtttc

SEQ ID NO: 8758002 - DNA, 22 bp, Homo sapiens
aaagagtttggagacaagatca

SEQ ID NO: 8758003 - DNA, 22 bp, Homo sapiens
aaagataatgtttccttattct

SEQ ID NO: 8758004 - DNA, 22 bp, Homo sapiens
aaagataatgtttccttattct

SEQ ID NO: 8758005 - DNA, 22 bp, Homo sapiens
aacaaacaaacattttgtcatc

SEQ ID NO: 8758006 - DNA, 22 bp, Homo sapiens
aacaaacaaacattttgtcatc

SEQ ID NO: 8758007 - DNA, 22 bp, Homo sapiens
aaagagtttccattgacatttc

SEQ ID NO: 8758008 - DNA, 22 bp, Homo sapiens
aaagatcacgtcccaggactcg

SEQ ID NO: 8758009 - DNA, 22 bp, Homo sapiens
aaagatcacgtcccaggactcg

SEQ ID NO: 8758010 - DNA, 22 bp, Homo sapiens
aaagatcaatagataaagctac

SEQ ID NO: 8758011 - DNA, 22 bp, Homo sapiens
aaagatcagaggatagctgagt

SEQ ID NO: 8758012 - DNA, 22 bp, Homo sapiens
aaagccaggggagggattccca

SEQ ID NO: 8758013 - DNA, 22 bp, Homo sapiens
aaagccaggggagggattccca

SEQ ID NO: 8758014 - DNA, 22 bp, Homo sapiens
aaagatcaagtaggcatggcct

SEQ ID NO: 8758015 - DNA, 22 bp, Homo sapiens
aaagatcaagtaggcatggcct

SEQ ID NO: 8758016 - DNA, 22 bp, Homo sapiens
aaagatatgtctccaaagagat

SEQ ID NO: 8758017 - DNA, 22 bp, Homo sapiens
aaagatatgtctccaaagagat

SEQ ID NO: 8758018 - DNA, 20 bp, Homo sapiens
aaagatactttttgtaatgg

SEQ ID NO: 8758019 - DNA, 22 bp, Homo sapiens
aaagatacttaatagttgtctg

SEQ ID NO: 8758020 - DNA, 22 bp, Homo sapiens
aaagatatgtctccaaagagat

SEQ ID NO: 8758021 - DNA, 22 bp, Homo sapiens
aaagccaggttgtgtgcaggaa

SEQ ID NO: 8758022 - DNA, 22 bp, Homo sapiens
aaagccagggtccaggcctgcc

SEQ ID NO: 8758023 - DNA, 22 bp, Homo sapiens
aaagccagggtccaggcctgcc

SEQ ID NO: 8758024 - DNA, 22 bp, Homo sapiens
aaagccagggtccaggcctgcc

SEQ ID NO: 8758025 - DNA, 22 bp, Homo sapiens
aaagccagggtccaggcctgcc

SEQ ID NO: 8758026 - DNA, 22 bp, Homo sapiens
aaagccagttcttagagaaagc

SEQ ID NO: 8758027 - DNA, 22 bp, Homo sapiens
aaagccagtggtatgagagaaa

SEQ ID NO: 8758028 - DNA, 22 bp, Homo sapiens
aaagccagtggtatgagagaaa

SEQ ID NO: 8758029 - DNA, 22 bp, Homo sapiens
aaagccatcagtaaaatgattt

SEQ ID NO: 8758030 - DNA, 22 bp, Homo sapiens
aaagccatcagtaaaatgattt

SEQ ID NO: 8758031 - DNA, 22 bp, Homo sapiens
aaagccagttcttttatattgg

SEQ ID NO: 8758032 - DNA, 22 bp, Homo sapiens
aaagccagttcttttatattgg

SEQ ID NO: 8758033 - DNA, 22 bp, Homo sapiens
aaagccagtttctggaagtacc

SEQ ID NO: 8758034 - DNA, 22 bp, Homo sapiens
aaagccagtttctggaagtacc

SEQ ID NO: 8758035 - DNA, 22 bp, Homo sapiens
aaagccagtttgtctctttaaa

SEQ ID NO: 8758036 - DNA, 22 bp, Homo sapiens
aaaggaaaataagtagttccat

SEQ ID NO: 8758037 - DNA, 22 bp, Homo sapiens
aaagcttttcagtatgttcatg

SEQ ID NO: 8758038 - DNA, 22 bp, Homo sapiens
aaagcttttcagtatgttcatg

SEQ ID NO: 8758039 - DNA, 22 bp, Homo sapiens
aaagctttgtaaataaacaggt

SEQ ID NO: 8758040 - DNA, 22 bp, Homo sapiens
aaagctttgtaaataaacaggt

SEQ ID NO: 8758041 - DNA, 22 bp, Homo sapiens
aaaggttctacttttaaagaat

SEQ ID NO: 8758042 - DNA, 22 bp, Homo sapiens
aaagggctgaagtagtctctgt

SEQ ID NO: 8758043 - DNA, 22 bp, Homo sapiens
aaagggctcccaggatcatctc

SEQ ID NO: 8758044 - DNA, 22 bp, Homo sapiens
aaagggcctccgcctgggcagg

SEQ ID NO: 8758045 - DNA, 22 bp, Homo sapiens
aaagggcctccgcctgggcagg

SEQ ID NO: 8758046 - DNA, 22 bp, Homo sapiens
aaaggtttatttaatcagggag

SEQ ID NO: 8758047 - DNA, 22 bp, Homo sapiens
aaaggttgtgttctggggtgag

SEQ ID NO: 8758048 - DNA, 22 bp, Homo sapiens
aactaaagtaaccaaggatatc

SEQ ID NO: 8758049 - DNA, 22 bp, Homo sapiens
aactaaaccatgacattatatt

SEQ ID NO: 8758050 - DNA, 22 bp, Homo sapiens
aactaaaggctgttgcagggaa

SEQ ID NO: 8758051 - DNA, 22 bp, Homo sapiens
aactaaatctggcatttagagc

SEQ ID NO: 8758052 - DNA, 22 bp, Homo sapiens
aactaaaactggtttgttctct

SEQ ID NO: 8758053 - DNA, 22 bp, Homo sapiens
aactaaaagtgtgtctcttgta

SEQ ID NO: 8758054 - DNA, 22 bp, Homo sapiens
aactaaaccatgacattatatt

SEQ ID NO: 8758055 - DNA, 22 bp, Homo sapiens
aactaaaagtgtgtctcttgta

SEQ ID NO: 8758056 - DNA, 22 bp, Homo sapiens
aactaaaagtgtgtctcttgta

SEQ ID NO: 8758057 - DNA, 22 bp, Homo sapiens
aaaggttttcatcacagcaaga

SEQ ID NO: 8758058 - DNA, 22 bp, Homo sapiens
aacgttttatcgtgtgctcttc

SEQ ID NO: 8758059 - DNA, 22 bp, Homo sapiens
aactaaaactggtttgttctct

SEQ ID NO: 8758060 - DNA, 22 bp, Homo sapiens
aaagtagaggcattgatcaggt

SEQ ID NO: 8758061 - DNA, 22 bp, Homo sapiens
aaagtagaacattttcttatct

SEQ ID NO: 8758062 - DNA, 22 bp, Homo sapiens
aaagtactgatgccatcagcac

SEQ ID NO: 8758063 - DNA, 21 bp, Homo sapiens
aactaaggaactgaaaaatgg

SEQ ID NO: 8758064 - DNA, 22 bp, Homo sapiens
aaagtaattgtggtttctgtca

SEQ ID NO: 8758065 - DNA, 22 bp, Homo sapiens
aaagtaattgtggttcttgcca

SEQ ID NO: 8758066 - DNA, 22 bp, Homo sapiens
aaagtacaaatgttctagccat

SEQ ID NO: 8758067 - DNA, 22 bp, Homo sapiens
aactaacagtcattaaaagaac

SEQ ID NO: 8758068 - DNA, 22 bp, Homo sapiens
aactaagtcatagagtccctca

SEQ ID NO: 8758069 - DNA, 22 bp, Homo sapiens
aaagtgggaacaatggagagtg

SEQ ID NO: 8758070 - DNA, 22 bp, Homo sapiens
aaagtggggtctagagggcctg

SEQ ID NO: 8758071 - DNA, 22 bp, Homo sapiens
aaagtggtttcccagttcagta

SEQ ID NO: 8758072 - DNA, 22 bp, Homo sapiens
aaagtgtactatgtcatgaaca

SEQ ID NO: 8758073 - DNA, 22 bp, Homo sapiens
aaagtgtactatgtcatgaaca

SEQ ID NO: 8758074 - DNA, 22 bp, Homo sapiens
aaagtgtactatgtcatgaaca

SEQ ID NO: 8758075 - DNA, 20 bp, Homo sapiens
aaagtgtaaggcaaagttgt

SEQ ID NO: 8758076 - DNA, 22 bp, Homo sapiens
aaagtgtactatgtcatgaaca

SEQ ID NO: 8758077 - DNA, 20 bp, Homo sapiens
aaagtgtaagcatataatta

SEQ ID NO: 8758078 - DNA, 22 bp, Homo sapiens
aaagtgtaaaagcatgttaggg

SEQ ID NO: 8758079 - DNA, 22 bp, Homo sapiens
aaagtgtaaaagcatgttaggg

SEQ ID NO: 8758080 - DNA, 20 bp, Homo sapiens
aaagtgtaagcatataatta

SEQ ID NO: 8758081 - DNA, 20 bp, Homo sapiens
aaagtgtaagcatataatta

SEQ ID NO: 8758082 - DNA, 22 bp, Homo sapiens
aaagtgctgtgggctgtaagtg

SEQ ID NO: 8758083 - DNA, 22 bp, Homo sapiens
aaagtgcttccttttagaggct

SEQ ID NO: 8758084 - DNA, 22 bp, Homo sapiens
aaagtgcttccttttagaggct

SEQ ID NO: 8758085 - DNA, 22 bp, Homo sapiens
aaagtgcttcctttttgagggt

SEQ ID NO: 8758086 - DNA, 22 bp, Homo sapiens
aaagtgcttctctttggtgggt

SEQ ID NO: 8758087 - DNA, 23 bp, Homo sapiens
aaagtgcttggcacgacacctgg

SEQ ID NO: 8758088 - DNA, 22 bp, Homo sapiens
aaagtgctttaggatatttgga

SEQ ID NO: 8758089 - DNA, 22 bp, Homo sapiens
aaagtgctttaggatatttgga

SEQ ID NO: 8758090 - DNA, 22 bp, Homo sapiens
aaagtggccatcctctgcatcg

SEQ ID NO: 8758091 - DNA, 22 bp, Homo sapiens
aaagtgcagcttgtgatcccta

SEQ ID NO: 8758092 - DNA, 22 bp, Homo sapiens
aaagtgcagggtgctctggtat

SEQ ID NO: 8758093 - DNA, 22 bp, Homo sapiens
aaagtgcagtaacttgcccaag

SEQ ID NO: 8758094 - DNA, 22 bp, Homo sapiens
aaagtgcagtaacttgcccaag

SEQ ID NO: 8758095 - DNA, 22 bp, Homo sapiens
aaagtgcagggtgctctggtat

SEQ ID NO: 8758096 - DNA, 22 bp, Homo sapiens
aaagtcacatagcatcacttct

SEQ ID NO: 8758097 - DNA, 22 bp, Homo sapiens
aaagtgcagcttgtgatcccta

SEQ ID NO: 8758098 - DNA, 22 bp, Homo sapiens
aaagtcacatagcatcacttct

SEQ ID NO: 8758099 - DNA, 22 bp, Homo sapiens
aaagtcacaatattggaaggtg

SEQ ID NO: 8758100 - DNA, 22 bp, Homo sapiens
aaagtcacagtttaggggatat

SEQ ID NO: 8758101 - DNA, 22 bp, Homo sapiens
aaagtcaaggtttagactagag

SEQ ID NO: 8758102 - DNA, 22 bp, Homo sapiens
aaagtcaatgatttctcctgga

SEQ ID NO: 8758103 - DNA, 22 bp, Homo sapiens
aaagtcacagtttaggggatat

SEQ ID NO: 8758104 - DNA, 22 bp, Homo sapiens
aaagtagcttagttgatatttc

SEQ ID NO: 8758105 - DNA, 22 bp, Homo sapiens
aaagtagtctctttcatctttt

SEQ ID NO: 8758106 - DNA, 22 bp, Homo sapiens
aaagtagtctctttcatctttt

SEQ ID NO: 8758107 - DNA, 22 bp, Homo sapiens
aaagtatatatgcactttagaa

SEQ ID NO: 8758108 - DNA, 22 bp, Homo sapiens
aaagtagcagtaattatgaaat

SEQ ID NO: 8758109 - DNA, 22 bp, Homo sapiens
aaagtagcagtaattatgaaat

SEQ ID NO: 8758110 - DNA, 22 bp, Homo sapiens
aaagtagaggcattgatcaggt

SEQ ID NO: 8758111 - DNA, 22 bp, Homo sapiens
aaagtagatttctcatggcgaa

SEQ ID NO: 8758112 - DNA, 22 bp, Homo sapiens
aaagtagcccttctggaattta

SEQ ID NO: 8758113 - DNA, 22 bp, Homo sapiens
aaagtagagttgtggaattact

SEQ ID NO: 8758114 - DNA, 22 bp, Homo sapiens
aaagtagaggcattgatcaggt

SEQ ID NO: 8758115 - DNA, 22 bp, Homo sapiens
aaagtatgattggggattattt

SEQ ID NO: 8758116 - DNA, 22 bp, Homo sapiens
aaagtatcaagggaagcatttt

SEQ ID NO: 8758117 - DNA, 22 bp, Homo sapiens
aaagtatatttacttactgtga

SEQ ID NO: 8758118 - DNA, 22 bp, Homo sapiens
aaagtatatttacttactgtga

SEQ ID NO: 8758119 - DNA, 22 bp, Homo sapiens
aaagtatatatgcactttagaa

SEQ ID NO: 8758120 - DNA, 22 bp, Homo sapiens
aaagtatatatgcactttagaa

SEQ ID NO: 8758121 - DNA, 22 bp, Homo sapiens
aaagtatatttacttactgtga

SEQ ID NO: 8758122 - DNA, 22 bp, Homo sapiens
aaagtagcttagttgatatttc

SEQ ID NO: 8758123 - DNA, 22 bp, Homo sapiens
aaagtattcaaaaatatttggt

SEQ ID NO: 8758124 - DNA, 22 bp, Homo sapiens
aaagtattcttgactgtttttc

SEQ ID NO: 8758125 - DNA, 22 bp, Homo sapiens
aaagtattcaaaaatatttggt

SEQ ID NO: 8758126 - DNA, 22 bp, Homo sapiens
aaagtattcaaaaatatttggt

SEQ ID NO: 8758127 - DNA, 22 bp, Homo sapiens
aaagtatgttgtggcttttaaa

SEQ ID NO: 8758128 - DNA, 22 bp, Homo sapiens
aaagtatgattggggattattt

SEQ ID NO: 8758129 - DNA, 22 bp, Homo sapiens
aaagtatttgtgatttttacca

SEQ ID NO: 8758130 - DNA, 22 bp, Homo sapiens
aaagtcaaggtttagactagag

SEQ ID NO: 8758131 - DNA, 22 bp, Homo sapiens
aaagtatttttgacaggcatta

SEQ ID NO: 8758132 - DNA, 22 bp, Homo sapiens
aaagtcaaaatgctctcctgtc

SEQ ID NO: 8758133 - DNA, 22 bp, Homo sapiens
aaagtatttttgacaggcatta

SEQ ID NO: 8758134 - DNA, 22 bp, Homo sapiens
aacaaactcaaatggaagagtg

SEQ ID NO: 8758135 - DNA, 22 bp, Homo sapiens
aacaaagaagactggttatttt

SEQ ID NO: 8758136 - DNA, 22 bp, Homo sapiens
aacaaagaagactggttatttt

SEQ ID NO: 8758137 - DNA, 22 bp, Homo sapiens
aacaaactcaaatggaagagtg

SEQ ID NO: 8758138 - DNA, 22 bp, Homo sapiens
aacaaactcaaatggaagagtg

SEQ ID NO: 8758139 - DNA, 22 bp, Homo sapiens
aacaaagatgggtgggaaagag

SEQ ID NO: 8758140 - DNA, 22 bp, Homo sapiens
aacaaagcaccactgagtcagt

SEQ ID NO: 8758141 - DNA, 22 bp, Homo sapiens
aacaaagcaccactgagtcagt

SEQ ID NO: 8758142 - DNA, 22 bp, Homo sapiens
aacaaagcaccactgagtcagt

SEQ ID NO: 8758143 - DNA, 22 bp, Homo sapiens
aacaaagtagctgctgttctta

SEQ ID NO: 8758144 - DNA, 22 bp, Homo sapiens
aacaaagtcgttgcctagaaga

SEQ ID NO: 8758145 - DNA, 22 bp, Homo sapiens
aacaaagccctgcccaagagct

SEQ ID NO: 8758146 - DNA, 22 bp, Homo sapiens
aacaaagccctgcccaagagct

SEQ ID NO: 8758147 - DNA, 22 bp, Homo sapiens
aacaaaggccgttaataaccac

SEQ ID NO: 8758148 - DNA, 22 bp, Homo sapiens
aacaaacattacctggtgctgg

SEQ ID NO: 8758149 - DNA, 22 bp, Homo sapiens
aacaaacattacctggtgctgg

SEQ ID NO: 8758150 - DNA, 22 bp, Homo sapiens
aacaaacagttaagtgtggatg

SEQ ID NO: 8758151 - DNA, 20 bp, Homo sapiens
aacaaactacaaaattatgt

SEQ ID NO: 8758152 - DNA, 20 bp, Homo sapiens
aacaaactacaaaattatgt

SEQ ID NO: 8758153 - DNA, 20 bp, Homo sapiens
aacaaactacaaaattatgt

SEQ ID NO: 8758154 - DNA, 22 bp, Homo sapiens
aaattttagaccaggcaaaact

SEQ ID NO: 8758155 - DNA, 22 bp, Homo sapiens
aaattgcattgagctgcttatt

SEQ ID NO: 8758156 - DNA, 22 bp, Homo sapiens
aacaaacagttaagtgtggatg

SEQ ID NO: 8758157 - DNA, 22 bp, Homo sapiens
aacaaacagttaagtgtggatg

SEQ ID NO: 8758158 - DNA, 22 bp, Homo sapiens
aaattttagaccaggcaaaact

SEQ ID NO: 8758159 - DNA, 22 bp, Homo sapiens
aaattttagaccaggcaaaact

SEQ ID NO: 8758160 - DNA, 22 bp, Homo sapiens
aaattctaaggtcacaatgttg

SEQ ID NO: 8758161 - DNA, 22 bp, Homo sapiens
aaattctatgtcaatgtttatt

SEQ ID NO: 8758162 - DNA, 22 bp, Homo sapiens
aaattctatgtcaatgtttatt

SEQ ID NO: 8758163 - DNA, 22 bp, Homo sapiens
aaattctaaggtcacaatgttg

SEQ ID NO: 8758164 - DNA, 22 bp, Homo sapiens
aaattctatgtcaatgtttatt

SEQ ID NO: 8758165 - DNA, 22 bp, Homo sapiens
aaattctatgtcaatgtttatt

SEQ ID NO: 8758166 - DNA, 22 bp, Homo sapiens
aaattctggcctatcacagtga

SEQ ID NO: 8758167 - DNA, 22 bp, Homo sapiens
aaattcttcaggtaattttgat

SEQ ID NO: 8758168 - DNA, 22 bp, Homo sapiens
aaattcttcaggtaattttgat

SEQ ID NO: 8758169 - DNA, 22 bp, Homo sapiens
aaattctggcctatcacagtga

SEQ ID NO: 8758170 - DNA, 22 bp, Homo sapiens
aaattctttggcctactttgaa

SEQ ID NO: 8758171 - DNA, 22 bp, Homo sapiens
aaattgaatttgggaaacattg

SEQ ID NO: 8758172 - DNA, 22 bp, Homo sapiens
aaattgaatttgggaaacattg

SEQ ID NO: 8758173 - DNA, 22 bp, Homo sapiens
aaattgcaaaagtacttttagg

SEQ ID NO: 8758174 - DNA, 22 bp, Homo sapiens
aaattgagctcatttcctctgt

SEQ ID NO: 8758175 - DNA, 22 bp, Homo sapiens
aaattgagacttttttcctcca

SEQ ID NO: 8758176 - DNA, 22 bp, Homo sapiens
aaattgatgttcccagttgaaa

SEQ ID NO: 8758177 - DNA, 22 bp, Homo sapiens
aaattgcacaatatagacatga

SEQ ID NO: 8758178 - DNA, 22 bp, Homo sapiens
aaattgcacaatatagacatga

SEQ ID NO: 8758179 - DNA, 22 bp, Homo sapiens
aaattgcagatgctaaatgact

SEQ ID NO: 8758180 - DNA, 23 bp, Homo sapiens
aaattccttgcagataggtattg

SEQ ID NO: 8758181 - DNA, 22 bp, Homo sapiens
aaattcctgtcatttgcacttt

SEQ ID NO: 8758182 - DNA, 22 bp, Homo sapiens
aaattctaaggtcacaatgttg

SEQ ID NO: 8758183 - DNA, 22 bp, Homo sapiens
aaattctaaggtcacaatgttg

SEQ ID NO: 8758184 - DNA, 22 bp, Homo sapiens
aaattctaaggtcacaatgttg

SEQ ID NO: 8758185 - DNA, 22 bp, Homo sapiens
aaattcctctgatcataagaat

SEQ ID NO: 8758186 - DNA, 22 bp, Homo sapiens
aaattcactctgttcctcatgg

SEQ ID NO: 8758187 - DNA, 21 bp, Homo sapiens
aaattcacctagtaaaacttc

SEQ ID NO: 8758188 - DNA, 22 bp, Homo sapiens
aaatgttctgaaagacccgctc

SEQ ID NO: 8758189 - DNA, 22 bp, Homo sapiens
aaatgttctactttgataatta

SEQ ID NO: 8758190 - DNA, 22 bp, Homo sapiens
aaatgtttctacttgtgagcat

SEQ ID NO: 8758191 - DNA, 22 bp, Homo sapiens
aaatgttttgctcccatgtggt

SEQ ID NO: 8758192 - DNA, 22 bp, Homo sapiens
aaatgttttgctcccatgtggt

SEQ ID NO: 8758193 - DNA, 22 bp, Homo sapiens
aaatgttcatttctcactcaca

SEQ ID NO: 8758194 - DNA, 22 bp, Homo sapiens
aaatgttcatttctcactcaca

SEQ ID NO: 8758195 - DNA, 22 bp, Homo sapiens
aaatgttcaccagatccatgac

SEQ ID NO: 8758196 - DNA, 22 bp, Homo sapiens
aaatgttcaccagatccatgac

SEQ ID NO: 8758197 - DNA, 22 bp, Homo sapiens
aaatgttcattaagggcctgtt

SEQ ID NO: 8758198 - DNA, 22 bp, Homo sapiens
aaatgttccattattgtgtaat

SEQ ID NO: 8758199 - DNA, 22 bp, Homo sapiens
aaatgttcccaatatgaagctg

SEQ ID NO: 8758200 - DNA, 22 bp, Homo sapiens
aaatgttccgggtaaggagaaa

SEQ ID NO: 8758201 - DNA, 22 bp, Homo sapiens
aaatgttcctttggattaaact

SEQ ID NO: 8758202 - DNA, 22 bp, Homo sapiens
aaatgttctactttgataatta

SEQ ID NO: 8758203 - DNA, 22 bp, Homo sapiens
aaatgttctaaattacatgtga

SEQ ID NO: 8758204 - DNA, 22 bp, Homo sapiens
aaatgtgtttcgaaaactggtg

SEQ ID NO: 8758205 - DNA, 22 bp, Homo sapiens
aaatgtgtttagatggtttatt

SEQ ID NO: 8758206 - DNA, 22 bp, Homo sapiens
aaatgtgtttctttgtgaatgg

SEQ ID NO: 8758207 - DNA, 22 bp, Homo sapiens
aaatgtgtttgataggaatatt

SEQ ID NO: 8758208 - DNA, 22 bp, Homo sapiens
aaatgtgtttgataggaatatt

SEQ ID NO: 8758209 - DNA, 22 bp, Homo sapiens
aaatgtgtttctttgtgaatgg

SEQ ID NO: 8758210 - DNA, 22 bp, Homo sapiens
aaatgtgtttctttgtgaatgg

SEQ ID NO: 8758211 - DNA, 22 bp, Homo sapiens
aaatgtgtatatgaaacatgat

SEQ ID NO: 8758212 - DNA, 22 bp, Homo sapiens
aaatgtgtatatgaaacatgat

SEQ ID NO: 8758213 - DNA, 22 bp, Homo sapiens
aaatgtgtcagtttcattctct

SEQ ID NO: 8758214 - DNA, 22 bp, Homo sapiens
aaatgtgcttgtgatcagctgt

SEQ ID NO: 8758215 - DNA, 22 bp, Homo sapiens
aaatgtgcttcttactctcaat

SEQ ID NO: 8758216 - DNA, 22 bp, Homo sapiens
aaatgtggggctggaggcagga

SEQ ID NO: 8758217 - DNA, 22 bp, Homo sapiens
aaatgtgcttgtgatcagctgt

SEQ ID NO: 8758218 - DNA, 22 bp, Homo sapiens
aaatgtgtgtatgtacatatat

SEQ ID NO: 8758219 - DNA, 22 bp, Homo sapiens
aaatgtgtcatattcaaagtca

SEQ ID NO: 8758220 - DNA, 22 bp, Homo sapiens
aaatgtgttcctttgctacaga

SEQ ID NO: 8758221 - DNA, 22 bp, Homo sapiens
aaatgtgttcctttgctacaga

SEQ ID NO: 8758222 - DNA, 22 bp, Homo sapiens
aaatgtgttcctttgctacaga

SEQ ID NO: 8758223 - DNA, 21 bp, Homo sapiens
aaatgtgttccataatgcttt

SEQ ID NO: 8758224 - DNA, 22 bp, Homo sapiens
aaatgtgagttatagcaataga

SEQ ID NO: 8758225 - DNA, 22 bp, Homo sapiens
aaatgtgatactgttcttttta

SEQ ID NO: 8758226 - DNA, 22 bp, Homo sapiens
aaatgtgatactgttcttttta

SEQ ID NO: 8758227 - DNA, 22 bp, Homo sapiens
aaatgtctatctggcatattcc

SEQ ID NO: 8758228 - DNA, 19 bp, Homo sapiens
aaatgtgatggtacaattc

SEQ ID NO: 8758229 - DNA, 19 bp, Homo sapiens
aaatgtgatggtacaattc

SEQ ID NO: 8758230 - DNA, 22 bp, Homo sapiens
aaatgtgctaaagtattaacat

SEQ ID NO: 8758231 - DNA, 22 bp, Homo sapiens
aaatgtgctcatttataaaagt

SEQ ID NO: 8758232 - DNA, 22 bp, Homo sapiens
aaatgtgctcatttataaaagt

SEQ ID NO: 8758233 - DNA, 22 bp, Homo sapiens
aagctgagccagtggcaagtgc

SEQ ID NO: 8758234 - DNA, 22 bp, Homo sapiens
aagctgaggcccatggcaaggt

SEQ ID NO: 8758235 - DNA, 22 bp, Homo sapiens
aagctgaggcccatggcaaggt

SEQ ID NO: 8758236 - DNA, 22 bp, Homo sapiens
aagctgaggatacatgaagcct

SEQ ID NO: 8758237 - DNA, 22 bp, Homo sapiens
aaatgtctacttcccatctgta

SEQ ID NO: 8758238 - DNA, 19 bp, Homo sapiens
aagctgagggctgtccacc

SEQ ID NO: 8758239 - DNA, 19 bp, Homo sapiens
aagctgagggctgtccacc

SEQ ID NO: 8758240 - DNA, 22 bp, Homo sapiens
aacagccactgatactgaatag

SEQ ID NO: 8758241 - DNA, 22 bp, Homo sapiens
aacagcatgctgggtaacattg

SEQ ID NO: 8758242 - DNA, 22 bp, Homo sapiens
aacagcatgctgggtaacattg

SEQ ID NO: 8758243 - DNA, 23 bp, Homo sapiens
aacagccaactttagcgggtggc

SEQ ID NO: 8758244 - DNA, 22 bp, Homo sapiens
aacagcatgctgggtaacattg

SEQ ID NO: 8758245 - DNA, 22 bp, Homo sapiens
aacagcatgctgggtaacattg

SEQ ID NO: 8758246 - DNA, 22 bp, Homo sapiens
aagtccaagatgcagttgtcag

SEQ ID NO: 8758247 - DNA, 22 bp, Homo sapiens
aagtccaaggtcaccattcaca

SEQ ID NO: 8758248 - DNA, 22 bp, Homo sapiens
aagtccaaggctgggtgcagtg

SEQ ID NO: 8758249 - DNA, 23 bp, Homo sapiens
aagtccacacgtagtgaaacagt

SEQ ID NO: 8758250 - DNA, 22 bp, Homo sapiens
aagtccaccagtcagactagga

SEQ ID NO: 8758251 - DNA, 22 bp, Homo sapiens
aagtccagctctaaatatctga

SEQ ID NO: 8758252 - DNA, 17 bp, Homo sapiens
aagtccagcctgcagct

SEQ ID NO: 8758253 - DNA, 22 bp, Homo sapiens
aacagcttgagactggatatgc

SEQ ID NO: 8758254 - DNA, 22 bp, Homo sapiens
aacaggaatgaggagaaaaggt

SEQ ID NO: 8758255 - DNA, 22 bp, Homo sapiens
aacagcttgaggaatatcatca

SEQ ID NO: 8758256 - DNA, 22 bp, Homo sapiens
aaggtcatggcaaattactttt

SEQ ID NO: 8758257 - DNA, 22 bp, Homo sapiens
aaggtcgtgtgggggttgctgc

SEQ ID NO: 8758258 - DNA, 22 bp, Homo sapiens
aaggtctgagttttgccaggcc

SEQ ID NO: 8758259 - DNA, 22 bp, Homo sapiens
aaggtcctgtagccacagagcc

SEQ ID NO: 8758260 - DNA, 22 bp, Homo sapiens
aaggtccttttgcagtgtgatc

SEQ ID NO: 8758261 - DNA, 22 bp, Homo sapiens
aacagagcttgggtcatctcat

SEQ ID NO: 8758262 - DNA, 22 bp, Homo sapiens
aacagagctggtgactccaggt

SEQ ID NO: 8758263 - DNA, 22 bp, Homo sapiens
aacagagctggtgactccaggt

SEQ ID NO: 8758264 - DNA, 22 bp, Homo sapiens
aacagaggatgtttgaaattca

SEQ ID NO: 8758265 - DNA, 22 bp, Homo sapiens
aacagaggctccctgcacttgt

SEQ ID NO: 8758266 - DNA, 22 bp, Homo sapiens
aacagagctgaccagtgagggc

SEQ ID NO: 8758267 - DNA, 22 bp, Homo sapiens
aaggtctgcttatatcttacat

SEQ ID NO: 8758268 - DNA, 22 bp, Homo sapiens
aacagcagctttcaggatcatc

SEQ ID NO: 8758269 - DNA, 22 bp, Homo sapiens
aacagcagctgcctgaatttgc

SEQ ID NO: 8758270 - DNA, 22 bp, Homo sapiens
aacagcagctgaggagctgggc

SEQ ID NO: 8758271 - DNA, 22 bp, Homo sapiens
aacagaggctccctgcacttgt

SEQ ID NO: 8758272 - DNA, 22 bp, Homo sapiens
aaggtctggatgatgggtgtgc

SEQ ID NO: 8758273 - DNA, 22 bp, Homo sapiens
aacagagtggagccaaactttg

SEQ ID NO: 8758274 - DNA, 22 bp, Homo sapiens
aacagcaggcaccaaggctatg

SEQ ID NO: 8758275 - DNA, 23 bp, Homo sapiens
aacagcaggatgatagaggaggt

SEQ ID NO: 8758276 - DNA, 22 bp, Homo sapiens
aacagcagggggacctgctggt

SEQ ID NO: 8758277 - DNA, 22 bp, Homo sapiens
aacagcagggatgacatggcca

SEQ ID NO: 8758278 - DNA, 22 bp, Homo sapiens
aacagcagggatggggtggcca

SEQ ID NO: 8758279 - DNA, 22 bp, Homo sapiens
aacagcagggacttgaatggaa

SEQ ID NO: 8758280 - DNA, 22 bp, Homo sapiens
aacagcagggaaattccaagtc

SEQ ID NO: 8758281 - DNA, 22 bp, Homo sapiens
aacagcaggcatttcttagctc

SEQ ID NO: 8758282 - DNA, 22 bp, Homo sapiens
aacagcataccaatgtacatat

SEQ ID NO: 8758283 - DNA, 22 bp, Homo sapiens
aacagcataccaatgtacatat

SEQ ID NO: 8758284 - DNA, 22 bp, Homo sapiens
aacagcagttacttttgcatca

SEQ ID NO: 8758285 - DNA, 22 bp, Homo sapiens
aacagcatcaccccataacatt

SEQ ID NO: 8758286 - DNA, 22 bp, Homo sapiens
aacagcatatttcatatattga

SEQ ID NO: 8758287 - DNA, 22 bp, Homo sapiens
aacagcataccaatgtacatat

SEQ ID NO: 8758288 - DNA, 22 bp, Homo sapiens
aacagcataccaatgtacatat

SEQ ID NO: 8758289 - DNA, 22 bp, Homo sapiens
aacactaatgggagaacaaccc

SEQ ID NO: 8758290 - DNA, 22 bp, Homo sapiens
aacactaacatatagtcagtgg

SEQ ID NO: 8758291 - DNA, 22 bp, Homo sapiens
aacactaacatatagtcagtgg

SEQ ID NO: 8758292 - DNA, 22 bp, Homo sapiens
aacactcaatttacaaactctg

SEQ ID NO: 8758293 - DNA, 22 bp, Homo sapiens
aacactagtctagaccagacca

SEQ ID NO: 8758294 - DNA, 22 bp, Homo sapiens
aacactctctgttggtaaggct

SEQ ID NO: 8758295 - DNA, 22 bp, Homo sapiens
aacactctctgttggtaaggct

SEQ ID NO: 8758296 - DNA, 22 bp, Homo sapiens
aacactgaaacattgattgaca

SEQ ID NO: 8758297 - DNA, 22 bp, Homo sapiens
aacactctctgttggtaaggct

SEQ ID NO: 8758298 - DNA, 22 bp, Homo sapiens
aacaaatgtaaaatgcagatgc

SEQ ID NO: 8758299 - DNA, 22 bp, Homo sapiens
aacaaatgtaaaatgcagatgc

SEQ ID NO: 8758300 - DNA, 22 bp, Homo sapiens
aacaaatgtaaaatgcagatgc

SEQ ID NO: 8758301 - DNA, 22 bp, Homo sapiens
aacacatagacgtttgatatca

SEQ ID NO: 8758302 - DNA, 19 bp, Homo sapiens
aacaccagagtcaggagtc

SEQ ID NO: 8758303 - DNA, 22 bp, Homo sapiens
aacaccttctccttgcaggcca

SEQ ID NO: 8758304 - DNA, 22 bp, Homo sapiens
aacactaaaggtcagttagaag

SEQ ID NO: 8758305 - DNA, 22 bp, Homo sapiens
aacactaaaggtcagttagaag

SEQ ID NO: 8758306 - DNA, 22 bp, Homo sapiens
aacaccttctccttgcaggcca

SEQ ID NO: 8758307 - DNA, 22 bp, Homo sapiens
aacaaatggggccttgtatgaa

SEQ ID NO: 8758308 - DNA, 22 bp, Homo sapiens
aacaaatggggccttgtatgaa

SEQ ID NO: 8758309 - DNA, 22 bp, Homo sapiens
aacaaatggaacacaaatcttt

SEQ ID NO: 8758310 - DNA, 22 bp, Homo sapiens
aacaaatggaacacaaatcttt

SEQ ID NO: 8758311 - DNA, 22 bp, Homo sapiens
aacaaatgattgttggttggag

SEQ ID NO: 8758312 - DNA, 22 bp, Homo sapiens
aacaaatgataccagttctcaa

SEQ ID NO: 8758313 - DNA, 22 bp, Homo sapiens
aacaaatggaacacaaatcttt

SEQ ID NO: 8758314 - DNA, 22 bp, Homo sapiens
aacaaatgacctgatttcttcc

SEQ ID NO: 8758315 - DNA, 22 bp, Homo sapiens
aacaaagtttcaggaagataga

SEQ ID NO: 8758316 - DNA, 22 bp, Homo sapiens
aacaaagtttcaggaagataga

SEQ ID NO: 8758317 - DNA, 22 bp, Homo sapiens
aacaaagtttcaggaagataga

SEQ ID NO: 8758318 - DNA, 22 bp, Homo sapiens
aacaaagtgtacttccatactg

SEQ ID NO: 8758319 - DNA, 22 bp, Homo sapiens
aacaaagtgtacttccatactg

SEQ ID NO: 8758320 - DNA, 22 bp, Homo sapiens
aaggtattattgtctatgtact

SEQ ID NO: 8758321 - DNA, 22 bp, Homo sapiens
aaggtattatttgcaatcattt

SEQ ID NO: 8758322 - DNA, 22 bp, Homo sapiens
aaggtattggcagggctgagtt

SEQ ID NO: 8758323 - DNA, 22 bp, Homo sapiens
aaggtattggggaatatttgac

SEQ ID NO: 8758324 - DNA, 22 bp, Homo sapiens
aaggtattggggaatatttgac

SEQ ID NO: 8758325 - DNA, 22 bp, Homo sapiens
aaggtattggtctggtcttcct

SEQ ID NO: 8758326 - DNA, 22 bp, Homo sapiens
aaggtattgttccctagtttct

SEQ ID NO: 8758327 - DNA, 22 bp, Homo sapiens
aaggtatttagtgtgaaagcta

SEQ ID NO: 8758328 - DNA, 22 bp, Homo sapiens
aaggtcaagacacaggaatcta

SEQ ID NO: 8758329 - DNA, 22 bp, Homo sapiens
aaggtcaagacacaggaatcta

SEQ ID NO: 8758330 - DNA, 22 bp, Homo sapiens
aaggtcaaagacagtaactttt

SEQ ID NO: 8758331 - DNA, 22 bp, Homo sapiens
aaggtcaacactgattttagtc

SEQ ID NO: 8758332 - DNA, 22 bp, Homo sapiens
aaggtattttctaatgtatact

SEQ ID NO: 8758333 - DNA, 22 bp, Homo sapiens
aaggtattttctaatgtatact

SEQ ID NO: 8758334 - DNA, 23 bp, Homo sapiens
aaggtatttattttaaaggtaag

SEQ ID NO: 8758335 - DNA, 22 bp, Homo sapiens
aaggtatttagtgtgaaagcta

SEQ ID NO: 8758336 - DNA, 23 bp, Homo sapiens
aaggtatttattttaaaggtaag

SEQ ID NO: 8758337 - DNA, 22 bp, Homo sapiens
aaggtcacactcccagagctga

SEQ ID NO: 8758338 - DNA, 22 bp, Homo sapiens
aaggtcacactcccagagctga

SEQ ID NO: 8758339 - DNA, 22 bp, Homo sapiens
aaggtcacactcccagagctga

SEQ ID NO: 8758340 - DNA, 22 bp, Homo sapiens
aaggtcatttaacaatttatga

SEQ ID NO: 8758341 - DNA, 22 bp, Homo sapiens
aaggtcagagtgagctgtggcc

SEQ ID NO: 8758342 - DNA, 22 bp, Homo sapiens
aacactgaaatgtcttaagatt

SEQ ID NO: 8758343 - DNA, 22 bp, Homo sapiens
aacactgaaatgtcttaagatt

SEQ ID NO: 8758344 - DNA, 22 bp, Homo sapiens
aacactgaaatgtcttaagatt

SEQ ID NO: 8758345 - DNA, 22 bp, Homo sapiens
aacactgaaatgtcttaagatt

SEQ ID NO: 8758346 - DNA, 22 bp, Homo sapiens
aacactgaagaccaggtaattt

SEQ ID NO: 8758347 - DNA, 22 bp, Homo sapiens
aacactgaagccgttaaacctt

SEQ ID NO: 8758348 - DNA, 22 bp, Homo sapiens
aacactgaagaccaggtaattt

SEQ ID NO: 8758349 - DNA, 22 bp, Homo sapiens
aacactgaagccgttaaacctt

SEQ ID NO: 8758350 - DNA, 22 bp, Homo sapiens
aacactgacgacgtgaactaaa

SEQ ID NO: 8758351 - DNA, 22 bp, Homo sapiens
aacactgacctctaccctcagt

SEQ ID NO: 8758352 - DNA, 22 bp, Homo sapiens
aacactgaagtagtgaatactg

SEQ ID NO: 8758353 - DNA, 22 bp, Homo sapiens
aacactgaagtagtgaatactg

SEQ ID NO: 8758354 - DNA, 22 bp, Homo sapiens
aacactgaagtagtgaatactg

SEQ ID NO: 8758355 - DNA, 22 bp, Homo sapiens
aacactgaagtagtgaatactg

SEQ ID NO: 8758356 - DNA, 22 bp, Homo sapiens
aacactgacctctaccctcagt

SEQ ID NO: 8758357 - DNA, 22 bp, Homo sapiens
aacactgacgacgtgaactaaa

SEQ ID NO: 8758358 - DNA, 22 bp, Homo sapiens
aacactgagaacaatacagagt

SEQ ID NO: 8758359 - DNA, 22 bp, Homo sapiens
aacactgagaacaatacagagt

SEQ ID NO: 8758360 - DNA, 22 bp, Homo sapiens
aacactgagaacaatacagagt

SEQ ID NO: 8758361 - DNA, 22 bp, Homo sapiens
aacactgagaacaatacagagt

SEQ ID NO: 8758362 - DNA, 22 bp, Homo sapiens
aacactgagaggggagtggcac

SEQ ID NO: 8758363 - DNA, 22 bp, Homo sapiens
aacactgagctattacggtgga

SEQ ID NO: 8758364 - DNA, 20 bp, Homo sapiens
aacactgaggcctactcttc

SEQ ID NO: 8758365 - DNA, 22 bp, Homo sapiens
aacactgagaactgttggtggt

SEQ ID NO: 8758366 - DNA, 22 bp, Homo sapiens
aacactgagaggggagtggcac

SEQ ID NO: 8758367 - DNA, 22 bp, Homo sapiens
aacactgagaggggagtggcac

SEQ ID NO: 8758368 - DNA, 22 bp, Homo sapiens
aaggtatatgtacaatagacat

SEQ ID NO: 8758369 - DNA, 22 bp, Homo sapiens
aaggtatagcttgcatacagaa

SEQ ID NO: 8758370 - DNA, 22 bp, Homo sapiens
aacttagacttgtttcttggta

SEQ ID NO: 8758371 - DNA, 22 bp, Homo sapiens
aacttaggaaaataaggcatga

SEQ ID NO: 8758372 - DNA, 22 bp, Homo sapiens
aacttaggaaaataaggcatga

SEQ ID NO: 8758373 - DNA, 22 bp, Homo sapiens
aacttagagctctcctaaatga

SEQ ID NO: 8758374 - DNA, 22 bp, Homo sapiens
aacttaggaaaataaggcatga

SEQ ID NO: 8758375 - DNA, 22 bp, Homo sapiens
aacttaggaaaataaggcatga

SEQ ID NO: 8758376 - DNA, 22 bp, Homo sapiens
aacttagtctttcaatttgata

SEQ ID NO: 8758377 - DNA, 22 bp, Homo sapiens
aacttagtacccaggcgttcgg

SEQ ID NO: 8758378 - DNA, 22 bp, Homo sapiens
aacttagtacccaggcgttcgg

SEQ ID NO: 8758379 - DNA, 22 bp, Homo sapiens
aacttagtgagccactcttgca

SEQ ID NO: 8758380 - DNA, 22 bp, Homo sapiens
aacttagtgtaatgcagtacag

SEQ ID NO: 8758381 - DNA, 23 bp, Homo sapiens
aacttaatactgggataagatgc

SEQ ID NO: 8758382 - DNA, 22 bp, Homo sapiens
aacttaaacaagctcccaagtt

SEQ ID NO: 8758383 - DNA, 22 bp, Homo sapiens
aactgtttttcacgtgtctcat

SEQ ID NO: 8758384 - DNA, 22 bp, Homo sapiens
aactgttttttactagaggact

SEQ ID NO: 8758385 - DNA, 22 bp, Homo sapiens
aacttaaacccactcatgtaga

SEQ ID NO: 8758386 - DNA, 22 bp, Homo sapiens
aacttaaacccactcatgtaga

SEQ ID NO: 8758387 - DNA, 23 bp, Homo sapiens
aacttaatactgggataagatgc

SEQ ID NO: 8758388 - DNA, 22 bp, Homo sapiens
aactgtttggaactcttccaca

SEQ ID NO: 8758389 - DNA, 22 bp, Homo sapiens
aactgtttggaactcttccaca

SEQ ID NO: 8758390 - DNA, 22 bp, Homo sapiens
aactgtttcagaaatattgttg

SEQ ID NO: 8758391 - DNA, 22 bp, Homo sapiens
aactgtttatgtaagtatgcag

SEQ ID NO: 8758392 - DNA, 22 bp, Homo sapiens
aactgttgcttgtaatatgtgc

SEQ ID NO: 8758393 - DNA, 22 bp, Homo sapiens
aactgttgcttgtaatatgtgc

SEQ ID NO: 8758394 - DNA, 22 bp, Homo sapiens
aactgttgtcatatggtcttaa

SEQ ID NO: 8758395 - DNA, 18 bp, Homo sapiens
aactgttgaaatagcttg

SEQ ID NO: 8758396 - DNA, 18 bp, Homo sapiens
aactgttgaaatagcttg

SEQ ID NO: 8758397 - DNA, 22 bp, Homo sapiens
aactgttacatagttatagatc

SEQ ID NO: 8758398 - DNA, 19 bp, Homo sapiens
aactgtaaagatctgtagc

SEQ ID NO: 8758399 - DNA, 22 bp, Homo sapiens
aactgttacatagttatagatc

SEQ ID NO: 8758400 - DNA, 23 bp, Homo sapiens
aactggttgaaggctgttaattg

SEQ ID NO: 8758401 - DNA, 22 bp, Homo sapiens
aatgatatttattgaatagatg

SEQ ID NO: 8758402 - DNA, 22 bp, Homo sapiens
aatgatatttattgaatagatg

SEQ ID NO: 8758403 - DNA, 20 bp, Homo sapiens
aatgatcagcatagcaagga

SEQ ID NO: 8758404 - DNA, 20 bp, Homo sapiens
aatgatcagcatagcaagga

SEQ ID NO: 8758405 - DNA, 22 bp, Homo sapiens
aatgatcacctggtaaagagag

SEQ ID NO: 8758406 - DNA, 22 bp, Homo sapiens
aatgatcactgcagttgatgag

SEQ ID NO: 8758407 - DNA, 22 bp, Homo sapiens
aatgatcattataaagtgctct

SEQ ID NO: 8758408 - DNA, 22 bp, Homo sapiens
aatgatcattataaagtgctct

SEQ ID NO: 8758409 - DNA, 22 bp, Homo sapiens
aatgatcccatttagaaacaga

SEQ ID NO: 8758410 - DNA, 22 bp, Homo sapiens
aactgctgcatcttagaatgca

SEQ ID NO: 8758411 - DNA, 22 bp, Homo sapiens
aactgctcatttgagagtatgc

SEQ ID NO: 8758412 - DNA, 22 bp, Homo sapiens
aactgctgacaagtgaccagtg

SEQ ID NO: 8758413 - DNA, 22 bp, Homo sapiens
aactgcatttaacaaatactct

SEQ ID NO: 8758414 - DNA, 22 bp, Homo sapiens
aactgcatttgcataagtccat

SEQ ID NO: 8758415 - DNA, 22 bp, Homo sapiens
aatgatatagcagacatagcct

SEQ ID NO: 8758416 - DNA, 22 bp, Homo sapiens
aacgtccacgtcaggctctggg

SEQ ID NO: 8758417 - DNA, 22 bp, Homo sapiens
aacgtgcaccaggaggtcatga

SEQ ID NO: 8758418 - DNA, 22 bp, Homo sapiens
aacgtgcattaggacctctcca

SEQ ID NO: 8758419 - DNA, 22 bp, Homo sapiens
aactacaatatgtatgtatgta

SEQ ID NO: 8758420 - DNA, 22 bp, Homo sapiens
aatataaattcctgggcccagc

SEQ ID NO: 8758421 - DNA, 22 bp, Homo sapiens
aatataatgctgttttatgcca

SEQ ID NO: 8758422 - DNA, 22 bp, Homo sapiens
aatataatgctgttttatgcca

SEQ ID NO: 8758423 - DNA, 22 bp, Homo sapiens
aatataatgctgttttatgcca

SEQ ID NO: 8758424 - DNA, 22 bp, Homo sapiens
aactacatcaccctatttctgt

SEQ ID NO: 8758425 - DNA, 22 bp, Homo sapiens
aactacatagaaattagtattt

SEQ ID NO: 8758426 - DNA, 22 bp, Homo sapiens
aactacagtgggcagaggcaat

SEQ ID NO: 8758427 - DNA, 22 bp, Homo sapiens
aactacagtgggcagaggcaat

SEQ ID NO: 8758428 - DNA, 22 bp, Homo sapiens
aactacagtatgtccaaagaat

SEQ ID NO: 8758429 - DNA, 21 bp, Homo sapiens
aactacagttgttccttcatt

SEQ ID NO: 8758430 - DNA, 23 bp, Homo sapiens
aactaccacaactcttgagatgc

SEQ ID NO: 8758431 - DNA, 22 bp, Homo sapiens
aactacattttacagaagatga

SEQ ID NO: 8758432 - DNA, 22 bp, Homo sapiens
aactacagtagtttgcccttct

SEQ ID NO: 8758433 - DNA, 22 bp, Homo sapiens
aatcatgacaggaatagaaggg

SEQ ID NO: 8758434 - DNA, 22 bp, Homo sapiens
aatcatgtactgctgtggcttt

SEQ ID NO: 8758435 - DNA, 22 bp, Homo sapiens
aatcatgtccatcttaactttc

SEQ ID NO: 8758436 - DNA, 21 bp, Homo sapiens
aatcatacaaaacatgtcagg

SEQ ID NO: 8758437 - DNA, 22 bp, Homo sapiens
aatccaatcctactcagaaagt

SEQ ID NO: 8758438 - DNA, 22 bp, Homo sapiens
aatcattctcatgccagtttcc

SEQ ID NO: 8758439 - DNA, 22 bp, Homo sapiens
aatcattgctcctttctctggt

SEQ ID NO: 8758440 - DNA, 22 bp, Homo sapiens
aatcattgagacaaattagctt

SEQ ID NO: 8758441 - DNA, 22 bp, Homo sapiens
aatcattcttatttcacagcaa

SEQ ID NO: 8758442 - DNA, 22 bp, Homo sapiens
aatcattctcatgccagtttcc

SEQ ID NO: 8758443 - DNA, 22 bp, Homo sapiens
aatcatcttcatcttacacaga

SEQ ID NO: 8758444 - DNA, 22 bp, Homo sapiens
aactgaaacgtatttttgagat

SEQ ID NO: 8758445 - DNA, 22 bp, Homo sapiens
aatccacacatctggcatgtga

SEQ ID NO: 8758446 - DNA, 22 bp, Homo sapiens
aactgaaacttaggaagtaatc

SEQ ID NO: 8758447 - DNA, 22 bp, Homo sapiens
aactgaaacgtatttttgagat

SEQ ID NO: 8758448 - DNA, 22 bp, Homo sapiens
aactgcaagagtaaatgtctag

SEQ ID NO: 8758449 - DNA, 22 bp, Homo sapiens
aactgcaagagtaaatgtctag

SEQ ID NO: 8758450 - DNA, 22 bp, Homo sapiens
aactgcaacttcgtaaagtgag

SEQ ID NO: 8758451 - DNA, 22 bp, Homo sapiens
aactgcaacttgtttgattctt

SEQ ID NO: 8758452 - DNA, 22 bp, Homo sapiens
aactgcaacttgtttgattctt

SEQ ID NO: 8758453 - DNA, 22 bp, Homo sapiens
aactgcaagctctttactgcta

SEQ ID NO: 8758454 - DNA, 23 bp, Homo sapiens
aactgcaaggttgctgggaagta

SEQ ID NO: 8758455 - DNA, 22 bp, Homo sapiens
aactgcaagctctttactgcta

SEQ ID NO: 8758456 - DNA, 23 bp, Homo sapiens
aactgcaaggttgctgggaagta

SEQ ID NO: 8758457 - DNA, 22 bp, Homo sapiens
aactgcaagtggggcttgtcat

SEQ ID NO: 8758458 - DNA, 22 bp, Homo sapiens
aactgcaataacttgtgcacca

SEQ ID NO: 8758459 - DNA, 22 bp, Homo sapiens
aactgcaagtggggcttgtcat

SEQ ID NO: 8758460 - DNA, 22 bp, Homo sapiens
aactgcattgtactaaacttgt

SEQ ID NO: 8758461 - DNA, 22 bp, Homo sapiens
aactgcattagctaacgtgagt

SEQ ID NO: 8758462 - DNA, 22 bp, Homo sapiens
aactgcattcagaaagctcact

SEQ ID NO: 8758463 - DNA, 22 bp, Homo sapiens
aactgcattcagaaagctcact

SEQ ID NO: 8758464 - DNA, 22 bp, Homo sapiens
aactgcatgtgtgtggcatgat

SEQ ID NO: 8758465 - DNA, 22 bp, Homo sapiens
aactgcataatatatcatgcag

SEQ ID NO: 8758466 - DNA, 22 bp, Homo sapiens
aactgcatgtgtgtggcatgat

SEQ ID NO: 8758467 - DNA, 16 bp, Homo sapiens
aactgcatgagtgggt

SEQ ID NO: 8758468 - DNA, 22 bp, Homo sapiens
aactgcaataacttgtgcacca

SEQ ID NO: 8758469 - DNA, 22 bp, Homo sapiens
aactgcaatcacttttgcacca

SEQ ID NO: 8758470 - DNA, 22 bp, Homo sapiens
aactgcaattacttttgcacca

SEQ ID NO: 8758471 - DNA, 22 bp, Homo sapiens
aactgcaattacttttgcacta

SEQ ID NO: 8758472 - DNA, 22 bp, Homo sapiens
aactgcaattacttttgcgcca

SEQ ID NO: 8758473 - DNA, 22 bp, Homo sapiens
aactgcactgttcttttctaca

SEQ ID NO: 8758474 - DNA, 22 bp, Homo sapiens
aacatgcatgttatttatcagt

SEQ ID NO: 8758475 - DNA, 22 bp, Homo sapiens
aacatgcatgaagaagttatat

SEQ ID NO: 8758476 - DNA, 22 bp, Homo sapiens
aacatgcatgaagaagttatat

SEQ ID NO: 8758477 - DNA, 22 bp, Homo sapiens
aacatgcatgaagaagttatat

SEQ ID NO: 8758478 - DNA, 22 bp, Homo sapiens
aacatgcccgctgtatgccatt

SEQ ID NO: 8758479 - DNA, 22 bp, Homo sapiens
aacatgcccgctgtatgccatt

SEQ ID NO: 8758480 - DNA, 22 bp, Homo sapiens
aacatgctgggtgtttttgatg

SEQ ID NO: 8758481 - DNA, 22 bp, Homo sapiens
aacatgaaacccaaacagaata

SEQ ID NO: 8758482 - DNA, 22 bp, Homo sapiens
aacatgaaacccaaacagaata

SEQ ID NO: 8758483 - DNA, 22 bp, Homo sapiens
aacagtaaagacagaatttatc

SEQ ID NO: 8758484 - DNA, 22 bp, Homo sapiens
aacatgcagtgagccgatgagg

SEQ ID NO: 8758485 - DNA, 22 bp, Homo sapiens
aacagtaaaaatcatttagttg

SEQ ID NO: 8758486 - DNA, 22 bp, Homo sapiens
aacagtaaaaatcatttagttg

SEQ ID NO: 8758487 - DNA, 22 bp, Homo sapiens
aacaggtagggactctaacttg

SEQ ID NO: 8758488 - DNA, 22 bp, Homo sapiens
aacaggttgaggtcaaatgcaa

SEQ ID NO: 8758489 - DNA, 22 bp, Homo sapiens
aacagggctttggaagtctccg

SEQ ID NO: 8758490 - DNA, 22 bp, Homo sapiens
aacaggggattagatagcaggc

SEQ ID NO: 8758491 - DNA, 22 bp, Homo sapiens
aacaggggctggttgaaagagc

SEQ ID NO: 8758492 - DNA, 20 bp, Homo sapiens
aacagggggctgcagagggc

SEQ ID NO: 8758493 - DNA, 22 bp, Homo sapiens
aacaggctatttctttacaaac

SEQ ID NO: 8758494 - DNA, 22 bp, Homo sapiens
aacaggctcactctgacttcta

SEQ ID NO: 8758495 - DNA, 22 bp, Homo sapiens
aacaggctcactctgacttcta

SEQ ID NO: 8758496 - DNA, 22 bp, Homo sapiens
aacaggccttgtttttgttcat

SEQ ID NO: 8758497 - DNA, 22 bp, Homo sapiens
aacaggctaaattgtccatttc

SEQ ID NO: 8758498 - DNA, 22 bp, Homo sapiens
aacaggcagcagactgaatctg

SEQ ID NO: 8758499 - DNA, 22 bp, Homo sapiens
aacaggcagcagactgaatctg

SEQ ID NO: 8758500 - DNA, 22 bp, Homo sapiens
aacaggcagcagactgaatctg

SEQ ID NO: 8758501 - DNA, 22 bp, Homo sapiens
aacaggcaggagaattctgcct

SEQ ID NO: 8758502 - DNA, 15 bp, Homo sapiens
aacaggcatttatat

SEQ ID NO: 8758503 - DNA, 22 bp, Homo sapiens
aacaggctccatgaacaacgtg

SEQ ID NO: 8758504 - DNA, 22 bp, Homo sapiens
aacaggctccttgtgaatggat

SEQ ID NO: 8758505 - DNA, 22 bp, Homo sapiens
aacaggctcttcatttccagag

SEQ ID NO: 8758506 - DNA, 22 bp, Homo sapiens
aacaggctcttcatttccagag

SEQ ID NO: 8758507 - DNA, 22 bp, Homo sapiens
aacaggcttccaggagggacga

SEQ ID NO: 8758508 - DNA, 22 bp, Homo sapiens
aacaggctggccttgaagcagt

SEQ ID NO: 8758509 - DNA, 22 bp, Homo sapiens
aacaggcttcttctgggctcct

SEQ ID NO: 8758510 - DNA, 22 bp, Homo sapiens
aacaggaattgcaggcagatct

SEQ ID NO: 8758511 - DNA, 22 bp, Homo sapiens
aacaggaattgatgggagtcct

SEQ ID NO: 8758512 - DNA, 22 bp, Homo sapiens
aacaggacatttcagaagcagg

SEQ ID NO: 8758513 - DNA, 22 bp, Homo sapiens
aacaggaccccgcgtggtgtct

SEQ ID NO: 8758514 - DNA, 22 bp, Homo sapiens
aacaggacactgggatggctac

SEQ ID NO: 8758515 - DNA, 22 bp, Homo sapiens
aacaggaattgcaggcagatct

SEQ ID NO: 8758516 - DNA, 22 bp, Homo sapiens
aacaggagaggggaatgtagag

SEQ ID NO: 8758517 - DNA, 22 bp, Homo sapiens
aacaggcaaactgtgggatccc

SEQ ID NO: 8758518 - DNA, 22 bp, Homo sapiens
aacaggcaacagttgactctga

SEQ ID NO: 8758519 - DNA, 22 bp, Homo sapiens
aacaggcaacagttgactctga

SEQ ID NO: 8758520 - DNA, 22 bp, Homo sapiens
aacaggcaatttaggactcttt

SEQ ID NO: 8758521 - DNA, 22 bp, Homo sapiens
aacaggcaatttaggactcttt

SEQ ID NO: 8758522 - DNA, 22 bp, Homo sapiens
aacaggcactaagcatgtgggg

SEQ ID NO: 8758523 - DNA, 22 bp, Homo sapiens
aaccactggtctgaggtacaag

SEQ ID NO: 8758524 - DNA, 22 bp, Homo sapiens
aaccaccattctctcctcttcc

SEQ ID NO: 8758525 - DNA, 22 bp, Homo sapiens
aaccagaaggaatctgagctga

SEQ ID NO: 8758526 - DNA, 22 bp, Homo sapiens
aaccactggtctgaggtacaag

SEQ ID NO: 8758527 - DNA, 22 bp, Homo sapiens
aaccaccattctctcctcttcc

SEQ ID NO: 8758528 - DNA, 22 bp, Homo sapiens
aaccaccattctctcctcttcc

SEQ ID NO: 8758529 - DNA, 22 bp, Homo sapiens
aaccaccattctctcctcttcc

SEQ ID NO: 8758530 - DNA, 22 bp, Homo sapiens
aaccaccattctctcctcttcc

SEQ ID NO: 8758531 - DNA, 22 bp, Homo sapiens
aaccaccattctctcctcttcc

SEQ ID NO: 8758532 - DNA, 22 bp, Homo sapiens
aaccacagacccagactagaga

SEQ ID NO: 8758533 - DNA, 22 bp, Homo sapiens
aaccacagacccagactagaga

SEQ ID NO: 8758534 - DNA, 22 bp, Homo sapiens
aaccacagagccccctcagatg

SEQ ID NO: 8758535 - DNA, 22 bp, Homo sapiens
aaccacagacccagactagaga

SEQ ID NO: 8758536 - DNA, 22 bp, Homo sapiens
aaccacagacccagactagaga

SEQ ID NO: 8758537 - DNA, 22 bp, Homo sapiens
aaccacagagccccctcagatg

SEQ ID NO: 8758538 - DNA, 22 bp, Homo sapiens
aaccaagcccattactttactt

SEQ ID NO: 8758539 - DNA, 22 bp, Homo sapiens
aaccaacataggaatgcagaga

SEQ ID NO: 8758540 - DNA, 22 bp, Homo sapiens
aaccaagctcaatggtctgagt

SEQ ID NO: 8758541 - DNA, 22 bp, Homo sapiens
aatagttctagctcagaagctc

SEQ ID NO: 8758542 - DNA, 22 bp, Homo sapiens
aatataaattcctgggcccagc

SEQ ID NO: 8758543 - DNA, 22 bp, Homo sapiens
aatataaattcctgggcccagc

SEQ ID NO: 8758544 - DNA, 22 bp, Homo sapiens
aatagttttataggtgggatta

SEQ ID NO: 8758545 - DNA, 22 bp, Homo sapiens
aatagtgcttacattatcatga

SEQ ID NO: 8758546 - DNA, 22 bp, Homo sapiens
aatagtgtatttttcaaaatta

SEQ ID NO: 8758547 - DNA, 22 bp, Homo sapiens
aatagttaagcaactttttcca

SEQ ID NO: 8758548 - DNA, 22 bp, Homo sapiens
aatagttagcttagttctgtat

SEQ ID NO: 8758549 - DNA, 20 bp, Homo sapiens
aatagtgctatatattttgt

SEQ ID NO: 8758550 - DNA, 22 bp, Homo sapiens
aataagaaagagtcagcttcag

SEQ ID NO: 8758551 - DNA, 22 bp, Homo sapiens
aataagaaagagtcagcttcag

SEQ ID NO: 8758552 - DNA, 22 bp, Homo sapiens
aataagaaagagtcagcttcag

SEQ ID NO: 8758553 - DNA, 22 bp, Homo sapiens
aataagaactccatttactcgt

SEQ ID NO: 8758554 - DNA, 22 bp, Homo sapiens
aataagaacaactaaggtttat

SEQ ID NO: 8758555 - DNA, 22 bp, Homo sapiens
aataagaacaactaaggtttat

SEQ ID NO: 8758556 - DNA, 22 bp, Homo sapiens
aataagaacaactaaggtttat

SEQ ID NO: 8758557 - DNA, 22 bp, Homo sapiens
aacatttttaagaccaagtgct

SEQ ID NO: 8758558 - DNA, 22 bp, Homo sapiens
aacatttttaagaccaagtgct

SEQ ID NO: 8758559 - DNA, 22 bp, Homo sapiens
aacatgtaaatatcattgtact

SEQ ID NO: 8758560 - DNA, 19 bp, Homo sapiens
aacatggaactggagaggg

SEQ ID NO: 8758561 - DNA, 22 bp, Homo sapiens
aacatgtaaatatcattgtact

SEQ ID NO: 8758562 - DNA, 22 bp, Homo sapiens
aacatgtaaatatcattgtact

SEQ ID NO: 8758563 - DNA, 22 bp, Homo sapiens
aataacttcagttcttacatta

SEQ ID NO: 8758564 - DNA, 22 bp, Homo sapiens
aataacttcatcttcaggatag

SEQ ID NO: 8758565 - DNA, 22 bp, Homo sapiens
aataacttcatcttcaggatag

SEQ ID NO: 8758566 - DNA, 22 bp, Homo sapiens
aacatggctgcaatcctagagg

SEQ ID NO: 8758567 - DNA, 22 bp, Homo sapiens
aacatggaggcagacagacgtg

SEQ ID NO: 8758568 - DNA, 23 bp, Homo sapiens
aacatggagttgttcctttggcc

SEQ ID NO: 8758569 - DNA, 22 bp, Homo sapiens
aacatgctttgataaataaaag

SEQ ID NO: 8758570 - DNA, 22 bp, Homo sapiens
aataacttgaagatctcttcca

SEQ ID NO: 8758571 - DNA, 22 bp, Homo sapiens
aataacttgaagatctcttcca

SEQ ID NO: 8758572 - DNA, 22 bp, Homo sapiens
aataacttgaagatctcttcca

SEQ ID NO: 8758573 - DNA, 22 bp, Homo sapiens
aataacttcatgtaacatttaa

SEQ ID NO: 8758574 - DNA, 22 bp, Homo sapiens
aataacttgtatggttattcca

SEQ ID NO: 8758575 - DNA, 22 bp, Homo sapiens
aataacttgtatggttattcca

SEQ ID NO: 8758576 - DNA, 22 bp, Homo sapiens
aataacttgtatggttattcca

SEQ ID NO: 8758577 - DNA, 22 bp, Homo sapiens
aataacttttaaaagaccctgg

SEQ ID NO: 8758578 - DNA, 22 bp, Homo sapiens
aataacttttaaaagaccctgg

SEQ ID NO: 8758579 - DNA, 22 bp, Homo sapiens
aataacttcatgtaacatttaa

SEQ ID NO: 8758580 - DNA, 22 bp, Homo sapiens
aataacttcatgtaacatttaa

SEQ ID NO: 8758581 - DNA, 22 bp, Homo sapiens
aataacttcatcttcaggatag

SEQ ID NO: 8758582 - DNA, 22 bp, Homo sapiens
aataacttcatgtaacatttaa

SEQ ID NO: 8758583 - DNA, 22 bp, Homo sapiens
aataacttcatgtaacatttaa

SEQ ID NO: 8758584 - DNA, 22 bp, Homo sapiens
aagcatattttaattagccaca

SEQ ID NO: 8758585 - DNA, 22 bp, Homo sapiens
aagcatggtttctgacgtcatg

SEQ ID NO: 8758586 - DNA, 22 bp, Homo sapiens
aagcatgtacaatgagtgtctc

SEQ ID NO: 8758587 - DNA, 22 bp, Homo sapiens
aagcatgtacaatgagtgtctc

SEQ ID NO: 8758588 - DNA, 22 bp, Homo sapiens
aagcattgtaagcagaagatgc

SEQ ID NO: 8758589 - DNA, 22 bp, Homo sapiens
aagcattctgcattttcaaaga

SEQ ID NO: 8758590 - DNA, 23 bp, Homo sapiens
aagcattcgccttcaccctcctc

SEQ ID NO: 8758591 - DNA, 22 bp, Homo sapiens
aagcatttatagataagaattt

SEQ ID NO: 8758592 - DNA, 17 bp, Homo sapiens
aagcatttaatttgcta

SEQ ID NO: 8758593 - DNA, 17 bp, Homo sapiens
aagcatttaatttgcta

SEQ ID NO: 8758594 - DNA, 22 bp, Homo sapiens
aagcatttatagataagaattt

SEQ ID NO: 8758595 - DNA, 22 bp, Homo sapiens
aagcatttatagataagaattt

SEQ ID NO: 8758596 - DNA, 22 bp, Homo sapiens
aagcatttcaggtagagatatt

SEQ ID NO: 8758597 - DNA, 22 bp, Homo sapiens
aagcatttcaggtagagatatt

SEQ ID NO: 8758598 - DNA, 22 bp, Homo sapiens
aagcatttcaatataatattca

SEQ ID NO: 8758599 - DNA, 22 bp, Homo sapiens
aagcatttcaatataatattca

SEQ ID NO: 8758600 - DNA, 22 bp, Homo sapiens
aagcatttcaatataatattca

SEQ ID NO: 8758601 - DNA, 22 bp, Homo sapiens
aagcatttctgtttatctatcg

SEQ ID NO: 8758602 - DNA, 22 bp, Homo sapiens
aagcatttggcatgaaactctt

SEQ ID NO: 8758603 - DNA, 22 bp, Homo sapiens
aagcatttggcatgaaactctt

SEQ ID NO: 8758604 - DNA, 22 bp, Homo sapiens
acagcagctaaaggtgtctcct

SEQ ID NO: 8758605 - DNA, 22 bp, Homo sapiens
acagcagctaacccctgggcca

SEQ ID NO: 8758606 - DNA, 22 bp, Homo sapiens
acagcagctaacccctgggcca

SEQ ID NO: 8758607 - DNA, 22 bp, Homo sapiens
acagcagctaaaggtgtctcct

SEQ ID NO: 8758608 - DNA, 22 bp, Homo sapiens
aagcatttgtgaaattcagatg

SEQ ID NO: 8758609 - DNA, 22 bp, Homo sapiens
aagcatttggttctgaagactc

SEQ ID NO: 8758610 - DNA, 22 bp, Homo sapiens
aagcatttggcatgaaactctt

SEQ ID NO: 8758611 - DNA, 22 bp, Homo sapiens
aagccaggaagggagctgtccc

SEQ ID NO: 8758612 - DNA, 21 bp, Homo sapiens
aagccagcccacagtggtttg

SEQ ID NO: 8758613 - DNA, 22 bp, Homo sapiens
aagccaagttggaagactgaat

SEQ ID NO: 8758614 - DNA, 22 bp, Homo sapiens
aagccagctccagcatatcact

SEQ ID NO: 8758615 - DNA, 22 bp, Homo sapiens
aagccagcctgtttccttcttc

SEQ ID NO: 8758616 - DNA, 19 bp, Homo sapiens
aagccagctgccagctcgg

SEQ ID NO: 8758617 - DNA, 22 bp, Homo sapiens
aagccagctccagcatatcact

SEQ ID NO: 8758618 - DNA, 19 bp, Homo sapiens
aagccagctgccagctcgg

SEQ ID NO: 8758619 - DNA, 22 bp, Homo sapiens
acagcagcttcctgactgtact

SEQ ID NO: 8758620 - DNA, 22 bp, Homo sapiens
acagcagcttcctgactgtact

SEQ ID NO: 8758621 - DNA, 22 bp, Homo sapiens
acagcagcttgcgtgtctggtc

SEQ ID NO: 8758622 - DNA, 22 bp, Homo sapiens
acagcagcttgcgtgtctggtc

SEQ ID NO: 8758623 - DNA, 22 bp, Homo sapiens
acagcagcttgtctgttcttta

SEQ ID NO: 8758624 - DNA, 22 bp, Homo sapiens
acagcagctgccttcaggctct

SEQ ID NO: 8758625 - DNA, 22 bp, Homo sapiens
acagcagctaacccctgggcca

SEQ ID NO: 8758626 - DNA, 22 bp, Homo sapiens
acagcagctgccttcaggctct

SEQ ID NO: 8758627 - DNA, 22 bp, Homo sapiens
acagcagctgccttcaggctct

SEQ ID NO: 8758628 - DNA, 23 bp, Homo sapiens
acagacaacactgatgagagaaa

SEQ ID NO: 8758629 - DNA, 18 bp, Homo sapiens
acagacaaaatggaaatg

SEQ ID NO: 8758630 - DNA, 18 bp, Homo sapiens
acagacaaaatggaaatg

SEQ ID NO: 8758631 - DNA, 22 bp, Homo sapiens
aagcagagtccccttcccatgg

SEQ ID NO: 8758632 - DNA, 22 bp, Homo sapiens
aagcagagtccccttcccatgg

SEQ ID NO: 8758633 - DNA, 22 bp, Homo sapiens
aagcagagtgatataaacatgg

SEQ ID NO: 8758634 - DNA, 22 bp, Homo sapiens
aagcagcatgctatgctggtgg

SEQ ID NO: 8758635 - DNA, 22 bp, Homo sapiens
aagcagcatgctatgctggtgg

SEQ ID NO: 8758636 - DNA, 22 bp, Homo sapiens
aagcagcatgtgggttatcggg

SEQ ID NO: 8758637 - DNA, 22 bp, Homo sapiens
aagcagcatgattgtaatacta

SEQ ID NO: 8758638 - DNA, 22 bp, Homo sapiens
aagcagcattcagtgaaatgtg

SEQ ID NO: 8758639 - DNA, 22 bp, Homo sapiens
aagcagcattgtaaccaatgcc

SEQ ID NO: 8758640 - DNA, 22 bp, Homo sapiens
acagaatttacacatctctaaa

SEQ ID NO: 8758641 - DNA, 22 bp, Homo sapiens
acagaattgatggaaatctcag

SEQ ID NO: 8758642 - DNA, 22 bp, Homo sapiens
acagaatttacacatctctaaa

SEQ ID NO: 8758643 - DNA, 22 bp, Homo sapiens
acagaattatcaggaaatgtta

SEQ ID NO: 8758644 - DNA, 22 bp, Homo sapiens
acagaattatcaggaaatgtta

SEQ ID NO: 8758645 - DNA, 22 bp, Homo sapiens
acagaattctctctgcagaggc

SEQ ID NO: 8758646 - DNA, 22 bp, Homo sapiens
acagaattgatggaaatctcag

SEQ ID NO: 8758647 - DNA, 22 bp, Homo sapiens
acagaattgatggaaatctcag

SEQ ID NO: 8758648 - DNA, 22 bp, Homo sapiens
acagaattgaagctgagtaaat

SEQ ID NO: 8758649 - DNA, 22 bp, Homo sapiens
acagaattgaagctgagtaaat

SEQ ID NO: 8758650 - DNA, 22 bp, Homo sapiens
acagaattgaagctgagtaaat

SEQ ID NO: 8758651 - DNA, 22 bp, Homo sapiens
acagagtaggtgctcagtaaat

SEQ ID NO: 8758652 - DNA, 22 bp, Homo sapiens
acagagtaggtgctcagtaaat

SEQ ID NO: 8758653 - DNA, 21 bp, Homo sapiens
acagagtagttgaaacagaga

SEQ ID NO: 8758654 - DNA, 22 bp, Homo sapiens
acagagtaggtgctgtcgactg

SEQ ID NO: 8758655 - DNA, 22 bp, Homo sapiens
acagagtaggtgctgtcgactg

SEQ ID NO: 8758656 - DNA, 21 bp, Homo sapiens
acagagtagttgaaacagaga

SEQ ID NO: 8758657 - DNA, 22 bp, Homo sapiens
acagagtatctatcaggagtat

SEQ ID NO: 8758658 - DNA, 16 bp, Homo sapiens
acagagtatcaagcga

SEQ ID NO: 8758659 - DNA, 22 bp, Homo sapiens
acagagtattggaaaggcagtg

SEQ ID NO: 8758660 - DNA, 22 bp, Homo sapiens
acagagtaaatccaagaacgct

SEQ ID NO: 8758661 - DNA, 22 bp, Homo sapiens
acagagtacagacaaaggtcag

SEQ ID NO: 8758662 - DNA, 23 bp, Homo sapiens
acagagtacagtgtgcttagtgg

SEQ ID NO: 8758663 - DNA, 22 bp, Homo sapiens
acagagtacagacaaaggtcag

SEQ ID NO: 8758664 - DNA, 22 bp, Homo sapiens
acagagtagctcaagaagattg

SEQ ID NO: 8758665 - DNA, 22 bp, Homo sapiens
acagagtagcagcactgtgctt

SEQ ID NO: 8758666 - DNA, 20 bp, Homo sapiens
acagagtagaacatatgcca

SEQ ID NO: 8758667 - DNA, 22 bp, Homo sapiens
acagagtacattcagagactat

SEQ ID NO: 8758668 - DNA, 22 bp, Homo sapiens
aagcagctgatttcacagctca

SEQ ID NO: 8758669 - DNA, 22 bp, Homo sapiens
aagcagctgatttcacagctca

SEQ ID NO: 8758670 - DNA, 22 bp, Homo sapiens
aagcagctgaaggattcagggt

SEQ ID NO: 8758671 - DNA, 22 bp, Homo sapiens
aagcagctgaaggattcagggt

SEQ ID NO: 8758672 - DNA, 22 bp, Homo sapiens
acagaggtgtgtgtaggacagt

SEQ ID NO: 8758673 - DNA, 22 bp, Homo sapiens
acagaggttaggatgggttgta

SEQ ID NO: 8758674 - DNA, 22 bp, Homo sapiens
acagaggttaggatgggttgta

SEQ ID NO: 8758675 - DNA, 22 bp, Homo sapiens
acagaggttaggatgggttgta

SEQ ID NO: 8758676 - DNA, 22 bp, Homo sapiens
acacaggaactcaagctcgctt

SEQ ID NO: 8758677 - DNA, 22 bp, Homo sapiens
acacaggaaatggtttagtttt

SEQ ID NO: 8758678 - DNA, 22 bp, Homo sapiens
acacagggctgcgcctgacccc

SEQ ID NO: 8758679 - DNA, 22 bp, Homo sapiens
acacaggggaaagtggagctga

SEQ ID NO: 8758680 - DNA, 22 bp, Homo sapiens
acacagggctgcgcctgacccc

SEQ ID NO: 8758681 - DNA, 22 bp, Homo sapiens
acacagggggcattctaggagt

SEQ ID NO: 8758682 - DNA, 22 bp, Homo sapiens
acacagggtctagagttaggcc

SEQ ID NO: 8758683 - DNA, 22 bp, Homo sapiens
acacaggtacacatatgtacct

SEQ ID NO: 8758684 - DNA, 22 bp, Homo sapiens
acacaggtacacatatgtacct

SEQ ID NO: 8758685 - DNA, 22 bp, Homo sapiens
acacaggttaaaataattggga

SEQ ID NO: 8758686 - DNA, 22 bp, Homo sapiens
acacaggtaatggttttggaag

SEQ ID NO: 8758687 - DNA, 20 bp, Homo sapiens
acacagtagcaattagtgca

SEQ ID NO: 8758688 - DNA, 21 bp, Homo sapiens
acacagtaactgggcgcaggg

SEQ ID NO: 8758689 - DNA, 21 bp, Homo sapiens
acacagtaactgggcgcaggg

SEQ ID NO: 8758690 - DNA, 18 bp, Homo sapiens
acacaggttattctctcc

SEQ ID NO: 8758691 - DNA, 18 bp, Homo sapiens
acacaggttattctctcc

SEQ ID NO: 8758692 - DNA, 22 bp, Homo sapiens
acacaggttccatctccacctt

SEQ ID NO: 8758693 - DNA, 22 bp, Homo sapiens
acacagtaaatatgtattgaat

SEQ ID NO: 8758694 - DNA, 22 bp, Homo sapiens
aagatgttattgtcttccttgc

SEQ ID NO: 8758695 - DNA, 22 bp, Homo sapiens
aagaggcctggaggcagaggtg

SEQ ID NO: 8758696 - DNA, 22 bp, Homo sapiens
aagaggccccccagcaggtgaa

SEQ ID NO: 8758697 - DNA, 22 bp, Homo sapiens
aagatgttgcaagggactcttc

SEQ ID NO: 8758698 - DNA, 22 bp, Homo sapiens
aagatgttgactcctttgatgt

SEQ ID NO: 8758699 - DNA, 22 bp, Homo sapiens
aagatgttgactcctttgatgt

SEQ ID NO: 8758700 - DNA, 22 bp, Homo sapiens
aagatgttgactcctttgatgt

SEQ ID NO: 8758701 - DNA, 22 bp, Homo sapiens
aagatgttgactcctttgatgt

SEQ ID NO: 8758702 - DNA, 22 bp, Homo sapiens
aagatgttctattttcactttt

SEQ ID NO: 8758703 - DNA, 22 bp, Homo sapiens
aagatgttctattttcactttt

SEQ ID NO: 8758704 - DNA, 22 bp, Homo sapiens
aagatgttctattttcactttt

SEQ ID NO: 8758705 - DNA, 22 bp, Homo sapiens
aagattctgtatttctaacaat

SEQ ID NO: 8758706 - DNA, 22 bp, Homo sapiens
aagattcttacctatacccagt

SEQ ID NO: 8758707 - DNA, 22 bp, Homo sapiens
aagattgttttggatgctaact

SEQ ID NO: 8758708 - DNA, 22 bp, Homo sapiens
aagattgttttgggggaagtgg

SEQ ID NO: 8758709 - DNA, 22 bp, Homo sapiens
aagatttaccactttattcaag

SEQ ID NO: 8758710 - DNA, 22 bp, Homo sapiens
aagatttaccactttattcaag

SEQ ID NO: 8758711 - DNA, 22 bp, Homo sapiens
aagatttaccactttattcaag

SEQ ID NO: 8758712 - DNA, 22 bp, Homo sapiens
aagatttaccactttattcaag

SEQ ID NO: 8758713 - DNA, 22 bp, Homo sapiens
aagatttaccactttattcaag

SEQ ID NO: 8758714 - DNA, 22 bp, Homo sapiens
aagatttactttctttgtaata

SEQ ID NO: 8758715 - DNA, 22 bp, Homo sapiens
aagatttactagcataatagct

SEQ ID NO: 8758716 - DNA, 22 bp, Homo sapiens
aagatttactagcataatagct

SEQ ID NO: 8758717 - DNA, 22 bp, Homo sapiens
aagatttactagcataatagct

SEQ ID NO: 8758718 - DNA, 22 bp, Homo sapiens
aagatttactagcataatagct

SEQ ID NO: 8758719 - DNA, 22 bp, Homo sapiens
aagatttactagcataatagct

SEQ ID NO: 8758720 - DNA, 22 bp, Homo sapiens
aagatttactagcataatagct

SEQ ID NO: 8758721 - DNA, 22 bp, Homo sapiens
aagatttactagcataatagct

SEQ ID NO: 8758722 - DNA, 22 bp, Homo sapiens
aagatttactttctttgtaata

SEQ ID NO: 8758723 - DNA, 22 bp, Homo sapiens
aagatttactttctttgtaata

SEQ ID NO: 8758724 - DNA, 22 bp, Homo sapiens
aagatttactttctttgtaata

SEQ ID NO: 8758725 - DNA, 21 bp, Homo sapiens
aagatttatgggacttgccaa

SEQ ID NO: 8758726 - DNA, 22 bp, Homo sapiens
aagatttagggccagtttacat

SEQ ID NO: 8758727 - DNA, 22 bp, Homo sapiens
aagatttagggccagtttacat

SEQ ID NO: 8758728 - DNA, 18 bp, Homo sapiens
acactgcagcagtctgct

SEQ ID NO: 8758729 - DNA, 22 bp, Homo sapiens
aagatttattagatgcttacct

SEQ ID NO: 8758730 - DNA, 22 bp, Homo sapiens
aagatttattagatgcttacct

SEQ ID NO: 8758731 - DNA, 22 bp, Homo sapiens
acactggatgaagcaagctaaa

SEQ ID NO: 8758732 - DNA, 22 bp, Homo sapiens
acactggagggtccagggatgt

SEQ ID NO: 8758733 - DNA, 22 bp, Homo sapiens
acactggaggagagctgttgct

SEQ ID NO: 8758734 - DNA, 22 bp, Homo sapiens
acactggactcagaggccagaa

SEQ ID NO: 8758735 - DNA, 22 bp, Homo sapiens
acactgcttctctggcagagcc

SEQ ID NO: 8758736 - DNA, 22 bp, Homo sapiens
acactgctcacttcttcccttg

SEQ ID NO: 8758737 - DNA, 21 bp, Homo sapiens
acactgcaggtgaagtgcact

SEQ ID NO: 8758738 - DNA, 21 bp, Homo sapiens
acactgcaggtgaagtgcact

SEQ ID NO: 8758739 - DNA, 22 bp, Homo sapiens
aagcacagtaaaagcagatttt

SEQ ID NO: 8758740 - DNA, 22 bp, Homo sapiens
aagcacagtaaaagcagatttt

SEQ ID NO: 8758741 - DNA, 22 bp, Homo sapiens
aagcacagtaaaagcagatttt

SEQ ID NO: 8758742 - DNA, 22 bp, Homo sapiens
aagcacagtaaaagcagatttt

SEQ ID NO: 8758743 - DNA, 22 bp, Homo sapiens
aagcacagtgccaagttctatt

SEQ ID NO: 8758744 - DNA, 22 bp, Homo sapiens
aagcacagtgccaagttctatt

SEQ ID NO: 8758745 - DNA, 22 bp, Homo sapiens
aagcacagtaaaagcagatttt

SEQ ID NO: 8758746 - DNA, 22 bp, Homo sapiens
aagcacagtgccaagttctatt

SEQ ID NO: 8758747 - DNA, 22 bp, Homo sapiens
aagcacagtgggcagagcagcc

SEQ ID NO: 8758748 - DNA, 22 bp, Homo sapiens
aagcacagtgggcagagcagcc

SEQ ID NO: 8758749 - DNA, 22 bp, Homo sapiens
aagcacagtgggcagagcagcc

SEQ ID NO: 8758750 - DNA, 22 bp, Homo sapiens
aagcacagtgggcagagcagcc

SEQ ID NO: 8758751 - DNA, 22 bp, Homo sapiens
aagcacagtgggcagagcagcc

SEQ ID NO: 8758752 - DNA, 22 bp, Homo sapiens
aagcacagtgccaagttctatt

SEQ ID NO: 8758753 - DNA, 22 bp, Homo sapiens
aagcacagggactcaggaccgg

SEQ ID NO: 8758754 - DNA, 22 bp, Homo sapiens
aagcacagggactttaggaata

SEQ ID NO: 8758755 - DNA, 22 bp, Homo sapiens
aagcacaggggaaataagttgt

SEQ ID NO: 8758756 - DNA, 22 bp, Homo sapiens
aagcacagggtgtctgcattca

SEQ ID NO: 8758757 - DNA, 22 bp, Homo sapiens
aagcacaggttgaggattattc

SEQ ID NO: 8758758 - DNA, 22 bp, Homo sapiens
aagcacaggttgaggattattc

SEQ ID NO: 8758759 - DNA, 18 bp, Homo sapiens
aagcacaggtgtttcagg

SEQ ID NO: 8758760 - DNA, 22 bp, Homo sapiens
aagcacaggttgaggattattc

SEQ ID NO: 8758761 - DNA, 18 bp, Homo sapiens
aagcacaggtgtttcagg

SEQ ID NO: 8758762 - DNA, 18 bp, Homo sapiens
aagcacaggtgtttcagg

SEQ ID NO: 8758763 - DNA, 18 bp, Homo sapiens
aagcacaggtgtttcagg

SEQ ID NO: 8758764 - DNA, 22 bp, Homo sapiens
aagcacaggagacgcacagcca

SEQ ID NO: 8758765 - DNA, 22 bp, Homo sapiens
aagcacaggagacgcacagcca

SEQ ID NO: 8758766 - DNA, 22 bp, Homo sapiens
aagcacaggagacgcacagcca

SEQ ID NO: 8758767 - DNA, 22 bp, Homo sapiens
aagcacaggagacgcacagcca

SEQ ID NO: 8758768 - DNA, 22 bp, Homo sapiens
aagcacaggagacgcacagcca

SEQ ID NO: 8758769 - DNA, 22 bp, Homo sapiens
aagcacaggagacgcacagcca

SEQ ID NO: 8758770 - DNA, 22 bp, Homo sapiens
aagcacaggatcttgaggagcg

SEQ ID NO: 8758771 - DNA, 22 bp, Homo sapiens
aagcacaggatcttgaggagcg

SEQ ID NO: 8758772 - DNA, 22 bp, Homo sapiens
aagcacaggatcttgaggagcg

SEQ ID NO: 8758773 - DNA, 22 bp, Homo sapiens
aagcacaggatcttgaggagcg

SEQ ID NO: 8758774 - DNA, 22 bp, Homo sapiens
aagcacacttggctctgtgtac

SEQ ID NO: 8758775 - DNA, 22 bp, Homo sapiens
aagcacacttggctctgtgtac

SEQ ID NO: 8758776 - DNA, 22 bp, Homo sapiens
aagcacagaaaaggagcatgga

SEQ ID NO: 8758777 - DNA, 22 bp, Homo sapiens
aagcacagaaaaggagcatgga

SEQ ID NO: 8758778 - DNA, 22 bp, Homo sapiens
aagaaatcagaaaagcattcgt

SEQ ID NO: 8758779 - DNA, 22 bp, Homo sapiens
aagaaatcagaaaagcattcgt

SEQ ID NO: 8758780 - DNA, 22 bp, Homo sapiens
aagaaatcatatcatttcttgg

SEQ ID NO: 8758781 - DNA, 22 bp, Homo sapiens
aagaaatcatatcatttcttgg

SEQ ID NO: 8758782 - DNA, 22 bp, Homo sapiens
aagaaatacatggtttttgagt

SEQ ID NO: 8758783 - DNA, 22 bp, Homo sapiens
aagaaatattgggccttataaa

SEQ ID NO: 8758784 - DNA, 22 bp, Homo sapiens
aagaaatattgggccttataaa

SEQ ID NO: 8758785 - DNA, 22 bp, Homo sapiens
aagaaatattgggccttataaa

SEQ ID NO: 8758786 - DNA, 22 bp, Homo sapiens
aagaaatattgggccttataaa

SEQ ID NO: 8758787 - DNA, 22 bp, Homo sapiens
aagaaatacatggtttttgagt

SEQ ID NO: 8758788 - DNA, 22 bp, Homo sapiens
aagaaagcattagacaggcatt

SEQ ID NO: 8758789 - DNA, 22 bp, Homo sapiens
aacttcatgtaatttaaaacag

SEQ ID NO: 8758790 - DNA, 21 bp, Homo sapiens
aagaaagataattaaggaccc

SEQ ID NO: 8758791 - DNA, 21 bp, Homo sapiens
aagaaagataattaaggaccc

SEQ ID NO: 8758792 - DNA, 21 bp, Homo sapiens
aagaaagataattaaggaccc

SEQ ID NO: 8758793 - DNA, 21 bp, Homo sapiens
aagaaagataattaaggaccc

SEQ ID NO: 8758794 - DNA, 22 bp, Homo sapiens
aacttcagggggcacattcaag

SEQ ID NO: 8758795 - DNA, 22 bp, Homo sapiens
aacttcagggacagaaaagagc

SEQ ID NO: 8758796 - DNA, 22 bp, Homo sapiens
aacttcagttgagaaaggcatg

SEQ ID NO: 8758797 - DNA, 22 bp, Homo sapiens
aacttcatgggttcaaagctgg

SEQ ID NO: 8758798 - DNA, 22 bp, Homo sapiens
aacttagttaagattaagtctc

SEQ ID NO: 8758799 - DNA, 22 bp, Homo sapiens
aacttagttcaatatcagtgct

SEQ ID NO: 8758800 - DNA, 22 bp, Homo sapiens
aacttatacccagggcagaaat

SEQ ID NO: 8758801 - DNA, 22 bp, Homo sapiens
aacttattccataggctcactg

SEQ ID NO: 8758802 - DNA, 22 bp, Homo sapiens
aacttcacctttttgccacact

SEQ ID NO: 8758803 - DNA, 22 bp, Homo sapiens
aacttcaaatgtgactttgcat

SEQ ID NO: 8758804 - DNA, 22 bp, Homo sapiens
aacttcacctttttgccacact

SEQ ID NO: 8758805 - DNA, 22 bp, Homo sapiens
aacttcagagctgtgtggtttg

SEQ ID NO: 8758806 - DNA, 22 bp, Homo sapiens
aacttattgaacattctcgaat

SEQ ID NO: 8758807 - DNA, 22 bp, Homo sapiens
aacttattgaacattctcgaat

SEQ ID NO: 8758808 - DNA, 22 bp, Homo sapiens
aatgttttcattatcctaactg

SEQ ID NO: 8758809 - DNA, 22 bp, Homo sapiens
aatgttttcattatcctaactg

SEQ ID NO: 8758810 - DNA, 22 bp, Homo sapiens
aatgttttctctgtgaacacat

SEQ ID NO: 8758811 - DNA, 22 bp, Homo sapiens
aatgttttgcattagttttcta

SEQ ID NO: 8758812 - DNA, 22 bp, Homo sapiens
aatgttttgcattagttttcta

SEQ ID NO: 8758813 - DNA, 22 bp, Homo sapiens
aatgttttgcattagttttcta

SEQ ID NO: 8758814 - DNA, 22 bp, Homo sapiens
aagaagcactttcctacatgtt

SEQ ID NO: 8758815 - DNA, 22 bp, Homo sapiens
aagaagcactttcctacatgtt

SEQ ID NO: 8758816 - DNA, 22 bp, Homo sapiens
aagaaatgctgatgttggatgg

SEQ ID NO: 8758817 - DNA, 22 bp, Homo sapiens
aagaaatgcacacaactgctgg

SEQ ID NO: 8758818 - DNA, 22 bp, Homo sapiens
aatgttttacagatcccattag

SEQ ID NO: 8758819 - DNA, 22 bp, Homo sapiens
aatgttttacagatcccattag

SEQ ID NO: 8758820 - DNA, 22 bp, Homo sapiens
aatgttttaaaagagattgaga

SEQ ID NO: 8758821 - DNA, 22 bp, Homo sapiens
aatgttttagattactgctggg

SEQ ID NO: 8758822 - DNA, 22 bp, Homo sapiens
aatgttttacagatcccattag

SEQ ID NO: 8758823 - DNA, 22 bp, Homo sapiens
aatgttttagattactgctggg

SEQ ID NO: 8758824 - DNA, 22 bp, Homo sapiens
aatgttttagattactgctggg

SEQ ID NO: 8758825 - DNA, 22 bp, Homo sapiens
aagaataagaggatttagaaca

SEQ ID NO: 8758826 - DNA, 22 bp, Homo sapiens
aagaataagaggatttagaaca

SEQ ID NO: 8758827 - DNA, 22 bp, Homo sapiens
aagaataagaggatttagaaca

SEQ ID NO: 8758828 - DNA, 22 bp, Homo sapiens
aagaataagtagatgggagaag

SEQ ID NO: 8758829 - DNA, 22 bp, Homo sapiens
aagaatacgtatcaacaatggt

SEQ ID NO: 8758830 - DNA, 22 bp, Homo sapiens
aagaatacgtatcaacaatggt

SEQ ID NO: 8758831 - DNA, 22 bp, Homo sapiens
aagaatacgtatcaacaatggt

SEQ ID NO: 8758832 - DNA, 22 bp, Homo sapiens
aagaatacgtatcaacaatggt

SEQ ID NO: 8758833 - DNA, 22 bp, Homo sapiens
aattggaaaatgctacatatca

SEQ ID NO: 8758834 - DNA, 22 bp, Homo sapiens
aattggactgtgctgctcaaaa

SEQ ID NO: 8758835 - DNA, 23 bp, Homo sapiens
aattggacttgctgtcaaacttc

SEQ ID NO: 8758836 - DNA, 22 bp, Homo sapiens
aattggcaagcaagttatccag

SEQ ID NO: 8758837 - DNA, 22 bp, Homo sapiens
aagaatacttcgtaagtaggat

SEQ ID NO: 8758838 - DNA, 22 bp, Homo sapiens
aattggcagtttcatcagacag

SEQ ID NO: 8758839 - DNA, 22 bp, Homo sapiens
aattggcagtttcatcagacag

SEQ ID NO: 8758840 - DNA, 22 bp, Homo sapiens
aattggcatagcatacaattca

SEQ ID NO: 8758841 - DNA, 22 bp, Homo sapiens
aattggtttgagttgtctctat

SEQ ID NO: 8758842 - DNA, 22 bp, Homo sapiens
aagaataacacttaggttttgc

SEQ ID NO: 8758843 - DNA, 22 bp, Homo sapiens
aagaataagaggatttagaaca

SEQ ID NO: 8758844 - DNA, 22 bp, Homo sapiens
aagaataacacttaggttttgc

SEQ ID NO: 8758845 - DNA, 22 bp, Homo sapiens
aagaataaattaagatacttag

SEQ ID NO: 8758846 - DNA, 22 bp, Homo sapiens
aagaataaattaagatacttag

SEQ ID NO: 8758847 - DNA, 22 bp, Homo sapiens
aagaataaattaagatacttag

SEQ ID NO: 8758848 - DNA, 18 bp, Homo sapiens
aagaagttggccaaagag

SEQ ID NO: 8758849 - DNA, 22 bp, Homo sapiens
aagaagcagagctgtgggtgtt

SEQ ID NO: 8758850 - DNA, 23 bp, Homo sapiens
aagaataaatgacattaaaggtg

SEQ ID NO: 8758851 - DNA, 23 bp, Homo sapiens
aagaataaatgacattaaaggtg

SEQ ID NO: 8758852 - DNA, 21 bp, Homo sapiens
aagaagtttggattttgtcct

SEQ ID NO: 8758853 - DNA, 23 bp, Homo sapiens
aagaataaatgacattaaaggtg

SEQ ID NO: 8758854 - DNA, 22 bp, Homo sapiens
aagacagtgtgtcaggcaggtg

SEQ ID NO: 8758855 - DNA, 22 bp, Homo sapiens
aagacaggaacatagcaaatcc

SEQ ID NO: 8758856 - DNA, 22 bp, Homo sapiens
aagacagtgacagtcacaattg

SEQ ID NO: 8758857 - DNA, 22 bp, Homo sapiens
aagacagtgacagtcacaattg

SEQ ID NO: 8758858 - DNA, 22 bp, Homo sapiens
aagacaggaaaagctccaggcc

SEQ ID NO: 8758859 - DNA, 20 bp, Homo sapiens
aagacaccagtggcagcccc

SEQ ID NO: 8758860 - DNA, 20 bp, Homo sapiens
aagacaccagtggcagcccc

SEQ ID NO: 8758861 - DNA, 20 bp, Homo sapiens
aagacaccagtggcagcccc

SEQ ID NO: 8758862 - DNA, 20 bp, Homo sapiens
aagacaccagtggcagcccc

SEQ ID NO: 8758863 - DNA, 22 bp, Homo sapiens
aagacagcagcacctctcgttt

SEQ ID NO: 8758864 - DNA, 22 bp, Homo sapiens
aagacagcattgctgagggctt

SEQ ID NO: 8758865 - DNA, 22 bp, Homo sapiens
aagacagccagctccatgggat

SEQ ID NO: 8758866 - DNA, 22 bp, Homo sapiens
aagacagcctttccctggtgcc

SEQ ID NO: 8758867 - DNA, 22 bp, Homo sapiens
aattgtgcccgtgacatttcat

SEQ ID NO: 8758868 - DNA, 22 bp, Homo sapiens
aattgtgcatttttaaatcacg

SEQ ID NO: 8758869 - DNA, 22 bp, Homo sapiens
aattgtcttggtgcaatcatga

SEQ ID NO: 8758870 - DNA, 22 bp, Homo sapiens
aattgtcaaacacaaataagag

SEQ ID NO: 8758871 - DNA, 22 bp, Homo sapiens
aattgtcaaaaattgcaattgt

SEQ ID NO: 8758872 - DNA, 17 bp, Homo sapiens
aattgtcagcagtagct

SEQ ID NO: 8758873 - DNA, 17 bp, Homo sapiens
aattgtcagcagtagct

SEQ ID NO: 8758874 - DNA, 17 bp, Homo sapiens
aattgtcagcagtagct

SEQ ID NO: 8758875 - DNA, 22 bp, Homo sapiens
aattgtcttgaaagcaacactt

SEQ ID NO: 8758876 - DNA, 22 bp, Homo sapiens
aattgtctttatcacagttcaa

SEQ ID NO: 8758877 - DNA, 22 bp, Homo sapiens
aattgtcttctccttcctggca

SEQ ID NO: 8758878 - DNA, 22 bp, Homo sapiens
aattgtcatgtttggtagataa

SEQ ID NO: 8758879 - DNA, 22 bp, Homo sapiens
aattgtcttgaaagcaacactt

SEQ ID NO: 8758880 - DNA, 22 bp, Homo sapiens
aattgtacaagccttgtgccat

SEQ ID NO: 8758881 - DNA, 22 bp, Homo sapiens
aattgtacaggaagttgctgga

SEQ ID NO: 8758882 - DNA, 22 bp, Homo sapiens
aattgtacaagccttgtgccat

SEQ ID NO: 8758883 - DNA, 22 bp, Homo sapiens
aattgtacaggaagttgctgga

SEQ ID NO: 8758884 - DNA, 22 bp, Homo sapiens
aattgtacatatttatgagcga

SEQ ID NO: 8758885 - DNA, 22 bp, Homo sapiens
aattgtacataaaccatttggc

SEQ ID NO: 8758886 - DNA, 22 bp, Homo sapiens
aattgtacataaaccatttggc

SEQ ID NO: 8758887 - DNA, 22 bp, Homo sapiens
aagacatgactgcacagccaaa

SEQ ID NO: 8758888 - DNA, 22 bp, Homo sapiens
aagacatgactgcacagccaaa

SEQ ID NO: 8758889 - DNA, 22 bp, Homo sapiens
aagacattactggaatctgact

SEQ ID NO: 8758890 - DNA, 22 bp, Homo sapiens
aagacatgttttaagaatattt

SEQ ID NO: 8758891 - DNA, 22 bp, Homo sapiens
aagacatgcagtttgttccatt

SEQ ID NO: 8758892 - DNA, 22 bp, Homo sapiens
aagacagtgtgtcaggcaggtg

SEQ ID NO: 8758893 - DNA, 22 bp, Homo sapiens
aagacagtgatctctgagagat

SEQ ID NO: 8758894 - DNA, 22 bp, Homo sapiens
aagacatacagacagtgagcca

SEQ ID NO: 8758895 - DNA, 22 bp, Homo sapiens
aagacatcagtgatgacatttg

SEQ ID NO: 8758896 - DNA, 22 bp, Homo sapiens
acaaagagggaccagtgacttg

SEQ ID NO: 8758897 - DNA, 22 bp, Homo sapiens
acaaagagggaccagtgacttg

SEQ ID NO: 8758898 - DNA, 22 bp, Homo sapiens
acaaagagaccatgagccaaac

SEQ ID NO: 8758899 - DNA, 22 bp, Homo sapiens
aagacattactggaatctgact

SEQ ID NO: 8758900 - DNA, 22 bp, Homo sapiens
aagacattactggaatctgact

SEQ ID NO: 8758901 - DNA, 22 bp, Homo sapiens
aagacattactggaatctgact

SEQ ID NO: 8758902 - DNA, 22 bp, Homo sapiens
aagacattactggaatctgact

SEQ ID NO: 8758903 - DNA, 20 bp, Homo sapiens
acaaagactggaaaagcaag

SEQ ID NO: 8758904 - DNA, 22 bp, Homo sapiens
aagacagtgatctctgagagat

SEQ ID NO: 8758905 - DNA, 20 bp, Homo sapiens
acaaagactggaaaagcaag

SEQ ID NO: 8758906 - DNA, 22 bp, Homo sapiens
acaaagcacgagtgccatggac

SEQ ID NO: 8758907 - DNA, 22 bp, Homo sapiens
aagagagaacacagcttgggca

SEQ ID NO: 8758908 - DNA, 22 bp, Homo sapiens
aagagagaacacagcttgggca

SEQ ID NO: 8758909 - DNA, 22 bp, Homo sapiens
acaaagattcatttgcattatt

SEQ ID NO: 8758910 - DNA, 22 bp, Homo sapiens
acaaagattcatttgcattatt

SEQ ID NO: 8758911 - DNA, 22 bp, Homo sapiens
acaaagattcatttgcattatt

SEQ ID NO: 8758912 - DNA, 22 bp, Homo sapiens
acaaagattcatttgcattatt

SEQ ID NO: 8758913 - DNA, 22 bp, Homo sapiens
acaaagatgtttaaagcattta

SEQ ID NO: 8758914 - DNA, 22 bp, Homo sapiens
acaaagatgtttaaagcattta

SEQ ID NO: 8758915 - DNA, 22 bp, Homo sapiens
acaaagatgtttaaagcattta

SEQ ID NO: 8758916 - DNA, 22 bp, Homo sapiens
acaaagatgtttaaagcattta

SEQ ID NO: 8758917 - DNA, 22 bp, Homo sapiens
acaaagataagtcagaaagtca

SEQ ID NO: 8758918 - DNA, 22 bp, Homo sapiens
acaaagataagtcagaaagtca

SEQ ID NO: 8758919 - DNA, 22 bp, Homo sapiens
acaaagataagtcagaaagtca

SEQ ID NO: 8758920 - DNA, 22 bp, Homo sapiens
acaaagataagtcagaaagtca

SEQ ID NO: 8758921 - DNA, 22 bp, Homo sapiens
acaaagatcttgctttcctact

SEQ ID NO: 8758922 - DNA, 22 bp, Homo sapiens
aagagaggggttgcatggaaat

SEQ ID NO: 8758923 - DNA, 22 bp, Homo sapiens
aagagagtcagtctgagcacca

SEQ ID NO: 8758924 - DNA, 22 bp, Homo sapiens
aagagagtcagtctgagcacca

SEQ ID NO: 8758925 - DNA, 22 bp, Homo sapiens
aagagagggacttattaaagtc

SEQ ID NO: 8758926 - DNA, 22 bp, Homo sapiens
aagagaggggttgcatggaaat

SEQ ID NO: 8758927 - DNA, 17 bp, Homo sapiens
aagagaggctgagctgg

SEQ ID NO: 8758928 - DNA, 22 bp, Homo sapiens
aagagaggacatggtgaacctg

SEQ ID NO: 8758929 - DNA, 17 bp, Homo sapiens
aagagaggctgagctgg

SEQ ID NO: 8758930 - DNA, 17 bp, Homo sapiens
aagagaggctgagctgg

SEQ ID NO: 8758931 - DNA, 17 bp, Homo sapiens
aagagaggctgagctgg

SEQ ID NO: 8758932 - DNA, 22 bp, Homo sapiens
aagagagggacttattaaagtc

SEQ ID NO: 8758933 - DNA, 22 bp, Homo sapiens
aagagattaaagtaacttgcct

SEQ ID NO: 8758934 - DNA, 22 bp, Homo sapiens
aagagattggttataagagatt

SEQ ID NO: 8758935 - DNA, 22 bp, Homo sapiens
aagagattcctcactcagaatg

SEQ ID NO: 8758936 - DNA, 22 bp, Homo sapiens
aagagattcctcactcagaatg

SEQ ID NO: 8758937 - DNA, 22 bp, Homo sapiens
aagagatgtgggctgctgtgca

SEQ ID NO: 8758938 - DNA, 22 bp, Homo sapiens
aagagatgtgggctgctgtgca

SEQ ID NO: 8758939 - DNA, 22 bp, Homo sapiens
aagagatgaaggtcctgactgt

SEQ ID NO: 8758940 - DNA, 22 bp, Homo sapiens
aagagatgatggcagccagagg

SEQ ID NO: 8758941 - DNA, 22 bp, Homo sapiens
aagagatgctttacatcggatg

SEQ ID NO: 8758942 - DNA, 22 bp, Homo sapiens
aagagatgtggaatcatttaca

SEQ ID NO: 8758943 - DNA, 22 bp, Homo sapiens
acaaggaccatgaggcagaccc

SEQ ID NO: 8758944 - DNA, 22 bp, Homo sapiens
acaaggacatgcaatttggatt

SEQ ID NO: 8758945 - DNA, 22 bp, Homo sapiens
aagagattgtcagagatatgcc

SEQ ID NO: 8758946 - DNA, 20 bp, Homo sapiens
acaaggaaccaggaggtggc

SEQ ID NO: 8758947 - DNA, 22 bp, Homo sapiens
acaaggacataggaaactacaa

SEQ ID NO: 8758948 - DNA, 22 bp, Homo sapiens
aagagattggttataagagatt

SEQ ID NO: 8758949 - DNA, 22 bp, Homo sapiens
aagagattggttataagagatt

SEQ ID NO: 8758950 - DNA, 22 bp, Homo sapiens
aagagattgtcagagatatgcc

SEQ ID NO: 8758951 - DNA, 22 bp, Homo sapiens
aagagattgtcagagatatgcc

SEQ ID NO: 8758952 - DNA, 22 bp, Homo sapiens
acaaggagaagaaattggtcat

SEQ ID NO: 8758953 - DNA, 18 bp, Homo sapiens
acaaggacgcgctgtgtg

SEQ ID NO: 8758954 - DNA, 22 bp, Homo sapiens
acaaggaggatatgtttaaggg

SEQ ID NO: 8758955 - DNA, 22 bp, Homo sapiens
acaaggattaaatgatatacag

SEQ ID NO: 8758956 - DNA, 22 bp, Homo sapiens
acaaggaggtctggggggccct

SEQ ID NO: 8758957 - DNA, 22 bp, Homo sapiens
acaaggagagcacacatgggga

SEQ ID NO: 8758958 - DNA, 22 bp, Homo sapiens
aagagctagattgcaaacctgg

SEQ ID NO: 8758959 - DNA, 22 bp, Homo sapiens
aagagctccaggcaatgcggtc

SEQ ID NO: 8758960 - DNA, 20 bp, Homo sapiens
aagagctgactcacagtggt

SEQ ID NO: 8758961 - DNA, 22 bp, Homo sapiens
aagagctcttcataaaggcata

SEQ ID NO: 8758962 - DNA, 22 bp, Homo sapiens
acaaggctgttggtcacaaacc

SEQ ID NO: 8758963 - DNA, 22 bp, Homo sapiens
acaaggctgttggtcacaaacc

SEQ ID NO: 8758964 - DNA, 22 bp, Homo sapiens
aagagctgattaagtcatgagg

SEQ ID NO: 8758965 - DNA, 22 bp, Homo sapiens
aagagctgattaagtcatgagg

SEQ ID NO: 8758966 - DNA, 20 bp, Homo sapiens
aagagctgactcacagtggt

SEQ ID NO: 8758967 - DNA, 22 bp, Homo sapiens
aagagctgcatctaagccatga

SEQ ID NO: 8758968 - DNA, 22 bp, Homo sapiens
aagagctgcacatatttatatc

SEQ ID NO: 8758969 - DNA, 19 bp, Homo sapiens
acaaggctgggagagcgcc

SEQ ID NO: 8758970 - DNA, 22 bp, Homo sapiens
acaaggctgtggggagaactga

SEQ ID NO: 8758971 - DNA, 22 bp, Homo sapiens
acaaggctgtgggagaacctct

SEQ ID NO: 8758972 - DNA, 22 bp, Homo sapiens
acaaggctctggagaagcagaa

SEQ ID NO: 8758973 - DNA, 22 bp, Homo sapiens
acaaggctaatttggaagatac

SEQ ID NO: 8758974 - DNA, 22 bp, Homo sapiens
acaaggctgaacagtgaagccg

SEQ ID NO: 8758975 - DNA, 22 bp, Homo sapiens
acaaggcagttaaaatggttaa

SEQ ID NO: 8758976 - DNA, 22 bp, Homo sapiens
acaaggcagtacaatgatgaca

SEQ ID NO: 8758977 - DNA, 22 bp, Homo sapiens
acaaggcagttaaaatggttaa

SEQ ID NO: 8758978 - DNA, 22 bp, Homo sapiens
acaaggcattccggaagtaacc

SEQ ID NO: 8758979 - DNA, 22 bp, Homo sapiens
acaaggccaagcattctagcaa

SEQ ID NO: 8758980 - DNA, 22 bp, Homo sapiens
acaaggcaattcctggtgaatt

SEQ ID NO: 8758981 - DNA, 22 bp, Homo sapiens
acaaggcactttatgaagagga

SEQ ID NO: 8758982 - DNA, 22 bp, Homo sapiens
acaaggcactttatgaagagga

SEQ ID NO: 8758983 - DNA, 22 bp, Homo sapiens
acaaggcaattcctggtgaatt

SEQ ID NO: 8758984 - DNA, 22 bp, Homo sapiens
acaaggcactttatgaagagga

SEQ ID NO: 8758985 - DNA, 22 bp, Homo sapiens
acaaggcactttatgaagagga

SEQ ID NO: 8758986 - DNA, 22 bp, Homo sapiens
acaaggcaatggcaggatttca

SEQ ID NO: 8758987 - DNA, 23 bp, Homo sapiens
acaaggcaacatagatcagggca

SEQ ID NO: 8758988 - DNA, 22 bp, Homo sapiens
acaaggcaatggcaggatttca

SEQ ID NO: 8758989 - DNA, 22 bp, Homo sapiens
acaaggatttgttcctaatgtt

SEQ ID NO: 8758990 - DNA, 22 bp, Homo sapiens
acaaggattaaggtatgcaaca

SEQ ID NO: 8758991 - DNA, 21 bp, Homo sapiens
aagagctggatcaaggataag

SEQ ID NO: 8758992 - DNA, 22 bp, Homo sapiens
aagagctggagtttgcagccct

SEQ ID NO: 8758993 - DNA, 22 bp, Homo sapiens
aagagctggagctgctacagga

SEQ ID NO: 8758994 - DNA, 22 bp, Homo sapiens
aagagctgcccaaggtgaacag

SEQ ID NO: 8758995 - DNA, 22 bp, Homo sapiens
aagagctggagctgctacagga

SEQ ID NO: 8758996 - DNA, 22 bp, Homo sapiens
aagagctggagctgctacagga

SEQ ID NO: 8758997 - DNA, 22 bp, Homo sapiens
aagagctggatggaatctggga

SEQ ID NO: 8758998 - DNA, 22 bp, Homo sapiens
aagagctggcccaatctgagca

SEQ ID NO: 8758999 - DNA, 22 bp, Homo sapiens
aagagctggattgtgctgcaga

SEQ ID NO: 8759000 - DNA, 22 bp, Homo sapiens
aagagctggtcacaggtccatt

SEQ ID NO: 8759001 - DNA, 22 bp, Homo sapiens
aagagctggctcttgcagcagc

SEQ ID NO: 8759002 - DNA, 22 bp, Homo sapiens
aagagctggtcacaggtccatt

SEQ ID NO: 8759003 - DNA, 22 bp, Homo sapiens
aagagctgtatgccatatgatt

SEQ ID NO: 8759004 - DNA, 21 bp, Homo sapiens
aagagctgtcaggaaggctgc

SEQ ID NO: 8759005 - DNA, 21 bp, Homo sapiens
aagagctgtcaggaaggctgc

SEQ ID NO: 8759006 - DNA, 22 bp, Homo sapiens
aagagctgttgtctgcttactg

SEQ ID NO: 8759007 - DNA, 22 bp, Homo sapiens
aagagctgttgtctgcttactg

SEQ ID NO: 8759008 - DNA, 22 bp, Homo sapiens
aagagcttccctgttgtagagg

SEQ ID NO: 8759009 - DNA, 22 bp, Homo sapiens
aagaggaactgggggctgagtc

SEQ ID NO: 8759010 - DNA, 22 bp, Homo sapiens
aagaggaaatgattgactatat

SEQ ID NO: 8759011 - DNA, 22 bp, Homo sapiens
aagaggaaatgattgactatat

SEQ ID NO: 8759012 - DNA, 19 bp, Homo sapiens
acaaatagttacatatcct

SEQ ID NO: 8759013 - DNA, 19 bp, Homo sapiens
acaaatagttacatatcct

SEQ ID NO: 8759014 - DNA, 22 bp, Homo sapiens
acaaatatggtactcggagaaa

SEQ ID NO: 8759015 - DNA, 22 bp, Homo sapiens
acaaatgactatttggtacagg

SEQ ID NO: 8759016 - DNA, 22 bp, Homo sapiens
acaaatgagaatgtagacagag

SEQ ID NO: 8759017 - DNA, 22 bp, Homo sapiens
acaaatgactcaaacaccactt

SEQ ID NO: 8759018 - DNA, 22 bp, Homo sapiens
acaaactacctacagatgttca

SEQ ID NO: 8759019 - DNA, 22 bp, Homo sapiens
acaaactacctacagatgttca

SEQ ID NO: 8759020 - DNA, 22 bp, Homo sapiens
acaaactaaaattctttattga

SEQ ID NO: 8759021 - DNA, 19 bp, Homo sapiens
acaaactgagtacacttgt

SEQ ID NO: 8759022 - DNA, 22 bp, Homo sapiens
acaaactgaatgggttttctgt

SEQ ID NO: 8759023 - DNA, 22 bp, Homo sapiens
acaaacttatgtttcatatgta

SEQ ID NO: 8759024 - DNA, 22 bp, Homo sapiens
acaaacttccatcatgaatttt

SEQ ID NO: 8759025 - DNA, 22 bp, Homo sapiens
acaaacttccatcatgaatttt

SEQ ID NO: 8759026 - DNA, 22 bp, Homo sapiens
acaaatgcaagttttatgtcaa

SEQ ID NO: 8759027 - DNA, 22 bp, Homo sapiens
acaaatgattttccaagccagt

SEQ ID NO: 8759028 - DNA, 22 bp, Homo sapiens
acaaatgccatgtgacctacca

SEQ ID NO: 8759029 - DNA, 23 bp, Homo sapiens
acaaatgcccatacatctagttc

SEQ ID NO: 8759030 - DNA, 22 bp, Homo sapiens
acaaatgcttagttcaccaaaa

SEQ ID NO: 8759031 - DNA, 19 bp, Homo sapiens
acaaatgatgttgcactga

SEQ ID NO: 8759032 - DNA, 22 bp, Homo sapiens
acaaatgagaatgtagacagag

SEQ ID NO: 8759033 - DNA, 22 bp, Homo sapiens
acaaatgagaatgtagacagag

SEQ ID NO: 8759034 - DNA, 22 bp, Homo sapiens
acaaatgagaatgtagacagag

SEQ ID NO: 8759035 - DNA, 22 bp, Homo sapiens
acaaaattatgaagaggccttg

SEQ ID NO: 8759036 - DNA, 22 bp, Homo sapiens
acaaaattatgaagaggccttg

SEQ ID NO: 8759037 - DNA, 22 bp, Homo sapiens
acaaaattacctagttattttc

SEQ ID NO: 8759038 - DNA, 22 bp, Homo sapiens
acaaaattacctagttattttc

SEQ ID NO: 8759039 - DNA, 22 bp, Homo sapiens
acaaaattacctagttattttc

SEQ ID NO: 8759040 - DNA, 22 bp, Homo sapiens
acaaaatcaaaggagtgattca

SEQ ID NO: 8759041 - DNA, 22 bp, Homo sapiens
acaaaattgtgttaaactttat

SEQ ID NO: 8759042 - DNA, 22 bp, Homo sapiens
acaaaattgtgttaaactttat

SEQ ID NO: 8759043 - DNA, 22 bp, Homo sapiens
acaaaattgtgttaaactttat

SEQ ID NO: 8759044 - DNA, 22 bp, Homo sapiens
acaaaattgtgttaaactttat

SEQ ID NO: 8759045 - DNA, 22 bp, Homo sapiens
acaaaattgtgttaaactttat

SEQ ID NO: 8759046 - DNA, 22 bp, Homo sapiens
acaaacacgagacgccactgtg

SEQ ID NO: 8759047 - DNA, 22 bp, Homo sapiens
acaaaatttttagacaaggctt

SEQ ID NO: 8759048 - DNA, 22 bp, Homo sapiens
acaaaatttttagacaaggctt

SEQ ID NO: 8759049 - DNA, 22 bp, Homo sapiens
acaaaccagcttaagcaagatg

SEQ ID NO: 8759050 - DNA, 22 bp, Homo sapiens
acaaaccagcttaagcaagatg

SEQ ID NO: 8759051 - DNA, 22 bp, Homo sapiens
acaaacatcttgacctcagatt

SEQ ID NO: 8759052 - DNA, 22 bp, Homo sapiens
acaaacatcttgacctcagatt

SEQ ID NO: 8759053 - DNA, 22 bp, Homo sapiens
acaaacagagttgaaaaatagg

SEQ ID NO: 8759054 - DNA, 22 bp, Homo sapiens
acaaacagagttgaaaaatagg

SEQ ID NO: 8759055 - DNA, 22 bp, Homo sapiens
acaaacacgagacgccactgtg

SEQ ID NO: 8759056 - DNA, 22 bp, Homo sapiens
acaaacagctaacatatgttaa

SEQ ID NO: 8759057 - DNA, 22 bp, Homo sapiens
acaaacagagttgaaaaatagg

SEQ ID NO: 8759058 - DNA, 22 bp, Homo sapiens
acaaacagagttgaaaaatagg

SEQ ID NO: 8759059 - DNA, 22 bp, Homo sapiens
acaaacagctaacatatgttaa

SEQ ID NO: 8759060 - DNA, 22 bp, Homo sapiens
agaggccatgctagaggcctgg

SEQ ID NO: 8759061 - DNA, 22 bp, Homo sapiens
agaggccatctgctctgtgggg

SEQ ID NO: 8759062 - DNA, 20 bp, Homo sapiens
agaggccagttaggagtcta

SEQ ID NO: 8759063 - DNA, 22 bp, Homo sapiens
aattttctgatgatgaagcacg

SEQ ID NO: 8759064 - DNA, 22 bp, Homo sapiens
aattttctgatgatgaagcacg

SEQ ID NO: 8759065 - DNA, 22 bp, Homo sapiens
aattttctaaggtgatgatctg

SEQ ID NO: 8759066 - DNA, 22 bp, Homo sapiens
aattttctgcctagcaaaaact

SEQ ID NO: 8759067 - DNA, 22 bp, Homo sapiens
aattttctgcctagcaaaaact

SEQ ID NO: 8759068 - DNA, 22 bp, Homo sapiens
aattttctgcctagcaaaaact

SEQ ID NO: 8759069 - DNA, 22 bp, Homo sapiens
agaggccccaggtgagcatgcc

SEQ ID NO: 8759070 - DNA, 22 bp, Homo sapiens
agaggccccatgggatggcggt

SEQ ID NO: 8759071 - DNA, 22 bp, Homo sapiens
agaggccccaggtgagcatgcc

SEQ ID NO: 8759072 - DNA, 22 bp, Homo sapiens
agaggccccaggtgagcatgcc

SEQ ID NO: 8759073 - DNA, 22 bp, Homo sapiens
agaggccccaggtgagcatgcc

SEQ ID NO: 8759074 - DNA, 20 bp, Homo sapiens
acaaaataggtactgggtag

SEQ ID NO: 8759075 - DNA, 20 bp, Homo sapiens
acaaaataggtactgggtag

SEQ ID NO: 8759076 - DNA, 22 bp, Homo sapiens
aattttatgccttgcacgttgg

SEQ ID NO: 8759077 - DNA, 22 bp, Homo sapiens
aattttatgccttgcacgttgg

SEQ ID NO: 8759078 - DNA, 22 bp, Homo sapiens
aattttattaactggatgtagc

SEQ ID NO: 8759079 - DNA, 22 bp, Homo sapiens
aattttattaactggatgtagc

SEQ ID NO: 8759080 - DNA, 22 bp, Homo sapiens
aattttattagaaggcaagggg

SEQ ID NO: 8759081 - DNA, 22 bp, Homo sapiens
aattttcacagtgctgtgagat

SEQ ID NO: 8759082 - DNA, 22 bp, Homo sapiens
aattttccatccaaagtaacat

SEQ ID NO: 8759083 - DNA, 22 bp, Homo sapiens
agagctggggcccgtaaagcca

SEQ ID NO: 8759084 - DNA, 22 bp, Homo sapiens
agagctggggcccgtaaagcca

SEQ ID NO: 8759085 - DNA, 22 bp, Homo sapiens
agagctggggccagagtcaagg

SEQ ID NO: 8759086 - DNA, 22 bp, Homo sapiens
agagctggggccagagtcaagg

SEQ ID NO: 8759087 - DNA, 22 bp, Homo sapiens
agagctggggccagagtcaagg

SEQ ID NO: 8759088 - DNA, 22 bp, Homo sapiens
agagctggggccagagtcaagg

SEQ ID NO: 8759089 - DNA, 22 bp, Homo sapiens
agagctggggccagagtcaagg

SEQ ID NO: 8759090 - DNA, 22 bp, Homo sapiens
agagctgggtgaagtgccatca

SEQ ID NO: 8759091 - DNA, 22 bp, Homo sapiens
agagctgggtgaagtgccatca

SEQ ID NO: 8759092 - DNA, 22 bp, Homo sapiens
agagctggggctctgggtttaa

SEQ ID NO: 8759093 - DNA, 22 bp, Homo sapiens
agagctgggtggacttgtagtt

SEQ ID NO: 8759094 - DNA, 22 bp, Homo sapiens
agagctgggtgaagtgccatca

SEQ ID NO: 8759095 - DNA, 22 bp, Homo sapiens
agagctgggtggtggtgactca

SEQ ID NO: 8759096 - DNA, 22 bp, Homo sapiens
agagctgggtggtggtgactca

SEQ ID NO: 8759097 - DNA, 22 bp, Homo sapiens
agagctgggtggtggtgactca

SEQ ID NO: 8759098 - DNA, 22 bp, Homo sapiens
aatttgttaaaagtgagtgaca

SEQ ID NO: 8759099 - DNA, 22 bp, Homo sapiens
acaaggaacaagcatgtagttt

SEQ ID NO: 8759100 - DNA, 22 bp, Homo sapiens
acaaggaacaagcatgtagttt

SEQ ID NO: 8759101 - DNA, 22 bp, Homo sapiens
acaagggattgttgagtagtct

SEQ ID NO: 8759102 - DNA, 22 bp, Homo sapiens
acaaattctttctgcctattgg

SEQ ID NO: 8759103 - DNA, 22 bp, Homo sapiens
acaagctttgtgatagtagaga

SEQ ID NO: 8759104 - DNA, 22 bp, Homo sapiens
acaagctttgtgatagtagaga

SEQ ID NO: 8759105 - DNA, 22 bp, Homo sapiens
acaaattctctaggcaaggaag

SEQ ID NO: 8759106 - DNA, 22 bp, Homo sapiens
acaaattctacaatcatatgat

SEQ ID NO: 8759107 - DNA, 22 bp, Homo sapiens
acaaatgttacataagtttgga

SEQ ID NO: 8759108 - DNA, 22 bp, Homo sapiens
acaaatgttacataagtttgga

SEQ ID NO: 8759109 - DNA, 22 bp, Homo sapiens
acaaatgttggatttgtcttcc

SEQ ID NO: 8759110 - DNA, 22 bp, Homo sapiens
acaaattatagaaaattgagct

SEQ ID NO: 8759111 - DNA, 22 bp, Homo sapiens
acaaattaccatggaatttggg

SEQ ID NO: 8759112 - DNA, 22 bp, Homo sapiens
acaaatgtctacattgagaata

SEQ ID NO: 8759113 - DNA, 23 bp, Homo sapiens
acaaatgtctagagagggtgtga

SEQ ID NO: 8759114 - DNA, 18 bp, Homo sapiens
acaaatgtagtgtcttaa

SEQ ID NO: 8759115 - DNA, 22 bp, Homo sapiens
acaaatgtgtctaattgtgcct

SEQ ID NO: 8759116 - DNA, 18 bp, Homo sapiens
acaaatgtgtcacaggaa

SEQ ID NO: 8759117 - DNA, 22 bp, Homo sapiens
acaaatgtggacatggataatg

SEQ ID NO: 8759118 - DNA, 22 bp, Homo sapiens
acaaatgtggacatggataatg

SEQ ID NO: 8759119 - DNA, 22 bp, Homo sapiens
acaaatgtctcctcttttgtta

SEQ ID NO: 8759120 - DNA, 22 bp, Homo sapiens
acaaatgtgattgtttctgaaa

SEQ ID NO: 8759121 - DNA, 22 bp, Homo sapiens
acaagtttcattgtttagaacc

SEQ ID NO: 8759122 - DNA, 19 bp, Homo sapiens
agatggggaagagtgtgag

SEQ ID NO: 8759123 - DNA, 22 bp, Homo sapiens
acaagttccactacagagttgt

SEQ ID NO: 8759124 - DNA, 22 bp, Homo sapiens
acaagttctgggaattaggaca

SEQ ID NO: 8759125 - DNA, 22 bp, Homo sapiens
acaagttcatggtgctttcctg

SEQ ID NO: 8759126 - DNA, 22 bp, Homo sapiens
agatggggctcagtgtggaggc

SEQ ID NO: 8759127 - DNA, 22 bp, Homo sapiens
agatggggcagaatggagccat

SEQ ID NO: 8759128 - DNA, 22 bp, Homo sapiens
agatggggcagaatggagccat

SEQ ID NO: 8759129 - DNA, 19 bp, Homo sapiens
agatggggaagagtgtgag

SEQ ID NO: 8759130 - DNA, 19 bp, Homo sapiens
agatggggaagagtgtgag

SEQ ID NO: 8759131 - DNA, 19 bp, Homo sapiens
agatggggaagagtgtgag

SEQ ID NO: 8759132 - DNA, 19 bp, Homo sapiens
acaagggcaggcaaggtga

SEQ ID NO: 8759133 - DNA, 22 bp, Homo sapiens
acaaggtaagaaacattggctt

SEQ ID NO: 8759134 - DNA, 22 bp, Homo sapiens
acaaggtacaaaacagagcaca

SEQ ID NO: 8759135 - DNA, 22 bp, Homo sapiens
acaaggtatccacattaaatgt

SEQ ID NO: 8759136 - DNA, 22 bp, Homo sapiens
acaaggtatcatcttggaagca

SEQ ID NO: 8759137 - DNA, 22 bp, Homo sapiens
acaaggtatccacattaaatgt

SEQ ID NO: 8759138 - DNA, 22 bp, Homo sapiens
acaaggttggctctttctttgt

SEQ ID NO: 8759139 - DNA, 22 bp, Homo sapiens
acaaggttgattctggcatctg

SEQ ID NO: 8759140 - DNA, 22 bp, Homo sapiens
acaagtagtaaattattaggtg

SEQ ID NO: 8759141 - DNA, 22 bp, Homo sapiens
acaagtatttaaggttagtata

SEQ ID NO: 8759142 - DNA, 19 bp, Homo sapiens
acaagtcacttacttagta

SEQ ID NO: 8759143 - DNA, 22 bp, Homo sapiens
acaaggtttggtcctatatttt

SEQ ID NO: 8759144 - DNA, 22 bp, Homo sapiens
acaaggtttggtaccacatcca

SEQ ID NO: 8759145 - DNA, 22 bp, Homo sapiens
acaaggtttaaatagccatcag

SEQ ID NO: 8759146 - DNA, 22 bp, Homo sapiens
acaagtaatttatgcaaacgga

SEQ ID NO: 8759147 - DNA, 23 bp, Homo sapiens
acaagtgtttccaatatggctgg

SEQ ID NO: 8759148 - DNA, 22 bp, Homo sapiens
acaagtgggtcctacataaagc

SEQ ID NO: 8759149 - DNA, 22 bp, Homo sapiens
acaagtgtgtgcagtttgtaaa

SEQ ID NO: 8759150 - DNA, 22 bp, Homo sapiens
acaagtgcatggaatcagctgt

SEQ ID NO: 8759151 - DNA, 22 bp, Homo sapiens
acaagtctttttcatgtcttct

SEQ ID NO: 8759152 - DNA, 22 bp, Homo sapiens
acaagtctgttatgcacctgga

SEQ ID NO: 8759153 - DNA, 22 bp, Homo sapiens
acaagtcagtggaattaatatt

SEQ ID NO: 8759154 - DNA, 21 bp, Homo sapiens
agcaaggcagcctctcagcct

SEQ ID NO: 8759155 - DNA, 22 bp, Homo sapiens
agcaaggagtagaacaagagtg

SEQ ID NO: 8759156 - DNA, 22 bp, Homo sapiens
agcaaggaaagtaggcacggaa

SEQ ID NO: 8759157 - DNA, 22 bp, Homo sapiens
agcaccatcacagctgtatgtc

SEQ ID NO: 8759158 - DNA, 22 bp, Homo sapiens
agcaccatcacagctgtatgtc

SEQ ID NO: 8759159 - DNA, 22 bp, Homo sapiens
agcaccatcagatgcaatatct

SEQ ID NO: 8759160 - DNA, 22 bp, Homo sapiens
agcaccatcgggttcttgcttt

SEQ ID NO: 8759161 - DNA, 21 bp, Homo sapiens
agcaccagttttatgccaggc

SEQ ID NO: 8759162 - DNA, 19 bp, Homo sapiens
agcaccatagccctgaaag

SEQ ID NO: 8759163 - DNA, 20 bp, Homo sapiens
agcaccagtgggggcagccc

SEQ ID NO: 8759164 - DNA, 22 bp, Homo sapiens
agcacaggtacggagatgctac

SEQ ID NO: 8759165 - DNA, 20 bp, Homo sapiens
agcaccagtgggggcagccc

SEQ ID NO: 8759166 - DNA, 22 bp, Homo sapiens
agcacaggtacggagatgctac

SEQ ID NO: 8759167 - DNA, 20 bp, Homo sapiens
agcaccagtgggggcagccc

SEQ ID NO: 8759168 - DNA, 22 bp, Homo sapiens
agcaagatttttcaggttagta

SEQ ID NO: 8759169 - DNA, 22 bp, Homo sapiens
agcaagattttccttgaatgtt

SEQ ID NO: 8759170 - DNA, 22 bp, Homo sapiens
agcaagattgaggcttcctcag

SEQ ID NO: 8759171 - DNA, 22 bp, Homo sapiens
agcaagcagaaatgccatggca

SEQ ID NO: 8759172 - DNA, 22 bp, Homo sapiens
agcaagatttttcaggttagta

SEQ ID NO: 8759173 - DNA, 22 bp, Homo sapiens
agcaagcagaattctgtcctct

SEQ ID NO: 8759174 - DNA, 21 bp, Homo sapiens
agcaagcagaatccatctaga

SEQ ID NO: 8759175 - DNA, 22 bp, Homo sapiens
agcaaggaaactatggagagat

SEQ ID NO: 8759176 - DNA, 22 bp, Homo sapiens
agcaagcaggatggtcaaacta

SEQ ID NO: 8759177 - DNA, 21 bp, Homo sapiens
agcaagcagaatccatctaga

SEQ ID NO: 8759178 - DNA, 18 bp, Homo sapiens
agcaagcagttttcatgt

SEQ ID NO: 8759179 - DNA, 22 bp, Homo sapiens
acaatgtttttgttcaaagagt

SEQ ID NO: 8759180 - DNA, 22 bp, Homo sapiens
acaatgtttttgttcaaagagt

SEQ ID NO: 8759181 - DNA, 22 bp, Homo sapiens
acaatgtttttgttcaaagagt

SEQ ID NO: 8759182 - DNA, 22 bp, Homo sapiens
acaatgtttttgttcaaagagt

SEQ ID NO: 8759183 - DNA, 22 bp, Homo sapiens
acaatgttttgaaacatctagg

SEQ ID NO: 8759184 - DNA, 22 bp, Homo sapiens
agatggggtttcatcatgttgg

SEQ ID NO: 8759185 - DNA, 22 bp, Homo sapiens
acaatgcttggtttttctagaa

SEQ ID NO: 8759186 - DNA, 22 bp, Homo sapiens
agatggggtttcatcatgttgg

SEQ ID NO: 8759187 - DNA, 22 bp, Homo sapiens
agatggggtttcatcatgttgg

SEQ ID NO: 8759188 - DNA, 22 bp, Homo sapiens
agatggggtttcatcatgttgg

SEQ ID NO: 8759189 - DNA, 22 bp, Homo sapiens
agatggggctgaaagttccaat

SEQ ID NO: 8759190 - DNA, 22 bp, Homo sapiens
agatggggctgaaagttccaat

SEQ ID NO: 8759191 - DNA, 22 bp, Homo sapiens
agatggggctgaaagttccaat

SEQ ID NO: 8759192 - DNA, 22 bp, Homo sapiens
agatggggctcagtgtggaggc

SEQ ID NO: 8759193 - DNA, 22 bp, Homo sapiens
agatggggctcagtgtggaggc

SEQ ID NO: 8759194 - DNA, 22 bp, Homo sapiens
agatggggctcagtgtggaggc

SEQ ID NO: 8759195 - DNA, 22 bp, Homo sapiens
acaattccacatggcatgcagg

SEQ ID NO: 8759196 - DNA, 22 bp, Homo sapiens
acaattctgatggtttcccagt

SEQ ID NO: 8759197 - DNA, 22 bp, Homo sapiens
acaattctgatggtttcccagt

SEQ ID NO: 8759198 - DNA, 22 bp, Homo sapiens
acaattactcaactttgctgct

SEQ ID NO: 8759199 - DNA, 22 bp, Homo sapiens
acaattcaagatgagattcagg

SEQ ID NO: 8759200 - DNA, 22 bp, Homo sapiens
acaattcaagaagagagatgaa

SEQ ID NO: 8759201 - DNA, 22 bp, Homo sapiens
acaattagtgatcagtgatgcc

SEQ ID NO: 8759202 - DNA, 22 bp, Homo sapiens
agaagtatcaggaagattctca

SEQ ID NO: 8759203 - DNA, 22 bp, Homo sapiens
agaagtaggcagggctgtatca

SEQ ID NO: 8759204 - DNA, 22 bp, Homo sapiens
agaagggttcaggaatatgtta

SEQ ID NO: 8759205 - DNA, 22 bp, Homo sapiens
agaagggtgtatacatttcctg

SEQ ID NO: 8759206 - DNA, 23 bp, Homo sapiens
agaagggtccttggcagcgacag

SEQ ID NO: 8759207 - DNA, 23 bp, Homo sapiens
agaagggtccttggcagcgacag

SEQ ID NO: 8759208 - DNA, 23 bp, Homo sapiens
agaaggtgggcctgctgagttat

SEQ ID NO: 8759209 - DNA, 23 bp, Homo sapiens
agaaggtgggcctgctgagttat

SEQ ID NO: 8759210 - DNA, 22 bp, Homo sapiens
agaagggctacacgggctctcc

SEQ ID NO: 8759211 - DNA, 22 bp, Homo sapiens
agaagggtagttgtaagagtga

SEQ ID NO: 8759212 - DNA, 22 bp, Homo sapiens
agaagggtagggacttatccaa

SEQ ID NO: 8759213 - DNA, 22 bp, Homo sapiens
aatgcaaacttcttgttacttg

SEQ ID NO: 8759214 - DNA, 22 bp, Homo sapiens
aatgcaaacagcccagaatcca

SEQ ID NO: 8759215 - DNA, 22 bp, Homo sapiens
aatgcaaacttcttgttacttg

SEQ ID NO: 8759216 - DNA, 22 bp, Homo sapiens
aatgcaaacttcttgttacttg

SEQ ID NO: 8759217 - DNA, 22 bp, Homo sapiens
aatgcaaagcaagcagagattt

SEQ ID NO: 8759218 - DNA, 22 bp, Homo sapiens
aatgcaaagcaagcagagattt

SEQ ID NO: 8759219 - DNA, 22 bp, Homo sapiens
aatgcaaagcaagcagagattt

SEQ ID NO: 8759220 - DNA, 22 bp, Homo sapiens
aatgcaaagctctttaatcctt

SEQ ID NO: 8759221 - DNA, 22 bp, Homo sapiens
aatgcaaatgtaagggtgggat

SEQ ID NO: 8759222 - DNA, 22 bp, Homo sapiens
aatgcaaagtgaggtgagtggc

SEQ ID NO: 8759223 - DNA, 22 bp, Homo sapiens
aatgcaaattctagggccctat

SEQ ID NO: 8759224 - DNA, 22 bp, Homo sapiens
aatgcaaattatcaggcttctc

SEQ ID NO: 8759225 - DNA, 23 bp, Homo sapiens
agacactgtaaagaattgcagtt

SEQ ID NO: 8759226 - DNA, 22 bp, Homo sapiens
agacagactttgatctggatgt

SEQ ID NO: 8759227 - DNA, 19 bp, Homo sapiens
agacagagactgaaataga

SEQ ID NO: 8759228 - DNA, 22 bp, Homo sapiens
agacagagatactatgttgtca

SEQ ID NO: 8759229 - DNA, 22 bp, Homo sapiens
agacagagatactatgttgtca

SEQ ID NO: 8759230 - DNA, 19 bp, Homo sapiens
agacagagactgaaataga

SEQ ID NO: 8759231 - DNA, 19 bp, Homo sapiens
agacagagactgaaataga

SEQ ID NO: 8759232 - DNA, 22 bp, Homo sapiens
agacagagatactatgttgtca

SEQ ID NO: 8759233 - DNA, 19 bp, Homo sapiens
agacagagctcagtgggtt

SEQ ID NO: 8759234 - DNA, 19 bp, Homo sapiens
agacagagctcagtgggtt

SEQ ID NO: 8759235 - DNA, 22 bp, Homo sapiens
agacagagatactatgttgtca

SEQ ID NO: 8759236 - DNA, 19 bp, Homo sapiens
agacagagctcagtgggtt

SEQ ID NO: 8759237 - DNA, 19 bp, Homo sapiens
agacagagctcagtgggtt

SEQ ID NO: 8759238 - DNA, 19 bp, Homo sapiens
agacagagctcagtgggtt

SEQ ID NO: 8759239 - DNA, 19 bp, Homo sapiens
agacagagctcagtgggtt

SEQ ID NO: 8759240 - DNA, 19 bp, Homo sapiens
agacagagctcagtgggtt

SEQ ID NO: 8759241 - DNA, 22 bp, Homo sapiens
agacagagatactatgttgtca

SEQ ID NO: 8759242 - DNA, 22 bp, Homo sapiens
agacagagatactatgttgtca

SEQ ID NO: 8759243 - DNA, 21 bp, Homo sapiens
agacactggtttagcattcat

SEQ ID NO: 8759244 - DNA, 21 bp, Homo sapiens
agacactggtttagcattcat

SEQ ID NO: 8759245 - DNA, 22 bp, Homo sapiens
aatgcaaggcctgtatctgatt

SEQ ID NO: 8759246 - DNA, 22 bp, Homo sapiens
aatgcaagtcaatgctataccc

SEQ ID NO: 8759247 - DNA, 22 bp, Homo sapiens
aatgcaagatcaaatctaacac

SEQ ID NO: 8759248 - DNA, 22 bp, Homo sapiens
agacaggctttgctgtatatca

SEQ ID NO: 8759249 - DNA, 22 bp, Homo sapiens
agacagcaatatgggagacgga

SEQ ID NO: 8759250 - DNA, 22 bp, Homo sapiens
agacagcaatatgggagacgga

SEQ ID NO: 8759251 - DNA, 22 bp, Homo sapiens
agacagcacttttgtatggggg

SEQ ID NO: 8759252 - DNA, 22 bp, Homo sapiens
agacagcacttttgtatggggg

SEQ ID NO: 8759253 - DNA, 22 bp, Homo sapiens
agacagcaatatgggagacgga

SEQ ID NO: 8759254 - DNA, 22 bp, Homo sapiens
agacagcaatatgggagacgga

SEQ ID NO: 8759255 - DNA, 21 bp, Homo sapiens
agacagagtgcagtctacata

SEQ ID NO: 8759256 - DNA, 21 bp, Homo sapiens
agacagagtgcagtctacata

SEQ ID NO: 8759257 - DNA, 21 bp, Homo sapiens
agacagagtgcagtctacata

SEQ ID NO: 8759258 - DNA, 23 bp, Homo sapiens
agacagaggctgaggctggccgc

SEQ ID NO: 8759259 - DNA, 23 bp, Homo sapiens
agacagaggctgaggctggccgc

SEQ ID NO: 8759260 - DNA, 23 bp, Homo sapiens
agacagaggctgaggctggccgc

SEQ ID NO: 8759261 - DNA, 23 bp, Homo sapiens
agacagaggctgaggctggccgc

SEQ ID NO: 8759262 - DNA, 23 bp, Homo sapiens
agacagaggctgaggctggccgc

SEQ ID NO: 8759263 - DNA, 23 bp, Homo sapiens
agacagaggctgaggctggccgc

SEQ ID NO: 8759264 - DNA, 22 bp, Homo sapiens
aatgtcacagaagaactcccca

SEQ ID NO: 8759265 - DNA, 22 bp, Homo sapiens
aatgtcaattaccagaacagaa

SEQ ID NO: 8759266 - DNA, 22 bp, Homo sapiens
aatgtcaattaccagaacagaa

SEQ ID NO: 8759267 - DNA, 22 bp, Homo sapiens
aatgtcaatctcagagaacaca

SEQ ID NO: 8759268 - DNA, 22 bp, Homo sapiens
aatgtcaatctcagagaacaca

SEQ ID NO: 8759269 - DNA, 22 bp, Homo sapiens
aatgtattctctttataagata

SEQ ID NO: 8759270 - DNA, 22 bp, Homo sapiens
aatgtattctctttataagata

SEQ ID NO: 8759271 - DNA, 19 bp, Homo sapiens
aatgtcagcatgttaattt

SEQ ID NO: 8759272 - DNA, 22 bp, Homo sapiens
aatgtcagcctgaaagctattc

SEQ ID NO: 8759273 - DNA, 22 bp, Homo sapiens
aatgtcagtgttactgctattg

SEQ ID NO: 8759274 - DNA, 22 bp, Homo sapiens
aatgtcagcctgaaagctattc

SEQ ID NO: 8759275 - DNA, 22 bp, Homo sapiens
aatgtcacatacaatggcaagt

SEQ ID NO: 8759276 - DNA, 21 bp, Homo sapiens
aatgtcattgaatggtgagac

SEQ ID NO: 8759277 - DNA, 22 bp, Homo sapiens
aatgtcattgagctccaatcct

SEQ ID NO: 8759278 - DNA, 21 bp, Homo sapiens
aatgtcattgaatggtgagac

SEQ ID NO: 8759279 - DNA, 22 bp, Homo sapiens
agacagggccactcatcctcac

SEQ ID NO: 8759280 - DNA, 22 bp, Homo sapiens
agacagggccactcatcctcac

SEQ ID NO: 8759281 - DNA, 22 bp, Homo sapiens
agacagggagggagcgcggctg

SEQ ID NO: 8759282 - DNA, 22 bp, Homo sapiens
agacagggtcttgatcagagct

SEQ ID NO: 8759283 - DNA, 22 bp, Homo sapiens
agacagggtgatcgcttgagcc

SEQ ID NO: 8759284 - DNA, 22 bp, Homo sapiens
agacagggtgatcgcttgagcc

SEQ ID NO: 8759285 - DNA, 22 bp, Homo sapiens
aatgtattcctcatgcaagagt

SEQ ID NO: 8759286 - DNA, 22 bp, Homo sapiens
aatgtcattggtaaagattagg

SEQ ID NO: 8759287 - DNA, 22 bp, Homo sapiens
aatgtcatttaaaataattctg

SEQ ID NO: 8759288 - DNA, 22 bp, Homo sapiens
aatgtcatttaaaataattctg

SEQ ID NO: 8759289 - DNA, 22 bp, Homo sapiens
aatgtcatttttaaatgtgaga

SEQ ID NO: 8759290 - DNA, 22 bp, Homo sapiens
aatgtcatttttaaatgtgaga

SEQ ID NO: 8759291 - DNA, 22 bp, Homo sapiens
aatgtcatttttaaatgtgaga

SEQ ID NO: 8759292 - DNA, 22 bp, Homo sapiens
aatgtcatttaggattatgttt

SEQ ID NO: 8759293 - DNA, 17 bp, Homo sapiens
aatgtccttggaccaca

SEQ ID NO: 8759294 - DNA, 22 bp, Homo sapiens
aatgtctacaccgtatgttgtt

SEQ ID NO: 8759295 - DNA, 22 bp, Homo sapiens
aatgtctacaccgtatgttgtt

SEQ ID NO: 8759296 - DNA, 22 bp, Homo sapiens
aatgtctattaaactgtcataa

SEQ ID NO: 8759297 - DNA, 22 bp, Homo sapiens
aatgtctatttgctacaaagcc

SEQ ID NO: 8759298 - DNA, 22 bp, Homo sapiens
aatgtctatttgctacaaagcc

SEQ ID NO: 8759299 - DNA, 22 bp, Homo sapiens
aatgtctagagttttaagctta

SEQ ID NO: 8759300 - DNA, 22 bp, Homo sapiens
aatgtctacattctgaattcgt

SEQ ID NO: 8759301 - DNA, 22 bp, Homo sapiens
aatgtctagacatgttaatgca

SEQ ID NO: 8759302 - DNA, 22 bp, Homo sapiens
aatgtctgtgccttaaaacttc

SEQ ID NO: 8759303 - DNA, 22 bp, Homo sapiens
aatgtctgtgccttaaaacttc

SEQ ID NO: 8759304 - DNA, 22 bp, Homo sapiens
aatgtcttacatttactgagca

SEQ ID NO: 8759305 - DNA, 22 bp, Homo sapiens
aatgtcttaaagtcgtgttaca

SEQ ID NO: 8759306 - DNA, 22 bp, Homo sapiens
aatgtcttcagtgtatacatgg

SEQ ID NO: 8759307 - DNA, 22 bp, Homo sapiens
aatgtcttcagtgtatacatgg

SEQ ID NO: 8759308 - DNA, 22 bp, Homo sapiens
aatgtgttatttcagaatccag

SEQ ID NO: 8759309 - DNA, 22 bp, Homo sapiens
aatgtgttcacaggaaatacag

SEQ ID NO: 8759310 - DNA, 22 bp, Homo sapiens
aatgtgttagtattgatttgtc

SEQ ID NO: 8759311 - DNA, 22 bp, Homo sapiens
aatgtgtttagttaatgagttg

SEQ ID NO: 8759312 - DNA, 22 bp, Homo sapiens
aatgtgttgaataaattgtgcc

SEQ ID NO: 8759313 - DNA, 22 bp, Homo sapiens
aatgtgttcagttaaatgaact

SEQ ID NO: 8759314 - DNA, 22 bp, Homo sapiens
aatgtgtttagttaatgagttg

SEQ ID NO: 8759315 - DNA, 22 bp, Homo sapiens
aatgtctgctctactcaggagg

SEQ ID NO: 8759316 - DNA, 22 bp, Homo sapiens
aatgtctgagtctctgtatccc

SEQ ID NO: 8759317 - DNA, 22 bp, Homo sapiens
aatgtctcttgagaggcgaaac

SEQ ID NO: 8759318 - DNA, 22 bp, Homo sapiens
aatgtctatgaaatgaaaggga

SEQ ID NO: 8759319 - DNA, 22 bp, Homo sapiens
aatgtctctctaaataaacttt

SEQ ID NO: 8759320 - DNA, 22 bp, Homo sapiens
aatgttgcagagtgattgtcca

SEQ ID NO: 8759321 - DNA, 22 bp, Homo sapiens
aatgttgcagagtgattgtcca

SEQ ID NO: 8759322 - DNA, 22 bp, Homo sapiens
aatgttcattgattaaatgaat

SEQ ID NO: 8759323 - DNA, 22 bp, Homo sapiens
aatgttcattgattaaatgaat

SEQ ID NO: 8759324 - DNA, 22 bp, Homo sapiens
aatgttcattgattaaatgaat

SEQ ID NO: 8759325 - DNA, 22 bp, Homo sapiens
aatgttcagtctcaagagtgat

SEQ ID NO: 8759326 - DNA, 22 bp, Homo sapiens
aatgttcctatttaccccctaa

SEQ ID NO: 8759327 - DNA, 22 bp, Homo sapiens
aatgttccacagatatagcatg

SEQ ID NO: 8759328 - DNA, 22 bp, Homo sapiens
aatgttccaccaacatttggga

SEQ ID NO: 8759329 - DNA, 22 bp, Homo sapiens
aatgttcagtagaataggaatg

SEQ ID NO: 8759330 - DNA, 22 bp, Homo sapiens
aatgttcaaaagcatcagtgaa

SEQ ID NO: 8759331 - DNA, 22 bp, Homo sapiens
aatgttcaaaagcatcagtgaa

SEQ ID NO: 8759332 - DNA, 22 bp, Homo sapiens
aatgtgtttatttagtgattta

SEQ ID NO: 8759333 - DNA, 22 bp, Homo sapiens
aatgttatttctgcatagtagt

SEQ ID NO: 8759334 - DNA, 22 bp, Homo sapiens
aatgttcagaggacaatataaa

SEQ ID NO: 8759335 - DNA, 22 bp, Homo sapiens
aatgttcagaggacaatataaa

SEQ ID NO: 8759336 - DNA, 22 bp, Homo sapiens
aatgttcagaggacaatataaa

SEQ ID NO: 8759337 - DNA, 22 bp, Homo sapiens
aatgttcaacagatggatattt

SEQ ID NO: 8759338 - DNA, 22 bp, Homo sapiens
aatgttcaaacagatcacttag

SEQ ID NO: 8759339 - DNA, 22 bp, Homo sapiens
aatgttcagtagaataggaatg

SEQ ID NO: 8759340 - DNA, 20 bp, Homo sapiens
aatgttcagtaattgtttta

SEQ ID NO: 8759341 - DNA, 22 bp, Homo sapiens
aatgttcagcgagggatgctag

SEQ ID NO: 8759342 - DNA, 19 bp, Homo sapiens
aatgtttaagagaaaaagg

SEQ ID NO: 8759343 - DNA, 22 bp, Homo sapiens
aatgttgtttttctgcatgtct

SEQ ID NO: 8759344 - DNA, 22 bp, Homo sapiens
aatgttgttggctcttcatgat

SEQ ID NO: 8759345 - DNA, 22 bp, Homo sapiens
aatgttgttggctcttcatgat

SEQ ID NO: 8759346 - DNA, 22 bp, Homo sapiens
aatgttgtgtttcagttcaaga

SEQ ID NO: 8759347 - DNA, 22 bp, Homo sapiens
aatgtttgagcatctacatgct

SEQ ID NO: 8759348 - DNA, 22 bp, Homo sapiens
aatgtttctggatattgtgggt

SEQ ID NO: 8759349 - DNA, 22 bp, Homo sapiens
aatgtttcgtaaattgtctatg

SEQ ID NO: 8759350 - DNA, 20 bp, Homo sapiens
aatgtttctgaacaggtagt

SEQ ID NO: 8759351 - DNA, 22 bp, Homo sapiens
aatgtttgaactttgcatattt

SEQ ID NO: 8759352 - DNA, 22 bp, Homo sapiens
aatgtttcaattaagtctttta

SEQ ID NO: 8759353 - DNA, 22 bp, Homo sapiens
aatgtttcatttagttgtctcc

SEQ ID NO: 8759354 - DNA, 20 bp, Homo sapiens
aattagcttaagtcaatcag

SEQ ID NO: 8759355 - DNA, 22 bp, Homo sapiens
aatgtttggctagatagatgga

SEQ ID NO: 8759356 - DNA, 22 bp, Homo sapiens
aattaccatcgtcaaatcatat

SEQ ID NO: 8759357 - DNA, 22 bp, Homo sapiens
aattacctgtcatacatcaagc

SEQ ID NO: 8759358 - DNA, 22 bp, Homo sapiens
aattaggaaatgagagtatttg

SEQ ID NO: 8759359 - DNA, 19 bp, Homo sapiens
aatttagttcttgtttaga

SEQ ID NO: 8759360 - DNA, 22 bp, Homo sapiens
aatttataataaatagggcttt

SEQ ID NO: 8759361 - DNA, 22 bp, Homo sapiens
aatttataataaatagggcttt

SEQ ID NO: 8759362 - DNA, 22 bp, Homo sapiens
aatttagattgataaacatgga

SEQ ID NO: 8759363 - DNA, 22 bp, Homo sapiens
aatttagattgataaacatgga

SEQ ID NO: 8759364 - DNA, 22 bp, Homo sapiens
agagctgggacttggactcaat

SEQ ID NO: 8759365 - DNA, 22 bp, Homo sapiens
agagctgggacttggactcaat

SEQ ID NO: 8759366 - DNA, 22 bp, Homo sapiens
agagctgggacttggactcaat

SEQ ID NO: 8759367 - DNA, 22 bp, Homo sapiens
aatttatatgtaattaggcaca

SEQ ID NO: 8759368 - DNA, 22 bp, Homo sapiens
aatttatatgtaattaggcaca

SEQ ID NO: 8759369 - DNA, 22 bp, Homo sapiens
aatttatatgtaattaggcaca

SEQ ID NO: 8759370 - DNA, 22 bp, Homo sapiens
aatttacacttcatttggaggg

SEQ ID NO: 8759371 - DNA, 22 bp, Homo sapiens
aatttacacttcatttggaggg

SEQ ID NO: 8759372 - DNA, 22 bp, Homo sapiens
aatttacacttcatttggaggg

SEQ ID NO: 8759373 - DNA, 22 bp, Homo sapiens
aatttacacttcatttggaggg

SEQ ID NO: 8759374 - DNA, 22 bp, Homo sapiens
aatttacaggtgcactcgccat

SEQ ID NO: 8759375 - DNA, 22 bp, Homo sapiens
aatttacaggtgcactcgccat

SEQ ID NO: 8759376 - DNA, 22 bp, Homo sapiens
aatttacaggtgcactcgccat

SEQ ID NO: 8759377 - DNA, 22 bp, Homo sapiens
aatttacaggtgcactcgccat

SEQ ID NO: 8759378 - DNA, 22 bp, Homo sapiens
aatttacagttgctgatggtac

SEQ ID NO: 8759379 - DNA, 22 bp, Homo sapiens
aatttacagttgctgatggtac

SEQ ID NO: 8759380 - DNA, 22 bp, Homo sapiens
aatttacagttgctgatggtac

SEQ ID NO: 8759381 - DNA, 22 bp, Homo sapiens
aatttacagttgctgatggtac

SEQ ID NO: 8759382 - DNA, 22 bp, Homo sapiens
aatttacagttgctgatggtac

SEQ ID NO: 8759383 - DNA, 20 bp, Homo sapiens
aatttactcacagaatgaat

SEQ ID NO: 8759384 - DNA, 20 bp, Homo sapiens
aatttactcacagaatgaat

SEQ ID NO: 8759385 - DNA, 22 bp, Homo sapiens
aattatcagatataaaactgca

SEQ ID NO: 8759386 - DNA, 22 bp, Homo sapiens
aattatcagatataaaactgca

SEQ ID NO: 8759387 - DNA, 22 bp, Homo sapiens
aattatgaggtagatatcacat

SEQ ID NO: 8759388 - DNA, 22 bp, Homo sapiens
aattatgcaaccaatgaccacg

SEQ ID NO: 8759389 - DNA, 22 bp, Homo sapiens
aattgcttttgggggcagttac

SEQ ID NO: 8759390 - DNA, 22 bp, Homo sapiens
aattggaaaaagacttaattgc

SEQ ID NO: 8759391 - DNA, 22 bp, Homo sapiens
aattatatgttaatcttcaatt

SEQ ID NO: 8759392 - DNA, 22 bp, Homo sapiens
aattatacattgaacaatctag

SEQ ID NO: 8759393 - DNA, 22 bp, Homo sapiens
aattatacattgaacaatctag

SEQ ID NO: 8759394 - DNA, 22 bp, Homo sapiens
aattatacatgaaggcattata

SEQ ID NO: 8759395 - DNA, 22 bp, Homo sapiens
aattatacaattgtcaagttct

SEQ ID NO: 8759396 - DNA, 22 bp, Homo sapiens
aattatacaattgtcaagttct

SEQ ID NO: 8759397 - DNA, 22 bp, Homo sapiens
aattagtattgcgattcattag

SEQ ID NO: 8759398 - DNA, 22 bp, Homo sapiens
acagagttacataacttgtcca

SEQ ID NO: 8759399 - DNA, 22 bp, Homo sapiens
acagagttaatggataggcagg

SEQ ID NO: 8759400 - DNA, 22 bp, Homo sapiens
acagagttaaagtggagtttaa

SEQ ID NO: 8759401 - DNA, 22 bp, Homo sapiens
acagagttaatggataggcagg

SEQ ID NO: 8759402 - DNA, 22 bp, Homo sapiens
acagagttaaagtggagtttaa

SEQ ID NO: 8759403 - DNA, 22 bp, Homo sapiens
acagagttgtgtttgtacaacg

SEQ ID NO: 8759404 - DNA, 22 bp, Homo sapiens
acagagttgtgtttgtacaacg

SEQ ID NO: 8759405 - DNA, 22 bp, Homo sapiens
acagagttgtaaacatttacca

SEQ ID NO: 8759406 - DNA, 22 bp, Homo sapiens
acagagttgtaaacatttacca

SEQ ID NO: 8759407 - DNA, 22 bp, Homo sapiens
acagagttgtgtttgtacaacg

SEQ ID NO: 8759408 - DNA, 22 bp, Homo sapiens
acagagttcccactccagaagc

SEQ ID NO: 8759409 - DNA, 22 bp, Homo sapiens
acagagttcccactccagaagc

SEQ ID NO: 8759410 - DNA, 22 bp, Homo sapiens
acagagttagcagaaagttgga

SEQ ID NO: 8759411 - DNA, 22 bp, Homo sapiens
acagagtttatgtgtgtacaaa

SEQ ID NO: 8759412 - DNA, 22 bp, Homo sapiens
acagagtttatgtgtgtacaaa

SEQ ID NO: 8759413 - DNA, 22 bp, Homo sapiens
acagagttgtgtttgtacaacg

SEQ ID NO: 8759414 - DNA, 22 bp, Homo sapiens
acagataatacattgtgctaca

SEQ ID NO: 8759415 - DNA, 22 bp, Homo sapiens
acagataaagaaacaatcacag

SEQ ID NO: 8759416 - DNA, 22 bp, Homo sapiens
acagataaatttataggagtgt

SEQ ID NO: 8759417 - DNA, 22 bp, Homo sapiens
agcccctgtaccctgagtgctt

SEQ ID NO: 8759418 - DNA, 22 bp, Homo sapiens
agcccctgtaccctgagtgctt

SEQ ID NO: 8759419 - DNA, 22 bp, Homo sapiens
agcccctgctgggtgtagctca

SEQ ID NO: 8759420 - DNA, 22 bp, Homo sapiens
agcccctctgtggctctgcctc

SEQ ID NO: 8759421 - DNA, 22 bp, Homo sapiens
agcccctctgtggctctgcctc

SEQ ID NO: 8759422 - DNA, 22 bp, Homo sapiens
agcccctctgtggctctgcctc

SEQ ID NO: 8759423 - DNA, 22 bp, Homo sapiens
agcccctctgtggctctgcctc

SEQ ID NO: 8759424 - DNA, 22 bp, Homo sapiens
acagagtcttacgtggtgataa

SEQ ID NO: 8759425 - DNA, 19 bp, Homo sapiens
acagagtgatgaggataga

SEQ ID NO: 8759426 - DNA, 22 bp, Homo sapiens
acagagtctgacaggtaggcgc

SEQ ID NO: 8759427 - DNA, 22 bp, Homo sapiens
acagagtctcagggatgaaagc

SEQ ID NO: 8759428 - DNA, 22 bp, Homo sapiens
acagagtctcaaacctacaaag

SEQ ID NO: 8759429 - DNA, 22 bp, Homo sapiens
acagagtcctagctgcaaagaa

SEQ ID NO: 8759430 - DNA, 22 bp, Homo sapiens
acagagtcattcattgtccagt

SEQ ID NO: 8759431 - DNA, 22 bp, Homo sapiens
acagaggtggacctcagcaggc

SEQ ID NO: 8759432 - DNA, 22 bp, Homo sapiens
acagagtcattcactgatgaag

SEQ ID NO: 8759433 - DNA, 22 bp, Homo sapiens
acagaggtggacctcagcaggc

SEQ ID NO: 8759434 - DNA, 22 bp, Homo sapiens
acagagcagtaagaacacagct

SEQ ID NO: 8759435 - DNA, 22 bp, Homo sapiens
acagagcagtaagaacacagct

SEQ ID NO: 8759436 - DNA, 22 bp, Homo sapiens
acagagcaggtccagaagtgcc

SEQ ID NO: 8759437 - DNA, 22 bp, Homo sapiens
acagagcagttctggagctggc

SEQ ID NO: 8759438 - DNA, 22 bp, Homo sapiens
acagagcagttctggagctggc

SEQ ID NO: 8759439 - DNA, 22 bp, Homo sapiens
acagagcagttctggagctggc

SEQ ID NO: 8759440 - DNA, 22 bp, Homo sapiens
acagagcagttctggagctggc

SEQ ID NO: 8759441 - DNA, 22 bp, Homo sapiens
acagagcataatgtctagcaca

SEQ ID NO: 8759442 - DNA, 22 bp, Homo sapiens
acagagcataatgtctagcaca

SEQ ID NO: 8759443 - DNA, 22 bp, Homo sapiens
acagagcataatgtctagcaca

SEQ ID NO: 8759444 - DNA, 22 bp, Homo sapiens
acagagcataatgtctagcaca

SEQ ID NO: 8759445 - DNA, 22 bp, Homo sapiens
acagagcataatgtctagcaca

SEQ ID NO: 8759446 - DNA, 21 bp, Homo sapiens
acagagcataatggtgtggca

SEQ ID NO: 8759447 - DNA, 21 bp, Homo sapiens
acagagcataatggtgtggca

SEQ ID NO: 8759448 - DNA, 21 bp, Homo sapiens
acagagcataatggtgtggca

SEQ ID NO: 8759449 - DNA, 22 bp, Homo sapiens
acagagcatataaagtgctttg

SEQ ID NO: 8759450 - DNA, 22 bp, Homo sapiens
acagagcatcagatgaaatcaa

SEQ ID NO: 8759451 - DNA, 22 bp, Homo sapiens
acagagcatttgggacagagag

SEQ ID NO: 8759452 - DNA, 22 bp, Homo sapiens
acagagcatgatggaagatcga

SEQ ID NO: 8759453 - DNA, 22 bp, Homo sapiens
acagagcatgatggaagatcga

SEQ ID NO: 8759454 - DNA, 22 bp, Homo sapiens
acagagcatgatggaagatcga

SEQ ID NO: 8759455 - DNA, 22 bp, Homo sapiens
agcccccaggagtctccacgcc

SEQ ID NO: 8759456 - DNA, 19 bp, Homo sapiens
agcccccagacagcaggcc

SEQ ID NO: 8759457 - DNA, 22 bp, Homo sapiens
acagagcatttgggacagagag

SEQ ID NO: 8759458 - DNA, 22 bp, Homo sapiens
agccccccaagggccttctctt

SEQ ID NO: 8759459 - DNA, 23 bp, Homo sapiens
agcccctcatatctgctttctct

SEQ ID NO: 8759460 - DNA, 23 bp, Homo sapiens
agcccctcatggtgtctagacag

SEQ ID NO: 8759461 - DNA, 23 bp, Homo sapiens
agcccctcatggtgtctagacag

SEQ ID NO: 8759462 - DNA, 17 bp, Homo sapiens
agcccctcagcgtcacc

SEQ ID NO: 8759463 - DNA, 22 bp, Homo sapiens
agcccctctgtagctaatagta

SEQ ID NO: 8759464 - DNA, 22 bp, Homo sapiens
agcccctccagtggcataaaat

SEQ ID NO: 8759465 - DNA, 22 bp, Homo sapiens
agcccctctccgccctgagtcg

SEQ ID NO: 8759466 - DNA, 22 bp, Homo sapiens
agcccctctccgccctgagtcg

SEQ ID NO: 8759467 - DNA, 22 bp, Homo sapiens
agccatctctgaaatcaaagct

SEQ ID NO: 8759468 - DNA, 22 bp, Homo sapiens
agccatgggagactgtgggaga

SEQ ID NO: 8759469 - DNA, 22 bp, Homo sapiens
agccatggcgccactagaggga

SEQ ID NO: 8759470 - DNA, 22 bp, Homo sapiens
agccatgggagactgtgggaga

SEQ ID NO: 8759471 - DNA, 22 bp, Homo sapiens
agccatggcgccactagaggga

SEQ ID NO: 8759472 - DNA, 22 bp, Homo sapiens
agccatggcgccactagaggga

SEQ ID NO: 8759473 - DNA, 22 bp, Homo sapiens
agccatggcgccactagaggga

SEQ ID NO: 8759474 - DNA, 22 bp, Homo sapiens
agccatgttaaatggacttgat

SEQ ID NO: 8759475 - DNA, 22 bp, Homo sapiens
agccatgggctcccagtccttt

SEQ ID NO: 8759476 - DNA, 22 bp, Homo sapiens
agccatggtctcagggccataa

SEQ ID NO: 8759477 - DNA, 22 bp, Homo sapiens
agccatgggctcccagtccttt

SEQ ID NO: 8759478 - DNA, 22 bp, Homo sapiens
agccacagtctgatgcctgaga

SEQ ID NO: 8759479 - DNA, 22 bp, Homo sapiens
agccacagtctgatgcctgaga

SEQ ID NO: 8759480 - DNA, 22 bp, Homo sapiens
agccagggtgggtgaatgctat

SEQ ID NO: 8759481 - DNA, 22 bp, Homo sapiens
agccacagtcaacctgtccata

SEQ ID NO: 8759482 - DNA, 22 bp, Homo sapiens
agccacagtcaacctgtccata

SEQ ID NO: 8759483 - DNA, 22 bp, Homo sapiens
agccacaggtgttggccagtgt

SEQ ID NO: 8759484 - DNA, 22 bp, Homo sapiens
agccacagtcaacctgtccata

SEQ ID NO: 8759485 - DNA, 22 bp, Homo sapiens
agccacaggtgttggccagtgt

SEQ ID NO: 8759486 - DNA, 22 bp, Homo sapiens
agccacaggtgttggccagtgt

SEQ ID NO: 8759487 - DNA, 22 bp, Homo sapiens
agccacaggtgttggccagtgt

SEQ ID NO: 8759488 - DNA, 22 bp, Homo sapiens
agccacagtcaacctgtccata

SEQ ID NO: 8759489 - DNA, 22 bp, Homo sapiens
agccacagtcaacctgtccata

SEQ ID NO: 8759490 - DNA, 22 bp, Homo sapiens
agcccagctgcctgcctgctgt

SEQ ID NO: 8759491 - DNA, 22 bp, Homo sapiens
agcccagctgcctgcctgctgt

SEQ ID NO: 8759492 - DNA, 22 bp, Homo sapiens
agcccagctgcctgcctgctgt

SEQ ID NO: 8759493 - DNA, 22 bp, Homo sapiens
agcccagctcctccacagaata

SEQ ID NO: 8759494 - DNA, 22 bp, Homo sapiens
agcccagctcctccacagaata

SEQ ID NO: 8759495 - DNA, 18 bp, Homo sapiens
agcccagcggagtgaatc

SEQ ID NO: 8759496 - DNA, 22 bp, Homo sapiens
agcccagcctgattctacaccc

SEQ ID NO: 8759497 - DNA, 22 bp, Homo sapiens
agcccaaacctgcgagcagagc

SEQ ID NO: 8759498 - DNA, 22 bp, Homo sapiens
agccattttggtaatgataaca

SEQ ID NO: 8759499 - DNA, 22 bp, Homo sapiens
agccattttggtaatgataaca

SEQ ID NO: 8759500 - DNA, 22 bp, Homo sapiens
agccattttcctgaaatataac

SEQ ID NO: 8759501 - DNA, 22 bp, Homo sapiens
agccattttcctgaaatataac

SEQ ID NO: 8759502 - DNA, 22 bp, Homo sapiens
acagagagggagtgataaatcc

SEQ ID NO: 8759503 - DNA, 22 bp, Homo sapiens
acagagagggagtgataaatcc

SEQ ID NO: 8759504 - DNA, 22 bp, Homo sapiens
acagagagggagtgataaatcc

SEQ ID NO: 8759505 - DNA, 22 bp, Homo sapiens
agcccagcttccttctgtctct

SEQ ID NO: 8759506 - DNA, 22 bp, Homo sapiens
agcccagcttccttctgtctct

SEQ ID NO: 8759507 - DNA, 19 bp, Homo sapiens
agcccagcttatttgtcag

SEQ ID NO: 8759508 - DNA, 22 bp, Homo sapiens
acagagcagtaagaacacagct

SEQ ID NO: 8759509 - DNA, 22 bp, Homo sapiens
acagagcaggtccagaagtgcc

SEQ ID NO: 8759510 - DNA, 22 bp, Homo sapiens
acagagcaggtccagaagtgcc

SEQ ID NO: 8759511 - DNA, 22 bp, Homo sapiens
acagagcaggtccagaagtgcc

SEQ ID NO: 8759512 - DNA, 17 bp, Homo sapiens
acagagcacatcaagat

SEQ ID NO: 8759513 - DNA, 17 bp, Homo sapiens
acagagcacatcaagat

SEQ ID NO: 8759514 - DNA, 17 bp, Homo sapiens
acagagcacatcaagat

SEQ ID NO: 8759515 - DNA, 22 bp, Homo sapiens
agctatatagatggtgtgtttg

SEQ ID NO: 8759516 - DNA, 22 bp, Homo sapiens
agctagttcagagagatatgta

SEQ ID NO: 8759517 - DNA, 22 bp, Homo sapiens
agctagttaaactatgaataca

SEQ ID NO: 8759518 - DNA, 22 bp, Homo sapiens
agctagttaaactatgaataca

SEQ ID NO: 8759519 - DNA, 22 bp, Homo sapiens
agctatggaacagagtggctgt

SEQ ID NO: 8759520 - DNA, 22 bp, Homo sapiens
agctatgaagccacttttaaca

SEQ ID NO: 8759521 - DNA, 22 bp, Homo sapiens
agctatcaccttaataaactga

SEQ ID NO: 8759522 - DNA, 22 bp, Homo sapiens
agctatcaccttaataaactga

SEQ ID NO: 8759523 - DNA, 22 bp, Homo sapiens
agctatcagtaggaccatgttc

SEQ ID NO: 8759524 - DNA, 22 bp, Homo sapiens
agctatctcaggcactcacatt

SEQ ID NO: 8759525 - DNA, 22 bp, Homo sapiens
agctatcaccttaataaactga

SEQ ID NO: 8759526 - DNA, 22 bp, Homo sapiens
agctaggataagcagagactgg

SEQ ID NO: 8759527 - DNA, 22 bp, Homo sapiens
agctagtatttcattgaggatt

SEQ ID NO: 8759528 - DNA, 22 bp, Homo sapiens
agctaggggaccaaggtggccc

SEQ ID NO: 8759529 - DNA, 22 bp, Homo sapiens
acagcaatcaatatggcattct

SEQ ID NO: 8759530 - DNA, 22 bp, Homo sapiens
acagcaatctgagagacatagt

SEQ ID NO: 8759531 - DNA, 21 bp, Homo sapiens
acagcaagccttcacatgagt

SEQ ID NO: 8759532 - DNA, 21 bp, Homo sapiens
acagcaagccttcctttcagg

SEQ ID NO: 8759533 - DNA, 22 bp, Homo sapiens
acagcaagccagcttgtcactg

SEQ ID NO: 8759534 - DNA, 21 bp, Homo sapiens
acagcaagccttcacatgagt

SEQ ID NO: 8759535 - DNA, 23 bp, Homo sapiens
acagcaagaggaccagatgtgag

SEQ ID NO: 8759536 - DNA, 23 bp, Homo sapiens
acagcaagaggaccagatgtgag

SEQ ID NO: 8759537 - DNA, 22 bp, Homo sapiens
acagcaagacccctagcatggt

SEQ ID NO: 8759538 - DNA, 22 bp, Homo sapiens
acagattgaagtccagaatggc

SEQ ID NO: 8759539 - DNA, 22 bp, Homo sapiens
acagatttaggactgtagcgat

SEQ ID NO: 8759540 - DNA, 23 bp, Homo sapiens
acagattggccatgagtcaccaa

SEQ ID NO: 8759541 - DNA, 21 bp, Homo sapiens
acagattgctgagctctacct

SEQ ID NO: 8759542 - DNA, 22 bp, Homo sapiens
acagattgcttagaattgaatg

SEQ ID NO: 8759543 - DNA, 17 bp, Homo sapiens
agcctgctgatctcaca

SEQ ID NO: 8759544 - DNA, 17 bp, Homo sapiens
agcctgctgatctcaca

SEQ ID NO: 8759545 - DNA, 22 bp, Homo sapiens
agcctgcgcggcctggggcgaa

SEQ ID NO: 8759546 - DNA, 22 bp, Homo sapiens
agcctgcgatcccacctggcct

SEQ ID NO: 8759547 - DNA, 22 bp, Homo sapiens
agcctgcgatcccacctggcct

SEQ ID NO: 8759548 - DNA, 22 bp, Homo sapiens
agcctgccttgggctgcttgag

SEQ ID NO: 8759549 - DNA, 22 bp, Homo sapiens
agcctgcgatcccacctggcct

SEQ ID NO: 8759550 - DNA, 22 bp, Homo sapiens
acagcaagacccctagcatggt

SEQ ID NO: 8759551 - DNA, 22 bp, Homo sapiens
acagcaagacccctagcatggt

SEQ ID NO: 8759552 - DNA, 22 bp, Homo sapiens
acagcaaatggttttctgtctg

SEQ ID NO: 8759553 - DNA, 22 bp, Homo sapiens
acagcaaaggacgaacactctg

SEQ ID NO: 8759554 - DNA, 22 bp, Homo sapiens
acagcaaaggacgaacactctg

SEQ ID NO: 8759555 - DNA, 22 bp, Homo sapiens
agcctgcctcagactcaggata

SEQ ID NO: 8759556 - DNA, 22 bp, Homo sapiens
agcctgcctcagactcaggata

SEQ ID NO: 8759557 - DNA, 22 bp, Homo sapiens
agcctgcctgtgaggctttgag

SEQ ID NO: 8759558 - DNA, 21 bp, Homo sapiens
agcctgcctgaactctgtggc

SEQ ID NO: 8759559 - DNA, 22 bp, Homo sapiens
agcctgcctgtgaggctttgag

SEQ ID NO: 8759560 - DNA, 17 bp, Homo sapiens
agcctgccccatgctgc

SEQ ID NO: 8759561 - DNA, 17 bp, Homo sapiens
agcctgccccatgctgc

SEQ ID NO: 8759562 - DNA, 22 bp, Homo sapiens
agcctgcctcagactcaggata

SEQ ID NO: 8759563 - DNA, 20 bp, Homo sapiens
agcctgccagctggcccaga

SEQ ID NO: 8759564 - DNA, 20 bp, Homo sapiens
agcctgccagctggcccaga

SEQ ID NO: 8759565 - DNA, 22 bp, Homo sapiens
agcctgccaggcgctgcctgga

SEQ ID NO: 8759566 - DNA, 22 bp, Homo sapiens
agcctgccaggcgctgcctgga

SEQ ID NO: 8759567 - DNA, 22 bp, Homo sapiens
acagataaggcagttaagagtt

SEQ ID NO: 8759568 - DNA, 22 bp, Homo sapiens
agcctgattttgataattatat

SEQ ID NO: 8759569 - DNA, 20 bp, Homo sapiens
agcctgccagctggcccaga

SEQ ID NO: 8759570 - DNA, 22 bp, Homo sapiens
agctcaagcgtgggctgggcgc

SEQ ID NO: 8759571 - DNA, 21 bp, Homo sapiens
agctatttcagatttgagagc

SEQ ID NO: 8759572 - DNA, 22 bp, Homo sapiens
agctatttcaaagtttgagaca

SEQ ID NO: 8759573 - DNA, 22 bp, Homo sapiens
agctatttcaggaaatttgtga

SEQ ID NO: 8759574 - DNA, 22 bp, Homo sapiens
acagcaggatttggcgatgttg

SEQ ID NO: 8759575 - DNA, 22 bp, Homo sapiens
acagcaggagccttcatatgct

SEQ ID NO: 8759576 - DNA, 22 bp, Homo sapiens
acagcaggcatgaatgacactg

SEQ ID NO: 8759577 - DNA, 22 bp, Homo sapiens
agctcctgtgtgcccacctgct

SEQ ID NO: 8759578 - DNA, 22 bp, Homo sapiens
acagcaggcacacaaggataga

SEQ ID NO: 8759579 - DNA, 22 bp, Homo sapiens
acagcaggatttggcgatgttg

SEQ ID NO: 8759580 - DNA, 22 bp, Homo sapiens
acagcaggcacacaaggataga

SEQ ID NO: 8759581 - DNA, 22 bp, Homo sapiens
acagcaggcacacaaggataga

SEQ ID NO: 8759582 - DNA, 22 bp, Homo sapiens
acagcaggcatgaagaaatgtt

SEQ ID NO: 8759583 - DNA, 22 bp, Homo sapiens
acagcaggcatgaagaaatgtt

SEQ ID NO: 8759584 - DNA, 22 bp, Homo sapiens
agctctgggctgacatgctccc

SEQ ID NO: 8759585 - DNA, 18 bp, Homo sapiens
agctctggggagatgggc

SEQ ID NO: 8759586 - DNA, 18 bp, Homo sapiens
agctctggggagatgggc

SEQ ID NO: 8759587 - DNA, 22 bp, Homo sapiens
agctctcattactttacagatg

SEQ ID NO: 8759588 - DNA, 22 bp, Homo sapiens
agctctccatctatctgtgatg

SEQ ID NO: 8759589 - DNA, 22 bp, Homo sapiens
agctctgggctgacatgctccc

SEQ ID NO: 8759590 - DNA, 22 bp, Homo sapiens
agctctgggggaaagtctgctc

SEQ ID NO: 8759591 - DNA, 22 bp, Homo sapiens
agctctgggggaaagtctgctc

SEQ ID NO: 8759592 - DNA, 22 bp, Homo sapiens
agctctgggggaaagtctgctc

SEQ ID NO: 8759593 - DNA, 22 bp, Homo sapiens
agctctggggtagggcccaaca

SEQ ID NO: 8759594 - DNA, 19 bp, Homo sapiens
agctcctgttcagcagctc

SEQ ID NO: 8759595 - DNA, 22 bp, Homo sapiens
agctcctgttctgagagcagga

SEQ ID NO: 8759596 - DNA, 22 bp, Homo sapiens
agctcctgttctgagagcagga

SEQ ID NO: 8759597 - DNA, 22 bp, Homo sapiens
agctcctgttctgagagcagga

SEQ ID NO: 8759598 - DNA, 22 bp, Homo sapiens
agctccttgaattaatgctgct

SEQ ID NO: 8759599 - DNA, 22 bp, Homo sapiens
agctctaaatggaattttgcct

SEQ ID NO: 8759600 - DNA, 22 bp, Homo sapiens
agctccttgaagggctctggga

SEQ ID NO: 8759601 - DNA, 22 bp, Homo sapiens
agctctatcacctgtcagttgc

SEQ ID NO: 8759602 - DNA, 21 bp, Homo sapiens
agctctatgacttggccaggt

SEQ ID NO: 8759603 - DNA, 22 bp, Homo sapiens
agctctcaagataagaaagaac

SEQ ID NO: 8759604 - DNA, 22 bp, Homo sapiens
acagaaagataggcacaaggtc

SEQ ID NO: 8759605 - DNA, 22 bp, Homo sapiens
acagaaagataggcacaaggtc

SEQ ID NO: 8759606 - DNA, 22 bp, Homo sapiens
agcagttactagttaaatgcat

SEQ ID NO: 8759607 - DNA, 22 bp, Homo sapiens
acagaaagataggcacaaggtc

SEQ ID NO: 8759608 - DNA, 22 bp, Homo sapiens
agcagtgtttaggcattcagta

SEQ ID NO: 8759609 - DNA, 22 bp, Homo sapiens
agcagtgttggtgggagcatct

SEQ ID NO: 8759610 - DNA, 22 bp, Homo sapiens
agcagttacgggcctatctagg

SEQ ID NO: 8759611 - DNA, 22 bp, Homo sapiens
agcagtgttttagccatttctg

SEQ ID NO: 8759612 - DNA, 18 bp, Homo sapiens
agcagtgtggcaagcaga

SEQ ID NO: 8759613 - DNA, 22 bp, Homo sapiens
agcagtgtgggctgcacgctgg

SEQ ID NO: 8759614 - DNA, 18 bp, Homo sapiens
agcagtgtggcaagcaga

SEQ ID NO: 8759615 - DNA, 22 bp, Homo sapiens
agcagtggtgtgaggagggctc

SEQ ID NO: 8759616 - DNA, 18 bp, Homo sapiens
agcagtgtgacctgaaga

SEQ ID NO: 8759617 - DNA, 22 bp, Homo sapiens
agcagtggtgtgaggagggctc

SEQ ID NO: 8759618 - DNA, 22 bp, Homo sapiens
agcagtggctggatggtgtgct

SEQ ID NO: 8759619 - DNA, 22 bp, Homo sapiens
agcagtgggggagtgttagttt

SEQ ID NO: 8759620 - DNA, 22 bp, Homo sapiens
acactgtgcagattccctgtga

SEQ ID NO: 8759621 - DNA, 22 bp, Homo sapiens
acactgtgatttctgggttcca

SEQ ID NO: 8759622 - DNA, 22 bp, Homo sapiens
acactgtgatcttgagaaaggt

SEQ ID NO: 8759623 - DNA, 21 bp, Homo sapiens
acactgtgtcataatgcttaa

SEQ ID NO: 8759624 - DNA, 22 bp, Homo sapiens
agcagtggctgacagacttacc

SEQ ID NO: 8759625 - DNA, 22 bp, Homo sapiens
acactgtgtctagcattttaca

SEQ ID NO: 8759626 - DNA, 20 bp, Homo sapiens
acactgtgctaaggattttc

SEQ ID NO: 8759627 - DNA, 22 bp, Homo sapiens
agccacaggtgttggccagtgt

SEQ ID NO: 8759628 - DNA, 22 bp, Homo sapiens
agccacagggggtgagggacaa

SEQ ID NO: 8759629 - DNA, 22 bp, Homo sapiens
agccacagggggtgagggacaa

SEQ ID NO: 8759630 - DNA, 22 bp, Homo sapiens
agccacagggggtgagggacaa

SEQ ID NO: 8759631 - DNA, 22 bp, Homo sapiens
agccacagggggtgagggacaa

SEQ ID NO: 8759632 - DNA, 22 bp, Homo sapiens
agccacaggccatgagatacca

SEQ ID NO: 8759633 - DNA, 22 bp, Homo sapiens
agccacaggccatgagatacca

SEQ ID NO: 8759634 - DNA, 22 bp, Homo sapiens
agccacaggccatgagatacca

SEQ ID NO: 8759635 - DNA, 22 bp, Homo sapiens
agccacaggaaacagagacagc

SEQ ID NO: 8759636 - DNA, 22 bp, Homo sapiens
agccacaggaaacagagacagc

SEQ ID NO: 8759637 - DNA, 22 bp, Homo sapiens
acagaacaagacctgcttattg

SEQ ID NO: 8759638 - DNA, 22 bp, Homo sapiens
acagaacaagacctgcttattg

SEQ ID NO: 8759639 - DNA, 22 bp, Homo sapiens
agccacaggaaacagagacagc

SEQ ID NO: 8759640 - DNA, 22 bp, Homo sapiens
acagaacaacaaggtggaccag

SEQ ID NO: 8759641 - DNA, 22 bp, Homo sapiens
acagaacaacaaggtggaccag

SEQ ID NO: 8759642 - DNA, 22 bp, Homo sapiens
acagaaattgggcaaatggaag

SEQ ID NO: 8759643 - DNA, 22 bp, Homo sapiens
acagaaattgggcaaatggaag

SEQ ID NO: 8759644 - DNA, 22 bp, Homo sapiens
acagaaattgggcaaatggaag

SEQ ID NO: 8759645 - DNA, 22 bp, Homo sapiens
acagaaattgggcaaatggaag

SEQ ID NO: 8759646 - DNA, 22 bp, Homo sapiens
acagaaattgctaatagctcat

SEQ ID NO: 8759647 - DNA, 22 bp, Homo sapiens
acagaaattgctaatagctcat

SEQ ID NO: 8759648 - DNA, 22 bp, Homo sapiens
acagaaattgctaatagctcat

SEQ ID NO: 8759649 - DNA, 22 bp, Homo sapiens
acagaaattgctaatagctcat

SEQ ID NO: 8759650 - DNA, 22 bp, Homo sapiens
acagaaattctgggacagaaaa

SEQ ID NO: 8759651 - DNA, 22 bp, Homo sapiens
acagaaattgctaatagctcat

SEQ ID NO: 8759652 - DNA, 22 bp, Homo sapiens
acagaaattgctaatagctcat

SEQ ID NO: 8759653 - DNA, 19 bp, Homo sapiens
acagaaattagttattttc

SEQ ID NO: 8759654 - DNA, 22 bp, Homo sapiens
acagaaattcaaactggaattt

SEQ ID NO: 8759655 - DNA, 19 bp, Homo sapiens
acagaaattagttattttc

SEQ ID NO: 8759656 - DNA, 22 bp, Homo sapiens
acactgtagatatagagttagt

SEQ ID NO: 8759657 - DNA, 22 bp, Homo sapiens
acactgtaggagaaaggagttt

SEQ ID NO: 8759658 - DNA, 18 bp, Homo sapiens
acactgcagcagtctgct

SEQ ID NO: 8759659 - DNA, 22 bp, Homo sapiens
acactgtaaagtgatgcttaaa

SEQ ID NO: 8759660 - DNA, 23 bp, Homo sapiens
acactgtctcatggatagactgc

SEQ ID NO: 8759661 - DNA, 22 bp, Homo sapiens
acactgtgagctgaagggctgc

SEQ ID NO: 8759662 - DNA, 22 bp, Homo sapiens
acactgtgagctgaagggctgc

SEQ ID NO: 8759663 - DNA, 22 bp, Homo sapiens
acactgtgacaaaggctgttct

SEQ ID NO: 8759664 - DNA, 22 bp, Homo sapiens
acactgtgacaagaaagagctg

SEQ ID NO: 8759665 - DNA, 22 bp, Homo sapiens
acactgtatgaaaacaggaaat

SEQ ID NO: 8759666 - DNA, 22 bp, Homo sapiens
acactgtctgggactcaggagt

SEQ ID NO: 8759667 - DNA, 22 bp, Homo sapiens
agcagggcccactaggggagat

SEQ ID NO: 8759668 - DNA, 22 bp, Homo sapiens
acactgcagatgaaagcataag

SEQ ID NO: 8759669 - DNA, 22 bp, Homo sapiens
agcagggcccactaggggagat

SEQ ID NO: 8759670 - DNA, 22 bp, Homo sapiens
agcagggcccactaggggagat

SEQ ID NO: 8759671 - DNA, 22 bp, Homo sapiens
agcagggcccactaggggagat

SEQ ID NO: 8759672 - DNA, 22 bp, Homo sapiens
agcagggccaacagtaaacacc

SEQ ID NO: 8759673 - DNA, 23 bp, Homo sapiens
agcagggccagaatacttgctgt

SEQ ID NO: 8759674 - DNA, 22 bp, Homo sapiens
agcagggcagttaaagggtcct

SEQ ID NO: 8759675 - DNA, 22 bp, Homo sapiens
agcagggcagttaaagggtcct

SEQ ID NO: 8759676 - DNA, 18 bp, Homo sapiens
agcagggcattttgccat

SEQ ID NO: 8759677 - DNA, 22 bp, Homo sapiens
agcagggcatgaataagggttt

SEQ ID NO: 8759678 - DNA, 22 bp, Homo sapiens
agcagggcagtgcttcagctct

SEQ ID NO: 8759679 - DNA, 22 bp, Homo sapiens
agcagggcatgaataagggttt

SEQ ID NO: 8759680 - DNA, 23 bp, Homo sapiens
agcaggaaaccgagggtgatgtt

SEQ ID NO: 8759681 - DNA, 23 bp, Homo sapiens
agcaggaaaccgagggtgatgtt

SEQ ID NO: 8759682 - DNA, 23 bp, Homo sapiens
agcaggaaaccgagggtgatgtt

SEQ ID NO: 8759683 - DNA, 22 bp, Homo sapiens
acacattatctcattaaatact

SEQ ID NO: 8759684 - DNA, 22 bp, Homo sapiens
acacattatctcattaaatact

SEQ ID NO: 8759685 - DNA, 22 bp, Homo sapiens
acacatttgcataatacctcat

SEQ ID NO: 8759686 - DNA, 19 bp, Homo sapiens
acacatttgcacaatccac

SEQ ID NO: 8759687 - DNA, 22 bp, Homo sapiens
acacatttgctaaaatgagctc

SEQ ID NO: 8759688 - DNA, 19 bp, Homo sapiens
acacatttgcacaatccac

SEQ ID NO: 8759689 - DNA, 22 bp, Homo sapiens
acaccaaagtagaattaatgta

SEQ ID NO: 8759690 - DNA, 22 bp, Homo sapiens
acaccaaagtagaattaatgta

SEQ ID NO: 8759691 - DNA, 23 bp, Homo sapiens
acacatttttcccgttctgaggt

SEQ ID NO: 8759692 - DNA, 23 bp, Homo sapiens
acacatttttcccgttctgaggt

SEQ ID NO: 8759693 - DNA, 22 bp, Homo sapiens
acaccagggatatgaggaagga

SEQ ID NO: 8759694 - DNA, 22 bp, Homo sapiens
acaccagcctcgcccgtgtgtt

SEQ ID NO: 8759695 - DNA, 22 bp, Homo sapiens
acacattttctaacagggatca

SEQ ID NO: 8759696 - DNA, 22 bp, Homo sapiens
acacattttcaacactgtcaag

SEQ ID NO: 8759697 - DNA, 22 bp, Homo sapiens
acacattttctaacagggatca

SEQ ID NO: 8759698 - DNA, 22 bp, Homo sapiens
acacattttggctaggtggaga

SEQ ID NO: 8759699 - DNA, 22 bp, Homo sapiens
acacattttgttaaaccctgtg

SEQ ID NO: 8759700 - DNA, 22 bp, Homo sapiens
acacattttcaacactgtcaag

SEQ ID NO: 8759701 - DNA, 22 bp, Homo sapiens
agcaccctcccaccctctcaga

SEQ ID NO: 8759702 - DNA, 22 bp, Homo sapiens
agcacccttcagcccagcctgg

SEQ ID NO: 8759703 - DNA, 22 bp, Homo sapiens
agcacccttcagcccagcctgg

SEQ ID NO: 8759704 - DNA, 22 bp, Homo sapiens
agcaccatttatcatctaggta

SEQ ID NO: 8759705 - DNA, 22 bp, Homo sapiens
agcaccattgcaaatatggcag

SEQ ID NO: 8759706 - DNA, 22 bp, Homo sapiens
agcaccatttctctaaagcact

SEQ ID NO: 8759707 - DNA, 22 bp, Homo sapiens
agcaccctcagccttatccaga

SEQ ID NO: 8759708 - DNA, 23 bp, Homo sapiens
agcaccattacagtttgattggg

SEQ ID NO: 8759709 - DNA, 22 bp, Homo sapiens
agcaccatcgggttcttgcttt

SEQ ID NO: 8759710 - DNA, 22 bp, Homo sapiens
agcaccatgaccttgccattga

SEQ ID NO: 8759711 - DNA, 22 bp, Homo sapiens
agcacctccagagcttgaagct

SEQ ID NO: 8759712 - DNA, 22 bp, Homo sapiens
agcaccctttgtgagcataagt

SEQ ID NO: 8759713 - DNA, 22 bp, Homo sapiens
agcacctgcacagtggaggaaa

SEQ ID NO: 8759714 - DNA, 22 bp, Homo sapiens
agcacctgcacagtggaggaaa

SEQ ID NO: 8759715 - DNA, 22 bp, Homo sapiens
agcacctgcacagtggaggaaa

SEQ ID NO: 8759716 - DNA, 22 bp, Homo sapiens
agcacctccttagctatgacca

SEQ ID NO: 8759717 - DNA, 22 bp, Homo sapiens
acaattgcattgtcacaaataa

SEQ ID NO: 8759718 - DNA, 22 bp, Homo sapiens
acaatttcaccttttggttcaa

SEQ ID NO: 8759719 - DNA, 22 bp, Homo sapiens
acaatttatccattgtatagtt

SEQ ID NO: 8759720 - DNA, 22 bp, Homo sapiens
acaatttatccattgtatagtt

SEQ ID NO: 8759721 - DNA, 22 bp, Homo sapiens
acaatttatccattgtatagtt

SEQ ID NO: 8759722 - DNA, 22 bp, Homo sapiens
acaattctgatggtttcccagt

SEQ ID NO: 8759723 - DNA, 22 bp, Homo sapiens
acaattctgatggtttcccagt

SEQ ID NO: 8759724 - DNA, 22 bp, Homo sapiens
agcacctgctatgtgtcaggga

SEQ ID NO: 8759725 - DNA, 22 bp, Homo sapiens
acaattttaagccagagtgggt

SEQ ID NO: 8759726 - DNA, 22 bp, Homo sapiens
acaattttaagccagagtgggt

SEQ ID NO: 8759727 - DNA, 22 bp, Homo sapiens
acacagatgggtagaaaacaga

SEQ ID NO: 8759728 - DNA, 22 bp, Homo sapiens
acaatttctgatcagtgaattt

SEQ ID NO: 8759729 - DNA, 22 bp, Homo sapiens
acaatttctgatcagtgaattt

SEQ ID NO: 8759730 - DNA, 22 bp, Homo sapiens
acaatttctgatcagtgaattt

SEQ ID NO: 8759731 - DNA, 20 bp, Homo sapiens
acaatttcctcactatatgc

SEQ ID NO: 8759732 - DNA, 22 bp, Homo sapiens
acaatttgaggctactcaattg

SEQ ID NO: 8759733 - DNA, 22 bp, Homo sapiens
acacagatgggtagaaaacaga

SEQ ID NO: 8759734 - DNA, 22 bp, Homo sapiens
acacaggaactctgagaggtgg

SEQ ID NO: 8759735 - DNA, 22 bp, Homo sapiens
acacagcaacttgcagtatgga

SEQ ID NO: 8759736 - DNA, 22 bp, Homo sapiens
acacaggaactctgagaggtgg

SEQ ID NO: 8759737 - DNA, 22 bp, Homo sapiens
acacaggaactctgagaggtgg

SEQ ID NO: 8759738 - DNA, 22 bp, Homo sapiens
acacaggaagagagataataat

SEQ ID NO: 8759739 - DNA, 22 bp, Homo sapiens
acacaggaagagagataataat

SEQ ID NO: 8759740 - DNA, 22 bp, Homo sapiens
acacaggagatatgtaatggct

SEQ ID NO: 8759741 - DNA, 22 bp, Homo sapiens
acacaggagatatgtaatggct

SEQ ID NO: 8759742 - DNA, 22 bp, Homo sapiens
acacaggagaaaagatctccca

SEQ ID NO: 8759743 - DNA, 22 bp, Homo sapiens
acacaggagagagttgggaagg

SEQ ID NO: 8759744 - DNA, 22 bp, Homo sapiens
acacaggagagagttgggaagg

SEQ ID NO: 8759745 - DNA, 22 bp, Homo sapiens
acacaggaggaggatggtggtc

SEQ ID NO: 8759746 - DNA, 22 bp, Homo sapiens
acacaggaggaggatggtggtc

SEQ ID NO: 8759747 - DNA, 21 bp, Homo sapiens
acacaggagtttcttctttct

SEQ ID NO: 8759748 - DNA, 21 bp, Homo sapiens
acacaggagtttcttctttct

SEQ ID NO: 8759749 - DNA, 23 bp, Homo sapiens
acacaggatacatacggaagcaa

SEQ ID NO: 8759750 - DNA, 23 bp, Homo sapiens
acacaggatacatacggaagcaa

SEQ ID NO: 8759751 - DNA, 21 bp, Homo sapiens
acacaggagtttcttctttct

SEQ ID NO: 8759752 - DNA, 21 bp, Homo sapiens
acacaggagtttcttctttct

SEQ ID NO: 8759753 - DNA, 22 bp, Homo sapiens
acacaggaagcaatttcagagc

SEQ ID NO: 8759754 - DNA, 22 bp, Homo sapiens
acacaggaagtcagcactgatg

SEQ ID NO: 8759755 - DNA, 22 bp, Homo sapiens
acacaggaagtcagcactgatg

SEQ ID NO: 8759756 - DNA, 22 bp, Homo sapiens
acacaggagaaaagatctccca

SEQ ID NO: 8759757 - DNA, 22 bp, Homo sapiens
acacaggacggccctgtggctt

SEQ ID NO: 8759758 - DNA, 22 bp, Homo sapiens
acacaggacggccctgtggctt

SEQ ID NO: 8759759 - DNA, 22 bp, Homo sapiens
acacaggacggccctgtggctt

SEQ ID NO: 8759760 - DNA, 22 bp, Homo sapiens
acacaggacggccctgtggctt

SEQ ID NO: 8759761 - DNA, 22 bp, Homo sapiens
acacaggacagggatgtgtttt

SEQ ID NO: 8759762 - DNA, 22 bp, Homo sapiens
acacaggacagggatgtgtttt

SEQ ID NO: 8759763 - DNA, 22 bp, Homo sapiens
acacaggacagggatgtgtttt

SEQ ID NO: 8759764 - DNA, 22 bp, Homo sapiens
agcagcagtacatataagacta

SEQ ID NO: 8759765 - DNA, 22 bp, Homo sapiens
agcagcagtacatataagacta

SEQ ID NO: 8759766 - DNA, 22 bp, Homo sapiens
agcagcagtacatataagacta

SEQ ID NO: 8759767 - DNA, 22 bp, Homo sapiens
agcagcagtcatgcctatgctc

SEQ ID NO: 8759768 - DNA, 22 bp, Homo sapiens
agcagcagtcatgcctatgctc

SEQ ID NO: 8759769 - DNA, 22 bp, Homo sapiens
acacaggcaagagtgcaggtct

SEQ ID NO: 8759770 - DNA, 22 bp, Homo sapiens
acacaggcaatgtgagtgggag

SEQ ID NO: 8759771 - DNA, 22 bp, Homo sapiens
acacaggcaagagtgcaggtct

SEQ ID NO: 8759772 - DNA, 22 bp, Homo sapiens
acacaggcaatgtgagtgggag

SEQ ID NO: 8759773 - DNA, 22 bp, Homo sapiens
agcagcaggtgcttctggatct

SEQ ID NO: 8759774 - DNA, 22 bp, Homo sapiens
agcagcagtgtggtttggggaa

SEQ ID NO: 8759775 - DNA, 22 bp, Homo sapiens
agcagcagtcctttgtgtaatt

SEQ ID NO: 8759776 - DNA, 22 bp, Homo sapiens
acacatatattatttgtggctc

SEQ ID NO: 8759777 - DNA, 22 bp, Homo sapiens
acacataagaaactacaaagag

SEQ ID NO: 8759778 - DNA, 22 bp, Homo sapiens
acacataagaaactacaaagag

SEQ ID NO: 8759779 - DNA, 22 bp, Homo sapiens
acacataagaaactacaaagag

SEQ ID NO: 8759780 - DNA, 22 bp, Homo sapiens
agcagcagtgtgtggtcatgtt

SEQ ID NO: 8759781 - DNA, 18 bp, Homo sapiens
agcagctttgtgcttgat

SEQ ID NO: 8759782 - DNA, 22 bp, Homo sapiens
acacatatgtatgcatcatgtg

SEQ ID NO: 8759783 - DNA, 22 bp, Homo sapiens
agcagcttgaggctggattcca

SEQ ID NO: 8759784 - DNA, 22 bp, Homo sapiens
acacatatgtatgcatcatgtg

SEQ ID NO: 8759785 - DNA, 21 bp, Homo sapiens
agcagcttgagtctggagctc

SEQ ID NO: 8759786 - DNA, 22 bp, Homo sapiens
agcagcttggggccgagataga

SEQ ID NO: 8759787 - DNA, 22 bp, Homo sapiens
acacatatatttgcatatacac

SEQ ID NO: 8759788 - DNA, 22 bp, Homo sapiens
acacatatatttgcatatacac

SEQ ID NO: 8759789 - DNA, 22 bp, Homo sapiens
acacatatatttgcatatacac

SEQ ID NO: 8759790 - DNA, 23 bp, Homo sapiens
acacatatattcagatacagatg

SEQ ID NO: 8759791 - DNA, 23 bp, Homo sapiens
acacatatattcagatacagatg

SEQ ID NO: 8759792 - DNA, 22 bp, Homo sapiens
acacatatatttgcatatacac

SEQ ID NO: 8759793 - DNA, 23 bp, Homo sapiens
acacatatattcagatacagatg

SEQ ID NO: 8759794 - DNA, 22 bp, Homo sapiens
acacatatgccattacagcaaa

SEQ ID NO: 8759795 - DNA, 22 bp, Homo sapiens
acacatatgccattacagcaaa

SEQ ID NO: 8759796 - DNA, 22 bp, Homo sapiens
acacatatctaagatagatgac

SEQ ID NO: 8759797 - DNA, 22 bp, Homo sapiens
acacatatctaagatagatgac

SEQ ID NO: 8759798 - DNA, 22 bp, Homo sapiens
acacatatctaagatagatgac

SEQ ID NO: 8759799 - DNA, 22 bp, Homo sapiens
aagttactatgactcttctttt

SEQ ID NO: 8759800 - DNA, 22 bp, Homo sapiens
aagttacattttggtctaattg

SEQ ID NO: 8759801 - DNA, 22 bp, Homo sapiens
aagttagagattccatcatgct

SEQ ID NO: 8759802 - DNA, 22 bp, Homo sapiens
aagttactatgactcttctttt

SEQ ID NO: 8759803 - DNA, 22 bp, Homo sapiens
aagttactggcaagggctgcag

SEQ ID NO: 8759804 - DNA, 22 bp, Homo sapiens
aagttactggcaagggctgcag

SEQ ID NO: 8759805 - DNA, 22 bp, Homo sapiens
aagttactggcaagggctgcag

SEQ ID NO: 8759806 - DNA, 22 bp, Homo sapiens
aagttaggcttagttgagattt

SEQ ID NO: 8759807 - DNA, 22 bp, Homo sapiens
aagttaggttgcattggtcatc

SEQ ID NO: 8759808 - DNA, 22 bp, Homo sapiens
aagttaggcttagttgagattt

SEQ ID NO: 8759809 - DNA, 22 bp, Homo sapiens
aagttaggatgaatgccttagc

SEQ ID NO: 8759810 - DNA, 22 bp, Homo sapiens
aagttaggagagtaaagtggta

SEQ ID NO: 8759811 - DNA, 22 bp, Homo sapiens
aagttagagattccatcatgct

SEQ ID NO: 8759812 - DNA, 23 bp, Homo sapiens
aagttagtttcaataaagcaatt

SEQ ID NO: 8759813 - DNA, 22 bp, Homo sapiens
aagttagtggataaacagcaaa

SEQ ID NO: 8759814 - DNA, 22 bp, Homo sapiens
aagttatctgatatctttgagg

SEQ ID NO: 8759815 - DNA, 22 bp, Homo sapiens
aagttattgcagcaatccaagt

SEQ ID NO: 8759816 - DNA, 22 bp, Homo sapiens
actaatagagacaaacatagat

SEQ ID NO: 8759817 - DNA, 22 bp, Homo sapiens
actaatagagacaaacatagat

SEQ ID NO: 8759818 - DNA, 22 bp, Homo sapiens
actaagtagtttcacatataat

SEQ ID NO: 8759819 - DNA, 22 bp, Homo sapiens
actaacttgctgagtgaccatg

SEQ ID NO: 8759820 - DNA, 22 bp, Homo sapiens
actaacttgctgagtgaccatg

SEQ ID NO: 8759821 - DNA, 22 bp, Homo sapiens
actaagacctaaaattgtgaat

SEQ ID NO: 8759822 - DNA, 23 bp, Homo sapiens
actaaggcttctttaagacagag

SEQ ID NO: 8759823 - DNA, 22 bp, Homo sapiens
actaagatgcaggaaatgctag

SEQ ID NO: 8759824 - DNA, 22 bp, Homo sapiens
actaagacctagatactagggg

SEQ ID NO: 8759825 - DNA, 22 bp, Homo sapiens
actaatagagacaaacatagat

SEQ ID NO: 8759826 - DNA, 22 bp, Homo sapiens
actacaatactcttagtaaaag

SEQ ID NO: 8759827 - DNA, 22 bp, Homo sapiens
actacaatactcttagtaaaag

SEQ ID NO: 8759828 - DNA, 22 bp, Homo sapiens
actacaaaagcactgggtatta

SEQ ID NO: 8759829 - DNA, 22 bp, Homo sapiens
actacaaaagcactgggtatta

SEQ ID NO: 8759830 - DNA, 22 bp, Homo sapiens
aagtgttttggcttctgtacac

SEQ ID NO: 8759831 - DNA, 22 bp, Homo sapiens
aagtgttttggcttctgtacac

SEQ ID NO: 8759832 - DNA, 22 bp, Homo sapiens
aagtgttttgtaaacagaaaag

SEQ ID NO: 8759833 - DNA, 22 bp, Homo sapiens
aagtgttttggcttctgtacac

SEQ ID NO: 8759834 - DNA, 22 bp, Homo sapiens
aagtgttttggcttctgtacac

SEQ ID NO: 8759835 - DNA, 20 bp, Homo sapiens
aagtgttttgacttctgacc

SEQ ID NO: 8759836 - DNA, 20 bp, Homo sapiens
aagtgttttgacttctgacc

SEQ ID NO: 8759837 - DNA, 20 bp, Homo sapiens
aagtgttttgacttctgacc

SEQ ID NO: 8759838 - DNA, 20 bp, Homo sapiens
aagtgttttgacttctgacc

SEQ ID NO: 8759839 - DNA, 22 bp, Homo sapiens
actacaatactcttagtaaaag

SEQ ID NO: 8759840 - DNA, 22 bp, Homo sapiens
aagttatttcctcgtgactgaa

SEQ ID NO: 8759841 - DNA, 22 bp, Homo sapiens
aagttcaaattggggcctgtga

SEQ ID NO: 8759842 - DNA, 22 bp, Homo sapiens
aagttcaagagtgacatattag

SEQ ID NO: 8759843 - DNA, 22 bp, Homo sapiens
aagttcaagagtgacatattag

SEQ ID NO: 8759844 - DNA, 22 bp, Homo sapiens
aagttcaagatcaaggttccag

SEQ ID NO: 8759845 - DNA, 22 bp, Homo sapiens
aagttcaaggaagcctccagtt

SEQ ID NO: 8759846 - DNA, 22 bp, Homo sapiens
aagttcaagctctgcctaaaat

SEQ ID NO: 8759847 - DNA, 22 bp, Homo sapiens
aagttcaaggaagcctccagtt

SEQ ID NO: 8759848 - DNA, 22 bp, Homo sapiens
aagttcaagctctgcctaaaat

SEQ ID NO: 8759849 - DNA, 22 bp, Homo sapiens
aagttcaagctctgcctaaaat

SEQ ID NO: 8759850 - DNA, 22 bp, Homo sapiens
aagttcaagatcaaggttccag

SEQ ID NO: 8759851 - DNA, 22 bp, Homo sapiens
aagttcaaattggggcctgtga

SEQ ID NO: 8759852 - DNA, 22 bp, Homo sapiens
aagttcaaaaatgtaatcagtg

SEQ ID NO: 8759853 - DNA, 22 bp, Homo sapiens
aagttcaaaaatgtaatcagtg

SEQ ID NO: 8759854 - DNA, 22 bp, Homo sapiens
aagttcaaaaatgtaatcagtg

SEQ ID NO: 8759855 - DNA, 22 bp, Homo sapiens
aagttatttttcaagatccttt

SEQ ID NO: 8759856 - DNA, 22 bp, Homo sapiens
aagttattggtggagagcactg

SEQ ID NO: 8759857 - DNA, 22 bp, Homo sapiens
aagttatttttcaagatccttt

SEQ ID NO: 8759858 - DNA, 20 bp, Homo sapiens
actccaggtggcatgaggac

SEQ ID NO: 8759859 - DNA, 22 bp, Homo sapiens
actccaggttttctctcaagtt

SEQ ID NO: 8759860 - DNA, 20 bp, Homo sapiens
actccaggtggcatgaggac

SEQ ID NO: 8759861 - DNA, 22 bp, Homo sapiens
aagttcaaggcaggtcctgagg

SEQ ID NO: 8759862 - DNA, 22 bp, Homo sapiens
aagttcaaggcaggtcctgagg

SEQ ID NO: 8759863 - DNA, 22 bp, Homo sapiens
actcccagaacatgctcttctt

SEQ ID NO: 8759864 - DNA, 22 bp, Homo sapiens
actccccagactgccatgctgg

SEQ ID NO: 8759865 - DNA, 22 bp, Homo sapiens
actccccagactgccatgctgg

SEQ ID NO: 8759866 - DNA, 18 bp, Homo sapiens
actccccacaggctctgt

SEQ ID NO: 8759867 - DNA, 22 bp, Homo sapiens
aagtggactaatacaaggacta

SEQ ID NO: 8759868 - DNA, 22 bp, Homo sapiens
aagtgcttttttcttgaggcca

SEQ ID NO: 8759869 - DNA, 22 bp, Homo sapiens
aagtgctttttcttgagctgct

SEQ ID NO: 8759870 - DNA, 23 bp, Homo sapiens
aagtgctttgggatggagtctgg

SEQ ID NO: 8759871 - DNA, 22 bp, Homo sapiens
aagtgctttataaacaatgaag

SEQ ID NO: 8759872 - DNA, 22 bp, Homo sapiens
aagtgctttaaaatttcctgag

SEQ ID NO: 8759873 - DNA, 22 bp, Homo sapiens
aagtgctttacaaatgtctgtt

SEQ ID NO: 8759874 - DNA, 22 bp, Homo sapiens
aagtcaggaagtgcaaaagttg

SEQ ID NO: 8759875 - DNA, 22 bp, Homo sapiens
aagtcaggtgagactctctggg

SEQ ID NO: 8759876 - DNA, 22 bp, Homo sapiens
aagtcaggtgagactctctggg

SEQ ID NO: 8759877 - DNA, 22 bp, Homo sapiens
aagtgcatagtaatggagtcaa

SEQ ID NO: 8759878 - DNA, 22 bp, Homo sapiens
aagtgcatacactagttaattg

SEQ ID NO: 8759879 - DNA, 22 bp, Homo sapiens
aagtgcataataactcccaagt

SEQ ID NO: 8759880 - DNA, 22 bp, Homo sapiens
aagtgcttggctaatggttatg

SEQ ID NO: 8759881 - DNA, 21 bp, Homo sapiens
aagtggagaagaaaagctgga

SEQ ID NO: 8759882 - DNA, 22 bp, Homo sapiens
aagtggagccagggaaactgaa

SEQ ID NO: 8759883 - DNA, 22 bp, Homo sapiens
aagtggactaatacaaggacta

SEQ ID NO: 8759884 - DNA, 22 bp, Homo sapiens
actaaatgctgcataaatgctt

SEQ ID NO: 8759885 - DNA, 23 bp, Homo sapiens
actaaatggggctttgcttaaag

SEQ ID NO: 8759886 - DNA, 22 bp, Homo sapiens
actaaatgaactattaatactt

SEQ ID NO: 8759887 - DNA, 22 bp, Homo sapiens
actaaatgagatactgtcttca

SEQ ID NO: 8759888 - DNA, 22 bp, Homo sapiens
actaaatttgtcaatgacactt

SEQ ID NO: 8759889 - DNA, 22 bp, Homo sapiens
actaaatttgtcaatgacactt

SEQ ID NO: 8759890 - DNA, 22 bp, Homo sapiens
actaaatttgtcaatgacactt

SEQ ID NO: 8759891 - DNA, 22 bp, Homo sapiens
actaacatgttaatcaaaagaa

SEQ ID NO: 8759892 - DNA, 22 bp, Homo sapiens
actaacttctgagaaccaattg

SEQ ID NO: 8759893 - DNA, 22 bp, Homo sapiens
actaaatttgtcaatgacactt

SEQ ID NO: 8759894 - DNA, 22 bp, Homo sapiens
aagtcacattctgaggtattgg

SEQ ID NO: 8759895 - DNA, 22 bp, Homo sapiens
aagtcacattctgaggtattgg

SEQ ID NO: 8759896 - DNA, 22 bp, Homo sapiens
aagtcacagctaaatagctaag

SEQ ID NO: 8759897 - DNA, 22 bp, Homo sapiens
aagtcacagctaaatagctaag

SEQ ID NO: 8759898 - DNA, 22 bp, Homo sapiens
aagtcacagaacccattgtaac

SEQ ID NO: 8759899 - DNA, 22 bp, Homo sapiens
aagtcacactagacaactgagg

SEQ ID NO: 8759900 - DNA, 22 bp, Homo sapiens
aagtcacactgctgggaactct

SEQ ID NO: 8759901 - DNA, 22 bp, Homo sapiens
aagtcacactagacaactgagg

SEQ ID NO: 8759902 - DNA, 22 bp, Homo sapiens
aagtcacagaacccattgtaac

SEQ ID NO: 8759903 - DNA, 22 bp, Homo sapiens
aagtcactggcaaaagctgcag

SEQ ID NO: 8759904 - DNA, 22 bp, Homo sapiens
aagtcacccacaggcagcagaa

SEQ ID NO: 8759905 - DNA, 18 bp, Homo sapiens
aagtcacccctgctccct

SEQ ID NO: 8759906 - DNA, 22 bp, Homo sapiens
aagtcaccccacactcttggga

SEQ ID NO: 8759907 - DNA, 22 bp, Homo sapiens
aagtcaccctagggcctggact

SEQ ID NO: 8759908 - DNA, 22 bp, Homo sapiens
aagtcagaaaacagagcaatta

SEQ ID NO: 8759909 - DNA, 22 bp, Homo sapiens
aagtcagaaaacagagcaatta

SEQ ID NO: 8759910 - DNA, 22 bp, Homo sapiens
aagtcagaaatatctgccatca

SEQ ID NO: 8759911 - DNA, 22 bp, Homo sapiens
aagtcagaccttgttgatagct

SEQ ID NO: 8759912 - DNA, 22 bp, Homo sapiens
aagtcagacagctgagctgcct

SEQ ID NO: 8759913 - DNA, 23 bp, Homo sapiens
aagtcagagccaagtcaatgaga

SEQ ID NO: 8759914 - DNA, 22 bp, Homo sapiens
aagtcagagcaactgagacatt

SEQ ID NO: 8759915 - DNA, 22 bp, Homo sapiens
aagtcagagatgccaaagatta

SEQ ID NO: 8759916 - DNA, 22 bp, Homo sapiens
aagtcagagcaactgagacatt

SEQ ID NO: 8759917 - DNA, 22 bp, Homo sapiens
aagtcagagcaactgagacatt

SEQ ID NO: 8759918 - DNA, 22 bp, Homo sapiens
aagtcagagatgccaaagatta

SEQ ID NO: 8759919 - DNA, 22 bp, Homo sapiens
aagtttatgttggtaagatatc

SEQ ID NO: 8759920 - DNA, 22 bp, Homo sapiens
aagtttatgttggtaagatatc

SEQ ID NO: 8759921 - DNA, 22 bp, Homo sapiens
aagtttatgttggtaagatatc

SEQ ID NO: 8759922 - DNA, 22 bp, Homo sapiens
aagtttatgttggtaagatatc

SEQ ID NO: 8759923 - DNA, 22 bp, Homo sapiens
aagtttcaaatgttgattatgc

SEQ ID NO: 8759924 - DNA, 22 bp, Homo sapiens
aagtttcaaatgttgattatgc

SEQ ID NO: 8759925 - DNA, 22 bp, Homo sapiens
aagtttcaaatataaaattaca

SEQ ID NO: 8759926 - DNA, 22 bp, Homo sapiens
aagtttattaattgacttgtgc

SEQ ID NO: 8759927 - DNA, 22 bp, Homo sapiens
aagtttattaattgacttgtgc

SEQ ID NO: 8759928 - DNA, 22 bp, Homo sapiens
aagtttcatgatgtaattattg

SEQ ID NO: 8759929 - DNA, 22 bp, Homo sapiens
aagtttcatgatgtaattattg

SEQ ID NO: 8759930 - DNA, 22 bp, Homo sapiens
aagtttcattgttcatgtaaca

SEQ ID NO: 8759931 - DNA, 22 bp, Homo sapiens
aagtttcatttctggatgctga

SEQ ID NO: 8759932 - DNA, 22 bp, Homo sapiens
aagtttcatgtggaggtagact

SEQ ID NO: 8759933 - DNA, 22 bp, Homo sapiens
aataagaatttacttgtcaaga

SEQ ID NO: 8759934 - DNA, 22 bp, Homo sapiens
aataagacacacaactgtcaag

SEQ ID NO: 8759935 - DNA, 22 bp, Homo sapiens
aataagactctgctagaaattc

SEQ ID NO: 8759936 - DNA, 22 bp, Homo sapiens
aataacttcagttcttacatta

SEQ ID NO: 8759937 - DNA, 22 bp, Homo sapiens
aataacttcagttcttacatta

SEQ ID NO: 8759938 - DNA, 22 bp, Homo sapiens
aataacttcagttcttacatta

SEQ ID NO: 8759939 - DNA, 22 bp, Homo sapiens
aataacttaagaaatttcccca

SEQ ID NO: 8759940 - DNA, 22 bp, Homo sapiens
aataacttaagaaatttcccca

SEQ ID NO: 8759941 - DNA, 22 bp, Homo sapiens
aataacttaagaaatttcccca

SEQ ID NO: 8759942 - DNA, 22 bp, Homo sapiens
aagtttctcaatggcaactggg

SEQ ID NO: 8759943 - DNA, 22 bp, Homo sapiens
aataagaattgccagatttgaa

SEQ ID NO: 8759944 - DNA, 22 bp, Homo sapiens
aataagaattgccagatttgaa

SEQ ID NO: 8759945 - DNA, 22 bp, Homo sapiens
aataagaattgccagatttgaa

SEQ ID NO: 8759946 - DNA, 22 bp, Homo sapiens
aataagaattgccagatttgaa

SEQ ID NO: 8759947 - DNA, 22 bp, Homo sapiens
aataagaattgccagatttgaa

SEQ ID NO: 8759948 - DNA, 22 bp, Homo sapiens
aagtttatgttctttgaaggca

SEQ ID NO: 8759949 - DNA, 22 bp, Homo sapiens
aagtttatgttggtaagatatc

SEQ ID NO: 8759950 - DNA, 22 bp, Homo sapiens
aagtttactggggagatcacct

SEQ ID NO: 8759951 - DNA, 22 bp, Homo sapiens
aagtttagaactataagagtga

SEQ ID NO: 8759952 - DNA, 20 bp, Homo sapiens
aagttggctcctcctagcaa

SEQ ID NO: 8759953 - DNA, 22 bp, Homo sapiens
aagttctatagtctttctacta

SEQ ID NO: 8759954 - DNA, 22 bp, Homo sapiens
aagttctaggtagtgctctttc

SEQ ID NO: 8759955 - DNA, 22 bp, Homo sapiens
aagttctacagcttcgcaggca

SEQ ID NO: 8759956 - DNA, 22 bp, Homo sapiens
aagttctactgtgggtaaaatg

SEQ ID NO: 8759957 - DNA, 22 bp, Homo sapiens
aagttctaattttgcattcagg

SEQ ID NO: 8759958 - DNA, 22 bp, Homo sapiens
aagttctagaggttgatttggt

SEQ ID NO: 8759959 - DNA, 22 bp, Homo sapiens
aagttctagaggttgatttggt

SEQ ID NO: 8759960 - DNA, 22 bp, Homo sapiens
aagttggtaggagacagaaggt

SEQ ID NO: 8759961 - DNA, 22 bp, Homo sapiens
aagttggttctgtgacatgttg

SEQ ID NO: 8759962 - DNA, 22 bp, Homo sapiens
aagttgtagtcagatgtcagtt

SEQ ID NO: 8759963 - DNA, 21 bp, Homo sapiens
aagttgtctcttttggttcct

SEQ ID NO: 8759964 - DNA, 22 bp, Homo sapiens
aagttgtagtcagatgtcagtt

SEQ ID NO: 8759965 - DNA, 21 bp, Homo sapiens
aagttgtctcttttggttcct

SEQ ID NO: 8759966 - DNA, 22 bp, Homo sapiens
aagtttaaggtggaagtggtgg

SEQ ID NO: 8759967 - DNA, 22 bp, Homo sapiens
aagtttaacttgaattctttct

SEQ ID NO: 8759968 - DNA, 22 bp, Homo sapiens
aagtttaacttgaattctttct

SEQ ID NO: 8759969 - DNA, 22 bp, Homo sapiens
aagtttaacttgaattctttct

SEQ ID NO: 8759970 - DNA, 22 bp, Homo sapiens
aataagattgacacaagtacct

SEQ ID NO: 8759971 - DNA, 23 bp, Homo sapiens
actgcctgtgccgatctctctca

SEQ ID NO: 8759972 - DNA, 22 bp, Homo sapiens
actgcctgtgtcccttcagtgc

SEQ ID NO: 8759973 - DNA, 23 bp, Homo sapiens
actgcctgtgccgatctctctca

SEQ ID NO: 8759974 - DNA, 22 bp, Homo sapiens
aataagattgacacaagtacct

SEQ ID NO: 8759975 - DNA, 22 bp, Homo sapiens
actgcctgtttggcatggcccc

SEQ ID NO: 8759976 - DNA, 22 bp, Homo sapiens
actgcctgtttggcatggcccc

SEQ ID NO: 8759977 - DNA, 22 bp, Homo sapiens
actgcctgtgtcccttcagtgc

SEQ ID NO: 8759978 - DNA, 22 bp, Homo sapiens
actgcctgtgtcccttcagtgc

SEQ ID NO: 8759979 - DNA, 22 bp, Homo sapiens
actgcctgtttggcatggcccc

SEQ ID NO: 8759980 - DNA, 22 bp, Homo sapiens
actgccttcaaacagcgccacc

SEQ ID NO: 8759981 - DNA, 22 bp, Homo sapiens
actgccttccacctatggatga

SEQ ID NO: 8759982 - DNA, 22 bp, Homo sapiens
actgccttcatgcagacccctg

SEQ ID NO: 8759983 - DNA, 22 bp, Homo sapiens
actgccttataatatgtcaaca

SEQ ID NO: 8759984 - DNA, 22 bp, Homo sapiens
actgccttatatgctgtgtgtg

SEQ ID NO: 8759985 - DNA, 22 bp, Homo sapiens
actgccttagaacaaagcagga

SEQ ID NO: 8759986 - DNA, 22 bp, Homo sapiens
actgccttctttaatcctagtt

SEQ ID NO: 8759987 - DNA, 22 bp, Homo sapiens
actgccttcttggccttcaaaa

SEQ ID NO: 8759988 - DNA, 22 bp, Homo sapiens
actgccttctgctcagggttca

SEQ ID NO: 8759989 - DNA, 22 bp, Homo sapiens
actgccttgattcatgctgatg

SEQ ID NO: 8759990 - DNA, 20 bp, Homo sapiens
actgccttggttcagtaggt

SEQ ID NO: 8759991 - DNA, 22 bp, Homo sapiens
actgccttgtctcttgcctgtt

SEQ ID NO: 8759992 - DNA, 20 bp, Homo sapiens
actgcctttaggtatccttg

SEQ ID NO: 8759993 - DNA, 22 bp, Homo sapiens
actgccttgaaagattgttgag

SEQ ID NO: 8759994 - DNA, 22 bp, Homo sapiens
actgccttgattgccagtttcc

SEQ ID NO: 8759995 - DNA, 22 bp, Homo sapiens
aataatagttgcaaagtgttta

SEQ ID NO: 8759996 - DNA, 22 bp, Homo sapiens
actgcgctccagcctgggtgac

SEQ ID NO: 8759997 - DNA, 22 bp, Homo sapiens
actgccttttccattacttaat

SEQ ID NO: 8759998 - DNA, 22 bp, Homo sapiens
actgcgctccagcctgggtgac

SEQ ID NO: 8759999 - DNA, 22 bp, Homo sapiens
aataatgtttatttgtattctc

SEQ ID NO: 8760000 - DNA, 22 bp, Homo sapiens
aataatgttatgtcattcttct

SEQ ID NO: 8760001 - DNA, 22 bp, Homo sapiens
aataatgtttatttgtattctc

SEQ ID NO: 8760002 - DNA, 22 bp, Homo sapiens
aataattacccatctttttgta

SEQ ID NO: 8760003 - DNA, 22 bp, Homo sapiens
aataattagtgggacagagaac

SEQ ID NO: 8760004 - DNA, 22 bp, Homo sapiens
aataattttgagagcctggaaa

SEQ ID NO: 8760005 - DNA, 22 bp, Homo sapiens
aataattttagctcagagttgt

SEQ ID NO: 8760006 - DNA, 21 bp, Homo sapiens
aataattcagacattgttgtt

SEQ ID NO: 8760007 - DNA, 22 bp, Homo sapiens
aataattgtcaactatgctaca

SEQ ID NO: 8760008 - DNA, 22 bp, Homo sapiens
aataattagtgggacagagaac

SEQ ID NO: 8760009 - DNA, 22 bp, Homo sapiens
aataattatttgagagcagacc

SEQ ID NO: 8760010 - DNA, 22 bp, Homo sapiens
aataattatttgagagcagacc

SEQ ID NO: 8760011 - DNA, 22 bp, Homo sapiens
agaaatactaggaatattcata

SEQ ID NO: 8760012 - DNA, 22 bp, Homo sapiens
agaaatactaggaatattcata

SEQ ID NO: 8760013 - DNA, 22 bp, Homo sapiens
agaaatactaggaatattcata

SEQ ID NO: 8760014 - DNA, 22 bp, Homo sapiens
agaaatactaggaatattcata

SEQ ID NO: 8760015 - DNA, 22 bp, Homo sapiens
agaaatactaggaatattcata

SEQ ID NO: 8760016 - DNA, 22 bp, Homo sapiens
agaaatactaggaatattcata

SEQ ID NO: 8760017 - DNA, 22 bp, Homo sapiens
agaaatactaggaatattcata

SEQ ID NO: 8760018 - DNA, 18 bp, Homo sapiens
agaaataccagtattgga

SEQ ID NO: 8760019 - DNA, 20 bp, Homo sapiens
agaaataccacatttggcaa

SEQ ID NO: 8760020 - DNA, 18 bp, Homo sapiens
agaaataccagtattgga

SEQ ID NO: 8760021 - DNA, 20 bp, Homo sapiens
agaaataccacatttggcaa

SEQ ID NO: 8760022 - DNA, 20 bp, Homo sapiens
agaaatacatgcatgcatga

SEQ ID NO: 8760023 - DNA, 20 bp, Homo sapiens
agaaatacatgcatgcatga

SEQ ID NO: 8760024 - DNA, 22 bp, Homo sapiens
agaaataagagctttccttggg

SEQ ID NO: 8760025 - DNA, 22 bp, Homo sapiens
agaaataagagctttccttggg

SEQ ID NO: 8760026 - DNA, 20 bp, Homo sapiens
agaaatacatgcatgcatga

SEQ ID NO: 8760027 - DNA, 20 bp, Homo sapiens
agaaatacatgcatgcatga

SEQ ID NO: 8760028 - DNA, 20 bp, Homo sapiens
agaaatacatgcatgcatga

SEQ ID NO: 8760029 - DNA, 22 bp, Homo sapiens
agaaatacaaagtactaagata

SEQ ID NO: 8760030 - DNA, 22 bp, Homo sapiens
agaaatacaaagtactaagata

SEQ ID NO: 8760031 - DNA, 22 bp, Homo sapiens
aatgaacaggtgaatgtcagat

SEQ ID NO: 8760032 - DNA, 22 bp, Homo sapiens
aatgaacagatacacataggca

SEQ ID NO: 8760033 - DNA, 22 bp, Homo sapiens
aatgaacacttagcctttctat

SEQ ID NO: 8760034 - DNA, 22 bp, Homo sapiens
aatgaacacgctggtggtgcaa

SEQ ID NO: 8760035 - DNA, 22 bp, Homo sapiens
aatgaacagtgggtgaggtacc

SEQ ID NO: 8760036 - DNA, 22 bp, Homo sapiens
aatgaacatataaagagatctt

SEQ ID NO: 8760037 - DNA, 22 bp, Homo sapiens
aatgaacatcaaatgcctacca

SEQ ID NO: 8760038 - DNA, 22 bp, Homo sapiens
aatgaacatggacaagttaata

SEQ ID NO: 8760039 - DNA, 22 bp, Homo sapiens
aatgaacatggacaagttaata

SEQ ID NO: 8760040 - DNA, 23 bp, Homo sapiens
aatgaactgagaatctgtacagt

SEQ ID NO: 8760041 - DNA, 23 bp, Homo sapiens
aatgaactgagaatctgtacagt

SEQ ID NO: 8760042 - DNA, 22 bp, Homo sapiens
aatgaactccgaacatttacat

SEQ ID NO: 8760043 - DNA, 22 bp, Homo sapiens
aatgaacggtgtccatctgttt

SEQ ID NO: 8760044 - DNA, 22 bp, Homo sapiens
aatgaacatgggagtactaata

SEQ ID NO: 8760045 - DNA, 22 bp, Homo sapiens
aatgaacatgggagtactaata

SEQ ID NO: 8760046 - DNA, 22 bp, Homo sapiens
agaaaacattacataggtgtgt

SEQ ID NO: 8760047 - DNA, 22 bp, Homo sapiens
agaaaacattacataggtgtgt

SEQ ID NO: 8760048 - DNA, 22 bp, Homo sapiens
agaaaactgcagagtagcctca

SEQ ID NO: 8760049 - DNA, 22 bp, Homo sapiens
agaaaactgcagagtagcctca

SEQ ID NO: 8760050 - DNA, 22 bp, Homo sapiens
aatgaaactatatttagagagg

SEQ ID NO: 8760051 - DNA, 22 bp, Homo sapiens
agaaaacattacataggtgtgt

SEQ ID NO: 8760052 - DNA, 22 bp, Homo sapiens
aatgaacaagagagagaacttt

SEQ ID NO: 8760053 - DNA, 22 bp, Homo sapiens
aatgaaactcgaaataatcaca

SEQ ID NO: 8760054 - DNA, 22 bp, Homo sapiens
aatgaacaagaaagactttgag

SEQ ID NO: 8760055 - DNA, 22 bp, Homo sapiens
aatgaacacatgtggtcagttt

SEQ ID NO: 8760056 - DNA, 22 bp, Homo sapiens
aatgaacacttagcctttctat

SEQ ID NO: 8760057 - DNA, 22 bp, Homo sapiens
aatgaacacagccctctacttt

SEQ ID NO: 8760058 - DNA, 22 bp, Homo sapiens
aatgaacacagccctctacttt

SEQ ID NO: 8760059 - DNA, 22 bp, Homo sapiens
agaaaacataggagacaggaaa

SEQ ID NO: 8760060 - DNA, 22 bp, Homo sapiens
agaaaacataggagacaggaaa

SEQ ID NO: 8760061 - DNA, 22 bp, Homo sapiens
agaaaacataggagacaggaaa

SEQ ID NO: 8760062 - DNA, 22 bp, Homo sapiens
agaaaacataggagacaggaaa

SEQ ID NO: 8760063 - DNA, 22 bp, Homo sapiens
agaaaacataggagacaggaaa

SEQ ID NO: 8760064 - DNA, 22 bp, Homo sapiens
agaaaacataggagacaggaaa

SEQ ID NO: 8760065 - DNA, 22 bp, Homo sapiens
agaaaacataggagacaggaaa

SEQ ID NO: 8760066 - DNA, 22 bp, Homo sapiens
agaaaacagaaagtcattggtg

SEQ ID NO: 8760067 - DNA, 22 bp, Homo sapiens
agaaaacagaaagtcattggtg

SEQ ID NO: 8760068 - DNA, 22 bp, Homo sapiens
agaaaacagaaagtcattggtg

SEQ ID NO: 8760069 - DNA, 22 bp, Homo sapiens
agaaaacagaaagtcattggtg

SEQ ID NO: 8760070 - DNA, 22 bp, Homo sapiens
aatcctggcatgtgccttggga

SEQ ID NO: 8760071 - DNA, 22 bp, Homo sapiens
agaaaaatcttggcgcttgtct

SEQ ID NO: 8760072 - DNA, 22 bp, Homo sapiens
agaaaaatcttggcgcttgtct

SEQ ID NO: 8760073 - DNA, 22 bp, Homo sapiens
agaaaacactgccccctctctc

SEQ ID NO: 8760074 - DNA, 22 bp, Homo sapiens
agaaaacactgccccctctctc

SEQ ID NO: 8760075 - DNA, 22 bp, Homo sapiens
aatgagaactgggagttggtgg

SEQ ID NO: 8760076 - DNA, 22 bp, Homo sapiens
aatgagaatgtaagtgaagaga

SEQ ID NO: 8760077 - DNA, 22 bp, Homo sapiens
aatgagaatgtaagtgaagaga

SEQ ID NO: 8760078 - DNA, 22 bp, Homo sapiens
aatgagaatgtaagtgaagaga

SEQ ID NO: 8760079 - DNA, 22 bp, Homo sapiens
aatgagaagcctaggtgtactg

SEQ ID NO: 8760080 - DNA, 23 bp, Homo sapiens
aatgagagaccatgtggagcaga

SEQ ID NO: 8760081 - DNA, 22 bp, Homo sapiens
aatgagagaagacaggcaagtg

SEQ ID NO: 8760082 - DNA, 22 bp, Homo sapiens
aatgagagaagacaggcaagtg

SEQ ID NO: 8760083 - DNA, 22 bp, Homo sapiens
aatgactttgaaatatttgagt

SEQ ID NO: 8760084 - DNA, 19 bp, Homo sapiens
aatgactgagtacattgtc

SEQ ID NO: 8760085 - DNA, 22 bp, Homo sapiens
aatgagaaccttgaaaggaact

SEQ ID NO: 8760086 - DNA, 22 bp, Homo sapiens
aatgagaaccttgaaaggaact

SEQ ID NO: 8760087 - DNA, 22 bp, Homo sapiens
aatgagaaaacacagaggaggt

SEQ ID NO: 8760088 - DNA, 22 bp, Homo sapiens
aatgagaaaacacagaggaggt

SEQ ID NO: 8760089 - DNA, 22 bp, Homo sapiens
aatgagaaaacacagaggaggt

SEQ ID NO: 8760090 - DNA, 22 bp, Homo sapiens
aatgacatggagcatcttttca

SEQ ID NO: 8760091 - DNA, 22 bp, Homo sapiens
aatgacctcagagcacccagaa

SEQ ID NO: 8760092 - DNA, 19 bp, Homo sapiens
aatgactgagtacattgtc

SEQ ID NO: 8760093 - DNA, 22 bp, Homo sapiens
aatgactctgctgcagagacac

SEQ ID NO: 8760094 - DNA, 22 bp, Homo sapiens
agaaatactgcctaagactgta

SEQ ID NO: 8760095 - DNA, 22 bp, Homo sapiens
agaaatactgcctaagactgta

SEQ ID NO: 8760096 - DNA, 22 bp, Homo sapiens
agaaatactgcctaagactgta

SEQ ID NO: 8760097 - DNA, 22 bp, Homo sapiens
aatgaatgtttgttgagtgaag

SEQ ID NO: 8760098 - DNA, 22 bp, Homo sapiens
aatgaatgtgattaacttcaag

SEQ ID NO: 8760099 - DNA, 20 bp, Homo sapiens
agaaatactttggtataatg

SEQ ID NO: 8760100 - DNA, 22 bp, Homo sapiens
agaagggaactcagagatgatt

SEQ ID NO: 8760101 - DNA, 22 bp, Homo sapiens
agaagggaactcagagatgatt

SEQ ID NO: 8760102 - DNA, 22 bp, Homo sapiens
agaagggaactcagagatgatt

SEQ ID NO: 8760103 - DNA, 22 bp, Homo sapiens
agaagggaactcagagatgatt

SEQ ID NO: 8760104 - DNA, 22 bp, Homo sapiens
agaagggaactcagagatgatt

SEQ ID NO: 8760105 - DNA, 22 bp, Homo sapiens
agaagggaactcagagatgatt

SEQ ID NO: 8760106 - DNA, 22 bp, Homo sapiens
agaagggaactcagagatgatt

SEQ ID NO: 8760107 - DNA, 21 bp, Homo sapiens
agaagggattgtggtaaagat

SEQ ID NO: 8760108 - DNA, 22 bp, Homo sapiens
aatgagttatttaatagaaagg

SEQ ID NO: 8760109 - DNA, 22 bp, Homo sapiens
aatgagttatttaatagaaagg

SEQ ID NO: 8760110 - DNA, 22 bp, Homo sapiens
aatgagttattaggtgtaagtg

SEQ ID NO: 8760111 - DNA, 22 bp, Homo sapiens
aatgagttagatgagaaaataa

SEQ ID NO: 8760112 - DNA, 22 bp, Homo sapiens
aatgagttagatgagaaaataa

SEQ ID NO: 8760113 - DNA, 22 bp, Homo sapiens
aatgagttctgacacttcacga

SEQ ID NO: 8760114 - DNA, 19 bp, Homo sapiens
aatgagttccatgaaaaga

SEQ ID NO: 8760115 - DNA, 19 bp, Homo sapiens
aatgagttccatgaaaaga

SEQ ID NO: 8760116 - DNA, 22 bp, Homo sapiens
aatgagttctgacacttcacga

SEQ ID NO: 8760117 - DNA, 22 bp, Homo sapiens
aatgagatcagagataactcaa

SEQ ID NO: 8760118 - DNA, 20 bp, Homo sapiens
aatgagatgacttagaggaa

SEQ ID NO: 8760119 - DNA, 22 bp, Homo sapiens
aatgagatggaggactcttaat

SEQ ID NO: 8760120 - DNA, 22 bp, Homo sapiens
aatgagcaaatgaagacgctgt

SEQ ID NO: 8760121 - DNA, 22 bp, Homo sapiens
aatgagatgttgaattattgtt

SEQ ID NO: 8760122 - DNA, 22 bp, Homo sapiens
aatgagggggatgggaaagtgt

SEQ ID NO: 8760123 - DNA, 22 bp, Homo sapiens
aatgaggtgttgagaccagcac

SEQ ID NO: 8760124 - DNA, 22 bp, Homo sapiens
aatgaggttggcataattaaat

SEQ ID NO: 8760125 - DNA, 22 bp, Homo sapiens
aatgaggttttttaaagccaga

SEQ ID NO: 8760126 - DNA, 22 bp, Homo sapiens
aatgagctgctgctgttccacc

SEQ ID NO: 8760127 - DNA, 21 bp, Homo sapiens
aatgaggcaaggaggaggata

SEQ ID NO: 8760128 - DNA, 22 bp, Homo sapiens
aatgaggcttgcattgtgaact

SEQ ID NO: 8760129 - DNA, 22 bp, Homo sapiens
aatgaggccagtagaaggaagt

SEQ ID NO: 8760130 - DNA, 22 bp, Homo sapiens
aatacagagaatgttatttgga

SEQ ID NO: 8760131 - DNA, 22 bp, Homo sapiens
aatacagagaatgttatttgga

SEQ ID NO: 8760132 - DNA, 22 bp, Homo sapiens
aatacagagaatgttatttgga

SEQ ID NO: 8760133 - DNA, 21 bp, Homo sapiens
aatacagaaatgagtagttgc

SEQ ID NO: 8760134 - DNA, 21 bp, Homo sapiens
aatacagaaatgagtagttgc

SEQ ID NO: 8760135 - DNA, 22 bp, Homo sapiens
acttcttttcaaatcatgcaaa

SEQ ID NO: 8760136 - DNA, 19 bp, Homo sapiens
acttcttttcaacacagga

SEQ ID NO: 8760137 - DNA, 22 bp, Homo sapiens
acttcctggattcccaagggct

SEQ ID NO: 8760138 - DNA, 22 bp, Homo sapiens
acttcctggattcccaagggct

SEQ ID NO: 8760139 - DNA, 19 bp, Homo sapiens
acttcctgcccgctccttt

SEQ ID NO: 8760140 - DNA, 22 bp, Homo sapiens
aatacagagaatgttatttgga

SEQ ID NO: 8760141 - DNA, 22 bp, Homo sapiens
acttcctgctatgagcttctgt

SEQ ID NO: 8760142 - DNA, 22 bp, Homo sapiens
acttgaaaagctcagcagtagt

SEQ ID NO: 8760143 - DNA, 22 bp, Homo sapiens
acttgaaaagctcagcagtagt

SEQ ID NO: 8760144 - DNA, 22 bp, Homo sapiens
acttgaaacatctttaaatgta

SEQ ID NO: 8760145 - DNA, 19 bp, Homo sapiens
acttcttttcaacacagga

SEQ ID NO: 8760146 - DNA, 22 bp, Homo sapiens
acttgaaaccttggcaaacaat

SEQ ID NO: 8760147 - DNA, 22 bp, Homo sapiens
acttgaaaccctgagatgataa

SEQ ID NO: 8760148 - DNA, 22 bp, Homo sapiens
acttgaaaccttggcaaacaat

SEQ ID NO: 8760149 - DNA, 22 bp, Homo sapiens
acttgaataggaaagccacaaa

SEQ ID NO: 8760150 - DNA, 22 bp, Homo sapiens
acttgaataggtgtcaaggcca

SEQ ID NO: 8760151 - DNA, 21 bp, Homo sapiens
acttgaagttggagtttctgt

SEQ ID NO: 8760152 - DNA, 22 bp, Homo sapiens
acttgaattaggccttgagaga

SEQ ID NO: 8760153 - DNA, 22 bp, Homo sapiens
acttgaattcaaagcgaaagca

SEQ ID NO: 8760154 - DNA, 22 bp, Homo sapiens
acttgaattaggccttgagaga

SEQ ID NO: 8760155 - DNA, 22 bp, Homo sapiens
acttgaattatatttctagaga

SEQ ID NO: 8760156 - DNA, 22 bp, Homo sapiens
aatatatagaagtacccgttgt

SEQ ID NO: 8760157 - DNA, 22 bp, Homo sapiens
aatatatagaagtacccgttgt

SEQ ID NO: 8760158 - DNA, 22 bp, Homo sapiens
aatatatgagggagctatttga

SEQ ID NO: 8760159 - DNA, 21 bp, Homo sapiens
aatatatgcaatgctttctgc

SEQ ID NO: 8760160 - DNA, 21 bp, Homo sapiens
aatatatgcaatgctttctgc

SEQ ID NO: 8760161 - DNA, 22 bp, Homo sapiens
aatatatgactccactgcatga

SEQ ID NO: 8760162 - DNA, 22 bp, Homo sapiens
acttgattgtatgaagttattt

SEQ ID NO: 8760163 - DNA, 22 bp, Homo sapiens
aatatatagaagtacccgttgt

SEQ ID NO: 8760164 - DNA, 22 bp, Homo sapiens
acttgagagaatcggaggagtc

SEQ ID NO: 8760165 - DNA, 22 bp, Homo sapiens
acttgaggaagcagcaagggat

SEQ ID NO: 8760166 - DNA, 22 bp, Homo sapiens
acttgactttgtcatttgtgct

SEQ ID NO: 8760167 - DNA, 22 bp, Homo sapiens
acttgagagaatcggaggagtc

SEQ ID NO: 8760168 - DNA, 22 bp, Homo sapiens
acttgaatttagtttttcctaa

SEQ ID NO: 8760169 - DNA, 22 bp, Homo sapiens
aatatatttgaatcaggaacaa

SEQ ID NO: 8760170 - DNA, 22 bp, Homo sapiens
aatatatgtggtattgaccagc

SEQ ID NO: 8760171 - DNA, 23 bp, Homo sapiens
aatatatgtgtttttctgcttca

SEQ ID NO: 8760172 - DNA, 18 bp, Homo sapiens
aatatcaataagggggag

SEQ ID NO: 8760173 - DNA, 22 bp, Homo sapiens
aatattctaataaatgcccatc

SEQ ID NO: 8760174 - DNA, 19 bp, Homo sapiens
aatattttagcctcttcct

SEQ ID NO: 8760175 - DNA, 19 bp, Homo sapiens
aatattttagcctcttcct

SEQ ID NO: 8760176 - DNA, 19 bp, Homo sapiens
aatattttagcctcttcct

SEQ ID NO: 8760177 - DNA, 19 bp, Homo sapiens
aatattttagcctcttcct

SEQ ID NO: 8760178 - DNA, 22 bp, Homo sapiens
aatattcatttgcagaagaagt

SEQ ID NO: 8760179 - DNA, 22 bp, Homo sapiens
aatatcacaggaggagaccaag

SEQ ID NO: 8760180 - DNA, 22 bp, Homo sapiens
aatatcacaggaggagaccaag

SEQ ID NO: 8760181 - DNA, 22 bp, Homo sapiens
aatatcacaggaggagaccaag

SEQ ID NO: 8760182 - DNA, 22 bp, Homo sapiens
acttgtttgaatctctctagag

SEQ ID NO: 8760183 - DNA, 22 bp, Homo sapiens
acttgtttgaatctctctagag

SEQ ID NO: 8760184 - DNA, 22 bp, Homo sapiens
acttgtttgaatctctctagag

SEQ ID NO: 8760185 - DNA, 22 bp, Homo sapiens
acttgtttcaactgtactctca

SEQ ID NO: 8760186 - DNA, 22 bp, Homo sapiens
acttgtttcaactgtactctcc

SEQ ID NO: 8760187 - DNA, 22 bp, Homo sapiens
acttgtttggtctcatgtttaa

SEQ ID NO: 8760188 - DNA, 22 bp, Homo sapiens
acttgtttgcctaaaattttga

SEQ ID NO: 8760189 - DNA, 19 bp, Homo sapiens
acttgttttggaggtgatg

SEQ ID NO: 8760190 - DNA, 22 bp, Homo sapiens
actttaaaaagagccttctaac

SEQ ID NO: 8760191 - DNA, 22 bp, Homo sapiens
aatccataatgttgtggggttt

SEQ ID NO: 8760192 - DNA, 22 bp, Homo sapiens
aatccagctgtgtcacaggtga

SEQ ID NO: 8760193 - DNA, 22 bp, Homo sapiens
aatccctgaggcatcaagtaca

SEQ ID NO: 8760194 - DNA, 22 bp, Homo sapiens
aatcccttcccttctctgggac

SEQ ID NO: 8760195 - DNA, 22 bp, Homo sapiens
aatcctaaatgtcccagtggtt

SEQ ID NO: 8760196 - DNA, 22 bp, Homo sapiens
aatcctaatgtgggtccagttt

SEQ ID NO: 8760197 - DNA, 22 bp, Homo sapiens
aatcctggaatacaagagtgaa

SEQ ID NO: 8760198 - DNA, 22 bp, Homo sapiens
aatcctggaatacaagagtgaa

SEQ ID NO: 8760199 - DNA, 22 bp, Homo sapiens
aatcctggaatacaagagtgaa

SEQ ID NO: 8760200 - DNA, 22 bp, Homo sapiens
aatcctgacctgggcatgcttg

SEQ ID NO: 8760201 - DNA, 22 bp, Homo sapiens
aatcctactccaggagattctg

SEQ ID NO: 8760202 - DNA, 22 bp, Homo sapiens
aatcctcagaagaaatagcaga

SEQ ID NO: 8760203 - DNA, 22 bp, Homo sapiens
aatccataggtttttccaagag

SEQ ID NO: 8760204 - DNA, 22 bp, Homo sapiens
aatcaagagctgactatatttt

SEQ ID NO: 8760205 - DNA, 22 bp, Homo sapiens
aatcaacattgttttaagtcaa

SEQ ID NO: 8760206 - DNA, 22 bp, Homo sapiens
aatcaagagctgactatatttt

SEQ ID NO: 8760207 - DNA, 22 bp, Homo sapiens
aatcaagaggcgatggatggaa

SEQ ID NO: 8760208 - DNA, 18 bp, Homo sapiens
aatcaagagctggctgta

SEQ ID NO: 8760209 - DNA, 22 bp, Homo sapiens
acttgtaaacaaatctaatgta

SEQ ID NO: 8760210 - DNA, 21 bp, Homo sapiens
aatcaagagtactggtgtggc

SEQ ID NO: 8760211 - DNA, 22 bp, Homo sapiens
acttggttggtctcaccctgtt

SEQ ID NO: 8760212 - DNA, 22 bp, Homo sapiens
acttggttgttttaacttggca

SEQ ID NO: 8760213 - DNA, 22 bp, Homo sapiens
acttgtatggagacttggaacc

SEQ ID NO: 8760214 - DNA, 22 bp, Homo sapiens
acttgtatggagacttggaacc

SEQ ID NO: 8760215 - DNA, 22 bp, Homo sapiens
acttgttcattgagtacatatg

SEQ ID NO: 8760216 - DNA, 22 bp, Homo sapiens
acttgttagttttatctgcatg

SEQ ID NO: 8760217 - DNA, 22 bp, Homo sapiens
aatattttaggctttccaggct

SEQ ID NO: 8760218 - DNA, 22 bp, Homo sapiens
aatattttaggctttccaggct

SEQ ID NO: 8760219 - DNA, 22 bp, Homo sapiens
aatattttaggctttccaggct

SEQ ID NO: 8760220 - DNA, 22 bp, Homo sapiens
aatattttaggctttccaggct

SEQ ID NO: 8760221 - DNA, 22 bp, Homo sapiens
aatatttttgaggccctgttat

SEQ ID NO: 8760222 - DNA, 22 bp, Homo sapiens
aatatttttgaggccctgttat

SEQ ID NO: 8760223 - DNA, 22 bp, Homo sapiens
aatatttttgaggccctgttat

SEQ ID NO: 8760224 - DNA, 22 bp, Homo sapiens
aatatttttgaggccctgttat

SEQ ID NO: 8760225 - DNA, 22 bp, Homo sapiens
aatcaaaacctacagaggtaat

SEQ ID NO: 8760226 - DNA, 22 bp, Homo sapiens
aatcaaaacctacagaggtaat

SEQ ID NO: 8760227 - DNA, 22 bp, Homo sapiens
aatcaaaacctacagaggtaat

SEQ ID NO: 8760228 - DNA, 22 bp, Homo sapiens
aatcaaaacctacagaggtaat

SEQ ID NO: 8760229 - DNA, 22 bp, Homo sapiens
aatcaaagaatgggctagttgg

SEQ ID NO: 8760230 - DNA, 22 bp, Homo sapiens
aatcaaagaatgggctagttgg

SEQ ID NO: 8760231 - DNA, 22 bp, Homo sapiens
aatcaagaaaatgaggattctt

SEQ ID NO: 8760232 - DNA, 22 bp, Homo sapiens
aatcaactgtttccacagggag

SEQ ID NO: 8760233 - DNA, 22 bp, Homo sapiens
aatcaaccatatatttgatggg

SEQ ID NO: 8760234 - DNA, 22 bp, Homo sapiens
aatcaacaggatgtgcattgta

SEQ ID NO: 8760235 - DNA, 22 bp, Homo sapiens
acagtataactccatgccaccc

SEQ ID NO: 8760236 - DNA, 22 bp, Homo sapiens
acagtatacattgattaggacc

SEQ ID NO: 8760237 - DNA, 22 bp, Homo sapiens
acagtataccattgtgactttg

SEQ ID NO: 8760238 - DNA, 22 bp, Homo sapiens
aaggaaatgaggttgatggatg

SEQ ID NO: 8760239 - DNA, 22 bp, Homo sapiens
aaggaaatctttgtaacatctt

SEQ ID NO: 8760240 - DNA, 22 bp, Homo sapiens
aaggaaatctttgtaacatctt

SEQ ID NO: 8760241 - DNA, 22 bp, Homo sapiens
aaggaaatgtgcctgacactgc

SEQ ID NO: 8760242 - DNA, 22 bp, Homo sapiens
aaggaaatgaggttgatggatg

SEQ ID NO: 8760243 - DNA, 22 bp, Homo sapiens
aaggaaatgtgcctgacactgc

SEQ ID NO: 8760244 - DNA, 22 bp, Homo sapiens
aaggaaatgtgcctgacactgc

SEQ ID NO: 8760245 - DNA, 22 bp, Homo sapiens
aaggaaattaggttattttgct

SEQ ID NO: 8760246 - DNA, 22 bp, Homo sapiens
aaggaacactacaaggctggga

SEQ ID NO: 8760247 - DNA, 22 bp, Homo sapiens
aaggaacactacaaggctggga

SEQ ID NO: 8760248 - DNA, 22 bp, Homo sapiens
acagtagtgctcaatcagtgtt

SEQ ID NO: 8760249 - DNA, 22 bp, Homo sapiens
acagtagtcctttattttggtt

SEQ ID NO: 8760250 - DNA, 22 bp, Homo sapiens
acagtagtcttaatttcatgta

SEQ ID NO: 8760251 - DNA, 22 bp, Homo sapiens
acagtagtcttaatttcatgta

SEQ ID NO: 8760252 - DNA, 22 bp, Homo sapiens
acagtagtttataaaaatgttg

SEQ ID NO: 8760253 - DNA, 22 bp, Homo sapiens
acagtagtttataaaaatgttg

SEQ ID NO: 8760254 - DNA, 22 bp, Homo sapiens
acagtataaactcctaaaagcc

SEQ ID NO: 8760255 - DNA, 22 bp, Homo sapiens
acagtaggaatagatgtagata

SEQ ID NO: 8760256 - DNA, 22 bp, Homo sapiens
acagtagtctcaggaataggca

SEQ ID NO: 8760257 - DNA, 22 bp, Homo sapiens
acagtagtacacatctatgtcc

SEQ ID NO: 8760258 - DNA, 22 bp, Homo sapiens
acagtaggaatagatgtagata

SEQ ID NO: 8760259 - DNA, 22 bp, Homo sapiens
acagtagattggtatgatgtca

SEQ ID NO: 8760260 - DNA, 22 bp, Homo sapiens
acagtagattggtatgatgtca

SEQ ID NO: 8760261 - DNA, 22 bp, Homo sapiens
acagtactgtgttaactgaacc

SEQ ID NO: 8760262 - DNA, 22 bp, Homo sapiens
acagtactgctgttcttgtcct

SEQ ID NO: 8760263 - DNA, 22 bp, Homo sapiens
acagtactgctgttcttgtcct

SEQ ID NO: 8760264 - DNA, 22 bp, Homo sapiens
acagtactgagtactgagttgg

SEQ ID NO: 8760265 - DNA, 22 bp, Homo sapiens
acagtactgagtactgagttgg

SEQ ID NO: 8760266 - DNA, 22 bp, Homo sapiens
acagtactctaatgaaaagtgc

SEQ ID NO: 8760267 - DNA, 21 bp, Homo sapiens
acagtacttgagatcttttga

SEQ ID NO: 8760268 - DNA, 21 bp, Homo sapiens
acagtacttgagatcttttga

SEQ ID NO: 8760269 - DNA, 22 bp, Homo sapiens
acagtagaaacaggcaggcaga

SEQ ID NO: 8760270 - DNA, 22 bp, Homo sapiens
acagtagatggctcagagacag

SEQ ID NO: 8760271 - DNA, 22 bp, Homo sapiens
acagtagaccctggataaacat

SEQ ID NO: 8760272 - DNA, 22 bp, Homo sapiens
acagtagaggcttgatcgcagc

SEQ ID NO: 8760273 - DNA, 22 bp, Homo sapiens
acagtagagcatttgttttgat

SEQ ID NO: 8760274 - DNA, 21 bp, Homo sapiens
aaggcagaagcatggaatgag

SEQ ID NO: 8760275 - DNA, 21 bp, Homo sapiens
aaggcagaagcatggaatgag

SEQ ID NO: 8760276 - DNA, 21 bp, Homo sapiens
aaggcagaagcatggaatgag

SEQ ID NO: 8760277 - DNA, 19 bp, Homo sapiens
aaggcagaagttggatatg

SEQ ID NO: 8760278 - DNA, 19 bp, Homo sapiens
aaggcagaagttggatatg

SEQ ID NO: 8760279 - DNA, 19 bp, Homo sapiens
aaggcagaagttggatatg

SEQ ID NO: 8760280 - DNA, 22 bp, Homo sapiens
aaggcagaaattcaactactgg

SEQ ID NO: 8760281 - DNA, 22 bp, Homo sapiens
aaggcagaaagggatgtgagtg

SEQ ID NO: 8760282 - DNA, 22 bp, Homo sapiens
aaggcagaaagggatgtgagtg

SEQ ID NO: 8760283 - DNA, 22 bp, Homo sapiens
aaggcagaaagggatgtgagtg

SEQ ID NO: 8760284 - DNA, 22 bp, Homo sapiens
aaggcagaaagggatgtgagtg

SEQ ID NO: 8760285 - DNA, 22 bp, Homo sapiens
aaggcacttgcccagagctgca

SEQ ID NO: 8760286 - DNA, 22 bp, Homo sapiens
aaggcactagcaagctgcctgg

SEQ ID NO: 8760287 - DNA, 22 bp, Homo sapiens
aaggcactacgctgctggggcg

SEQ ID NO: 8760288 - DNA, 22 bp, Homo sapiens
aaggaagaagactctttactcc

SEQ ID NO: 8760289 - DNA, 22 bp, Homo sapiens
aaggaagaagactctttactcc

SEQ ID NO: 8760290 - DNA, 22 bp, Homo sapiens
aaggaactttgcagaggtgatt

SEQ ID NO: 8760291 - DNA, 22 bp, Homo sapiens
aaggaagaaatgaataggtgga

SEQ ID NO: 8760292 - DNA, 22 bp, Homo sapiens
aaggaagaaatgaataggtgga

SEQ ID NO: 8760293 - DNA, 22 bp, Homo sapiens
aaggaagaaatgaataggtgga

SEQ ID NO: 8760294 - DNA, 22 bp, Homo sapiens
aaggaactgatgctcaaagaat

SEQ ID NO: 8760295 - DNA, 22 bp, Homo sapiens
aaggcagggaaagtggattagg

SEQ ID NO: 8760296 - DNA, 22 bp, Homo sapiens
aaggcaggatgggaaaagattt

SEQ ID NO: 8760297 - DNA, 22 bp, Homo sapiens
aaggcagggaaagtggattagg

SEQ ID NO: 8760298 - DNA, 22 bp, Homo sapiens
aaggcaggatgcggacccatct

SEQ ID NO: 8760299 - DNA, 22 bp, Homo sapiens
aaggcaggatgcggacccatct

SEQ ID NO: 8760300 - DNA, 22 bp, Homo sapiens
aaggcaggatgggaaaagattt

SEQ ID NO: 8760301 - DNA, 22 bp, Homo sapiens
aaggcaggatgggaaaagattt

SEQ ID NO: 8760302 - DNA, 22 bp, Homo sapiens
aaggcaggatgggaaaagattt

SEQ ID NO: 8760303 - DNA, 22 bp, Homo sapiens
aaggcaggatgcggacccatct

SEQ ID NO: 8760304 - DNA, 22 bp, Homo sapiens
aaggcaggatgcggacccatct

SEQ ID NO: 8760305 - DNA, 22 bp, Homo sapiens
aaggcaggagctgtatcttatt

SEQ ID NO: 8760306 - DNA, 22 bp, Homo sapiens
aaggcagctttaaaaaagatgc

SEQ ID NO: 8760307 - DNA, 22 bp, Homo sapiens
aaggcagctcagctcatggcag

SEQ ID NO: 8760308 - DNA, 22 bp, Homo sapiens
aaggcagctcagctcatggcag

SEQ ID NO: 8760309 - DNA, 22 bp, Homo sapiens
aaggcagcttcaccacagcatt

SEQ ID NO: 8760310 - DNA, 22 bp, Homo sapiens
aaggcagcttcaccacagcatt

SEQ ID NO: 8760311 - DNA, 22 bp, Homo sapiens
aaggcagcttcaccacagcatt

SEQ ID NO: 8760312 - DNA, 22 bp, Homo sapiens
aaggcagcttcaccacagcatt

SEQ ID NO: 8760313 - DNA, 22 bp, Homo sapiens
aaggcagctttaaaaaagatgc

SEQ ID NO: 8760314 - DNA, 22 bp, Homo sapiens
aaggcagctttaaaaaagatgc

SEQ ID NO: 8760315 - DNA, 22 bp, Homo sapiens
aaggcagcttcaccacagcatt

SEQ ID NO: 8760316 - DNA, 22 bp, Homo sapiens
aaggcagtaggtgtttcaaact

SEQ ID NO: 8760317 - DNA, 22 bp, Homo sapiens
aaggcagtaggatcttccacag

SEQ ID NO: 8760318 - DNA, 18 bp, Homo sapiens
aaggcagtatgattgcac

SEQ ID NO: 8760319 - DNA, 22 bp, Homo sapiens
aaggcaggtattgatgccacag

SEQ ID NO: 8760320 - DNA, 22 bp, Homo sapiens
aaggcaggtattgatgccacag

SEQ ID NO: 8760321 - DNA, 22 bp, Homo sapiens
aaggcaggtattgatgccacag

SEQ ID NO: 8760322 - DNA, 22 bp, Homo sapiens
aaggcaggtattgatgccacag

SEQ ID NO: 8760323 - DNA, 22 bp, Homo sapiens
aaggcaggtattgatgccacag

SEQ ID NO: 8760324 - DNA, 22 bp, Homo sapiens
aaggcaggtattgatgccacag

SEQ ID NO: 8760325 - DNA, 22 bp, Homo sapiens
aaggcagtcaaagcagacttct

SEQ ID NO: 8760326 - DNA, 22 bp, Homo sapiens
aaggcagtcagttgttttgaaa

SEQ ID NO: 8760327 - DNA, 22 bp, Homo sapiens
aaggcagtcagttgttttgaaa

SEQ ID NO: 8760328 - DNA, 22 bp, Homo sapiens
aaggcagtggttgggtggagga

SEQ ID NO: 8760329 - DNA, 22 bp, Homo sapiens
aaggcagtggctggaaaacctg

SEQ ID NO: 8760330 - DNA, 22 bp, Homo sapiens
aaggcagttcactcacgcagcc

SEQ ID NO: 8760331 - DNA, 22 bp, Homo sapiens
aaggcagtttgggccaccatct

SEQ ID NO: 8760332 - DNA, 22 bp, Homo sapiens
acagttgggctgtagcatgctt

SEQ ID NO: 8760333 - DNA, 22 bp, Homo sapiens
acagttggttaacacaaatatt

SEQ ID NO: 8760334 - DNA, 22 bp, Homo sapiens
acagttgatttcattagaatcg

SEQ ID NO: 8760335 - DNA, 22 bp, Homo sapiens
acagttgatttcattagaatcg

SEQ ID NO: 8760336 - DNA, 22 bp, Homo sapiens
acagttgaggacttaaacaaaa

SEQ ID NO: 8760337 - DNA, 22 bp, Homo sapiens
aaggcagccgtgtgactgcatg

SEQ ID NO: 8760338 - DNA, 22 bp, Homo sapiens
aaggcagccgtgtgactgcatg

SEQ ID NO: 8760339 - DNA, 22 bp, Homo sapiens
aaggcagccgtgtgactgcatg

SEQ ID NO: 8760340 - DNA, 22 bp, Homo sapiens
aaggcagccgtgtgactgcatg

SEQ ID NO: 8760341 - DNA, 22 bp, Homo sapiens
aaggcagccgtgtgactgcatg

SEQ ID NO: 8760342 - DNA, 22 bp, Homo sapiens
aaggcagccgtgtgactgcatg

SEQ ID NO: 8760343 - DNA, 22 bp, Homo sapiens
aaggcagcctctgccagccggg

SEQ ID NO: 8760344 - DNA, 22 bp, Homo sapiens
aaggcagcctctgccagccggg

SEQ ID NO: 8760345 - DNA, 22 bp, Homo sapiens
aaggcagcctttgtttgattga

SEQ ID NO: 8760346 - DNA, 22 bp, Homo sapiens
aaggcagcctttgtttgattga

SEQ ID NO: 8760347 - DNA, 22 bp, Homo sapiens
aaggcagccttttgagttgatt

SEQ ID NO: 8760348 - DNA, 22 bp, Homo sapiens
aaggcagctcagctcatggcag

SEQ ID NO: 8760349 - DNA, 22 bp, Homo sapiens
aaggcagctcagctcatggcag

SEQ ID NO: 8760350 - DNA, 22 bp, Homo sapiens
aaggcagccttttgagttgatt

SEQ ID NO: 8760351 - DNA, 22 bp, Homo sapiens
aaggcagccttttgagttgatt

SEQ ID NO: 8760352 - DNA, 22 bp, Homo sapiens
aaggcagccttttgagttgatt

SEQ ID NO: 8760353 - DNA, 22 bp, Homo sapiens
acagttgagatgcaactttggg

SEQ ID NO: 8760354 - DNA, 22 bp, Homo sapiens
acagttctttgtttatagcttg

SEQ ID NO: 8760355 - DNA, 22 bp, Homo sapiens
acagttctttggatggaagaat

SEQ ID NO: 8760356 - DNA, 22 bp, Homo sapiens
acagttctgtcctagacttcgt

SEQ ID NO: 8760357 - DNA, 22 bp, Homo sapiens
acagttctgtcctagacttcgt

SEQ ID NO: 8760358 - DNA, 22 bp, Homo sapiens
acagttcttaaaacttgaatta

SEQ ID NO: 8760359 - DNA, 22 bp, Homo sapiens
acagttctgagctataattgct

SEQ ID NO: 8760360 - DNA, 22 bp, Homo sapiens
aaggcagagatattcttgatct

SEQ ID NO: 8760361 - DNA, 19 bp, Homo sapiens
acagttctaatttctgtgg

SEQ ID NO: 8760362 - DNA, 22 bp, Homo sapiens
aaggaaagacatataaatgact

SEQ ID NO: 8760363 - DNA, 22 bp, Homo sapiens
aagctttaagtgtcagtcagcc

SEQ ID NO: 8760364 - DNA, 22 bp, Homo sapiens
acaggcagttgaggtttgtgtg

SEQ ID NO: 8760365 - DNA, 22 bp, Homo sapiens
acaggcagttgaggtttgtgtg

SEQ ID NO: 8760366 - DNA, 22 bp, Homo sapiens
acaggcagtgggccagatttgt

SEQ ID NO: 8760367 - DNA, 22 bp, Homo sapiens
acaggccacagtggagtctctg

SEQ ID NO: 8760368 - DNA, 22 bp, Homo sapiens
acaggcattgggatggaggttg

SEQ ID NO: 8760369 - DNA, 22 bp, Homo sapiens
acaggcagttgaggtttgtgtg

SEQ ID NO: 8760370 - DNA, 22 bp, Homo sapiens
acaggcatccaggactaggcct

SEQ ID NO: 8760371 - DNA, 22 bp, Homo sapiens
aaggaaagctgtggttctgaga

SEQ ID NO: 8760372 - DNA, 22 bp, Homo sapiens
aaggaaagattctctctctaga

SEQ ID NO: 8760373 - DNA, 22 bp, Homo sapiens
aaggaaagattctctctctaga

SEQ ID NO: 8760374 - DNA, 22 bp, Homo sapiens
aaggaaaggatgagcatgcatt

SEQ ID NO: 8760375 - DNA, 22 bp, Homo sapiens
aaggaaaggatgagcatgcatt

SEQ ID NO: 8760376 - DNA, 22 bp, Homo sapiens
aaggaaatacaacatgtattca

SEQ ID NO: 8760377 - DNA, 22 bp, Homo sapiens
aaggaaatacttctgcagagca

SEQ ID NO: 8760378 - DNA, 22 bp, Homo sapiens
aaggaaatctttgtaacatctt

SEQ ID NO: 8760379 - DNA, 22 bp, Homo sapiens
acagggctcccagcaggtctgt

SEQ ID NO: 8760380 - DNA, 22 bp, Homo sapiens
acagggctggcgttgggacaga

SEQ ID NO: 8760381 - DNA, 22 bp, Homo sapiens
acagggctggcgttgggacaga

SEQ ID NO: 8760382 - DNA, 22 bp, Homo sapiens
acagggctggggaaagaggcta

SEQ ID NO: 8760383 - DNA, 22 bp, Homo sapiens
acagggctggggaaagaggcta

SEQ ID NO: 8760384 - DNA, 22 bp, Homo sapiens
acagggctgaggctggcttctt

SEQ ID NO: 8760385 - DNA, 19 bp, Homo sapiens
acagggctctggacgccat

SEQ ID NO: 8760386 - DNA, 23 bp, Homo sapiens
acagggctggcagctgcaagacc

SEQ ID NO: 8760387 - DNA, 23 bp, Homo sapiens
acagggctggcagctgcaagacc

SEQ ID NO: 8760388 - DNA, 22 bp, Homo sapiens
acagggctggggcacttggctg

SEQ ID NO: 8760389 - DNA, 22 bp, Homo sapiens
acagggcttagaacttggcctc

SEQ ID NO: 8760390 - DNA, 23 bp, Homo sapiens
acagggctgtccagggctaggtc

SEQ ID NO: 8760391 - DNA, 23 bp, Homo sapiens
acagggctgtccagggctaggtc

SEQ ID NO: 8760392 - DNA, 23 bp, Homo sapiens
acagggctgtccagggctaggtc

SEQ ID NO: 8760393 - DNA, 22 bp, Homo sapiens
acagtacagctgaaactttagt

SEQ ID NO: 8760394 - DNA, 22 bp, Homo sapiens
acagtacagctgaaactttagt

SEQ ID NO: 8760395 - DNA, 22 bp, Homo sapiens
acagtacagtgcagaggaagat

SEQ ID NO: 8760396 - DNA, 22 bp, Homo sapiens
acagtacaggacgagttttcct

SEQ ID NO: 8760397 - DNA, 22 bp, Homo sapiens
acagtacctgctctcaagcaaa

SEQ ID NO: 8760398 - DNA, 22 bp, Homo sapiens
acagtactaagtgctcacatga

SEQ ID NO: 8760399 - DNA, 22 bp, Homo sapiens
acagtacataatcctgagtctg

SEQ ID NO: 8760400 - DNA, 22 bp, Homo sapiens
acaggcaggttgagaaacattt

SEQ ID NO: 8760401 - DNA, 22 bp, Homo sapiens
acaggcagtgatttcctctggt

SEQ ID NO: 8760402 - DNA, 22 bp, Homo sapiens
acaggcaggttgagaaacattt

SEQ ID NO: 8760403 - DNA, 22 bp, Homo sapiens
acaggcaggttgagaaacattt

SEQ ID NO: 8760404 - DNA, 22 bp, Homo sapiens
acaggcagtgatttcctctggt

SEQ ID NO: 8760405 - DNA, 22 bp, Homo sapiens
acaggcagtgggccagatttgt

SEQ ID NO: 8760406 - DNA, 22 bp, Homo sapiens
acaggcagtgatttcctctggt

SEQ ID NO: 8760407 - DNA, 22 bp, Homo sapiens
acaggcagtgggccagatttgt

SEQ ID NO: 8760408 - DNA, 22 bp, Homo sapiens
acaggcaggttgagaaacattt

SEQ ID NO: 8760409 - DNA, 22 bp, Homo sapiens
acaggcaggtcctgtcccagct

SEQ ID NO: 8760410 - DNA, 22 bp, Homo sapiens
acaggcaggtcctgtcccagct

SEQ ID NO: 8760411 - DNA, 22 bp, Homo sapiens
acaggcaggtcctgtcccagct

SEQ ID NO: 8760412 - DNA, 22 bp, Homo sapiens
aagctgcagcacagagaggtgg

SEQ ID NO: 8760413 - DNA, 22 bp, Homo sapiens
aagctgcagatgtgcctgtgga

SEQ ID NO: 8760414 - DNA, 22 bp, Homo sapiens
aagctgcagcacagagaggtgg

SEQ ID NO: 8760415 - DNA, 22 bp, Homo sapiens
aagctgcactacttgagggacc

SEQ ID NO: 8760416 - DNA, 22 bp, Homo sapiens
aagccagggattcctgagggag

SEQ ID NO: 8760417 - DNA, 22 bp, Homo sapiens
aagccagggattcctgagggag

SEQ ID NO: 8760418 - DNA, 22 bp, Homo sapiens
aagccaggccattctctggttc

SEQ ID NO: 8760419 - DNA, 18 bp, Homo sapiens
aagccaggtcaagataag

SEQ ID NO: 8760420 - DNA, 22 bp, Homo sapiens
aagccagggtttgtggatctat

SEQ ID NO: 8760421 - DNA, 22 bp, Homo sapiens
aagccaggtgtttaggccagcg

SEQ ID NO: 8760422 - DNA, 22 bp, Homo sapiens
aagccaggtgtttaggccagcg

SEQ ID NO: 8760423 - DNA, 22 bp, Homo sapiens
aagccaggtgtttaggccagcg

SEQ ID NO: 8760424 - DNA, 21 bp, Homo sapiens
aagctcttctcagggtcacct

SEQ ID NO: 8760425 - DNA, 22 bp, Homo sapiens
aagggaaatcatatggtgcagt

SEQ ID NO: 8760426 - DNA, 22 bp, Homo sapiens
aagggaaactttcacaatgtcc

SEQ ID NO: 8760427 - DNA, 22 bp, Homo sapiens
aagggaaatggccaggcagaga

SEQ ID NO: 8760428 - DNA, 22 bp, Homo sapiens
aagggaaggttccattatactt

SEQ ID NO: 8760429 - DNA, 22 bp, Homo sapiens
aagggaaatcctcagcccagga

SEQ ID NO: 8760430 - DNA, 22 bp, Homo sapiens
aagggaaatcctcagcccagga

SEQ ID NO: 8760431 - DNA, 22 bp, Homo sapiens
aagggaccctggatcaaatgga

SEQ ID NO: 8760432 - DNA, 22 bp, Homo sapiens
aagggagaaaacttgtggctta

SEQ ID NO: 8760433 - DNA, 22 bp, Homo sapiens
aagggagaaagaatgagtttag

SEQ ID NO: 8760434 - DNA, 22 bp, Homo sapiens
aagggagaaaacttgtggctta

SEQ ID NO: 8760435 - DNA, 22 bp, Homo sapiens
aagggactttgtcagctttcca

SEQ ID NO: 8760436 - DNA, 22 bp, Homo sapiens
aagggactttgtcagctttcca

SEQ ID NO: 8760437 - DNA, 22 bp, Homo sapiens
aagggacatagactgtacatct

SEQ ID NO: 8760438 - DNA, 22 bp, Homo sapiens
aagggaagtttgcatcctcact

SEQ ID NO: 8760439 - DNA, 22 bp, Homo sapiens
aagggaagtttgcatcctcact

SEQ ID NO: 8760440 - DNA, 22 bp, Homo sapiens
aaggctttgtgggctgcaggca

SEQ ID NO: 8760441 - DNA, 22 bp, Homo sapiens
aaggcttttaaactgtcaagga

SEQ ID NO: 8760442 - DNA, 22 bp, Homo sapiens
aagggaaaatagttgatgacca

SEQ ID NO: 8760443 - DNA, 22 bp, Homo sapiens
aagggaaaatagttgatgacca

SEQ ID NO: 8760444 - DNA, 22 bp, Homo sapiens
aaggctttgattccattgccct

SEQ ID NO: 8760445 - DNA, 22 bp, Homo sapiens
aaggctttgattccattgccct

SEQ ID NO: 8760446 - DNA, 22 bp, Homo sapiens
aagggcccattctctcagaaaa

SEQ ID NO: 8760447 - DNA, 19 bp, Homo sapiens
aagggcctctgctgtcttc

SEQ ID NO: 8760448 - DNA, 22 bp, Homo sapiens
aagggctcacccaactcacttc

SEQ ID NO: 8760449 - DNA, 22 bp, Homo sapiens
aagggcctgccagctcttcatg

SEQ ID NO: 8760450 - DNA, 22 bp, Homo sapiens
aagggctgaaagaccttgggca

SEQ ID NO: 8760451 - DNA, 22 bp, Homo sapiens
aagggctctgttgccatttcag

SEQ ID NO: 8760452 - DNA, 22 bp, Homo sapiens
aagggctctgtgtgcctcccca

SEQ ID NO: 8760453 - DNA, 22 bp, Homo sapiens
aagggctctgtgcttgtcccat

SEQ ID NO: 8760454 - DNA, 22 bp, Homo sapiens
aagggctctgggctacgcactg

SEQ ID NO: 8760455 - DNA, 22 bp, Homo sapiens
aagggctccacttgaatcacac

SEQ ID NO: 8760456 - DNA, 22 bp, Homo sapiens
aagggctccaagaggtagctgg

SEQ ID NO: 8760457 - DNA, 22 bp, Homo sapiens
aagggctccatccttataaatg

SEQ ID NO: 8760458 - DNA, 22 bp, Homo sapiens
aagggctcccaactcatctttt

SEQ ID NO: 8760459 - DNA, 22 bp, Homo sapiens
aagggctccctgcctgaggtgg

SEQ ID NO: 8760460 - DNA, 22 bp, Homo sapiens
aagggctcggtagcagtcctga

SEQ ID NO: 8760461 - DNA, 22 bp, Homo sapiens
aagggctcggtagcagtcctga

SEQ ID NO: 8760462 - DNA, 22 bp, Homo sapiens
aagggctctctgcattgaaatt

SEQ ID NO: 8760463 - DNA, 22 bp, Homo sapiens
aagggctctgctgtctctcccc

SEQ ID NO: 8760464 - DNA, 22 bp, Homo sapiens
aagggccatcccagaacagaaa

SEQ ID NO: 8760465 - DNA, 22 bp, Homo sapiens
aagggcatgggatgaaaagtag

SEQ ID NO: 8760466 - DNA, 22 bp, Homo sapiens
aagggcaggtgggcatttctgg

SEQ ID NO: 8760467 - DNA, 20 bp, Homo sapiens
aagggagaataatgattgta

SEQ ID NO: 8760468 - DNA, 22 bp, Homo sapiens
aaggcatgaaagcgaaatgaga

SEQ ID NO: 8760469 - DNA, 22 bp, Homo sapiens
aaggctgaggcagtgaggcaga

SEQ ID NO: 8760470 - DNA, 22 bp, Homo sapiens
aaggctgaggctggagaattac

SEQ ID NO: 8760471 - DNA, 22 bp, Homo sapiens
aaggctgaggcagtgaggcaga

SEQ ID NO: 8760472 - DNA, 22 bp, Homo sapiens
aaggctcttggagtgaatgcag

SEQ ID NO: 8760473 - DNA, 22 bp, Homo sapiens
aaggctgaaagaccttgaacct

SEQ ID NO: 8760474 - DNA, 22 bp, Homo sapiens
aaggctgaggagggcctgcagg

SEQ ID NO: 8760475 - DNA, 22 bp, Homo sapiens
aaggctgaggagggcctgcagg

SEQ ID NO: 8760476 - DNA, 22 bp, Homo sapiens
aaggctgaggagggcctgcagg

SEQ ID NO: 8760477 - DNA, 22 bp, Homo sapiens
aaggctgaaagaccttgaacct

SEQ ID NO: 8760478 - DNA, 22 bp, Homo sapiens
aaggctgaggagggcctgcagg

SEQ ID NO: 8760479 - DNA, 22 bp, Homo sapiens
aaggctgagtaaaacagagaac

SEQ ID NO: 8760480 - DNA, 22 bp, Homo sapiens
aaggctgattagactgatagct

SEQ ID NO: 8760481 - DNA, 22 bp, Homo sapiens
aaggctgattagactgatagct

SEQ ID NO: 8760482 - DNA, 22 bp, Homo sapiens
aaggctgagtaaaacagagaac

SEQ ID NO: 8760483 - DNA, 22 bp, Homo sapiens
aaggctgagtaaaacagagaac

SEQ ID NO: 8760484 - DNA, 22 bp, Homo sapiens
aaggctgaggtagggcctaaaa

SEQ ID NO: 8760485 - DNA, 22 bp, Homo sapiens
aaggctgaggtagggcctaaaa

SEQ ID NO: 8760486 - DNA, 22 bp, Homo sapiens
aaggctgaggtagggcctaaaa

SEQ ID NO: 8760487 - DNA, 22 bp, Homo sapiens
aaggctgagggctgtacctggc

SEQ ID NO: 8760488 - DNA, 22 bp, Homo sapiens
aaggctgagggctgtacctggc

SEQ ID NO: 8760489 - DNA, 22 bp, Homo sapiens
aaggctgattagactgatagct

SEQ ID NO: 8760490 - DNA, 22 bp, Homo sapiens
aaggctgcctctgccagaggag

SEQ ID NO: 8760491 - DNA, 16 bp, Homo sapiens
aaggctgattttccct

SEQ ID NO: 8760492 - DNA, 22 bp, Homo sapiens
acatgtgtacatatatatgtgc

SEQ ID NO: 8760493 - DNA, 22 bp, Homo sapiens
acatgtgtacatatatatgtgc

SEQ ID NO: 8760494 - DNA, 22 bp, Homo sapiens
aaggctgcctctgccagaggag

SEQ ID NO: 8760495 - DNA, 22 bp, Homo sapiens
aaggcttgtagatttgggcttt

SEQ ID NO: 8760496 - DNA, 22 bp, Homo sapiens
aaggctttaaataaccgtaaag

SEQ ID NO: 8760497 - DNA, 22 bp, Homo sapiens
aaggcttggtctagtcatgcca

SEQ ID NO: 8760498 - DNA, 22 bp, Homo sapiens
aaggcttctttgcaggctttag

SEQ ID NO: 8760499 - DNA, 22 bp, Homo sapiens
aaggctgtttattagaaaaagt

SEQ ID NO: 8760500 - DNA, 22 bp, Homo sapiens
aaggctgtgtcagaagctccct

SEQ ID NO: 8760501 - DNA, 22 bp, Homo sapiens
aaggctgtgtcagaagctccct

SEQ ID NO: 8760502 - DNA, 22 bp, Homo sapiens
aaggctgtgtcagaagctccct

SEQ ID NO: 8760503 - DNA, 22 bp, Homo sapiens
aaggctgttgtttcacaacaaa

SEQ ID NO: 8760504 - DNA, 22 bp, Homo sapiens
aaggctgtttattagaaaaagt

SEQ ID NO: 8760505 - DNA, 22 bp, Homo sapiens
aaggcttccactttgttgggtc

SEQ ID NO: 8760506 - DNA, 18 bp, Homo sapiens
aaggcttcaaagagtaga

SEQ ID NO: 8760507 - DNA, 22 bp, Homo sapiens
aaggcttctggagcttgctggc

SEQ ID NO: 8760508 - DNA, 22 bp, Homo sapiens
aaggcttcctggaggaggtgtc

SEQ ID NO: 8760509 - DNA, 22 bp, Homo sapiens
aaggcttcttatgcaattgttt

SEQ ID NO: 8760510 - DNA, 22 bp, Homo sapiens
aaggcttctttagtgtcctaat

SEQ ID NO: 8760511 - DNA, 22 bp, Homo sapiens
aaggctggtttccttgatgttt

SEQ ID NO: 8760512 - DNA, 22 bp, Homo sapiens
aaggctgtccaggagaaaatag

SEQ ID NO: 8760513 - DNA, 22 bp, Homo sapiens
aaggctggtttccttgatgttt

SEQ ID NO: 8760514 - DNA, 22 bp, Homo sapiens
aaggctgggaaacatgcaggcc

SEQ ID NO: 8760515 - DNA, 22 bp, Homo sapiens
acatgtgtggccgctgtagaca

SEQ ID NO: 8760516 - DNA, 22 bp, Homo sapiens
acatgtgtggacatgaatctac

SEQ ID NO: 8760517 - DNA, 22 bp, Homo sapiens
acatgtgtgacaacagaggtga

SEQ ID NO: 8760518 - DNA, 22 bp, Homo sapiens
acatgtgtctaagaatgaaaga

SEQ ID NO: 8760519 - DNA, 22 bp, Homo sapiens
acatgtgtacttttaaggatgt

SEQ ID NO: 8760520 - DNA, 22 bp, Homo sapiens
aaggtgaggattttgttctgct

SEQ ID NO: 8760521 - DNA, 17 bp, Homo sapiens
aaggtgagagctgttct

SEQ ID NO: 8760522 - DNA, 22 bp, Homo sapiens
aaggtgctcacgggctcaggga

SEQ ID NO: 8760523 - DNA, 22 bp, Homo sapiens
aaggtgctcgttatggccagtg

SEQ ID NO: 8760524 - DNA, 22 bp, Homo sapiens
aaggtctgttgagtgaatagta

SEQ ID NO: 8760525 - DNA, 22 bp, Homo sapiens
aaggtgaaactggaagctggcc

SEQ ID NO: 8760526 - DNA, 18 bp, Homo sapiens
aaggtctgtctggtaggt

SEQ ID NO: 8760527 - DNA, 22 bp, Homo sapiens
aaggtctgtggccacctctggg

SEQ ID NO: 8760528 - DNA, 22 bp, Homo sapiens
aaggtctgtggccacctctggg

SEQ ID NO: 8760529 - DNA, 22 bp, Homo sapiens
aagggctgagaagtggggctgg

SEQ ID NO: 8760530 - DNA, 22 bp, Homo sapiens
aagggctgagaagtggggctgg

SEQ ID NO: 8760531 - DNA, 22 bp, Homo sapiens
aagggctgaatgaagggttgaa

SEQ ID NO: 8760532 - DNA, 22 bp, Homo sapiens
aagggctgaaagaccttgggca

SEQ ID NO: 8760533 - DNA, 22 bp, Homo sapiens
aagggctcttctatttatggcc

SEQ ID NO: 8760534 - DNA, 22 bp, Homo sapiens
aagggctgatctcactttcttt

SEQ ID NO: 8760535 - DNA, 22 bp, Homo sapiens
aaggtagattctggatcgaagg

SEQ ID NO: 8760536 - DNA, 22 bp, Homo sapiens
aagggctgagcacagtgagcca

SEQ ID NO: 8760537 - DNA, 22 bp, Homo sapiens
aagggctgagaagtggggctgg

SEQ ID NO: 8760538 - DNA, 22 bp, Homo sapiens
aaggtggcgctggagctggtcc

SEQ ID NO: 8760539 - DNA, 22 bp, Homo sapiens
aaggtgggcagatcacaaggtc

SEQ ID NO: 8760540 - DNA, 22 bp, Homo sapiens
aaggtggccctgagcatgacaa

SEQ ID NO: 8760541 - DNA, 19 bp, Homo sapiens
aaggtggcagcaggtatta

SEQ ID NO: 8760542 - DNA, 22 bp, Homo sapiens
aaggtgggtggatcacgaggtc

SEQ ID NO: 8760543 - DNA, 22 bp, Homo sapiens
aaggtggggtcctgtcatctga

SEQ ID NO: 8760544 - DNA, 22 bp, Homo sapiens
accatccaaactgctttctgtg

SEQ ID NO: 8760545 - DNA, 22 bp, Homo sapiens
aaggtgggtggatcacgaggtc

SEQ ID NO: 8760546 - DNA, 22 bp, Homo sapiens
accatccaaactgctttctgtg

SEQ ID NO: 8760547 - DNA, 22 bp, Homo sapiens
accatcctgtgactccgcttcc

SEQ ID NO: 8760548 - DNA, 22 bp, Homo sapiens
accatctgagtagagagaagta

SEQ ID NO: 8760549 - DNA, 21 bp, Homo sapiens
accatcttccatgcattatat

SEQ ID NO: 8760550 - DNA, 22 bp, Homo sapiens
accatcttagtggccagctctc

SEQ ID NO: 8760551 - DNA, 22 bp, Homo sapiens
accatcttaaggggacttctta

SEQ ID NO: 8760552 - DNA, 22 bp, Homo sapiens
accatcttagcagactgcagtg

SEQ ID NO: 8760553 - DNA, 22 bp, Homo sapiens
accatgtcatttattggccaaa

SEQ ID NO: 8760554 - DNA, 22 bp, Homo sapiens
accatgtcatttattggccaaa

SEQ ID NO: 8760555 - DNA, 22 bp, Homo sapiens
accatgttggccaagctggtct

SEQ ID NO: 8760556 - DNA, 22 bp, Homo sapiens
accatgtgttttacacatggta

SEQ ID NO: 8760557 - DNA, 23 bp, Homo sapiens
aagtaacagggataatagcagtt

SEQ ID NO: 8760558 - DNA, 23 bp, Homo sapiens
aagtaacagggataatagcagtt

SEQ ID NO: 8760559 - DNA, 22 bp, Homo sapiens
accatgatgcatccttaaggaa

SEQ ID NO: 8760560 - DNA, 21 bp, Homo sapiens
acccccacacctccttagttc

SEQ ID NO: 8760561 - DNA, 22 bp, Homo sapiens
acccccacggaaggccgtacgc

SEQ ID NO: 8760562 - DNA, 22 bp, Homo sapiens
accccccagataatcccttgag

SEQ ID NO: 8760563 - DNA, 22 bp, Homo sapiens
accccctgcctgcagcaggggc

SEQ ID NO: 8760564 - DNA, 22 bp, Homo sapiens
aagtatgaatcaaagactatct

SEQ ID NO: 8760565 - DNA, 22 bp, Homo sapiens
aagtcacaagcatatatgcatt

SEQ ID NO: 8760566 - DNA, 22 bp, Homo sapiens
aagtcacaaagtgctgtacatg

SEQ ID NO: 8760567 - DNA, 22 bp, Homo sapiens
aagtcacaaagtgctgtacatg

SEQ ID NO: 8760568 - DNA, 22 bp, Homo sapiens
aagtcacaagcatatatgcatt

SEQ ID NO: 8760569 - DNA, 22 bp, Homo sapiens
aagtcacaagcatatatgcatt

SEQ ID NO: 8760570 - DNA, 22 bp, Homo sapiens
aagtcacaagcatatatgcatt

SEQ ID NO: 8760571 - DNA, 22 bp, Homo sapiens
aagtcacacagttaacatgagg

SEQ ID NO: 8760572 - DNA, 22 bp, Homo sapiens
aagtcacacagttaacatgagg

SEQ ID NO: 8760573 - DNA, 22 bp, Homo sapiens
aagtcacactagacaactgagg

SEQ ID NO: 8760574 - DNA, 23 bp, Homo sapiens
accccaggcatcgcattcctctt

SEQ ID NO: 8760575 - DNA, 22 bp, Homo sapiens
accccaggcccagggaagaggc

SEQ ID NO: 8760576 - DNA, 22 bp, Homo sapiens
accccaggcccagggaagaggc

SEQ ID NO: 8760577 - DNA, 23 bp, Homo sapiens
accccaggcatcgcattcctctt

SEQ ID NO: 8760578 - DNA, 22 bp, Homo sapiens
accccagggctgccagcctcct

SEQ ID NO: 8760579 - DNA, 22 bp, Homo sapiens
accccagggctgccagcctcct

SEQ ID NO: 8760580 - DNA, 22 bp, Homo sapiens
accccagggctgccagcctcct

SEQ ID NO: 8760581 - DNA, 22 bp, Homo sapiens
accccaggtccaggttacagag

SEQ ID NO: 8760582 - DNA, 22 bp, Homo sapiens
accccaggtccaggttacagag

SEQ ID NO: 8760583 - DNA, 22 bp, Homo sapiens
accccaggtccaggttacagag

SEQ ID NO: 8760584 - DNA, 22 bp, Homo sapiens
accccaggtcatctgagagtcc

SEQ ID NO: 8760585 - DNA, 22 bp, Homo sapiens
accccaggtcatctgagagtcc

SEQ ID NO: 8760586 - DNA, 22 bp, Homo sapiens
accccaggtctccaggctctgg

SEQ ID NO: 8760587 - DNA, 22 bp, Homo sapiens
accccaggtctccaggctctgg

SEQ ID NO: 8760588 - DNA, 21 bp, Homo sapiens
acccccacacctccttagttc

SEQ ID NO: 8760589 - DNA, 22 bp, Homo sapiens
aagtacctcatagggttatttt

SEQ ID NO: 8760590 - DNA, 22 bp, Homo sapiens
aagtactaaggctattatgatg

SEQ ID NO: 8760591 - DNA, 22 bp, Homo sapiens
aagtacttctagatggataatc

SEQ ID NO: 8760592 - DNA, 22 bp, Homo sapiens
aagtacttctagatggataatc

SEQ ID NO: 8760593 - DNA, 22 bp, Homo sapiens
aagtacttaaatggccatgtca

SEQ ID NO: 8760594 - DNA, 22 bp, Homo sapiens
aagtactacagagctaaatgaa

SEQ ID NO: 8760595 - DNA, 22 bp, Homo sapiens
aagtacatttttaacttacagc

SEQ ID NO: 8760596 - DNA, 22 bp, Homo sapiens
aagtacatttttaacttacagc

SEQ ID NO: 8760597 - DNA, 22 bp, Homo sapiens
aagtactttaggatatgtaact

SEQ ID NO: 8760598 - DNA, 22 bp, Homo sapiens
aagtacttctagatggataatc

SEQ ID NO: 8760599 - DNA, 22 bp, Homo sapiens
aagtacttgatagattaactgt

SEQ ID NO: 8760600 - DNA, 22 bp, Homo sapiens
aagtagaaaaccgcactggact

SEQ ID NO: 8760601 - DNA, 22 bp, Homo sapiens
aagtactttaggatatgtaact

SEQ ID NO: 8760602 - DNA, 22 bp, Homo sapiens
aagtactttaggatatgtaact

SEQ ID NO: 8760603 - DNA, 22 bp, Homo sapiens
aagtagaatctcaggtaggcta

SEQ ID NO: 8760604 - DNA, 21 bp, Homo sapiens
aagtagaagggagaagggtta

SEQ ID NO: 8760605 - DNA, 22 bp, Homo sapiens
accccaggaagtggaggtcatg

SEQ ID NO: 8760606 - DNA, 22 bp, Homo sapiens
accccaggagctgtgcctagtc

SEQ ID NO: 8760607 - DNA, 22 bp, Homo sapiens
accccaggagctgtgcctagtc

SEQ ID NO: 8760608 - DNA, 22 bp, Homo sapiens
accccaggagctgtgcctagtc

SEQ ID NO: 8760609 - DNA, 22 bp, Homo sapiens
aagtacatggaggatagctgct

SEQ ID NO: 8760610 - DNA, 22 bp, Homo sapiens
aagtacatgttgctcaacagcc

SEQ ID NO: 8760611 - DNA, 22 bp, Homo sapiens
aagtacatgttgttcaaaagcc

SEQ ID NO: 8760612 - DNA, 22 bp, Homo sapiens
aagtacatggaggatagctgct

SEQ ID NO: 8760613 - DNA, 22 bp, Homo sapiens
aagtacatggaggatagctgct

SEQ ID NO: 8760614 - DNA, 22 bp, Homo sapiens
aagtacatgctgtaatgattgg

SEQ ID NO: 8760615 - DNA, 23 bp, Homo sapiens
aagtacatatatttagatagtga

SEQ ID NO: 8760616 - DNA, 22 bp, Homo sapiens
aagtacatcctagtctctttca

SEQ ID NO: 8760617 - DNA, 20 bp, Homo sapiens
acatttgaagtcgcatttct

SEQ ID NO: 8760618 - DNA, 22 bp, Homo sapiens
acatttgacatttagtatcagc

SEQ ID NO: 8760619 - DNA, 22 bp, Homo sapiens
acatttgaaattctgaacagat

SEQ ID NO: 8760620 - DNA, 22 bp, Homo sapiens
acatttcttttcatctctatat

SEQ ID NO: 8760621 - DNA, 22 bp, Homo sapiens
acatttgaaataaactcaagtg

SEQ ID NO: 8760622 - DNA, 22 bp, Homo sapiens
acatttgaaataaactcaagtg

SEQ ID NO: 8760623 - DNA, 22 bp, Homo sapiens
acatttgactgtagatacttgc

SEQ ID NO: 8760624 - DNA, 22 bp, Homo sapiens
acatttgactgtagatacttgc

SEQ ID NO: 8760625 - DNA, 22 bp, Homo sapiens
acatttgagcatctactaagtg

SEQ ID NO: 8760626 - DNA, 22 bp, Homo sapiens
acatttgagcatctactaagtg

SEQ ID NO: 8760627 - DNA, 17 bp, Homo sapiens
acatttgcaaaggtctg

SEQ ID NO: 8760628 - DNA, 23 bp, Homo sapiens
acatttggccaaaaattatttct

SEQ ID NO: 8760629 - DNA, 20 bp, Homo sapiens
acatttgagtatcatctact

SEQ ID NO: 8760630 - DNA, 22 bp, Homo sapiens
acatttgataattataaagaca

SEQ ID NO: 8760631 - DNA, 22 bp, Homo sapiens
acatttcttgatgcctctgtga

SEQ ID NO: 8760632 - DNA, 22 bp, Homo sapiens
acatttctcttagagttggact

SEQ ID NO: 8760633 - DNA, 22 bp, Homo sapiens
acatttcttcctaattatccct

SEQ ID NO: 8760634 - DNA, 22 bp, Homo sapiens
acatttctcttagagttggact

SEQ ID NO: 8760635 - DNA, 22 bp, Homo sapiens
acatttcttttcatctctatat

SEQ ID NO: 8760636 - DNA, 22 bp, Homo sapiens
acatttctttgctagacagcag

SEQ ID NO: 8760637 - DNA, 22 bp, Homo sapiens
acatttctttgctagacagcag

SEQ ID NO: 8760638 - DNA, 22 bp, Homo sapiens
acatttctttctattcagtagc

SEQ ID NO: 8760639 - DNA, 22 bp, Homo sapiens
acatttctttctattcagtagc

SEQ ID NO: 8760640 - DNA, 22 bp, Homo sapiens
aggctgagctggcccttgaaat

SEQ ID NO: 8760641 - DNA, 18 bp, Homo sapiens
acatttctatgcttctgg

SEQ ID NO: 8760642 - DNA, 18 bp, Homo sapiens
acatttctatgcttctgg

SEQ ID NO: 8760643 - DNA, 22 bp, Homo sapiens
acatttctcagggagttttgct

SEQ ID NO: 8760644 - DNA, 22 bp, Homo sapiens
aggctgagctggtagtgagtac

SEQ ID NO: 8760645 - DNA, 22 bp, Homo sapiens
aggctgagctggtagtgagtac

SEQ ID NO: 8760646 - DNA, 22 bp, Homo sapiens
aggctgagctggtagtgagtac

SEQ ID NO: 8760647 - DNA, 22 bp, Homo sapiens
aggctgagctggcccttgaaat

SEQ ID NO: 8760648 - DNA, 22 bp, Homo sapiens
aggctgagctggtagtgagtac

SEQ ID NO: 8760649 - DNA, 22 bp, Homo sapiens
acattgcagatgtgtttaatgt

SEQ ID NO: 8760650 - DNA, 22 bp, Homo sapiens
acattgatgtgatgcagaagtg

SEQ ID NO: 8760651 - DNA, 18 bp, Homo sapiens
acattgatggctttaagc

SEQ ID NO: 8760652 - DNA, 22 bp, Homo sapiens
acattgatgatcccacttacag

SEQ ID NO: 8760653 - DNA, 22 bp, Homo sapiens
acattgatgaaaaggtatcatt

SEQ ID NO: 8760654 - DNA, 22 bp, Homo sapiens
acattgatatttcaaatacagg

SEQ ID NO: 8760655 - DNA, 22 bp, Homo sapiens
aggctgagaaagtgggaagatg

SEQ ID NO: 8760656 - DNA, 22 bp, Homo sapiens
aggctgacggcttgcttgtatc

SEQ ID NO: 8760657 - DNA, 22 bp, Homo sapiens
aggctgagaaagtgggaagatg

SEQ ID NO: 8760658 - DNA, 22 bp, Homo sapiens
aggctgagactgtgcattagtg

SEQ ID NO: 8760659 - DNA, 22 bp, Homo sapiens
acattgatatttcaaatacagg

SEQ ID NO: 8760660 - DNA, 22 bp, Homo sapiens
aggctctgttattctagagggc

SEQ ID NO: 8760661 - DNA, 22 bp, Homo sapiens
aggctctgtttgctgtggtacc

SEQ ID NO: 8760662 - DNA, 22 bp, Homo sapiens
aggctctttgagactacctgga

SEQ ID NO: 8760663 - DNA, 22 bp, Homo sapiens
aggctgaaaacgagatggcaat

SEQ ID NO: 8760664 - DNA, 22 bp, Homo sapiens
aggcctgcccgtgggacctgtg

SEQ ID NO: 8760665 - DNA, 22 bp, Homo sapiens
aggcctgcccgtgggacctgtg

SEQ ID NO: 8760666 - DNA, 22 bp, Homo sapiens
aggcctgaggttcctgtgctca

SEQ ID NO: 8760667 - DNA, 22 bp, Homo sapiens
aggcctgcccgtgggacctgtg

SEQ ID NO: 8760668 - DNA, 18 bp, Homo sapiens
aggcctgcccagcactgt

SEQ ID NO: 8760669 - DNA, 18 bp, Homo sapiens
aggcctgcccagcactgt

SEQ ID NO: 8760670 - DNA, 18 bp, Homo sapiens
aggcctgcccagcactgt

SEQ ID NO: 8760671 - DNA, 22 bp, Homo sapiens
acatttctatcatcctgtaatg

SEQ ID NO: 8760672 - DNA, 22 bp, Homo sapiens
acatttctatagtgcatctgtt

SEQ ID NO: 8760673 - DNA, 22 bp, Homo sapiens
acatttctatagtgcatctgtt

SEQ ID NO: 8760674 - DNA, 22 bp, Homo sapiens
acatttctagttgttcatctcc

SEQ ID NO: 8760675 - DNA, 22 bp, Homo sapiens
acatttctatagtgcatctgtt

SEQ ID NO: 8760676 - DNA, 22 bp, Homo sapiens
acatttctagttgttcatctcc

SEQ ID NO: 8760677 - DNA, 17 bp, Homo sapiens
acatttcctaactgaag

SEQ ID NO: 8760678 - DNA, 18 bp, Homo sapiens
acatttctaggtgaaagc

SEQ ID NO: 8760679 - DNA, 22 bp, Homo sapiens
acatttctaatttaatgtaaca

SEQ ID NO: 8760680 - DNA, 22 bp, Homo sapiens
acatttctaatttaatgtaaca

SEQ ID NO: 8760681 - DNA, 22 bp, Homo sapiens
acattgtaaatacctttatcac

SEQ ID NO: 8760682 - DNA, 22 bp, Homo sapiens
acattgtactcttagcgttgtt

SEQ ID NO: 8760683 - DNA, 22 bp, Homo sapiens
acattgtagttgttctgcagca

SEQ ID NO: 8760684 - DNA, 22 bp, Homo sapiens
acattgtatacagacttagtca

SEQ ID NO: 8760685 - DNA, 22 bp, Homo sapiens
acatttcactgttcacagcagg

SEQ ID NO: 8760686 - DNA, 22 bp, Homo sapiens
acattggtcaactgtatcttgg

SEQ ID NO: 8760687 - DNA, 22 bp, Homo sapiens
acatttcagaatcacacagctt

SEQ ID NO: 8760688 - DNA, 22 bp, Homo sapiens
acatttcctaacgtatacactg

SEQ ID NO: 8760689 - DNA, 22 bp, Homo sapiens
aggccaggcaacattctgaagt

SEQ ID NO: 8760690 - DNA, 22 bp, Homo sapiens
acatgctttgcacttacatcat

SEQ ID NO: 8760691 - DNA, 22 bp, Homo sapiens
acatgctttgcacttacatcat

SEQ ID NO: 8760692 - DNA, 22 bp, Homo sapiens
acatgcttgtttttcacaacct

SEQ ID NO: 8760693 - DNA, 20 bp, Homo sapiens
acatgcttgagaggatgcag

SEQ ID NO: 8760694 - DNA, 22 bp, Homo sapiens
acatgcttccaaattatgttgg

SEQ ID NO: 8760695 - DNA, 22 bp, Homo sapiens
acatgcttctgtttcaagaact

SEQ ID NO: 8760696 - DNA, 22 bp, Homo sapiens
acatgcttctgtttcaagaact

SEQ ID NO: 8760697 - DNA, 22 bp, Homo sapiens
acatgctctcctaaggccctgt

SEQ ID NO: 8760698 - DNA, 22 bp, Homo sapiens
acatgctacagtgaaggaggaa

SEQ ID NO: 8760699 - DNA, 22 bp, Homo sapiens
acatgccagcactgcttttcag

SEQ ID NO: 8760700 - DNA, 22 bp, Homo sapiens
acatgccagcactgcttttcag

SEQ ID NO: 8760701 - DNA, 22 bp, Homo sapiens
acatgccaatttggttagttca

SEQ ID NO: 8760702 - DNA, 22 bp, Homo sapiens
acatgccagcccatttaaatgg

SEQ ID NO: 8760703 - DNA, 22 bp, Homo sapiens
acatgccagcccatttaaatgg

SEQ ID NO: 8760704 - DNA, 22 bp, Homo sapiens
acatgctacacagagctcctcg

SEQ ID NO: 8760705 - DNA, 22 bp, Homo sapiens
acatgctaatggagatgccaag

SEQ ID NO: 8760706 - DNA, 22 bp, Homo sapiens
acatgctatgagagattacttc

SEQ ID NO: 8760707 - DNA, 22 bp, Homo sapiens
acatgctaggtacagatctaaa

SEQ ID NO: 8760708 - DNA, 22 bp, Homo sapiens
acatgcctccattgagctgtgg

SEQ ID NO: 8760709 - DNA, 22 bp, Homo sapiens
acatgccatggttgtttgctgc

SEQ ID NO: 8760710 - DNA, 22 bp, Homo sapiens
acatgccatgaaggtatttttg

SEQ ID NO: 8760711 - DNA, 22 bp, Homo sapiens
acatgccatggttgtttgctgc

SEQ ID NO: 8760712 - DNA, 22 bp, Homo sapiens
acatgccagcctcagcagcagt

SEQ ID NO: 8760713 - DNA, 22 bp, Homo sapiens
acatgccatcactttcattcct

SEQ ID NO: 8760714 - DNA, 22 bp, Homo sapiens
acatgccatgaaggtatttttg

SEQ ID NO: 8760715 - DNA, 22 bp, Homo sapiens
acatgccatctttgtcaggagt

SEQ ID NO: 8760716 - DNA, 22 bp, Homo sapiens
acatattttgaaagctttctaa

SEQ ID NO: 8760717 - DNA, 22 bp, Homo sapiens
acatcacacgccttccaggagg

SEQ ID NO: 8760718 - DNA, 22 bp, Homo sapiens
acatcacacgccttccaggagg

SEQ ID NO: 8760719 - DNA, 22 bp, Homo sapiens
acatattttgaaagctttctaa

SEQ ID NO: 8760720 - DNA, 22 bp, Homo sapiens
acatcacagagcccagataaag

SEQ ID NO: 8760721 - DNA, 22 bp, Homo sapiens
acatcagtaactgtaaaacagg

SEQ ID NO: 8760722 - DNA, 22 bp, Homo sapiens
acatcagtaactgtaaaacagg

SEQ ID NO: 8760723 - DNA, 22 bp, Homo sapiens
acatcagtaattaagtctcaag

SEQ ID NO: 8760724 - DNA, 22 bp, Homo sapiens
acatcattgtccgttgtcatga

SEQ ID NO: 8760725 - DNA, 22 bp, Homo sapiens
acatcatgagagacttaaattg

SEQ ID NO: 8760726 - DNA, 22 bp, Homo sapiens
acatcatgagagacttaaattg

SEQ ID NO: 8760727 - DNA, 22 bp, Homo sapiens
acatcatcgtgcacatacataa

SEQ ID NO: 8760728 - DNA, 22 bp, Homo sapiens
acatcagtgctcttggttcttg

SEQ ID NO: 8760729 - DNA, 22 bp, Homo sapiens
acatcagtcttttgcatacata

SEQ ID NO: 8760730 - DNA, 18 bp, Homo sapiens
acatcagttaccaggcca

SEQ ID NO: 8760731 - DNA, 22 bp, Homo sapiens
acatcagtccaccactgcagtt

SEQ ID NO: 8760732 - DNA, 22 bp, Homo sapiens
acatcagtaattaagtctcaag

SEQ ID NO: 8760733 - DNA, 22 bp, Homo sapiens
acatccagatctcagcatggct

SEQ ID NO: 8760734 - DNA, 22 bp, Homo sapiens
acatccactatccttgcttgtt

SEQ ID NO: 8760735 - DNA, 22 bp, Homo sapiens
acatcatttgtctgtagctgaa

SEQ ID NO: 8760736 - DNA, 22 bp, Homo sapiens
acatcattttcttcagtgtttg

SEQ ID NO: 8760737 - DNA, 22 bp, Homo sapiens
acatcattgtccgttgtcatga

SEQ ID NO: 8760738 - DNA, 22 bp, Homo sapiens
acatccagaggcgtggaaggct

SEQ ID NO: 8760739 - DNA, 22 bp, Homo sapiens
acatccacatttattcagtcat

SEQ ID NO: 8760740 - DNA, 22 bp, Homo sapiens
acatccaccacatgccaggctc

SEQ ID NO: 8760741 - DNA, 22 bp, Homo sapiens
aggcctctgggtctcctctgac

SEQ ID NO: 8760742 - DNA, 22 bp, Homo sapiens
aggcctctgggtctcctctgac

SEQ ID NO: 8760743 - DNA, 22 bp, Homo sapiens
aggcctgaggaccttctggagg

SEQ ID NO: 8760744 - DNA, 22 bp, Homo sapiens
aggcctcttgtcttcctcacat

SEQ ID NO: 8760745 - DNA, 22 bp, Homo sapiens
acatgtttggctctatgctata

SEQ ID NO: 8760746 - DNA, 22 bp, Homo sapiens
acatgtttgataaatatttggg

SEQ ID NO: 8760747 - DNA, 19 bp, Homo sapiens
acatgttttgcagaacagc

SEQ ID NO: 8760748 - DNA, 22 bp, Homo sapiens
acatgtttggctctatgctata

SEQ ID NO: 8760749 - DNA, 22 bp, Homo sapiens
acatgtttaagtttaatgaaaa

SEQ ID NO: 8760750 - DNA, 22 bp, Homo sapiens
acatgtttaagtttaatgaaaa

SEQ ID NO: 8760751 - DNA, 22 bp, Homo sapiens
acatgtttaagtttaatgaaaa

SEQ ID NO: 8760752 - DNA, 22 bp, Homo sapiens
acatgtttaagtttgttatatg

SEQ ID NO: 8760753 - DNA, 22 bp, Homo sapiens
acatgtttaagtttgttatatg

SEQ ID NO: 8760754 - DNA, 22 bp, Homo sapiens
aggccagggtcccacactcgca

SEQ ID NO: 8760755 - DNA, 22 bp, Homo sapiens
aggccagggtcccacactcgca

SEQ ID NO: 8760756 - DNA, 22 bp, Homo sapiens
acatgttaaacatcatggaatg

SEQ ID NO: 8760757 - DNA, 22 bp, Homo sapiens
acatgttaaacatcatggaatg

SEQ ID NO: 8760758 - DNA, 22 bp, Homo sapiens
acatgtgtaaggtctctcagtc

SEQ ID NO: 8760759 - DNA, 22 bp, Homo sapiens
aggccaggggtgagcacttctg

SEQ ID NO: 8760760 - DNA, 22 bp, Homo sapiens
acatgttagctactattgttat

SEQ ID NO: 8760761 - DNA, 22 bp, Homo sapiens
acatgttagaaatgcagaatct

SEQ ID NO: 8760762 - DNA, 22 bp, Homo sapiens
acatgttaaacatcatggaatg

SEQ ID NO: 8760763 - DNA, 22 bp, Homo sapiens
acatgttagaaatgcagaatct

SEQ ID NO: 8760764 - DNA, 22 bp, Homo sapiens
acatgttagggacagagtatgt

SEQ ID NO: 8760765 - DNA, 22 bp, Homo sapiens
acatgttagggacagagtatgt

SEQ ID NO: 8760766 - DNA, 22 bp, Homo sapiens
acatgttgctaaatccaatggt

SEQ ID NO: 8760767 - DNA, 22 bp, Homo sapiens
acatgttgctaaatccaatggt

SEQ ID NO: 8760768 - DNA, 22 bp, Homo sapiens
acatgttgtttgccccagttgt

SEQ ID NO: 8760769 - DNA, 22 bp, Homo sapiens
acatgttgtttgccccagttgt

SEQ ID NO: 8760770 - DNA, 22 bp, Homo sapiens
aggccaggcctttctccattcc

SEQ ID NO: 8760771 - DNA, 22 bp, Homo sapiens
aggccaggcctttctccattcc

SEQ ID NO: 8760772 - DNA, 22 bp, Homo sapiens
aggccaggcctttctccattcc

SEQ ID NO: 8760773 - DNA, 22 bp, Homo sapiens
aggccaggcctttctccattcc

SEQ ID NO: 8760774 - DNA, 22 bp, Homo sapiens
aggccaggcgagacacccggct

SEQ ID NO: 8760775 - DNA, 22 bp, Homo sapiens
aggccaggcgagacacccggct

SEQ ID NO: 8760776 - DNA, 22 bp, Homo sapiens
aggccaggcgagacacccggct

SEQ ID NO: 8760777 - DNA, 22 bp, Homo sapiens
aggccaggcgagacacccggct

SEQ ID NO: 8760778 - DNA, 22 bp, Homo sapiens
aggccagggcactgctctttag

SEQ ID NO: 8760779 - DNA, 22 bp, Homo sapiens
aggccagggcactgctctttag

SEQ ID NO: 8760780 - DNA, 22 bp, Homo sapiens
aggccaggggtgagcacttctg

SEQ ID NO: 8760781 - DNA, 22 bp, Homo sapiens
aggccaggggtgagcacttctg

SEQ ID NO: 8760782 - DNA, 22 bp, Homo sapiens
aggccagggtagggcccattgt

SEQ ID NO: 8760783 - DNA, 22 bp, Homo sapiens
aggccaggggtgagcacttctg

SEQ ID NO: 8760784 - DNA, 22 bp, Homo sapiens
aggccagggcactgctctttag

SEQ ID NO: 8760785 - DNA, 22 bp, Homo sapiens
aggccagggccagattagccac

SEQ ID NO: 8760786 - DNA, 22 bp, Homo sapiens
accaggctggagtgcagtggcg

SEQ ID NO: 8760787 - DNA, 22 bp, Homo sapiens
accaggctggagtgcagtggcg

SEQ ID NO: 8760788 - DNA, 22 bp, Homo sapiens
accaggctggagtgcagtggcg

SEQ ID NO: 8760789 - DNA, 22 bp, Homo sapiens
acccagagccagggtcaggagc

SEQ ID NO: 8760790 - DNA, 22 bp, Homo sapiens
accaggcctggctgggcagcca

SEQ ID NO: 8760791 - DNA, 19 bp, Homo sapiens
accaggcctcagaggccct

SEQ ID NO: 8760792 - DNA, 22 bp, Homo sapiens
accaggcctggctgggcagcca

SEQ ID NO: 8760793 - DNA, 22 bp, Homo sapiens
acccagcaaagataaacttatg

SEQ ID NO: 8760794 - DNA, 22 bp, Homo sapiens
acccagcaaagataaacttatg

SEQ ID NO: 8760795 - DNA, 22 bp, Homo sapiens
acccagcatgacacctgcacat

SEQ ID NO: 8760796 - DNA, 22 bp, Homo sapiens
acccagagtgtctgtctcagtc

SEQ ID NO: 8760797 - DNA, 22 bp, Homo sapiens
acccagccatgttcagttctct

SEQ ID NO: 8760798 - DNA, 22 bp, Homo sapiens
acccagccatgttcagttctct

SEQ ID NO: 8760799 - DNA, 19 bp, Homo sapiens
acccagcccaggagtggca

SEQ ID NO: 8760800 - DNA, 22 bp, Homo sapiens
acccagcccagaatctggggcc

SEQ ID NO: 8760801 - DNA, 22 bp, Homo sapiens
acccagcccagaatctggggcc

SEQ ID NO: 8760802 - DNA, 22 bp, Homo sapiens
acccagcctacaaagctcacct

SEQ ID NO: 8760803 - DNA, 19 bp, Homo sapiens
acccagcccaggagtggca

SEQ ID NO: 8760804 - DNA, 19 bp, Homo sapiens
acccagcccaggagtggca

SEQ ID NO: 8760805 - DNA, 22 bp, Homo sapiens
acccaggacacagagatgaccc

SEQ ID NO: 8760806 - DNA, 22 bp, Homo sapiens
acccagctggatgcatggaggc

SEQ ID NO: 8760807 - DNA, 22 bp, Homo sapiens
acccaggaaaacatggtgcaga

SEQ ID NO: 8760808 - DNA, 22 bp, Homo sapiens
acccagctgtttcccgtgtcat

SEQ ID NO: 8760809 - DNA, 20 bp, Homo sapiens
acccagctctgtgccctggg

SEQ ID NO: 8760810 - DNA, 20 bp, Homo sapiens
acccagctctgtgccctggg

SEQ ID NO: 8760811 - DNA, 22 bp, Homo sapiens
acccagctggatgcatggaggc

SEQ ID NO: 8760812 - DNA, 22 bp, Homo sapiens
acccaggactctcttccagtag

SEQ ID NO: 8760813 - DNA, 22 bp, Homo sapiens
acccaggacatgggcacccgtg

SEQ ID NO: 8760814 - DNA, 22 bp, Homo sapiens
acccaggagacggaggtgcagt

SEQ ID NO: 8760815 - DNA, 22 bp, Homo sapiens
acccaggagacaggttgcagtg

SEQ ID NO: 8760816 - DNA, 22 bp, Homo sapiens
agggctgacagtgaggagtcaa

SEQ ID NO: 8760817 - DNA, 22 bp, Homo sapiens
agggctgacagtgaggagtcaa

SEQ ID NO: 8760818 - DNA, 22 bp, Homo sapiens
agggctgccatttctggcccaa

SEQ ID NO: 8760819 - DNA, 22 bp, Homo sapiens
agggctgcccagtgtgagagct

SEQ ID NO: 8760820 - DNA, 22 bp, Homo sapiens
agggctgcccagtgtgagagct

SEQ ID NO: 8760821 - DNA, 22 bp, Homo sapiens
acccaggctggcgtgcagtggc

SEQ ID NO: 8760822 - DNA, 22 bp, Homo sapiens
acccaggctggcagaggctcct

SEQ ID NO: 8760823 - DNA, 22 bp, Homo sapiens
acccaggctggagtgcagtgtc

SEQ ID NO: 8760824 - DNA, 22 bp, Homo sapiens
acccaggctggagtgcagtgtc

SEQ ID NO: 8760825 - DNA, 22 bp, Homo sapiens
acccaggctggagtgcagtgtc

SEQ ID NO: 8760826 - DNA, 22 bp, Homo sapiens
acccaggctggagtgcagtgtc

SEQ ID NO: 8760827 - DNA, 22 bp, Homo sapiens
acccaggctggagtgcagtggt

SEQ ID NO: 8760828 - DNA, 22 bp, Homo sapiens
acccaggctggagtgcagtggt

SEQ ID NO: 8760829 - DNA, 22 bp, Homo sapiens
acccaggctggagtgcagtggt

SEQ ID NO: 8760830 - DNA, 22 bp, Homo sapiens
acccaggctggagtgcagtggt

SEQ ID NO: 8760831 - DNA, 22 bp, Homo sapiens
acccaggctggagtgcagtggg

SEQ ID NO: 8760832 - DNA, 22 bp, Homo sapiens
acccaggctggagtgcagtggc

SEQ ID NO: 8760833 - DNA, 22 bp, Homo sapiens
acccaggctggagtgcagtggc

SEQ ID NO: 8760834 - DNA, 22 bp, Homo sapiens
acccaggctggagtgcagtggg

SEQ ID NO: 8760835 - DNA, 22 bp, Homo sapiens
acccaggctggagtgcagtggg

SEQ ID NO: 8760836 - DNA, 22 bp, Homo sapiens
acccaggctggagtgcagtggg

SEQ ID NO: 8760837 - DNA, 22 bp, Homo sapiens
acccaggctggagtgcagtgat

SEQ ID NO: 8760838 - DNA, 22 bp, Homo sapiens
acccaggctggagtgcagtgat

SEQ ID NO: 8760839 - DNA, 22 bp, Homo sapiens
acccaggctggagtgcagtgat

SEQ ID NO: 8760840 - DNA, 22 bp, Homo sapiens
acccaggctggagtgcagtggc

SEQ ID NO: 8760841 - DNA, 22 bp, Homo sapiens
acccaggctggagtgcagtggc

SEQ ID NO: 8760842 - DNA, 22 bp, Homo sapiens
agggctgccccagtccagccgg

SEQ ID NO: 8760843 - DNA, 22 bp, Homo sapiens
agggctgccccagtccagccgg

SEQ ID NO: 8760844 - DNA, 22 bp, Homo sapiens
agggctgcctgactccagagcc

SEQ ID NO: 8760845 - DNA, 22 bp, Homo sapiens
agggctgcctgctctgcattga

SEQ ID NO: 8760846 - DNA, 22 bp, Homo sapiens
agggctgcctgctctgcattga

SEQ ID NO: 8760847 - DNA, 22 bp, Homo sapiens
acccaggctggagtgcagtgat

SEQ ID NO: 8760848 - DNA, 22 bp, Homo sapiens
acccaggctggagtgcagtgac

SEQ ID NO: 8760849 - DNA, 22 bp, Homo sapiens
acccaggctggagtgcagtgac

SEQ ID NO: 8760850 - DNA, 22 bp, Homo sapiens
acccaggctggagtgcagtgac

SEQ ID NO: 8760851 - DNA, 22 bp, Homo sapiens
agggctgctcctccttcaggcc

SEQ ID NO: 8760852 - DNA, 22 bp, Homo sapiens
agggctgctcctccttcaggcc

SEQ ID NO: 8760853 - DNA, 19 bp, Homo sapiens
agggctgctctggcctggg

SEQ ID NO: 8760854 - DNA, 19 bp, Homo sapiens
agggctgctctggcctggg

SEQ ID NO: 8760855 - DNA, 22 bp, Homo sapiens
agggggcaggagagacctgctg

SEQ ID NO: 8760856 - DNA, 22 bp, Homo sapiens
agggggcatcaggtcctggctc

SEQ ID NO: 8760857 - DNA, 22 bp, Homo sapiens
acccaggctggcgtgcagtggc

SEQ ID NO: 8760858 - DNA, 22 bp, Homo sapiens
aggggcctggcactgagctggc

SEQ ID NO: 8760859 - DNA, 22 bp, Homo sapiens
aggggcctggcactgagctggc

SEQ ID NO: 8760860 - DNA, 22 bp, Homo sapiens
agggggcccttgcaggtgagcg

SEQ ID NO: 8760861 - DNA, 22 bp, Homo sapiens
agggggctcagcaggctctgga

SEQ ID NO: 8760862 - DNA, 22 bp, Homo sapiens
agggggctcagcatggatggag

SEQ ID NO: 8760863 - DNA, 22 bp, Homo sapiens
agggggctcagcatggatggag

SEQ ID NO: 8760864 - DNA, 22 bp, Homo sapiens
agggggctcagcaggctctgga

SEQ ID NO: 8760865 - DNA, 22 bp, Homo sapiens
agggggctcctccggtgcttcc

SEQ ID NO: 8760866 - DNA, 22 bp, Homo sapiens
agggggctcagcatggatggag

SEQ ID NO: 8760867 - DNA, 22 bp, Homo sapiens
agggggctcagtgactgaagtg

SEQ ID NO: 8760868 - DNA, 20 bp, Homo sapiens
accctccactgttcactgtg

SEQ ID NO: 8760869 - DNA, 22 bp, Homo sapiens
accctcatgaagctggcctgga

SEQ ID NO: 8760870 - DNA, 22 bp, Homo sapiens
agggagaggagggtcttgttga

SEQ ID NO: 8760871 - DNA, 22 bp, Homo sapiens
agggagaggagcgtttcacatc

SEQ ID NO: 8760872 - DNA, 22 bp, Homo sapiens
agggagaggagggtcttgttga

SEQ ID NO: 8760873 - DNA, 22 bp, Homo sapiens
agggagaggagggtcttgttga

SEQ ID NO: 8760874 - DNA, 16 bp, Homo sapiens
agggagagaggaacat

SEQ ID NO: 8760875 - DNA, 22 bp, Homo sapiens
agggagagaagttatacaagat

SEQ ID NO: 8760876 - DNA, 22 bp, Homo sapiens
agggagagaagttatacaagat

SEQ ID NO: 8760877 - DNA, 22 bp, Homo sapiens
agggagagacatttccttcttg

SEQ ID NO: 8760878 - DNA, 22 bp, Homo sapiens
agggagagacatttccttcttg

SEQ ID NO: 8760879 - DNA, 22 bp, Homo sapiens
agggagagaagttatacaagat

SEQ ID NO: 8760880 - DNA, 22 bp, Homo sapiens
agggagagacatttccttcttg

SEQ ID NO: 8760881 - DNA, 22 bp, Homo sapiens
agggagagacatttccttcttg

SEQ ID NO: 8760882 - DNA, 18 bp, Homo sapiens
agggagagaccgcgggtc

SEQ ID NO: 8760883 - DNA, 18 bp, Homo sapiens
agggagagaccgcgggtc

SEQ ID NO: 8760884 - DNA, 18 bp, Homo sapiens
agggagagaccgcgggtc

SEQ ID NO: 8760885 - DNA, 18 bp, Homo sapiens
agggagagaccgcgggtc

SEQ ID NO: 8760886 - DNA, 18 bp, Homo sapiens
agggagagaccgcgggtc

SEQ ID NO: 8760887 - DNA, 18 bp, Homo sapiens
agggagagaccgcgggtc

SEQ ID NO: 8760888 - DNA, 18 bp, Homo sapiens
agggagagaccgcgggtc

SEQ ID NO: 8760889 - DNA, 22 bp, Homo sapiens
accagcctgtctgagtcgtggg

SEQ ID NO: 8760890 - DNA, 22 bp, Homo sapiens
accagcctgtctgagtcgtggg

SEQ ID NO: 8760891 - DNA, 22 bp, Homo sapiens
accagcctggccaacatggtga

SEQ ID NO: 8760892 - DNA, 17 bp, Homo sapiens
accagcctctcctgggg

SEQ ID NO: 8760893 - DNA, 22 bp, Homo sapiens
accagcctggccaacatggcaa

SEQ ID NO: 8760894 - DNA, 22 bp, Homo sapiens
accagccctcaggtcagatact

SEQ ID NO: 8760895 - DNA, 22 bp, Homo sapiens
accagccctcaggtcagatact

SEQ ID NO: 8760896 - DNA, 22 bp, Homo sapiens
agggagaggagcgtttcacatc

SEQ ID NO: 8760897 - DNA, 22 bp, Homo sapiens
accagcctcctagctgctcctg

SEQ ID NO: 8760898 - DNA, 22 bp, Homo sapiens
accagctctctagccctggtcc

SEQ ID NO: 8760899 - DNA, 22 bp, Homo sapiens
accagctctggacaggcatttc

SEQ ID NO: 8760900 - DNA, 22 bp, Homo sapiens
agggcacttgaggctgggcctg

SEQ ID NO: 8760901 - DNA, 22 bp, Homo sapiens
agggcacttcagtcagactgag

SEQ ID NO: 8760902 - DNA, 21 bp, Homo sapiens
agggcagattagctgtaagag

SEQ ID NO: 8760903 - DNA, 22 bp, Homo sapiens
agggcagcaatgcagctgctgc

SEQ ID NO: 8760904 - DNA, 22 bp, Homo sapiens
agggcagcacaaggcatggact

SEQ ID NO: 8760905 - DNA, 22 bp, Homo sapiens
agggcagcacagctgtgctcct

SEQ ID NO: 8760906 - DNA, 22 bp, Homo sapiens
agggcagcacaaggcatggact

SEQ ID NO: 8760907 - DNA, 22 bp, Homo sapiens
agggcagcacaaggcatggact

SEQ ID NO: 8760908 - DNA, 22 bp, Homo sapiens
agggcagcaatttggttcctgg

SEQ ID NO: 8760909 - DNA, 22 bp, Homo sapiens
agggcagcaatgcagctgctgc

SEQ ID NO: 8760910 - DNA, 22 bp, Homo sapiens
agggcagcaatgcagctgctgc

SEQ ID NO: 8760911 - DNA, 22 bp, Homo sapiens
agggcagcaatgcagctgctgc

SEQ ID NO: 8760912 - DNA, 22 bp, Homo sapiens
agggcagcagcggcccaggcct

SEQ ID NO: 8760913 - DNA, 22 bp, Homo sapiens
agggcagcagcggcccaggcct

SEQ ID NO: 8760914 - DNA, 22 bp, Homo sapiens
agggcagcagcggcccaggcct

SEQ ID NO: 8760915 - DNA, 22 bp, Homo sapiens
agggcagcagcccatggctctg

SEQ ID NO: 8760916 - DNA, 22 bp, Homo sapiens
agggcagcagcccatggctctg

SEQ ID NO: 8760917 - DNA, 22 bp, Homo sapiens
agggcagcagcccatggctctg

SEQ ID NO: 8760918 - DNA, 22 bp, Homo sapiens
agggcagcagcccatggctctg

SEQ ID NO: 8760919 - DNA, 22 bp, Homo sapiens
agggcagcagcccatggctctg

SEQ ID NO: 8760920 - DNA, 22 bp, Homo sapiens
agggcagcacagctgtgctcct

SEQ ID NO: 8760921 - DNA, 22 bp, Homo sapiens
agggagacaaaagcagctgcca

SEQ ID NO: 8760922 - DNA, 22 bp, Homo sapiens
agggagagaagttatacaagat

SEQ ID NO: 8760923 - DNA, 22 bp, Homo sapiens
agggagacacatgaggaagtca

SEQ ID NO: 8760924 - DNA, 22 bp, Homo sapiens
agggagacacatgaggaagtca

SEQ ID NO: 8760925 - DNA, 22 bp, Homo sapiens
agggagacacatgaggaagtca

SEQ ID NO: 8760926 - DNA, 22 bp, Homo sapiens
agggagacaaaagcagctgcca

SEQ ID NO: 8760927 - DNA, 19 bp, Homo sapiens
agggagaattccaagagga

SEQ ID NO: 8760928 - DNA, 22 bp, Homo sapiens
agggacagtatccatctcacag

SEQ ID NO: 8760929 - DNA, 22 bp, Homo sapiens
aggctttaattatctacaggag

SEQ ID NO: 8760930 - DNA, 21 bp, Homo sapiens
aggctttacctctgggtaggt

SEQ ID NO: 8760931 - DNA, 22 bp, Homo sapiens
aggctttaagtggcctacagct

SEQ ID NO: 8760932 - DNA, 22 bp, Homo sapiens
aggcttgtggggaatctgtgtg

SEQ ID NO: 8760933 - DNA, 22 bp, Homo sapiens
aggcttgtttgaggatagtaat

SEQ ID NO: 8760934 - DNA, 22 bp, Homo sapiens
aggctttaagcaagcatattgt

SEQ ID NO: 8760935 - DNA, 22 bp, Homo sapiens
aggcttggttaattctgtgtga

SEQ ID NO: 8760936 - DNA, 19 bp, Homo sapiens
aggcttggttgcagcaagc

SEQ ID NO: 8760937 - DNA, 22 bp, Homo sapiens
aggcttgtctcagaagatgctg

SEQ ID NO: 8760938 - DNA, 22 bp, Homo sapiens
aggcttggtgccaaggagcctg

SEQ ID NO: 8760939 - DNA, 22 bp, Homo sapiens
aggcttgggactgcttaggagc

SEQ ID NO: 8760940 - DNA, 22 bp, Homo sapiens
aggcttgggactgcttaggagc

SEQ ID NO: 8760941 - DNA, 22 bp, Homo sapiens
aggcttggctggcagccctggg

SEQ ID NO: 8760942 - DNA, 22 bp, Homo sapiens
accagccccaccgggactgcag

SEQ ID NO: 8760943 - DNA, 22 bp, Homo sapiens
accagccccaccgggactgcag

SEQ ID NO: 8760944 - DNA, 22 bp, Homo sapiens
accagccccaccgggactgcag

SEQ ID NO: 8760945 - DNA, 22 bp, Homo sapiens
acatttgtctggctagaaagtt

SEQ ID NO: 8760946 - DNA, 22 bp, Homo sapiens
acatttgtaggacagaggaaga

SEQ ID NO: 8760947 - DNA, 22 bp, Homo sapiens
acatttgtatatatgcagcata

SEQ ID NO: 8760948 - DNA, 22 bp, Homo sapiens
acatttgtacattggcatgtct

SEQ ID NO: 8760949 - DNA, 22 bp, Homo sapiens
acatttgtaggacagaggaaga

SEQ ID NO: 8760950 - DNA, 22 bp, Homo sapiens
accagcagctgcgggccactgc

SEQ ID NO: 8760951 - DNA, 22 bp, Homo sapiens
accagcagctgccagagtggag

SEQ ID NO: 8760952 - DNA, 22 bp, Homo sapiens
accagcagctgcgggccactgc

SEQ ID NO: 8760953 - DNA, 21 bp, Homo sapiens
accagcaggagatcagaagga

SEQ ID NO: 8760954 - DNA, 22 bp, Homo sapiens
accagcagagttgaggaggaca

SEQ ID NO: 8760955 - DNA, 22 bp, Homo sapiens
accagcagcctagagcgttctt

SEQ ID NO: 8760956 - DNA, 22 bp, Homo sapiens
accagcagctgccagagtggag

SEQ ID NO: 8760957 - DNA, 22 bp, Homo sapiens
accagcagctgccagagtggag

SEQ ID NO: 8760958 - DNA, 22 bp, Homo sapiens
accagccagccacagtggctcc

SEQ ID NO: 8760959 - DNA, 19 bp, Homo sapiens
accagcccactcccagttt

SEQ ID NO: 8760960 - DNA, 22 bp, Homo sapiens
accagccaccaccaggagatcg

SEQ ID NO: 8760961 - DNA, 22 bp, Homo sapiens
accagccaccaccaggagatcg

SEQ ID NO: 8760962 - DNA, 22 bp, Homo sapiens
accagcagttatgaggccagga

SEQ ID NO: 8760963 - DNA, 22 bp, Homo sapiens
accagcattggacttagaatgc

SEQ ID NO: 8760964 - DNA, 21 bp, Homo sapiens
accagcaggagatcagaagga

SEQ ID NO: 8760965 - DNA, 22 bp, Homo sapiens
accagcaggccaggggcactgc

SEQ ID NO: 8760966 - DNA, 22 bp, Homo sapiens
accagcagggctgggccaatgg

SEQ ID NO: 8760967 - DNA, 22 bp, Homo sapiens
accagcaggtggcagtatgtat

SEQ ID NO: 8760968 - DNA, 22 bp, Homo sapiens
accagcagttatgaggccagga

SEQ ID NO: 8760969 - DNA, 22 bp, Homo sapiens
accagcagttatgaggccagga

SEQ ID NO: 8760970 - DNA, 22 bp, Homo sapiens
accagcagttatgaggccagga

SEQ ID NO: 8760971 - DNA, 22 bp, Homo sapiens
acagtatttgcgatactgatga

SEQ ID NO: 8760972 - DNA, 22 bp, Homo sapiens
acagtatgaatgtctgaaaaat

SEQ ID NO: 8760973 - DNA, 22 bp, Homo sapiens
acagtatattttcttgattgtt

SEQ ID NO: 8760974 - DNA, 22 bp, Homo sapiens
acagtatttgcgatactgatga

SEQ ID NO: 8760975 - DNA, 22 bp, Homo sapiens
acagtatttgcgatactgatga

SEQ ID NO: 8760976 - DNA, 22 bp, Homo sapiens
acagtcaatgagtgagtgaatg

SEQ ID NO: 8760977 - DNA, 22 bp, Homo sapiens
acagtcaatcagaacagcatgt

SEQ ID NO: 8760978 - DNA, 22 bp, Homo sapiens
acagtcaatgagtgagtgaatg

SEQ ID NO: 8760979 - DNA, 22 bp, Homo sapiens
acagtcatagcagcctttgtta

SEQ ID NO: 8760980 - DNA, 22 bp, Homo sapiens
acagtcagggcttactcaggga

SEQ ID NO: 8760981 - DNA, 19 bp, Homo sapiens
acagtccagctgtttgtac

SEQ ID NO: 8760982 - DNA, 22 bp, Homo sapiens
acagtctacttgagcttgtata

SEQ ID NO: 8760983 - DNA, 22 bp, Homo sapiens
acagtctaggcctaggtcaaaa

SEQ ID NO: 8760984 - DNA, 22 bp, Homo sapiens
acagtctaggtgtgtgatttaa

SEQ ID NO: 8760985 - DNA, 21 bp, Homo sapiens
acagtctccccagatctctcc

SEQ ID NO: 8760986 - DNA, 22 bp, Homo sapiens
acagtctctccacactgcaggg

SEQ ID NO: 8760987 - DNA, 22 bp, Homo sapiens
acagtctctgttgctgctgttt

SEQ ID NO: 8760988 - DNA, 22 bp, Homo sapiens
acagtcctgttgtcaaagcaat

SEQ ID NO: 8760989 - DNA, 20 bp, Homo sapiens
acagtcctgcactggtgttt

SEQ ID NO: 8760990 - DNA, 22 bp, Homo sapiens
acagtctaatcttgtgttctgt

SEQ ID NO: 8760991 - DNA, 22 bp, Homo sapiens
acagtctactaaacatcatcag

SEQ ID NO: 8760992 - DNA, 22 bp, Homo sapiens
acagtctacaaagtgatgtgtg

SEQ ID NO: 8760993 - DNA, 22 bp, Homo sapiens
acagtctacaaagtgatgtgtg

SEQ ID NO: 8760994 - DNA, 22 bp, Homo sapiens
acagtctaatcttgtgttctgt

SEQ ID NO: 8760995 - DNA, 22 bp, Homo sapiens
acagtgggacagtgacggggga

SEQ ID NO: 8760996 - DNA, 22 bp, Homo sapiens
acagtgggacagtgacggggga

SEQ ID NO: 8760997 - DNA, 22 bp, Homo sapiens
acagtctgcttgtctccatggt

SEQ ID NO: 8760998 - DNA, 17 bp, Homo sapiens
acagtctgcctgacagt

SEQ ID NO: 8760999 - DNA, 22 bp, Homo sapiens
acagtctgcctctcagagcagc

SEQ ID NO: 8761000 - DNA, 22 bp, Homo sapiens
acagtctgcctctcagagcagc

SEQ ID NO: 8761001 - DNA, 22 bp, Homo sapiens
acagtgtctcactgctgaaatc

SEQ ID NO: 8761002 - DNA, 22 bp, Homo sapiens
acagtgtctcactgctgaaatc

SEQ ID NO: 8761003 - DNA, 22 bp, Homo sapiens
acagtgggatgaggctggcccc

SEQ ID NO: 8761004 - DNA, 22 bp, Homo sapiens
acagtggggtcttaatagaaca

SEQ ID NO: 8761005 - DNA, 22 bp, Homo sapiens
acagtgtctcctggtacccagt

SEQ ID NO: 8761006 - DNA, 22 bp, Homo sapiens
acagtgtctgacacattgtagc

SEQ ID NO: 8761007 - DNA, 22 bp, Homo sapiens
acagtgtctgacacgtaggaag

SEQ ID NO: 8761008 - DNA, 23 bp, Homo sapiens
acagtgtctgctgcaagatatct

SEQ ID NO: 8761009 - DNA, 23 bp, Homo sapiens
acagtgtggtggacaaggagcag

SEQ ID NO: 8761010 - DNA, 22 bp, Homo sapiens
acagtgtggttgtttctggtta

SEQ ID NO: 8761011 - DNA, 22 bp, Homo sapiens
acagtgtggtttgagcactggg

SEQ ID NO: 8761012 - DNA, 22 bp, Homo sapiens
acagtgtggtttgagcactggg

SEQ ID NO: 8761013 - DNA, 22 bp, Homo sapiens
acagtgtgtcctaaaggtctgg

SEQ ID NO: 8761014 - DNA, 22 bp, Homo sapiens
acagtgtggggtgagatggaac

SEQ ID NO: 8761015 - DNA, 22 bp, Homo sapiens
acagtgtggggtgagatggaac

SEQ ID NO: 8761016 - DNA, 22 bp, Homo sapiens
acagtgtgacaattgtgtcaga

SEQ ID NO: 8761017 - DNA, 19 bp, Homo sapiens
acagtgtctgtatataaat

SEQ ID NO: 8761018 - DNA, 22 bp, Homo sapiens
acagtgtgatgggcctgcctga

SEQ ID NO: 8761019 - DNA, 21 bp, Homo sapiens
acagtgtgcttctctccctcc

SEQ ID NO: 8761020 - DNA, 22 bp, Homo sapiens
acagtatatatagtctaaaagc

SEQ ID NO: 8761021 - DNA, 22 bp, Homo sapiens
acagtatagggcttatattgta

SEQ ID NO: 8761022 - DNA, 22 bp, Homo sapiens
acagtatatatagtctaaaagc

SEQ ID NO: 8761023 - DNA, 22 bp, Homo sapiens
acagtatgaatgcagaatgtag

SEQ ID NO: 8761024 - DNA, 21 bp, Homo sapiens
acagtatattagatatttgaa

SEQ ID NO: 8761025 - DNA, 22 bp, Homo sapiens
acagtatattttcttgattgtt

SEQ ID NO: 8761026 - DNA, 22 bp, Homo sapiens
acagtatatatggttatctgat

SEQ ID NO: 8761027 - DNA, 22 bp, Homo sapiens
acagtatatatggttatctgat

SEQ ID NO: 8761028 - DNA, 21 bp, Homo sapiens
acagtatattagatatttgaa

SEQ ID NO: 8761029 - DNA, 22 bp, Homo sapiens
aggagcagaccgtagtcctgca

SEQ ID NO: 8761030 - DNA, 22 bp, Homo sapiens
aggagcagaatttaatgtgcag

SEQ ID NO: 8761031 - DNA, 22 bp, Homo sapiens
aggagcagaccgtagtcctgca

SEQ ID NO: 8761032 - DNA, 22 bp, Homo sapiens
aggagcaaatgatgagacagca

SEQ ID NO: 8761033 - DNA, 22 bp, Homo sapiens
aggagcaaatgatgagacagca

SEQ ID NO: 8761034 - DNA, 22 bp, Homo sapiens
aggagcaccattgtgctggtgt

SEQ ID NO: 8761035 - DNA, 22 bp, Homo sapiens
aggagattgtggtgcaaggaat

SEQ ID NO: 8761036 - DNA, 22 bp, Homo sapiens
aggagatggagctcagtgggca

SEQ ID NO: 8761037 - DNA, 22 bp, Homo sapiens
acagtaaatcaacagaatatct

SEQ ID NO: 8761038 - DNA, 22 bp, Homo sapiens
acagtaaatcaacagaatatct

SEQ ID NO: 8761039 - DNA, 22 bp, Homo sapiens
aggagcagaactgttgtggagg

SEQ ID NO: 8761040 - DNA, 22 bp, Homo sapiens
aggagcactaattcctgcagag

SEQ ID NO: 8761041 - DNA, 22 bp, Homo sapiens
aggagcactgagccagcatggg

SEQ ID NO: 8761042 - DNA, 22 bp, Homo sapiens
aggagcagaactgattctgact

SEQ ID NO: 8761043 - DNA, 22 bp, Homo sapiens
aggacacagacttagatttaaa

SEQ ID NO: 8761044 - DNA, 22 bp, Homo sapiens
aggacacaggcaggaggagatc

SEQ ID NO: 8761045 - DNA, 22 bp, Homo sapiens
aggacacagctcttcagtaaga

SEQ ID NO: 8761046 - DNA, 22 bp, Homo sapiens
aggacacagctgctctgcagag

SEQ ID NO: 8761047 - DNA, 22 bp, Homo sapiens
acaggtgttgactcacaggccc

SEQ ID NO: 8761048 - DNA, 22 bp, Homo sapiens
acaggtgttgactcacaggccc

SEQ ID NO: 8761049 - DNA, 22 bp, Homo sapiens
acaggtgttgaatgatgtcaca

SEQ ID NO: 8761050 - DNA, 22 bp, Homo sapiens
acaggtgtacaatgcatgacag

SEQ ID NO: 8761051 - DNA, 22 bp, Homo sapiens
acaggtgtaatttgcccgaggt

SEQ ID NO: 8761052 - DNA, 22 bp, Homo sapiens
acaggtttagctcttagtagtc

SEQ ID NO: 8761053 - DNA, 22 bp, Homo sapiens
acaggttgataaggtgatattc

SEQ ID NO: 8761054 - DNA, 22 bp, Homo sapiens
acaggtttgctgctgttttagg

SEQ ID NO: 8761055 - DNA, 22 bp, Homo sapiens
acaggtttgtctgatgtaatga

SEQ ID NO: 8761056 - DNA, 22 bp, Homo sapiens
acaggtttgcagcttgttacct

SEQ ID NO: 8761057 - DNA, 22 bp, Homo sapiens
acaggtttttgtggatatatgt

SEQ ID NO: 8761058 - DNA, 22 bp, Homo sapiens
acaggttttggactccagattt

SEQ ID NO: 8761059 - DNA, 22 bp, Homo sapiens
acaggtttgtctgatgtaatga

SEQ ID NO: 8761060 - DNA, 22 bp, Homo sapiens
acagtaaaaagccttagaattt

SEQ ID NO: 8761061 - DNA, 22 bp, Homo sapiens
acagtaaaaagccttagaattt

SEQ ID NO: 8761062 - DNA, 22 bp, Homo sapiens
acagtaaacaatgcagcaaatt

SEQ ID NO: 8761063 - DNA, 22 bp, Homo sapiens
acagtaaaacatttttattagg

SEQ ID NO: 8761064 - DNA, 22 bp, Homo sapiens
acagtaaaacatttttattagg

SEQ ID NO: 8761065 - DNA, 22 bp, Homo sapiens
acagtaaatattaagcctgagt

SEQ ID NO: 8761066 - DNA, 22 bp, Homo sapiens
acagtaaataatgcatgttgat

SEQ ID NO: 8761067 - DNA, 22 bp, Homo sapiens
acagtaaataatgcatgttgat

SEQ ID NO: 8761068 - DNA, 22 bp, Homo sapiens
acagtaaagccttctggttgac

SEQ ID NO: 8761069 - DNA, 18 bp, Homo sapiens
acagtaaagaaaggaatt

SEQ ID NO: 8761070 - DNA, 22 bp, Homo sapiens
acagtttgaagtttagaagtct

SEQ ID NO: 8761071 - DNA, 22 bp, Homo sapiens
acagtttgaataatttagatag

SEQ ID NO: 8761072 - DNA, 22 bp, Homo sapiens
acagtttgaataatttagatag

SEQ ID NO: 8761073 - DNA, 22 bp, Homo sapiens
acagtttgaataatttagatag

SEQ ID NO: 8761074 - DNA, 22 bp, Homo sapiens
aggcactgcttctaagtaggaa

SEQ ID NO: 8761075 - DNA, 22 bp, Homo sapiens
acagtttgcactgttcatcaaa

SEQ ID NO: 8761076 - DNA, 17 bp, Homo sapiens
acagtttgattttagca

SEQ ID NO: 8761077 - DNA, 17 bp, Homo sapiens
acagtttgattttagca

SEQ ID NO: 8761078 - DNA, 22 bp, Homo sapiens
acagtttatggtgttttatata

SEQ ID NO: 8761079 - DNA, 22 bp, Homo sapiens
acagtttataaaaataatgagg

SEQ ID NO: 8761080 - DNA, 22 bp, Homo sapiens
acagtttatgcctctgagcctg

SEQ ID NO: 8761081 - DNA, 21 bp, Homo sapiens
acagtttattagagtaagtgc

SEQ ID NO: 8761082 - DNA, 22 bp, Homo sapiens
acagtttatgtaaagctgccaa

SEQ ID NO: 8761083 - DNA, 21 bp, Homo sapiens
acagtttattagagtaagtgc

SEQ ID NO: 8761084 - DNA, 22 bp, Homo sapiens
aggcactgcttctaagtaggaa

SEQ ID NO: 8761085 - DNA, 22 bp, Homo sapiens
aggcactgcttctaagtaggaa

SEQ ID NO: 8761086 - DNA, 18 bp, Homo sapiens
aggcactggaattaaggg

SEQ ID NO: 8761087 - DNA, 20 bp, Homo sapiens
aggcactggatttcttatat

SEQ ID NO: 8761088 - DNA, 18 bp, Homo sapiens
aggcactggaattaaggg

SEQ ID NO: 8761089 - DNA, 22 bp, Homo sapiens
aggcactgggaatatgctgagg

SEQ ID NO: 8761090 - DNA, 22 bp, Homo sapiens
aggcactgggaatatgctgagg

SEQ ID NO: 8761091 - DNA, 18 bp, Homo sapiens
aggcactggaattaaggg

SEQ ID NO: 8761092 - DNA, 22 bp, Homo sapiens
aggcactgggaatatgctgagg

SEQ ID NO: 8761093 - DNA, 20 bp, Homo sapiens
aggcactggggataggtaag

SEQ ID NO: 8761094 - DNA, 22 bp, Homo sapiens
aggcactgggggatgagcaagg

SEQ ID NO: 8761095 - DNA, 22 bp, Homo sapiens
aggcactgggggatgagcaagg

SEQ ID NO: 8761096 - DNA, 20 bp, Homo sapiens
aggcactggggataggtaag

SEQ ID NO: 8761097 - DNA, 22 bp, Homo sapiens
aggcactgggggatgagcaagg

SEQ ID NO: 8761098 - DNA, 22 bp, Homo sapiens
aggcactgggggatgagcaagg

SEQ ID NO: 8761099 - DNA, 22 bp, Homo sapiens
aggcactgggtaattagtagct

SEQ ID NO: 8761100 - DNA, 22 bp, Homo sapiens
acagtttgcactgttcatcaaa

SEQ ID NO: 8761101 - DNA, 22 bp, Homo sapiens
acagtttaggatgagagaacac

SEQ ID NO: 8761102 - DNA, 22 bp, Homo sapiens
acagtttataaaaataatgagg

SEQ ID NO: 8761103 - DNA, 22 bp, Homo sapiens
acagtttatcgattcacctacc

SEQ ID NO: 8761104 - DNA, 22 bp, Homo sapiens
acagttcagacaagtgttccat

SEQ ID NO: 8761105 - DNA, 22 bp, Homo sapiens
aggatggattctgtatgtggga

SEQ ID NO: 8761106 - DNA, 19 bp, Homo sapiens
aggatggagcaggcggtga

SEQ ID NO: 8761107 - DNA, 22 bp, Homo sapiens
aggatggaattaggtagcaagt

SEQ ID NO: 8761108 - DNA, 22 bp, Homo sapiens
acagttcccgtcttgcacagct

SEQ ID NO: 8761109 - DNA, 22 bp, Homo sapiens
acagtttagagcatgatgacca

SEQ ID NO: 8761110 - DNA, 20 bp, Homo sapiens
aggatgcagggagtctgcag

SEQ ID NO: 8761111 - DNA, 22 bp, Homo sapiens
aggatgaggctggacacttctt

SEQ ID NO: 8761112 - DNA, 22 bp, Homo sapiens
aggatgagccgcgcaagctgac

SEQ ID NO: 8761113 - DNA, 22 bp, Homo sapiens
aggatgaggctggacacttctt

SEQ ID NO: 8761114 - DNA, 22 bp, Homo sapiens
aggatgaggctggcaggtcttg

SEQ ID NO: 8761115 - DNA, 20 bp, Homo sapiens
aggatgcagggagtctgcag

SEQ ID NO: 8761116 - DNA, 22 bp, Homo sapiens
aggatgaggctggcaggtcttg

SEQ ID NO: 8761117 - DNA, 22 bp, Homo sapiens
aggatgagattccagggtcaat

SEQ ID NO: 8761118 - DNA, 22 bp, Homo sapiens
aggatgagattccagggtcaat

SEQ ID NO: 8761119 - DNA, 22 bp, Homo sapiens
aggatgagattgctgtgttgta

SEQ ID NO: 8761120 - DNA, 22 bp, Homo sapiens
aggatgagattgctgtgttgta

SEQ ID NO: 8761121 - DNA, 22 bp, Homo sapiens
aggatgagattgctgtgttgta

SEQ ID NO: 8761122 - DNA, 22 bp, Homo sapiens
aggatgagattccagggtcaat

SEQ ID NO: 8761123 - DNA, 22 bp, Homo sapiens
aggatgagagatacatggagca

SEQ ID NO: 8761124 - DNA, 22 bp, Homo sapiens
acagtgtgttggaggagactgt

SEQ ID NO: 8761125 - DNA, 22 bp, Homo sapiens
acagtgtgttctgggacctcca

SEQ ID NO: 8761126 - DNA, 22 bp, Homo sapiens
acagtgtgttggaggagactgt

SEQ ID NO: 8761127 - DNA, 22 bp, Homo sapiens
acatatttccatgcagcatgtc

SEQ ID NO: 8761128 - DNA, 22 bp, Homo sapiens
acatatttccatgcagcatgtc

SEQ ID NO: 8761129 - DNA, 22 bp, Homo sapiens
acatatttccatgcagcatgtc

SEQ ID NO: 8761130 - DNA, 22 bp, Homo sapiens
acatatttccatgcagcatgtc

SEQ ID NO: 8761131 - DNA, 22 bp, Homo sapiens
acatatttccatgcagcatgtc

SEQ ID NO: 8761132 - DNA, 22 bp, Homo sapiens
acatatttccatgcagcatgtc

SEQ ID NO: 8761133 - DNA, 22 bp, Homo sapiens
acatatattttcacacatggtt

SEQ ID NO: 8761134 - DNA, 22 bp, Homo sapiens
aggcagctggacataactaacc

SEQ ID NO: 8761135 - DNA, 22 bp, Homo sapiens
aggcagctggacataactaacc

SEQ ID NO: 8761136 - DNA, 21 bp, Homo sapiens
aggcagctggaaggcctggct

SEQ ID NO: 8761137 - DNA, 22 bp, Homo sapiens
aggcagctggacataactaacc

SEQ ID NO: 8761138 - DNA, 22 bp, Homo sapiens
aggcagctggaggcagagacta

SEQ ID NO: 8761139 - DNA, 22 bp, Homo sapiens
acatattaactgcactacacta

SEQ ID NO: 8761140 - DNA, 20 bp, Homo sapiens
acatatcatggtagagtcct

SEQ ID NO: 8761141 - DNA, 22 bp, Homo sapiens
acatatctgtgaggttttgttg

SEQ ID NO: 8761142 - DNA, 22 bp, Homo sapiens
acatatgttgtaaacattccaa

SEQ ID NO: 8761143 - DNA, 17 bp, Homo sapiens
aggcagctcagaacatc

SEQ ID NO: 8761144 - DNA, 21 bp, Homo sapiens
aggcagctcaggcccagagag

SEQ ID NO: 8761145 - DNA, 21 bp, Homo sapiens
aggcagctcaggcccagagag

SEQ ID NO: 8761146 - DNA, 21 bp, Homo sapiens
aggcagctcaggcccagagag

SEQ ID NO: 8761147 - DNA, 22 bp, Homo sapiens
aggcagctctgtggcctcccag

SEQ ID NO: 8761148 - DNA, 22 bp, Homo sapiens
aggcagctctgtggcctcccag

SEQ ID NO: 8761149 - DNA, 22 bp, Homo sapiens
aggcagctgaccacagtatgat

SEQ ID NO: 8761150 - DNA, 22 bp, Homo sapiens
aggcagctgaccacagtatgat

SEQ ID NO: 8761151 - DNA, 22 bp, Homo sapiens
aggcagctgaggtctggcgccc

SEQ ID NO: 8761152 - DNA, 22 bp, Homo sapiens
aggcagctgaggtctggcgccc

SEQ ID NO: 8761153 - DNA, 22 bp, Homo sapiens
aggcagctgaggtctggcgccc

SEQ ID NO: 8761154 - DNA, 22 bp, Homo sapiens
aggcagctgaggtctggcgccc

SEQ ID NO: 8761155 - DNA, 22 bp, Homo sapiens
aggcagctgaccacagtatgat

SEQ ID NO: 8761156 - DNA, 21 bp, Homo sapiens
aggcagctggaaggcctggct

SEQ ID NO: 8761157 - DNA, 21 bp, Homo sapiens
aggcagctggaaggcctggct

SEQ ID NO: 8761158 - DNA, 21 bp, Homo sapiens
aggcagctggaaggcctggct

SEQ ID NO: 8761159 - DNA, 21 bp, Homo sapiens
aggcagctggaaggcctggct

SEQ ID NO: 8761160 - DNA, 21 bp, Homo sapiens
aggcagctggaaggcctggct

SEQ ID NO: 8761161 - DNA, 22 bp, Homo sapiens
aggcagctggaaaactccaggc

SEQ ID NO: 8761162 - DNA, 22 bp, Homo sapiens
aggcagctggaaaactccaggc

SEQ ID NO: 8761163 - DNA, 22 bp, Homo sapiens
aggcagctgccctctccttcct

SEQ ID NO: 8761164 - DNA, 22 bp, Homo sapiens
aggcagctgccctctccttcct

SEQ ID NO: 8761165 - DNA, 22 bp, Homo sapiens
aggcagctgccctctccttcct

SEQ ID NO: 8761166 - DNA, 22 bp, Homo sapiens
aggcagctgaggtctggcgccc

SEQ ID NO: 8761167 - DNA, 22 bp, Homo sapiens
aggcagctgaggtctggcgccc

SEQ ID NO: 8761168 - DNA, 22 bp, Homo sapiens
aggcagctgaggtctggcgccc

SEQ ID NO: 8761169 - DNA, 20 bp, Homo sapiens
acatagatcagtgattgaca

SEQ ID NO: 8761170 - DNA, 22 bp, Homo sapiens
acatagagttcaattttcagtc

SEQ ID NO: 8761171 - DNA, 22 bp, Homo sapiens
acatagagttcaattttcagtc

SEQ ID NO: 8761172 - DNA, 22 bp, Homo sapiens
acatagagtatcatactggatg

SEQ ID NO: 8761173 - DNA, 22 bp, Homo sapiens
acatagagagcacttagaagtt

SEQ ID NO: 8761174 - DNA, 22 bp, Homo sapiens
acatagagagcacttagaagtt

SEQ ID NO: 8761175 - DNA, 22 bp, Homo sapiens
acatagaagtgatgcttatcca

SEQ ID NO: 8761176 - DNA, 22 bp, Homo sapiens
acatagaagtgatgcttatcca

SEQ ID NO: 8761177 - DNA, 22 bp, Homo sapiens
acatagatctgtgattcattct

SEQ ID NO: 8761178 - DNA, 22 bp, Homo sapiens
acatagatttaagagcaattag

SEQ ID NO: 8761179 - DNA, 22 bp, Homo sapiens
acatagcaagtgctcaataaat

SEQ ID NO: 8761180 - DNA, 22 bp, Homo sapiens
acatagcaagtgctcaataaat

SEQ ID NO: 8761181 - DNA, 22 bp, Homo sapiens
acatagaacttcccagtgagca

SEQ ID NO: 8761182 - DNA, 22 bp, Homo sapiens
acatagaacttcccagtgagca

SEQ ID NO: 8761183 - DNA, 22 bp, Homo sapiens
acatagaacttcccagtgagca

SEQ ID NO: 8761184 - DNA, 22 bp, Homo sapiens
acatagaaggaagagtagtagg

SEQ ID NO: 8761185 - DNA, 22 bp, Homo sapiens
acatagaaggaagagtagtagg

SEQ ID NO: 8761186 - DNA, 22 bp, Homo sapiens
acatagaacttcgatgtctttt

SEQ ID NO: 8761187 - DNA, 22 bp, Homo sapiens
acatagaacttcgatgtctttt

SEQ ID NO: 8761188 - DNA, 22 bp, Homo sapiens
acatagaacttcgatgtctttt

SEQ ID NO: 8761189 - DNA, 22 bp, Homo sapiens
acatagtgagagaaagatcagc

SEQ ID NO: 8761190 - DNA, 22 bp, Homo sapiens
acatagtgttttgagagacagc

SEQ ID NO: 8761191 - DNA, 22 bp, Homo sapiens
acatagttagcttagagatact

SEQ ID NO: 8761192 - DNA, 22 bp, Homo sapiens
aggcagctagagagtgaaactg

SEQ ID NO: 8761193 - DNA, 22 bp, Homo sapiens
aggcagctaagatggataatga

SEQ ID NO: 8761194 - DNA, 17 bp, Homo sapiens
aggcagctcagaacatc

SEQ ID NO: 8761195 - DNA, 17 bp, Homo sapiens
aggcagctcagaacatc

SEQ ID NO: 8761196 - DNA, 22 bp, Homo sapiens
aggcagctagagagtgaaactg

SEQ ID NO: 8761197 - DNA, 22 bp, Homo sapiens
acatagcagaggactgagcaga

SEQ ID NO: 8761198 - DNA, 22 bp, Homo sapiens
aggacacacccagctcacgggg

SEQ ID NO: 8761199 - DNA, 22 bp, Homo sapiens
aggacacacaaagagtgagaac

SEQ ID NO: 8761200 - DNA, 22 bp, Homo sapiens
aggacacaccaggtccagctgt

SEQ ID NO: 8761201 - DNA, 22 bp, Homo sapiens
aggacacactgcaagagcctgg

SEQ ID NO: 8761202 - DNA, 22 bp, Homo sapiens
aggacacactgttctcacgtaa

SEQ ID NO: 8761203 - DNA, 19 bp, Homo sapiens
acaggggcctttccagggt

SEQ ID NO: 8761204 - DNA, 19 bp, Homo sapiens
acaggggctagcggaagca

SEQ ID NO: 8761205 - DNA, 20 bp, Homo sapiens
acaggggcagcacaataatg

SEQ ID NO: 8761206 - DNA, 19 bp, Homo sapiens
acaggggctagcggaagca

SEQ ID NO: 8761207 - DNA, 19 bp, Homo sapiens
acaggggctagcggaagca

SEQ ID NO: 8761208 - DNA, 22 bp, Homo sapiens
aggacaattagactctttgttt

SEQ ID NO: 8761209 - DNA, 22 bp, Homo sapiens
aggacacaacatcatttctgtg

SEQ ID NO: 8761210 - DNA, 22 bp, Homo sapiens
aggacacaacatcatttctgtg

SEQ ID NO: 8761211 - DNA, 22 bp, Homo sapiens
aggacacacaaagagtgagaac

SEQ ID NO: 8761212 - DNA, 19 bp, Homo sapiens
acaggggctagcggaagca

SEQ ID NO: 8761213 - DNA, 22 bp, Homo sapiens
aggacacacagaatacaaatcc

SEQ ID NO: 8761214 - DNA, 22 bp, Homo sapiens
acaggggcaagggctcacggcc

SEQ ID NO: 8761215 - DNA, 22 bp, Homo sapiens
acaggggcaagggctcacggcc

SEQ ID NO: 8761216 - DNA, 19 bp, Homo sapiens
acaggggcctttccagggt

SEQ ID NO: 8761217 - DNA, 22 bp, Homo sapiens
acaggggcaggcaggacccttt

SEQ ID NO: 8761218 - DNA, 22 bp, Homo sapiens
acaggggcaggcaggacccttt

SEQ ID NO: 8761219 - DNA, 19 bp, Homo sapiens
acagggcttggcctgacat

SEQ ID NO: 8761220 - DNA, 22 bp, Homo sapiens
acagggcttgttgaaagcggag

SEQ ID NO: 8761221 - DNA, 22 bp, Homo sapiens
acaggggattgattggaagtct

SEQ ID NO: 8761222 - DNA, 23 bp, Homo sapiens
aggaagagagagtgcctctttct

SEQ ID NO: 8761223 - DNA, 22 bp, Homo sapiens
aggaagaatgtttacatatcaa

SEQ ID NO: 8761224 - DNA, 22 bp, Homo sapiens
aggaagaatgtttacatatcaa

SEQ ID NO: 8761225 - DNA, 22 bp, Homo sapiens
aggaagagcattcacatggtag

SEQ ID NO: 8761226 - DNA, 22 bp, Homo sapiens
acagggctatattcctcagagt

SEQ ID NO: 8761227 - DNA, 22 bp, Homo sapiens
acagggagccccagcatttcca

SEQ ID NO: 8761228 - DNA, 22 bp, Homo sapiens
aggaagaaatgtgacttcaaac

SEQ ID NO: 8761229 - DNA, 22 bp, Homo sapiens
aggaagaaatgtgacttcaaac

SEQ ID NO: 8761230 - DNA, 22 bp, Homo sapiens
aggaagaaatgtgacttcaaac

SEQ ID NO: 8761231 - DNA, 22 bp, Homo sapiens
aggaagaacctaagaaagtctc

SEQ ID NO: 8761232 - DNA, 22 bp, Homo sapiens
aggaagaacctaagaaagtctc

SEQ ID NO: 8761233 - DNA, 22 bp, Homo sapiens
aggaagaacctaagaaagtctc

SEQ ID NO: 8761234 - DNA, 22 bp, Homo sapiens
aggaagaacctaagaaagtctc

SEQ ID NO: 8761235 - DNA, 22 bp, Homo sapiens
aggaagaacagataatggacgc

SEQ ID NO: 8761236 - DNA, 22 bp, Homo sapiens
aggaagaacagataatggacgc

SEQ ID NO: 8761237 - DNA, 22 bp, Homo sapiens
aggaagaacagataatggacgc

SEQ ID NO: 8761238 - DNA, 22 bp, Homo sapiens
acaggcagcactaatctctggt

SEQ ID NO: 8761239 - DNA, 22 bp, Homo sapiens
acaggcagcactaatctctggt

SEQ ID NO: 8761240 - DNA, 22 bp, Homo sapiens
acaggcagccctctccctggtt

SEQ ID NO: 8761241 - DNA, 22 bp, Homo sapiens
acaggcagcgtcattgctgctc

SEQ ID NO: 8761242 - DNA, 22 bp, Homo sapiens
acaggcagcgtcattgctgctc

SEQ ID NO: 8761243 - DNA, 22 bp, Homo sapiens
acaggcagccctctccctggtt

SEQ ID NO: 8761244 - DNA, 22 bp, Homo sapiens
acaggcaggagctccccattcc

SEQ ID NO: 8761245 - DNA, 22 bp, Homo sapiens
acaggcaggagctccccattcc

SEQ ID NO: 8761246 - DNA, 22 bp, Homo sapiens
acaggcagcgtcattgctgctc

SEQ ID NO: 8761247 - DNA, 23 bp, Homo sapiens
acaggcaggcatggccaaatgtg

SEQ ID NO: 8761248 - DNA, 22 bp, Homo sapiens
acaggcaggagctccccattcc

SEQ ID NO: 8761249 - DNA, 22 bp, Homo sapiens
acaggcaggagctccccattcc

SEQ ID NO: 8761250 - DNA, 23 bp, Homo sapiens
acaggcaggcatggccaaatgtg

SEQ ID NO: 8761251 - DNA, 22 bp, Homo sapiens
acaggcaggcgggacagcccga

SEQ ID NO: 8761252 - DNA, 22 bp, Homo sapiens
acaggcaggcttcggccagagc

SEQ ID NO: 8761253 - DNA, 22 bp, Homo sapiens
acaggcaggcgggacagcccga

SEQ ID NO: 8761254 - DNA, 22 bp, Homo sapiens
acaggcaggcttcggccagagc

SEQ ID NO: 8761255 - DNA, 22 bp, Homo sapiens
acaggcaggcgggacagcccga

SEQ ID NO: 8761256 - DNA, 22 bp, Homo sapiens
acaggcaggcgggacagcccga

SEQ ID NO: 8761257 - DNA, 22 bp, Homo sapiens
acaggcagcactaatctctggt

SEQ ID NO: 8761258 - DNA, 22 bp, Homo sapiens
acaggcagcaaaatcagcctca

SEQ ID NO: 8761259 - DNA, 14 bp, Homo sapiens
acaggcagatttct

SEQ ID NO: 8761260 - DNA, 22 bp, Homo sapiens
acaggcagcaaaatcagcctca

SEQ ID NO: 8761261 - DNA, 14 bp, Homo sapiens
acaggcagatttct

SEQ ID NO: 8761262 - DNA, 22 bp, Homo sapiens
acaggcagcaaaatcagcctca

SEQ ID NO: 8761263 - DNA, 22 bp, Homo sapiens
acaggcagcaaaatcagcctca

SEQ ID NO: 8761264 - DNA, 22 bp, Homo sapiens
acaggcagattaagggtaggca

SEQ ID NO: 8761265 - DNA, 22 bp, Homo sapiens
acaggcagattaagggtaggca

SEQ ID NO: 8761266 - DNA, 22 bp, Homo sapiens
acaggcagattaagggtaggca

SEQ ID NO: 8761267 - DNA, 22 bp, Homo sapiens
acaggcagattaagggtaggca

SEQ ID NO: 8761268 - DNA, 22 bp, Homo sapiens
acaggcagattaagggtaggca

SEQ ID NO: 8761269 - DNA, 22 bp, Homo sapiens
acaggcagattaagggtaggca

SEQ ID NO: 8761270 - DNA, 17 bp, Homo sapiens
acaggcagatcacctga

SEQ ID NO: 8761271 - DNA, 17 bp, Homo sapiens
acaggcagatcacctga

SEQ ID NO: 8761272 - DNA, 22 bp, Homo sapiens
acaggcagatgttttagttgta

SEQ ID NO: 8761273 - DNA, 22 bp, Homo sapiens
acaggcagattaagggtaggca

SEQ ID NO: 8761274 - DNA, 22 bp, Homo sapiens
acaggcagatgttttagttgta

SEQ ID NO: 8761275 - DNA, 22 bp, Homo sapiens
acagggaagctcaggggctctg

SEQ ID NO: 8761276 - DNA, 22 bp, Homo sapiens
acaggctgttggggtccagggt

SEQ ID NO: 8761277 - DNA, 22 bp, Homo sapiens
acagggaagctcaggggctctg

SEQ ID NO: 8761278 - DNA, 22 bp, Homo sapiens
acagggaagctcaggggctctg

SEQ ID NO: 8761279 - DNA, 22 bp, Homo sapiens
acagggaaggacatgacttggc

SEQ ID NO: 8761280 - DNA, 22 bp, Homo sapiens
acaggctgttggggtccagggt

SEQ ID NO: 8761281 - DNA, 22 bp, Homo sapiens
acaggcagggaccttggctaag

SEQ ID NO: 8761282 - DNA, 22 bp, Homo sapiens
acaggctgttggggtccagggt

SEQ ID NO: 8761283 - DNA, 22 bp, Homo sapiens
acaggcagggacctcttgagtt

SEQ ID NO: 8761284 - DNA, 22 bp, Homo sapiens
acaggcaggcttcggccagagc

SEQ ID NO: 8761285 - DNA, 22 bp, Homo sapiens
acaggcaggcttcggccagagc

SEQ ID NO: 8761286 - DNA, 22 bp, Homo sapiens
acaggcagggaccttggctaag

SEQ ID NO: 8761287 - DNA, 22 bp, Homo sapiens
acaggcagggacctcttgagtt

SEQ ID NO: 8761288 - DNA, 22 bp, Homo sapiens
acaggcagggaccttggctaag

SEQ ID NO: 8761289 - DNA, 22 bp, Homo sapiens
acaggcagggacctcttgagtt

SEQ ID NO: 8761290 - DNA, 22 bp, Homo sapiens
acagggaatggagggatcagta

SEQ ID NO: 8761291 - DNA, 22 bp, Homo sapiens
acagggaaggatttagtgggaa

SEQ ID NO: 8761292 - DNA, 22 bp, Homo sapiens
acagggaagttctgcaacagga

SEQ ID NO: 8761293 - DNA, 22 bp, Homo sapiens
acagggaagttctgcaacagga

SEQ ID NO: 8761294 - DNA, 22 bp, Homo sapiens
acagggaaggatttagtgggaa

SEQ ID NO: 8761295 - DNA, 22 bp, Homo sapiens
acagggaaggcatccgcgaatg

SEQ ID NO: 8761296 - DNA, 22 bp, Homo sapiens
acagggaaggagcatagaaaaa

SEQ ID NO: 8761297 - DNA, 22 bp, Homo sapiens
acagggaccttggaagctggaa

SEQ ID NO: 8761298 - DNA, 22 bp, Homo sapiens
acagggaccttggaagctggaa

SEQ ID NO: 8761299 - DNA, 22 bp, Homo sapiens
acagggagatgggtgaaagcgg

SEQ ID NO: 8761300 - DNA, 22 bp, Homo sapiens
acagggagatgggtgaaagcgg

SEQ ID NO: 8761301 - DNA, 22 bp, Homo sapiens
acagggacctgtgagctccata

SEQ ID NO: 8761302 - DNA, 19 bp, Homo sapiens
acagggaatttccacagaa

SEQ ID NO: 8761303 - DNA, 22 bp, Homo sapiens
acagggacctgtgagctccata

SEQ ID NO: 8761304 - DNA, 22 bp, Homo sapiens
acagggaatggagggatcagta

SEQ ID NO: 8761305 - DNA, 23 bp, Homo sapiens
agctggaggctgtctactcccaa

SEQ ID NO: 8761306 - DNA, 23 bp, Homo sapiens
agctggaggctgtctactcccaa

SEQ ID NO: 8761307 - DNA, 22 bp, Homo sapiens
acagctgtattcaagttgcaag

SEQ ID NO: 8761308 - DNA, 22 bp, Homo sapiens
agctggaggggccagcaggtgt

SEQ ID NO: 8761309 - DNA, 22 bp, Homo sapiens
agctggaggggccagcaggtgt

SEQ ID NO: 8761310 - DNA, 22 bp, Homo sapiens
agctggaggggccagcaggtgt

SEQ ID NO: 8761311 - DNA, 22 bp, Homo sapiens
agctggatgaatttggaacact

SEQ ID NO: 8761312 - DNA, 22 bp, Homo sapiens
acagctggtgaatgttctctgt

SEQ ID NO: 8761313 - DNA, 22 bp, Homo sapiens
acagctgtatccccagagctca

SEQ ID NO: 8761314 - DNA, 22 bp, Homo sapiens
acagctgggtgctgctcagagc

SEQ ID NO: 8761315 - DNA, 22 bp, Homo sapiens
acagctgggtgtcccacttctg

SEQ ID NO: 8761316 - DNA, 22 bp, Homo sapiens
acagctggtgaatgttctctgt

SEQ ID NO: 8761317 - DNA, 22 bp, Homo sapiens
acagctggcaggggggcatgaa

SEQ ID NO: 8761318 - DNA, 22 bp, Homo sapiens
acagctgccaagacagagcagg

SEQ ID NO: 8761319 - DNA, 22 bp, Homo sapiens
acagctgggaatcagctgggga

SEQ ID NO: 8761320 - DNA, 21 bp, Homo sapiens
acagctggccgcgcgggtcgg

SEQ ID NO: 8761321 - DNA, 22 bp, Homo sapiens
acagctgggaactcacacagca

SEQ ID NO: 8761322 - DNA, 22 bp, Homo sapiens
acagctggccgaggctcaggga

SEQ ID NO: 8761323 - DNA, 22 bp, Homo sapiens
acagctggccgaggctcaggga

SEQ ID NO: 8761324 - DNA, 22 bp, Homo sapiens
agctgacaggatggcattatta

SEQ ID NO: 8761325 - DNA, 22 bp, Homo sapiens
agctgaatgttctcagaccaga

SEQ ID NO: 8761326 - DNA, 22 bp, Homo sapiens
agctgacagtgcatggagggac

SEQ ID NO: 8761327 - DNA, 22 bp, Homo sapiens
agctgaatcttgactaggaaga

SEQ ID NO: 8761328 - DNA, 22 bp, Homo sapiens
agctgaagtttagaattgtgaa

SEQ ID NO: 8761329 - DNA, 22 bp, Homo sapiens
agctgaagttcagtccagagaa

SEQ ID NO: 8761330 - DNA, 22 bp, Homo sapiens
agctgaagtgttggtggtttca

SEQ ID NO: 8761331 - DNA, 22 bp, Homo sapiens
agctgaagtgttggtggtttca

SEQ ID NO: 8761332 - DNA, 22 bp, Homo sapiens
agctgaagtcctcgcggtgcta

SEQ ID NO: 8761333 - DNA, 22 bp, Homo sapiens
agctgaagtcctcgcggtgcta

SEQ ID NO: 8761334 - DNA, 22 bp, Homo sapiens
agctgaagtttagaattgtgaa

SEQ ID NO: 8761335 - DNA, 22 bp, Homo sapiens
agctgaagttcagtccagagaa

SEQ ID NO: 8761336 - DNA, 22 bp, Homo sapiens
agctgagaatcttccccagtgt

SEQ ID NO: 8761337 - DNA, 22 bp, Homo sapiens
agctgacttcttgatccaatga

SEQ ID NO: 8761338 - DNA, 22 bp, Homo sapiens
agctgactgatgaagaggcctt

SEQ ID NO: 8761339 - DNA, 22 bp, Homo sapiens
agctgactctggcctctggtcc

SEQ ID NO: 8761340 - DNA, 22 bp, Homo sapiens
agctctgggtcacggctgccga

SEQ ID NO: 8761341 - DNA, 22 bp, Homo sapiens
agctctggggtggagcccagga

SEQ ID NO: 8761342 - DNA, 22 bp, Homo sapiens
agctctggtatttctttaatcc

SEQ ID NO: 8761343 - DNA, 22 bp, Homo sapiens
agctctggtactgctgaccgaa

SEQ ID NO: 8761344 - DNA, 22 bp, Homo sapiens
agctctggttattgaagcaggg

SEQ ID NO: 8761345 - DNA, 22 bp, Homo sapiens
agctctggttattgaagcaggg

SEQ ID NO: 8761346 - DNA, 22 bp, Homo sapiens
agctctggttattgaagcaggg

SEQ ID NO: 8761347 - DNA, 22 bp, Homo sapiens
agctgaagcactgggatggaag

SEQ ID NO: 8761348 - DNA, 22 bp, Homo sapiens
agctctggttattgaagcaggg

SEQ ID NO: 8761349 - DNA, 20 bp, Homo sapiens
agctgaagcccttggggaaa

SEQ ID NO: 8761350 - DNA, 22 bp, Homo sapiens
agctgaagctcagcccagtagt

SEQ ID NO: 8761351 - DNA, 22 bp, Homo sapiens
agctgaagcagtcagttcagct

SEQ ID NO: 8761352 - DNA, 22 bp, Homo sapiens
agctgaagcaacaacaggatgg

SEQ ID NO: 8761353 - DNA, 22 bp, Homo sapiens
agctgaagggaggatatgtaca

SEQ ID NO: 8761354 - DNA, 22 bp, Homo sapiens
agctgaagcagtcagttcagct

SEQ ID NO: 8761355 - DNA, 22 bp, Homo sapiens
agctgaaggctagaacagctgg

SEQ ID NO: 8761356 - DNA, 22 bp, Homo sapiens
agctgaagggaggatatgtaca

SEQ ID NO: 8761357 - DNA, 22 bp, Homo sapiens
agctgaaggctagaacagctgg

SEQ ID NO: 8761358 - DNA, 22 bp, Homo sapiens
agctgaagctcagcccagtagt

SEQ ID NO: 8761359 - DNA, 22 bp, Homo sapiens
acaggaggggcatgaaagacgg

SEQ ID NO: 8761360 - DNA, 22 bp, Homo sapiens
acaggaggggcatgaaagacgg

SEQ ID NO: 8761361 - DNA, 22 bp, Homo sapiens
acaggaggggcatgaaagacgg

SEQ ID NO: 8761362 - DNA, 22 bp, Homo sapiens
acaggaggggcatgaaagacgg

SEQ ID NO: 8761363 - DNA, 23 bp, Homo sapiens
acaggaggggacaggtggccgtg

SEQ ID NO: 8761364 - DNA, 22 bp, Homo sapiens
acaggagtggctctaccagacc

SEQ ID NO: 8761365 - DNA, 22 bp, Homo sapiens
acaggagtggagaggtgcctct

SEQ ID NO: 8761366 - DNA, 23 bp, Homo sapiens
acaggaggggacaggtggccgtg

SEQ ID NO: 8761367 - DNA, 22 bp, Homo sapiens
acaggagggacaccttcctgct

SEQ ID NO: 8761368 - DNA, 22 bp, Homo sapiens
acaggagaattatctggaacaa

SEQ ID NO: 8761369 - DNA, 22 bp, Homo sapiens
acaggagaattatctggaacaa

SEQ ID NO: 8761370 - DNA, 22 bp, Homo sapiens
agctggcaaggcaatttggatt

SEQ ID NO: 8761371 - DNA, 22 bp, Homo sapiens
agctggcaaacagcttacggcc

SEQ ID NO: 8761372 - DNA, 22 bp, Homo sapiens
agctggattccagtgcagtcac

SEQ ID NO: 8761373 - DNA, 22 bp, Homo sapiens
agctggcaatgtaagtccctgg

SEQ ID NO: 8761374 - DNA, 22 bp, Homo sapiens
agctggcaatgtaagtccctgg

SEQ ID NO: 8761375 - DNA, 22 bp, Homo sapiens
agctggcaaggctttagattca

SEQ ID NO: 8761376 - DNA, 22 bp, Homo sapiens
agctggcaatctttctaaatac

SEQ ID NO: 8761377 - DNA, 21 bp, Homo sapiens
agctggcaatgttgtcctctt

SEQ ID NO: 8761378 - DNA, 22 bp, Homo sapiens
agctggcaccaaatatagtaaa

SEQ ID NO: 8761379 - DNA, 22 bp, Homo sapiens
agctggcacagaccaggagatc

SEQ ID NO: 8761380 - DNA, 22 bp, Homo sapiens
agctggtggagcctttctgttt

SEQ ID NO: 8761381 - DNA, 22 bp, Homo sapiens
agctggtggattatgctgtaca

SEQ ID NO: 8761382 - DNA, 22 bp, Homo sapiens
agctggtggggaagctgcaggt

SEQ ID NO: 8761383 - DNA, 18 bp, Homo sapiens
agctggtggggagacagc

SEQ ID NO: 8761384 - DNA, 22 bp, Homo sapiens
acaggatcgccctgttgcccag

SEQ ID NO: 8761385 - DNA, 22 bp, Homo sapiens
agctggtggagaagcagacctc

SEQ ID NO: 8761386 - DNA, 22 bp, Homo sapiens
acaggagtttctgacagagaca

SEQ ID NO: 8761387 - DNA, 22 bp, Homo sapiens
acaggagttaaggctgagttga

SEQ ID NO: 8761388 - DNA, 22 bp, Homo sapiens
acaggagtttaagaaatatttc

SEQ ID NO: 8761389 - DNA, 22 bp, Homo sapiens
agctggtgtcctcctggagctg

SEQ ID NO: 8761390 - DNA, 22 bp, Homo sapiens
agctggtgtcctcctggagctg

SEQ ID NO: 8761391 - DNA, 22 bp, Homo sapiens
agctggtgtcctcctggagctg

SEQ ID NO: 8761392 - DNA, 22 bp, Homo sapiens
agctggtgtcctcctggagctg

SEQ ID NO: 8761393 - DNA, 22 bp, Homo sapiens
agctggtgtgccactgttgggg

SEQ ID NO: 8761394 - DNA, 22 bp, Homo sapiens
agctggtgtgccactgttgggg

SEQ ID NO: 8761395 - DNA, 22 bp, Homo sapiens
agctggtgtcacctccagtcca

SEQ ID NO: 8761396 - DNA, 21 bp, Homo sapiens
agctggtgtcagagctctggg

SEQ ID NO: 8761397 - DNA, 22 bp, Homo sapiens
agctggtgtgccagttccagtt

SEQ ID NO: 8761398 - DNA, 22 bp, Homo sapiens
agctggtgtgccagttccagtt

SEQ ID NO: 8761399 - DNA, 22 bp, Homo sapiens
agctggtgtgctctggaatcct

SEQ ID NO: 8761400 - DNA, 22 bp, Homo sapiens
acaggcagagtcaggttgggtt

SEQ ID NO: 8761401 - DNA, 22 bp, Homo sapiens
acaggcagagtcaggttgggtt

SEQ ID NO: 8761402 - DNA, 21 bp, Homo sapiens
acaggcaccatgcctgtgcct

SEQ ID NO: 8761403 - DNA, 22 bp, Homo sapiens
acaggcacaggtgtgccccacc

SEQ ID NO: 8761404 - DNA, 22 bp, Homo sapiens
atacattagtgaacaaaagaga

SEQ ID NO: 8761405 - DNA, 22 bp, Homo sapiens
atacattagtgaacaaaagaga

SEQ ID NO: 8761406 - DNA, 22 bp, Homo sapiens
atacattagctcatatgattaa

SEQ ID NO: 8761407 - DNA, 22 bp, Homo sapiens
atacattagctcatatgattaa

SEQ ID NO: 8761408 - DNA, 22 bp, Homo sapiens
atacatgttgagaaaatatctg

SEQ ID NO: 8761409 - DNA, 22 bp, Homo sapiens
atacatgttgagaaaatatctg

SEQ ID NO: 8761410 - DNA, 22 bp, Homo sapiens
atacatgttgagaaaatatctg

SEQ ID NO: 8761411 - DNA, 22 bp, Homo sapiens
atacatgttgtaccatatgttt

SEQ ID NO: 8761412 - DNA, 22 bp, Homo sapiens
atacatgttgtaccatatgttt

SEQ ID NO: 8761413 - DNA, 22 bp, Homo sapiens
atacatgttgtaccatatgttt

SEQ ID NO: 8761414 - DNA, 22 bp, Homo sapiens
atacatgtttgctggataaaca

SEQ ID NO: 8761415 - DNA, 22 bp, Homo sapiens
atacatgttgtaccatatgttt

SEQ ID NO: 8761416 - DNA, 22 bp, Homo sapiens
acttcttcttcagctgggggat

SEQ ID NO: 8761417 - DNA, 22 bp, Homo sapiens
acttcttcttcagctgggggat

SEQ ID NO: 8761418 - DNA, 22 bp, Homo sapiens
atacatgttcgtgtacatgttc

SEQ ID NO: 8761419 - DNA, 22 bp, Homo sapiens
atacatgttgagaaaatatctg

SEQ ID NO: 8761420 - DNA, 22 bp, Homo sapiens
atacatctatgcctttctgaca

SEQ ID NO: 8761421 - DNA, 22 bp, Homo sapiens
acttctttcacaatgtttctag

SEQ ID NO: 8761422 - DNA, 22 bp, Homo sapiens
acttctttcacaatgtttctag

SEQ ID NO: 8761423 - DNA, 22 bp, Homo sapiens
acttcttcttcagctgggggat

SEQ ID NO: 8761424 - DNA, 22 bp, Homo sapiens
atactgaattaggtaaagcata

SEQ ID NO: 8761425 - DNA, 22 bp, Homo sapiens
atactgaaggcattcagataac

SEQ ID NO: 8761426 - DNA, 22 bp, Homo sapiens
atactgaacatgtttgcagtca

SEQ ID NO: 8761427 - DNA, 22 bp, Homo sapiens
atactgaaggcattcagataac

SEQ ID NO: 8761428 - DNA, 22 bp, Homo sapiens
atactgatacggaagaaaaaag

SEQ ID NO: 8761429 - DNA, 22 bp, Homo sapiens
atactgatgatgtgaagaaaca

SEQ ID NO: 8761430 - DNA, 22 bp, Homo sapiens
atactgattagttgagaaagca

SEQ ID NO: 8761431 - DNA, 22 bp, Homo sapiens
atactgatgatgtgaagaaaca

SEQ ID NO: 8761432 - DNA, 22 bp, Homo sapiens
atactgaattaggtaaagcata

SEQ ID NO: 8761433 - DNA, 22 bp, Homo sapiens
atactggagaagccaagaagcc

SEQ ID NO: 8761434 - DNA, 22 bp, Homo sapiens
atactgtaatacctaaatgaac

SEQ ID NO: 8761435 - DNA, 22 bp, Homo sapiens
atactggttttctttcagcact

SEQ ID NO: 8761436 - DNA, 22 bp, Homo sapiens
actttatttcctattgcatcca

SEQ ID NO: 8761437 - DNA, 23 bp, Homo sapiens
actttatcctatatctttgttct

SEQ ID NO: 8761438 - DNA, 22 bp, Homo sapiens
actttcaaaagagaagtcatga

SEQ ID NO: 8761439 - DNA, 22 bp, Homo sapiens
actttcaaaagagaagtcatga

SEQ ID NO: 8761440 - DNA, 22 bp, Homo sapiens
actttagtaaacttatgttact

SEQ ID NO: 8761441 - DNA, 22 bp, Homo sapiens
actttagtaaacttatgttact

SEQ ID NO: 8761442 - DNA, 22 bp, Homo sapiens
atactgtatatttcacatcttg

SEQ ID NO: 8761443 - DNA, 22 bp, Homo sapiens
atactgtagaggcatagctagt

SEQ ID NO: 8761444 - DNA, 22 bp, Homo sapiens
atactgtacgtcccagatagga

SEQ ID NO: 8761445 - DNA, 22 bp, Homo sapiens
atactgtagaggcatagctagt

SEQ ID NO: 8761446 - DNA, 21 bp, Homo sapiens
acttaaattccttgatattta

SEQ ID NO: 8761447 - DNA, 21 bp, Homo sapiens
acttaaattccttgatattta

SEQ ID NO: 8761448 - DNA, 22 bp, Homo sapiens
acttaacagacattatttacct

SEQ ID NO: 8761449 - DNA, 22 bp, Homo sapiens
acttaaatagaactcctcaata

SEQ ID NO: 8761450 - DNA, 23 bp, Homo sapiens
acttaaatggttctttatctcag

SEQ ID NO: 8761451 - DNA, 22 bp, Homo sapiens
ataatgctgggagaaattgtta

SEQ ID NO: 8761452 - DNA, 22 bp, Homo sapiens
acttaaagttataatttgctaa

SEQ ID NO: 8761453 - DNA, 22 bp, Homo sapiens
acttacaatcaaccaccttgga

SEQ ID NO: 8761454 - DNA, 22 bp, Homo sapiens
acttagaaattcagttttgtca

SEQ ID NO: 8761455 - DNA, 22 bp, Homo sapiens
acttagaaagggattctagatt

SEQ ID NO: 8761456 - DNA, 22 bp, Homo sapiens
acttaacagacattatttacct

SEQ ID NO: 8761457 - DNA, 22 bp, Homo sapiens
atacagatgttaaagcaatttc

SEQ ID NO: 8761458 - DNA, 22 bp, Homo sapiens
atacagatgttaaagcaatttc

SEQ ID NO: 8761459 - DNA, 22 bp, Homo sapiens
atacacttgtacattttttaat

SEQ ID NO: 8761460 - DNA, 22 bp, Homo sapiens
atacagatgttgaatgttatat

SEQ ID NO: 8761461 - DNA, 22 bp, Homo sapiens
atacagatgttgaatgttatat

SEQ ID NO: 8761462 - DNA, 22 bp, Homo sapiens
acttagaagatgcagtaaagca

SEQ ID NO: 8761463 - DNA, 22 bp, Homo sapiens
acttagaacaggcagaattcca

SEQ ID NO: 8761464 - DNA, 22 bp, Homo sapiens
acttctcttccccggaactcta

SEQ ID NO: 8761465 - DNA, 22 bp, Homo sapiens
acttctctttagtactaaatgt

SEQ ID NO: 8761466 - DNA, 22 bp, Homo sapiens
atacagtaaccacattctatag

SEQ ID NO: 8761467 - DNA, 22 bp, Homo sapiens
atacagtaaccacattctatag

SEQ ID NO: 8761468 - DNA, 22 bp, Homo sapiens
atacagtaaccacattctatag

SEQ ID NO: 8761469 - DNA, 22 bp, Homo sapiens
atacagtaaccacattctatag

SEQ ID NO: 8761470 - DNA, 22 bp, Homo sapiens
atacaggtggacttcagttagt

SEQ ID NO: 8761471 - DNA, 22 bp, Homo sapiens
atacaggtggggtggtctatga

SEQ ID NO: 8761472 - DNA, 22 bp, Homo sapiens
atacaggtggaactaaataaat

SEQ ID NO: 8761473 - DNA, 22 bp, Homo sapiens
atacaggttgaattttctttta

SEQ ID NO: 8761474 - DNA, 22 bp, Homo sapiens
atacaggttaagccaaggctgg

SEQ ID NO: 8761475 - DNA, 22 bp, Homo sapiens
atacaggttgaattttctttta

SEQ ID NO: 8761476 - DNA, 22 bp, Homo sapiens
atacaggtgtgagggtctcttt

SEQ ID NO: 8761477 - DNA, 22 bp, Homo sapiens
atacagtaaccacattctatag

SEQ ID NO: 8761478 - DNA, 22 bp, Homo sapiens
acttctctttagtactaaatgt

SEQ ID NO: 8761479 - DNA, 19 bp, Homo sapiens
acttctgaggaactgcaca

SEQ ID NO: 8761480 - DNA, 22 bp, Homo sapiens
atacagctttctttcacatgag

SEQ ID NO: 8761481 - DNA, 22 bp, Homo sapiens
atacagcttacagttctaatgc

SEQ ID NO: 8761482 - DNA, 22 bp, Homo sapiens
atacagcttacagttctaatgc

SEQ ID NO: 8761483 - DNA, 22 bp, Homo sapiens
atacagcttatgcatatatctc

SEQ ID NO: 8761484 - DNA, 22 bp, Homo sapiens
atacagggacatccagtttttc

SEQ ID NO: 8761485 - DNA, 22 bp, Homo sapiens
atacagggacatccagtttttc

SEQ ID NO: 8761486 - DNA, 22 bp, Homo sapiens
atacaggtaatttgaataatag

SEQ ID NO: 8761487 - DNA, 22 bp, Homo sapiens
atacaggaactctctacacttt

SEQ ID NO: 8761488 - DNA, 22 bp, Homo sapiens
atacagattgctatacttacaa

SEQ ID NO: 8761489 - DNA, 22 bp, Homo sapiens
atacagcagcccttgctttgca

SEQ ID NO: 8761490 - DNA, 22 bp, Homo sapiens
atacagcagtgaataagataaa

SEQ ID NO: 8761491 - DNA, 22 bp, Homo sapiens
atacagcagcccttgctttgca

SEQ ID NO: 8761492 - DNA, 22 bp, Homo sapiens
atacagcagcccttgctttgca

SEQ ID NO: 8761493 - DNA, 22 bp, Homo sapiens
atacagattgctatacttacaa

SEQ ID NO: 8761494 - DNA, 22 bp, Homo sapiens
atacagcagtgaataagataaa

SEQ ID NO: 8761495 - DNA, 22 bp, Homo sapiens
atacagcagtttgtgatcctag

SEQ ID NO: 8761496 - DNA, 22 bp, Homo sapiens
atacagcctattcttaccattg

SEQ ID NO: 8761497 - DNA, 22 bp, Homo sapiens
ataaaatgtctccactgggctc

SEQ ID NO: 8761498 - DNA, 22 bp, Homo sapiens
ataaaatttgctactgttaaat

SEQ ID NO: 8761499 - DNA, 22 bp, Homo sapiens
ataaaatttgctactgttaaat

SEQ ID NO: 8761500 - DNA, 22 bp, Homo sapiens
ataaaatttgctactgttaaat

SEQ ID NO: 8761501 - DNA, 22 bp, Homo sapiens
ataaaatttgctactgttaaat

SEQ ID NO: 8761502 - DNA, 22 bp, Homo sapiens
ataaaatttgctactgttaaat

SEQ ID NO: 8761503 - DNA, 22 bp, Homo sapiens
ataaacaagactggccaacttt

SEQ ID NO: 8761504 - DNA, 22 bp, Homo sapiens
ataaacaagactggccaacttt

SEQ ID NO: 8761505 - DNA, 22 bp, Homo sapiens
ataaacaagactggccaacttt

SEQ ID NO: 8761506 - DNA, 22 bp, Homo sapiens
ataaacaagactggccaacttt

SEQ ID NO: 8761507 - DNA, 22 bp, Homo sapiens
ataaacagtaaatgtgagcagt

SEQ ID NO: 8761508 - DNA, 22 bp, Homo sapiens
ataaacagtaaatgtgagcagt

SEQ ID NO: 8761509 - DNA, 22 bp, Homo sapiens
ataaacagtaaatgtgagcagt

SEQ ID NO: 8761510 - DNA, 22 bp, Homo sapiens
ataaacagtagagaaaggtggt

SEQ ID NO: 8761511 - DNA, 22 bp, Homo sapiens
ataaacagtagagaaaggtggt

SEQ ID NO: 8761512 - DNA, 21 bp, Homo sapiens
ataaacagcatgtgatccatg

SEQ ID NO: 8761513 - DNA, 22 bp, Homo sapiens
ataaacagcctgcccaaattgg

SEQ ID NO: 8761514 - DNA, 22 bp, Homo sapiens
ataaacagagtagttgctactg

SEQ ID NO: 8761515 - DNA, 22 bp, Homo sapiens
ataaacagcataaaatacgctt

SEQ ID NO: 8761516 - DNA, 22 bp, Homo sapiens
ataaacacttctagggcacaca

SEQ ID NO: 8761517 - DNA, 22 bp, Homo sapiens
ataaacacttctagggcacaca

SEQ ID NO: 8761518 - DNA, 22 bp, Homo sapiens
actgtgatgttctctatcttgg

SEQ ID NO: 8761519 - DNA, 22 bp, Homo sapiens
actgtgatgcagttgccatcca

SEQ ID NO: 8761520 - DNA, 22 bp, Homo sapiens
actgtgatgcagttgccatcca

SEQ ID NO: 8761521 - DNA, 22 bp, Homo sapiens
actgtgatgatgaagcatggtt

SEQ ID NO: 8761522 - DNA, 22 bp, Homo sapiens
actgtgagtgatttccttctgg

SEQ ID NO: 8761523 - DNA, 22 bp, Homo sapiens
actgtgagtttatttatctgat

SEQ ID NO: 8761524 - DNA, 22 bp, Homo sapiens
actgtgatgtttgtgatcatct

SEQ ID NO: 8761525 - DNA, 22 bp, Homo sapiens
actgtgatgtttgtgatcatct

SEQ ID NO: 8761526 - DNA, 22 bp, Homo sapiens
actgtgatgtttgtgatcatct

SEQ ID NO: 8761527 - DNA, 22 bp, Homo sapiens
actgtgcaagtcaaagatgggc

SEQ ID NO: 8761528 - DNA, 22 bp, Homo sapiens
actgtgcaatgagtaataaact

SEQ ID NO: 8761529 - DNA, 22 bp, Homo sapiens
ataatctggtctttgtatgagt

SEQ ID NO: 8761530 - DNA, 22 bp, Homo sapiens
ataatcttgtatttcctaaagt

SEQ ID NO: 8761531 - DNA, 22 bp, Homo sapiens
ataatccatgtctagagtaaag

SEQ ID NO: 8761532 - DNA, 22 bp, Homo sapiens
ataatctggtctttgtatgagt

SEQ ID NO: 8761533 - DNA, 22 bp, Homo sapiens
ataatctgagctatttcatgag

SEQ ID NO: 8761534 - DNA, 22 bp, Homo sapiens
ataatgaatgcagagttatttt

SEQ ID NO: 8761535 - DNA, 22 bp, Homo sapiens
ataatgagcttttgaatactga

SEQ ID NO: 8761536 - DNA, 22 bp, Homo sapiens
ataatgacattcttagactgga

SEQ ID NO: 8761537 - DNA, 22 bp, Homo sapiens
ataatgagaatacagtaactat

SEQ ID NO: 8761538 - DNA, 22 bp, Homo sapiens
ataatgatcaacagcatcttgc

SEQ ID NO: 8761539 - DNA, 22 bp, Homo sapiens
actgtgcatgaaccgaaacaaa

SEQ ID NO: 8761540 - DNA, 22 bp, Homo sapiens
actgtgcaggggaagagagaaa

SEQ ID NO: 8761541 - DNA, 22 bp, Homo sapiens
actgtgcaggggaagagagaaa

SEQ ID NO: 8761542 - DNA, 21 bp, Homo sapiens
actgtgcagcctgaggatgtg

SEQ ID NO: 8761543 - DNA, 22 bp, Homo sapiens
actgtgcacacaaaaatagatt

SEQ ID NO: 8761544 - DNA, 21 bp, Homo sapiens
actgtgcagcctgaggatgtg

SEQ ID NO: 8761545 - DNA, 22 bp, Homo sapiens
actgtgcagctgagtgctaatt

SEQ ID NO: 8761546 - DNA, 22 bp, Homo sapiens
actgtgcaccctggacagtgtc

SEQ ID NO: 8761547 - DNA, 22 bp, Homo sapiens
ataagtaggaaaatttgaatat

SEQ ID NO: 8761548 - DNA, 22 bp, Homo sapiens
ataaggttaacatcatcagtga

SEQ ID NO: 8761549 - DNA, 22 bp, Homo sapiens
actgtgcatttgtcatggggtt

SEQ ID NO: 8761550 - DNA, 22 bp, Homo sapiens
actgtgcatttgaagggatcat

SEQ ID NO: 8761551 - DNA, 22 bp, Homo sapiens
actgtgcatttcatgtcttttc

SEQ ID NO: 8761552 - DNA, 19 bp, Homo sapiens
actgtagcactgcagtata

SEQ ID NO: 8761553 - DNA, 19 bp, Homo sapiens
actgtagcactgcagtata

SEQ ID NO: 8761554 - DNA, 22 bp, Homo sapiens
actgtagaggcctggattgagg

SEQ ID NO: 8761555 - DNA, 22 bp, Homo sapiens
actgtagagaatctgagaaaaa

SEQ ID NO: 8761556 - DNA, 22 bp, Homo sapiens
actgtaaattttggttgcaggt

SEQ ID NO: 8761557 - DNA, 20 bp, Homo sapiens
actgggagctaacggagatt

SEQ ID NO: 8761558 - DNA, 22 bp, Homo sapiens
actgtaacacaatggtatctgt

SEQ ID NO: 8761559 - DNA, 22 bp, Homo sapiens
actgtacatgtaaacattgtca

SEQ ID NO: 8761560 - DNA, 22 bp, Homo sapiens
actgtacatgtaaacattgtca

SEQ ID NO: 8761561 - DNA, 20 bp, Homo sapiens
actgggagctaacggagatt

SEQ ID NO: 8761562 - DNA, 22 bp, Homo sapiens
actgtacatgtaaacattgtca

SEQ ID NO: 8761563 - DNA, 22 bp, Homo sapiens
actgggaaaagctatggcaaat

SEQ ID NO: 8761564 - DNA, 19 bp, Homo sapiens
actgggaaaaaggcactgg

SEQ ID NO: 8761565 - DNA, 22 bp, Homo sapiens
actgggaacctgtgctaggagg

SEQ ID NO: 8761566 - DNA, 22 bp, Homo sapiens
actgggaagagagaattctgtc

SEQ ID NO: 8761567 - DNA, 22 bp, Homo sapiens
actgggaagacaagaaagatag

SEQ ID NO: 8761568 - DNA, 19 bp, Homo sapiens
actgggaaaaaggcactgg

SEQ ID NO: 8761569 - DNA, 22 bp, Homo sapiens
actgggaaggagcaggatctgt

SEQ ID NO: 8761570 - DNA, 22 bp, Homo sapiens
actgggaatctcaggaacatgg

SEQ ID NO: 8761571 - DNA, 22 bp, Homo sapiens
actgggacagtcagaaacatga

SEQ ID NO: 8761572 - DNA, 23 bp, Homo sapiens
actgggaagtttggagagacgca

SEQ ID NO: 8761573 - DNA, 22 bp, Homo sapiens
actgtcactaactaagtctagt

SEQ ID NO: 8761574 - DNA, 22 bp, Homo sapiens
actgtcactccaactgagtcgt

SEQ ID NO: 8761575 - DNA, 19 bp, Homo sapiens
actgtcacataaaggaagg

SEQ ID NO: 8761576 - DNA, 22 bp, Homo sapiens
actgtcaagagattcaaattca

SEQ ID NO: 8761577 - DNA, 22 bp, Homo sapiens
actgtcaagagattcaaattca

SEQ ID NO: 8761578 - DNA, 22 bp, Homo sapiens
actgtcaaatttatggaaagag

SEQ ID NO: 8761579 - DNA, 22 bp, Homo sapiens
actgtcatctggtagatgatgg

SEQ ID NO: 8761580 - DNA, 22 bp, Homo sapiens
actgtcacttgcaactgtgagg

SEQ ID NO: 8761581 - DNA, 22 bp, Homo sapiens
actgtcacttgcaactgtgagg

SEQ ID NO: 8761582 - DNA, 22 bp, Homo sapiens
actgtcaggatggcagcttgtt

SEQ ID NO: 8761583 - DNA, 22 bp, Homo sapiens
actgtcactgtgatgttagaga

SEQ ID NO: 8761584 - DNA, 22 bp, Homo sapiens
actgtagctgccactggatgca

SEQ ID NO: 8761585 - DNA, 22 bp, Homo sapiens
actgtatagtatttattcttag

SEQ ID NO: 8761586 - DNA, 22 bp, Homo sapiens
actgtatagtatttattcttag

SEQ ID NO: 8761587 - DNA, 22 bp, Homo sapiens
actgtatattggacaaggaaaa

SEQ ID NO: 8761588 - DNA, 22 bp, Homo sapiens
actgtattctagtcatgtttgt

SEQ ID NO: 8761589 - DNA, 22 bp, Homo sapiens
actgtattctagtcatgtttgt

SEQ ID NO: 8761590 - DNA, 22 bp, Homo sapiens
actgtcaaatgcaatgaactca

SEQ ID NO: 8761591 - DNA, 22 bp, Homo sapiens
actgtattttgggtgtattttc

SEQ ID NO: 8761592 - DNA, 22 bp, Homo sapiens
actgtatttggatataagatct

SEQ ID NO: 8761593 - DNA, 22 bp, Homo sapiens
agaaaagtgctctagtgagagc

SEQ ID NO: 8761594 - DNA, 21 bp, Homo sapiens
agaaaagtatttgaatcaaga

SEQ ID NO: 8761595 - DNA, 21 bp, Homo sapiens
agaaaagtatttgaatcaaga

SEQ ID NO: 8761596 - DNA, 21 bp, Homo sapiens
agaaaagtatttgaatcaaga

SEQ ID NO: 8761597 - DNA, 21 bp, Homo sapiens
agaaaagtatttgaatcaaga

SEQ ID NO: 8761598 - DNA, 21 bp, Homo sapiens
agaaaagtatttgaatcaaga

SEQ ID NO: 8761599 - DNA, 23 bp, Homo sapiens
agaaaagttcatacctttttaac

SEQ ID NO: 8761600 - DNA, 22 bp, Homo sapiens
agaaaataaattgatggtggaa

SEQ ID NO: 8761601 - DNA, 22 bp, Homo sapiens
atattctctgctgcttttgtgt

SEQ ID NO: 8761602 - DNA, 22 bp, Homo sapiens
atattacacacggtatcacggg

SEQ ID NO: 8761603 - DNA, 22 bp, Homo sapiens
agaaaataaattgatggtggaa

SEQ ID NO: 8761604 - DNA, 22 bp, Homo sapiens
atattcatcgtgtagaaatact

SEQ ID NO: 8761605 - DNA, 22 bp, Homo sapiens
atattcattgaacacctactac

SEQ ID NO: 8761606 - DNA, 23 bp, Homo sapiens
atatttccaggttagtgaggtaa

SEQ ID NO: 8761607 - DNA, 23 bp, Homo sapiens
atatttccaggttagtgaggtaa

SEQ ID NO: 8761608 - DNA, 22 bp, Homo sapiens
atatttcagctttacttaggaa

SEQ ID NO: 8761609 - DNA, 20 bp, Homo sapiens
atatttcaggtagtgtgccc

SEQ ID NO: 8761610 - DNA, 22 bp, Homo sapiens
atatttcaggttttgcaggccg

SEQ ID NO: 8761611 - DNA, 22 bp, Homo sapiens
atatttcacgtaggttgttttc

SEQ ID NO: 8761612 - DNA, 22 bp, Homo sapiens
atattcttatccttttctctgt

SEQ ID NO: 8761613 - DNA, 22 bp, Homo sapiens
atattcttccaaaacatcattt

SEQ ID NO: 8761614 - DNA, 22 bp, Homo sapiens
atattcttccaaaacatcattt

SEQ ID NO: 8761615 - DNA, 22 bp, Homo sapiens
atatttataaggcaggcaagta

SEQ ID NO: 8761616 - DNA, 22 bp, Homo sapiens
atatttataaggcaggcaagta

SEQ ID NO: 8761617 - DNA, 22 bp, Homo sapiens
atatttataaggcaggcaagta

SEQ ID NO: 8761618 - DNA, 22 bp, Homo sapiens
atatttataagcaagcaggact

SEQ ID NO: 8761619 - DNA, 22 bp, Homo sapiens
atatttataagcaagcaggact

SEQ ID NO: 8761620 - DNA, 22 bp, Homo sapiens
atatttataagcaagcaggact

SEQ ID NO: 8761621 - DNA, 22 bp, Homo sapiens
actttcaattcccttagcaact

SEQ ID NO: 8761622 - DNA, 22 bp, Homo sapiens
actttcaagccctctagagaca

SEQ ID NO: 8761623 - DNA, 22 bp, Homo sapiens
actttcaattcactgagatata

SEQ ID NO: 8761624 - DNA, 22 bp, Homo sapiens
actttcaattcccttagcaact

SEQ ID NO: 8761625 - DNA, 22 bp, Homo sapiens
actttcaagcaagaacactttg

SEQ ID NO: 8761626 - DNA, 22 bp, Homo sapiens
actttcaagccctctagagaca

SEQ ID NO: 8761627 - DNA, 22 bp, Homo sapiens
actttcaacttggtgggagagc

SEQ ID NO: 8761628 - DNA, 22 bp, Homo sapiens
actttcaagaacttctttaatg

SEQ ID NO: 8761629 - DNA, 22 bp, Homo sapiens
actttcaagaacttctttaatg

SEQ ID NO: 8761630 - DNA, 22 bp, Homo sapiens
actttcatttgtgaagactgta

SEQ ID NO: 8761631 - DNA, 22 bp, Homo sapiens
actttcatgttggtgaagggtt

SEQ ID NO: 8761632 - DNA, 22 bp, Homo sapiens
actttcatttgtaataaacttc

SEQ ID NO: 8761633 - DNA, 22 bp, Homo sapiens
actttcatggtagttgtattct

SEQ ID NO: 8761634 - DNA, 22 bp, Homo sapiens
actttcatgttcatttggaacc

SEQ ID NO: 8761635 - DNA, 22 bp, Homo sapiens
actttctcaaatcagactttaa

SEQ ID NO: 8761636 - DNA, 22 bp, Homo sapiens
actttctattcccacagagata

SEQ ID NO: 8761637 - DNA, 22 bp, Homo sapiens
actttctatggcttattatgag

SEQ ID NO: 8761638 - DNA, 22 bp, Homo sapiens
actttcctggccctgtcctctg

SEQ ID NO: 8761639 - DNA, 22 bp, Homo sapiens
actttcctggccctgtcctctg

SEQ ID NO: 8761640 - DNA, 22 bp, Homo sapiens
actttcctgccaaggccagagt

SEQ ID NO: 8761641 - DNA, 22 bp, Homo sapiens
actttcctagacttcagtgaca

SEQ ID NO: 8761642 - DNA, 22 bp, Homo sapiens
actttcctagacttcagtgaca

SEQ ID NO: 8761643 - DNA, 22 bp, Homo sapiens
actttcctagacttcagtgaca

SEQ ID NO: 8761644 - DNA, 22 bp, Homo sapiens
agaaaaggttgaaagtaggatt

SEQ ID NO: 8761645 - DNA, 22 bp, Homo sapiens
atatggatgagataatgagcca

SEQ ID NO: 8761646 - DNA, 22 bp, Homo sapiens
atatggaactattctgtgtaga

SEQ ID NO: 8761647 - DNA, 22 bp, Homo sapiens
atatggaaatagcaatatggtt

SEQ ID NO: 8761648 - DNA, 22 bp, Homo sapiens
atatgcttgtcacacacatcca

SEQ ID NO: 8761649 - DNA, 22 bp, Homo sapiens
atatgaaagtaagcatgtgtgt

SEQ ID NO: 8761650 - DNA, 22 bp, Homo sapiens
atatgcttacagcttaaaatcc

SEQ ID NO: 8761651 - DNA, 22 bp, Homo sapiens
atatgcttgggactgatacagt

SEQ ID NO: 8761652 - DNA, 22 bp, Homo sapiens
atatgcttgggactgatacagt

SEQ ID NO: 8761653 - DNA, 22 bp, Homo sapiens
actttctcccacccacccgtct

SEQ ID NO: 8761654 - DNA, 22 bp, Homo sapiens
actttctcaggaattcacagac

SEQ ID NO: 8761655 - DNA, 22 bp, Homo sapiens
actttctccagaaaaccaagga

SEQ ID NO: 8761656 - DNA, 22 bp, Homo sapiens
actttctcaggaattcacagac

SEQ ID NO: 8761657 - DNA, 22 bp, Homo sapiens
actttctccagaaaaccaagga

SEQ ID NO: 8761658 - DNA, 19 bp, Homo sapiens
actttctccaggacctgtt

SEQ ID NO: 8761659 - DNA, 22 bp, Homo sapiens
agaaagttatcacaaaattgag

SEQ ID NO: 8761660 - DNA, 22 bp, Homo sapiens
agaaagttatcacaaaattgag

SEQ ID NO: 8761661 - DNA, 22 bp, Homo sapiens
agaaagttaaacagtgataaga

SEQ ID NO: 8761662 - DNA, 22 bp, Homo sapiens
agaaagttagcagactcttggc

SEQ ID NO: 8761663 - DNA, 22 bp, Homo sapiens
agaaagttgttggaggaaatga

SEQ ID NO: 8761664 - DNA, 22 bp, Homo sapiens
agaaagttgttggaggaaatga

SEQ ID NO: 8761665 - DNA, 22 bp, Homo sapiens
agaaagttcactggtatatttt

SEQ ID NO: 8761666 - DNA, 22 bp, Homo sapiens
agaaagtgaacgtgttcagttt

SEQ ID NO: 8761667 - DNA, 22 bp, Homo sapiens
agaaagtgaccttgaaaactgg

SEQ ID NO: 8761668 - DNA, 22 bp, Homo sapiens
agaaagtgaccttgaaaactgg

SEQ ID NO: 8761669 - DNA, 22 bp, Homo sapiens
agaaagtgcctcccttgggagc

SEQ ID NO: 8761670 - DNA, 22 bp, Homo sapiens
agaaagttaaacagtgataaga

SEQ ID NO: 8761671 - DNA, 22 bp, Homo sapiens
agaaagtgtgtcatactaagtg

SEQ ID NO: 8761672 - DNA, 22 bp, Homo sapiens
agaaagtgcttccctttggtga

SEQ ID NO: 8761673 - DNA, 22 bp, Homo sapiens
agaaagtgcttccctttggact

SEQ ID NO: 8761674 - DNA, 22 bp, Homo sapiens
agaaagggttctctgaggtgct

SEQ ID NO: 8761675 - DNA, 22 bp, Homo sapiens
agaaagggtcactgaaagagga

SEQ ID NO: 8761676 - DNA, 22 bp, Homo sapiens
agaaagggctattttgaggtag

SEQ ID NO: 8761677 - DNA, 22 bp, Homo sapiens
agaaagctggaagagctgggat

SEQ ID NO: 8761678 - DNA, 22 bp, Homo sapiens
agaaagggttctctgaggtgct

SEQ ID NO: 8761679 - DNA, 22 bp, Homo sapiens
agaaagggttctctgaggtgct

SEQ ID NO: 8761680 - DNA, 22 bp, Homo sapiens
agaaagtacagatgagacactt

SEQ ID NO: 8761681 - DNA, 22 bp, Homo sapiens
agaaagtttgagaactgtagat

SEQ ID NO: 8761682 - DNA, 22 bp, Homo sapiens
agaaagtttggggctgggcacg

SEQ ID NO: 8761683 - DNA, 22 bp, Homo sapiens
agaaattaggaaagtaacactt

SEQ ID NO: 8761684 - DNA, 22 bp, Homo sapiens
agaaagttctgtgagttgttca

SEQ ID NO: 8761685 - DNA, 22 bp, Homo sapiens
agaaagttgttttagccaaacc

SEQ ID NO: 8761686 - DNA, 22 bp, Homo sapiens
agaaagtttattcctatctagc

SEQ ID NO: 8761687 - DNA, 22 bp, Homo sapiens
agaaagtttatttcttgatgga

SEQ ID NO: 8761688 - DNA, 23 bp, Homo sapiens
agaaagtttgtgccttgtgacac

SEQ ID NO: 8761689 - DNA, 22 bp, Homo sapiens
agaacacactgggggaaacaag

SEQ ID NO: 8761690 - DNA, 22 bp, Homo sapiens
agaacacactgggggaaacaag

SEQ ID NO: 8761691 - DNA, 22 bp, Homo sapiens
agaacacactgggggaaacaag

SEQ ID NO: 8761692 - DNA, 22 bp, Homo sapiens
agaacactgggaagttactaac

SEQ ID NO: 8761693 - DNA, 22 bp, Homo sapiens
agaacactctcctgaaaattaa

SEQ ID NO: 8761694 - DNA, 22 bp, Homo sapiens
agaacactctcctgaaaattaa

SEQ ID NO: 8761695 - DNA, 22 bp, Homo sapiens
agaacacttgctcctgattctc

SEQ ID NO: 8761696 - DNA, 18 bp, Homo sapiens
agaacacttggttagatc

SEQ ID NO: 8761697 - DNA, 18 bp, Homo sapiens
agaacacttggttagatc

SEQ ID NO: 8761698 - DNA, 22 bp, Homo sapiens
agaacacttgctcctgattctc

SEQ ID NO: 8761699 - DNA, 22 bp, Homo sapiens
agaacacttttaaatggcttgt

SEQ ID NO: 8761700 - DNA, 22 bp, Homo sapiens
agaacagaagggaggaaggcct

SEQ ID NO: 8761701 - DNA, 22 bp, Homo sapiens
agaacagaagggaggaaggcct

SEQ ID NO: 8761702 - DNA, 22 bp, Homo sapiens
agaacagaagggaggaaggcct

SEQ ID NO: 8761703 - DNA, 22 bp, Homo sapiens
agaacagaggccttatgtttca

SEQ ID NO: 8761704 - DNA, 22 bp, Homo sapiens
agaacagaggccttatgtttca

SEQ ID NO: 8761705 - DNA, 22 bp, Homo sapiens
agaacagatgtgggcagacctg

SEQ ID NO: 8761706 - DNA, 22 bp, Homo sapiens
agaacagaggccttatgtttca

SEQ ID NO: 8761707 - DNA, 22 bp, Homo sapiens
agaacagatgtgggcagacctg

SEQ ID NO: 8761708 - DNA, 22 bp, Homo sapiens
agaacagatgtgggcagacctg

SEQ ID NO: 8761709 - DNA, 22 bp, Homo sapiens
agaacagatgtgggcagacctg

SEQ ID NO: 8761710 - DNA, 22 bp, Homo sapiens
agaacagcacaggaagtgtatc

SEQ ID NO: 8761711 - DNA, 22 bp, Homo sapiens
agaacagcaggaaggccaggta

SEQ ID NO: 8761712 - DNA, 22 bp, Homo sapiens
agaacagcaggaaggccaggta

SEQ ID NO: 8761713 - DNA, 22 bp, Homo sapiens
agaacagcaggaaggccaggta

SEQ ID NO: 8761714 - DNA, 22 bp, Homo sapiens
agaacagcagtagtatacagta

SEQ ID NO: 8761715 - DNA, 22 bp, Homo sapiens
agaacagcagtagtatacagta

SEQ ID NO: 8761716 - DNA, 22 bp, Homo sapiens
agaacagccaataaaagagggg

SEQ ID NO: 8761717 - DNA, 22 bp, Homo sapiens
agaacagcctatagtggccttt

SEQ ID NO: 8761718 - DNA, 19 bp, Homo sapiens
atctaagagatgggggaaa

SEQ ID NO: 8761719 - DNA, 22 bp, Homo sapiens
atctaagagagagagcatgtct

SEQ ID NO: 8761720 - DNA, 22 bp, Homo sapiens
atctaagagttaacatcaagaa

SEQ ID NO: 8761721 - DNA, 22 bp, Homo sapiens
atctaagaggatggttggaaat

SEQ ID NO: 8761722 - DNA, 22 bp, Homo sapiens
atctaacttatgttttaccaaa

SEQ ID NO: 8761723 - DNA, 22 bp, Homo sapiens
atctaactgggctattttattg

SEQ ID NO: 8761724 - DNA, 22 bp, Homo sapiens
atctaagacaatgagtgagact

SEQ ID NO: 8761725 - DNA, 22 bp, Homo sapiens
atctaaagtgtttcatgaaaga

SEQ ID NO: 8761726 - DNA, 22 bp, Homo sapiens
atctaaagtgtcataagtagct

SEQ ID NO: 8761727 - DNA, 22 bp, Homo sapiens
atctaaagtgtcataagtagct

SEQ ID NO: 8761728 - DNA, 23 bp, Homo sapiens
atctaaagtgttaaatagctggg

SEQ ID NO: 8761729 - DNA, 22 bp, Homo sapiens
atctaaaaggagctctttatct

SEQ ID NO: 8761730 - DNA, 20 bp, Homo sapiens
atcggcttgcctggaaacaa

SEQ ID NO: 8761731 - DNA, 22 bp, Homo sapiens
atcggggaaaagggaggctgtg

SEQ ID NO: 8761732 - DNA, 20 bp, Homo sapiens
atcgcttaaatcatagcact

SEQ ID NO: 8761733 - DNA, 22 bp, Homo sapiens
atctaaaatgtggttagttggt

SEQ ID NO: 8761734 - DNA, 22 bp, Homo sapiens
atctaaaatgtggttagttggt

SEQ ID NO: 8761735 - DNA, 22 bp, Homo sapiens
atctaaaaggagctctttatct

SEQ ID NO: 8761736 - DNA, 22 bp, Homo sapiens
atctaaaccctactttctttct

SEQ ID NO: 8761737 - DNA, 22 bp, Homo sapiens
atctaaacaggtgttctttaga

SEQ ID NO: 8761738 - DNA, 22 bp, Homo sapiens
atctaaaaggagctctttatct

SEQ ID NO: 8761739 - DNA, 22 bp, Homo sapiens
atctcaaagcatggagcagaat

SEQ ID NO: 8761740 - DNA, 21 bp, Homo sapiens
atctcacagcccagagaagcc

SEQ ID NO: 8761741 - DNA, 22 bp, Homo sapiens
atctcacagaggcccaccagga

SEQ ID NO: 8761742 - DNA, 22 bp, Homo sapiens
atctcacatcctcagtagtgca

SEQ ID NO: 8761743 - DNA, 22 bp, Homo sapiens
atctcaccaagttattacgaga

SEQ ID NO: 8761744 - DNA, 23 bp, Homo sapiens
atctaatttctccaaatctctac

SEQ ID NO: 8761745 - DNA, 22 bp, Homo sapiens
atctaagattttgctaagatca

SEQ ID NO: 8761746 - DNA, 22 bp, Homo sapiens
atctaagattttgctaagatca

SEQ ID NO: 8761747 - DNA, 22 bp, Homo sapiens
atctaagatgtattgagcactt

SEQ ID NO: 8761748 - DNA, 22 bp, Homo sapiens
atctcaaacatctttgaccata

SEQ ID NO: 8761749 - DNA, 22 bp, Homo sapiens
atctattttaaatggcagtaaa

SEQ ID NO: 8761750 - DNA, 22 bp, Homo sapiens
atctattttaaatggcagtaaa

SEQ ID NO: 8761751 - DNA, 18 bp, Homo sapiens
atcctgggagcagacagc

SEQ ID NO: 8761752 - DNA, 22 bp, Homo sapiens
atcatcttgctttctgtttact

SEQ ID NO: 8761753 - DNA, 22 bp, Homo sapiens
atcatcttgctttctgtttact

SEQ ID NO: 8761754 - DNA, 22 bp, Homo sapiens
atcatcttgaaagtctatgttt

SEQ ID NO: 8761755 - DNA, 22 bp, Homo sapiens
atcggcaagccccacaccgtcc

SEQ ID NO: 8761756 - DNA, 22 bp, Homo sapiens
atcgcatttgagcaatcttttc

SEQ ID NO: 8761757 - DNA, 22 bp, Homo sapiens
atcgatgctgacttcttgttat

SEQ ID NO: 8761758 - DNA, 22 bp, Homo sapiens
atcgaggaaaggacagttcctt

SEQ ID NO: 8761759 - DNA, 22 bp, Homo sapiens
atcgaggagagttggtttgttt

SEQ ID NO: 8761760 - DNA, 22 bp, Homo sapiens
atcatcttaaatctagaatgtg

SEQ ID NO: 8761761 - DNA, 22 bp, Homo sapiens
atcatcttaaggtatctcaagc

SEQ ID NO: 8761762 - DNA, 22 bp, Homo sapiens
atcatcttatctgactcatttt

SEQ ID NO: 8761763 - DNA, 22 bp, Homo sapiens
atcatcttatctgactcatttt

SEQ ID NO: 8761764 - DNA, 22 bp, Homo sapiens
atcatcttatctgactcatttt

SEQ ID NO: 8761765 - DNA, 22 bp, Homo sapiens
atcatcttcatattcctcagct

SEQ ID NO: 8761766 - DNA, 22 bp, Homo sapiens
atcatcttgaaagtctatgttt

SEQ ID NO: 8761767 - DNA, 22 bp, Homo sapiens
atcatcttgaaagtctatgttt

SEQ ID NO: 8761768 - DNA, 22 bp, Homo sapiens
atcatcttgaaagtctatgttt

SEQ ID NO: 8761769 - DNA, 22 bp, Homo sapiens
atcatcttcgaaaaaagtcaga

SEQ ID NO: 8761770 - DNA, 22 bp, Homo sapiens
atcatccaagcgtagttcttct

SEQ ID NO: 8761771 - DNA, 22 bp, Homo sapiens
agaacagggactggaggcttca

SEQ ID NO: 8761772 - DNA, 22 bp, Homo sapiens
agaacaggcagttggttggatt

SEQ ID NO: 8761773 - DNA, 22 bp, Homo sapiens
agaacagcttgcctttaataga

SEQ ID NO: 8761774 - DNA, 19 bp, Homo sapiens
agaacagctttttgtgaca

SEQ ID NO: 8761775 - DNA, 19 bp, Homo sapiens
atcatcctgggtcatgcac

SEQ ID NO: 8761776 - DNA, 22 bp, Homo sapiens
atcatctaaattgagtccagct

SEQ ID NO: 8761777 - DNA, 22 bp, Homo sapiens
atcatctagtttaactttcttt

SEQ ID NO: 8761778 - DNA, 22 bp, Homo sapiens
atcatctgcctcatcactgcat

SEQ ID NO: 8761779 - DNA, 22 bp, Homo sapiens
atcatctgcctcatcactgcat

SEQ ID NO: 8761780 - DNA, 22 bp, Homo sapiens
atcatctgggttaatgtgctca

SEQ ID NO: 8761781 - DNA, 22 bp, Homo sapiens
atcatctggcattcagattggc

SEQ ID NO: 8761782 - DNA, 22 bp, Homo sapiens
atcatctgggttaatgtgctca

SEQ ID NO: 8761783 - DNA, 22 bp, Homo sapiens
atcatctgtctccttgtatgtt

SEQ ID NO: 8761784 - DNA, 22 bp, Homo sapiens
atcatctgtcccaaataagaga

SEQ ID NO: 8761785 - DNA, 22 bp, Homo sapiens
agtaaaattgtattggaaaaca

SEQ ID NO: 8761786 - DNA, 22 bp, Homo sapiens
agtaaaattgtattggaaaaca

SEQ ID NO: 8761787 - DNA, 22 bp, Homo sapiens
agtaaaattgtattggaaaaca

SEQ ID NO: 8761788 - DNA, 22 bp, Homo sapiens
agtaaaattaatggatcagaag

SEQ ID NO: 8761789 - DNA, 22 bp, Homo sapiens
agtaaacaatgtatgaggacag

SEQ ID NO: 8761790 - DNA, 22 bp, Homo sapiens
agtaaacacgtggggtttcttt

SEQ ID NO: 8761791 - DNA, 22 bp, Homo sapiens
agtaaacacgtggggtttcttt

SEQ ID NO: 8761792 - DNA, 22 bp, Homo sapiens
agtaaacaatgtatgaggacag

SEQ ID NO: 8761793 - DNA, 22 bp, Homo sapiens
agtaaacactaaaatgactgcg

SEQ ID NO: 8761794 - DNA, 22 bp, Homo sapiens
agtaaacactgtctttatatat

SEQ ID NO: 8761795 - DNA, 22 bp, Homo sapiens
agtaaacactaaaatgactgcg

SEQ ID NO: 8761796 - DNA, 22 bp, Homo sapiens
agtaaacactaaaatgactgcg

SEQ ID NO: 8761797 - DNA, 22 bp, Homo sapiens
agtaaaatcttaagcacagtgg

SEQ ID NO: 8761798 - DNA, 22 bp, Homo sapiens
agtaaaatcttaagcacagtgg

SEQ ID NO: 8761799 - DNA, 22 bp, Homo sapiens
agtaaaattaatggatcagaag

SEQ ID NO: 8761800 - DNA, 22 bp, Homo sapiens
agtaaaatcaccatctctttgt

SEQ ID NO: 8761801 - DNA, 22 bp, Homo sapiens
actagaatgcaggattggtctc

SEQ ID NO: 8761802 - DNA, 22 bp, Homo sapiens
actagaatgcaagctccacaag

SEQ ID NO: 8761803 - DNA, 22 bp, Homo sapiens
actagacaggttgtactattgg

SEQ ID NO: 8761804 - DNA, 19 bp, Homo sapiens
actagatacaacatgcaga

SEQ ID NO: 8761805 - DNA, 22 bp, Homo sapiens
actagaccaaggaatcctggaa

SEQ ID NO: 8761806 - DNA, 22 bp, Homo sapiens
actagacatcgagctacagagt

SEQ ID NO: 8761807 - DNA, 22 bp, Homo sapiens
actagacatcgagctacagagt

SEQ ID NO: 8761808 - DNA, 22 bp, Homo sapiens
actagcagggatgttattactt

SEQ ID NO: 8761809 - DNA, 22 bp, Homo sapiens
actagcagaaactgatcatggc

SEQ ID NO: 8761810 - DNA, 22 bp, Homo sapiens
actagattttggccattataca

SEQ ID NO: 8761811 - DNA, 22 bp, Homo sapiens
actagattttggccattataca

SEQ ID NO: 8761812 - DNA, 21 bp, Homo sapiens
actagcaaaagcctattatcc

SEQ ID NO: 8761813 - DNA, 22 bp, Homo sapiens
agtaaacagaaagcaagatgat

SEQ ID NO: 8761814 - DNA, 22 bp, Homo sapiens
agtaaacactgtctttatatat

SEQ ID NO: 8761815 - DNA, 22 bp, Homo sapiens
agtaaacagaaagcaagatgat

SEQ ID NO: 8761816 - DNA, 22 bp, Homo sapiens
actagaaccagaggaggcaggt

SEQ ID NO: 8761817 - DNA, 22 bp, Homo sapiens
actagaaattactcagaataaa

SEQ ID NO: 8761818 - DNA, 22 bp, Homo sapiens
actagaaattactcagaataaa

SEQ ID NO: 8761819 - DNA, 22 bp, Homo sapiens
actagaaccagaggaggcaggt

SEQ ID NO: 8761820 - DNA, 22 bp, Homo sapiens
actagaacttctaactaaggtc

SEQ ID NO: 8761821 - DNA, 22 bp, Homo sapiens
agtaaacagtaggaactgagaa

SEQ ID NO: 8761822 - DNA, 22 bp, Homo sapiens
acgcttttactattttgagctc

SEQ ID NO: 8761823 - DNA, 18 bp, Homo sapiens
acggatccgcgggaccgc

SEQ ID NO: 8761824 - DNA, 22 bp, Homo sapiens
acggatttgggttaggtcacca

SEQ ID NO: 8761825 - DNA, 22 bp, Homo sapiens
acgctcctaataaatgtggttt

SEQ ID NO: 8761826 - DNA, 22 bp, Homo sapiens
acgcctgtaatcccagcacttt

SEQ ID NO: 8761827 - DNA, 22 bp, Homo sapiens
acgcctgtaatcccagcacttt

SEQ ID NO: 8761828 - DNA, 22 bp, Homo sapiens
acgcctgtaatcccagcacttt

SEQ ID NO: 8761829 - DNA, 22 bp, Homo sapiens
acgcctgtaatcccagcacttt

SEQ ID NO: 8761830 - DNA, 22 bp, Homo sapiens
acgcctgtaatcccagcacttt

SEQ ID NO: 8761831 - DNA, 22 bp, Homo sapiens
acgcctgtaatcccagcacttt

SEQ ID NO: 8761832 - DNA, 22 bp, Homo sapiens
aggttcttggtgtccagatttc

SEQ ID NO: 8761833 - DNA, 22 bp, Homo sapiens
aggttcttttggccaacctcat

SEQ ID NO: 8761834 - DNA, 22 bp, Homo sapiens
acggcaggctcagagctggaat

SEQ ID NO: 8761835 - DNA, 22 bp, Homo sapiens
acggcttcttgactgtgggttg

SEQ ID NO: 8761836 - DNA, 22 bp, Homo sapiens
agtaaaaattgaggtgcaaaat

SEQ ID NO: 8761837 - DNA, 22 bp, Homo sapiens
acggcctggtgcagcaggtcgc

SEQ ID NO: 8761838 - DNA, 22 bp, Homo sapiens
aggttcttttggccaacctcat

SEQ ID NO: 8761839 - DNA, 22 bp, Homo sapiens
agtaaaaattgaggtgcaaaat

SEQ ID NO: 8761840 - DNA, 22 bp, Homo sapiens
aggttggccaagctgctggccc

SEQ ID NO: 8761841 - DNA, 20 bp, Homo sapiens
aggtggctcctgctgggggt

SEQ ID NO: 8761842 - DNA, 20 bp, Homo sapiens
acgcacacgcgggggcgtgc

SEQ ID NO: 8761843 - DNA, 22 bp, Homo sapiens
acgcctgtaatcccagcacttt

SEQ ID NO: 8761844 - DNA, 22 bp, Homo sapiens
acgcctgtaatcccagcacttt

SEQ ID NO: 8761845 - DNA, 22 bp, Homo sapiens
acgcctctgcagctgccgggcc

SEQ ID NO: 8761846 - DNA, 22 bp, Homo sapiens
acgcccagactcccatactttg

SEQ ID NO: 8761847 - DNA, 22 bp, Homo sapiens
acgcatttaaaatgtgctccca

SEQ ID NO: 8761848 - DNA, 22 bp, Homo sapiens
acgccagtagactgaacctttc

SEQ ID NO: 8761849 - DNA, 22 bp, Homo sapiens
acgcccagactcccatactttg

SEQ ID NO: 8761850 - DNA, 21 bp, Homo sapiens
actcaggagactaactatgtc

SEQ ID NO: 8761851 - DNA, 22 bp, Homo sapiens
agtcaagagacttaaaatattt

SEQ ID NO: 8761852 - DNA, 22 bp, Homo sapiens
actcaggaaatgaagactggtt

SEQ ID NO: 8761853 - DNA, 22 bp, Homo sapiens
agtcaacatataacacctggca

SEQ ID NO: 8761854 - DNA, 22 bp, Homo sapiens
agtcaacacctggttctattac

SEQ ID NO: 8761855 - DNA, 22 bp, Homo sapiens
agtcaacacattaaacctaggg

SEQ ID NO: 8761856 - DNA, 22 bp, Homo sapiens
agtcaacacattaaacctaggg

SEQ ID NO: 8761857 - DNA, 22 bp, Homo sapiens
agtcaaataagactgtcataag

SEQ ID NO: 8761858 - DNA, 22 bp, Homo sapiens
agtcaacacattaaacctaggg

SEQ ID NO: 8761859 - DNA, 22 bp, Homo sapiens
agtccaggcgggtatagaggct

SEQ ID NO: 8761860 - DNA, 22 bp, Homo sapiens
agtcccagctactcaagaggct

SEQ ID NO: 8761861 - DNA, 22 bp, Homo sapiens
agtccaggcgggtatagaggct

SEQ ID NO: 8761862 - DNA, 22 bp, Homo sapiens
actcaggcttcaggcacagctg

SEQ ID NO: 8761863 - DNA, 22 bp, Homo sapiens
actcaggctacaggggcagaag

SEQ ID NO: 8761864 - DNA, 22 bp, Homo sapiens
actcaggcactcagccctcgcc

SEQ ID NO: 8761865 - DNA, 22 bp, Homo sapiens
actcaggcactcagccctcgcc

SEQ ID NO: 8761866 - DNA, 22 bp, Homo sapiens
actcaggctacaacgcgtggct

SEQ ID NO: 8761867 - DNA, 22 bp, Homo sapiens
agtcaaaacatgtactttcctt

SEQ ID NO: 8761868 - DNA, 22 bp, Homo sapiens
agtcaaaacatgtactttcctt

SEQ ID NO: 8761869 - DNA, 22 bp, Homo sapiens
agtcaaaacatgtactttcctt

SEQ ID NO: 8761870 - DNA, 22 bp, Homo sapiens
agtattttcgccatcacaagaa

SEQ ID NO: 8761871 - DNA, 22 bp, Homo sapiens
agtattttcgccatcacaagaa

SEQ ID NO: 8761872 - DNA, 22 bp, Homo sapiens
agtattttcgccatcacaagaa

SEQ ID NO: 8761873 - DNA, 22 bp, Homo sapiens
agtattttcgccatcacaagaa

SEQ ID NO: 8761874 - DNA, 22 bp, Homo sapiens
agtcaaagatgaccgagttcct

SEQ ID NO: 8761875 - DNA, 22 bp, Homo sapiens
agtcaaagatgaccgagttcct

SEQ ID NO: 8761876 - DNA, 21 bp, Homo sapiens
agtatttcttcatgtccttgc

SEQ ID NO: 8761877 - DNA, 22 bp, Homo sapiens
agtatttgatacagtcttctag

SEQ ID NO: 8761878 - DNA, 22 bp, Homo sapiens
agtatttgagaggtccaggtgt

SEQ ID NO: 8761879 - DNA, 22 bp, Homo sapiens
agtatttgtggatttgtattgg

SEQ ID NO: 8761880 - DNA, 22 bp, Homo sapiens
agtatttggcctctacagtctc

SEQ ID NO: 8761881 - DNA, 22 bp, Homo sapiens
agtattttcaaccatagcctgg

SEQ ID NO: 8761882 - DNA, 21 bp, Homo sapiens
actagctttctggagaagtgt

SEQ ID NO: 8761883 - DNA, 22 bp, Homo sapiens
actaggaacggggtttgcactc

SEQ ID NO: 8761884 - DNA, 22 bp, Homo sapiens
actaggaaggcatatgggcaga

SEQ ID NO: 8761885 - DNA, 22 bp, Homo sapiens
actaggaagtggcaaaactgga

SEQ ID NO: 8761886 - DNA, 22 bp, Homo sapiens
actaggaattcaagtagacaga

SEQ ID NO: 8761887 - DNA, 22 bp, Homo sapiens
actaggaagtggcaaaactgga

SEQ ID NO: 8761888 - DNA, 22 bp, Homo sapiens
actagggaaagttatgttcaca

SEQ ID NO: 8761889 - DNA, 22 bp, Homo sapiens
actagggagaagcacttacaca

SEQ ID NO: 8761890 - DNA, 22 bp, Homo sapiens
actaggagaaaacttacactga

SEQ ID NO: 8761891 - DNA, 22 bp, Homo sapiens
actaggaggcatataaaacatt

SEQ ID NO: 8761892 - DNA, 22 bp, Homo sapiens
actagtattgcctactgtacat

SEQ ID NO: 8761893 - DNA, 22 bp, Homo sapiens
actagtattcttggtcttgtat

SEQ ID NO: 8761894 - DNA, 22 bp, Homo sapiens
actagtattagactaaaagtca

SEQ ID NO: 8761895 - DNA, 22 bp, Homo sapiens
actagtataattgccctaacct

SEQ ID NO: 8761896 - DNA, 22 bp, Homo sapiens
actaggggctcaggcccaggga

SEQ ID NO: 8761897 - DNA, 22 bp, Homo sapiens
agtatttcttcatatgattact

SEQ ID NO: 8761898 - DNA, 19 bp, Homo sapiens
agtatagagtattgaggag

SEQ ID NO: 8761899 - DNA, 22 bp, Homo sapiens
acctctgggcagcacctttgta

SEQ ID NO: 8761900 - DNA, 22 bp, Homo sapiens
acctctgtatagttgcctgtgg

SEQ ID NO: 8761901 - DNA, 22 bp, Homo sapiens
acctctttgaacctcagtgtga

SEQ ID NO: 8761902 - DNA, 22 bp, Homo sapiens
acctcttaatattgcaccttct

SEQ ID NO: 8761903 - DNA, 22 bp, Homo sapiens
acctctggccttcaggcatcat

SEQ ID NO: 8761904 - DNA, 22 bp, Homo sapiens
acctctgggaaaagtatggaaa

SEQ ID NO: 8761905 - DNA, 22 bp, Homo sapiens
acctgagaatgggggcatgtgt

SEQ ID NO: 8761906 - DNA, 22 bp, Homo sapiens
acctgagaatgggggcatgtgt

SEQ ID NO: 8761907 - DNA, 22 bp, Homo sapiens
acctgaactggtctgctgcccg

SEQ ID NO: 8761908 - DNA, 22 bp, Homo sapiens
acctcttaatattgcaccttct

SEQ ID NO: 8761909 - DNA, 22 bp, Homo sapiens
acctgaaaattattatttccgc

SEQ ID NO: 8761910 - DNA, 19 bp, Homo sapiens
accctctgccacaagcctc

SEQ ID NO: 8761911 - DNA, 22 bp, Homo sapiens
accctctgagaggcacactttg

SEQ ID NO: 8761912 - DNA, 22 bp, Homo sapiens
acctcccttgctaaagactgtg

SEQ ID NO: 8761913 - DNA, 19 bp, Homo sapiens
accctctctgtagaaagat

SEQ ID NO: 8761914 - DNA, 19 bp, Homo sapiens
accctctccccactgggtc

SEQ ID NO: 8761915 - DNA, 19 bp, Homo sapiens
accctctccccactgggtc

SEQ ID NO: 8761916 - DNA, 22 bp, Homo sapiens
accctcccatttccatgtagca

SEQ ID NO: 8761917 - DNA, 22 bp, Homo sapiens
accctcccatttccatgtagca

SEQ ID NO: 8761918 - DNA, 22 bp, Homo sapiens
accctccaggctgcagctcctg

SEQ ID NO: 8761919 - DNA, 22 bp, Homo sapiens
accctccccaagaggtcgtgcc

SEQ ID NO: 8761920 - DNA, 22 bp, Homo sapiens
accctccccaagaggtcgtgcc

SEQ ID NO: 8761921 - DNA, 22 bp, Homo sapiens
acctgaggcctccccagcagac

SEQ ID NO: 8761922 - DNA, 22 bp, Homo sapiens
acctgaggcctccccagcagac

SEQ ID NO: 8761923 - DNA, 22 bp, Homo sapiens
acctgaggctgttagtctaggt

SEQ ID NO: 8761924 - DNA, 22 bp, Homo sapiens
acctgagggagattaggcctga

SEQ ID NO: 8761925 - DNA, 22 bp, Homo sapiens
acctgagggagattaggcctga

SEQ ID NO: 8761926 - DNA, 22 bp, Homo sapiens
acctgaggctgttagtctaggt

SEQ ID NO: 8761927 - DNA, 22 bp, Homo sapiens
acctgaggctgttagtctaggt

SEQ ID NO: 8761928 - DNA, 20 bp, Homo sapiens
acctgaggtccctatggtct

SEQ ID NO: 8761929 - DNA, 20 bp, Homo sapiens
acctgaggtccctatggtct

SEQ ID NO: 8761930 - DNA, 22 bp, Homo sapiens
acctgagggcccaaacttggta

SEQ ID NO: 8761931 - DNA, 22 bp, Homo sapiens
acctgagggcccaaacttggta

SEQ ID NO: 8761932 - DNA, 22 bp, Homo sapiens
acctgatatgtttgatcaccct

SEQ ID NO: 8761933 - DNA, 22 bp, Homo sapiens
acctgcaagcattacacttcta

SEQ ID NO: 8761934 - DNA, 22 bp, Homo sapiens
acctgcaaaatattatgttctt

SEQ ID NO: 8761935 - DNA, 23 bp, Homo sapiens
acctgcaaatttggtcctcttct

SEQ ID NO: 8761936 - DNA, 22 bp, Homo sapiens
acctgagacctaatctgactgt

SEQ ID NO: 8761937 - DNA, 22 bp, Homo sapiens
acctgagacttgggatgggaat

SEQ ID NO: 8761938 - DNA, 22 bp, Homo sapiens
acctgagacttgggatgggaat

SEQ ID NO: 8761939 - DNA, 22 bp, Homo sapiens
acctgagacttgggatgggaat

SEQ ID NO: 8761940 - DNA, 22 bp, Homo sapiens
acctgaggaagggcgagaagct

SEQ ID NO: 8761941 - DNA, 22 bp, Homo sapiens
acctgaggactggatggtagaa

SEQ ID NO: 8761942 - DNA, 22 bp, Homo sapiens
acctgaggactggatggtagaa

SEQ ID NO: 8761943 - DNA, 22 bp, Homo sapiens
acctgaggaagggcgagaagct

SEQ ID NO: 8761944 - DNA, 22 bp, Homo sapiens
acctgcagctaaagatgtaggg

SEQ ID NO: 8761945 - DNA, 22 bp, Homo sapiens
acctgcagtggccactcctaat

SEQ ID NO: 8761946 - DNA, 22 bp, Homo sapiens
acctgcccacacttccttccca

SEQ ID NO: 8761947 - DNA, 22 bp, Homo sapiens
aggtggctatgaggatgcagtc

SEQ ID NO: 8761948 - DNA, 22 bp, Homo sapiens
aggtggctatgaggatgcagtc

SEQ ID NO: 8761949 - DNA, 18 bp, Homo sapiens
aggtggcctgggagcttt

SEQ ID NO: 8761950 - DNA, 22 bp, Homo sapiens
aggtggccggtgccagccgggc

SEQ ID NO: 8761951 - DNA, 22 bp, Homo sapiens
aggtggccggtgccagccgggc

SEQ ID NO: 8761952 - DNA, 22 bp, Homo sapiens
aggtggccggtgccagccgggc

SEQ ID NO: 8761953 - DNA, 22 bp, Homo sapiens
aggtggcccagctgacagatag

SEQ ID NO: 8761954 - DNA, 19 bp, Homo sapiens
aggtggccatgtccagcct

SEQ ID NO: 8761955 - DNA, 21 bp, Homo sapiens
aggtggccacaaatctgtttc

SEQ ID NO: 8761956 - DNA, 22 bp, Homo sapiens
aggtggcatgcctgagacataa

SEQ ID NO: 8761957 - DNA, 22 bp, Homo sapiens
aggtggcatttacaccatggga

SEQ ID NO: 8761958 - DNA, 22 bp, Homo sapiens
aggtggcatgcctgagacataa

SEQ ID NO: 8761959 - DNA, 22 bp, Homo sapiens
aggtggagatcagggactaagg

SEQ ID NO: 8761960 - DNA, 22 bp, Homo sapiens
acctggctgagaacgtgcagct

SEQ ID NO: 8761961 - DNA, 19 bp, Homo sapiens
acctggcctcttgagcaag

SEQ ID NO: 8761962 - DNA, 20 bp, Homo sapiens
acctggctctcaggagcaac

SEQ ID NO: 8761963 - DNA, 22 bp, Homo sapiens
acctggccccactgtgctgctg

SEQ ID NO: 8761964 - DNA, 19 bp, Homo sapiens
acctggcctcttgagcaag

SEQ ID NO: 8761965 - DNA, 22 bp, Homo sapiens
acctggccatccagctggcatc

SEQ ID NO: 8761966 - DNA, 22 bp, Homo sapiens
acctggccccactgtgctgctg

SEQ ID NO: 8761967 - DNA, 22 bp, Homo sapiens
acctggccccactgtgctgctg

SEQ ID NO: 8761968 - DNA, 22 bp, Homo sapiens
acctggcataagggcttgagtc

SEQ ID NO: 8761969 - DNA, 22 bp, Homo sapiens
acctggcataagggcttgagtc

SEQ ID NO: 8761970 - DNA, 22 bp, Homo sapiens
acctggccagtggggccgcgct

SEQ ID NO: 8761971 - DNA, 22 bp, Homo sapiens
acctggccatccagctggcatc

SEQ ID NO: 8761972 - DNA, 22 bp, Homo sapiens
acctggccagtggggccgcgct

SEQ ID NO: 8761973 - DNA, 19 bp, Homo sapiens
acctggccagagttcaata

SEQ ID NO: 8761974 - DNA, 22 bp, Homo sapiens
acctggccaatttttgtatttt

SEQ ID NO: 8761975 - DNA, 22 bp, Homo sapiens
aggtctctggggaactccaggg

SEQ ID NO: 8761976 - DNA, 22 bp, Homo sapiens
aggtctctgcagaaagtaagtc

SEQ ID NO: 8761977 - DNA, 22 bp, Homo sapiens
aggtctctaaaatagtcaaact

SEQ ID NO: 8761978 - DNA, 22 bp, Homo sapiens
aggtctctgagtactgctggac

SEQ ID NO: 8761979 - DNA, 22 bp, Homo sapiens
aggtctcctcatattctgcctc

SEQ ID NO: 8761980 - DNA, 22 bp, Homo sapiens
aggtctccttgtgggtcttgcc

SEQ ID NO: 8761981 - DNA, 22 bp, Homo sapiens
aggtctcctcatattctgcctc

SEQ ID NO: 8761982 - DNA, 22 bp, Homo sapiens
acctggattttgcttagacatg

SEQ ID NO: 8761983 - DNA, 22 bp, Homo sapiens
acctggcacacactggggagtg

SEQ ID NO: 8761984 - DNA, 22 bp, Homo sapiens
acctggcacagagtatgctctc

SEQ ID NO: 8761985 - DNA, 22 bp, Homo sapiens
aggtctcttgctgtctctgggc

SEQ ID NO: 8761986 - DNA, 22 bp, Homo sapiens
acctggagggaagttctgactt

SEQ ID NO: 8761987 - DNA, 22 bp, Homo sapiens
aggtcctgtcttatctctgtaa

SEQ ID NO: 8761988 - DNA, 22 bp, Homo sapiens
aggtcctgtcttatctctgtaa

SEQ ID NO: 8761989 - DNA, 22 bp, Homo sapiens
aggtcctgtctatcaccctcgc

SEQ ID NO: 8761990 - DNA, 22 bp, Homo sapiens
aggtccagttgccagaatggcc

SEQ ID NO: 8761991 - DNA, 22 bp, Homo sapiens
aggtccagttgccagaatggcc

SEQ ID NO: 8761992 - DNA, 22 bp, Homo sapiens
aggtcctgtctatcaccctcgc

SEQ ID NO: 8761993 - DNA, 22 bp, Homo sapiens
aggtcctgtcttatctctgtaa

SEQ ID NO: 8761994 - DNA, 22 bp, Homo sapiens
aggtcctgtggtttgggtaaaa

SEQ ID NO: 8761995 - DNA, 22 bp, Homo sapiens
aggtcctgtgtccaggggcctg

SEQ ID NO: 8761996 - DNA, 20 bp, Homo sapiens
aggtcctgttccttgtctcc

SEQ ID NO: 8761997 - DNA, 20 bp, Homo sapiens
aggtcctgttccttgtctcc

SEQ ID NO: 8761998 - DNA, 22 bp, Homo sapiens
aggtcctgtgtccaggggcctg

SEQ ID NO: 8761999 - DNA, 19 bp, Homo sapiens
aggtctaatcataagacaa

SEQ ID NO: 8762000 - DNA, 22 bp, Homo sapiens
aggtctaactgatagaattcat

SEQ ID NO: 8762001 - DNA, 22 bp, Homo sapiens
aggtcgagtttcggggctactt

SEQ ID NO: 8762002 - DNA, 22 bp, Homo sapiens
aggtcctgtttcttccctgggg

SEQ ID NO: 8762003 - DNA, 19 bp, Homo sapiens
aggtccttggctggaagtt

SEQ ID NO: 8762004 - DNA, 22 bp, Homo sapiens
aggtctcaagttgagaaggcag

SEQ ID NO: 8762005 - DNA, 22 bp, Homo sapiens
agtgttgtaataaatatcatct

SEQ ID NO: 8762006 - DNA, 23 bp, Homo sapiens
agtgttggttgggaagccaagca

SEQ ID NO: 8762007 - DNA, 22 bp, Homo sapiens
agtgttgtatgggatgactgct

SEQ ID NO: 8762008 - DNA, 22 bp, Homo sapiens
agtgttgtaataaatatcatct

SEQ ID NO: 8762009 - DNA, 22 bp, Homo sapiens
agtgttgtctaaatgaatgcta

SEQ ID NO: 8762010 - DNA, 22 bp, Homo sapiens
agtgttgtctaaatgaatgcta

SEQ ID NO: 8762011 - DNA, 22 bp, Homo sapiens
agtgttgtatgggatgactgct

SEQ ID NO: 8762012 - DNA, 22 bp, Homo sapiens
agtgtttaaactgaagtgatga

SEQ ID NO: 8762013 - DNA, 22 bp, Homo sapiens
agtgtttaaactgaagtgatga

SEQ ID NO: 8762014 - DNA, 22 bp, Homo sapiens
agtgtttaacttcgtcctgaag

SEQ ID NO: 8762015 - DNA, 22 bp, Homo sapiens
agtgttgggtctttagaattta

SEQ ID NO: 8762016 - DNA, 22 bp, Homo sapiens
agtgttcttgtttctaagcaaa

SEQ ID NO: 8762017 - DNA, 21 bp, Homo sapiens
agtgtgtgataggcaggaaga

SEQ ID NO: 8762018 - DNA, 22 bp, Homo sapiens
agtgtgtgaccttttaatttaa

SEQ ID NO: 8762019 - DNA, 21 bp, Homo sapiens
agtgtgtgataggcaggaaga

SEQ ID NO: 8762020 - DNA, 21 bp, Homo sapiens
agtgtgtgataggcaggaaga

SEQ ID NO: 8762021 - DNA, 22 bp, Homo sapiens
actggctttgcctctgcctctc

SEQ ID NO: 8762022 - DNA, 18 bp, Homo sapiens
actggctttagcatcaga

SEQ ID NO: 8762023 - DNA, 22 bp, Homo sapiens
agtgtttagcatgaagttcatt

SEQ ID NO: 8762024 - DNA, 22 bp, Homo sapiens
agtgtttagttaagatttcaaa

SEQ ID NO: 8762025 - DNA, 22 bp, Homo sapiens
agtgtttaccccaatcagttta

SEQ ID NO: 8762026 - DNA, 22 bp, Homo sapiens
actggaatgaagttaatctgat

SEQ ID NO: 8762027 - DNA, 22 bp, Homo sapiens
agtgtgtgaccttttaatttaa

SEQ ID NO: 8762028 - DNA, 22 bp, Homo sapiens
actggaaattgagaggtcactg

SEQ ID NO: 8762029 - DNA, 22 bp, Homo sapiens
actgcttttgatctcttctgta

SEQ ID NO: 8762030 - DNA, 22 bp, Homo sapiens
actggaaactacagcctatcct

SEQ ID NO: 8762031 - DNA, 22 bp, Homo sapiens
actggaaatgagatgatatcag

SEQ ID NO: 8762032 - DNA, 22 bp, Homo sapiens
agtgtattacagaactgacatt

SEQ ID NO: 8762033 - DNA, 22 bp, Homo sapiens
agtgtatgtcctgaggggagaa

SEQ ID NO: 8762034 - DNA, 22 bp, Homo sapiens
agtgtatgtgaaactttccaaa

SEQ ID NO: 8762035 - DNA, 22 bp, Homo sapiens
agtgtatgtcaagtatatacac

SEQ ID NO: 8762036 - DNA, 22 bp, Homo sapiens
agtgtatgcaggttttcaatgt

SEQ ID NO: 8762037 - DNA, 20 bp, Homo sapiens
agtgtatgaatctggatggg

SEQ ID NO: 8762038 - DNA, 22 bp, Homo sapiens
agtgtatggaattagctccctt

SEQ ID NO: 8762039 - DNA, 22 bp, Homo sapiens
agtgtagtggcattgacttcgt

SEQ ID NO: 8762040 - DNA, 20 bp, Homo sapiens
agtgtatgaacagatgcggg

SEQ ID NO: 8762041 - DNA, 22 bp, Homo sapiens
agtgtatgaacttaagagagag

SEQ ID NO: 8762042 - DNA, 20 bp, Homo sapiens
agtgtatgaacagatgcggg

SEQ ID NO: 8762043 - DNA, 20 bp, Homo sapiens
agtgtatgaatctggatggg

SEQ ID NO: 8762044 - DNA, 22 bp, Homo sapiens
agtgtatgagtttcagttcttc

SEQ ID NO: 8762045 - DNA, 22 bp, Homo sapiens
agtgtatcatggttggcagaca

SEQ ID NO: 8762046 - DNA, 22 bp, Homo sapiens
agtgtatatgtgctgagaaacg

SEQ ID NO: 8762047 - DNA, 22 bp, Homo sapiens
agtgtattatcagaaactgtgg

SEQ ID NO: 8762048 - DNA, 22 bp, Homo sapiens
agtgtattacagaactgacatt

SEQ ID NO: 8762049 - DNA, 22 bp, Homo sapiens
actgctttgctctgcccccagg

SEQ ID NO: 8762050 - DNA, 22 bp, Homo sapiens
agtggcagtggctgggcagagc

SEQ ID NO: 8762051 - DNA, 22 bp, Homo sapiens
actgcacttcagcctgggtgac

SEQ ID NO: 8762052 - DNA, 22 bp, Homo sapiens
actgcacttcagcctgggtgac

SEQ ID NO: 8762053 - DNA, 22 bp, Homo sapiens
actgcacttcagcctgggtgac

SEQ ID NO: 8762054 - DNA, 22 bp, Homo sapiens
actgcacttcagcctgggtgac

SEQ ID NO: 8762055 - DNA, 22 bp, Homo sapiens
actgcacttcagcctgggtgac

SEQ ID NO: 8762056 - DNA, 22 bp, Homo sapiens
actgcacttcagcctgggtgac

SEQ ID NO: 8762057 - DNA, 22 bp, Homo sapiens
agtggcagtagatgagctggtt

SEQ ID NO: 8762058 - DNA, 22 bp, Homo sapiens
agtggcagtagatgagctggtt

SEQ ID NO: 8762059 - DNA, 22 bp, Homo sapiens
agtggcagtagatgagctggtt

SEQ ID NO: 8762060 - DNA, 22 bp, Homo sapiens
agtggcagtggaaagcacacgg

SEQ ID NO: 8762061 - DNA, 22 bp, Homo sapiens
agtggcagtggctgggcagagc

SEQ ID NO: 8762062 - DNA, 22 bp, Homo sapiens
agtggcagggctggctgctgca

SEQ ID NO: 8762063 - DNA, 22 bp, Homo sapiens
agtggcaggtgtgtagtatccc

SEQ ID NO: 8762064 - DNA, 22 bp, Homo sapiens
agtggcaggtgtttcgtggtgc

SEQ ID NO: 8762065 - DNA, 22 bp, Homo sapiens
agtggcagtaacattccacaat

SEQ ID NO: 8762066 - DNA, 22 bp, Homo sapiens
agtggcagtaacattccacaat

SEQ ID NO: 8762067 - DNA, 22 bp, Homo sapiens
agtggcagtagatgagctggtt

SEQ ID NO: 8762068 - DNA, 21 bp, Homo sapiens
actgagggccagagaggacct

SEQ ID NO: 8762069 - DNA, 21 bp, Homo sapiens
actgagggccagagaggacct

SEQ ID NO: 8762070 - DNA, 22 bp, Homo sapiens
agtggcagagccagggttggga

SEQ ID NO: 8762071 - DNA, 22 bp, Homo sapiens
agtggcagagccagggttggga

SEQ ID NO: 8762072 - DNA, 22 bp, Homo sapiens
agtggcagagctgggatttggg

SEQ ID NO: 8762073 - DNA, 22 bp, Homo sapiens
agtggcagagctgggatttggg

SEQ ID NO: 8762074 - DNA, 22 bp, Homo sapiens
agtggcagggctggctgctgca

SEQ ID NO: 8762075 - DNA, 22 bp, Homo sapiens
actgcagactctacagttataa

SEQ ID NO: 8762076 - DNA, 22 bp, Homo sapiens
actgcagaggtggggtgcagag

SEQ ID NO: 8762077 - DNA, 21 bp, Homo sapiens
agtggggtctctgtggaggcc

SEQ ID NO: 8762078 - DNA, 21 bp, Homo sapiens
agtggggtctctgtggaggcc

SEQ ID NO: 8762079 - DNA, 19 bp, Homo sapiens
actgcactttagcctgggc

SEQ ID NO: 8762080 - DNA, 22 bp, Homo sapiens
actgcacttcagcctgggtgtc

SEQ ID NO: 8762081 - DNA, 22 bp, Homo sapiens
actgcacttcagcctgggtgtc

SEQ ID NO: 8762082 - DNA, 22 bp, Homo sapiens
actgcacttcagcctgggtgtc

SEQ ID NO: 8762083 - DNA, 22 bp, Homo sapiens
actgcacttcagcctgggtgtc

SEQ ID NO: 8762084 - DNA, 22 bp, Homo sapiens
actgcacttcagcctgggtgtc

SEQ ID NO: 8762085 - DNA, 22 bp, Homo sapiens
actgcacttcagcctgggtgtc

SEQ ID NO: 8762086 - DNA, 22 bp, Homo sapiens
actgcacttcagcctgggtgtc

SEQ ID NO: 8762087 - DNA, 22 bp, Homo sapiens
actgcacttcagcctgggtgtc

SEQ ID NO: 8762088 - DNA, 22 bp, Homo sapiens
actgcacttcagcctgggtgtc

SEQ ID NO: 8762089 - DNA, 22 bp, Homo sapiens
actgcacttcagcctgggtgtc

SEQ ID NO: 8762090 - DNA, 22 bp, Homo sapiens
actgcacttcagcctgggtgac

SEQ ID NO: 8762091 - DNA, 22 bp, Homo sapiens
agtgtacatagttaggaacatc

SEQ ID NO: 8762092 - DNA, 22 bp, Homo sapiens
agtgtacatcagaacatatcaa

SEQ ID NO: 8762093 - DNA, 22 bp, Homo sapiens
agtgtacatcagaacatatcaa

SEQ ID NO: 8762094 - DNA, 22 bp, Homo sapiens
agtgtacatgtacacattagta

SEQ ID NO: 8762095 - DNA, 22 bp, Homo sapiens
agtgtacatgtacacattagta

SEQ ID NO: 8762096 - DNA, 20 bp, Homo sapiens
agtgtacagacactagaaat

SEQ ID NO: 8762097 - DNA, 20 bp, Homo sapiens
agtgtacagacactagaaat

SEQ ID NO: 8762098 - DNA, 20 bp, Homo sapiens
agtgtacagacactagaaat

SEQ ID NO: 8762099 - DNA, 22 bp, Homo sapiens
agtgtacactaaatgaatacaa

SEQ ID NO: 8762100 - DNA, 22 bp, Homo sapiens
agtgtacagttctatgaatttc

SEQ ID NO: 8762101 - DNA, 22 bp, Homo sapiens
agtctttacatgtgttatatat

SEQ ID NO: 8762102 - DNA, 18 bp, Homo sapiens
agtctttaaagatgttac

SEQ ID NO: 8762103 - DNA, 22 bp, Homo sapiens
agtctttagaaggtagttgagg

SEQ ID NO: 8762104 - DNA, 22 bp, Homo sapiens
actctgtaattctgaagcacct

SEQ ID NO: 8762105 - DNA, 19 bp, Homo sapiens
agtcttgtggctttgtgca

SEQ ID NO: 8762106 - DNA, 18 bp, Homo sapiens
agtcttgttctgttgccc

SEQ ID NO: 8762107 - DNA, 22 bp, Homo sapiens
agtcttgtcttattttaataga

SEQ ID NO: 8762108 - DNA, 22 bp, Homo sapiens
agtcttgtcttattttaataga

SEQ ID NO: 8762109 - DNA, 18 bp, Homo sapiens
agtctttaaagatgttac

SEQ ID NO: 8762110 - DNA, 22 bp, Homo sapiens
agtcttggtccaggctcatttc

SEQ ID NO: 8762111 - DNA, 22 bp, Homo sapiens
agtcttgggagaggctggcagt

SEQ ID NO: 8762112 - DNA, 20 bp, Homo sapiens
agtcttggcatgtggttttc

SEQ ID NO: 8762113 - DNA, 22 bp, Homo sapiens
agtcttggctgccgccgtctcc

SEQ ID NO: 8762114 - DNA, 22 bp, Homo sapiens
agtcttggctatgcatagagct

SEQ ID NO: 8762115 - DNA, 22 bp, Homo sapiens
agtcttggtccaggctcatttc

SEQ ID NO: 8762116 - DNA, 19 bp, Homo sapiens
agtcttgtatttttcaagc

SEQ ID NO: 8762117 - DNA, 22 bp, Homo sapiens
agtcttggttttcttaggtctg

SEQ ID NO: 8762118 - DNA, 22 bp, Homo sapiens
agtcttggttttgacagggaaa

SEQ ID NO: 8762119 - DNA, 22 bp, Homo sapiens
agtcttggttttgacagggaaa

SEQ ID NO: 8762120 - DNA, 22 bp, Homo sapiens
agtcttgggttgcctgatattg

SEQ ID NO: 8762121 - DNA, 22 bp, Homo sapiens
agtcttggtctccctggcagct

SEQ ID NO: 8762122 - DNA, 22 bp, Homo sapiens
agtcttggtttcattggcaatg

SEQ ID NO: 8762123 - DNA, 22 bp, Homo sapiens
agtcttggtgtcagtggtctga

SEQ ID NO: 8762124 - DNA, 22 bp, Homo sapiens
agtctgtcagtcattctaacaa

SEQ ID NO: 8762125 - DNA, 22 bp, Homo sapiens
agtctgtctaatattattcagg

SEQ ID NO: 8762126 - DNA, 23 bp, Homo sapiens
actcgtggaattctctgcgatcg

SEQ ID NO: 8762127 - DNA, 23 bp, Homo sapiens
actcgtggaattctctgcgatcg

SEQ ID NO: 8762128 - DNA, 22 bp, Homo sapiens
agtcttggacatattctacttc

SEQ ID NO: 8762129 - DNA, 22 bp, Homo sapiens
agtcttgaaagcacattagagt

SEQ ID NO: 8762130 - DNA, 22 bp, Homo sapiens
agtcttctttgtgttctctcat

SEQ ID NO: 8762131 - DNA, 22 bp, Homo sapiens
agtcttcttgatcttttcagtg

SEQ ID NO: 8762132 - DNA, 22 bp, Homo sapiens
agtcccagtgagatgagccacg

SEQ ID NO: 8762133 - DNA, 22 bp, Homo sapiens
agtcccaggcagccgagccggt

SEQ ID NO: 8762134 - DNA, 22 bp, Homo sapiens
actcctgggttgcagtcctcaa

SEQ ID NO: 8762135 - DNA, 17 bp, Homo sapiens
actcctggtctgaaggg

SEQ ID NO: 8762136 - DNA, 22 bp, Homo sapiens
actctgtgaagtcttattatgc

SEQ ID NO: 8762137 - DNA, 22 bp, Homo sapiens
actctgtgaagatgcaggcttg

SEQ ID NO: 8762138 - DNA, 22 bp, Homo sapiens
actctgtatccctctcaaattg

SEQ ID NO: 8762139 - DNA, 20 bp, Homo sapiens
actctgtaggtaatgagact

SEQ ID NO: 8762140 - DNA, 22 bp, Homo sapiens
actctgtagagtataccaatgt

SEQ ID NO: 8762141 - DNA, 22 bp, Homo sapiens
actctgtagcctgtaagagagc

SEQ ID NO: 8762142 - DNA, 22 bp, Homo sapiens
actctgtgccaggcactttggg

SEQ ID NO: 8762143 - DNA, 22 bp, Homo sapiens
actctgtgtgagtagagcctgt

SEQ ID NO: 8762144 - DNA, 22 bp, Homo sapiens
actctgtgtgagtagagcctgt

SEQ ID NO: 8762145 - DNA, 22 bp, Homo sapiens
actctgtgttttggtggcagca

SEQ ID NO: 8762146 - DNA, 22 bp, Homo sapiens
actcttattccctcagaaatat

SEQ ID NO: 8762147 - DNA, 22 bp, Homo sapiens
actctgtttgcaggtagctcag

SEQ ID NO: 8762148 - DNA, 19 bp, Homo sapiens
actctgttgtacttgaggg

SEQ ID NO: 8762149 - DNA, 22 bp, Homo sapiens
agtgcagtaaatgggcattatg

SEQ ID NO: 8762150 - DNA, 22 bp, Homo sapiens
agtgcaggttaaggaactggcc

SEQ ID NO: 8762151 - DNA, 22 bp, Homo sapiens
agtgcaggttaaggaactggcc

SEQ ID NO: 8762152 - DNA, 22 bp, Homo sapiens
agtgcagggggaaagggtgtct

SEQ ID NO: 8762153 - DNA, 22 bp, Homo sapiens
agtgcagggggaaagggtgtct

SEQ ID NO: 8762154 - DNA, 22 bp, Homo sapiens
agtgcagggggaaagggtgtct

SEQ ID NO: 8762155 - DNA, 22 bp, Homo sapiens
actcttcaccgctactgaaata

SEQ ID NO: 8762156 - DNA, 22 bp, Homo sapiens
actcttcacacttgtctccagg

SEQ ID NO: 8762157 - DNA, 22 bp, Homo sapiens
actcttcacacatgctgccctc

SEQ ID NO: 8762158 - DNA, 22 bp, Homo sapiens
actcttattttgaagtaataat

SEQ ID NO: 8762159 - DNA, 22 bp, Homo sapiens
agtgcaatgaataacagccacc

SEQ ID NO: 8762160 - DNA, 22 bp, Homo sapiens
actcttcacttcccctgccagc

SEQ ID NO: 8762161 - DNA, 22 bp, Homo sapiens
agtgcaatggtgccatcatagc

SEQ ID NO: 8762162 - DNA, 22 bp, Homo sapiens
agtgcaatgcagtagttcagca

SEQ ID NO: 8762163 - DNA, 22 bp, Homo sapiens
actgaggattagcccaggctag

SEQ ID NO: 8762164 - DNA, 22 bp, Homo sapiens
actgaggcagaagggtaagtgg

SEQ ID NO: 8762165 - DNA, 21 bp, Homo sapiens
actgaggcaatggatttttgt

SEQ ID NO: 8762166 - DNA, 22 bp, Homo sapiens
actgaggcagaagggtaagtgg

SEQ ID NO: 8762167 - DNA, 22 bp, Homo sapiens
actgaggcagtgaggtcggtct

SEQ ID NO: 8762168 - DNA, 22 bp, Homo sapiens
actgaggacagtgaggagggct

SEQ ID NO: 8762169 - DNA, 22 bp, Homo sapiens
actgaggaacatatataagatg

SEQ ID NO: 8762170 - DNA, 22 bp, Homo sapiens
actgaggcgcagtccggctgtc

SEQ ID NO: 8762171 - DNA, 22 bp, Homo sapiens
actgaggcccgaggatctcctg

SEQ ID NO: 8762172 - DNA, 22 bp, Homo sapiens
actgaggctagattgctgttct

SEQ ID NO: 8762173 - DNA, 22 bp, Homo sapiens
actgaggctagattgctgttct

SEQ ID NO: 8762174 - DNA, 22 bp, Homo sapiens
actgaggcttacaaaggtaaag

SEQ ID NO: 8762175 - DNA, 22 bp, Homo sapiens
actgaggcttacaaaggtaaag

SEQ ID NO: 8762176 - DNA, 23 bp, Homo sapiens
actgagggccacttccatcgtga

SEQ ID NO: 8762177 - DNA, 22 bp, Homo sapiens
actgagctgcaagtcagggagg

SEQ ID NO: 8762178 - DNA, 20 bp, Homo sapiens
agtgcatggagggagagggc

SEQ ID NO: 8762179 - DNA, 22 bp, Homo sapiens
agtgcatgcgcttgggaggggt

SEQ ID NO: 8762180 - DNA, 22 bp, Homo sapiens
agtgcatgcgcttgggaggggt

SEQ ID NO: 8762181 - DNA, 22 bp, Homo sapiens
agtgcatacccttctaaaaagt

SEQ ID NO: 8762182 - DNA, 22 bp, Homo sapiens
agtgcataaaggaaaaactgaa

SEQ ID NO: 8762183 - DNA, 22 bp, Homo sapiens
agtgcagttaggatggggaatt

SEQ ID NO: 8762184 - DNA, 22 bp, Homo sapiens
cagagaaactcagatagctgat

SEQ ID NO: 8762185 - DNA, 22 bp, Homo sapiens
cagagaaactcagatagctgat

SEQ ID NO: 8762186 - DNA, 22 bp, Homo sapiens
cagagaaactcagatagctgat

SEQ ID NO: 8762187 - DNA, 22 bp, Homo sapiens
cagagaaactcagatagctgat

SEQ ID NO: 8762188 - DNA, 22 bp, Homo sapiens
cagagaaaaaatcctgctctca

SEQ ID NO: 8762189 - DNA, 22 bp, Homo sapiens
cagactttctgactcccttgcc

SEQ ID NO: 8762190 - DNA, 22 bp, Homo sapiens
cagactttctgactcccttgcc

SEQ ID NO: 8762191 - DNA, 22 bp, Homo sapiens
cagacatggaaatttagtgtta

SEQ ID NO: 8762192 - DNA, 22 bp, Homo sapiens
cagacatgatgtaagcagaggc

SEQ ID NO: 8762193 - DNA, 22 bp, Homo sapiens
cagagaaaaaatcctgctctca

SEQ ID NO: 8762194 - DNA, 22 bp, Homo sapiens
cagagaaaaaatcctgctctca

SEQ ID NO: 8762195 - DNA, 22 bp, Homo sapiens
cagagaaaaaatcctgctctca

SEQ ID NO: 8762196 - DNA, 22 bp, Homo sapiens
agcccaagcataggagggaggc

SEQ ID NO: 8762197 - DNA, 22 bp, Homo sapiens
agcccaagcataggagggaggc

SEQ ID NO: 8762198 - DNA, 16 bp, Homo sapiens
agccatcatcaacttg

SEQ ID NO: 8762199 - DNA, 23 bp, Homo sapiens
agccatcatcctgctgctggggc

SEQ ID NO: 8762200 - DNA, 23 bp, Homo sapiens
agccatcatcctgctgctggggc

SEQ ID NO: 8762201 - DNA, 22 bp, Homo sapiens
agccatcacttgagaatctatt

SEQ ID NO: 8762202 - DNA, 22 bp, Homo sapiens
agccatcacttgagaatctatt

SEQ ID NO: 8762203 - DNA, 22 bp, Homo sapiens
agccatcactggggcccaccat

SEQ ID NO: 8762204 - DNA, 22 bp, Homo sapiens
agccatcatttctgtcactggc

SEQ ID NO: 8762205 - DNA, 22 bp, Homo sapiens
cagagaaagggtgaattccttc

SEQ ID NO: 8762206 - DNA, 22 bp, Homo sapiens
cagagaaagaagcccattcatt

SEQ ID NO: 8762207 - DNA, 22 bp, Homo sapiens
cagagaaagggtgaattccttc

SEQ ID NO: 8762208 - DNA, 22 bp, Homo sapiens
agccagtttgcttgtaataaca

SEQ ID NO: 8762209 - DNA, 22 bp, Homo sapiens
cagagaaactcagatagctgat

SEQ ID NO: 8762210 - DNA, 22 bp, Homo sapiens
cagagaaagaagcccattcatt

SEQ ID NO: 8762211 - DNA, 22 bp, Homo sapiens
cagagaaagaagcccattcatt

SEQ ID NO: 8762212 - DNA, 22 bp, Homo sapiens
cagagaaagacttgcccttagt

SEQ ID NO: 8762213 - DNA, 23 bp, Homo sapiens
agcccaccttgttagtcctgtgg

SEQ ID NO: 8762214 - DNA, 22 bp, Homo sapiens
agcccactccaagggtttttct

SEQ ID NO: 8762215 - DNA, 22 bp, Homo sapiens
agcccactgttttcatttctct

SEQ ID NO: 8762216 - DNA, 22 bp, Homo sapiens
agcccagcagaaagtccagcct

SEQ ID NO: 8762217 - DNA, 22 bp, Homo sapiens
agcccagcccgggctgcgcttt

SEQ ID NO: 8762218 - DNA, 22 bp, Homo sapiens
agcccagcccgggctgcgcttt

SEQ ID NO: 8762219 - DNA, 22 bp, Homo sapiens
agcccagccactattaaatgtt

SEQ ID NO: 8762220 - DNA, 22 bp, Homo sapiens
agcccagcagtaagattagaga

SEQ ID NO: 8762221 - DNA, 22 bp, Homo sapiens
agcccagcactgggggcccagc

SEQ ID NO: 8762222 - DNA, 22 bp, Homo sapiens
agcccagcagaaagtccagcct

SEQ ID NO: 8762223 - DNA, 22 bp, Homo sapiens
agcccagcaaaggggtttgaga

SEQ ID NO: 8762224 - DNA, 22 bp, Homo sapiens
agcccagcaaagggaggttcag

SEQ ID NO: 8762225 - DNA, 22 bp, Homo sapiens
agcccagcaaagggaggttcag

SEQ ID NO: 8762226 - DNA, 22 bp, Homo sapiens
cagaggctcttcctcactgccc

SEQ ID NO: 8762227 - DNA, 22 bp, Homo sapiens
agcccagggaaccaggaagtgg

SEQ ID NO: 8762228 - DNA, 22 bp, Homo sapiens
agcccagggaaccaggaagtgg

SEQ ID NO: 8762229 - DNA, 22 bp, Homo sapiens
agcccagggaaccaggaagtgg

SEQ ID NO: 8762230 - DNA, 22 bp, Homo sapiens
agcccagggaaccaggaagtgg

SEQ ID NO: 8762231 - DNA, 22 bp, Homo sapiens
cagagggagccctccaggagca

SEQ ID NO: 8762232 - DNA, 22 bp, Homo sapiens
cagagggagtttctgaggttgc

SEQ ID NO: 8762233 - DNA, 22 bp, Homo sapiens
cagagggagccctccaggagca

SEQ ID NO: 8762234 - DNA, 22 bp, Homo sapiens
cagagggacagtgtaatgcata

SEQ ID NO: 8762235 - DNA, 22 bp, Homo sapiens
agcccaggctggagtgcagtgg

SEQ ID NO: 8762236 - DNA, 22 bp, Homo sapiens
agcccaggctggagtgcagtgg

SEQ ID NO: 8762237 - DNA, 22 bp, Homo sapiens
agcccagggaaccaggaagtgg

SEQ ID NO: 8762238 - DNA, 22 bp, Homo sapiens
agcccaggctggagtgcagtgg

SEQ ID NO: 8762239 - DNA, 18 bp, Homo sapiens
agcccaggcatcgtctgc

SEQ ID NO: 8762240 - DNA, 22 bp, Homo sapiens
agcccaggcagagggatgcttg

SEQ ID NO: 8762241 - DNA, 22 bp, Homo sapiens
agcccaggcagagggatgcttg

SEQ ID NO: 8762242 - DNA, 18 bp, Homo sapiens
agcccaggcatcgtctgc

SEQ ID NO: 8762243 - DNA, 18 bp, Homo sapiens
agcccaggcatcgtctgc

SEQ ID NO: 8762244 - DNA, 22 bp, Homo sapiens
agcccaggctggagtgcagtgg

SEQ ID NO: 8762245 - DNA, 20 bp, Homo sapiens
agcccaggcctgtgtgagtc

SEQ ID NO: 8762246 - DNA, 20 bp, Homo sapiens
agcccaggcctgtgtgagtc

SEQ ID NO: 8762247 - DNA, 20 bp, Homo sapiens
agcccaggcctgtgtgagtc

SEQ ID NO: 8762248 - DNA, 20 bp, Homo sapiens
agcccaggcctgtgtgagtc

SEQ ID NO: 8762249 - DNA, 22 bp, Homo sapiens
cagaggcatactcccagtcttg

SEQ ID NO: 8762250 - DNA, 22 bp, Homo sapiens
cagaggcatactcccagtcttg

SEQ ID NO: 8762251 - DNA, 23 bp, Homo sapiens
cagaggcatcggattcaacatca

SEQ ID NO: 8762252 - DNA, 22 bp, Homo sapiens
agcccaggcagagggatgcttg

SEQ ID NO: 8762253 - DNA, 22 bp, Homo sapiens
agcccaggcagagggatgcttg

SEQ ID NO: 8762254 - DNA, 22 bp, Homo sapiens
cagaggagttcagtacacagcc

SEQ ID NO: 8762255 - DNA, 21 bp, Homo sapiens
cagaggcaggctctgtgtgtg

SEQ ID NO: 8762256 - DNA, 21 bp, Homo sapiens
cagaggcaggtcctgggacgg

SEQ ID NO: 8762257 - DNA, 22 bp, Homo sapiens
cagaggagttcagtacacagcc

SEQ ID NO: 8762258 - DNA, 22 bp, Homo sapiens
agcccagcccgggctgcgcttt

SEQ ID NO: 8762259 - DNA, 22 bp, Homo sapiens
cagaggcagtggggttgctcct

SEQ ID NO: 8762260 - DNA, 22 bp, Homo sapiens
cagaggcagtggggttgctcct

SEQ ID NO: 8762261 - DNA, 21 bp, Homo sapiens
cagaggcaggtcctgggacgg

SEQ ID NO: 8762262 - DNA, 21 bp, Homo sapiens
cagaggcaggctctgtgtgtg

SEQ ID NO: 8762263 - DNA, 22 bp, Homo sapiens
agccagagaacagcaggaaatg

SEQ ID NO: 8762264 - DNA, 22 bp, Homo sapiens
agccagagaacagcaggaaatg

SEQ ID NO: 8762265 - DNA, 22 bp, Homo sapiens
agccagagactgtgtctgtaat

SEQ ID NO: 8762266 - DNA, 22 bp, Homo sapiens
agccagagactttacctgtgca

SEQ ID NO: 8762267 - DNA, 22 bp, Homo sapiens
agccagagagccccaggttcta

SEQ ID NO: 8762268 - DNA, 22 bp, Homo sapiens
agccagagagccccaggttcta

SEQ ID NO: 8762269 - DNA, 22 bp, Homo sapiens
cagacagggtgggtttctgggc

SEQ ID NO: 8762270 - DNA, 22 bp, Homo sapiens
cagacaggtagggacagaacat

SEQ ID NO: 8762271 - DNA, 22 bp, Homo sapiens
cagacagtggacttgataaagg

SEQ ID NO: 8762272 - DNA, 22 bp, Homo sapiens
cagacaggtagggacagaacat

SEQ ID NO: 8762273 - DNA, 22 bp, Homo sapiens
cagacaggttgcaaaacttcaa

SEQ ID NO: 8762274 - DNA, 22 bp, Homo sapiens
cagacagtttatcctaaataac

SEQ ID NO: 8762275 - DNA, 22 bp, Homo sapiens
cagacagtgttagagtcaagct

SEQ ID NO: 8762276 - DNA, 22 bp, Homo sapiens
cagacatgatgtaagcagaggc

SEQ ID NO: 8762277 - DNA, 22 bp, Homo sapiens
cagacatcttttatcttcagga

SEQ ID NO: 8762278 - DNA, 22 bp, Homo sapiens
cagacatcacactcagattgca

SEQ ID NO: 8762279 - DNA, 22 bp, Homo sapiens
cagacatcacactcagattgca

SEQ ID NO: 8762280 - DNA, 22 bp, Homo sapiens
cagacatatgttttaacagatt

SEQ ID NO: 8762281 - DNA, 22 bp, Homo sapiens
cagacatccaggtacgagcttt

SEQ ID NO: 8762282 - DNA, 22 bp, Homo sapiens
cagacatccaggtacgagcttt

SEQ ID NO: 8762283 - DNA, 22 bp, Homo sapiens
cagacatccaggtacgagcttt

SEQ ID NO: 8762284 - DNA, 20 bp, Homo sapiens
cagacatctccaaatctgtg

SEQ ID NO: 8762285 - DNA, 20 bp, Homo sapiens
cagacatctccaaatctgtg

SEQ ID NO: 8762286 - DNA, 22 bp, Homo sapiens
agccagaacgcatcgccaaggc

SEQ ID NO: 8762287 - DNA, 22 bp, Homo sapiens
agccagaaccactggaacggtg

SEQ ID NO: 8762288 - DNA, 19 bp, Homo sapiens
agccagaactagtgtttct

SEQ ID NO: 8762289 - DNA, 22 bp, Homo sapiens
agccagaaaggggcattatctg

SEQ ID NO: 8762290 - DNA, 22 bp, Homo sapiens
agccactttactttcatatttt

SEQ ID NO: 8762291 - DNA, 22 bp, Homo sapiens
agccactgtgcaggagcagtgt

SEQ ID NO: 8762292 - DNA, 22 bp, Homo sapiens
agccactgtgtgaccagctgtc

SEQ ID NO: 8762293 - DNA, 22 bp, Homo sapiens
agccactgtgtgaccagctgtc

SEQ ID NO: 8762294 - DNA, 22 bp, Homo sapiens
agccactgtgagaggaccaggg

SEQ ID NO: 8762295 - DNA, 22 bp, Homo sapiens
cagaatgtattctcataaagcc

SEQ ID NO: 8762296 - DNA, 22 bp, Homo sapiens
agccactgtgagaggaccaggg

SEQ ID NO: 8762297 - DNA, 22 bp, Homo sapiens
agccactgtgagaggaccaggg

SEQ ID NO: 8762298 - DNA, 22 bp, Homo sapiens
agccactgtgagaggaccaggg

SEQ ID NO: 8762299 - DNA, 22 bp, Homo sapiens
cagaatgtatatgatctaaggt

SEQ ID NO: 8762300 - DNA, 22 bp, Homo sapiens
cagaatgtagatcatcatcaag

SEQ ID NO: 8762301 - DNA, 22 bp, Homo sapiens
cagaatgtagatcatcatcaag

SEQ ID NO: 8762302 - DNA, 22 bp, Homo sapiens
cagaatgggaaggactgcagtt

SEQ ID NO: 8762303 - DNA, 22 bp, Homo sapiens
cagaatctacaccctcagaaat

SEQ ID NO: 8762304 - DNA, 22 bp, Homo sapiens
cagaatctcgacttctggcccc

SEQ ID NO: 8762305 - DNA, 22 bp, Homo sapiens
cagaataccctatagacagaat

SEQ ID NO: 8762306 - DNA, 20 bp, Homo sapiens
cagaatgctgtaatcaagaa

SEQ ID NO: 8762307 - DNA, 22 bp, Homo sapiens
cagaatgagtagcatcttcacc

SEQ ID NO: 8762308 - DNA, 22 bp, Homo sapiens
cagaatgaaatgtaagaacacc

SEQ ID NO: 8762309 - DNA, 22 bp, Homo sapiens
cagaatctgttggggttgcaga

SEQ ID NO: 8762310 - DNA, 22 bp, Homo sapiens
cagaatcttcttaattggcaca

SEQ ID NO: 8762311 - DNA, 22 bp, Homo sapiens
cagaatcttcttaattggcaca

SEQ ID NO: 8762312 - DNA, 22 bp, Homo sapiens
cagaatctctgggagtggatca

SEQ ID NO: 8762313 - DNA, 22 bp, Homo sapiens
cagaatctacaccctcagaaat

SEQ ID NO: 8762314 - DNA, 22 bp, Homo sapiens
cagaatctgagtcgtgattgta

SEQ ID NO: 8762315 - DNA, 22 bp, Homo sapiens
agccacagtgcaagagagaaaa

SEQ ID NO: 8762316 - DNA, 22 bp, Homo sapiens
agccacagtctgtagccagctt

SEQ ID NO: 8762317 - DNA, 22 bp, Homo sapiens
agccacagtctgtagccagctt

SEQ ID NO: 8762318 - DNA, 22 bp, Homo sapiens
agccacagtctgtagccagctt

SEQ ID NO: 8762319 - DNA, 22 bp, Homo sapiens
agccacagtctgtagccagctt

SEQ ID NO: 8762320 - DNA, 22 bp, Homo sapiens
agccacaggaaacagagacagc

SEQ ID NO: 8762321 - DNA, 22 bp, Homo sapiens
agccacaggaaacagagacagc

SEQ ID NO: 8762322 - DNA, 22 bp, Homo sapiens
agccacaggaaacagagacagc

SEQ ID NO: 8762323 - DNA, 22 bp, Homo sapiens
agcataggcggtggtaggaccc

SEQ ID NO: 8762324 - DNA, 22 bp, Homo sapiens
agcatatacaaactcatataca

SEQ ID NO: 8762325 - DNA, 22 bp, Homo sapiens
agcatatacaaactcatataca

SEQ ID NO: 8762326 - DNA, 22 bp, Homo sapiens
agccacctctgtgcaggcctcg

SEQ ID NO: 8762327 - DNA, 22 bp, Homo sapiens
agccacctggacacaggcttgc

SEQ ID NO: 8762328 - DNA, 22 bp, Homo sapiens
agccaccttctccaaggcctag

SEQ ID NO: 8762329 - DNA, 22 bp, Homo sapiens
agccaccttctccaaggcctag

SEQ ID NO: 8762330 - DNA, 22 bp, Homo sapiens
agccactccttcagcgtctgct

SEQ ID NO: 8762331 - DNA, 22 bp, Homo sapiens
agccaccctaccagccctgaaa

SEQ ID NO: 8762332 - DNA, 22 bp, Homo sapiens
agccacctcacctgctgccgtt

SEQ ID NO: 8762333 - DNA, 22 bp, Homo sapiens
agccacagtgggctaccagctc

SEQ ID NO: 8762334 - DNA, 22 bp, Homo sapiens
agccacagtgggctaccagctc

SEQ ID NO: 8762335 - DNA, 22 bp, Homo sapiens
agccacagtgcaagagagaaaa

SEQ ID NO: 8762336 - DNA, 22 bp, Homo sapiens
agccacagtgcaagagagaaaa

SEQ ID NO: 8762337 - DNA, 22 bp, Homo sapiens
agccacccattcccgagcccta

SEQ ID NO: 8762338 - DNA, 22 bp, Homo sapiens
agccacatttttctgctcctga

SEQ ID NO: 8762339 - DNA, 22 bp, Homo sapiens
agccacatgagtgagccatctt

SEQ ID NO: 8762340 - DNA, 22 bp, Homo sapiens
agccacagtgggctaccagctc

SEQ ID NO: 8762341 - DNA, 22 bp, Homo sapiens
cagaaatcattgtgatgacagg

SEQ ID NO: 8762342 - DNA, 22 bp, Homo sapiens
cagaaatatgtgccatgcctta

SEQ ID NO: 8762343 - DNA, 22 bp, Homo sapiens
cagaaatatgtgccatgcctta

SEQ ID NO: 8762344 - DNA, 22 bp, Homo sapiens
cagaaatatgtgccatgcctta

SEQ ID NO: 8762345 - DNA, 22 bp, Homo sapiens
cagaaatatgtgccatgcctta

SEQ ID NO: 8762346 - DNA, 22 bp, Homo sapiens
cagaaatattccaagtactgca

SEQ ID NO: 8762347 - DNA, 22 bp, Homo sapiens
cagaaatatttattgagtgaca

SEQ ID NO: 8762348 - DNA, 22 bp, Homo sapiens
cagaaatatttattgagtgaca

SEQ ID NO: 8762349 - DNA, 22 bp, Homo sapiens
cagaaatattccaagtactgca

SEQ ID NO: 8762350 - DNA, 22 bp, Homo sapiens
cagaaatattccaagtactgca

SEQ ID NO: 8762351 - DNA, 22 bp, Homo sapiens
cagaaatatcagttgaaagtgc

SEQ ID NO: 8762352 - DNA, 22 bp, Homo sapiens
agccactgcccttagccatttg

SEQ ID NO: 8762353 - DNA, 22 bp, Homo sapiens
agccactggtaaactggtagga

SEQ ID NO: 8762354 - DNA, 22 bp, Homo sapiens
agccactggcctgggcagctct

SEQ ID NO: 8762355 - DNA, 22 bp, Homo sapiens
agccactgtaaggggaattgcc

SEQ ID NO: 8762356 - DNA, 22 bp, Homo sapiens
agccactgtaaggggaattgcc

SEQ ID NO: 8762357 - DNA, 19 bp, Homo sapiens
cagaaatagcgaagtgtaa

SEQ ID NO: 8762358 - DNA, 22 bp, Homo sapiens
cagaaatatatatgggtcagag

SEQ ID NO: 8762359 - DNA, 22 bp, Homo sapiens
cagcagggcccccgggtgcgcc

SEQ ID NO: 8762360 - DNA, 22 bp, Homo sapiens
cagcaggggaactgtgggccag

SEQ ID NO: 8762361 - DNA, 22 bp, Homo sapiens
cagcaggggaactgtgggccag

SEQ ID NO: 8762362 - DNA, 22 bp, Homo sapiens
cagcagggctgtgctaccccat

SEQ ID NO: 8762363 - DNA, 22 bp, Homo sapiens
cagcaggatatggtggagagag

SEQ ID NO: 8762364 - DNA, 22 bp, Homo sapiens
agcctggcactgccccatccat

SEQ ID NO: 8762365 - DNA, 22 bp, Homo sapiens
cagcaggatatggtggagagag

SEQ ID NO: 8762366 - DNA, 22 bp, Homo sapiens
cagcaggatatggtggagagag

SEQ ID NO: 8762367 - DNA, 22 bp, Homo sapiens
agcctggcactgaggcagggcg

SEQ ID NO: 8762368 - DNA, 22 bp, Homo sapiens
agcctggcactgaggcagggcg

SEQ ID NO: 8762369 - DNA, 23 bp, Homo sapiens
agcctggcacctgcagatcggag

SEQ ID NO: 8762370 - DNA, 22 bp, Homo sapiens
agcctggcactgccccatccat

SEQ ID NO: 8762371 - DNA, 22 bp, Homo sapiens
agcctggcactgaggcagggcg

SEQ ID NO: 8762372 - DNA, 22 bp, Homo sapiens
agcctggcactgccccatccat

SEQ ID NO: 8762373 - DNA, 22 bp, Homo sapiens
agcctggcactgccccatccat

SEQ ID NO: 8762374 - DNA, 22 bp, Homo sapiens
agcctggaggtaatgaggaaac

SEQ ID NO: 8762375 - DNA, 22 bp, Homo sapiens
cagcagctgaggcgctggcgtg

SEQ ID NO: 8762376 - DNA, 22 bp, Homo sapiens
cagcagctgaggcgctggcgtg

SEQ ID NO: 8762377 - DNA, 22 bp, Homo sapiens
agcctggagttcccaggagaag

SEQ ID NO: 8762378 - DNA, 20 bp, Homo sapiens
agcctggcaaacacccccag

SEQ ID NO: 8762379 - DNA, 20 bp, Homo sapiens
agcctggcaaacacccccag

SEQ ID NO: 8762380 - DNA, 23 bp, Homo sapiens
agcctggcacctgcagatcggag

SEQ ID NO: 8762381 - DNA, 23 bp, Homo sapiens
agcctggcacctgcagatcggag

SEQ ID NO: 8762382 - DNA, 20 bp, Homo sapiens
agcctggcaaacacccccag

SEQ ID NO: 8762383 - DNA, 22 bp, Homo sapiens
agcctggcactgaggcagggcg

SEQ ID NO: 8762384 - DNA, 22 bp, Homo sapiens
agcctggatcctaggctcagct

SEQ ID NO: 8762385 - DNA, 22 bp, Homo sapiens
agcctggatcctaggctcagct

SEQ ID NO: 8762386 - DNA, 22 bp, Homo sapiens
cagcagctcaggctgcttccca

SEQ ID NO: 8762387 - DNA, 22 bp, Homo sapiens
cagcagctcaggctgcttccca

SEQ ID NO: 8762388 - DNA, 22 bp, Homo sapiens
cagcagctcaggctccttccca

SEQ ID NO: 8762389 - DNA, 22 bp, Homo sapiens
cagcagctcaggctccttccca

SEQ ID NO: 8762390 - DNA, 22 bp, Homo sapiens
cagcagctcagtctctcagtag

SEQ ID NO: 8762391 - DNA, 22 bp, Homo sapiens
cagcagctcagtctctcagtag

SEQ ID NO: 8762392 - DNA, 22 bp, Homo sapiens
cagcagctcagtctctcagtag

SEQ ID NO: 8762393 - DNA, 22 bp, Homo sapiens
cagcagctccaaagaatagcca

SEQ ID NO: 8762394 - DNA, 22 bp, Homo sapiens
cagcagctcccatccgctgagc

SEQ ID NO: 8762395 - DNA, 22 bp, Homo sapiens
cagcagctgactccaagagagc

SEQ ID NO: 8762396 - DNA, 22 bp, Homo sapiens
cagcagctgactccaagagagc

SEQ ID NO: 8762397 - DNA, 22 bp, Homo sapiens
cagcagctcctctgcggctatg

SEQ ID NO: 8762398 - DNA, 22 bp, Homo sapiens
agcctgagaaaggagtttggag

SEQ ID NO: 8762399 - DNA, 22 bp, Homo sapiens
agcctgactaataggagttgag

SEQ ID NO: 8762400 - DNA, 22 bp, Homo sapiens
agcctgactaataggagttgag

SEQ ID NO: 8762401 - DNA, 23 bp, Homo sapiens
agcctcttttctcctgccctgca

SEQ ID NO: 8762402 - DNA, 23 bp, Homo sapiens
agcctcttttctcctgccctgca

SEQ ID NO: 8762403 - DNA, 22 bp, Homo sapiens
agcctcttattctccaggactt

SEQ ID NO: 8762404 - DNA, 22 bp, Homo sapiens
agcctgagagccaagctgtgca

SEQ ID NO: 8762405 - DNA, 22 bp, Homo sapiens
agcctgagccccatccagctga

SEQ ID NO: 8762406 - DNA, 22 bp, Homo sapiens
agcctgagagccaagctgtgca

SEQ ID NO: 8762407 - DNA, 22 bp, Homo sapiens
agcctgagagccaagctgtgca

SEQ ID NO: 8762408 - DNA, 22 bp, Homo sapiens
cagcagcattgctctggattcc

SEQ ID NO: 8762409 - DNA, 22 bp, Homo sapiens
cagcagctcactcaggtggctc

SEQ ID NO: 8762410 - DNA, 22 bp, Homo sapiens
cagcagctcactgaataatgac

SEQ ID NO: 8762411 - DNA, 22 bp, Homo sapiens
cagcagctcactgaataatgac

SEQ ID NO: 8762412 - DNA, 22 bp, Homo sapiens
cagcagctcactcaggtggctc

SEQ ID NO: 8762413 - DNA, 22 bp, Homo sapiens
agcctcctggagtttctgggat

SEQ ID NO: 8762414 - DNA, 22 bp, Homo sapiens
agcctcctggagtttctgggat

SEQ ID NO: 8762415 - DNA, 22 bp, Homo sapiens
agcctccctatgcaccttcagg

SEQ ID NO: 8762416 - DNA, 22 bp, Homo sapiens
agcctccatctcccatctgtga

SEQ ID NO: 8762417 - DNA, 22 bp, Homo sapiens
cagaggtcaagatctgaagtga

SEQ ID NO: 8762418 - DNA, 22 bp, Homo sapiens
cagaggtccctgttcttaagga

SEQ ID NO: 8762419 - DNA, 22 bp, Homo sapiens
cagagggagtttctgaggttgc

SEQ ID NO: 8762420 - DNA, 22 bp, Homo sapiens
cagagggagtttctgaggttgc

SEQ ID NO: 8762421 - DNA, 22 bp, Homo sapiens
cagagggcactcggagtgacat

SEQ ID NO: 8762422 - DNA, 22 bp, Homo sapiens
cagagggcactcggagtgacat

SEQ ID NO: 8762423 - DNA, 22 bp, Homo sapiens
cagagggccccctggccacagt

SEQ ID NO: 8762424 - DNA, 21 bp, Homo sapiens
cagagggccggcatgtggtct

SEQ ID NO: 8762425 - DNA, 22 bp, Homo sapiens
cagagggccccctggccacagt

SEQ ID NO: 8762426 - DNA, 22 bp, Homo sapiens
cagagggccccctggccacagt

SEQ ID NO: 8762427 - DNA, 22 bp, Homo sapiens
agcctctgggggagctgggagc

SEQ ID NO: 8762428 - DNA, 22 bp, Homo sapiens
agcctctggtcctccctcagct

SEQ ID NO: 8762429 - DNA, 22 bp, Homo sapiens
agcctctggtcctccctcagct

SEQ ID NO: 8762430 - DNA, 22 bp, Homo sapiens
agcctctgggggagctgggagc

SEQ ID NO: 8762431 - DNA, 22 bp, Homo sapiens
agcctctgggggagctgggagc

SEQ ID NO: 8762432 - DNA, 22 bp, Homo sapiens
agcctctgggggagctgggagc

SEQ ID NO: 8762433 - DNA, 22 bp, Homo sapiens
agcctctggccctagactgctt

SEQ ID NO: 8762434 - DNA, 22 bp, Homo sapiens
agcctctggccctagactgctt

SEQ ID NO: 8762435 - DNA, 22 bp, Homo sapiens
agcctctgtagaaagcagtgtg

SEQ ID NO: 8762436 - DNA, 22 bp, Homo sapiens
agcctctgtagaaagcagtgtg

SEQ ID NO: 8762437 - DNA, 22 bp, Homo sapiens
agcctctgtagaaagcagtgtg

SEQ ID NO: 8762438 - DNA, 22 bp, Homo sapiens
agcctctgtcaagcttttcaaa

SEQ ID NO: 8762439 - DNA, 22 bp, Homo sapiens
agcctctgtcaagcttttcaaa

SEQ ID NO: 8762440 - DNA, 22 bp, Homo sapiens
agcctctgtcaagcttttcaaa

SEQ ID NO: 8762441 - DNA, 22 bp, Homo sapiens
agcctctgtgactcacaggtca

SEQ ID NO: 8762442 - DNA, 20 bp, Homo sapiens
agcctctgcccttcccactg

SEQ ID NO: 8762443 - DNA, 20 bp, Homo sapiens
agcctctgcccttcccactg

SEQ ID NO: 8762444 - DNA, 22 bp, Homo sapiens
agcctctgcacttcttacaggt

SEQ ID NO: 8762445 - DNA, 22 bp, Homo sapiens
agcctctgcacttcttacaggt

SEQ ID NO: 8762446 - DNA, 22 bp, Homo sapiens
agcctctgcacgggcacgggtg

SEQ ID NO: 8762447 - DNA, 22 bp, Homo sapiens
agcctctgctggccctggcact

SEQ ID NO: 8762448 - DNA, 22 bp, Homo sapiens
agcctctgctggccctggcact

SEQ ID NO: 8762449 - DNA, 22 bp, Homo sapiens
agcctctgctggccctggcact

SEQ ID NO: 8762450 - DNA, 18 bp, Homo sapiens
agcctctggcagagagaa

SEQ ID NO: 8762451 - DNA, 22 bp, Homo sapiens
agcctctggccctagactgctt

SEQ ID NO: 8762452 - DNA, 22 bp, Homo sapiens
agcctctggccctagactgctt

SEQ ID NO: 8762453 - DNA, 18 bp, Homo sapiens
agcctctggcagagagaa

SEQ ID NO: 8762454 - DNA, 18 bp, Homo sapiens
agcctctggcagagagaa

SEQ ID NO: 8762455 - DNA, 18 bp, Homo sapiens
agcctctggcagagagaa

SEQ ID NO: 8762456 - DNA, 22 bp, Homo sapiens
agctcagagggaggtgaagtgg

SEQ ID NO: 8762457 - DNA, 21 bp, Homo sapiens
agctcagcaagatggaggctc

SEQ ID NO: 8762458 - DNA, 22 bp, Homo sapiens
agctcagcactgtcagcactcc

SEQ ID NO: 8762459 - DNA, 22 bp, Homo sapiens
cagccctgcagagggcgctcct

SEQ ID NO: 8762460 - DNA, 22 bp, Homo sapiens
agctcagcttcctctccatgct

SEQ ID NO: 8762461 - DNA, 22 bp, Homo sapiens
agctcaggcaactctgggcccc

SEQ ID NO: 8762462 - DNA, 22 bp, Homo sapiens
agctcagccctcctgtgcagct

SEQ ID NO: 8762463 - DNA, 21 bp, Homo sapiens
agctcagccgggcacagtggc

SEQ ID NO: 8762464 - DNA, 22 bp, Homo sapiens
cagctcaggctctccatgctcc

SEQ ID NO: 8762465 - DNA, 22 bp, Homo sapiens
cagctcagtctggagagatgca

SEQ ID NO: 8762466 - DNA, 19 bp, Homo sapiens
cagctcaggactcagcccc

SEQ ID NO: 8762467 - DNA, 22 bp, Homo sapiens
agctcaggcaactctgggcccc

SEQ ID NO: 8762468 - DNA, 22 bp, Homo sapiens
cagcgtctcgttgtgggcctcg

SEQ ID NO: 8762469 - DNA, 20 bp, Homo sapiens
agctcctgagggttactttc

SEQ ID NO: 8762470 - DNA, 22 bp, Homo sapiens
agctcctgagtagctttactca

SEQ ID NO: 8762471 - DNA, 22 bp, Homo sapiens
agctcctgatacatgcaggaat

SEQ ID NO: 8762472 - DNA, 23 bp, Homo sapiens
agctcctgaggccagcctctcct

SEQ ID NO: 8762473 - DNA, 23 bp, Homo sapiens
agctcctgaggccagcctctcct

SEQ ID NO: 8762474 - DNA, 22 bp, Homo sapiens
agctcctgatacatgcaggaat

SEQ ID NO: 8762475 - DNA, 22 bp, Homo sapiens
agctcctgatacatgcaggaat

SEQ ID NO: 8762476 - DNA, 22 bp, Homo sapiens
cagctctgagactgaggctatg

SEQ ID NO: 8762477 - DNA, 22 bp, Homo sapiens
cagctctgagactgaggctatg

SEQ ID NO: 8762478 - DNA, 22 bp, Homo sapiens
cagctctgagactgaggctatg

SEQ ID NO: 8762479 - DNA, 22 bp, Homo sapiens
agctcctgattctcagagatag

SEQ ID NO: 8762480 - DNA, 22 bp, Homo sapiens
agctcctgattctcagagatag

SEQ ID NO: 8762481 - DNA, 22 bp, Homo sapiens
cagctccaaagccccactgtcc

SEQ ID NO: 8762482 - DNA, 22 bp, Homo sapiens
cagctccaaagccccactgtcc

SEQ ID NO: 8762483 - DNA, 22 bp, Homo sapiens
cagctcattcctcaatctagga

SEQ ID NO: 8762484 - DNA, 22 bp, Homo sapiens
agctcctgaaaatccagactgg

SEQ ID NO: 8762485 - DNA, 22 bp, Homo sapiens
agctcctgaaaatccagactgg

SEQ ID NO: 8762486 - DNA, 22 bp, Homo sapiens
cagctcagtcttgaagcactgg

SEQ ID NO: 8762487 - DNA, 22 bp, Homo sapiens
cagctcagtcttgaagcactgg

SEQ ID NO: 8762488 - DNA, 22 bp, Homo sapiens
cagctcagtctggagagatgca

SEQ ID NO: 8762489 - DNA, 22 bp, Homo sapiens
cagctcagtctggagagatgca

SEQ ID NO: 8762490 - DNA, 22 bp, Homo sapiens
cagcagttgtttcggattggga

SEQ ID NO: 8762491 - DNA, 22 bp, Homo sapiens
cagcagttgtttcggattggga

SEQ ID NO: 8762492 - DNA, 22 bp, Homo sapiens
cagcagttatgagtagaatagt

SEQ ID NO: 8762493 - DNA, 22 bp, Homo sapiens
cagcagttcaggctccttcccg

SEQ ID NO: 8762494 - DNA, 22 bp, Homo sapiens
cagcagttctgtactttagagt

SEQ ID NO: 8762495 - DNA, 22 bp, Homo sapiens
cagcagttgaaattgacatgtg

SEQ ID NO: 8762496 - DNA, 22 bp, Homo sapiens
cagcagtttcctatggttcagc

SEQ ID NO: 8762497 - DNA, 22 bp, Homo sapiens
cagcagttttgaagtgtggaga

SEQ ID NO: 8762498 - DNA, 22 bp, Homo sapiens
cagcagttttgaagtgtggaga

SEQ ID NO: 8762499 - DNA, 22 bp, Homo sapiens
cagcataggacagggtttcatc

SEQ ID NO: 8762500 - DNA, 22 bp, Homo sapiens
cagcagtgtggaagctgagggg

SEQ ID NO: 8762501 - DNA, 22 bp, Homo sapiens
cagcagtgtggaagctgagggg

SEQ ID NO: 8762502 - DNA, 22 bp, Homo sapiens
cagcagtgtgcaggtgtgctgg

SEQ ID NO: 8762503 - DNA, 22 bp, Homo sapiens
cagcagttatgagtagaatagt

SEQ ID NO: 8762504 - DNA, 22 bp, Homo sapiens
cagcagttcaatccagtgcacg

SEQ ID NO: 8762505 - DNA, 22 bp, Homo sapiens
cagcagttcacacttaacaagt

SEQ ID NO: 8762506 - DNA, 22 bp, Homo sapiens
cagcagggggcagcgcagatca

SEQ ID NO: 8762507 - DNA, 22 bp, Homo sapiens
cagcagggtaggttgtatcagt

SEQ ID NO: 8762508 - DNA, 22 bp, Homo sapiens
cagcaggggtgtcattgtagtt

SEQ ID NO: 8762509 - DNA, 22 bp, Homo sapiens
cagcaggggaactgtgggccag

SEQ ID NO: 8762510 - DNA, 22 bp, Homo sapiens
cagcaggggaactgtgggccag

SEQ ID NO: 8762511 - DNA, 22 bp, Homo sapiens
cagcagtgtctccagcatcaca

SEQ ID NO: 8762512 - DNA, 22 bp, Homo sapiens
cagcagggttaagtgactcacc

SEQ ID NO: 8762513 - DNA, 22 bp, Homo sapiens
cagcagggtaggttgtatcagt

SEQ ID NO: 8762514 - DNA, 22 bp, Homo sapiens
cagcagggtaggttgtatcagt

SEQ ID NO: 8762515 - DNA, 22 bp, Homo sapiens
cagcagggtatacagggaattt

SEQ ID NO: 8762516 - DNA, 22 bp, Homo sapiens
cagcatcacagtgcccgaagtc

SEQ ID NO: 8762517 - DNA, 22 bp, Homo sapiens
cagcatcaacattctcagctct

SEQ ID NO: 8762518 - DNA, 22 bp, Homo sapiens
cagcatcaacattctcagctct

SEQ ID NO: 8762519 - DNA, 22 bp, Homo sapiens
cagcatattactttaaaaaatc

SEQ ID NO: 8762520 - DNA, 22 bp, Homo sapiens
cagccccagcacttagctgagt

SEQ ID NO: 8762521 - DNA, 22 bp, Homo sapiens
cagccccagcacttagctgagt

SEQ ID NO: 8762522 - DNA, 23 bp, Homo sapiens
cagccctgaaatcgaggtgacac

SEQ ID NO: 8762523 - DNA, 22 bp, Homo sapiens
cagccctgagagaaccatctat

SEQ ID NO: 8762524 - DNA, 22 bp, Homo sapiens
cagccctgagaaggaggatctc

SEQ ID NO: 8762525 - DNA, 22 bp, Homo sapiens
cagccctgagaaggaggatctc

SEQ ID NO: 8762526 - DNA, 23 bp, Homo sapiens
cagccctgaaatcgaggtgacac

SEQ ID NO: 8762527 - DNA, 23 bp, Homo sapiens
cagccctgaaatcgaggtgacac

SEQ ID NO: 8762528 - DNA, 23 bp, Homo sapiens
cagccctgaaatcgaggtgacac

SEQ ID NO: 8762529 - DNA, 22 bp, Homo sapiens
cagccctgagttagcccacgga

SEQ ID NO: 8762530 - DNA, 22 bp, Homo sapiens
cagccctgagttagcccacgga

SEQ ID NO: 8762531 - DNA, 22 bp, Homo sapiens
cagccctgagttagcccacgga

SEQ ID NO: 8762532 - DNA, 22 bp, Homo sapiens
cagccctgagcaaggcttttaa

SEQ ID NO: 8762533 - DNA, 22 bp, Homo sapiens
cagccctgagttagcccacgga

SEQ ID NO: 8762534 - DNA, 22 bp, Homo sapiens
cagccctgcacgctgcctccgc

SEQ ID NO: 8762535 - DNA, 16 bp, Homo sapiens
cagccctgaggaagaa

SEQ ID NO: 8762536 - DNA, 22 bp, Homo sapiens
cagccctgcagagggcgctcct

SEQ ID NO: 8762537 - DNA, 22 bp, Homo sapiens
cagccctgcagagggcgctcct

SEQ ID NO: 8762538 - DNA, 22 bp, Homo sapiens
cagccctgcagagggcgctcct

SEQ ID NO: 8762539 - DNA, 22 bp, Homo sapiens
cagccctgcacgctgcctccgc

SEQ ID NO: 8762540 - DNA, 22 bp, Homo sapiens
cagccctgcacgctgcctccgc

SEQ ID NO: 8762541 - DNA, 22 bp, Homo sapiens
cagccctgcacgctgcctccgc

SEQ ID NO: 8762542 - DNA, 22 bp, Homo sapiens
cacacactgttaatgtaggagt

SEQ ID NO: 8762543 - DNA, 22 bp, Homo sapiens
agcaggagcatttccatgattc

SEQ ID NO: 8762544 - DNA, 22 bp, Homo sapiens
agcaggagtgtcccctggctgt

SEQ ID NO: 8762545 - DNA, 22 bp, Homo sapiens
agcaggagtgtcccctggctgt

SEQ ID NO: 8762546 - DNA, 22 bp, Homo sapiens
cacacacagttttgtattctgt

SEQ ID NO: 8762547 - DNA, 22 bp, Homo sapiens
cacacacagttttgtattctgt

SEQ ID NO: 8762548 - DNA, 22 bp, Homo sapiens
cacacacagttttgtattctgt

SEQ ID NO: 8762549 - DNA, 22 bp, Homo sapiens
cacacacagttttgtattctgt

SEQ ID NO: 8762550 - DNA, 22 bp, Homo sapiens
cacacaccaatcaaatgtcaga

SEQ ID NO: 8762551 - DNA, 22 bp, Homo sapiens
cacacactgacaccttatcttg

SEQ ID NO: 8762552 - DNA, 22 bp, Homo sapiens
cacacactggagcaaggagatg

SEQ ID NO: 8762553 - DNA, 22 bp, Homo sapiens
cacacactgacaccttatcttg

SEQ ID NO: 8762554 - DNA, 21 bp, Homo sapiens
agcaggcaaaggtgaagtctt

SEQ ID NO: 8762555 - DNA, 21 bp, Homo sapiens
agcaggcaaaggtgaagtctt

SEQ ID NO: 8762556 - DNA, 22 bp, Homo sapiens
agcaggcaagcgtgagttctct

SEQ ID NO: 8762557 - DNA, 22 bp, Homo sapiens
agcaggcaagcgtgagttctct

SEQ ID NO: 8762558 - DNA, 22 bp, Homo sapiens
agcaggcaagcgtgagttctct

SEQ ID NO: 8762559 - DNA, 22 bp, Homo sapiens
agcaggcaaggtccgtgcctcg

SEQ ID NO: 8762560 - DNA, 21 bp, Homo sapiens
agcaggcaaaggtgaagtctt

SEQ ID NO: 8762561 - DNA, 22 bp, Homo sapiens
agcaggcacaagaaagggaggt

SEQ ID NO: 8762562 - DNA, 22 bp, Homo sapiens
agcaggcacaagaaagggaggt

SEQ ID NO: 8762563 - DNA, 22 bp, Homo sapiens
agcaggcacaagaaagggaggt

SEQ ID NO: 8762564 - DNA, 22 bp, Homo sapiens
agcaggcacaagaaagggaggt

SEQ ID NO: 8762565 - DNA, 22 bp, Homo sapiens
agcaggcaccagggctcgtcct

SEQ ID NO: 8762566 - DNA, 17 bp, Homo sapiens
agcaggcacgtcagcac

SEQ ID NO: 8762567 - DNA, 22 bp, Homo sapiens
agcaggcacgctccctgcgcga

SEQ ID NO: 8762568 - DNA, 22 bp, Homo sapiens
agcaggcacgctccctgcgcga

SEQ ID NO: 8762569 - DNA, 22 bp, Homo sapiens
agcagctgagccccagctgtga

SEQ ID NO: 8762570 - DNA, 22 bp, Homo sapiens
agcagctgatcaaagcacttat

SEQ ID NO: 8762571 - DNA, 22 bp, Homo sapiens
agcagctgatggggaaggagtt

SEQ ID NO: 8762572 - DNA, 22 bp, Homo sapiens
agcagctgatggggaaggagtt

SEQ ID NO: 8762573 - DNA, 22 bp, Homo sapiens
agcagctgatggggaaggagtt

SEQ ID NO: 8762574 - DNA, 22 bp, Homo sapiens
agcagctgatggggaaggagtt

SEQ ID NO: 8762575 - DNA, 22 bp, Homo sapiens
agcagctgatggggaaggagtt

SEQ ID NO: 8762576 - DNA, 22 bp, Homo sapiens
agcagctgcagagggctccccc

SEQ ID NO: 8762577 - DNA, 22 bp, Homo sapiens
agcagctgcagggagggtctgc

SEQ ID NO: 8762578 - DNA, 22 bp, Homo sapiens
agcagctgcagagggctccccc

SEQ ID NO: 8762579 - DNA, 22 bp, Homo sapiens
agcagctgcagggagggtctgc

SEQ ID NO: 8762580 - DNA, 22 bp, Homo sapiens
agcagctgcagggagggtctgc

SEQ ID NO: 8762581 - DNA, 22 bp, Homo sapiens
agcagctgccagagagagttcc

SEQ ID NO: 8762582 - DNA, 22 bp, Homo sapiens
agcagctgccactggaatagga

SEQ ID NO: 8762583 - DNA, 22 bp, Homo sapiens
agcagctgccactggaatagga

SEQ ID NO: 8762584 - DNA, 21 bp, Homo sapiens
agcagctgcagtttctatctg

SEQ ID NO: 8762585 - DNA, 22 bp, Homo sapiens
agcagctgccactggaatagga

SEQ ID NO: 8762586 - DNA, 22 bp, Homo sapiens
cacacaattatgtgtgcacaat

SEQ ID NO: 8762587 - DNA, 22 bp, Homo sapiens
cacacacagttttgtattctgt

SEQ ID NO: 8762588 - DNA, 22 bp, Homo sapiens
cacacaaatattctggaggcaa

SEQ ID NO: 8762589 - DNA, 22 bp, Homo sapiens
agcagctgctccacttgcttaa

SEQ ID NO: 8762590 - DNA, 22 bp, Homo sapiens
agcagctgctccacttgcttaa

SEQ ID NO: 8762591 - DNA, 22 bp, Homo sapiens
cacaattttcctttaagtgtat

SEQ ID NO: 8762592 - DNA, 22 bp, Homo sapiens
cacacaaatattctggaggcaa

SEQ ID NO: 8762593 - DNA, 22 bp, Homo sapiens
agcaggcactatgccaggatct

SEQ ID NO: 8762594 - DNA, 22 bp, Homo sapiens
agcaggcactatgccaggatct

SEQ ID NO: 8762595 - DNA, 22 bp, Homo sapiens
agcaggcagccatttggaaggc

SEQ ID NO: 8762596 - DNA, 22 bp, Homo sapiens
agcaggcagccatttggaaggc

SEQ ID NO: 8762597 - DNA, 22 bp, Homo sapiens
agcaggcagcatgggaccctcc

SEQ ID NO: 8762598 - DNA, 22 bp, Homo sapiens
agcaggcagcatgggaccctcc

SEQ ID NO: 8762599 - DNA, 22 bp, Homo sapiens
agcaggcagcatgggaccctcc

SEQ ID NO: 8762600 - DNA, 22 bp, Homo sapiens
agcaggcagcatgggaccctcc

SEQ ID NO: 8762601 - DNA, 22 bp, Homo sapiens
agcaggcacttcatagggttcc

SEQ ID NO: 8762602 - DNA, 22 bp, Homo sapiens
agcaggcacttcatagggttcc

SEQ ID NO: 8762603 - DNA, 22 bp, Homo sapiens
agcaggcaggaaggcagcactg

SEQ ID NO: 8762604 - DNA, 22 bp, Homo sapiens
agcaggcagctgggggagttga

SEQ ID NO: 8762605 - DNA, 22 bp, Homo sapiens
agcaggcagctgggggagttga

SEQ ID NO: 8762606 - DNA, 22 bp, Homo sapiens
agcaggcagctgggggagttga

SEQ ID NO: 8762607 - DNA, 22 bp, Homo sapiens
agcaggcagcctaggaagtgaa

SEQ ID NO: 8762608 - DNA, 22 bp, Homo sapiens
agcaggcagcctaggaagtgaa

SEQ ID NO: 8762609 - DNA, 22 bp, Homo sapiens
agcaggcagcctaggaagtgaa

SEQ ID NO: 8762610 - DNA, 22 bp, Homo sapiens
agcaggcagccatttggaaggc

SEQ ID NO: 8762611 - DNA, 22 bp, Homo sapiens
cacagtcctgccagagggcctt

SEQ ID NO: 8762612 - DNA, 22 bp, Homo sapiens
cacagtgttccagagcagtggt

SEQ ID NO: 8762613 - DNA, 22 bp, Homo sapiens
cacagtgttccagagcagtggt

SEQ ID NO: 8762614 - DNA, 22 bp, Homo sapiens
cacagttagaggtagagtccag

SEQ ID NO: 8762615 - DNA, 22 bp, Homo sapiens
cacagttaagggatgtcatgtt

SEQ ID NO: 8762616 - DNA, 22 bp, Homo sapiens
cacagttagctccagtcttagc

SEQ ID NO: 8762617 - DNA, 22 bp, Homo sapiens
cacagttagctccagtcttagc

SEQ ID NO: 8762618 - DNA, 22 bp, Homo sapiens
cacagttatatgttcacaagga

SEQ ID NO: 8762619 - DNA, 22 bp, Homo sapiens
agcaggcaggcccagcggctgg

SEQ ID NO: 8762620 - DNA, 22 bp, Homo sapiens
agcaggcaggaggctactaagg

SEQ ID NO: 8762621 - DNA, 22 bp, Homo sapiens
agcaggcaggaggctactaagg

SEQ ID NO: 8762622 - DNA, 22 bp, Homo sapiens
cacagtcctacagagatcagag

SEQ ID NO: 8762623 - DNA, 22 bp, Homo sapiens
agcaggcaggaatggtggaaca

SEQ ID NO: 8762624 - DNA, 22 bp, Homo sapiens
agcaggcaggaatggtggaaca

SEQ ID NO: 8762625 - DNA, 22 bp, Homo sapiens
agcaggcaggaatggtggaaca

SEQ ID NO: 8762626 - DNA, 22 bp, Homo sapiens
agcaggcaggaatggtggaaca

SEQ ID NO: 8762627 - DNA, 22 bp, Homo sapiens
agcaggcaggaaggcagcactg

SEQ ID NO: 8762628 - DNA, 22 bp, Homo sapiens
agcaggcaggaaggcagcactg

SEQ ID NO: 8762629 - DNA, 22 bp, Homo sapiens
agcaggcaggaaggcagcactg

SEQ ID NO: 8762630 - DNA, 22 bp, Homo sapiens
agcaggcaggaaggcagcactg

SEQ ID NO: 8762631 - DNA, 22 bp, Homo sapiens
agcaggcaggaaggcagcactg

SEQ ID NO: 8762632 - DNA, 22 bp, Homo sapiens
agcaggctgagcacccaggggg

SEQ ID NO: 8762633 - DNA, 22 bp, Homo sapiens
agcaggctgatgggcatgcttg

SEQ ID NO: 8762634 - DNA, 22 bp, Homo sapiens
agcaggctgatgggcatgcttg

SEQ ID NO: 8762635 - DNA, 22 bp, Homo sapiens
agcaggctgatgggcatgcttg

SEQ ID NO: 8762636 - DNA, 17 bp, Homo sapiens
agcaggctgcagaggcc

SEQ ID NO: 8762637 - DNA, 17 bp, Homo sapiens
agcaggctgcagaggcc

SEQ ID NO: 8762638 - DNA, 17 bp, Homo sapiens
agcaggctgcagaggcc

SEQ ID NO: 8762639 - DNA, 17 bp, Homo sapiens
agcaggctgcagaggcc

SEQ ID NO: 8762640 - DNA, 22 bp, Homo sapiens
agcaggctccaggctggccatc

SEQ ID NO: 8762641 - DNA, 22 bp, Homo sapiens
agcaggctccaggctggccatc

SEQ ID NO: 8762642 - DNA, 22 bp, Homo sapiens
agcaggctccaggctggccatc

SEQ ID NO: 8762643 - DNA, 22 bp, Homo sapiens
agcaggctccttccttctctgg

SEQ ID NO: 8762644 - DNA, 16 bp, Homo sapiens
cacagttatgggtgtg

SEQ ID NO: 8762645 - DNA, 22 bp, Homo sapiens
cacagttatgggaaacgtagtt

SEQ ID NO: 8762646 - DNA, 22 bp, Homo sapiens
cacagttatatgttcacaagga

SEQ ID NO: 8762647 - DNA, 22 bp, Homo sapiens
cacagttgttcatattttccca

SEQ ID NO: 8762648 - DNA, 22 bp, Homo sapiens
cacagtttcaataattattctt

SEQ ID NO: 8762649 - DNA, 22 bp, Homo sapiens
cacagtttctgaacactttgca

SEQ ID NO: 8762650 - DNA, 22 bp, Homo sapiens
cacagtttggttttgctgtaat

SEQ ID NO: 8762651 - DNA, 22 bp, Homo sapiens
cacagtttggtatagaagtgat

SEQ ID NO: 8762652 - DNA, 22 bp, Homo sapiens
cacagtttgggtctccggggca

SEQ ID NO: 8762653 - DNA, 22 bp, Homo sapiens
agcaggggcagggttttgtgct

SEQ ID NO: 8762654 - DNA, 22 bp, Homo sapiens
agcaggggcagggttttgtgct

SEQ ID NO: 8762655 - DNA, 22 bp, Homo sapiens
agcagggctttgtctctgtgaa

SEQ ID NO: 8762656 - DNA, 22 bp, Homo sapiens
agcaggggctcctccacagcca

SEQ ID NO: 8762657 - DNA, 22 bp, Homo sapiens
agcaggggctcctccacagcca

SEQ ID NO: 8762658 - DNA, 22 bp, Homo sapiens
agcaggggctcctccacagcca

SEQ ID NO: 8762659 - DNA, 22 bp, Homo sapiens
agcaggggctcctccacagcca

SEQ ID NO: 8762660 - DNA, 20 bp, Homo sapiens
agcaggctgcagggtgaaat

SEQ ID NO: 8762661 - DNA, 22 bp, Homo sapiens
agcaggctgctggcgttgaagt

SEQ ID NO: 8762662 - DNA, 22 bp, Homo sapiens
agcaggctgccttccaaagcct

SEQ ID NO: 8762663 - DNA, 22 bp, Homo sapiens
agcagggctggggcacgagcca

SEQ ID NO: 8762664 - DNA, 22 bp, Homo sapiens
agcagggctggggcacgagcca

SEQ ID NO: 8762665 - DNA, 23 bp, Homo sapiens
agcaggctgcttctccacagctg

SEQ ID NO: 8762666 - DNA, 23 bp, Homo sapiens
agcaggctgcttctccacagctg

SEQ ID NO: 8762667 - DNA, 22 bp, Homo sapiens
agcagggctggggcacgagcca

SEQ ID NO: 8762668 - DNA, 23 bp, Homo sapiens
agcaggctgcttctccacagctg

SEQ ID NO: 8762669 - DNA, 22 bp, Homo sapiens
agcagggggcatccttgccctt

SEQ ID NO: 8762670 - DNA, 22 bp, Homo sapiens
agcagggggcatccttgccctt

SEQ ID NO: 8762671 - DNA, 22 bp, Homo sapiens
agcagggggagttagactagat

SEQ ID NO: 8762672 - DNA, 22 bp, Homo sapiens
agcaggggctcctccacagcca

SEQ ID NO: 8762673 - DNA, 22 bp, Homo sapiens
agcagggggagttagactagat

SEQ ID NO: 8762674 - DNA, 22 bp, Homo sapiens
agcaggggctcctccacagcca

SEQ ID NO: 8762675 - DNA, 22 bp, Homo sapiens
agcagggggcatccttgccctt

SEQ ID NO: 8762676 - DNA, 22 bp, Homo sapiens
agcagggggccacagtcacagc

SEQ ID NO: 8762677 - DNA, 22 bp, Homo sapiens
agcaggggtaacagaaggaaag

SEQ ID NO: 8762678 - DNA, 22 bp, Homo sapiens
agcaggggtggaaggtagcttt

SEQ ID NO: 8762679 - DNA, 22 bp, Homo sapiens
agcaggggtggaaggtagcttt

SEQ ID NO: 8762680 - DNA, 22 bp, Homo sapiens
agcaggggtctctgctaatgaa

SEQ ID NO: 8762681 - DNA, 22 bp, Homo sapiens
agcaggggtctctgctaatgaa

SEQ ID NO: 8762682 - DNA, 22 bp, Homo sapiens
agcaggggtctctgctaatgaa

SEQ ID NO: 8762683 - DNA, 22 bp, Homo sapiens
agcaggggtggaaggtagcttt

SEQ ID NO: 8762684 - DNA, 22 bp, Homo sapiens
agcagggtgtggtggccctgga

SEQ ID NO: 8762685 - DNA, 22 bp, Homo sapiens
cacccaggctggagagcagtgg

SEQ ID NO: 8762686 - DNA, 22 bp, Homo sapiens
cacccaggctggagtgcagggg

SEQ ID NO: 8762687 - DNA, 22 bp, Homo sapiens
cacccaggctggagagcagtgg

SEQ ID NO: 8762688 - DNA, 22 bp, Homo sapiens
caccaggtggaaatgtcacagc

SEQ ID NO: 8762689 - DNA, 22 bp, Homo sapiens
cacccaggctggaatgcagtgg

SEQ ID NO: 8762690 - DNA, 22 bp, Homo sapiens
caccaggtggaaatgtcacagc

SEQ ID NO: 8762691 - DNA, 22 bp, Homo sapiens
cacccaggctggagtgcagtgg

SEQ ID NO: 8762692 - DNA, 22 bp, Homo sapiens
cacccaggctggagtgcagtga

SEQ ID NO: 8762693 - DNA, 22 bp, Homo sapiens
cacccaggctggagtgcagtga

SEQ ID NO: 8762694 - DNA, 22 bp, Homo sapiens
cacccaggctggagtgcagtga

SEQ ID NO: 8762695 - DNA, 22 bp, Homo sapiens
cacccaggctggagtgcagtga

SEQ ID NO: 8762696 - DNA, 22 bp, Homo sapiens
cacccaggctggagtgcagtga

SEQ ID NO: 8762697 - DNA, 22 bp, Homo sapiens
cacccaggctggagtgcagggg

SEQ ID NO: 8762698 - DNA, 22 bp, Homo sapiens
cacccaggctggagtgcagggg

SEQ ID NO: 8762699 - DNA, 22 bp, Homo sapiens
cacccaggctggagagcagtgg

SEQ ID NO: 8762700 - DNA, 22 bp, Homo sapiens
cactgcacttcagcctgggtga

SEQ ID NO: 8762701 - DNA, 22 bp, Homo sapiens
cactgcctgtgagctgtgtgcc

SEQ ID NO: 8762702 - DNA, 22 bp, Homo sapiens
cactgcctgtgagctgtgtgcc

SEQ ID NO: 8762703 - DNA, 22 bp, Homo sapiens
cacctcatgtcatcagtaaaat

SEQ ID NO: 8762704 - DNA, 22 bp, Homo sapiens
cacctctgcctcaagcttccca

SEQ ID NO: 8762705 - DNA, 22 bp, Homo sapiens
cacctctgctgtccacaggatg

SEQ ID NO: 8762706 - DNA, 22 bp, Homo sapiens
cacctctgctgtccacaggatg

SEQ ID NO: 8762707 - DNA, 22 bp, Homo sapiens
cacctctttgatttgaggcaag

SEQ ID NO: 8762708 - DNA, 22 bp, Homo sapiens
cacctctgctgtccacaggatg

SEQ ID NO: 8762709 - DNA, 22 bp, Homo sapiens
cacctctgctgtccacaggatg

SEQ ID NO: 8762710 - DNA, 22 bp, Homo sapiens
cacctctttgatttgaggcaag

SEQ ID NO: 8762711 - DNA, 22 bp, Homo sapiens
cacctagggtttcgcctttctt

SEQ ID NO: 8762712 - DNA, 22 bp, Homo sapiens
cacctagggtttcgcctttctt

SEQ ID NO: 8762713 - DNA, 22 bp, Homo sapiens
cacctagggtttcgcctttctt

SEQ ID NO: 8762714 - DNA, 22 bp, Homo sapiens
cacctagggcatccctgcccca

SEQ ID NO: 8762715 - DNA, 22 bp, Homo sapiens
caccctgtcagttgcaggatag

SEQ ID NO: 8762716 - DNA, 22 bp, Homo sapiens
cacccttcagctttcttagctc

SEQ ID NO: 8762717 - DNA, 22 bp, Homo sapiens
caccctttgctgctcttcctcc

SEQ ID NO: 8762718 - DNA, 22 bp, Homo sapiens
caccgaggctggagtgcagtgg

SEQ ID NO: 8762719 - DNA, 22 bp, Homo sapiens
caccgagtgacagtagccatca

SEQ ID NO: 8762720 - DNA, 22 bp, Homo sapiens
cacccaggctggagtgcagtgg

SEQ ID NO: 8762721 - DNA, 22 bp, Homo sapiens
cacccaggctggagtgcagtgg

SEQ ID NO: 8762722 - DNA, 22 bp, Homo sapiens
cacccaggctggagtgcattgg

SEQ ID NO: 8762723 - DNA, 22 bp, Homo sapiens
cacccaggctggagtgcagtgg

SEQ ID NO: 8762724 - DNA, 22 bp, Homo sapiens
cacccaggctggagtgcagtgg

SEQ ID NO: 8762725 - DNA, 22 bp, Homo sapiens
cacccaggctggagtgcattgg

SEQ ID NO: 8762726 - DNA, 22 bp, Homo sapiens
cacccagggctgtgcctgccca

SEQ ID NO: 8762727 - DNA, 22 bp, Homo sapiens
cacccagggctgtgcctgccca

SEQ ID NO: 8762728 - DNA, 22 bp, Homo sapiens
caccctgtacaaatggacatct

SEQ ID NO: 8762729 - DNA, 22 bp, Homo sapiens
caccctgtcagttgcaggatag

SEQ ID NO: 8762730 - DNA, 22 bp, Homo sapiens
agcatacagtaggtgctcagtt

SEQ ID NO: 8762731 - DNA, 20 bp, Homo sapiens
agcatacatcataagaaacc

SEQ ID NO: 8762732 - DNA, 22 bp, Homo sapiens
agcatacttgacacttctctat

SEQ ID NO: 8762733 - DNA, 22 bp, Homo sapiens
agcatagagcaggaagttaaga

SEQ ID NO: 8762734 - DNA, 22 bp, Homo sapiens
agcatacaccctaaactgctta

SEQ ID NO: 8762735 - DNA, 22 bp, Homo sapiens
cactgcttgcagtatgagtgga

SEQ ID NO: 8762736 - DNA, 22 bp, Homo sapiens
cactgcttatgtctccttttca

SEQ ID NO: 8762737 - DNA, 23 bp, Homo sapiens
cactgccttcagttgcttcacct

SEQ ID NO: 8762738 - DNA, 22 bp, Homo sapiens
cactgccttcacctgccctatc

SEQ ID NO: 8762739 - DNA, 23 bp, Homo sapiens
cactgccttcagttgcttcacct

SEQ ID NO: 8762740 - DNA, 22 bp, Homo sapiens
cactgcttatgtctccttttca

SEQ ID NO: 8762741 - DNA, 22 bp, Homo sapiens
cactgctgtttttaccacactg

SEQ ID NO: 8762742 - DNA, 22 bp, Homo sapiens
cactgcttcagtcagagaaatt

SEQ ID NO: 8762743 - DNA, 22 bp, Homo sapiens
cactgcttataaattctaggca

SEQ ID NO: 8762744 - DNA, 22 bp, Homo sapiens
cactgcttagatcttccttcaa

SEQ ID NO: 8762745 - DNA, 22 bp, Homo sapiens
cactgcttagatcttccttcaa

SEQ ID NO: 8762746 - DNA, 22 bp, Homo sapiens
cactgctgatttcataggcagg

SEQ ID NO: 8762747 - DNA, 22 bp, Homo sapiens
agcagcaggctagggaactgct

SEQ ID NO: 8762748 - DNA, 22 bp, Homo sapiens
agcagcaggctagggaactgct

SEQ ID NO: 8762749 - DNA, 22 bp, Homo sapiens
agcagcaggattttcgttggga

SEQ ID NO: 8762750 - DNA, 23 bp, Homo sapiens
agcagcaggaggtattgataagg

SEQ ID NO: 8762751 - DNA, 22 bp, Homo sapiens
agcagcaggctgggatgagtct

SEQ ID NO: 8762752 - DNA, 22 bp, Homo sapiens
agcagcaggctgggatgagtct

SEQ ID NO: 8762753 - DNA, 22 bp, Homo sapiens
agcagcaggctagggaactgct

SEQ ID NO: 8762754 - DNA, 22 bp, Homo sapiens
agcagcaggctgggatgagtct

SEQ ID NO: 8762755 - DNA, 22 bp, Homo sapiens
agcagcaggctgggatgagtct

SEQ ID NO: 8762756 - DNA, 22 bp, Homo sapiens
agcagcaggctgtgtggactga

SEQ ID NO: 8762757 - DNA, 22 bp, Homo sapiens
agcagcaggctgtgtggactga

SEQ ID NO: 8762758 - DNA, 22 bp, Homo sapiens
agcagcaggctgtgtggactga

SEQ ID NO: 8762759 - DNA, 20 bp, Homo sapiens
agcagcagatgttggaggtg

SEQ ID NO: 8762760 - DNA, 22 bp, Homo sapiens
caagcagagactagatagctgt

SEQ ID NO: 8762761 - DNA, 22 bp, Homo sapiens
agcagcagctctgttgccctac

SEQ ID NO: 8762762 - DNA, 20 bp, Homo sapiens
agcagcagatgttggaggtg

SEQ ID NO: 8762763 - DNA, 20 bp, Homo sapiens
agcagcagatgttggaggtg

SEQ ID NO: 8762764 - DNA, 22 bp, Homo sapiens
agcagcaggaggctgtccacca

SEQ ID NO: 8762765 - DNA, 22 bp, Homo sapiens
agcagcaggagccgtggggtga

SEQ ID NO: 8762766 - DNA, 22 bp, Homo sapiens
agcagcaggaggccattgtctt

SEQ ID NO: 8762767 - DNA, 22 bp, Homo sapiens
agcagcaggagccgtggggtga

SEQ ID NO: 8762768 - DNA, 22 bp, Homo sapiens
caagcagagaagtctctaggct

SEQ ID NO: 8762769 - DNA, 22 bp, Homo sapiens
caagcaatgctatactcattat

SEQ ID NO: 8762770 - DNA, 22 bp, Homo sapiens
caagcaatgctatactcattat

SEQ ID NO: 8762771 - DNA, 22 bp, Homo sapiens
caagcaacgactttcaagctgt

SEQ ID NO: 8762772 - DNA, 22 bp, Homo sapiens
caagcactgtggcactcgcagg

SEQ ID NO: 8762773 - DNA, 22 bp, Homo sapiens
caagcagaaatctagaactcca

SEQ ID NO: 8762774 - DNA, 22 bp, Homo sapiens
caagattttatctccgtttctg

SEQ ID NO: 8762775 - DNA, 22 bp, Homo sapiens
caagatttggcaactttgtcat

SEQ ID NO: 8762776 - DNA, 22 bp, Homo sapiens
caagagatacatttctagtagg

SEQ ID NO: 8762777 - DNA, 22 bp, Homo sapiens
caagagcaggtgctgcttccat

SEQ ID NO: 8762778 - DNA, 22 bp, Homo sapiens
caagagacttatgtggaaacct

SEQ ID NO: 8762779 - DNA, 17 bp, Homo sapiens
caagagagatgactgga

SEQ ID NO: 8762780 - DNA, 22 bp, Homo sapiens
caagatttagctcccttatctc

SEQ ID NO: 8762781 - DNA, 22 bp, Homo sapiens
caagagcatccctgcatccagc

SEQ ID NO: 8762782 - DNA, 22 bp, Homo sapiens
caagagcatttagttagctggt

SEQ ID NO: 8762783 - DNA, 22 bp, Homo sapiens
caagagctaccctgtgccatat

SEQ ID NO: 8762784 - DNA, 22 bp, Homo sapiens
cacaaggccctgggtcaccaca

SEQ ID NO: 8762785 - DNA, 22 bp, Homo sapiens
cacaaggctttcatctggcata

SEQ ID NO: 8762786 - DNA, 22 bp, Homo sapiens
agcagccaaccttacattcatc

SEQ ID NO: 8762787 - DNA, 22 bp, Homo sapiens
agcagccaaggtaacctgtgct

SEQ ID NO: 8762788 - DNA, 22 bp, Homo sapiens
agcagccaaatgaagattttac

SEQ ID NO: 8762789 - DNA, 22 bp, Homo sapiens
cacaagatggtttccagatgct

SEQ ID NO: 8762790 - DNA, 22 bp, Homo sapiens
cacaagctccttatgtggagaa

SEQ ID NO: 8762791 - DNA, 22 bp, Homo sapiens
cacaagctgggcaagtgtatat

SEQ ID NO: 8762792 - DNA, 22 bp, Homo sapiens
cacaagatggtcacataagtgc

SEQ ID NO: 8762793 - DNA, 20 bp, Homo sapiens
cacaagaggagttccctgag

SEQ ID NO: 8762794 - DNA, 22 bp, Homo sapiens
cacaagatggtcacataagtgc

SEQ ID NO: 8762795 - DNA, 22 bp, Homo sapiens
cacaaggaggtcctgaggaagc

SEQ ID NO: 8762796 - DNA, 22 bp, Homo sapiens
cacaaggaggtcctgaggaagc

SEQ ID NO: 8762797 - DNA, 22 bp, Homo sapiens
cacaaggacatgtatatttatg

SEQ ID NO: 8762798 - DNA, 22 bp, Homo sapiens
cacaaggactggatggagtggg

SEQ ID NO: 8762799 - DNA, 22 bp, Homo sapiens
agcagccagaaagggcagtcga

SEQ ID NO: 8762800 - DNA, 22 bp, Homo sapiens
agcagccacccagctgctcatt

SEQ ID NO: 8762801 - DNA, 22 bp, Homo sapiens
agcagccacccagctgctcatt

SEQ ID NO: 8762802 - DNA, 22 bp, Homo sapiens
agcagccacccagctgctcatt

SEQ ID NO: 8762803 - DNA, 22 bp, Homo sapiens
agcagctccctcctcagccacc

SEQ ID NO: 8762804 - DNA, 22 bp, Homo sapiens
agcagctccctcctcagccacc

SEQ ID NO: 8762805 - DNA, 22 bp, Homo sapiens
agcagctccctcctcagccacc

SEQ ID NO: 8762806 - DNA, 22 bp, Homo sapiens
agcagctccctcctcagccacc

SEQ ID NO: 8762807 - DNA, 22 bp, Homo sapiens
agcagctcctctaggaacggat

SEQ ID NO: 8762808 - DNA, 22 bp, Homo sapiens
agcagctgagccccagctgtga

SEQ ID NO: 8762809 - DNA, 22 bp, Homo sapiens
agcagctcctctaggaacggat

SEQ ID NO: 8762810 - DNA, 22 bp, Homo sapiens
agcagccacagcagatctgagt

SEQ ID NO: 8762811 - DNA, 22 bp, Homo sapiens
agcagccaattggaggatgaag

SEQ ID NO: 8762812 - DNA, 22 bp, Homo sapiens
agcagccaaggtaacctgtgct

SEQ ID NO: 8762813 - DNA, 22 bp, Homo sapiens
agcagccaattggaggatgaag

SEQ ID NO: 8762814 - DNA, 22 bp, Homo sapiens
agcagccaattggaggatgaag

SEQ ID NO: 8762815 - DNA, 22 bp, Homo sapiens
agcagccacagtctgggacagg

SEQ ID NO: 8762816 - DNA, 22 bp, Homo sapiens
cacaagacttatttgtgtagaa

SEQ ID NO: 8762817 - DNA, 22 bp, Homo sapiens
cacaagacttatttgtgtagaa

SEQ ID NO: 8762818 - DNA, 20 bp, Homo sapiens
cacaagagaatacacactgg

SEQ ID NO: 8762819 - DNA, 22 bp, Homo sapiens
cacaagagagtgcgcgttgcaa

SEQ ID NO: 8762820 - DNA, 20 bp, Homo sapiens
cacaagagaatacacactgg

SEQ ID NO: 8762821 - DNA, 21 bp, Homo sapiens
cacaagacacatagggtgttt

SEQ ID NO: 8762822 - DNA, 21 bp, Homo sapiens
cacaagacacatagggtgttt

SEQ ID NO: 8762823 - DNA, 22 bp, Homo sapiens
cacaagaaataagctgcctttc

SEQ ID NO: 8762824 - DNA, 22 bp, Homo sapiens
cacaactttccttgactgtaag

SEQ ID NO: 8762825 - DNA, 22 bp, Homo sapiens
caattttttccatgctcttaca

SEQ ID NO: 8762826 - DNA, 22 bp, Homo sapiens
caattttttccatgctcttaca

SEQ ID NO: 8762827 - DNA, 22 bp, Homo sapiens
agcagcagggtgatagtgccca

SEQ ID NO: 8762828 - DNA, 22 bp, Homo sapiens
agcagcagggtcattgctcttt

SEQ ID NO: 8762829 - DNA, 22 bp, Homo sapiens
agcagcagggctctgcccgtgc

SEQ ID NO: 8762830 - DNA, 22 bp, Homo sapiens
agcagcagggcatgtcttactc

SEQ ID NO: 8762831 - DNA, 22 bp, Homo sapiens
agcagcagggacaaaggaacag

SEQ ID NO: 8762832 - DNA, 22 bp, Homo sapiens
agcagcagggacaaaggaacag

SEQ ID NO: 8762833 - DNA, 22 bp, Homo sapiens
agcagcagggacaaaggaacag

SEQ ID NO: 8762834 - DNA, 22 bp, Homo sapiens
agcagcagggacaaaggaacag

SEQ ID NO: 8762835 - DNA, 21 bp, Homo sapiens
agcagcagggaagcctcatcc

SEQ ID NO: 8762836 - DNA, 21 bp, Homo sapiens
agcagcagggaagcctcatcc

SEQ ID NO: 8762837 - DNA, 21 bp, Homo sapiens
agcagcagggaagcctcatcc

SEQ ID NO: 8762838 - DNA, 21 bp, Homo sapiens
agcagcagggaagcctcatcc

SEQ ID NO: 8762839 - DNA, 22 bp, Homo sapiens
agcagcagggacaaaggaacag

SEQ ID NO: 8762840 - DNA, 22 bp, Homo sapiens
agcagcaggcttaaggaaaagt

SEQ ID NO: 8762841 - DNA, 22 bp, Homo sapiens
agcagcaggcttaaggaaaagt

SEQ ID NO: 8762842 - DNA, 22 bp, Homo sapiens
agcagcaggcttaaggaaaagt

SEQ ID NO: 8762843 - DNA, 21 bp, Homo sapiens
agcacagctttaagccatgtg

SEQ ID NO: 8762844 - DNA, 21 bp, Homo sapiens
agcacagctttaagccatgtg

SEQ ID NO: 8762845 - DNA, 22 bp, Homo sapiens
agcacagcttcaccgagcccat

SEQ ID NO: 8762846 - DNA, 20 bp, Homo sapiens
agcaaagcctttagagtttg

SEQ ID NO: 8762847 - DNA, 22 bp, Homo sapiens
agcaaagctaccaattattgag

SEQ ID NO: 8762848 - DNA, 20 bp, Homo sapiens
agcaaagcctttagagtttg

SEQ ID NO: 8762849 - DNA, 22 bp, Homo sapiens
agcaaagccgagacagccagtg

SEQ ID NO: 8762850 - DNA, 22 bp, Homo sapiens
agcaaagcaccatatggcagtt

SEQ ID NO: 8762851 - DNA, 22 bp, Homo sapiens
agcaaagatgtccggggcaagc

SEQ ID NO: 8762852 - DNA, 18 bp, Homo sapiens
agcaaagcaagagatcac

SEQ ID NO: 8762853 - DNA, 22 bp, Homo sapiens
agcaaagccgagacagccagtg

SEQ ID NO: 8762854 - DNA, 22 bp, Homo sapiens
agcaaagccgagacagccagtg

SEQ ID NO: 8762855 - DNA, 22 bp, Homo sapiens
agcaaagcagtggctaagctga

SEQ ID NO: 8762856 - DNA, 22 bp, Homo sapiens
agcaaagcactttgcatacata

SEQ ID NO: 8762857 - DNA, 22 bp, Homo sapiens
agcaaagcactttgcatacata

SEQ ID NO: 8762858 - DNA, 22 bp, Homo sapiens
agcaaagaaatggaggctcaga

SEQ ID NO: 8762859 - DNA, 22 bp, Homo sapiens
agcaaagaagggttcttcatta

SEQ ID NO: 8762860 - DNA, 22 bp, Homo sapiens
agcaaagaagacacaggcttca

SEQ ID NO: 8762861 - DNA, 22 bp, Homo sapiens
agcaaagaagacacaggcttca

SEQ ID NO: 8762862 - DNA, 22 bp, Homo sapiens
agcaaagacagggacgaccaag

SEQ ID NO: 8762863 - DNA, 22 bp, Homo sapiens
agcaaagagtaattttgttttg

SEQ ID NO: 8762864 - DNA, 22 bp, Homo sapiens
agcaaagatgtccggggcaagc

SEQ ID NO: 8762865 - DNA, 22 bp, Homo sapiens
agcaaagacagggacgaccaag

SEQ ID NO: 8762866 - DNA, 22 bp, Homo sapiens
agcaaagaagggttcttcatta

SEQ ID NO: 8762867 - DNA, 22 bp, Homo sapiens
agcaaagaagggttcttcatta

SEQ ID NO: 8762868 - DNA, 22 bp, Homo sapiens
caaaagtcttcctattctctta

SEQ ID NO: 8762869 - DNA, 22 bp, Homo sapiens
caaaagtctgtcctttaacttc

SEQ ID NO: 8762870 - DNA, 23 bp, Homo sapiens
caaaagttagcccttcccatctc

SEQ ID NO: 8762871 - DNA, 22 bp, Homo sapiens
caaaagtcttcctattctctta

SEQ ID NO: 8762872 - DNA, 22 bp, Homo sapiens
caaaagttctcacccagacatg

SEQ ID NO: 8762873 - DNA, 22 bp, Homo sapiens
caaaataccacgacttgtttta

SEQ ID NO: 8762874 - DNA, 22 bp, Homo sapiens
caaaataccacgacttgtttta

SEQ ID NO: 8762875 - DNA, 22 bp, Homo sapiens
caaatagattgttcaatcctga

SEQ ID NO: 8762876 - DNA, 22 bp, Homo sapiens
caaatagattgttcaatcctga

SEQ ID NO: 8762877 - DNA, 22 bp, Homo sapiens
caaatagattgttcaatcctga

SEQ ID NO: 8762878 - DNA, 22 bp, Homo sapiens
caaatagacttcaatctcttga

SEQ ID NO: 8762879 - DNA, 22 bp, Homo sapiens
agcacatgcacagtgctacact

SEQ ID NO: 8762880 - DNA, 20 bp, Homo sapiens
agcacattaaacatactcct

SEQ ID NO: 8762881 - DNA, 22 bp, Homo sapiens
agcacatgcacagtgctacact

SEQ ID NO: 8762882 - DNA, 22 bp, Homo sapiens
agcacatgacttttagtcgagt

SEQ ID NO: 8762883 - DNA, 22 bp, Homo sapiens
agcacatattcagttcatacaa

SEQ ID NO: 8762884 - DNA, 22 bp, Homo sapiens
agcacagtaattgatattactg

SEQ ID NO: 8762885 - DNA, 22 bp, Homo sapiens
agcacagtgaatggtttactca

SEQ ID NO: 8762886 - DNA, 22 bp, Homo sapiens
agcacaggtgaaacagtcaggt

SEQ ID NO: 8762887 - DNA, 22 bp, Homo sapiens
agcacaggtgaaacagtcaggt

SEQ ID NO: 8762888 - DNA, 22 bp, Homo sapiens
agcacaggtgaaacagtcaggt

SEQ ID NO: 8762889 - DNA, 22 bp, Homo sapiens
agcacagtttcttttccttgtc

SEQ ID NO: 8762890 - DNA, 19 bp, Homo sapiens
agcacagtttccacatgca

SEQ ID NO: 8762891 - DNA, 20 bp, Homo sapiens
agcacataactctaccagaa

SEQ ID NO: 8762892 - DNA, 22 bp, Homo sapiens
agcacataccagaaccacaggt

SEQ ID NO: 8762893 - DNA, 22 bp, Homo sapiens
agcacagtggcttctatgtcta

SEQ ID NO: 8762894 - DNA, 22 bp, Homo sapiens
agcacagttctttctctagctg

SEQ ID NO: 8762895 - DNA, 22 bp, Homo sapiens
agcacagttctttctctagctg

SEQ ID NO: 8762896 - DNA, 22 bp, Homo sapiens
caacagctgatctttgatgaag

SEQ ID NO: 8762897 - DNA, 22 bp, Homo sapiens
caacagaggagtggcctgatcc

SEQ ID NO: 8762898 - DNA, 22 bp, Homo sapiens
caacagagcagttgatcaggaa

SEQ ID NO: 8762899 - DNA, 22 bp, Homo sapiens
caacagagcagttgatcaggaa

SEQ ID NO: 8762900 - DNA, 22 bp, Homo sapiens
caacagagcagttgatcaggaa

SEQ ID NO: 8762901 - DNA, 22 bp, Homo sapiens
caacagagggaatggatctcat

SEQ ID NO: 8762902 - DNA, 22 bp, Homo sapiens
caacagagagaccagaaacagg

SEQ ID NO: 8762903 - DNA, 22 bp, Homo sapiens
caacagagggaatggatctcat

SEQ ID NO: 8762904 - DNA, 20 bp, Homo sapiens
caacagaggggtctggagta

SEQ ID NO: 8762905 - DNA, 20 bp, Homo sapiens
caacagaggggtctggagta

SEQ ID NO: 8762906 - DNA, 20 bp, Homo sapiens
caacagaggggtctggagta

SEQ ID NO: 8762907 - DNA, 22 bp, Homo sapiens
caacagagagaccagaaacagg

SEQ ID NO: 8762908 - DNA, 22 bp, Homo sapiens
caacagacctggattcaaaaac

SEQ ID NO: 8762909 - DNA, 22 bp, Homo sapiens
caacagacctggattcaaaaac

SEQ ID NO: 8762910 - DNA, 22 bp, Homo sapiens
caacagagagaccagaaacagg

SEQ ID NO: 8762911 - DNA, 22 bp, Homo sapiens
caacagacctggattcaaaaac

SEQ ID NO: 8762912 - DNA, 22 bp, Homo sapiens
caacagacctggattcaaaaac

SEQ ID NO: 8762913 - DNA, 22 bp, Homo sapiens
caacagaaggtgtactactgaa

SEQ ID NO: 8762914 - DNA, 22 bp, Homo sapiens
caacagaaggtgtactactgaa

SEQ ID NO: 8762915 - DNA, 22 bp, Homo sapiens
caacagacctggattcaaaaac

SEQ ID NO: 8762916 - DNA, 23 bp, Homo sapiens
caacactgccttcaggtgaagaa

SEQ ID NO: 8762917 - DNA, 20 bp, Homo sapiens
caacactgcccattgtttgc

SEQ ID NO: 8762918 - DNA, 20 bp, Homo sapiens
caacactgcccattgtttgc

SEQ ID NO: 8762919 - DNA, 23 bp, Homo sapiens
caacactgccttcaggtgaagaa

SEQ ID NO: 8762920 - DNA, 23 bp, Homo sapiens
caacactgccttcaggtgaagaa

SEQ ID NO: 8762921 - DNA, 22 bp, Homo sapiens
caacagaaatcaattttcccat

SEQ ID NO: 8762922 - DNA, 22 bp, Homo sapiens
caacagaaggaagcagggtcag

SEQ ID NO: 8762923 - DNA, 22 bp, Homo sapiens
caacagaaggaagcagggtcag

SEQ ID NO: 8762924 - DNA, 22 bp, Homo sapiens
caacagaaggtgtactactgaa

SEQ ID NO: 8762925 - DNA, 22 bp, Homo sapiens
caaatagtttttcatgtattat

SEQ ID NO: 8762926 - DNA, 22 bp, Homo sapiens
caaatagtgtcacattgtgagg

SEQ ID NO: 8762927 - DNA, 22 bp, Homo sapiens
caaatagtttttcatgtattat

SEQ ID NO: 8762928 - DNA, 22 bp, Homo sapiens
caaatattccaggtacatccct

SEQ ID NO: 8762929 - DNA, 22 bp, Homo sapiens
agcaccaggctgttggaagccc

SEQ ID NO: 8762930 - DNA, 22 bp, Homo sapiens
caacttggctctctggctatcc

SEQ ID NO: 8762931 - DNA, 22 bp, Homo sapiens
caactttaaatggctatgtctg

SEQ ID NO: 8762932 - DNA, 22 bp, Homo sapiens
caactttaaatggctatgtctg

SEQ ID NO: 8762933 - DNA, 22 bp, Homo sapiens
caactttaatttgggtgtcaga

SEQ ID NO: 8762934 - DNA, 22 bp, Homo sapiens
caactttagaccccaagtagct

SEQ ID NO: 8762935 - DNA, 22 bp, Homo sapiens
caagacctcaaaatgagagggg

SEQ ID NO: 8762936 - DNA, 22 bp, Homo sapiens
caagacctcaaaatgagagggg

SEQ ID NO: 8762937 - DNA, 22 bp, Homo sapiens
caagacttcaccgctctgtgct

SEQ ID NO: 8762938 - DNA, 22 bp, Homo sapiens
caagacttagagcatcttgaaa

SEQ ID NO: 8762939 - DNA, 22 bp, Homo sapiens
caagacatgcaattgccacttt

SEQ ID NO: 8762940 - DNA, 21 bp, Homo sapiens
caagacatatgagtactctgg

SEQ ID NO: 8762941 - DNA, 22 bp, Homo sapiens
caagacattgattttgtacaga

SEQ ID NO: 8762942 - DNA, 22 bp, Homo sapiens
agcacattttatttaagaaaat

SEQ ID NO: 8762943 - DNA, 22 bp, Homo sapiens
agcacatttaagtatgaaatat

SEQ ID NO: 8762944 - DNA, 22 bp, Homo sapiens
agcaccagctcaaggtgcacct

SEQ ID NO: 8762945 - DNA, 22 bp, Homo sapiens
agcaccaggatattgttggaga

SEQ ID NO: 8762946 - DNA, 23 bp, Homo sapiens
agcaccaggaacagtgtggtcct

SEQ ID NO: 8762947 - DNA, 22 bp, Homo sapiens
agcaccagagctatgggcctgc

SEQ ID NO: 8762948 - DNA, 22 bp, Homo sapiens
agcaccagcgtgggggccgttg

SEQ ID NO: 8762949 - DNA, 22 bp, Homo sapiens
atgtcaaatcagttttatcaga

SEQ ID NO: 8762950 - DNA, 22 bp, Homo sapiens
atgtcaaacacaacaccagtgg

SEQ ID NO: 8762951 - DNA, 22 bp, Homo sapiens
atgtcaaacacaacaccagtgg

SEQ ID NO: 8762952 - DNA, 22 bp, Homo sapiens
atgtcaaagcagactgagagcg

SEQ ID NO: 8762953 - DNA, 22 bp, Homo sapiens
atgtcaaagcagactgagagcg

SEQ ID NO: 8762954 - DNA, 22 bp, Homo sapiens
atgtattttaagatttgcctca

SEQ ID NO: 8762955 - DNA, 22 bp, Homo sapiens
atgtattttaagatttgcctca

SEQ ID NO: 8762956 - DNA, 22 bp, Homo sapiens
agagcctgggcagctcctctgg

SEQ ID NO: 8762957 - DNA, 22 bp, Homo sapiens
agagcctgggcagctcctctgg

SEQ ID NO: 8762958 - DNA, 22 bp, Homo sapiens
agagcctgggaatttgcatgtt

SEQ ID NO: 8762959 - DNA, 22 bp, Homo sapiens
agagcctgggaatttgcatgtt

SEQ ID NO: 8762960 - DNA, 22 bp, Homo sapiens
agagcctgggaatttgcatgtt

SEQ ID NO: 8762961 - DNA, 22 bp, Homo sapiens
agagcctgcagtggagaccttg

SEQ ID NO: 8762962 - DNA, 22 bp, Homo sapiens
atgtatttgcttgttatggatt

SEQ ID NO: 8762963 - DNA, 22 bp, Homo sapiens
atgtatttgcttgttatggatt

SEQ ID NO: 8762964 - DNA, 22 bp, Homo sapiens
atgtatttgaaatttgagacat

SEQ ID NO: 8762965 - DNA, 22 bp, Homo sapiens
agagccagcaactctagccctg

SEQ ID NO: 8762966 - DNA, 22 bp, Homo sapiens
agagccagcaactctagccctg

SEQ ID NO: 8762967 - DNA, 22 bp, Homo sapiens
agagccagcaactctagccctg

SEQ ID NO: 8762968 - DNA, 22 bp, Homo sapiens
agagccagatggagccgtgtgt

SEQ ID NO: 8762969 - DNA, 22 bp, Homo sapiens
agagcctgtgggagatgcagct

SEQ ID NO: 8762970 - DNA, 22 bp, Homo sapiens
agagcctgtgggagatgcagct

SEQ ID NO: 8762971 - DNA, 22 bp, Homo sapiens
agagcctgtgattgtcatcacc

SEQ ID NO: 8762972 - DNA, 22 bp, Homo sapiens
agagcctgttcggaggcgcccc

SEQ ID NO: 8762973 - DNA, 22 bp, Homo sapiens
agagcctgtgggagatgcagct

SEQ ID NO: 8762974 - DNA, 22 bp, Homo sapiens
agagcctgttcggaggcgcccc

SEQ ID NO: 8762975 - DNA, 22 bp, Homo sapiens
agagcctgttcggaggcgcccc

SEQ ID NO: 8762976 - DNA, 22 bp, Homo sapiens
atgtggcttttcctgggttcct

SEQ ID NO: 8762977 - DNA, 22 bp, Homo sapiens
agagcctgtctgcctttctacc

SEQ ID NO: 8762978 - DNA, 22 bp, Homo sapiens
agagcctgtgattgtcatcacc

SEQ ID NO: 8762979 - DNA, 22 bp, Homo sapiens
agagcctgtgattgtcatcacc

SEQ ID NO: 8762980 - DNA, 22 bp, Homo sapiens
agagcctgtgattgtcatcacc

SEQ ID NO: 8762981 - DNA, 22 bp, Homo sapiens
agagcctgtgggagatgcagct

SEQ ID NO: 8762982 - DNA, 22 bp, Homo sapiens
agagcctgtaacatctttctta

SEQ ID NO: 8762983 - DNA, 22 bp, Homo sapiens
agagcctgtaacatctttctta

SEQ ID NO: 8762984 - DNA, 22 bp, Homo sapiens
agagcctgtaacatctttctta

SEQ ID NO: 8762985 - DNA, 22 bp, Homo sapiens
agagcctggtctgagataggac

SEQ ID NO: 8762986 - DNA, 22 bp, Homo sapiens
agagcctggtctgagataggac

SEQ ID NO: 8762987 - DNA, 22 bp, Homo sapiens
agagcctggggattggcaaggg

SEQ ID NO: 8762988 - DNA, 22 bp, Homo sapiens
agagcctgtcaattgtaaagag

SEQ ID NO: 8762989 - DNA, 22 bp, Homo sapiens
agagcctgtcaattgtaaagag

SEQ ID NO: 8762990 - DNA, 22 bp, Homo sapiens
agagcctgtctgcctttctacc

SEQ ID NO: 8762991 - DNA, 22 bp, Homo sapiens
agagcctgtacttttctgtgaa

SEQ ID NO: 8762992 - DNA, 22 bp, Homo sapiens
agagcctgtacttttctgtgaa

SEQ ID NO: 8762993 - DNA, 22 bp, Homo sapiens
agagcctgtacttttctgtgaa

SEQ ID NO: 8762994 - DNA, 22 bp, Homo sapiens
atgtgggccgtgcgggtgtcct

SEQ ID NO: 8762995 - DNA, 22 bp, Homo sapiens
atgtgggccgtgcgggtgtcct

SEQ ID NO: 8762996 - DNA, 22 bp, Homo sapiens
atgtgggccgtgcgggtgtcct

SEQ ID NO: 8762997 - DNA, 22 bp, Homo sapiens
atgtgggccgtgcgggtgtcct

SEQ ID NO: 8762998 - DNA, 22 bp, Homo sapiens
atgtggcttttctaacccttcc

SEQ ID NO: 8762999 - DNA, 20 bp, Homo sapiens
atgtggctttttgacctgct

SEQ ID NO: 8763000 - DNA, 22 bp, Homo sapiens
atgtgggaaatacaagctaaaa

SEQ ID NO: 8763001 - DNA, 22 bp, Homo sapiens
atgtgggagatttcaggaggtg

SEQ ID NO: 8763002 - DNA, 22 bp, Homo sapiens
atgtgggaaatacaagctaaaa

SEQ ID NO: 8763003 - DNA, 22 bp, Homo sapiens
atgtggttgaagaattacatct

SEQ ID NO: 8763004 - DNA, 22 bp, Homo sapiens
atgtggttgaagaattacatct

SEQ ID NO: 8763005 - DNA, 22 bp, Homo sapiens
atgtgtaaaaggcatgttttat

SEQ ID NO: 8763006 - DNA, 22 bp, Homo sapiens
atgtggttttggattattcatg

SEQ ID NO: 8763007 - DNA, 22 bp, Homo sapiens
atgtggttttggattattcatg

SEQ ID NO: 8763008 - DNA, 22 bp, Homo sapiens
atgtgtacaaccaagcactaaa

SEQ ID NO: 8763009 - DNA, 22 bp, Homo sapiens
atgtgtaatgtggtattttaat

SEQ ID NO: 8763010 - DNA, 22 bp, Homo sapiens
atgtgtaaagttagatgtctga

SEQ ID NO: 8763011 - DNA, 22 bp, Homo sapiens
atgggtaaggctgaaggaaagt

SEQ ID NO: 8763012 - DNA, 22 bp, Homo sapiens
atgggtccctggccgccctcgg

SEQ ID NO: 8763013 - DNA, 22 bp, Homo sapiens
agagcagcctgtgatgatgcac

SEQ ID NO: 8763014 - DNA, 22 bp, Homo sapiens
atgggtggagggtgacacggat

SEQ ID NO: 8763015 - DNA, 22 bp, Homo sapiens
agagcatccatttttgtcacat

SEQ ID NO: 8763016 - DNA, 23 bp, Homo sapiens
agagcatcatctatggagtgagg

SEQ ID NO: 8763017 - DNA, 22 bp, Homo sapiens
agagccaaggcctcagtctcaa

SEQ ID NO: 8763018 - DNA, 22 bp, Homo sapiens
agagccaaggcctcagtctcaa

SEQ ID NO: 8763019 - DNA, 22 bp, Homo sapiens
agagcagtgctgaagagtaggg

SEQ ID NO: 8763020 - DNA, 22 bp, Homo sapiens
agagccaaggctgagagctatt

SEQ ID NO: 8763021 - DNA, 22 bp, Homo sapiens
agagccaaggcctcagtctcaa

SEQ ID NO: 8763022 - DNA, 22 bp, Homo sapiens
agagccacagtggataggagcc

SEQ ID NO: 8763023 - DNA, 22 bp, Homo sapiens
agagccacggcaggcctaggaa

SEQ ID NO: 8763024 - DNA, 19 bp, Homo sapiens
agagccagacagcatagga

SEQ ID NO: 8763025 - DNA, 22 bp, Homo sapiens
agagccactgggagacagagca

SEQ ID NO: 8763026 - DNA, 22 bp, Homo sapiens
agagccagaccattgccgtgca

SEQ ID NO: 8763027 - DNA, 22 bp, Homo sapiens
agagccagaccattgccgtgca

SEQ ID NO: 8763028 - DNA, 22 bp, Homo sapiens
agagccagaccattgccgtgca

SEQ ID NO: 8763029 - DNA, 22 bp, Homo sapiens
agagccagaccattgccgtgca

SEQ ID NO: 8763030 - DNA, 19 bp, Homo sapiens
agagccagacagcatagga

SEQ ID NO: 8763031 - DNA, 22 bp, Homo sapiens
atgggggcggctgaagcccagg

SEQ ID NO: 8763032 - DNA, 22 bp, Homo sapiens
atggggggatgaaggagtccaa

SEQ ID NO: 8763033 - DNA, 22 bp, Homo sapiens
atgggggcggctgaagcccagg

SEQ ID NO: 8763034 - DNA, 22 bp, Homo sapiens
agagatggccttaggtgggaat

SEQ ID NO: 8763035 - DNA, 22 bp, Homo sapiens
agagatggccttaggtgggaat

SEQ ID NO: 8763036 - DNA, 22 bp, Homo sapiens
agagatggagagcactggggct

SEQ ID NO: 8763037 - DNA, 22 bp, Homo sapiens
atgggggaaagtacgagcatgg

SEQ ID NO: 8763038 - DNA, 22 bp, Homo sapiens
agagatggcgtctcagagcctg

SEQ ID NO: 8763039 - DNA, 22 bp, Homo sapiens
atgggggcctgaacaggcaaaa

SEQ ID NO: 8763040 - DNA, 22 bp, Homo sapiens
agagatgaatcttgagactctg

SEQ ID NO: 8763041 - DNA, 22 bp, Homo sapiens
agagatgacatgagggacttaa

SEQ ID NO: 8763042 - DNA, 22 bp, Homo sapiens
agagatgaatcttgagactctg

SEQ ID NO: 8763043 - DNA, 22 bp, Homo sapiens
agagatgactgatggctgatta

SEQ ID NO: 8763044 - DNA, 22 bp, Homo sapiens
agagatgactgatggctgatta

SEQ ID NO: 8763045 - DNA, 22 bp, Homo sapiens
agagatgcagggtacatggaat

SEQ ID NO: 8763046 - DNA, 22 bp, Homo sapiens
agagatgctgcccgcagacgtg

SEQ ID NO: 8763047 - DNA, 22 bp, Homo sapiens
agagatgcattcagcatggatg

SEQ ID NO: 8763048 - DNA, 22 bp, Homo sapiens
agagatgcccttgaaaggatta

SEQ ID NO: 8763049 - DNA, 22 bp, Homo sapiens
agagatgcagggtacatggaat

SEQ ID NO: 8763050 - DNA, 22 bp, Homo sapiens
agagatgcattcagcatggatg

SEQ ID NO: 8763051 - DNA, 22 bp, Homo sapiens
agagatgctgtgggtagaggca

SEQ ID NO: 8763052 - DNA, 22 bp, Homo sapiens
agagatggagagcactggggct

SEQ ID NO: 8763053 - DNA, 22 bp, Homo sapiens
agagatgctgcccgcagacgtg

SEQ ID NO: 8763054 - DNA, 22 bp, Homo sapiens
agagatgctgcccgcagacgtg

SEQ ID NO: 8763055 - DNA, 22 bp, Homo sapiens
agacattttggaaagtattact

SEQ ID NO: 8763056 - DNA, 22 bp, Homo sapiens
agacattttggaaagtattact

SEQ ID NO: 8763057 - DNA, 22 bp, Homo sapiens
agacattttggaaagtattact

SEQ ID NO: 8763058 - DNA, 22 bp, Homo sapiens
agaccaaagaaaacacatctgg

SEQ ID NO: 8763059 - DNA, 22 bp, Homo sapiens
agaccacaggcatgcacagagc

SEQ ID NO: 8763060 - DNA, 22 bp, Homo sapiens
agaccacaggcatgcacagagc

SEQ ID NO: 8763061 - DNA, 22 bp, Homo sapiens
agaccactaaaactttctctat

SEQ ID NO: 8763062 - DNA, 22 bp, Homo sapiens
agaccacaggcatgcacagagc

SEQ ID NO: 8763063 - DNA, 22 bp, Homo sapiens
agacattttacattcttccatt

SEQ ID NO: 8763064 - DNA, 22 bp, Homo sapiens
agacattttagacataaaagat

SEQ ID NO: 8763065 - DNA, 22 bp, Homo sapiens
agacattttacattcttccatt

SEQ ID NO: 8763066 - DNA, 22 bp, Homo sapiens
agacattttagacataaaagat

SEQ ID NO: 8763067 - DNA, 22 bp, Homo sapiens
agacattttagacataaaagat

SEQ ID NO: 8763068 - DNA, 22 bp, Homo sapiens
agacattttcgttggagaggtt

SEQ ID NO: 8763069 - DNA, 22 bp, Homo sapiens
agaccagctgcctcccagggcc

SEQ ID NO: 8763070 - DNA, 18 bp, Homo sapiens
agaccagacaagaatggt

SEQ ID NO: 8763071 - DNA, 22 bp, Homo sapiens
agaccactggcctcctgcagac

SEQ ID NO: 8763072 - DNA, 22 bp, Homo sapiens
agaccagggtcccacagagtct

SEQ ID NO: 8763073 - DNA, 22 bp, Homo sapiens
agaccagggtcccacagagtct

SEQ ID NO: 8763074 - DNA, 22 bp, Homo sapiens
agaccaggggttgagtcctagc

SEQ ID NO: 8763075 - DNA, 22 bp, Homo sapiens
agaccaggggttgagtcctagc

SEQ ID NO: 8763076 - DNA, 22 bp, Homo sapiens
agaccatgacctgccactaagc

SEQ ID NO: 8763077 - DNA, 22 bp, Homo sapiens
agaccatgggctcctgggacat

SEQ ID NO: 8763078 - DNA, 22 bp, Homo sapiens
atggccagcccttcccgcagct

SEQ ID NO: 8763079 - DNA, 22 bp, Homo sapiens
atggccagctagcacttgcatt

SEQ ID NO: 8763080 - DNA, 22 bp, Homo sapiens
atggccagctcagagcactcag

SEQ ID NO: 8763081 - DNA, 22 bp, Homo sapiens
atggccagctcagagcactcag

SEQ ID NO: 8763082 - DNA, 22 bp, Homo sapiens
atggccagctcagagcactcag

SEQ ID NO: 8763083 - DNA, 22 bp, Homo sapiens
atggccagcaaggtagggcaat

SEQ ID NO: 8763084 - DNA, 22 bp, Homo sapiens
atggcagcctgtggacagtcaa

SEQ ID NO: 8763085 - DNA, 22 bp, Homo sapiens
atggcagcctgagcagaggaat

SEQ ID NO: 8763086 - DNA, 23 bp, Homo sapiens
agacccagagactggctctgctc

SEQ ID NO: 8763087 - DNA, 23 bp, Homo sapiens
agacccagagactggctctgctc

SEQ ID NO: 8763088 - DNA, 22 bp, Homo sapiens
agagaagagcaatgataaattt

SEQ ID NO: 8763089 - DNA, 22 bp, Homo sapiens
agagaagagcaatgataaattt

SEQ ID NO: 8763090 - DNA, 22 bp, Homo sapiens
agagaagagcaatgataaattt

SEQ ID NO: 8763091 - DNA, 21 bp, Homo sapiens
agagaagaggactttctcaca

SEQ ID NO: 8763092 - DNA, 21 bp, Homo sapiens
agagaagaggactttctcaca

SEQ ID NO: 8763093 - DNA, 22 bp, Homo sapiens
agagaagagcaatgataaattt

SEQ ID NO: 8763094 - DNA, 22 bp, Homo sapiens
agagaagacttacagccacagt

SEQ ID NO: 8763095 - DNA, 22 bp, Homo sapiens
atggccaggcacctctggctga

SEQ ID NO: 8763096 - DNA, 22 bp, Homo sapiens
atggctagcaccgcgttgctgg

SEQ ID NO: 8763097 - DNA, 22 bp, Homo sapiens
atggctagcaccgcgttgctgg

SEQ ID NO: 8763098 - DNA, 17 bp, Homo sapiens
atggctcacctgtgggc

SEQ ID NO: 8763099 - DNA, 17 bp, Homo sapiens
atggctcacctgtgggc

SEQ ID NO: 8763100 - DNA, 17 bp, Homo sapiens
atggctcacctgtgggc

SEQ ID NO: 8763101 - DNA, 17 bp, Homo sapiens
atggctcacctgtgggc

SEQ ID NO: 8763102 - DNA, 22 bp, Homo sapiens
atggccttggctgcagagacat

SEQ ID NO: 8763103 - DNA, 22 bp, Homo sapiens
atggctaaacctgaactggtct

SEQ ID NO: 8763104 - DNA, 20 bp, Homo sapiens
atggccttcctctctgtcca

SEQ ID NO: 8763105 - DNA, 22 bp, Homo sapiens
atggcctggggattcctgagca

SEQ ID NO: 8763106 - DNA, 22 bp, Homo sapiens
agagagttgtatgtttctaaaa

SEQ ID NO: 8763107 - DNA, 22 bp, Homo sapiens
agagagttgtaccacactcata

SEQ ID NO: 8763108 - DNA, 22 bp, Homo sapiens
agagatgaaaagtggagactgg

SEQ ID NO: 8763109 - DNA, 22 bp, Homo sapiens
agagatgaacataaaacaagga

SEQ ID NO: 8763110 - DNA, 22 bp, Homo sapiens
agagatgaacataaaacaagga

SEQ ID NO: 8763111 - DNA, 22 bp, Homo sapiens
agagagttgaggaagcaacact

SEQ ID NO: 8763112 - DNA, 22 bp, Homo sapiens
agagagttgaggaagcaacact

SEQ ID NO: 8763113 - DNA, 22 bp, Homo sapiens
agagagttgaggaagcaacact

SEQ ID NO: 8763114 - DNA, 22 bp, Homo sapiens
agagagttgtaccacactcata

SEQ ID NO: 8763115 - DNA, 22 bp, Homo sapiens
agagagttgtaccacactcata

SEQ ID NO: 8763116 - DNA, 22 bp, Homo sapiens
atggctcagcccatggaagaaa

SEQ ID NO: 8763117 - DNA, 22 bp, Homo sapiens
atggctcagcccatggaagaaa

SEQ ID NO: 8763118 - DNA, 22 bp, Homo sapiens
atggcctggggattcctgagca

SEQ ID NO: 8763119 - DNA, 22 bp, Homo sapiens
atggcctggccagagctctgct

SEQ ID NO: 8763120 - DNA, 22 bp, Homo sapiens
atggcctgggcccgcttcagat

SEQ ID NO: 8763121 - DNA, 22 bp, Homo sapiens
atggcctgggcccgcttcagat

SEQ ID NO: 8763122 - DNA, 20 bp, Homo sapiens
atggcctgctagaagtctgt

SEQ ID NO: 8763123 - DNA, 20 bp, Homo sapiens
atggcctgctagaagtctgt

SEQ ID NO: 8763124 - DNA, 22 bp, Homo sapiens
atggcctgcagtgctgccacag

SEQ ID NO: 8763125 - DNA, 22 bp, Homo sapiens
atggcctgcagtgctgccacag

SEQ ID NO: 8763126 - DNA, 22 bp, Homo sapiens
atggcctgatgcacctgtccca

SEQ ID NO: 8763127 - DNA, 22 bp, Homo sapiens
agagacctgagatcctcgacat

SEQ ID NO: 8763128 - DNA, 22 bp, Homo sapiens
agagaccttcctgactccagag

SEQ ID NO: 8763129 - DNA, 22 bp, Homo sapiens
agagacgcattcagaggcaggc

SEQ ID NO: 8763130 - DNA, 22 bp, Homo sapiens
agagactaagaagttttaactt

SEQ ID NO: 8763131 - DNA, 22 bp, Homo sapiens
agagaccttttgccttctagtt

SEQ ID NO: 8763132 - DNA, 22 bp, Homo sapiens
agagacctttgttattctagga

SEQ ID NO: 8763133 - DNA, 22 bp, Homo sapiens
agagacctttctcctgcctttc

SEQ ID NO: 8763134 - DNA, 23 bp, Homo sapiens
agagactataagttatgttctgt

SEQ ID NO: 8763135 - DNA, 22 bp, Homo sapiens
agagactaagccagcatagtgc

SEQ ID NO: 8763136 - DNA, 22 bp, Homo sapiens
atggcctctagctgagaccaat

SEQ ID NO: 8763137 - DNA, 22 bp, Homo sapiens
atggcctctagctgagaccaat

SEQ ID NO: 8763138 - DNA, 22 bp, Homo sapiens
atggcctgatgcacctgtccca

SEQ ID NO: 8763139 - DNA, 22 bp, Homo sapiens
agagacagaggcaatatagctt

SEQ ID NO: 8763140 - DNA, 22 bp, Homo sapiens
agagaagctgacaggggcgtgc

SEQ ID NO: 8763141 - DNA, 22 bp, Homo sapiens
agagaaggaaagctgacatggg

SEQ ID NO: 8763142 - DNA, 22 bp, Homo sapiens
agagaaggaaagctgacatggg

SEQ ID NO: 8763143 - DNA, 22 bp, Homo sapiens
agagaaggaaagctgacatggg

SEQ ID NO: 8763144 - DNA, 21 bp, Homo sapiens
agagacagagaaagtaacatt

SEQ ID NO: 8763145 - DNA, 22 bp, Homo sapiens
agagaagcagggagtcatctgt

SEQ ID NO: 8763146 - DNA, 22 bp, Homo sapiens
agagaagcattcttctcagggc

SEQ ID NO: 8763147 - DNA, 22 bp, Homo sapiens
agagacagggttttgtcgtgtt

SEQ ID NO: 8763148 - DNA, 22 bp, Homo sapiens
agagacagggttttgtcgtgtt

SEQ ID NO: 8763149 - DNA, 22 bp, Homo sapiens
agagacagggttttgtcgtgtt

SEQ ID NO: 8763150 - DNA, 22 bp, Homo sapiens
agagacatggagaggcaaagtt

SEQ ID NO: 8763151 - DNA, 22 bp, Homo sapiens
agagaccaagggaatagtctca

SEQ ID NO: 8763152 - DNA, 22 bp, Homo sapiens
agagacatgcagttgttgtgaa

SEQ ID NO: 8763153 - DNA, 22 bp, Homo sapiens
agagaccagaatccagctgcct

SEQ ID NO: 8763154 - DNA, 19 bp, Homo sapiens
agagaccacagagctgcct

SEQ ID NO: 8763155 - DNA, 22 bp, Homo sapiens
agagaccaagggaatagtctca

SEQ ID NO: 8763156 - DNA, 22 bp, Homo sapiens
agagaccaagggaatagtctca

SEQ ID NO: 8763157 - DNA, 19 bp, Homo sapiens
agagaccacagagctgcct

SEQ ID NO: 8763158 - DNA, 22 bp, Homo sapiens
agagaccagaatccagctgcct

SEQ ID NO: 8763159 - DNA, 21 bp, Homo sapiens
agagaccagctgttactccca

SEQ ID NO: 8763160 - DNA, 22 bp, Homo sapiens
agagaccagaatccagctgcct

SEQ ID NO: 8763161 - DNA, 22 bp, Homo sapiens
agagacccgcagcctcggagct

SEQ ID NO: 8763162 - DNA, 22 bp, Homo sapiens
agaaggctttaagtactggcat

SEQ ID NO: 8763163 - DNA, 22 bp, Homo sapiens
agaagtattctgcatgtactga

SEQ ID NO: 8763164 - DNA, 22 bp, Homo sapiens
agaaggctggccctgggtggcc

SEQ ID NO: 8763165 - DNA, 22 bp, Homo sapiens
agaaggcttaaaacatggaata

SEQ ID NO: 8763166 - DNA, 22 bp, Homo sapiens
agaaggcttaaaacatggaata

SEQ ID NO: 8763167 - DNA, 22 bp, Homo sapiens
agaaggcttaaaacatggaata

SEQ ID NO: 8763168 - DNA, 22 bp, Homo sapiens
agaaggctggccctgggtggcc

SEQ ID NO: 8763169 - DNA, 22 bp, Homo sapiens
agaagtatttggctaaaagaca

SEQ ID NO: 8763170 - DNA, 22 bp, Homo sapiens
atctcagagaaatttgaatgca

SEQ ID NO: 8763171 - DNA, 22 bp, Homo sapiens
atctcagatctacagatctaca

SEQ ID NO: 8763172 - DNA, 22 bp, Homo sapiens
atctcagaaacatatctaatcc

SEQ ID NO: 8763173 - DNA, 22 bp, Homo sapiens
atctcagaaagtttaatttttc

SEQ ID NO: 8763174 - DNA, 22 bp, Homo sapiens
atctcagaaggcatttccaaga

SEQ ID NO: 8763175 - DNA, 22 bp, Homo sapiens
agaagtgaggaaatcctcttta

SEQ ID NO: 8763176 - DNA, 22 bp, Homo sapiens
agaagtgagtgtgactcagcag

SEQ ID NO: 8763177 - DNA, 22 bp, Homo sapiens
agaagtgagtgtgactcagcag

SEQ ID NO: 8763178 - DNA, 22 bp, Homo sapiens
agaagtgagactcagttgatga

SEQ ID NO: 8763179 - DNA, 22 bp, Homo sapiens
agaagtgagactcagttgatga

SEQ ID NO: 8763180 - DNA, 22 bp, Homo sapiens
agaagtgagttgtgactatggg

SEQ ID NO: 8763181 - DNA, 22 bp, Homo sapiens
agaagtgagttgtgactatggg

SEQ ID NO: 8763182 - DNA, 22 bp, Homo sapiens
agaagtgaaactgcaaaagtgt

SEQ ID NO: 8763183 - DNA, 22 bp, Homo sapiens
agaagtctggttgcaaagcgct

SEQ ID NO: 8763184 - DNA, 22 bp, Homo sapiens
agaagtctggaattcctgcagg

SEQ ID NO: 8763185 - DNA, 22 bp, Homo sapiens
agaagtctggaattcctgcagg

SEQ ID NO: 8763186 - DNA, 21 bp, Homo sapiens
agaagtcaattgaactgaaat

SEQ ID NO: 8763187 - DNA, 22 bp, Homo sapiens
agaagtcaccctgttgctgtga

SEQ ID NO: 8763188 - DNA, 22 bp, Homo sapiens
agaagtcaccctgttgctgtga

SEQ ID NO: 8763189 - DNA, 22 bp, Homo sapiens
agaagtttgaaattaggagaaa

SEQ ID NO: 8763190 - DNA, 22 bp, Homo sapiens
agaagtttgaaattaggagaaa

SEQ ID NO: 8763191 - DNA, 22 bp, Homo sapiens
atctttgttatctcagatcttg

SEQ ID NO: 8763192 - DNA, 22 bp, Homo sapiens
atctttgttgctctcatttctg

SEQ ID NO: 8763193 - DNA, 22 bp, Homo sapiens
atgaaactaaactacataagtt

SEQ ID NO: 8763194 - DNA, 22 bp, Homo sapiens
atgaaactaaactacataagtt

SEQ ID NO: 8763195 - DNA, 22 bp, Homo sapiens
atgaaactaaactacataagtt

SEQ ID NO: 8763196 - DNA, 22 bp, Homo sapiens
atgaaacatgctttgtggatga

SEQ ID NO: 8763197 - DNA, 22 bp, Homo sapiens
atgaaactctaacttaacaagt

SEQ ID NO: 8763198 - DNA, 22 bp, Homo sapiens
atgaaactctaacttaacaagt

SEQ ID NO: 8763199 - DNA, 22 bp, Homo sapiens
atgaaactctagctttcagcac

SEQ ID NO: 8763200 - DNA, 22 bp, Homo sapiens
atgaaactctagctttcagcac

SEQ ID NO: 8763201 - DNA, 22 bp, Homo sapiens
agaagtggtctgtcttccagat

SEQ ID NO: 8763202 - DNA, 20 bp, Homo sapiens
agaagtggctgcagacacta

SEQ ID NO: 8763203 - DNA, 20 bp, Homo sapiens
agaagtggctgcagacacta

SEQ ID NO: 8763204 - DNA, 20 bp, Homo sapiens
agaagtggctgcagacacta

SEQ ID NO: 8763205 - DNA, 22 bp, Homo sapiens
agaagtgtcagtgcaggcagct

SEQ ID NO: 8763206 - DNA, 22 bp, Homo sapiens
agaagtgtttatttcagcaaca

SEQ ID NO: 8763207 - DNA, 22 bp, Homo sapiens
agaagtgtggtctagcagtggc

SEQ ID NO: 8763208 - DNA, 22 bp, Homo sapiens
agaagtgtctcatcaggcaata

SEQ ID NO: 8763209 - DNA, 22 bp, Homo sapiens
agaagttatccaccttagatgc

SEQ ID NO: 8763210 - DNA, 23 bp, Homo sapiens
agaagttcaagaccagcctgccc

SEQ ID NO: 8763211 - DNA, 22 bp, Homo sapiens
agaagtttccagtctagtaagg

SEQ ID NO: 8763212 - DNA, 22 bp, Homo sapiens
agaagttgtaggtttgcatatt

SEQ ID NO: 8763213 - DNA, 22 bp, Homo sapiens
agacaaaggattaatgatgatg

SEQ ID NO: 8763214 - DNA, 22 bp, Homo sapiens
agacaaaggattaatgatgatg

SEQ ID NO: 8763215 - DNA, 22 bp, Homo sapiens
agacaaaggattaatgatgatg

SEQ ID NO: 8763216 - DNA, 22 bp, Homo sapiens
agacaaataactttttatgtcc

SEQ ID NO: 8763217 - DNA, 22 bp, Homo sapiens
agacaaataactttttatgtcc

SEQ ID NO: 8763218 - DNA, 22 bp, Homo sapiens
agacaaataagtgctgggattt

SEQ ID NO: 8763219 - DNA, 22 bp, Homo sapiens
agacaaattgggacattgtgtt

SEQ ID NO: 8763220 - DNA, 22 bp, Homo sapiens
agacaaattgggacattgtgtt

SEQ ID NO: 8763221 - DNA, 22 bp, Homo sapiens
agacaaatggtaattatgtcta

SEQ ID NO: 8763222 - DNA, 22 bp, Homo sapiens
agacaaatggtaattatgtcta

SEQ ID NO: 8763223 - DNA, 22 bp, Homo sapiens
agacaaatggagtatgagcaac

SEQ ID NO: 8763224 - DNA, 22 bp, Homo sapiens
agacaaatggagtatgagcaac

SEQ ID NO: 8763225 - DNA, 22 bp, Homo sapiens
agacaaatggagtatgagcaac

SEQ ID NO: 8763226 - DNA, 22 bp, Homo sapiens
agacaaatggagtatgagcaac

SEQ ID NO: 8763227 - DNA, 22 bp, Homo sapiens
agacaaatggagtatgagcaac

SEQ ID NO: 8763228 - DNA, 22 bp, Homo sapiens
agacaaatgaacaaatatgtga

SEQ ID NO: 8763229 - DNA, 22 bp, Homo sapiens
agacaaaccttgttttatgatg

SEQ ID NO: 8763230 - DNA, 22 bp, Homo sapiens
agacaaaccttgttttatgatg

SEQ ID NO: 8763231 - DNA, 18 bp, Homo sapiens
agacaaacttcttctgcc

SEQ ID NO: 8763232 - DNA, 23 bp, Homo sapiens
agacaaacttccttcactgcacc

SEQ ID NO: 8763233 - DNA, 22 bp, Homo sapiens
agacaaagaaaccgtagaagca

SEQ ID NO: 8763234 - DNA, 22 bp, Homo sapiens
agacaaagacagcatctcaggt

SEQ ID NO: 8763235 - DNA, 22 bp, Homo sapiens
agacaaagacagcatctcaggt

SEQ ID NO: 8763236 - DNA, 22 bp, Homo sapiens
agacaaagacagcatctcaggt

SEQ ID NO: 8763237 - DNA, 22 bp, Homo sapiens
agacaaagacagcatctcaggt

SEQ ID NO: 8763238 - DNA, 22 bp, Homo sapiens
agacaaagacagcatctcaggt

SEQ ID NO: 8763239 - DNA, 22 bp, Homo sapiens
atgaacaatctggcaagaactt

SEQ ID NO: 8763240 - DNA, 22 bp, Homo sapiens
atgaacaaaaacaaggcctgtt

SEQ ID NO: 8763241 - DNA, 22 bp, Homo sapiens
agaattgctggaatttgcttta

SEQ ID NO: 8763242 - DNA, 22 bp, Homo sapiens
agaattcttggtggttagaata

SEQ ID NO: 8763243 - DNA, 22 bp, Homo sapiens
atgaacaatgactacatattga

SEQ ID NO: 8763244 - DNA, 20 bp, Homo sapiens
agaattcttaccctttgatg

SEQ ID NO: 8763245 - DNA, 22 bp, Homo sapiens
atgaaatttgaccaattattta

SEQ ID NO: 8763246 - DNA, 22 bp, Homo sapiens
atgaaattgatcttgaactttt

SEQ ID NO: 8763247 - DNA, 22 bp, Homo sapiens
atgaaattgatcttgaactttt

SEQ ID NO: 8763248 - DNA, 23 bp, Homo sapiens
atgaaagttcttaaaatgtcatg

SEQ ID NO: 8763249 - DNA, 22 bp, Homo sapiens
atgaaatttgctgctaagttcc

SEQ ID NO: 8763250 - DNA, 22 bp, Homo sapiens
atgaacaacttgaagctccatg

SEQ ID NO: 8763251 - DNA, 22 bp, Homo sapiens
atgaaatttgctgctaagttcc

SEQ ID NO: 8763252 - DNA, 22 bp, Homo sapiens
atgaaagtggcttgattaaatg

SEQ ID NO: 8763253 - DNA, 22 bp, Homo sapiens
atgaaagtggcttgattaaatg

SEQ ID NO: 8763254 - DNA, 22 bp, Homo sapiens
atgaaagtggcttgattaaatg

SEQ ID NO: 8763255 - DNA, 22 bp, Homo sapiens
atgaaagtacctgtaatatgtt

SEQ ID NO: 8763256 - DNA, 22 bp, Homo sapiens
atgaaagtacctgtaatatgtt

SEQ ID NO: 8763257 - DNA, 22 bp, Homo sapiens
atgaaagcaggaattgttctgt

SEQ ID NO: 8763258 - DNA, 22 bp, Homo sapiens
atgaaagctcagtgcactgaca

SEQ ID NO: 8763259 - DNA, 22 bp, Homo sapiens
atgaaagctcagtgcactgaca

SEQ ID NO: 8763260 - DNA, 22 bp, Homo sapiens
atgaaagtacctgtaatatgtt

SEQ ID NO: 8763261 - DNA, 22 bp, Homo sapiens
atgaaagcacgtgggaagataa

SEQ ID NO: 8763262 - DNA, 22 bp, Homo sapiens
atgaaagatgatttaaagtact

SEQ ID NO: 8763263 - DNA, 22 bp, Homo sapiens
atgaaagatgatttaaagtact

SEQ ID NO: 8763264 - DNA, 22 bp, Homo sapiens
atgaaagatgatttaaagtact

SEQ ID NO: 8763265 - DNA, 22 bp, Homo sapiens
atgaaagatgatttaaagtact

SEQ ID NO: 8763266 - DNA, 22 bp, Homo sapiens
atgaaactgggataactatagc

SEQ ID NO: 8763267 - DNA, 22 bp, Homo sapiens
atgcaacatccaattccttttg

SEQ ID NO: 8763268 - DNA, 22 bp, Homo sapiens
atgcaacatccaattccttttg

SEQ ID NO: 8763269 - DNA, 22 bp, Homo sapiens
atgcaacatacattctgaagct

SEQ ID NO: 8763270 - DNA, 22 bp, Homo sapiens
atgcaacatacattctgaagct

SEQ ID NO: 8763271 - DNA, 22 bp, Homo sapiens
atgacaagggttgacacatgtc

SEQ ID NO: 8763272 - DNA, 22 bp, Homo sapiens
atgacaagggttgacacatgtc

SEQ ID NO: 8763273 - DNA, 22 bp, Homo sapiens
atgacaagagtgttcagggaga

SEQ ID NO: 8763274 - DNA, 22 bp, Homo sapiens
atgacaagggagggtcctgcta

SEQ ID NO: 8763275 - DNA, 22 bp, Homo sapiens
atgacaaattcagaccatagca

SEQ ID NO: 8763276 - DNA, 22 bp, Homo sapiens
atgcacataggccaaatcattt

SEQ ID NO: 8763277 - DNA, 22 bp, Homo sapiens
atgcacatcactctgaagaaaa

SEQ ID NO: 8763278 - DNA, 20 bp, Homo sapiens
atgcacatacgcatgcacat

SEQ ID NO: 8763279 - DNA, 22 bp, Homo sapiens
atgcaagaaacagagacgctga

SEQ ID NO: 8763280 - DNA, 19 bp, Homo sapiens
atgcacagtcatttgtaag

SEQ ID NO: 8763281 - DNA, 23 bp, Homo sapiens
atgcaacattgccagtatgggca

SEQ ID NO: 8763282 - DNA, 23 bp, Homo sapiens
atgcaacattgccagtatgggca

SEQ ID NO: 8763283 - DNA, 22 bp, Homo sapiens
atgcaactacttctgcaccaat

SEQ ID NO: 8763284 - DNA, 22 bp, Homo sapiens
atgacaaaatgaatgcagctag

SEQ ID NO: 8763285 - DNA, 22 bp, Homo sapiens
atgacaaaatgaatgcagctag

SEQ ID NO: 8763286 - DNA, 22 bp, Homo sapiens
atgacaaaagaagacatgaggt

SEQ ID NO: 8763287 - DNA, 22 bp, Homo sapiens
atgacaaaagaagacatgaggt

SEQ ID NO: 8763288 - DNA, 22 bp, Homo sapiens
atgacaaacccaggatgtaaca

SEQ ID NO: 8763289 - DNA, 22 bp, Homo sapiens
atgacaaaggctgaaagggaaa

SEQ ID NO: 8763290 - DNA, 22 bp, Homo sapiens
atgacaaattcagaccatagca

SEQ ID NO: 8763291 - DNA, 23 bp, Homo sapiens
atgacaaacaggacatcttgtgc

SEQ ID NO: 8763292 - DNA, 23 bp, Homo sapiens
atgacaaacaggacatcttgtgc

SEQ ID NO: 8763293 - DNA, 23 bp, Homo sapiens
atgacaaacaggacatcttgtgc

SEQ ID NO: 8763294 - DNA, 22 bp, Homo sapiens
atgacaaacccaggatgtaaca

SEQ ID NO: 8763295 - DNA, 17 bp, Homo sapiens
agacagacctctgcatc

SEQ ID NO: 8763296 - DNA, 17 bp, Homo sapiens
agacagacctctgcatc

SEQ ID NO: 8763297 - DNA, 22 bp, Homo sapiens
agacagaccatggctattcaga

SEQ ID NO: 8763298 - DNA, 22 bp, Homo sapiens
agacagacattctagagccacc

SEQ ID NO: 8763299 - DNA, 22 bp, Homo sapiens
agacagacgtagtgtgagagta

SEQ ID NO: 8763300 - DNA, 22 bp, Homo sapiens
agacagacgtagtgtgagagta

SEQ ID NO: 8763301 - DNA, 22 bp, Homo sapiens
agacagacggctttatacacag

SEQ ID NO: 8763302 - DNA, 22 bp, Homo sapiens
agacagacggctttatacacag

SEQ ID NO: 8763303 - DNA, 21 bp, Homo sapiens
agacagactgcctgacccacg

SEQ ID NO: 8763304 - DNA, 22 bp, Homo sapiens
agacagacatagaaattagtaa

SEQ ID NO: 8763305 - DNA, 22 bp, Homo sapiens
atgcactgtgagagtgaggggt

SEQ ID NO: 8763306 - DNA, 22 bp, Homo sapiens
agacagacattctagagccacc

SEQ ID NO: 8763307 - DNA, 22 bp, Homo sapiens
agacagacatgctagttttctt

SEQ ID NO: 8763308 - DNA, 22 bp, Homo sapiens
agacagaccatggctattcaga

SEQ ID NO: 8763309 - DNA, 22 bp, Homo sapiens
atgcacatcttacagatgcaga

SEQ ID NO: 8763310 - DNA, 22 bp, Homo sapiens
atgcacataggccaaatcattt

SEQ ID NO: 8763311 - DNA, 17 bp, Homo sapiens
atgcacatgtaagagga

SEQ ID NO: 8763312 - DNA, 22 bp, Homo sapiens
atgcacatgtatgtcaatattt

SEQ ID NO: 8763313 - DNA, 22 bp, Homo sapiens
atgcacattgtagccacacaat

SEQ ID NO: 8763314 - DNA, 22 bp, Homo sapiens
atgcacattgtagccacacaat

SEQ ID NO: 8763315 - DNA, 22 bp, Homo sapiens
atgcacctgaactccatcagct

SEQ ID NO: 8763316 - DNA, 22 bp, Homo sapiens
agacagcagaaactagagcact

SEQ ID NO: 8763317 - DNA, 22 bp, Homo sapiens
agacagcagaaactagagcact

SEQ ID NO: 8763318 - DNA, 22 bp, Homo sapiens
agacagcagaaactagagcact

SEQ ID NO: 8763319 - DNA, 22 bp, Homo sapiens
agacagacttgaaaatgttctt

SEQ ID NO: 8763320 - DNA, 22 bp, Homo sapiens
agacagactggtttgaattggt

SEQ ID NO: 8763321 - DNA, 21 bp, Homo sapiens
agacagactgcctgacccacg

SEQ ID NO: 8763322 - DNA, 22 bp, Homo sapiens
agacagcagcagaggggctccc

SEQ ID NO: 8763323 - DNA, 22 bp, Homo sapiens
agacagcagcagaggggctccc

SEQ ID NO: 8763324 - DNA, 21 bp, Homo sapiens
agacagcagatagtcgaaagg

SEQ ID NO: 8763325 - DNA, 22 bp, Homo sapiens
agacagactgtgtttgaatcct

SEQ ID NO: 8763326 - DNA, 22 bp, Homo sapiens
agacagcatgagcctgctgatg

SEQ ID NO: 8763327 - DNA, 21 bp, Homo sapiens
agacagcagatagtcgaaagg

SEQ ID NO: 8763328 - DNA, 22 bp, Homo sapiens
agacagcatgagcctgctgatg

SEQ ID NO: 8763329 - DNA, 22 bp, Homo sapiens
agacagcatgagcctgctgatg

SEQ ID NO: 8763330 - DNA, 21 bp, Homo sapiens
agacagcagtctccaaacccc

SEQ ID NO: 8763331 - DNA, 22 bp, Homo sapiens
agacagcaggggagtctggttt

SEQ ID NO: 8763332 - DNA, 22 bp, Homo sapiens
agacagcagggagcaggattca

SEQ ID NO: 8763333 - DNA, 22 bp, Homo sapiens
agacagctctgggttccacact

SEQ ID NO: 8763334 - DNA, 22 bp, Homo sapiens
agacagctctgggttccacact

SEQ ID NO: 8763335 - DNA, 22 bp, Homo sapiens
agacagctctgggttccacact

SEQ ID NO: 8763336 - DNA, 22 bp, Homo sapiens
agacagctgcctccaccacagc

SEQ ID NO: 8763337 - DNA, 22 bp, Homo sapiens
agacagctccaagtgtctctgt

SEQ ID NO: 8763338 - DNA, 22 bp, Homo sapiens
agacagctaataaatgagtgtg

SEQ ID NO: 8763339 - DNA, 22 bp, Homo sapiens
agacagctaataaatgagtgtg

SEQ ID NO: 8763340 - DNA, 22 bp, Homo sapiens
agacagccaatgctggaagatg

SEQ ID NO: 8763341 - DNA, 22 bp, Homo sapiens
agacagcatttctagcaccagg

SEQ ID NO: 8763342 - DNA, 22 bp, Homo sapiens
agacagcatttctagcaccagg

SEQ ID NO: 8763343 - DNA, 22 bp, Homo sapiens
agacagcatggagctgataaca

SEQ ID NO: 8763344 - DNA, 22 bp, Homo sapiens
agacagcatttcccggaaccgc

SEQ ID NO: 8763345 - DNA, 22 bp, Homo sapiens
agacagcatttctagcaccagg

SEQ ID NO: 8763346 - DNA, 22 bp, Homo sapiens
agacagcatgatacatgatgct

SEQ ID NO: 8763347 - DNA, 22 bp, Homo sapiens
agacagcatgatacatgatgct

SEQ ID NO: 8763348 - DNA, 22 bp, Homo sapiens
agacaggacacaagctgcataa

SEQ ID NO: 8763349 - DNA, 22 bp, Homo sapiens
agacaggacacaagctgcataa

SEQ ID NO: 8763350 - DNA, 22 bp, Homo sapiens
agacaggatgcatactcttggt

SEQ ID NO: 8763351 - DNA, 22 bp, Homo sapiens
agacagctgttccttcatgttt

SEQ ID NO: 8763352 - DNA, 21 bp, Homo sapiens
agacagctttaaagacacagg

SEQ ID NO: 8763353 - DNA, 22 bp, Homo sapiens
agacagctgttccttcatgttt

SEQ ID NO: 8763354 - DNA, 22 bp, Homo sapiens
agacagctgggagtgtccttct

SEQ ID NO: 8763355 - DNA, 22 bp, Homo sapiens
agacagctgctcgcagagctat

SEQ ID NO: 8763356 - DNA, 22 bp, Homo sapiens
agacagctgggaaatggagtgt

SEQ ID NO: 8763357 - DNA, 22 bp, Homo sapiens
agacatttcctagacatcaatg

SEQ ID NO: 8763358 - DNA, 22 bp, Homo sapiens
agacatttcctagacatcaatg

SEQ ID NO: 8763359 - DNA, 22 bp, Homo sapiens
agacatttcctagacatcaatg

SEQ ID NO: 8763360 - DNA, 22 bp, Homo sapiens
agacatttcctagacatcaatg

SEQ ID NO: 8763361 - DNA, 22 bp, Homo sapiens
agacatttggaagatacacata

SEQ ID NO: 8763362 - DNA, 22 bp, Homo sapiens
agacatttggaagatacacata

SEQ ID NO: 8763363 - DNA, 22 bp, Homo sapiens
agacatttggaagatacacata

SEQ ID NO: 8763364 - DNA, 22 bp, Homo sapiens
agacatttggaagatacacata

SEQ ID NO: 8763365 - DNA, 22 bp, Homo sapiens
agacatttggaagatacacata

SEQ ID NO: 8763366 - DNA, 22 bp, Homo sapiens
agacatttcctagacatcaatg

SEQ ID NO: 8763367 - DNA, 22 bp, Homo sapiens
agacatttcctagacatcaatg

SEQ ID NO: 8763368 - DNA, 22 bp, Homo sapiens
agacatttattcacacatttat

SEQ ID NO: 8763369 - DNA, 22 bp, Homo sapiens
agacatattggcttgctttaat

SEQ ID NO: 8763370 - DNA, 22 bp, Homo sapiens
agacatatattgcaattcactg

SEQ ID NO: 8763371 - DNA, 22 bp, Homo sapiens
attattattgttgatgttaggg

SEQ ID NO: 8763372 - DNA, 22 bp, Homo sapiens
attattatggttgctcttttcc

SEQ ID NO: 8763373 - DNA, 22 bp, Homo sapiens
attattatggttgctcttttcc

SEQ ID NO: 8763374 - DNA, 22 bp, Homo sapiens
attattattgttgatgttaggg

SEQ ID NO: 8763375 - DNA, 22 bp, Homo sapiens
attattattttagagagaggcc

SEQ ID NO: 8763376 - DNA, 21 bp, Homo sapiens
attattatttctgtgtccagc

SEQ ID NO: 8763377 - DNA, 22 bp, Homo sapiens
agaggcagaagtgttcaaaccc

SEQ ID NO: 8763378 - DNA, 22 bp, Homo sapiens
agaggcagaagtgttcaaaccc

SEQ ID NO: 8763379 - DNA, 22 bp, Homo sapiens
attattcaaattcccactatac

SEQ ID NO: 8763380 - DNA, 22 bp, Homo sapiens
attattcaacacttgagaaatt

SEQ ID NO: 8763381 - DNA, 22 bp, Homo sapiens
attattcaacacttgagaaatt

SEQ ID NO: 8763382 - DNA, 22 bp, Homo sapiens
attattatatagggaaagtccc

SEQ ID NO: 8763383 - DNA, 22 bp, Homo sapiens
attattatatagggaaagtccc

SEQ ID NO: 8763384 - DNA, 21 bp, Homo sapiens
attattataaagaccacaggg

SEQ ID NO: 8763385 - DNA, 22 bp, Homo sapiens
attattagattcttaattgtaa

SEQ ID NO: 8763386 - DNA, 22 bp, Homo sapiens
attattaaagcttaggtcttat

SEQ ID NO: 8763387 - DNA, 22 bp, Homo sapiens
agaggaggctgggtccagataa

SEQ ID NO: 8763388 - DNA, 22 bp, Homo sapiens
agaggaggctctgggatcgtcc

SEQ ID NO: 8763389 - DNA, 22 bp, Homo sapiens
agaggaggctctgggatcgtcc

SEQ ID NO: 8763390 - DNA, 22 bp, Homo sapiens
agaggaggctctgggatcgtcc

SEQ ID NO: 8763391 - DNA, 22 bp, Homo sapiens
attataggcttgagccaccgtg

SEQ ID NO: 8763392 - DNA, 22 bp, Homo sapiens
agaggaggctctgggatcgtcc

SEQ ID NO: 8763393 - DNA, 22 bp, Homo sapiens
agaggaggcagcttaactcagt

SEQ ID NO: 8763394 - DNA, 22 bp, Homo sapiens
agaggaggatttgtaaaggtct

SEQ ID NO: 8763395 - DNA, 22 bp, Homo sapiens
agaggaggcagcttaactcagt

SEQ ID NO: 8763396 - DNA, 22 bp, Homo sapiens
agaggaggcagcttaactcagt

SEQ ID NO: 8763397 - DNA, 22 bp, Homo sapiens
agaggaggccaggcccacacct

SEQ ID NO: 8763398 - DNA, 22 bp, Homo sapiens
agaggaggccaggcccacacct

SEQ ID NO: 8763399 - DNA, 22 bp, Homo sapiens
agaggaggcagcttaactcagt

SEQ ID NO: 8763400 - DNA, 22 bp, Homo sapiens
agaggaggctctgggatcgtcc

SEQ ID NO: 8763401 - DNA, 22 bp, Homo sapiens
agaggaggctctgggatcgtcc

SEQ ID NO: 8763402 - DNA, 22 bp, Homo sapiens
agaggaggccaggcccacacct

SEQ ID NO: 8763403 - DNA, 22 bp, Homo sapiens
agaggaggccaggcccacacct

SEQ ID NO: 8763404 - DNA, 22 bp, Homo sapiens
agaggaggccaggcccacacct

SEQ ID NO: 8763405 - DNA, 22 bp, Homo sapiens
agaggacaggttttccatgggc

SEQ ID NO: 8763406 - DNA, 22 bp, Homo sapiens
agaggacaggttttccatgggc

SEQ ID NO: 8763407 - DNA, 22 bp, Homo sapiens
agaggagcctcagtttgcagcc

SEQ ID NO: 8763408 - DNA, 22 bp, Homo sapiens
agaggagctgggaggccctcgt

SEQ ID NO: 8763409 - DNA, 22 bp, Homo sapiens
agaggagctgggaggccctcgt

SEQ ID NO: 8763410 - DNA, 22 bp, Homo sapiens
agaggagcttttggaaaaggcc

SEQ ID NO: 8763411 - DNA, 22 bp, Homo sapiens
agaggaggaagagctttaaaat

SEQ ID NO: 8763412 - DNA, 22 bp, Homo sapiens
agaggaggaagagctttaaaat

SEQ ID NO: 8763413 - DNA, 20 bp, Homo sapiens
agaggaggattattttattc

SEQ ID NO: 8763414 - DNA, 22 bp, Homo sapiens
agaggaggaagagctttaaaat

SEQ ID NO: 8763415 - DNA, 22 bp, Homo sapiens
agaggaggaagagctttaaaat

SEQ ID NO: 8763416 - DNA, 22 bp, Homo sapiens
agaggaggatttgtaaaggtct

SEQ ID NO: 8763417 - DNA, 20 bp, Homo sapiens
agaggaggattattttattc

SEQ ID NO: 8763418 - DNA, 20 bp, Homo sapiens
agaggaggattattttattc

SEQ ID NO: 8763419 - DNA, 20 bp, Homo sapiens
agaggaggattattttattc

SEQ ID NO: 8763420 - DNA, 22 bp, Homo sapiens
agaggaggatttgtaaaggtct

SEQ ID NO: 8763421 - DNA, 22 bp, Homo sapiens
agaggaggatttgtaaaggtct

SEQ ID NO: 8763422 - DNA, 22 bp, Homo sapiens
agaggacaaaatgagaagtgct

SEQ ID NO: 8763423 - DNA, 22 bp, Homo sapiens
agaggaagctgagatgcctctt

SEQ ID NO: 8763424 - DNA, 22 bp, Homo sapiens
agaggaagctgagatgcctctt

SEQ ID NO: 8763425 - DNA, 22 bp, Homo sapiens
agaggaagccattgcttactga

SEQ ID NO: 8763426 - DNA, 22 bp, Homo sapiens
atgtttatggagcaggtattag

SEQ ID NO: 8763427 - DNA, 22 bp, Homo sapiens
agaggacagacggaaagtgcca

SEQ ID NO: 8763428 - DNA, 22 bp, Homo sapiens
agaggacaaaatgagaagtgct

SEQ ID NO: 8763429 - DNA, 22 bp, Homo sapiens
agaggacacatctttcctcaaa

SEQ ID NO: 8763430 - DNA, 22 bp, Homo sapiens
agaggacaggttttccatgggc

SEQ ID NO: 8763431 - DNA, 22 bp, Homo sapiens
atgtttatgcaaacatgtgagt

SEQ ID NO: 8763432 - DNA, 22 bp, Homo sapiens
atgtttatgcaaacatgtgagt

SEQ ID NO: 8763433 - DNA, 22 bp, Homo sapiens
atgtttatgcaaacatgtgagt

SEQ ID NO: 8763434 - DNA, 22 bp, Homo sapiens
atgtttactgaaaagatttcaa

SEQ ID NO: 8763435 - DNA, 19 bp, Homo sapiens
atgtttacactcaggggct

SEQ ID NO: 8763436 - DNA, 22 bp, Homo sapiens
atgtttacaaaaaggaggcttg

SEQ ID NO: 8763437 - DNA, 22 bp, Homo sapiens
agagctgtttggacatctgagt

SEQ ID NO: 8763438 - DNA, 22 bp, Homo sapiens
atgtgtaggtgaatcgaggctg

SEQ ID NO: 8763439 - DNA, 22 bp, Homo sapiens
atgtgtatacttgtgcttactc

SEQ ID NO: 8763440 - DNA, 22 bp, Homo sapiens
atgtgtatatttggtgtcaata

SEQ ID NO: 8763441 - DNA, 22 bp, Homo sapiens
atgtgtatatttattgtagttt

SEQ ID NO: 8763442 - DNA, 21 bp, Homo sapiens
agagctgggacttgcctgaga

SEQ ID NO: 8763443 - DNA, 21 bp, Homo sapiens
agagctgggacttgcctgaga

SEQ ID NO: 8763444 - DNA, 21 bp, Homo sapiens
agagctgggacttgcctgaga

SEQ ID NO: 8763445 - DNA, 22 bp, Homo sapiens
agagctggtttactcaggaatt

SEQ ID NO: 8763446 - DNA, 22 bp, Homo sapiens
agagctggtttactcaggaatt

SEQ ID NO: 8763447 - DNA, 22 bp, Homo sapiens
agagctggtttactcaggaatt

SEQ ID NO: 8763448 - DNA, 21 bp, Homo sapiens
agagctggtaggtaggtaggt

SEQ ID NO: 8763449 - DNA, 21 bp, Homo sapiens
agagctggtaggtaggtaggt

SEQ ID NO: 8763450 - DNA, 22 bp, Homo sapiens
agagctgggacttggactcaat

SEQ ID NO: 8763451 - DNA, 22 bp, Homo sapiens
agagctggtgcatattcagaaa

SEQ ID NO: 8763452 - DNA, 21 bp, Homo sapiens
agagctggtaggtaggtaggt

SEQ ID NO: 8763453 - DNA, 21 bp, Homo sapiens
agagctggtaggtaggtaggt

SEQ ID NO: 8763454 - DNA, 22 bp, Homo sapiens
agagctgtatccccttaccagt

SEQ ID NO: 8763455 - DNA, 22 bp, Homo sapiens
agagctggtttactcaggaatt

SEQ ID NO: 8763456 - DNA, 22 bp, Homo sapiens
agagctgtagcttcctagagcc

SEQ ID NO: 8763457 - DNA, 22 bp, Homo sapiens
agagctgtgctttgcaccacgt

SEQ ID NO: 8763458 - DNA, 22 bp, Homo sapiens
agagctgtttattgatgtcaca

SEQ ID NO: 8763459 - DNA, 22 bp, Homo sapiens
agagctgttcagcagccaggtt

SEQ ID NO: 8763460 - DNA, 22 bp, Homo sapiens
agagctgtttattgatgtcaca

SEQ ID NO: 8763461 - DNA, 22 bp, Homo sapiens
agagctgttcagcagccaggtt

SEQ ID NO: 8763462 - DNA, 22 bp, Homo sapiens
agagctgttaattttgcactgg

SEQ ID NO: 8763463 - DNA, 22 bp, Homo sapiens
agagctgttaattttgcactgg

SEQ ID NO: 8763464 - DNA, 22 bp, Homo sapiens
attccagtgtgcatggtacaca

SEQ ID NO: 8763465 - DNA, 22 bp, Homo sapiens
attccagttagtggcagcttat

SEQ ID NO: 8763466 - DNA, 22 bp, Homo sapiens
attccagttagtggcagcttat

SEQ ID NO: 8763467 - DNA, 22 bp, Homo sapiens
attccattcttgcttttgatct

SEQ ID NO: 8763468 - DNA, 22 bp, Homo sapiens
attccattgtgtaaggatatcg

SEQ ID NO: 8763469 - DNA, 22 bp, Homo sapiens
attccattgtatgtgtagacta

SEQ ID NO: 8763470 - DNA, 22 bp, Homo sapiens
attccattgtatgtgtagacta

SEQ ID NO: 8763471 - DNA, 22 bp, Homo sapiens
attccattacagatcttttcct

SEQ ID NO: 8763472 - DNA, 20 bp, Homo sapiens
attccatagttggcactttt

SEQ ID NO: 8763473 - DNA, 22 bp, Homo sapiens
attccaggattccaggacaaat

SEQ ID NO: 8763474 - DNA, 22 bp, Homo sapiens
attccaggcagaccagagagat

SEQ ID NO: 8763475 - DNA, 22 bp, Homo sapiens
attgcagggtccctgccatcgg

SEQ ID NO: 8763476 - DNA, 22 bp, Homo sapiens
attgcagggactcaataagaat

SEQ ID NO: 8763477 - DNA, 22 bp, Homo sapiens
attgcagggaggcaggtagatg

SEQ ID NO: 8763478 - DNA, 22 bp, Homo sapiens
attgcattcattgacatatgag

SEQ ID NO: 8763479 - DNA, 22 bp, Homo sapiens
attgcatgacatatccacttgt

SEQ ID NO: 8763480 - DNA, 22 bp, Homo sapiens
attgcatgccacttgtgttggt

SEQ ID NO: 8763481 - DNA, 22 bp, Homo sapiens
attgcagatgatccccaagtta

SEQ ID NO: 8763482 - DNA, 22 bp, Homo sapiens
attgataaattgcaatggggct

SEQ ID NO: 8763483 - DNA, 22 bp, Homo sapiens
attgcagctcagggtgatgact

SEQ ID NO: 8763484 - DNA, 22 bp, Homo sapiens
attgagtacttagtgtcatata

SEQ ID NO: 8763485 - DNA, 22 bp, Homo sapiens
attgagtagtaggaaaataact

SEQ ID NO: 8763486 - DNA, 22 bp, Homo sapiens
attgataaattgcaatggggct

SEQ ID NO: 8763487 - DNA, 22 bp, Homo sapiens
attgagtaataattgatcttgg

SEQ ID NO: 8763488 - DNA, 22 bp, Homo sapiens
attccatttacaaggactagat

SEQ ID NO: 8763489 - DNA, 22 bp, Homo sapiens
attccatttgtgtggaatggct

SEQ ID NO: 8763490 - DNA, 22 bp, Homo sapiens
agagggagaaaagaatcagttg

SEQ ID NO: 8763491 - DNA, 22 bp, Homo sapiens
agagggagaagctaaaataact

SEQ ID NO: 8763492 - DNA, 22 bp, Homo sapiens
agagggagaagctaaaataact

SEQ ID NO: 8763493 - DNA, 22 bp, Homo sapiens
agagggagaagctaaaataact

SEQ ID NO: 8763494 - DNA, 21 bp, Homo sapiens
agagggagagtggcccttcca

SEQ ID NO: 8763495 - DNA, 22 bp, Homo sapiens
agagggagaaaagaatcagttg

SEQ ID NO: 8763496 - DNA, 22 bp, Homo sapiens
agagggaatgtgattgcaccat

SEQ ID NO: 8763497 - DNA, 22 bp, Homo sapiens
attccagagaggttctggaggt

SEQ ID NO: 8763498 - DNA, 22 bp, Homo sapiens
attccagaataccggcaagatg

SEQ ID NO: 8763499 - DNA, 22 bp, Homo sapiens
attccagagaaaggcctggctg

SEQ ID NO: 8763500 - DNA, 21 bp, Homo sapiens
agagggagagtggcccttcca

SEQ ID NO: 8763501 - DNA, 22 bp, Homo sapiens
agagggaaatccaggagtgctt

SEQ ID NO: 8763502 - DNA, 22 bp, Homo sapiens
agagggaaatccaggagtgctt

SEQ ID NO: 8763503 - DNA, 22 bp, Homo sapiens
agagggaaatccaggagtgctt

SEQ ID NO: 8763504 - DNA, 18 bp, Homo sapiens
agagggaaagcaggctga

SEQ ID NO: 8763505 - DNA, 18 bp, Homo sapiens
agagggaaagcaggctga

SEQ ID NO: 8763506 - DNA, 22 bp, Homo sapiens
agagggaaggacagatgtttca

SEQ ID NO: 8763507 - DNA, 18 bp, Homo sapiens
agagggaatcagttggat

SEQ ID NO: 8763508 - DNA, 22 bp, Homo sapiens
agagggaaaaactcatgtcatt

SEQ ID NO: 8763509 - DNA, 17 bp, Homo sapiens
agagggaaaatgcggtt

SEQ ID NO: 8763510 - DNA, 22 bp, Homo sapiens
agagggaaaaactcatgtcatt

SEQ ID NO: 8763511 - DNA, 22 bp, Homo sapiens
agaggcctttgggcaacatccc

SEQ ID NO: 8763512 - DNA, 21 bp, Homo sapiens
agaggccttacaggatagacc

SEQ ID NO: 8763513 - DNA, 16 bp, Homo sapiens
agaggccttgaggaag

SEQ ID NO: 8763514 - DNA, 22 bp, Homo sapiens
agaggcctttctgttgagtgaa

SEQ ID NO: 8763515 - DNA, 22 bp, Homo sapiens
agaggcctttgggcaacatccc

SEQ ID NO: 8763516 - DNA, 22 bp, Homo sapiens
agaggcctttctgttgagtgaa

SEQ ID NO: 8763517 - DNA, 22 bp, Homo sapiens
agaggcggaggttgcagtgagc

SEQ ID NO: 8763518 - DNA, 22 bp, Homo sapiens
agaggcggagcttgcagtgagc

SEQ ID NO: 8763519 - DNA, 22 bp, Homo sapiens
agaggcggaggttgcagtgagc

SEQ ID NO: 8763520 - DNA, 22 bp, Homo sapiens
agaggcggagcttgcagtgagc

SEQ ID NO: 8763521 - DNA, 22 bp, Homo sapiens
agaggctccaccttctctgtcc

SEQ ID NO: 8763522 - DNA, 23 bp, Homo sapiens
agaggctcagcgtccacctctac

SEQ ID NO: 8763523 - DNA, 22 bp, Homo sapiens
agaggctcagaggcctggtcct

SEQ ID NO: 8763524 - DNA, 22 bp, Homo sapiens
attcatttgctattgtgtatgg

SEQ ID NO: 8763525 - DNA, 22 bp, Homo sapiens
attcatttgctattgtgtatgg

SEQ ID NO: 8763526 - DNA, 22 bp, Homo sapiens
attcatttgctattgtgtatgg

SEQ ID NO: 8763527 - DNA, 22 bp, Homo sapiens
attcatttgctattgtgtatgg

SEQ ID NO: 8763528 - DNA, 22 bp, Homo sapiens
attcatttgctattgtgtatgg

SEQ ID NO: 8763529 - DNA, 22 bp, Homo sapiens
agaggcctgtgtgctccagtgg

SEQ ID NO: 8763530 - DNA, 22 bp, Homo sapiens
agaggcctgtgtgctccagtgg

SEQ ID NO: 8763531 - DNA, 22 bp, Homo sapiens
agaggcctgtgtgctccagtgg

SEQ ID NO: 8763532 - DNA, 22 bp, Homo sapiens
attcatttagagggattaagca

SEQ ID NO: 8763533 - DNA, 22 bp, Homo sapiens
attcatttagagggattaagca

SEQ ID NO: 8763534 - DNA, 22 bp, Homo sapiens
attcatttagagggattaagca

SEQ ID NO: 8763535 - DNA, 22 bp, Homo sapiens
attcatttagagggattaagca

SEQ ID NO: 8763536 - DNA, 22 bp, Homo sapiens
attcattggcttgaactccacc

SEQ ID NO: 8763537 - DNA, 22 bp, Homo sapiens
attcatttagagggattaagca

SEQ ID NO: 8763538 - DNA, 22 bp, Homo sapiens
attcatttaggtattcacttac

SEQ ID NO: 8763539 - DNA, 22 bp, Homo sapiens
attcatttaggtattcacttac

SEQ ID NO: 8763540 - DNA, 22 bp, Homo sapiens
attcatttaggtattcacttac

SEQ ID NO: 8763541 - DNA, 22 bp, Homo sapiens
attcatttaggtattcacttac

SEQ ID NO: 8763542 - DNA, 22 bp, Homo sapiens
attcatttaggtattcacttac

SEQ ID NO: 8763543 - DNA, 22 bp, Homo sapiens
attcatttaggtattcacttac

SEQ ID NO: 8763544 - DNA, 22 bp, Homo sapiens
attcatttaggtattcacttac

SEQ ID NO: 8763545 - DNA, 22 bp, Homo sapiens
agaggcaggaggttgacttgag

SEQ ID NO: 8763546 - DNA, 22 bp, Homo sapiens
agaggcaggaggttgacttgag

SEQ ID NO: 8763547 - DNA, 22 bp, Homo sapiens
agaggcaggaggttgacttgag

SEQ ID NO: 8763548 - DNA, 22 bp, Homo sapiens
attcagggaggaaaggggcctc

SEQ ID NO: 8763549 - DNA, 22 bp, Homo sapiens
attcagtagaagttagctatta

SEQ ID NO: 8763550 - DNA, 22 bp, Homo sapiens
attcatgtcatagcaggatttc

SEQ ID NO: 8763551 - DNA, 22 bp, Homo sapiens
attcatgtagtgattgagtcac

SEQ ID NO: 8763552 - DNA, 22 bp, Homo sapiens
attcatggcagtggtaacgttt

SEQ ID NO: 8763553 - DNA, 22 bp, Homo sapiens
attcatgtaacattagagaaat

SEQ ID NO: 8763554 - DNA, 22 bp, Homo sapiens
attcatgtaaaattggatagac

SEQ ID NO: 8763555 - DNA, 22 bp, Homo sapiens
attcagtattctgctgcataat

SEQ ID NO: 8763556 - DNA, 22 bp, Homo sapiens
attcatgttagcccacatgtag

SEQ ID NO: 8763557 - DNA, 22 bp, Homo sapiens
attcatgttttcttgcttcaag

SEQ ID NO: 8763558 - DNA, 22 bp, Homo sapiens
attcatgttagcccacatgtag

SEQ ID NO: 8763559 - DNA, 22 bp, Homo sapiens
attcatgttagcccacatgtag

SEQ ID NO: 8763560 - DNA, 22 bp, Homo sapiens
attcatgttagcccacatgtag

SEQ ID NO: 8763561 - DNA, 22 bp, Homo sapiens
attcatgtggggagccttctgt

SEQ ID NO: 8763562 - DNA, 22 bp, Homo sapiens
attcattctgacctcaagagaa

SEQ ID NO: 8763563 - DNA, 22 bp, Homo sapiens
attcattccaggtcagtcagac

SEQ ID NO: 8763564 - DNA, 22 bp, Homo sapiens
attcattcttggtatgaacagc

SEQ ID NO: 8763565 - DNA, 22 bp, Homo sapiens
attcatgttcggggccacgttg

SEQ ID NO: 8763566 - DNA, 22 bp, Homo sapiens
agaggcagcagtcatactacag

SEQ ID NO: 8763567 - DNA, 22 bp, Homo sapiens
agaggcagcagtcatactacag

SEQ ID NO: 8763568 - DNA, 22 bp, Homo sapiens
agaggcagcagtcatactacag

SEQ ID NO: 8763569 - DNA, 22 bp, Homo sapiens
agaggcagcagtcatactacag

SEQ ID NO: 8763570 - DNA, 17 bp, Homo sapiens
agaggcagatacttgga

SEQ ID NO: 8763571 - DNA, 17 bp, Homo sapiens
agaggcagatacttgga

SEQ ID NO: 8763572 - DNA, 17 bp, Homo sapiens
agaggcagatacttgga

SEQ ID NO: 8763573 - DNA, 22 bp, Homo sapiens
agaggcagaagtgttcaaaccc

SEQ ID NO: 8763574 - DNA, 22 bp, Homo sapiens
agaggcaggaagagctgatttt

SEQ ID NO: 8763575 - DNA, 22 bp, Homo sapiens
agaggcaggaagagctgatttt

SEQ ID NO: 8763576 - DNA, 22 bp, Homo sapiens
agaggcaggaagagctgatttt

SEQ ID NO: 8763577 - DNA, 22 bp, Homo sapiens
agaggcaggaagagctgatttt

SEQ ID NO: 8763578 - DNA, 22 bp, Homo sapiens
agaggcagccgtatttcaaagg

SEQ ID NO: 8763579 - DNA, 22 bp, Homo sapiens
agaggcagccgtatttcaaagg

SEQ ID NO: 8763580 - DNA, 22 bp, Homo sapiens
agagtttgttgaatttacttgg

SEQ ID NO: 8763581 - DNA, 23 bp, Homo sapiens
agagtttgtttctaatgagtgag

SEQ ID NO: 8763582 - DNA, 17 bp, Homo sapiens
agagttttaagaaattt

SEQ ID NO: 8763583 - DNA, 17 bp, Homo sapiens
agagttttaagaaattt

SEQ ID NO: 8763584 - DNA, 22 bp, Homo sapiens
agagtttgtgggcttttcctcc

SEQ ID NO: 8763585 - DNA, 22 bp, Homo sapiens
agagtttgtgtcctttatcagg

SEQ ID NO: 8763586 - DNA, 22 bp, Homo sapiens
agagttttatggctttaattct

SEQ ID NO: 8763587 - DNA, 23 bp, Homo sapiens
agagttttctgttttctgtaggg

SEQ ID NO: 8763588 - DNA, 22 bp, Homo sapiens
agataaaatgattttctggatc

SEQ ID NO: 8763589 - DNA, 22 bp, Homo sapiens
agataaaatgattttctggatc

SEQ ID NO: 8763590 - DNA, 22 bp, Homo sapiens
agataaaatgattttctggatc

SEQ ID NO: 8763591 - DNA, 22 bp, Homo sapiens
agataaaatgattttctggatc

SEQ ID NO: 8763592 - DNA, 20 bp, Homo sapiens
agagtttggggtcattttgg

SEQ ID NO: 8763593 - DNA, 22 bp, Homo sapiens
agagtttggattttaggacatc

SEQ ID NO: 8763594 - DNA, 22 bp, Homo sapiens
agagtttgaattttgaaaagat

SEQ ID NO: 8763595 - DNA, 22 bp, Homo sapiens
agagtttgaagttatctttgac

SEQ ID NO: 8763596 - DNA, 22 bp, Homo sapiens
agagtttcttgtgagcactgac

SEQ ID NO: 8763597 - DNA, 22 bp, Homo sapiens
agagtttggggtatgattgttt

SEQ ID NO: 8763598 - DNA, 22 bp, Homo sapiens
agagtttgggtgggacagcttg

SEQ ID NO: 8763599 - DNA, 22 bp, Homo sapiens
agagtttggtgaagcaatttga

SEQ ID NO: 8763600 - DNA, 22 bp, Homo sapiens
agagtttgtatttttcagtgaa

SEQ ID NO: 8763601 - DNA, 22 bp, Homo sapiens
agagtttggtgaagcaatttga

SEQ ID NO: 8763602 - DNA, 22 bp, Homo sapiens
agagtttgtatttttcagtgaa

SEQ ID NO: 8763603 - DNA, 22 bp, Homo sapiens
agataaagtccaaactgtgtag

SEQ ID NO: 8763604 - DNA, 22 bp, Homo sapiens
agataaaatggttcaaaggcta

SEQ ID NO: 8763605 - DNA, 22 bp, Homo sapiens
agataaaatggttcaaaggcta

SEQ ID NO: 8763606 - DNA, 22 bp, Homo sapiens
agataaaatggttcaaaggcta

SEQ ID NO: 8763607 - DNA, 22 bp, Homo sapiens
agataaaatggttcaaaggcta

SEQ ID NO: 8763608 - DNA, 22 bp, Homo sapiens
atttcacagctgctgttcaggt

SEQ ID NO: 8763609 - DNA, 22 bp, Homo sapiens
atttcacagctgctgttcaggt

SEQ ID NO: 8763610 - DNA, 22 bp, Homo sapiens
atttcacagcgtggttgactgc

SEQ ID NO: 8763611 - DNA, 22 bp, Homo sapiens
atttcacaaagaacagatgcag

SEQ ID NO: 8763612 - DNA, 22 bp, Homo sapiens
atttcacaaagaacagatgcag

SEQ ID NO: 8763613 - DNA, 22 bp, Homo sapiens
atttcacaaagaacagatgcag

SEQ ID NO: 8763614 - DNA, 21 bp, Homo sapiens
atttcacaccctcctttttct

SEQ ID NO: 8763615 - DNA, 22 bp, Homo sapiens
atttcactcttaattgcttcct

SEQ ID NO: 8763616 - DNA, 22 bp, Homo sapiens
atttcactctccctgccactta

SEQ ID NO: 8763617 - DNA, 22 bp, Homo sapiens
atttcacattaatttgatgctc

SEQ ID NO: 8763618 - DNA, 22 bp, Homo sapiens
atttcacattaatttgatgctc

SEQ ID NO: 8763619 - DNA, 22 bp, Homo sapiens
atttcacattaatttgatgctc

SEQ ID NO: 8763620 - DNA, 22 bp, Homo sapiens
atttcacagctgtcagtgttac

SEQ ID NO: 8763621 - DNA, 22 bp, Homo sapiens
atttcacagctgctgttcaggt

SEQ ID NO: 8763622 - DNA, 22 bp, Homo sapiens
atttcacatctatctcagattt

SEQ ID NO: 8763623 - DNA, 22 bp, Homo sapiens
atttcacatctatctcagattt

SEQ ID NO: 8763624 - DNA, 22 bp, Homo sapiens
atttcacatctatctcagattt

SEQ ID NO: 8763625 - DNA, 22 bp, Homo sapiens
atttcacagctgtcagtgttac

SEQ ID NO: 8763626 - DNA, 22 bp, Homo sapiens
atttcacagctgtcagtgttac

SEQ ID NO: 8763627 - DNA, 22 bp, Homo sapiens
agatacagtgttacatttttat

SEQ ID NO: 8763628 - DNA, 22 bp, Homo sapiens
agatacagtgttacatttttat

SEQ ID NO: 8763629 - DNA, 20 bp, Homo sapiens
agatacagtggtttctttag

SEQ ID NO: 8763630 - DNA, 17 bp, Homo sapiens
atttcacttagcatgag

SEQ ID NO: 8763631 - DNA, 22 bp, Homo sapiens
agatacatagctgtgagcacac

SEQ ID NO: 8763632 - DNA, 22 bp, Homo sapiens
agatacatatagaaaacatcaa

SEQ ID NO: 8763633 - DNA, 22 bp, Homo sapiens
agatacatatagaaaacatcaa

SEQ ID NO: 8763634 - DNA, 20 bp, Homo sapiens
agatacagtttaattactct

SEQ ID NO: 8763635 - DNA, 22 bp, Homo sapiens
agatacatatagaaaacatcaa

SEQ ID NO: 8763636 - DNA, 22 bp, Homo sapiens
agatacatcatttataccttca

SEQ ID NO: 8763637 - DNA, 22 bp, Homo sapiens
agatacattagtagttacttgt

SEQ ID NO: 8763638 - DNA, 22 bp, Homo sapiens
agatacattagtagttacttgt

SEQ ID NO: 8763639 - DNA, 22 bp, Homo sapiens
agatacattgttctaagcattg

SEQ ID NO: 8763640 - DNA, 22 bp, Homo sapiens
agaggtgacataggagaggctc

SEQ ID NO: 8763641 - DNA, 22 bp, Homo sapiens
agaggtcttttggtctgcagaa

SEQ ID NO: 8763642 - DNA, 22 bp, Homo sapiens
agaggtgaaagaatttggctct

SEQ ID NO: 8763643 - DNA, 22 bp, Homo sapiens
agaggtcttaagttccttgatg

SEQ ID NO: 8763644 - DNA, 19 bp, Homo sapiens
agagtttaggtctatcagg

SEQ ID NO: 8763645 - DNA, 22 bp, Homo sapiens
agagtttcttgtgagcactgac

SEQ ID NO: 8763646 - DNA, 22 bp, Homo sapiens
agagtttcttgtgagcactgac

SEQ ID NO: 8763647 - DNA, 22 bp, Homo sapiens
agagtttacagaaataagctgt

SEQ ID NO: 8763648 - DNA, 22 bp, Homo sapiens
agagtttacagaaataagctgt

SEQ ID NO: 8763649 - DNA, 23 bp, Homo sapiens
agagttgtatcctatgtgcttct

SEQ ID NO: 8763650 - DNA, 22 bp, Homo sapiens
agagttggcccacgtgtaggcg

SEQ ID NO: 8763651 - DNA, 22 bp, Homo sapiens
agagttggcccacgtgtaggcg

SEQ ID NO: 8763652 - DNA, 22 bp, Homo sapiens
agagttggcccacgtgtaggcg

SEQ ID NO: 8763653 - DNA, 22 bp, Homo sapiens
agagttgctaccaagatgctag

SEQ ID NO: 8763654 - DNA, 22 bp, Homo sapiens
agagttgctatagaaggatgga

SEQ ID NO: 8763655 - DNA, 22 bp, Homo sapiens
agaggtcagatttctcctggtg

SEQ ID NO: 8763656 - DNA, 22 bp, Homo sapiens
agaggtcagatttctcctggtg

SEQ ID NO: 8763657 - DNA, 22 bp, Homo sapiens
agaggtcagagcaggaaaggca

SEQ ID NO: 8763658 - DNA, 22 bp, Homo sapiens
agaggtcagctgcatgccacat

SEQ ID NO: 8763659 - DNA, 22 bp, Homo sapiens
agaggtcagaggtcgccaggtc

SEQ ID NO: 8763660 - DNA, 22 bp, Homo sapiens
agaggtcagaggtcgccaggtc

SEQ ID NO: 8763661 - DNA, 22 bp, Homo sapiens
agaggtcatatctcagaagaga

SEQ ID NO: 8763662 - DNA, 21 bp, Homo sapiens
agaggtcattgggctggttct

SEQ ID NO: 8763663 - DNA, 22 bp, Homo sapiens
agaggtcaatgggacttggatc

SEQ ID NO: 8763664 - DNA, 22 bp, Homo sapiens
agaggtcactccaccttcttct

SEQ ID NO: 8763665 - DNA, 22 bp, Homo sapiens
agaggtcagaacaggaaagtgt

SEQ ID NO: 8763666 - DNA, 22 bp, Homo sapiens
attgctgaatctaaggcttcca

SEQ ID NO: 8763667 - DNA, 22 bp, Homo sapiens
attgctgaacttataaatgaat

SEQ ID NO: 8763668 - DNA, 22 bp, Homo sapiens
attgctgactttaatattatat

SEQ ID NO: 8763669 - DNA, 22 bp, Homo sapiens
attgctgaataatattccactg

SEQ ID NO: 8763670 - DNA, 22 bp, Homo sapiens
attgctgacaccaagtagtagc

SEQ ID NO: 8763671 - DNA, 22 bp, Homo sapiens
attgcccaataataaaatggta

SEQ ID NO: 8763672 - DNA, 22 bp, Homo sapiens
attgctctctatgtgtcggaca

SEQ ID NO: 8763673 - DNA, 22 bp, Homo sapiens
attgctcctgatgcatagagct

SEQ ID NO: 8763674 - DNA, 22 bp, Homo sapiens
attgctaatgtgcgaatgtgta

SEQ ID NO: 8763675 - DNA, 22 bp, Homo sapiens
caaaaaacacagatgtctgtgt

SEQ ID NO: 8763676 - DNA, 22 bp, Homo sapiens
caaaaaacacagatgtctgtgt

SEQ ID NO: 8763677 - DNA, 21 bp, Homo sapiens
caaaaggataggaaattaggg

SEQ ID NO: 8763678 - DNA, 21 bp, Homo sapiens
caaaaggataggaaattaggg

SEQ ID NO: 8763679 - DNA, 21 bp, Homo sapiens
caaaaggataggaaattaggg

SEQ ID NO: 8763680 - DNA, 22 bp, Homo sapiens
attttttgttaactcaggatag

SEQ ID NO: 8763681 - DNA, 22 bp, Homo sapiens
atttgttgttgctcccctaaga

SEQ ID NO: 8763682 - DNA, 22 bp, Homo sapiens
atttgtttatcgtcgattgtag

SEQ ID NO: 8763683 - DNA, 22 bp, Homo sapiens
atttgttgctagcagcactgat

SEQ ID NO: 8763684 - DNA, 22 bp, Homo sapiens
atttgtttatcgtcgattgtag

SEQ ID NO: 8763685 - DNA, 22 bp, Homo sapiens
atttgtttatcgtcgattgtag

SEQ ID NO: 8763686 - DNA, 20 bp, Homo sapiens
atttgtttctactctctgac

SEQ ID NO: 8763687 - DNA, 22 bp, Homo sapiens
atttgtttcagggccttggtat

SEQ ID NO: 8763688 - DNA, 22 bp, Homo sapiens
caaaagtaattgcagtttttgc

SEQ ID NO: 8763689 - DNA, 22 bp, Homo sapiens
caaaagtaattgcagtttttgc

SEQ ID NO: 8763690 - DNA, 22 bp, Homo sapiens
caaaagtaattgcggtttttgc

SEQ ID NO: 8763691 - DNA, 22 bp, Homo sapiens
caaaagtaattgtggtttttgc

SEQ ID NO: 8763692 - DNA, 22 bp, Homo sapiens
caaaagtaccttgtgtgctttg

SEQ ID NO: 8763693 - DNA, 22 bp, Homo sapiens
caaaagtaccttgtgtgctttg

SEQ ID NO: 8763694 - DNA, 22 bp, Homo sapiens
caaaagtaccttgtgtgctttg

SEQ ID NO: 8763695 - DNA, 22 bp, Homo sapiens
caaaagtaatgtatgctcatcg

SEQ ID NO: 8763696 - DNA, 22 bp, Homo sapiens
caaaagtaatggcggtttttac

SEQ ID NO: 8763697 - DNA, 22 bp, Homo sapiens
caaaagtaatgtatgctcatcg

SEQ ID NO: 8763698 - DNA, 22 bp, Homo sapiens
caaaagtaatgtatgctcatcg

SEQ ID NO: 8763699 - DNA, 22 bp, Homo sapiens
caaaagtaatgtatgctcatcg

SEQ ID NO: 8763700 - DNA, 22 bp, Homo sapiens
caaaagtaattgcagtttttgc

SEQ ID NO: 8763701 - DNA, 22 bp, Homo sapiens
caaaagtaattatggtttttgc

SEQ ID NO: 8763702 - DNA, 22 bp, Homo sapiens
caaaaggccagtactttgtttg

SEQ ID NO: 8763703 - DNA, 22 bp, Homo sapiens
caaaaggcaggggaaagagtgc

SEQ ID NO: 8763704 - DNA, 22 bp, Homo sapiens
caaaaggccagtactttgtttg

SEQ ID NO: 8763705 - DNA, 22 bp, Homo sapiens
caaaaggcaggggaaagagtgc

SEQ ID NO: 8763706 - DNA, 22 bp, Homo sapiens
atttggcagtgaagggatcaca

SEQ ID NO: 8763707 - DNA, 22 bp, Homo sapiens
atttggcagccacagcaatctt

SEQ ID NO: 8763708 - DNA, 22 bp, Homo sapiens
atttggcataggcagaggccca

SEQ ID NO: 8763709 - DNA, 20 bp, Homo sapiens
atttggcatgaagtattgat

SEQ ID NO: 8763710 - DNA, 20 bp, Homo sapiens
atttggcatgaagtattgat

SEQ ID NO: 8763711 - DNA, 22 bp, Homo sapiens
atttggcacactgggttctcgt

SEQ ID NO: 8763712 - DNA, 22 bp, Homo sapiens
atttggcaacattaattgaatc

SEQ ID NO: 8763713 - DNA, 21 bp, Homo sapiens
atttggcaaaggcgatgcaca

SEQ ID NO: 8763714 - DNA, 22 bp, Homo sapiens
atttggcaacattaattgaatc

SEQ ID NO: 8763715 - DNA, 22 bp, Homo sapiens
atttggattcttatttagcact

SEQ ID NO: 8763716 - DNA, 17 bp, Homo sapiens
atttgtgatgtaacgtc

SEQ ID NO: 8763717 - DNA, 22 bp, Homo sapiens
atttgtgggactataatgcagg

SEQ ID NO: 8763718 - DNA, 22 bp, Homo sapiens
atttgtctttggacctgtgaga

SEQ ID NO: 8763719 - DNA, 22 bp, Homo sapiens
atttggctagcttatggttata

SEQ ID NO: 8763720 - DNA, 22 bp, Homo sapiens
atttggctattgaattattcct

SEQ ID NO: 8763721 - DNA, 22 bp, Homo sapiens
atttgttccatgagtaaggcta

SEQ ID NO: 8763722 - DNA, 22 bp, Homo sapiens
atttgttcagcattgaatttgg

SEQ ID NO: 8763723 - DNA, 22 bp, Homo sapiens
atttgttcatgggttgttatgc

SEQ ID NO: 8763724 - DNA, 22 bp, Homo sapiens
atttgttaattatgaggcatac

SEQ ID NO: 8763725 - DNA, 22 bp, Homo sapiens
atttgttcacaatcagggcagg

SEQ ID NO: 8763726 - DNA, 17 bp, Homo sapiens
atttggaatttctcttc

SEQ ID NO: 8763727 - DNA, 22 bp, Homo sapiens
atttggaggcccatcccttaca

SEQ ID NO: 8763728 - DNA, 22 bp, Homo sapiens
atttgcttttactatgttaaaa

SEQ ID NO: 8763729 - DNA, 22 bp, Homo sapiens
atttggatatcactgaatacat

SEQ ID NO: 8763730 - DNA, 21 bp, Homo sapiens
atttggatattgctggcaaat

SEQ ID NO: 8763731 - DNA, 21 bp, Homo sapiens
atttggatattgctggcaaat

SEQ ID NO: 8763732 - DNA, 22 bp, Homo sapiens
atttggattcttatttagcact

SEQ ID NO: 8763733 - DNA, 22 bp, Homo sapiens
atttggattcttatttagcact

SEQ ID NO: 8763734 - DNA, 22 bp, Homo sapiens
atttggatgcactaaataaaat

SEQ ID NO: 8763735 - DNA, 22 bp, Homo sapiens
atttggatgcactaaataaaat

SEQ ID NO: 8763736 - DNA, 22 bp, Homo sapiens
atttggatgaacaatggaaaaa

SEQ ID NO: 8763737 - DNA, 22 bp, Homo sapiens
atttggatgcactaaataaaat

SEQ ID NO: 8763738 - DNA, 22 bp, Homo sapiens
atttgcttttactatgttaaaa

SEQ ID NO: 8763739 - DNA, 22 bp, Homo sapiens
atttgctttgggacagcttaaa

SEQ ID NO: 8763740 - DNA, 22 bp, Homo sapiens
atttctctgcagtgttcggaat

SEQ ID NO: 8763741 - DNA, 18 bp, Homo sapiens
atttctctggggtgattc

SEQ ID NO: 8763742 - DNA, 22 bp, Homo sapiens
atttctctgcctcagcttctgc

SEQ ID NO: 8763743 - DNA, 22 bp, Homo sapiens
atttctcctccagatggtggtt

SEQ ID NO: 8763744 - DNA, 22 bp, Homo sapiens
atttctccttgttgcaatgcag

SEQ ID NO: 8763745 - DNA, 22 bp, Homo sapiens
atttctcattttgcttcaaagg

SEQ ID NO: 8763746 - DNA, 22 bp, Homo sapiens
atttctctaagcatccgtttgc

SEQ ID NO: 8763747 - DNA, 22 bp, Homo sapiens
atttctctcattgttagctagg

SEQ ID NO: 8763748 - DNA, 22 bp, Homo sapiens
atttctctcattgttagctagg

SEQ ID NO: 8763749 - DNA, 22 bp, Homo sapiens
atttctcatcaagtgccaactc

SEQ ID NO: 8763750 - DNA, 22 bp, Homo sapiens
atttctcatctttgtgaatggt

SEQ ID NO: 8763751 - DNA, 22 bp, Homo sapiens
atttctcagttcctactgttta

SEQ ID NO: 8763752 - DNA, 22 bp, Homo sapiens
atttccttcatcagcctatcct

SEQ ID NO: 8763753 - DNA, 22 bp, Homo sapiens
atttctcatgtacaaaaacact

SEQ ID NO: 8763754 - DNA, 22 bp, Homo sapiens
atttctcattaagatcttccaa

SEQ ID NO: 8763755 - DNA, 22 bp, Homo sapiens
atttctcattttgcttcaaagg

SEQ ID NO: 8763756 - DNA, 22 bp, Homo sapiens
atttctcattaagatcttccaa

SEQ ID NO: 8763757 - DNA, 22 bp, Homo sapiens
agataggccattaagaaggata

SEQ ID NO: 8763758 - DNA, 22 bp, Homo sapiens
agatagatagtgaggtaatagc

SEQ ID NO: 8763759 - DNA, 22 bp, Homo sapiens
agatagatggtgacaggtatac

SEQ ID NO: 8763760 - DNA, 22 bp, Homo sapiens
agatactacatgaatgggaatt

SEQ ID NO: 8763761 - DNA, 22 bp, Homo sapiens
agatacattgttctaagcattg

SEQ ID NO: 8763762 - DNA, 22 bp, Homo sapiens
agatacattgttctaagcattg

SEQ ID NO: 8763763 - DNA, 22 bp, Homo sapiens
agatacatttgtgtgcatgtat

SEQ ID NO: 8763764 - DNA, 22 bp, Homo sapiens
agatacattgttctaagcattg

SEQ ID NO: 8763765 - DNA, 22 bp, Homo sapiens
atttcctatggatacaggcaga

SEQ ID NO: 8763766 - DNA, 22 bp, Homo sapiens
atttcctatacagttgtccata

SEQ ID NO: 8763767 - DNA, 22 bp, Homo sapiens
atttccagcataggcttattga

SEQ ID NO: 8763768 - DNA, 22 bp, Homo sapiens
atttccagcagcatatttgtct

SEQ ID NO: 8763769 - DNA, 22 bp, Homo sapiens
atttccagcagcatatttgtct

SEQ ID NO: 8763770 - DNA, 17 bp, Homo sapiens
atttcctcagggctgag

SEQ ID NO: 8763771 - DNA, 22 bp, Homo sapiens
atttcctgacagggcagtggta

SEQ ID NO: 8763772 - DNA, 22 bp, Homo sapiens
atttcctgacttccattgaggc

SEQ ID NO: 8763773 - DNA, 22 bp, Homo sapiens
atttcctgatatatcctgtagt

SEQ ID NO: 8763774 - DNA, 22 bp, Homo sapiens
atttcctgatctgtaaaatagc

SEQ ID NO: 8763775 - DNA, 22 bp, Homo sapiens
atttcctgatttgtaaaattcc

SEQ ID NO: 8763776 - DNA, 22 bp, Homo sapiens
atttcctgcagagcccctccga

SEQ ID NO: 8763777 - DNA, 17 bp, Homo sapiens
atttcctgcaagcccct

SEQ ID NO: 8763778 - DNA, 22 bp, Homo sapiens
atttcctgcaaggagtgggttt

SEQ ID NO: 8763779 - DNA, 22 bp, Homo sapiens
atttcctggttgcattggcttt

SEQ ID NO: 8763780 - DNA, 22 bp, Homo sapiens
atttcctggtaccaggctttct

SEQ ID NO: 8763781 - DNA, 22 bp, Homo sapiens
atttcctggtgtggaagtattt

SEQ ID NO: 8763782 - DNA, 22 bp, Homo sapiens
atttcctgggtctcactccaga

SEQ ID NO: 8763783 - DNA, 22 bp, Homo sapiens
atttcctggagccagtttacct

SEQ ID NO: 8763784 - DNA, 22 bp, Homo sapiens
atttcctgcaggggctggtggg

SEQ ID NO: 8763785 - DNA, 22 bp, Homo sapiens
atttcctggaatgactagtggg

SEQ ID NO: 8763786 - DNA, 22 bp, Homo sapiens
atttcctggaggaatggaagca

SEQ ID NO: 8763787 - DNA, 22 bp, Homo sapiens
atttcctgttgcttttgccact

SEQ ID NO: 8763788 - DNA, 22 bp, Homo sapiens
atttccttcagtgtttaatact

SEQ ID NO: 8763789 - DNA, 22 bp, Homo sapiens
atttcctgtgtctctatttatg

SEQ ID NO: 8763790 - DNA, 22 bp, Homo sapiens
atttcctgtaggggcttgcgaa

SEQ ID NO: 8763791 - DNA, 22 bp, Homo sapiens
atttcctgtaaaatggtactgc

SEQ ID NO: 8763792 - DNA, 22 bp, Homo sapiens
atttcctgtacctatcaaggca

SEQ ID NO: 8763793 - DNA, 22 bp, Homo sapiens
gcattgcaactgacagatcatt

SEQ ID NO: 8763794 - DNA, 22 bp, Homo sapiens
gcattgatctttattctgcttt

SEQ ID NO: 8763795 - DNA, 22 bp, Homo sapiens
gcattgatttaaacatctctct

SEQ ID NO: 8763796 - DNA, 22 bp, Homo sapiens
gcattgcaggtgtacccagtta

SEQ ID NO: 8763797 - DNA, 22 bp, Homo sapiens
gcattgtcaaaagtggtatgac

SEQ ID NO: 8763798 - DNA, 22 bp, Homo sapiens
gcattgttagtctatgcagata

SEQ ID NO: 8763799 - DNA, 22 bp, Homo sapiens
gccaccctggaccaccctgggc

SEQ ID NO: 8763800 - DNA, 22 bp, Homo sapiens
gccaccctggaccaccctgggc

SEQ ID NO: 8763801 - DNA, 22 bp, Homo sapiens
gccaccctgcaaatgcccagga

SEQ ID NO: 8763802 - DNA, 22 bp, Homo sapiens
gccaccctgcaaatgcccagga

SEQ ID NO: 8763803 - DNA, 22 bp, Homo sapiens
gccaccctgacgccgcagaccc

SEQ ID NO: 8763804 - DNA, 18 bp, Homo sapiens
gccaccctcctcgtctcc

SEQ ID NO: 8763805 - DNA, 22 bp, Homo sapiens
gccaccctgagctgggccaggg

SEQ ID NO: 8763806 - DNA, 22 bp, Homo sapiens
gccaccctgagctgggccaggg

SEQ ID NO: 8763807 - DNA, 22 bp, Homo sapiens
gcatttcagaaaggttaccaac

SEQ ID NO: 8763808 - DNA, 22 bp, Homo sapiens
gcatttcaaaattccaggcaag

SEQ ID NO: 8763809 - DNA, 22 bp, Homo sapiens
gcatttatttctttactgcatc

SEQ ID NO: 8763810 - DNA, 22 bp, Homo sapiens
gcatttatttctttactgcatc

SEQ ID NO: 8763811 - DNA, 22 bp, Homo sapiens
gcatttattatctgccaggcac

SEQ ID NO: 8763812 - DNA, 22 bp, Homo sapiens
gcatttatattctgttcggata

SEQ ID NO: 8763813 - DNA, 18 bp, Homo sapiens
gcatttatgcggggctac

SEQ ID NO: 8763814 - DNA, 22 bp, Homo sapiens
gccacctcccaggacgaggctg

SEQ ID NO: 8763815 - DNA, 21 bp, Homo sapiens
gccacctcaatcttctagcgc

SEQ ID NO: 8763816 - DNA, 22 bp, Homo sapiens
gccacccttatcccatgcttct

SEQ ID NO: 8763817 - DNA, 22 bp, Homo sapiens
gccacccttatcccatgcttct

SEQ ID NO: 8763818 - DNA, 18 bp, Homo sapiens
gccaccctcctcgtctcc

SEQ ID NO: 8763819 - DNA, 22 bp, Homo sapiens
gccacccttatcccatgcttct

SEQ ID NO: 8763820 - DNA, 22 bp, Homo sapiens
gccaccctggacgcactgttcg

SEQ ID NO: 8763821 - DNA, 22 bp, Homo sapiens
gccaccctggacgcactgttcg

SEQ ID NO: 8763822 - DNA, 22 bp, Homo sapiens
gccacctccttattccacctgt

SEQ ID NO: 8763823 - DNA, 22 bp, Homo sapiens
gccacctggactcagagccagg

SEQ ID NO: 8763824 - DNA, 22 bp, Homo sapiens
gccacctggactcagagccagg

SEQ ID NO: 8763825 - DNA, 22 bp, Homo sapiens
gccacctggtggcatcttctgg

SEQ ID NO: 8763826 - DNA, 22 bp, Homo sapiens
gccacctgtgtgggcctttgtg

SEQ ID NO: 8763827 - DNA, 22 bp, Homo sapiens
gccacctgtgtgggcctttgtg

SEQ ID NO: 8763828 - DNA, 22 bp, Homo sapiens
gccacctgtgtgggcctttgtg

SEQ ID NO: 8763829 - DNA, 22 bp, Homo sapiens
gccacctgtaagccattaggcc

SEQ ID NO: 8763830 - DNA, 22 bp, Homo sapiens
gccacctgcgggccgtggtgga

SEQ ID NO: 8763831 - DNA, 22 bp, Homo sapiens
gccacctgcgggccgtggtgga

SEQ ID NO: 8763832 - DNA, 22 bp, Homo sapiens
gccacctgccaacttgctggaa

SEQ ID NO: 8763833 - DNA, 22 bp, Homo sapiens
gccacctgccaacttgctggaa

SEQ ID NO: 8763834 - DNA, 22 bp, Homo sapiens
gccacctgcgggccgtggtgga

SEQ ID NO: 8763835 - DNA, 22 bp, Homo sapiens
gccacctggacagctgtgccct

SEQ ID NO: 8763836 - DNA, 22 bp, Homo sapiens
gccacctggacagctgtgccct

SEQ ID NO: 8763837 - DNA, 22 bp, Homo sapiens
gccacctggacagctgtgccct

SEQ ID NO: 8763838 - DNA, 22 bp, Homo sapiens
gccacctgtttcagatgtggtt

SEQ ID NO: 8763839 - DNA, 22 bp, Homo sapiens
gccacctgtttcgcttgcccag

SEQ ID NO: 8763840 - DNA, 22 bp, Homo sapiens
gccacctgtttcgcttgcccag

SEQ ID NO: 8763841 - DNA, 22 bp, Homo sapiens
gcagtttgaggttttctgatgt

SEQ ID NO: 8763842 - DNA, 22 bp, Homo sapiens
gcagtttgaaagtatgagtcca

SEQ ID NO: 8763843 - DNA, 22 bp, Homo sapiens
gcagtttgctggactaatgaag

SEQ ID NO: 8763844 - DNA, 22 bp, Homo sapiens
gcagtttgtttgtggacacctt

SEQ ID NO: 8763845 - DNA, 22 bp, Homo sapiens
gcagtttggaaaatgtgcctct

SEQ ID NO: 8763846 - DNA, 22 bp, Homo sapiens
gcagtttggaaaatgtgcctct

SEQ ID NO: 8763847 - DNA, 22 bp, Homo sapiens
gcagtttgaaagtatgagtcca

SEQ ID NO: 8763848 - DNA, 22 bp, Homo sapiens
gcagtttgaggttttctgatgt

SEQ ID NO: 8763849 - DNA, 22 bp, Homo sapiens
gcagttttattatgatggaaat

SEQ ID NO: 8763850 - DNA, 22 bp, Homo sapiens
gcattacaggctgtaagatgca

SEQ ID NO: 8763851 - DNA, 22 bp, Homo sapiens
gcattacaggctgtaagatgca

SEQ ID NO: 8763852 - DNA, 22 bp, Homo sapiens
gcattacttctttcataggtca

SEQ ID NO: 8763853 - DNA, 22 bp, Homo sapiens
gcattagaagggacctctgggg

SEQ ID NO: 8763854 - DNA, 22 bp, Homo sapiens
gcattacaggaatttgttactg

SEQ ID NO: 8763855 - DNA, 22 bp, Homo sapiens
gcattacaggctgtaagatgca

SEQ ID NO: 8763856 - DNA, 22 bp, Homo sapiens
gcattacagcagttcaacttgg

SEQ ID NO: 8763857 - DNA, 22 bp, Homo sapiens
gcattacaggaatttgttactg

SEQ ID NO: 8763858 - DNA, 22 bp, Homo sapiens
gcattacacatagacattcgtt

SEQ ID NO: 8763859 - DNA, 22 bp, Homo sapiens
gcattacagcagttcaacttgg

SEQ ID NO: 8763860 - DNA, 22 bp, Homo sapiens
gcattacacatagacattcgtt

SEQ ID NO: 8763861 - DNA, 21 bp, Homo sapiens
gcattaaaagcagttgttggt

SEQ ID NO: 8763862 - DNA, 19 bp, Homo sapiens
gcataaaatgtcaatgtgt

SEQ ID NO: 8763863 - DNA, 19 bp, Homo sapiens
gcataaaatgtcaatgtgt

SEQ ID NO: 8763864 - DNA, 22 bp, Homo sapiens
gcattaatgtaagacccactcc

SEQ ID NO: 8763865 - DNA, 22 bp, Homo sapiens
gcattaatgtaagacccactcc

SEQ ID NO: 8763866 - DNA, 22 bp, Homo sapiens
gcattcttgaggtgtggactca

SEQ ID NO: 8763867 - DNA, 22 bp, Homo sapiens
gcattcttggtggagtgctaaa

SEQ ID NO: 8763868 - DNA, 22 bp, Homo sapiens
gcattcttggtatgaaggacag

SEQ ID NO: 8763869 - DNA, 22 bp, Homo sapiens
gcattcttgtttttcctaccct

SEQ ID NO: 8763870 - DNA, 22 bp, Homo sapiens
gcattctttccacgaggaggta

SEQ ID NO: 8763871 - DNA, 22 bp, Homo sapiens
gcattcttcacagtattcctcc

SEQ ID NO: 8763872 - DNA, 22 bp, Homo sapiens
gcattcttcactaggtgagagc

SEQ ID NO: 8763873 - DNA, 22 bp, Homo sapiens
gcattcttcctgggctgggggc

SEQ ID NO: 8763874 - DNA, 22 bp, Homo sapiens
gcattcttcgaagtaagtagtg

SEQ ID NO: 8763875 - DNA, 21 bp, Homo sapiens
gcattcttcatgtgattcaga

SEQ ID NO: 8763876 - DNA, 22 bp, Homo sapiens
gcattcttcacagtattcctcc

SEQ ID NO: 8763877 - DNA, 22 bp, Homo sapiens
gcattcttagggcctggggtgt

SEQ ID NO: 8763878 - DNA, 22 bp, Homo sapiens
gcattctttgaatgcttctaat

SEQ ID NO: 8763879 - DNA, 22 bp, Homo sapiens
gcattctttttgactcctggtt

SEQ ID NO: 8763880 - DNA, 22 bp, Homo sapiens
gcattctttagactgagagata

SEQ ID NO: 8763881 - DNA, 22 bp, Homo sapiens
gcattctttgaatgcttctaat

SEQ ID NO: 8763882 - DNA, 22 bp, Homo sapiens
gcattctttttaggaggttcct

SEQ ID NO: 8763883 - DNA, 17 bp, Homo sapiens
gcagttaaattaagatg

SEQ ID NO: 8763884 - DNA, 22 bp, Homo sapiens
gcagttaaaaataaaccttcat

SEQ ID NO: 8763885 - DNA, 22 bp, Homo sapiens
gcagtgtttttcaatgcttcca

SEQ ID NO: 8763886 - DNA, 21 bp, Homo sapiens
gcagttaatagcagagcacac

SEQ ID NO: 8763887 - DNA, 22 bp, Homo sapiens
gcagtgtttgtgttctcacatg

SEQ ID NO: 8763888 - DNA, 22 bp, Homo sapiens
gcagtgtttgtgttctcacatg

SEQ ID NO: 8763889 - DNA, 23 bp, Homo sapiens
gcagtgtttgcttcatcttatcc

SEQ ID NO: 8763890 - DNA, 22 bp, Homo sapiens
gcagtgtttgtgttctcacatg

SEQ ID NO: 8763891 - DNA, 22 bp, Homo sapiens
gcagttatgtgaatcatgtgac

SEQ ID NO: 8763892 - DNA, 22 bp, Homo sapiens
gcagttatggtttttattgcag

SEQ ID NO: 8763893 - DNA, 22 bp, Homo sapiens
gcagttctacttatccatagac

SEQ ID NO: 8763894 - DNA, 22 bp, Homo sapiens
gcagttgcaggatttgtgttgt

SEQ ID NO: 8763895 - DNA, 22 bp, Homo sapiens
gcagttagcttgtcacagtcct

SEQ ID NO: 8763896 - DNA, 22 bp, Homo sapiens
gcagttcacccaagtgcagaga

SEQ ID NO: 8763897 - DNA, 22 bp, Homo sapiens
gcagttgtaatatgatgtgagg

SEQ ID NO: 8763898 - DNA, 22 bp, Homo sapiens
gcagttggcagggagcccagat

SEQ ID NO: 8763899 - DNA, 16 bp, Homo sapiens
gcagttggggagagct

SEQ ID NO: 8763900 - DNA, 23 bp, Homo sapiens
gcagtgtttgcttcatcttatcc

SEQ ID NO: 8763901 - DNA, 22 bp, Homo sapiens
gcagtgtttcagtgctttttct

SEQ ID NO: 8763902 - DNA, 18 bp, Homo sapiens
gcaggtgccactgctgtt

SEQ ID NO: 8763903 - DNA, 22 bp, Homo sapiens
gcaggtgattcaccctgggcct

SEQ ID NO: 8763904 - DNA, 18 bp, Homo sapiens
gcaggtgccactgctgtt

SEQ ID NO: 8763905 - DNA, 22 bp, Homo sapiens
gcaggtgatgtgatgtgagcat

SEQ ID NO: 8763906 - DNA, 22 bp, Homo sapiens
gcaggtggaagcagcagactca

SEQ ID NO: 8763907 - DNA, 18 bp, Homo sapiens
gcaggtgccactgctgtt

SEQ ID NO: 8763908 - DNA, 22 bp, Homo sapiens
gccaggctaagaaaggtgtgat

SEQ ID NO: 8763909 - DNA, 22 bp, Homo sapiens
gccaggctaagaaaggtgtgat

SEQ ID NO: 8763910 - DNA, 22 bp, Homo sapiens
gccaggcgggtctcaaactcct

SEQ ID NO: 8763911 - DNA, 22 bp, Homo sapiens
gccaggcgggtctcaaactcct

SEQ ID NO: 8763912 - DNA, 22 bp, Homo sapiens
gccaggcatgtcctctgcagaa

SEQ ID NO: 8763913 - DNA, 22 bp, Homo sapiens
gccaggcgggtctcaaactcct

SEQ ID NO: 8763914 - DNA, 22 bp, Homo sapiens
gccaggcattattccgatccct

SEQ ID NO: 8763915 - DNA, 22 bp, Homo sapiens
gccaggcatgtcctctgcagaa

SEQ ID NO: 8763916 - DNA, 22 bp, Homo sapiens
gccaggcatgtcctctgcagaa

SEQ ID NO: 8763917 - DNA, 23 bp, Homo sapiens
gccaggctccggtctgtggccac

SEQ ID NO: 8763918 - DNA, 22 bp, Homo sapiens
gccaggctccccggatccctgg

SEQ ID NO: 8763919 - DNA, 22 bp, Homo sapiens
gccaggctcagcagtcaacctg

SEQ ID NO: 8763920 - DNA, 22 bp, Homo sapiens
gccaggctccaggccctcctga

SEQ ID NO: 8763921 - DNA, 22 bp, Homo sapiens
gcccaaagccagtgtgctctcc

SEQ ID NO: 8763922 - DNA, 22 bp, Homo sapiens
gcccaaagtcactcagctagga

SEQ ID NO: 8763923 - DNA, 22 bp, Homo sapiens
gcccaagatcagtggggcagat

SEQ ID NO: 8763924 - DNA, 23 bp, Homo sapiens
gccaggctccggtctgtggccac

SEQ ID NO: 8763925 - DNA, 23 bp, Homo sapiens
gccaggctccggtctgtggccac

SEQ ID NO: 8763926 - DNA, 23 bp, Homo sapiens
gccaggctccggtctgtggccac

SEQ ID NO: 8763927 - DNA, 21 bp, Homo sapiens
gccatttcacacagacatttg

SEQ ID NO: 8763928 - DNA, 22 bp, Homo sapiens
gccatttggcaaaactgacttc

SEQ ID NO: 8763929 - DNA, 21 bp, Homo sapiens
gccatttcacacagacatttg

SEQ ID NO: 8763930 - DNA, 21 bp, Homo sapiens
gccatttcacacagacatttg

SEQ ID NO: 8763931 - DNA, 21 bp, Homo sapiens
gccatttcacacagacatttg

SEQ ID NO: 8763932 - DNA, 22 bp, Homo sapiens
gcccaaggtatatcagagacag

SEQ ID NO: 8763933 - DNA, 22 bp, Homo sapiens
gcccaaggtatatcagagacag

SEQ ID NO: 8763934 - DNA, 22 bp, Homo sapiens
gcccaaggtatatcagagacag

SEQ ID NO: 8763935 - DNA, 22 bp, Homo sapiens
gcccaagggcatcaagttctac

SEQ ID NO: 8763936 - DNA, 20 bp, Homo sapiens
gcccaaggtccagaaggggg

SEQ ID NO: 8763937 - DNA, 20 bp, Homo sapiens
gcccaaggtccagaaggggg

SEQ ID NO: 8763938 - DNA, 22 bp, Homo sapiens
gcccaaggtcacacacaggaag

SEQ ID NO: 8763939 - DNA, 22 bp, Homo sapiens
gcccaaggtcacacacaggaag

SEQ ID NO: 8763940 - DNA, 20 bp, Homo sapiens
gcccaagcgccggccgcaga

SEQ ID NO: 8763941 - DNA, 22 bp, Homo sapiens
gcccaagccggagctgggagag

SEQ ID NO: 8763942 - DNA, 22 bp, Homo sapiens
gcccaagctggactgcagtggc

SEQ ID NO: 8763943 - DNA, 22 bp, Homo sapiens
gcccaagggcatcaagttctac

SEQ ID NO: 8763944 - DNA, 22 bp, Homo sapiens
gcccaagctggactgcagtggc

SEQ ID NO: 8763945 - DNA, 22 bp, Homo sapiens
gcccaagctccgcctcctgtcg

SEQ ID NO: 8763946 - DNA, 22 bp, Homo sapiens
gccaggaacacaatgccaagct

SEQ ID NO: 8763947 - DNA, 22 bp, Homo sapiens
gccaggaaattcatgccagatc

SEQ ID NO: 8763948 - DNA, 22 bp, Homo sapiens
gccaggaagcagttagatgggt

SEQ ID NO: 8763949 - DNA, 18 bp, Homo sapiens
gccaggaagaggaatgtg

SEQ ID NO: 8763950 - DNA, 22 bp, Homo sapiens
gccaggaatgcataaatgacct

SEQ ID NO: 8763951 - DNA, 22 bp, Homo sapiens
gccaggcatgtcctctgcagaa

SEQ ID NO: 8763952 - DNA, 22 bp, Homo sapiens
gccaggaagttgggccagtcta

SEQ ID NO: 8763953 - DNA, 22 bp, Homo sapiens
gccaggaagttgggccagtcta

SEQ ID NO: 8763954 - DNA, 22 bp, Homo sapiens
gccaggaaggctccctggtcac

SEQ ID NO: 8763955 - DNA, 23 bp, Homo sapiens
gccagctttggtctgtctcctag

SEQ ID NO: 8763956 - DNA, 22 bp, Homo sapiens
gccaggaaaaagggtggccaat

SEQ ID NO: 8763957 - DNA, 22 bp, Homo sapiens
gccaggaaaaagggtggccaat

SEQ ID NO: 8763958 - DNA, 19 bp, Homo sapiens
gccaggaaagaatcaggcg

SEQ ID NO: 8763959 - DNA, 22 bp, Homo sapiens
gccaggaaagcaaaatcaccca

SEQ ID NO: 8763960 - DNA, 22 bp, Homo sapiens
gccagctgttcagacattcttt

SEQ ID NO: 8763961 - DNA, 22 bp, Homo sapiens
gccagctgtgcttttcctaaaa

SEQ ID NO: 8763962 - DNA, 22 bp, Homo sapiens
gccagctgtgcttttcctaaaa

SEQ ID NO: 8763963 - DNA, 22 bp, Homo sapiens
gccagctgtctaagagagtaaa

SEQ ID NO: 8763964 - DNA, 22 bp, Homo sapiens
gccagctgtaagcagtgattct

SEQ ID NO: 8763965 - DNA, 22 bp, Homo sapiens
gccagctgtaggtggtgggttg

SEQ ID NO: 8763966 - DNA, 22 bp, Homo sapiens
gccagctgtaagctggggtgat

SEQ ID NO: 8763967 - DNA, 22 bp, Homo sapiens
gccagctgtctaagagagtaaa

SEQ ID NO: 8763968 - DNA, 22 bp, Homo sapiens
gccagctgaggccgtgcaggct

SEQ ID NO: 8763969 - DNA, 22 bp, Homo sapiens
gccagctggctgcaggtcccag

SEQ ID NO: 8763970 - DNA, 22 bp, Homo sapiens
gccagctggtaggcacctagcc

SEQ ID NO: 8763971 - DNA, 22 bp, Homo sapiens
gccagctggtaggcacctagcc

SEQ ID NO: 8763972 - DNA, 22 bp, Homo sapiens
gccagaaggggtggatccaggc

SEQ ID NO: 8763973 - DNA, 22 bp, Homo sapiens
gccagaccagctgtgattccag

SEQ ID NO: 8763974 - DNA, 22 bp, Homo sapiens
gccagagacacttggaggtaga

SEQ ID NO: 8763975 - DNA, 22 bp, Homo sapiens
gccagctgaggccgtgcaggct

SEQ ID NO: 8763976 - DNA, 22 bp, Homo sapiens
gccagctgagaaatcattgata

SEQ ID NO: 8763977 - DNA, 22 bp, Homo sapiens
gccacttgtgtaagcgcctgtc

SEQ ID NO: 8763978 - DNA, 22 bp, Homo sapiens
gccagaagcacatgagaggtga

SEQ ID NO: 8763979 - DNA, 22 bp, Homo sapiens
gcctgcagggtgatgggctgcc

SEQ ID NO: 8763980 - DNA, 23 bp, Homo sapiens
gcctggagaaaagctgcagttca

SEQ ID NO: 8763981 - DNA, 21 bp, Homo sapiens
gcctgcagttttgaagccctt

SEQ ID NO: 8763982 - DNA, 22 bp, Homo sapiens
gcctgcagttctgtgctaggca

SEQ ID NO: 8763983 - DNA, 22 bp, Homo sapiens
gcctgcagttctgtgctaggca

SEQ ID NO: 8763984 - DNA, 22 bp, Homo sapiens
gcctgcagtgagtgcagaaggt

SEQ ID NO: 8763985 - DNA, 22 bp, Homo sapiens
gcctggagaaaggaaggtggga

SEQ ID NO: 8763986 - DNA, 22 bp, Homo sapiens
gcctggagaaaggaaggtggga

SEQ ID NO: 8763987 - DNA, 22 bp, Homo sapiens
gcctggagaaaggaaggtggga

SEQ ID NO: 8763988 - DNA, 22 bp, Homo sapiens
gcctggagaagatggaactagc

SEQ ID NO: 8763989 - DNA, 22 bp, Homo sapiens
gcctggagacaaggacaaaggg

SEQ ID NO: 8763990 - DNA, 22 bp, Homo sapiens
gcctggagaattaaaaggaagg

SEQ ID NO: 8763991 - DNA, 22 bp, Homo sapiens
gcctggagaggaagccggtgga

SEQ ID NO: 8763992 - DNA, 22 bp, Homo sapiens
gcctggagaggaagccggtgga

SEQ ID NO: 8763993 - DNA, 22 bp, Homo sapiens
gcctggagcagacgtgtcccgg

SEQ ID NO: 8763994 - DNA, 22 bp, Homo sapiens
gcctggagacctgctcctctac

SEQ ID NO: 8763995 - DNA, 22 bp, Homo sapiens
gcctggagagcactgtgcgctt

SEQ ID NO: 8763996 - DNA, 22 bp, Homo sapiens
gcctggagacagcagaggcggc

SEQ ID NO: 8763997 - DNA, 22 bp, Homo sapiens
gcctggagacagcagaggcggc

SEQ ID NO: 8763998 - DNA, 22 bp, Homo sapiens
gcctggagacagcagaggcggc

SEQ ID NO: 8763999 - DNA, 22 bp, Homo sapiens
gcctggagtgcagtggcgtgat

SEQ ID NO: 8764000 - DNA, 22 bp, Homo sapiens
gcctggagtgcagtggcgtgat

SEQ ID NO: 8764001 - DNA, 22 bp, Homo sapiens
gcctggagtggacttggcccct

SEQ ID NO: 8764002 - DNA, 16 bp, Homo sapiens
gcctggagtggcaggg

SEQ ID NO: 8764003 - DNA, 16 bp, Homo sapiens
gcctggagtggcaggg

SEQ ID NO: 8764004 - DNA, 22 bp, Homo sapiens
gcctggagtagcatggcaagcc

SEQ ID NO: 8764005 - DNA, 22 bp, Homo sapiens
gcctggagtagcatggcaagcc

SEQ ID NO: 8764006 - DNA, 22 bp, Homo sapiens
gcctggagcccagtgtggggct

SEQ ID NO: 8764007 - DNA, 22 bp, Homo sapiens
gcctggagcccagtgtggggct

SEQ ID NO: 8764008 - DNA, 22 bp, Homo sapiens
gcctggagcccagtgtggggct

SEQ ID NO: 8764009 - DNA, 20 bp, Homo sapiens
gcctgcagagaaggtcagag

SEQ ID NO: 8764010 - DNA, 20 bp, Homo sapiens
gcctgcagagaaggtcagag

SEQ ID NO: 8764011 - DNA, 22 bp, Homo sapiens
gcctgcagaactgtgaggcaat

SEQ ID NO: 8764012 - DNA, 21 bp, Homo sapiens
gcctgcagaccccaccaggct

SEQ ID NO: 8764013 - DNA, 22 bp, Homo sapiens
gcctgcacccacaggcatggcc

SEQ ID NO: 8764014 - DNA, 22 bp, Homo sapiens
gcctgcaactggcacagcttgt

SEQ ID NO: 8764015 - DNA, 22 bp, Homo sapiens
gcctgcaagatggctggtcact

SEQ ID NO: 8764016 - DNA, 22 bp, Homo sapiens
gcctgcaaacctgaagatttaa

SEQ ID NO: 8764017 - DNA, 22 bp, Homo sapiens
gcctgcaacatccttgctcctg

SEQ ID NO: 8764018 - DNA, 22 bp, Homo sapiens
gcctgagtgcatctgcagacat

SEQ ID NO: 8764019 - DNA, 22 bp, Homo sapiens
gcctgagtttgaactctagctc

SEQ ID NO: 8764020 - DNA, 22 bp, Homo sapiens
gcctgagtgcatctgcagacat

SEQ ID NO: 8764021 - DNA, 22 bp, Homo sapiens
gcctgatgagcttccagctgag

SEQ ID NO: 8764022 - DNA, 22 bp, Homo sapiens
gcctgcaaacaaggacttctga

SEQ ID NO: 8764023 - DNA, 22 bp, Homo sapiens
gcctgcactcaaacactctctt

SEQ ID NO: 8764024 - DNA, 19 bp, Homo sapiens
gcctgcagaaaaggcaggg

SEQ ID NO: 8764025 - DNA, 19 bp, Homo sapiens
gcctgcagaaaaggcaggg

SEQ ID NO: 8764026 - DNA, 22 bp, Homo sapiens
gcctgcagaactgtgaggcaat

SEQ ID NO: 8764027 - DNA, 22 bp, Homo sapiens
gcctgcagcccctctgcagtag

SEQ ID NO: 8764028 - DNA, 22 bp, Homo sapiens
gcctgcagcctcaagggctgag

SEQ ID NO: 8764029 - DNA, 22 bp, Homo sapiens
gcctgcagaggtgctgctagct

SEQ ID NO: 8764030 - DNA, 22 bp, Homo sapiens
gcctgcagaggtgctgctagct

SEQ ID NO: 8764031 - DNA, 22 bp, Homo sapiens
gcctgcagaggtgctgctagct

SEQ ID NO: 8764032 - DNA, 22 bp, Homo sapiens
gcctgcagcctcaagggctgag

SEQ ID NO: 8764033 - DNA, 22 bp, Homo sapiens
gcctgcagctgcttccacacac

SEQ ID NO: 8764034 - DNA, 22 bp, Homo sapiens
gcctgcagctgcttccacacac

SEQ ID NO: 8764035 - DNA, 22 bp, Homo sapiens
gcctcccctgcaattgtccttg

SEQ ID NO: 8764036 - DNA, 22 bp, Homo sapiens
gcctcccctgcaattgtccttg

SEQ ID NO: 8764037 - DNA, 22 bp, Homo sapiens
gcctccctccaccactgcaggt

SEQ ID NO: 8764038 - DNA, 22 bp, Homo sapiens
gcctccctccaccactgcaggt

SEQ ID NO: 8764039 - DNA, 22 bp, Homo sapiens
gcctccctccaccactgcaggt

SEQ ID NO: 8764040 - DNA, 22 bp, Homo sapiens
gcctccctccaccactgcaggt

SEQ ID NO: 8764041 - DNA, 22 bp, Homo sapiens
gcctccctggcccacagcagcg

SEQ ID NO: 8764042 - DNA, 22 bp, Homo sapiens
gcctccctggcccacagcagcg

SEQ ID NO: 8764043 - DNA, 22 bp, Homo sapiens
gcctccctgagtcacccaagca

SEQ ID NO: 8764044 - DNA, 22 bp, Homo sapiens
gcctccctgagtcacccaagca

SEQ ID NO: 8764045 - DNA, 22 bp, Homo sapiens
gcctccctccaccactgcaggt

SEQ ID NO: 8764046 - DNA, 22 bp, Homo sapiens
gcctccctggcccacagcagcg

SEQ ID NO: 8764047 - DNA, 22 bp, Homo sapiens
gcctccctggcccacagcagcg

SEQ ID NO: 8764048 - DNA, 22 bp, Homo sapiens
gcctccctgagtcacccaagca

SEQ ID NO: 8764049 - DNA, 22 bp, Homo sapiens
gcctccaccgaacgctctcttg

SEQ ID NO: 8764050 - DNA, 22 bp, Homo sapiens
gcctccccaggggtgtcatgag

SEQ ID NO: 8764051 - DNA, 22 bp, Homo sapiens
gcctccctgtttcctgctccaa

SEQ ID NO: 8764052 - DNA, 22 bp, Homo sapiens
gcctccctgtttcctgctccaa

SEQ ID NO: 8764053 - DNA, 22 bp, Homo sapiens
gcctccctgtttcctgctccaa

SEQ ID NO: 8764054 - DNA, 22 bp, Homo sapiens
gcctccctgttcttccacaata

SEQ ID NO: 8764055 - DNA, 22 bp, Homo sapiens
gcctccctgttcttccacaata

SEQ ID NO: 8764056 - DNA, 18 bp, Homo sapiens
gcctccctggctacactt

SEQ ID NO: 8764057 - DNA, 18 bp, Homo sapiens
gcctccctggctacactt

SEQ ID NO: 8764058 - DNA, 22 bp, Homo sapiens
gcctccctgtagaggccagcct

SEQ ID NO: 8764059 - DNA, 22 bp, Homo sapiens
gcctccctgtagaggccagcct

SEQ ID NO: 8764060 - DNA, 18 bp, Homo sapiens
gcctccctggctacactt

SEQ ID NO: 8764061 - DNA, 22 bp, Homo sapiens
gcctccctgtagaggccagcct

SEQ ID NO: 8764062 - DNA, 22 bp, Homo sapiens
gcctgagggctcctagcaggct

SEQ ID NO: 8764063 - DNA, 22 bp, Homo sapiens
gcctgaggaatgctcctgactt

SEQ ID NO: 8764064 - DNA, 22 bp, Homo sapiens
gcctgagggctcctagcaggct

SEQ ID NO: 8764065 - DNA, 22 bp, Homo sapiens
gcctgagggctcctagcaggct

SEQ ID NO: 8764066 - DNA, 22 bp, Homo sapiens
gcctgagggctcctagcaggct

SEQ ID NO: 8764067 - DNA, 22 bp, Homo sapiens
gcctgagtaaatatgcggcagg

SEQ ID NO: 8764068 - DNA, 22 bp, Homo sapiens
gcctgagtgcatctgcagacat

SEQ ID NO: 8764069 - DNA, 22 bp, Homo sapiens
gcctgagtcaagatgtggcacc

SEQ ID NO: 8764070 - DNA, 22 bp, Homo sapiens
gcccacagaggcaccaccaggc

SEQ ID NO: 8764071 - DNA, 22 bp, Homo sapiens
gcccacagaggcaccaccaggc

SEQ ID NO: 8764072 - DNA, 22 bp, Homo sapiens
gcccacaccatttattctttgt

SEQ ID NO: 8764073 - DNA, 22 bp, Homo sapiens
gccccaggggaggtgccctgca

SEQ ID NO: 8764074 - DNA, 22 bp, Homo sapiens
gcccacaggggacctggtggct

SEQ ID NO: 8764075 - DNA, 22 bp, Homo sapiens
gcccacagctcgttcctctcct

SEQ ID NO: 8764076 - DNA, 20 bp, Homo sapiens
gcccaaggtccagaaggggg

SEQ ID NO: 8764077 - DNA, 22 bp, Homo sapiens
gcccaaggtcccatggcagcac

SEQ ID NO: 8764078 - DNA, 22 bp, Homo sapiens
gcccaaggtcccatggcagcac

SEQ ID NO: 8764079 - DNA, 22 bp, Homo sapiens
gcccaaggtcccatggcagcac

SEQ ID NO: 8764080 - DNA, 22 bp, Homo sapiens
gcccacacaccagctcaggagg

SEQ ID NO: 8764081 - DNA, 22 bp, Homo sapiens
gcccacacagcagatcctttgg

SEQ ID NO: 8764082 - DNA, 22 bp, Homo sapiens
gcccctggctggccagctcctc

SEQ ID NO: 8764083 - DNA, 22 bp, Homo sapiens
gcccctggctggccagctcctc

SEQ ID NO: 8764084 - DNA, 22 bp, Homo sapiens
gcccctctccttgtgcacctgc

SEQ ID NO: 8764085 - DNA, 22 bp, Homo sapiens
gcccctctcccttgaggcaggc

SEQ ID NO: 8764086 - DNA, 22 bp, Homo sapiens
gcccctccgggcgcgtcatagc

SEQ ID NO: 8764087 - DNA, 22 bp, Homo sapiens
gcccctccgggcgcgtcatagc

SEQ ID NO: 8764088 - DNA, 22 bp, Homo sapiens
gcccctctccttgtgcacctgc

SEQ ID NO: 8764089 - DNA, 22 bp, Homo sapiens
gcccctctcccttgaggcaggc

SEQ ID NO: 8764090 - DNA, 22 bp, Homo sapiens
gcccctctccttgtgcacctgc

SEQ ID NO: 8764091 - DNA, 22 bp, Homo sapiens
gcccctcccagtcaggagcact

SEQ ID NO: 8764092 - DNA, 22 bp, Homo sapiens
gcccctcccagtcaggagcact

SEQ ID NO: 8764093 - DNA, 22 bp, Homo sapiens
gcccctcccagtcaggagcact

SEQ ID NO: 8764094 - DNA, 22 bp, Homo sapiens
gcccctccatccatcaccgggg

SEQ ID NO: 8764095 - DNA, 22 bp, Homo sapiens
gcccctccatccatcaccgggg

SEQ ID NO: 8764096 - DNA, 22 bp, Homo sapiens
gcccctccatccatcaccgggg

SEQ ID NO: 8764097 - DNA, 22 bp, Homo sapiens
gccccaggtggtaaacctaaga

SEQ ID NO: 8764098 - DNA, 22 bp, Homo sapiens
gccccaggtggtaaacctaaga

SEQ ID NO: 8764099 - DNA, 22 bp, Homo sapiens
gccccaggggaggtgccctgca

SEQ ID NO: 8764100 - DNA, 22 bp, Homo sapiens
gccccaggtggtaaacctaaga

SEQ ID NO: 8764101 - DNA, 22 bp, Homo sapiens
gccccttcgtggaagtgcattc

SEQ ID NO: 8764102 - DNA, 22 bp, Homo sapiens
gccccttccatcatgtgaggac

SEQ ID NO: 8764103 - DNA, 22 bp, Homo sapiens
gccccttgtctccaggccccaa

SEQ ID NO: 8764104 - DNA, 22 bp, Homo sapiens
gccccttctctgaggaacctgc

SEQ ID NO: 8764105 - DNA, 22 bp, Homo sapiens
gccccttcttctggagattcaa

SEQ ID NO: 8764106 - DNA, 22 bp, Homo sapiens
gccccttgggaattcctccact

SEQ ID NO: 8764107 - DNA, 22 bp, Homo sapiens
gcccggccaggaacagagtata

SEQ ID NO: 8764108 - DNA, 22 bp, Homo sapiens
gcccgcgccagcctctccatct

SEQ ID NO: 8764109 - DNA, 22 bp, Homo sapiens
gcccgcgccagcctctccatct

SEQ ID NO: 8764110 - DNA, 22 bp, Homo sapiens
gccctagcccgggccacctgtt

SEQ ID NO: 8764111 - DNA, 22 bp, Homo sapiens
gcccggccaggaacagagtata

SEQ ID NO: 8764112 - DNA, 22 bp, Homo sapiens
gcccgtgtctcctgctctgtgg

SEQ ID NO: 8764113 - DNA, 19 bp, Homo sapiens
gccctgagtaagctaggag

SEQ ID NO: 8764114 - DNA, 19 bp, Homo sapiens
gccctgagtaagctaggag

SEQ ID NO: 8764115 - DNA, 22 bp, Homo sapiens
gccctgagtggtacctgtgggt

SEQ ID NO: 8764116 - DNA, 22 bp, Homo sapiens
gccctgagtggtacctgtgggt

SEQ ID NO: 8764117 - DNA, 22 bp, Homo sapiens
gccctcagaggacagctgactt

SEQ ID NO: 8764118 - DNA, 22 bp, Homo sapiens
gccctcagagttccccacagtg

SEQ ID NO: 8764119 - DNA, 22 bp, Homo sapiens
gccctaggcttttgtgactgcc

SEQ ID NO: 8764120 - DNA, 22 bp, Homo sapiens
gccctcagaggacagctgactt

SEQ ID NO: 8764121 - DNA, 22 bp, Homo sapiens
gccctcagaggacagctgactt

SEQ ID NO: 8764122 - DNA, 22 bp, Homo sapiens
gccctcagaatgggctctaatc

SEQ ID NO: 8764123 - DNA, 22 bp, Homo sapiens
gccctagggcttttgggcctgt

SEQ ID NO: 8764124 - DNA, 22 bp, Homo sapiens
gcctcatgagggatctgccctc

SEQ ID NO: 8764125 - DNA, 22 bp, Homo sapiens
gcctcatcgctgctcggcccgg

SEQ ID NO: 8764126 - DNA, 22 bp, Homo sapiens
gcctcatctaagagattccttc

SEQ ID NO: 8764127 - DNA, 20 bp, Homo sapiens
gcctccaccccaggcttcag

SEQ ID NO: 8764128 - DNA, 19 bp, Homo sapiens
gcctcatttccacctcccc

SEQ ID NO: 8764129 - DNA, 22 bp, Homo sapiens
gcctcagggggagaggccagct

SEQ ID NO: 8764130 - DNA, 22 bp, Homo sapiens
gcctcagggggagaggccagct

SEQ ID NO: 8764131 - DNA, 22 bp, Homo sapiens
gcctcagggggagaggccagct

SEQ ID NO: 8764132 - DNA, 22 bp, Homo sapiens
gcctcagggggagaggccagct

SEQ ID NO: 8764133 - DNA, 22 bp, Homo sapiens
gcctcagggggagaggccagct

SEQ ID NO: 8764134 - DNA, 22 bp, Homo sapiens
gccctgcttctggcatgcagaa

SEQ ID NO: 8764135 - DNA, 22 bp, Homo sapiens
gccctgcttctggcatgcagaa

SEQ ID NO: 8764136 - DNA, 22 bp, Homo sapiens
gccctggaatctctccatggga

SEQ ID NO: 8764137 - DNA, 22 bp, Homo sapiens
gccctggacagtgacggtgacc

SEQ ID NO: 8764138 - DNA, 22 bp, Homo sapiens
gccctgcctgtctgctgggagg

SEQ ID NO: 8764139 - DNA, 22 bp, Homo sapiens
gccctgcctgtctgctgggagg

SEQ ID NO: 8764140 - DNA, 22 bp, Homo sapiens
gccctgcctgtctgctgggagg

SEQ ID NO: 8764141 - DNA, 17 bp, Homo sapiens
gccctgcctgctgccct

SEQ ID NO: 8764142 - DNA, 17 bp, Homo sapiens
gccctgcctgctgccct

SEQ ID NO: 8764143 - DNA, 17 bp, Homo sapiens
gccctgcctgctgccct

SEQ ID NO: 8764144 - DNA, 22 bp, Homo sapiens
gccctgcgccgtcccgctggtg

SEQ ID NO: 8764145 - DNA, 22 bp, Homo sapiens
gccctgctccaggagaataccc

SEQ ID NO: 8764146 - DNA, 23 bp, Homo sapiens
gccctgctcctggctgggaggga

SEQ ID NO: 8764147 - DNA, 22 bp, Homo sapiens
gccctgctctggtctctgcccg

SEQ ID NO: 8764148 - DNA, 22 bp, Homo sapiens
gccctgctctggtctctgcccg

SEQ ID NO: 8764149 - DNA, 22 bp, Homo sapiens
gccctgctgcgcagcacgcatg

SEQ ID NO: 8764150 - DNA, 22 bp, Homo sapiens
gccctgctgctggcagaggcgc

SEQ ID NO: 8764151 - DNA, 22 bp, Homo sapiens
gccctgctgctggcagaggcgc

SEQ ID NO: 8764152 - DNA, 23 bp, Homo sapiens
gccctgctgggacctcctgctac

SEQ ID NO: 8764153 - DNA, 22 bp, Homo sapiens
gccctgctgtcttcagagtata

SEQ ID NO: 8764154 - DNA, 22 bp, Homo sapiens
gccctgctgtttagagagctac

SEQ ID NO: 8764155 - DNA, 22 bp, Homo sapiens
gccctgctggggcacagcaaga

SEQ ID NO: 8764156 - DNA, 22 bp, Homo sapiens
gccctgctgtcttcagagtata

SEQ ID NO: 8764157 - DNA, 23 bp, Homo sapiens
gccctgctgggacctcctgctac

SEQ ID NO: 8764158 - DNA, 22 bp, Homo sapiens
gcagggcatgggccctgtctgc

SEQ ID NO: 8764159 - DNA, 22 bp, Homo sapiens
gcagggcatgggccctgtctgc

SEQ ID NO: 8764160 - DNA, 22 bp, Homo sapiens
gcagggccagggctcaggctgt

SEQ ID NO: 8764161 - DNA, 22 bp, Homo sapiens
gcagggccagggctcaggctgt

SEQ ID NO: 8764162 - DNA, 22 bp, Homo sapiens
gcagggccagggctcaggctgt

SEQ ID NO: 8764163 - DNA, 22 bp, Homo sapiens
gcagggccagggctcaggctgt

SEQ ID NO: 8764164 - DNA, 22 bp, Homo sapiens
gcagggcaggatttgaacccag

SEQ ID NO: 8764165 - DNA, 22 bp, Homo sapiens
gcagggcaggatttgaacccag

SEQ ID NO: 8764166 - DNA, 22 bp, Homo sapiens
gcagggcagggcaagaactggg

SEQ ID NO: 8764167 - DNA, 22 bp, Homo sapiens
gcagggcagggcaagaactggg

SEQ ID NO: 8764168 - DNA, 22 bp, Homo sapiens
gcagggcagtaagagctagagt

SEQ ID NO: 8764169 - DNA, 22 bp, Homo sapiens
gcagggtgtgtctcatacagtt

SEQ ID NO: 8764170 - DNA, 22 bp, Homo sapiens
gcagggtgtgtctcatacagtt

SEQ ID NO: 8764171 - DNA, 19 bp, Homo sapiens
gcagggtgttgactgtccc

SEQ ID NO: 8764172 - DNA, 19 bp, Homo sapiens
gcagggtggcagagctctt

SEQ ID NO: 8764173 - DNA, 22 bp, Homo sapiens
gcagggccagtgcagagaggaa

SEQ ID NO: 8764174 - DNA, 22 bp, Homo sapiens
gcagggccaggtacaagaagca

SEQ ID NO: 8764175 - DNA, 22 bp, Homo sapiens
gcagggccaggtacaagaagca

SEQ ID NO: 8764176 - DNA, 22 bp, Homo sapiens
gcagggccaggtacaagaagca

SEQ ID NO: 8764177 - DNA, 22 bp, Homo sapiens
gcagggccagtgcagagaggaa

SEQ ID NO: 8764178 - DNA, 22 bp, Homo sapiens
gcagggccagtgcagagaggaa

SEQ ID NO: 8764179 - DNA, 22 bp, Homo sapiens
gcagggccagtgcagagaggaa

SEQ ID NO: 8764180 - DNA, 22 bp, Homo sapiens
gcagggccagtgcagagaggaa

SEQ ID NO: 8764181 - DNA, 22 bp, Homo sapiens
gcaggtctcaatctgagcaggc

SEQ ID NO: 8764182 - DNA, 22 bp, Homo sapiens
gcaggtctggagggcactgggg

SEQ ID NO: 8764183 - DNA, 22 bp, Homo sapiens
gcaggtctatcaggctgcaggt

SEQ ID NO: 8764184 - DNA, 22 bp, Homo sapiens
gcaggtctgttgattacagtca

SEQ ID NO: 8764185 - DNA, 22 bp, Homo sapiens
gcaggtctggcatagagcctgc

SEQ ID NO: 8764186 - DNA, 22 bp, Homo sapiens
gcaggtcttgaaggtgtgattt

SEQ ID NO: 8764187 - DNA, 22 bp, Homo sapiens
gcaggtgaaagtgagtagtgag

SEQ ID NO: 8764188 - DNA, 22 bp, Homo sapiens
gcaggtgaaagtgagtagtgag

SEQ ID NO: 8764189 - DNA, 22 bp, Homo sapiens
gcaggtgaatgatggactagga

SEQ ID NO: 8764190 - DNA, 22 bp, Homo sapiens
gcaggtgaaagtgagtagtgag

SEQ ID NO: 8764191 - DNA, 22 bp, Homo sapiens
gcaggtgaatgatggactagga

SEQ ID NO: 8764192 - DNA, 19 bp, Homo sapiens
gcaggtgagccgtggctcc

SEQ ID NO: 8764193 - DNA, 22 bp, Homo sapiens
gcaggtgatgtgatgtgagcat

SEQ ID NO: 8764194 - DNA, 22 bp, Homo sapiens
gcaggtgatgtgatgtgagcat

SEQ ID NO: 8764195 - DNA, 22 bp, Homo sapiens
gcaggtgatgtgatgtgagcat

SEQ ID NO: 8764196 - DNA, 19 bp, Homo sapiens
gcagggtgttgactgtccc

SEQ ID NO: 8764197 - DNA, 22 bp, Homo sapiens
gcaggtaagagaggctggcttc

SEQ ID NO: 8764198 - DNA, 19 bp, Homo sapiens
gcaggtagagacagcagcc

SEQ ID NO: 8764199 - DNA, 22 bp, Homo sapiens
gcaggtctagaagctgcctctg

SEQ ID NO: 8764200 - DNA, 20 bp, Homo sapiens
gcaggtccctggcatgcaga

SEQ ID NO: 8764201 - DNA, 22 bp, Homo sapiens
gcaggtctagaagctgcctctg

SEQ ID NO: 8764202 - DNA, 22 bp, Homo sapiens
gcaggtcccagaaagttaattc

SEQ ID NO: 8764203 - DNA, 19 bp, Homo sapiens
gcaggtcattaggctaggt

SEQ ID NO: 8764204 - DNA, 19 bp, Homo sapiens
gcaggtcattaggctaggt

SEQ ID NO: 8764205 - DNA, 22 bp, Homo sapiens
gcaggtagtgatcgagggtgac

SEQ ID NO: 8764206 - DNA, 22 bp, Homo sapiens
gcaggtagtgatcgagggtgac

SEQ ID NO: 8764207 - DNA, 22 bp, Homo sapiens
gcaggtagtgatcgagggtgac

SEQ ID NO: 8764208 - DNA, 22 bp, Homo sapiens
gcaggccaagccctcgcagaga

SEQ ID NO: 8764209 - DNA, 22 bp, Homo sapiens
gcaggccaagccctcgcagaga

SEQ ID NO: 8764210 - DNA, 22 bp, Homo sapiens
gcaggccaagccctcgcagaga

SEQ ID NO: 8764211 - DNA, 22 bp, Homo sapiens
gcaggcatctctgtagccaggg

SEQ ID NO: 8764212 - DNA, 22 bp, Homo sapiens
gcaggcatggtcgctgccaggt

SEQ ID NO: 8764213 - DNA, 22 bp, Homo sapiens
gcaggcagtttgcttttccctc

SEQ ID NO: 8764214 - DNA, 22 bp, Homo sapiens
gcagctgtcagaagttggaatc

SEQ ID NO: 8764215 - DNA, 22 bp, Homo sapiens
gcagctgtcactttcacaatgc

SEQ ID NO: 8764216 - DNA, 22 bp, Homo sapiens
gcagctgtagaggggagaaaga

SEQ ID NO: 8764217 - DNA, 22 bp, Homo sapiens
gcagctgtatcacttttaaaca

SEQ ID NO: 8764218 - DNA, 23 bp, Homo sapiens
gcagctggttagaagggaaggag

SEQ ID NO: 8764219 - DNA, 22 bp, Homo sapiens
gcagctgtaaagcagaaatagt

SEQ ID NO: 8764220 - DNA, 22 bp, Homo sapiens
gcagctgtactggcagcattgt

SEQ ID NO: 8764221 - DNA, 23 bp, Homo sapiens
gcagctggttagaagggaaggag

SEQ ID NO: 8764222 - DNA, 22 bp, Homo sapiens
gcaggccagctgtgcagatggg

SEQ ID NO: 8764223 - DNA, 22 bp, Homo sapiens
gcaggccactgtctcctctggg

SEQ ID NO: 8764224 - DNA, 22 bp, Homo sapiens
gcaggccagctgtgcagatggg

SEQ ID NO: 8764225 - DNA, 22 bp, Homo sapiens
gcaggccactgtctcctctggg

SEQ ID NO: 8764226 - DNA, 22 bp, Homo sapiens
gcaggccacagtggagtctctg

SEQ ID NO: 8764227 - DNA, 22 bp, Homo sapiens
gcaggccattcaggagatgtgc

SEQ ID NO: 8764228 - DNA, 22 bp, Homo sapiens
gcaggccattcaggagatgtgc

SEQ ID NO: 8764229 - DNA, 22 bp, Homo sapiens
gcaggccattcaggagatgtgc

SEQ ID NO: 8764230 - DNA, 22 bp, Homo sapiens
gcaggcccagagtcgctggcct

SEQ ID NO: 8764231 - DNA, 19 bp, Homo sapiens
gcaggccaggaggcggagg

SEQ ID NO: 8764232 - DNA, 19 bp, Homo sapiens
gcaggccaggaggcggagg

SEQ ID NO: 8764233 - DNA, 19 bp, Homo sapiens
gcaggccaggaggcggagg

SEQ ID NO: 8764234 - DNA, 19 bp, Homo sapiens
gcaggccaggaggcggagg

SEQ ID NO: 8764235 - DNA, 22 bp, Homo sapiens
gcaggccagctgtgcagatggg

SEQ ID NO: 8764236 - DNA, 22 bp, Homo sapiens
gcaggccaggctaggggctgtc

SEQ ID NO: 8764237 - DNA, 22 bp, Homo sapiens
gcaggccaggctaggggctgtc

SEQ ID NO: 8764238 - DNA, 22 bp, Homo sapiens
gcagggcagcttagtccctgtc

SEQ ID NO: 8764239 - DNA, 22 bp, Homo sapiens
gcagggcagcttagtccctgtc

SEQ ID NO: 8764240 - DNA, 22 bp, Homo sapiens
gcagggcagcttagtccctgtc

SEQ ID NO: 8764241 - DNA, 22 bp, Homo sapiens
gcagggcagctgaagctaggtg

SEQ ID NO: 8764242 - DNA, 22 bp, Homo sapiens
gcagggcagctgaagctaggtg

SEQ ID NO: 8764243 - DNA, 22 bp, Homo sapiens
gcagggcagctcactgtggttc

SEQ ID NO: 8764244 - DNA, 22 bp, Homo sapiens
gcagggcagctcactgtggttc

SEQ ID NO: 8764245 - DNA, 22 bp, Homo sapiens
gcagggcagccacaggccccct

SEQ ID NO: 8764246 - DNA, 22 bp, Homo sapiens
gcagggcagctcactgtggttc

SEQ ID NO: 8764247 - DNA, 22 bp, Homo sapiens
gcaggcccttagccttggtggg

SEQ ID NO: 8764248 - DNA, 22 bp, Homo sapiens
gcaggcccttagccttggtggg

SEQ ID NO: 8764249 - DNA, 22 bp, Homo sapiens
gcaggccagctgtgcagatggg

SEQ ID NO: 8764250 - DNA, 22 bp, Homo sapiens
gcaggcctcccctgctggagct

SEQ ID NO: 8764251 - DNA, 22 bp, Homo sapiens
gcaggcccttagccttggtggg

SEQ ID NO: 8764252 - DNA, 18 bp, Homo sapiens
gcaggccctgtttctggg

SEQ ID NO: 8764253 - DNA, 20 bp, Homo sapiens
gcaggccctctctctagtct

SEQ ID NO: 8764254 - DNA, 22 bp, Homo sapiens
gcaggccctcctctagcaaggc

SEQ ID NO: 8764255 - DNA, 19 bp, Homo sapiens
gcaggcccagtcgggctgg

SEQ ID NO: 8764256 - DNA, 19 bp, Homo sapiens
gcaggcccagtcgggctgg

SEQ ID NO: 8764257 - DNA, 22 bp, Homo sapiens
gcagcagaagtagaagtacagg

SEQ ID NO: 8764258 - DNA, 22 bp, Homo sapiens
gcagcagaagtagaagtacagg

SEQ ID NO: 8764259 - DNA, 22 bp, Homo sapiens
gcagcagcagcaattttctgtc

SEQ ID NO: 8764260 - DNA, 22 bp, Homo sapiens
gcagcagcaagaaggttggact

SEQ ID NO: 8764261 - DNA, 22 bp, Homo sapiens
gcagcagcaggcgctcggccgt

SEQ ID NO: 8764262 - DNA, 22 bp, Homo sapiens
gcagcagcaggcgctcggccgt

SEQ ID NO: 8764263 - DNA, 22 bp, Homo sapiens
gcagcagcaggcgctcggccgt

SEQ ID NO: 8764264 - DNA, 22 bp, Homo sapiens
gcagcagcaggcgctcggccgt

SEQ ID NO: 8764265 - DNA, 22 bp, Homo sapiens
gcagcagcagggagtctgactt

SEQ ID NO: 8764266 - DNA, 19 bp, Homo sapiens
gcagcagcatttggtaata

SEQ ID NO: 8764267 - DNA, 22 bp, Homo sapiens
gcagcacaaagtccccagggac

SEQ ID NO: 8764268 - DNA, 22 bp, Homo sapiens
gcagcacaaagtccccagggac

SEQ ID NO: 8764269 - DNA, 22 bp, Homo sapiens
gcagcacatataaacaaagaga

SEQ ID NO: 8764270 - DNA, 22 bp, Homo sapiens
gcagcactgtcttgtcttagga

SEQ ID NO: 8764271 - DNA, 22 bp, Homo sapiens
gcagcaccaaccagggcctgtt

SEQ ID NO: 8764272 - DNA, 22 bp, Homo sapiens
gcagcagaaggccaaggggagc

SEQ ID NO: 8764273 - DNA, 22 bp, Homo sapiens
gcagcagaaggccaaggggagc

SEQ ID NO: 8764274 - DNA, 22 bp, Homo sapiens
gcagcagaaggccaaggggagc

SEQ ID NO: 8764275 - DNA, 22 bp, Homo sapiens
gcagcaattatcaatctcatta

SEQ ID NO: 8764276 - DNA, 22 bp, Homo sapiens
gcagcaatcttcacagtgtcat

SEQ ID NO: 8764277 - DNA, 22 bp, Homo sapiens
gcagcaatatccatgtcttcac

SEQ ID NO: 8764278 - DNA, 19 bp, Homo sapiens
gcagcaatagaagacaaat

SEQ ID NO: 8764279 - DNA, 22 bp, Homo sapiens
gcagcaagaggtttctgttgac

SEQ ID NO: 8764280 - DNA, 22 bp, Homo sapiens
gcagcaaggatgaagcacttgg

SEQ ID NO: 8764281 - DNA, 22 bp, Homo sapiens
gcagcaagtctagtttgtaggc

SEQ ID NO: 8764282 - DNA, 21 bp, Homo sapiens
gcagccacagccaccaagcta

SEQ ID NO: 8764283 - DNA, 22 bp, Homo sapiens
gcagccacagaggagggatgca

SEQ ID NO: 8764284 - DNA, 22 bp, Homo sapiens
gcagcagccactattctggcat

SEQ ID NO: 8764285 - DNA, 22 bp, Homo sapiens
gcagcagcccagggctctcaga

SEQ ID NO: 8764286 - DNA, 22 bp, Homo sapiens
gcagcagcccagggctctcaga

SEQ ID NO: 8764287 - DNA, 22 bp, Homo sapiens
gcagcagcccagggctctcaga

SEQ ID NO: 8764288 - DNA, 21 bp, Homo sapiens
gcagccactgccttcaacaat

SEQ ID NO: 8764289 - DNA, 22 bp, Homo sapiens
gcagccactgggagtgcttata

SEQ ID NO: 8764290 - DNA, 22 bp, Homo sapiens
gcagccaccctcaaggctgaat

SEQ ID NO: 8764291 - DNA, 22 bp, Homo sapiens
gcagccaccctcaaggctgaat

SEQ ID NO: 8764292 - DNA, 19 bp, Homo sapiens
gcagccaccgcggcggccg

SEQ ID NO: 8764293 - DNA, 22 bp, Homo sapiens
gcagccacctcccatggcgggg

SEQ ID NO: 8764294 - DNA, 19 bp, Homo sapiens
gcagccaccgcggcggccg

SEQ ID NO: 8764295 - DNA, 22 bp, Homo sapiens
gcagccagaagactcagaacaa

SEQ ID NO: 8764296 - DNA, 22 bp, Homo sapiens
gcagccagaagactcagaacaa

SEQ ID NO: 8764297 - DNA, 22 bp, Homo sapiens
gcagccactttgcaaccaagag

SEQ ID NO: 8764298 - DNA, 21 bp, Homo sapiens
gcagccagacgggattcagtt

SEQ ID NO: 8764299 - DNA, 22 bp, Homo sapiens
gcagccagcccctctgacctct

SEQ ID NO: 8764300 - DNA, 22 bp, Homo sapiens
gcagccagcccctctgacctct

SEQ ID NO: 8764301 - DNA, 22 bp, Homo sapiens
gcagccagcccctctgacctct

SEQ ID NO: 8764302 - DNA, 22 bp, Homo sapiens
gcagccagcaggaagcgggaga

SEQ ID NO: 8764303 - DNA, 22 bp, Homo sapiens
gcagccagcaggaagcgggaga

SEQ ID NO: 8764304 - DNA, 22 bp, Homo sapiens
gcagccaggaaagctggaccct

SEQ ID NO: 8764305 - DNA, 22 bp, Homo sapiens
gcagccaggaaagctggaccct

SEQ ID NO: 8764306 - DNA, 22 bp, Homo sapiens
gcagccaggaaagctggaccct

SEQ ID NO: 8764307 - DNA, 21 bp, Homo sapiens
gcagccagccgagaccatgcc

SEQ ID NO: 8764308 - DNA, 21 bp, Homo sapiens
gcagccagccgagaccatgcc

SEQ ID NO: 8764309 - DNA, 21 bp, Homo sapiens
gcagccagccgagaccatgcc

SEQ ID NO: 8764310 - DNA, 22 bp, Homo sapiens
gcagccagccctagtcccactt

SEQ ID NO: 8764311 - DNA, 22 bp, Homo sapiens
gcagctggctcagagaggtggg

SEQ ID NO: 8764312 - DNA, 22 bp, Homo sapiens
gcagctggctcagagaggtggg

SEQ ID NO: 8764313 - DNA, 22 bp, Homo sapiens
gcagctggctcagagaggtggg

SEQ ID NO: 8764314 - DNA, 22 bp, Homo sapiens
gcagctggctcagagaggtggg

SEQ ID NO: 8764315 - DNA, 22 bp, Homo sapiens
gcagctggctctgggaaaaact

SEQ ID NO: 8764316 - DNA, 22 bp, Homo sapiens
gcagctggccctgacacgcaga

SEQ ID NO: 8764317 - DNA, 22 bp, Homo sapiens
gcagcccacagctggaggccta

SEQ ID NO: 8764318 - DNA, 22 bp, Homo sapiens
gcagcccacaccactctgctca

SEQ ID NO: 8764319 - DNA, 22 bp, Homo sapiens
gcagcccacaccactctgctca

SEQ ID NO: 8764320 - DNA, 22 bp, Homo sapiens
gcagcccaagcctgagcatcct

SEQ ID NO: 8764321 - DNA, 22 bp, Homo sapiens
gcagcccaatggactgagacag

SEQ ID NO: 8764322 - DNA, 22 bp, Homo sapiens
gcagccaggaagcccaggacac

SEQ ID NO: 8764323 - DNA, 22 bp, Homo sapiens
gcagccaggaagcccaggacac

SEQ ID NO: 8764324 - DNA, 22 bp, Homo sapiens
gcagccaggaagcccaggacac

SEQ ID NO: 8764325 - DNA, 22 bp, Homo sapiens
gcagccagtatcctctgagatt

SEQ ID NO: 8764326 - DNA, 17 bp, Homo sapiens
gcagccagtgcagcagg

SEQ ID NO: 8764327 - DNA, 22 bp, Homo sapiens
gcagccagtatcctctgagatt

SEQ ID NO: 8764328 - DNA, 22 bp, Homo sapiens
gcagccagtatcctctgagatt

SEQ ID NO: 8764329 - DNA, 22 bp, Homo sapiens
gcagcccaagcctgagcatcct

SEQ ID NO: 8764330 - DNA, 22 bp, Homo sapiens
gcagcccaagcctgagcatcct

SEQ ID NO: 8764331 - DNA, 22 bp, Homo sapiens
gcagcccaagagactctgttga

SEQ ID NO: 8764332 - DNA, 22 bp, Homo sapiens
gcagcccaagagactctgttga

SEQ ID NO: 8764333 - DNA, 22 bp, Homo sapiens
gcagcccaaaaaagaggtagat

SEQ ID NO: 8764334 - DNA, 22 bp, Homo sapiens
gcagcccaaaaaagaggtagat

SEQ ID NO: 8764335 - DNA, 17 bp, Homo sapiens
gcagccagtgcagcagg

SEQ ID NO: 8764336 - DNA, 17 bp, Homo sapiens
gcagccagtgcagcagg

SEQ ID NO: 8764337 - DNA, 22 bp, Homo sapiens
gcagccagtgggatgagaaaga

SEQ ID NO: 8764338 - DNA, 22 bp, Homo sapiens
gcagccattgagcgaaaaaatc

SEQ ID NO: 8764339 - DNA, 23 bp, Homo sapiens
gcagccatgttcccgtctcagct

SEQ ID NO: 8764340 - DNA, 22 bp, Homo sapiens
gcagccagtgggatgagaaaga

SEQ ID NO: 8764341 - DNA, 23 bp, Homo sapiens
gcagctggttagaagggaaggag

SEQ ID NO: 8764342 - DNA, 23 bp, Homo sapiens
gcagctggttagaagggaaggag

SEQ ID NO: 8764343 - DNA, 23 bp, Homo sapiens
gcagctggttagaagggaaggag

SEQ ID NO: 8764344 - DNA, 22 bp, Homo sapiens
gcagctggttaatgggagaatt

SEQ ID NO: 8764345 - DNA, 22 bp, Homo sapiens
gcagctggttaatgggagaatt

SEQ ID NO: 8764346 - DNA, 22 bp, Homo sapiens
gcagctggtgcaaatgtcactc

SEQ ID NO: 8764347 - DNA, 22 bp, Homo sapiens
gcagctggtgcaaatgtcactc

SEQ ID NO: 8764348 - DNA, 22 bp, Homo sapiens
gcagctggtgcaaatgtcactc

SEQ ID NO: 8764349 - DNA, 22 bp, Homo sapiens
gcagctggtgcaaatgtcactc

SEQ ID NO: 8764350 - DNA, 22 bp, Homo sapiens
gcagctggtctggcctagagta

SEQ ID NO: 8764351 - DNA, 22 bp, Homo sapiens
gcagctggtctggcctagagta

SEQ ID NO: 8764352 - DNA, 21 bp, Homo sapiens
gcagctggtctcagagcttgc

SEQ ID NO: 8764353 - DNA, 22 bp, Homo sapiens
gcagctgggtctgtgtgggctg

SEQ ID NO: 8764354 - DNA, 22 bp, Homo sapiens
gcagctgggtctgtgtgggctg

SEQ ID NO: 8764355 - DNA, 22 bp, Homo sapiens
gcagctggggccacacttaggc

SEQ ID NO: 8764356 - DNA, 22 bp, Homo sapiens
gcagctggggaggtcgtgggga

SEQ ID NO: 8764357 - DNA, 22 bp, Homo sapiens
gcagctgggccccagcctctcc

SEQ ID NO: 8764358 - DNA, 22 bp, Homo sapiens
gcagctgggccccagcctctcc

SEQ ID NO: 8764359 - DNA, 22 bp, Homo sapiens
gcagctgggacactgaggccag

SEQ ID NO: 8764360 - DNA, 22 bp, Homo sapiens
gcagctgggacactgaggccag

SEQ ID NO: 8764361 - DNA, 22 bp, Homo sapiens
gcagctgggacactgaggccag

SEQ ID NO: 8764362 - DNA, 22 bp, Homo sapiens
gcagacagaagctaagtagaca

SEQ ID NO: 8764363 - DNA, 22 bp, Homo sapiens
gcagacacttttattctgcata

SEQ ID NO: 8764364 - DNA, 22 bp, Homo sapiens
gcagacagaagctaagtagaca

SEQ ID NO: 8764365 - DNA, 22 bp, Homo sapiens
gcagacacttgaggtgggcttt

SEQ ID NO: 8764366 - DNA, 22 bp, Homo sapiens
gcagacacttgaggtgggcttt

SEQ ID NO: 8764367 - DNA, 17 bp, Homo sapiens
gcagacacttctattga

SEQ ID NO: 8764368 - DNA, 22 bp, Homo sapiens
gcagacacagggaaggcaagga

SEQ ID NO: 8764369 - DNA, 22 bp, Homo sapiens
gcagacaatttattagcagatt

SEQ ID NO: 8764370 - DNA, 22 bp, Homo sapiens
gcagacacatccactcctacag

SEQ ID NO: 8764371 - DNA, 22 bp, Homo sapiens
gcagacaccttgtaggtgtgta

SEQ ID NO: 8764372 - DNA, 22 bp, Homo sapiens
gcagacacttcccactgcagcg

SEQ ID NO: 8764373 - DNA, 18 bp, Homo sapiens
gcagacactcgtggaggg

SEQ ID NO: 8764374 - DNA, 22 bp, Homo sapiens
gcagacagcatgttgggctatt

SEQ ID NO: 8764375 - DNA, 22 bp, Homo sapiens
gcagacagcatgttgggctatt

SEQ ID NO: 8764376 - DNA, 22 bp, Homo sapiens
gcagacagatgagggtgctggg

SEQ ID NO: 8764377 - DNA, 22 bp, Homo sapiens
gcagacagatgagggtgctggg

SEQ ID NO: 8764378 - DNA, 23 bp, Homo sapiens
gcagacagagcagactaagacaa

SEQ ID NO: 8764379 - DNA, 22 bp, Homo sapiens
gcagacaggcccagtggaggga

SEQ ID NO: 8764380 - DNA, 22 bp, Homo sapiens
gcagacagcatgttgggctatt

SEQ ID NO: 8764381 - DNA, 22 bp, Homo sapiens
gcacccagcccagggcgtgatg

SEQ ID NO: 8764382 - DNA, 21 bp, Homo sapiens
gcacccagccggttctcccag

SEQ ID NO: 8764383 - DNA, 22 bp, Homo sapiens
gcacccagaggtcagcagtgct

SEQ ID NO: 8764384 - DNA, 22 bp, Homo sapiens
gcacccagaggtcagcagtgct

SEQ ID NO: 8764385 - DNA, 22 bp, Homo sapiens
gcaccactaagagcagggaccg

SEQ ID NO: 8764386 - DNA, 22 bp, Homo sapiens
gcaccactacactccagcctgg

SEQ ID NO: 8764387 - DNA, 22 bp, Homo sapiens
gcaccacatcaatgaggggagc

SEQ ID NO: 8764388 - DNA, 22 bp, Homo sapiens
gcacatttgccactgagctcct

SEQ ID NO: 8764389 - DNA, 19 bp, Homo sapiens
gcaccagattgagtgacac

SEQ ID NO: 8764390 - DNA, 22 bp, Homo sapiens
gcaccagctgcagggtggctga

SEQ ID NO: 8764391 - DNA, 22 bp, Homo sapiens
gcaccaggaagctgttatagca

SEQ ID NO: 8764392 - DNA, 22 bp, Homo sapiens
gcacccagagggcagggtctcc

SEQ ID NO: 8764393 - DNA, 22 bp, Homo sapiens
gcaccaggagaatcacgttaga

SEQ ID NO: 8764394 - DNA, 22 bp, Homo sapiens
gcagaggtgagtttctcagctg

SEQ ID NO: 8764395 - DNA, 22 bp, Homo sapiens
gcagaggtgctcagtggcagaa

SEQ ID NO: 8764396 - DNA, 22 bp, Homo sapiens
gcagacagggctacagaggtac

SEQ ID NO: 8764397 - DNA, 22 bp, Homo sapiens
gcagacagggctacagaggtac

SEQ ID NO: 8764398 - DNA, 22 bp, Homo sapiens
gcagacagggctacagaggtac

SEQ ID NO: 8764399 - DNA, 22 bp, Homo sapiens
gcagaggtggcatctgggctct

SEQ ID NO: 8764400 - DNA, 22 bp, Homo sapiens
gcagaggtgtcaccttccagga

SEQ ID NO: 8764401 - DNA, 22 bp, Homo sapiens
gcagaggtgtcaccttccagga

SEQ ID NO: 8764402 - DNA, 22 bp, Homo sapiens
gcagaggtgtagccccctccat

SEQ ID NO: 8764403 - DNA, 22 bp, Homo sapiens
gcagaggtgtgggaggggccac

SEQ ID NO: 8764404 - DNA, 22 bp, Homo sapiens
gcagaggtgtgggaggggccac

SEQ ID NO: 8764405 - DNA, 22 bp, Homo sapiens
gcagagtatgagcatggcttta

SEQ ID NO: 8764406 - DNA, 22 bp, Homo sapiens
gcagaggttggattggtgactt

SEQ ID NO: 8764407 - DNA, 19 bp, Homo sapiens
gcagagtcaagagctgctg

SEQ ID NO: 8764408 - DNA, 19 bp, Homo sapiens
gcagagtcaagagctgctg

SEQ ID NO: 8764409 - DNA, 22 bp, Homo sapiens
gcagagtctgggcagcctccat

SEQ ID NO: 8764410 - DNA, 22 bp, Homo sapiens
gcagagtctggtaggtgctggt

SEQ ID NO: 8764411 - DNA, 22 bp, Homo sapiens
gcagagtgaagggagaggtgtg

SEQ ID NO: 8764412 - DNA, 22 bp, Homo sapiens
gcagagtgagccgaggctgctc

SEQ ID NO: 8764413 - DNA, 22 bp, Homo sapiens
gcagagtgagatatgaacccag

SEQ ID NO: 8764414 - DNA, 22 bp, Homo sapiens
gcagagtgaagggagaggtgtg

SEQ ID NO: 8764415 - DNA, 22 bp, Homo sapiens
gcagagtgagccgaggctgctc

SEQ ID NO: 8764416 - DNA, 22 bp, Homo sapiens
gcagagtgagccgaggctgctc

SEQ ID NO: 8764417 - DNA, 22 bp, Homo sapiens
gcagagtgaggaagagcttcca

SEQ ID NO: 8764418 - DNA, 22 bp, Homo sapiens
gcagagtgagccgaggctgctc

SEQ ID NO: 8764419 - DNA, 22 bp, Homo sapiens
gcagagtgctgtcgtacgcccc

SEQ ID NO: 8764420 - DNA, 22 bp, Homo sapiens
gcagatgttctgtgtctcacaa

SEQ ID NO: 8764421 - DNA, 22 bp, Homo sapiens
gcagagtgggagcccagggctg

SEQ ID NO: 8764422 - DNA, 22 bp, Homo sapiens
gcagcaaaaaagtaatatttat

SEQ ID NO: 8764423 - DNA, 22 bp, Homo sapiens
gcagcaaaaaagtaatatttat

SEQ ID NO: 8764424 - DNA, 22 bp, Homo sapiens
gcagcaaaaaagtaatatttat

SEQ ID NO: 8764425 - DNA, 22 bp, Homo sapiens
gcagattgtggggttcaggttt

SEQ ID NO: 8764426 - DNA, 22 bp, Homo sapiens
gcagatgttgatgcaagaagag

SEQ ID NO: 8764427 - DNA, 22 bp, Homo sapiens
gcagcaagaataatttgggtag

SEQ ID NO: 8764428 - DNA, 22 bp, Homo sapiens
gcagcaagaggtgccatcttga

SEQ ID NO: 8764429 - DNA, 21 bp, Homo sapiens
gcagcaaatgacaacagtgag

SEQ ID NO: 8764430 - DNA, 21 bp, Homo sapiens
gcagcaaatgacaacagtgag

SEQ ID NO: 8764431 - DNA, 22 bp, Homo sapiens
gcagcaaagctcttcatgtgat

SEQ ID NO: 8764432 - DNA, 22 bp, Homo sapiens
gcagcaaacttccacaagtaga

SEQ ID NO: 8764433 - DNA, 22 bp, Homo sapiens
gcagcaaacttccacaagtaga

SEQ ID NO: 8764434 - DNA, 22 bp, Homo sapiens
gagtagggtttccaggttagag

SEQ ID NO: 8764435 - DNA, 22 bp, Homo sapiens
gagtaggttgtcagactccaaa

SEQ ID NO: 8764436 - DNA, 22 bp, Homo sapiens
gagtataagctttttcacttca

SEQ ID NO: 8764437 - DNA, 22 bp, Homo sapiens
gagtataagctttttcacttca

SEQ ID NO: 8764438 - DNA, 22 bp, Homo sapiens
gagtataagctttttcacttca

SEQ ID NO: 8764439 - DNA, 22 bp, Homo sapiens
gagtataagtaatttcaagcaa

SEQ ID NO: 8764440 - DNA, 22 bp, Homo sapiens
gagtataagtaatttcaagcaa

SEQ ID NO: 8764441 - DNA, 22 bp, Homo sapiens
gagtataagtaatttcaagcaa

SEQ ID NO: 8764442 - DNA, 19 bp, Homo sapiens
gagtattccaaggaaactt

SEQ ID NO: 8764443 - DNA, 22 bp, Homo sapiens
gagtattcaatatatacaaatg

SEQ ID NO: 8764444 - DNA, 22 bp, Homo sapiens
gagtattcaatatatacaaatg

SEQ ID NO: 8764445 - DNA, 22 bp, Homo sapiens
gagtataatgattttcattcac

SEQ ID NO: 8764446 - DNA, 22 bp, Homo sapiens
gagtatatatagacatgtcaca

SEQ ID NO: 8764447 - DNA, 22 bp, Homo sapiens
gagtatataattaattggtctg

SEQ ID NO: 8764448 - DNA, 22 bp, Homo sapiens
gagtataatgattttcattcac

SEQ ID NO: 8764449 - DNA, 22 bp, Homo sapiens
gagtataatgattttcattcac

SEQ ID NO: 8764450 - DNA, 22 bp, Homo sapiens
gagtatatgactttcttttgca

SEQ ID NO: 8764451 - DNA, 22 bp, Homo sapiens
gagtatatttctctctcttaag

SEQ ID NO: 8764452 - DNA, 20 bp, Homo sapiens
gagtatatttcttcctttgc

SEQ ID NO: 8764453 - DNA, 22 bp, Homo sapiens
gagtatgatgggatgacaggag

SEQ ID NO: 8764454 - DNA, 22 bp, Homo sapiens
gagtagggatgctggtgactcc

SEQ ID NO: 8764455 - DNA, 22 bp, Homo sapiens
gagtaggaatgttctgccatct

SEQ ID NO: 8764456 - DNA, 22 bp, Homo sapiens
gagtagacattaaattacactg

SEQ ID NO: 8764457 - DNA, 22 bp, Homo sapiens
gagtagacaaggtacatgttct

SEQ ID NO: 8764458 - DNA, 22 bp, Homo sapiens
gagtagaaggaagttatctacc

SEQ ID NO: 8764459 - DNA, 22 bp, Homo sapiens
gagtagaactggttatctaata

SEQ ID NO: 8764460 - DNA, 22 bp, Homo sapiens
gagtacttaactccaaatagga

SEQ ID NO: 8764461 - DNA, 22 bp, Homo sapiens
gagtagaaagtaaagtacgaat

SEQ ID NO: 8764462 - DNA, 22 bp, Homo sapiens
gagtattttcaaattcagcaga

SEQ ID NO: 8764463 - DNA, 22 bp, Homo sapiens
gagtattttcaaattcagcaga

SEQ ID NO: 8764464 - DNA, 19 bp, Homo sapiens
gagtattttccaacttggt

SEQ ID NO: 8764465 - DNA, 22 bp, Homo sapiens
gcaaggagcacctttctggaac

SEQ ID NO: 8764466 - DNA, 22 bp, Homo sapiens
gcaaggagcctggaggtgagtg

SEQ ID NO: 8764467 - DNA, 22 bp, Homo sapiens
gcaaggaggctggtggaggaag

SEQ ID NO: 8764468 - DNA, 22 bp, Homo sapiens
gcaaggatctgttgtggggcca

SEQ ID NO: 8764469 - DNA, 22 bp, Homo sapiens
gcaaggaggctggtggaggaag

SEQ ID NO: 8764470 - DNA, 22 bp, Homo sapiens
gcaaggaggctggtggaggaag

SEQ ID NO: 8764471 - DNA, 22 bp, Homo sapiens
gcaaggaggctggtggaggaag

SEQ ID NO: 8764472 - DNA, 22 bp, Homo sapiens
gcaaggcctgaggtgggtgctc

SEQ ID NO: 8764473 - DNA, 21 bp, Homo sapiens
gcaaggcctatcatggcagct

SEQ ID NO: 8764474 - DNA, 18 bp, Homo sapiens
gcaaggctcaggccaggc

SEQ ID NO: 8764475 - DNA, 21 bp, Homo sapiens
gcaaggcctatcatggcagct

SEQ ID NO: 8764476 - DNA, 22 bp, Homo sapiens
gcaaggcagtcctggggccctg

SEQ ID NO: 8764477 - DNA, 22 bp, Homo sapiens
gcaaggcagtcctggggccctg

SEQ ID NO: 8764478 - DNA, 20 bp, Homo sapiens
gcaaggcaggttgaccaaga

SEQ ID NO: 8764479 - DNA, 22 bp, Homo sapiens
gcaaggcagtcctggggccctg

SEQ ID NO: 8764480 - DNA, 20 bp, Homo sapiens
gcaaggcacagtgaggaggg

SEQ ID NO: 8764481 - DNA, 20 bp, Homo sapiens
gcaaggcacagtgaggaggg

SEQ ID NO: 8764482 - DNA, 20 bp, Homo sapiens
gcaaggcacagtgaggaggg

SEQ ID NO: 8764483 - DNA, 22 bp, Homo sapiens
gcaaggcagcatccttttgagg

SEQ ID NO: 8764484 - DNA, 21 bp, Homo sapiens
gcaaggcaatgccatgatttc

SEQ ID NO: 8764485 - DNA, 22 bp, Homo sapiens
gcaaggcagcgcggagtagcta

SEQ ID NO: 8764486 - DNA, 18 bp, Homo sapiens
gcaaggcagctctctggg

SEQ ID NO: 8764487 - DNA, 20 bp, Homo sapiens
gcaaggcaggttgaccaaga

SEQ ID NO: 8764488 - DNA, 18 bp, Homo sapiens
gcaaggcagctctctggg

SEQ ID NO: 8764489 - DNA, 22 bp, Homo sapiens
gcaaggcagcatccttttgagg

SEQ ID NO: 8764490 - DNA, 20 bp, Homo sapiens
gcaaggctccaaggggtgtg

SEQ ID NO: 8764491 - DNA, 20 bp, Homo sapiens
gcaaggctccaaggggtgtg

SEQ ID NO: 8764492 - DNA, 22 bp, Homo sapiens
gcaataaaatgtaatgattggg

SEQ ID NO: 8764493 - DNA, 22 bp, Homo sapiens
gcaataaaatgtaatgattggg

SEQ ID NO: 8764494 - DNA, 22 bp, Homo sapiens
gcaataaacatgtttgatgcgc

SEQ ID NO: 8764495 - DNA, 22 bp, Homo sapiens
gcaataaacatgtttgatgcgc

SEQ ID NO: 8764496 - DNA, 22 bp, Homo sapiens
gcaataaactctctcaagccac

SEQ ID NO: 8764497 - DNA, 22 bp, Homo sapiens
gcaataaataacatggaagaca

SEQ ID NO: 8764498 - DNA, 22 bp, Homo sapiens
gcaatacagaagagtggcaagg

SEQ ID NO: 8764499 - DNA, 23 bp, Homo sapiens
gcaatacaagactggtcatgagc

SEQ ID NO: 8764500 - DNA, 22 bp, Homo sapiens
gcaatacagtaggtttattggt

SEQ ID NO: 8764501 - DNA, 22 bp, Homo sapiens
gcaatacagtaagagtactgta

SEQ ID NO: 8764502 - DNA, 22 bp, Homo sapiens
gcaatacagtaggtttattggt

SEQ ID NO: 8764503 - DNA, 22 bp, Homo sapiens
gcaatacagttgaagagattga

SEQ ID NO: 8764504 - DNA, 22 bp, Homo sapiens
gcaatacagttgaagagattga

SEQ ID NO: 8764505 - DNA, 22 bp, Homo sapiens
gcaataaagattttactgtcag

SEQ ID NO: 8764506 - DNA, 22 bp, Homo sapiens
gcaataaagtagcagctcatca

SEQ ID NO: 8764507 - DNA, 22 bp, Homo sapiens
gcaataaagtagcagctcatca

SEQ ID NO: 8764508 - DNA, 22 bp, Homo sapiens
gcacagagtgggtgagatgtgg

SEQ ID NO: 8764509 - DNA, 22 bp, Homo sapiens
gcacagcacagcaacatgtttt

SEQ ID NO: 8764510 - DNA, 22 bp, Homo sapiens
gcacatgcactgtgggggcaat

SEQ ID NO: 8764511 - DNA, 22 bp, Homo sapiens
gcacagcagctgggggccctgg

SEQ ID NO: 8764512 - DNA, 22 bp, Homo sapiens
gcacagagtcactagctaagca

SEQ ID NO: 8764513 - DNA, 22 bp, Homo sapiens
gcacagaggtggaggacaaata

SEQ ID NO: 8764514 - DNA, 22 bp, Homo sapiens
gcacagaggtggaggacaaata

SEQ ID NO: 8764515 - DNA, 22 bp, Homo sapiens
gcacagatggtactagcttggt

SEQ ID NO: 8764516 - DNA, 22 bp, Homo sapiens
gcacagagtgggtgagatgtgg

SEQ ID NO: 8764517 - DNA, 17 bp, Homo sapiens
gcacatgtgttctttta

SEQ ID NO: 8764518 - DNA, 22 bp, Homo sapiens
gcacatgtgggtaagcacatgg

SEQ ID NO: 8764519 - DNA, 22 bp, Homo sapiens
gcacatgttgctagttacttgc

SEQ ID NO: 8764520 - DNA, 22 bp, Homo sapiens
gcacatttaactgagctcagga

SEQ ID NO: 8764521 - DNA, 22 bp, Homo sapiens
gcacattgttactcttactgtg

SEQ ID NO: 8764522 - DNA, 22 bp, Homo sapiens
gcacatgtcttattcactgtta

SEQ ID NO: 8764523 - DNA, 18 bp, Homo sapiens
gcacatgtaagagtaaag

SEQ ID NO: 8764524 - DNA, 22 bp, Homo sapiens
gcacatgtgagagtagaggcct

SEQ ID NO: 8764525 - DNA, 22 bp, Homo sapiens
gcacatgtgagagtagaggcct

SEQ ID NO: 8764526 - DNA, 18 bp, Homo sapiens
gcacatgtaagagtaaag

SEQ ID NO: 8764527 - DNA, 22 bp, Homo sapiens
gcacatggacaatggaggtgca

SEQ ID NO: 8764528 - DNA, 22 bp, Homo sapiens
gcacagcagctgggggccctgg

SEQ ID NO: 8764529 - DNA, 22 bp, Homo sapiens
gcacatgcgtgcttagaaagaa

SEQ ID NO: 8764530 - DNA, 22 bp, Homo sapiens
gcacagaataacactctgggct

SEQ ID NO: 8764531 - DNA, 22 bp, Homo sapiens
gcacagaataacactctgggct

SEQ ID NO: 8764532 - DNA, 22 bp, Homo sapiens
gcacagaataacactctgggct

SEQ ID NO: 8764533 - DNA, 22 bp, Homo sapiens
gcacagaagtaaaatacaagtc

SEQ ID NO: 8764534 - DNA, 22 bp, Homo sapiens
gcacagaagtaaaatacaagtc

SEQ ID NO: 8764535 - DNA, 22 bp, Homo sapiens
gcacagaagtaaaatacaagtc

SEQ ID NO: 8764536 - DNA, 22 bp, Homo sapiens
gcacagacagaatccctactcc

SEQ ID NO: 8764537 - DNA, 22 bp, Homo sapiens
gcacagacatatccatatttac

SEQ ID NO: 8764538 - DNA, 22 bp, Homo sapiens
gcacagaaccagacatgaggca

SEQ ID NO: 8764539 - DNA, 22 bp, Homo sapiens
gcacagaaccagacatgaggca

SEQ ID NO: 8764540 - DNA, 22 bp, Homo sapiens
gcacagaaccctatctttcgga

SEQ ID NO: 8764541 - DNA, 22 bp, Homo sapiens
gcacagaaccagacatgaggca

SEQ ID NO: 8764542 - DNA, 22 bp, Homo sapiens
gcacagaacttctcttagtagg

SEQ ID NO: 8764543 - DNA, 22 bp, Homo sapiens
gcacagaacttctcttagtagg

SEQ ID NO: 8764544 - DNA, 22 bp, Homo sapiens
gcacagaagagctttggaatga

SEQ ID NO: 8764545 - DNA, 17 bp, Homo sapiens
gcacagaggccaaagga

SEQ ID NO: 8764546 - DNA, 22 bp, Homo sapiens
gcacagagggcagtgagcctct

SEQ ID NO: 8764547 - DNA, 22 bp, Homo sapiens
gcacagagggcagtgagcctct

SEQ ID NO: 8764548 - DNA, 22 bp, Homo sapiens
gcacagagagtcccgggtgccc

SEQ ID NO: 8764549 - DNA, 22 bp, Homo sapiens
gcacagagagtcccgggtgccc

SEQ ID NO: 8764550 - DNA, 22 bp, Homo sapiens
gcacagagagggaaggtaactt

SEQ ID NO: 8764551 - DNA, 22 bp, Homo sapiens
gcacagagagggaaggtaactt

SEQ ID NO: 8764552 - DNA, 22 bp, Homo sapiens
gcacagagagcagtgggggaca

SEQ ID NO: 8764553 - DNA, 22 bp, Homo sapiens
gcacagagaggctgtgagcgcc

SEQ ID NO: 8764554 - DNA, 22 bp, Homo sapiens
gcacagagagcagtgggggaca

SEQ ID NO: 8764555 - DNA, 22 bp, Homo sapiens
gcacagagaggctgtgagcgcc

SEQ ID NO: 8764556 - DNA, 22 bp, Homo sapiens
gcacagagagcagtgggggaca

SEQ ID NO: 8764557 - DNA, 22 bp, Homo sapiens
gcacagactttgattgcagtca

SEQ ID NO: 8764558 - DNA, 22 bp, Homo sapiens
gcacagagacagtcctgagatc

SEQ ID NO: 8764559 - DNA, 22 bp, Homo sapiens
gcacagagagcagtgggggaca

SEQ ID NO: 8764560 - DNA, 22 bp, Homo sapiens
gctggagttggcaaggcatgta

SEQ ID NO: 8764561 - DNA, 22 bp, Homo sapiens
gctggcagggtggttgagagag

SEQ ID NO: 8764562 - DNA, 22 bp, Homo sapiens
gctggcagggtggttgagagag

SEQ ID NO: 8764563 - DNA, 22 bp, Homo sapiens
gctggcagggtggttgagagag

SEQ ID NO: 8764564 - DNA, 22 bp, Homo sapiens
gctggcaggtccaagatagagc

SEQ ID NO: 8764565 - DNA, 22 bp, Homo sapiens
gctggcaggtaaagccccgggg

SEQ ID NO: 8764566 - DNA, 22 bp, Homo sapiens
gctggcaggtaaagccccgggg

SEQ ID NO: 8764567 - DNA, 22 bp, Homo sapiens
gctggcagggttctcactgaaa

SEQ ID NO: 8764568 - DNA, 22 bp, Homo sapiens
gctggcagggttctcactgaaa

SEQ ID NO: 8764569 - DNA, 22 bp, Homo sapiens
gctggcagggttctcactgaaa

SEQ ID NO: 8764570 - DNA, 22 bp, Homo sapiens
gctggcagtaaagggtttggca

SEQ ID NO: 8764571 - DNA, 22 bp, Homo sapiens
gctggcagtaaagggtttggca

SEQ ID NO: 8764572 - DNA, 22 bp, Homo sapiens
gctggcaggtaaagccccgggg

SEQ ID NO: 8764573 - DNA, 22 bp, Homo sapiens
gctggcaggtccaagatagagc

SEQ ID NO: 8764574 - DNA, 22 bp, Homo sapiens
gctggcagtcccatcagctggg

SEQ ID NO: 8764575 - DNA, 22 bp, Homo sapiens
gctggcagtgtattgttagctg

SEQ ID NO: 8764576 - DNA, 22 bp, Homo sapiens
gctggcagtttcctcaccgagg

SEQ ID NO: 8764577 - DNA, 22 bp, Homo sapiens
gctggccaaagtgtacctggag

SEQ ID NO: 8764578 - DNA, 22 bp, Homo sapiens
gctggcagtgtattgttagctg

SEQ ID NO: 8764579 - DNA, 22 bp, Homo sapiens
gctggcagtgtgaatgacaagc

SEQ ID NO: 8764580 - DNA, 22 bp, Homo sapiens
gctggcagtgtgaatgacaagc

SEQ ID NO: 8764581 - DNA, 22 bp, Homo sapiens
gctggcagtgtgaatgacaagc

SEQ ID NO: 8764582 - DNA, 22 bp, Homo sapiens
gctggcagtttcctcaccgagg

SEQ ID NO: 8764583 - DNA, 22 bp, Homo sapiens
gctggagtaggaccatgcttga

SEQ ID NO: 8764584 - DNA, 22 bp, Homo sapiens
gctggagtaggaccatgcttga

SEQ ID NO: 8764585 - DNA, 22 bp, Homo sapiens
gctggaggtttcacctgagttt

SEQ ID NO: 8764586 - DNA, 22 bp, Homo sapiens
gctggaggtttcacctgagttt

SEQ ID NO: 8764587 - DNA, 22 bp, Homo sapiens
gctggagtatctggggaaggag

SEQ ID NO: 8764588 - DNA, 22 bp, Homo sapiens
gctggagtatctggggaaggag

SEQ ID NO: 8764589 - DNA, 22 bp, Homo sapiens
gctggagtccagtggcatgatc

SEQ ID NO: 8764590 - DNA, 22 bp, Homo sapiens
gctggaggtagggaggtcctgt

SEQ ID NO: 8764591 - DNA, 22 bp, Homo sapiens
gctggaggtagggaggtcctgt

SEQ ID NO: 8764592 - DNA, 22 bp, Homo sapiens
gctggaggtagggaggtcctgt

SEQ ID NO: 8764593 - DNA, 22 bp, Homo sapiens
gctggaggtagggaggtcctgt

SEQ ID NO: 8764594 - DNA, 22 bp, Homo sapiens
gctggagtccagtggtatgatc

SEQ ID NO: 8764595 - DNA, 22 bp, Homo sapiens
gctggagtctggaggtgtgcca

SEQ ID NO: 8764596 - DNA, 22 bp, Homo sapiens
gctggagtctggaggtgtgcca

SEQ ID NO: 8764597 - DNA, 22 bp, Homo sapiens
gctggagtgagggaccatattt

SEQ ID NO: 8764598 - DNA, 22 bp, Homo sapiens
gctggagttaggtgggcttgaa

SEQ ID NO: 8764599 - DNA, 22 bp, Homo sapiens
gctggagttagaactagcctgg

SEQ ID NO: 8764600 - DNA, 22 bp, Homo sapiens
gctggagtgctgaggtgcagtg

SEQ ID NO: 8764601 - DNA, 22 bp, Homo sapiens
gctggagtgatgcctgtgtctc

SEQ ID NO: 8764602 - DNA, 22 bp, Homo sapiens
gctggagtgcagttgcacagtc

SEQ ID NO: 8764603 - DNA, 22 bp, Homo sapiens
gctggagtgcagttgcacagtc

SEQ ID NO: 8764604 - DNA, 22 bp, Homo sapiens
gctgctggaagcatgcgatgaa

SEQ ID NO: 8764605 - DNA, 22 bp, Homo sapiens
gctgctggaacaaatcacccca

SEQ ID NO: 8764606 - DNA, 22 bp, Homo sapiens
gctgctgcttgaaggctcggag

SEQ ID NO: 8764607 - DNA, 22 bp, Homo sapiens
gctgcctgaagtgtctacactg

SEQ ID NO: 8764608 - DNA, 22 bp, Homo sapiens
gctgcctgaagtgtctacactg

SEQ ID NO: 8764609 - DNA, 23 bp, Homo sapiens
gctgcctctgttggtcttcagtt

SEQ ID NO: 8764610 - DNA, 22 bp, Homo sapiens
gctgcctgaaatgttgcctagc

SEQ ID NO: 8764611 - DNA, 22 bp, Homo sapiens
gctgctggggtcacatggtaag

SEQ ID NO: 8764612 - DNA, 22 bp, Homo sapiens
gctgctgggggaacagttaaaa

SEQ ID NO: 8764613 - DNA, 22 bp, Homo sapiens
gctgctgggatcctgggtctca

SEQ ID NO: 8764614 - DNA, 22 bp, Homo sapiens
gctgctgggcaccccctgagct

SEQ ID NO: 8764615 - DNA, 19 bp, Homo sapiens
gctgctggctctggctgga

SEQ ID NO: 8764616 - DNA, 22 bp, Homo sapiens
gctgctggcttcctgctgtttt

SEQ ID NO: 8764617 - DNA, 22 bp, Homo sapiens
gctgctggcttcctgctgtttt

SEQ ID NO: 8764618 - DNA, 22 bp, Homo sapiens
gctgctgggaatgaacagtgtt

SEQ ID NO: 8764619 - DNA, 22 bp, Homo sapiens
gctggagcttgagaggacaggg

SEQ ID NO: 8764620 - DNA, 22 bp, Homo sapiens
gctggagcttgagaggacaggg

SEQ ID NO: 8764621 - DNA, 22 bp, Homo sapiens
gctgctgtccttagggagttct

SEQ ID NO: 8764622 - DNA, 22 bp, Homo sapiens
gctgctgtccttcaagtctgcg

SEQ ID NO: 8764623 - DNA, 22 bp, Homo sapiens
gctgctgtccttagggagttct

SEQ ID NO: 8764624 - DNA, 22 bp, Homo sapiens
gctgctgtcagtggtggcagtt

SEQ ID NO: 8764625 - DNA, 22 bp, Homo sapiens
gctgctgtcagtggtggcagtt

SEQ ID NO: 8764626 - DNA, 18 bp, Homo sapiens
gctgctggtggagggagc

SEQ ID NO: 8764627 - DNA, 18 bp, Homo sapiens
gctgctggtggagggagc

SEQ ID NO: 8764628 - DNA, 18 bp, Homo sapiens
gctgctggtggagggagc

SEQ ID NO: 8764629 - DNA, 22 bp, Homo sapiens
gctgctgtaatgtgttaagtca

SEQ ID NO: 8764630 - DNA, 22 bp, Homo sapiens
gctgctgtaacactaagtgcag

SEQ ID NO: 8764631 - DNA, 22 bp, Homo sapiens
gctgctgtcacggtgctaaggg

SEQ ID NO: 8764632 - DNA, 22 bp, Homo sapiens
gctgctgtacttggggggtgct

SEQ ID NO: 8764633 - DNA, 22 bp, Homo sapiens
gctgctgtcacccacatctgtc

SEQ ID NO: 8764634 - DNA, 22 bp, Homo sapiens
gctgctgtacttggggggtgct

SEQ ID NO: 8764635 - DNA, 22 bp, Homo sapiens
gctgctgtcagcaggccttgtt

SEQ ID NO: 8764636 - DNA, 22 bp, Homo sapiens
gctgctgggtccctctgtgcca

SEQ ID NO: 8764637 - DNA, 22 bp, Homo sapiens
gctgctggggtggagaaacgct

SEQ ID NO: 8764638 - DNA, 22 bp, Homo sapiens
gctgctgggtccctctgtgcca

SEQ ID NO: 8764639 - DNA, 22 bp, Homo sapiens
gctgctggtcctcagagctcat

SEQ ID NO: 8764640 - DNA, 22 bp, Homo sapiens
gctgctggtcctcagagctcat

SEQ ID NO: 8764641 - DNA, 22 bp, Homo sapiens
gctgcctctgcgactctgggcg

SEQ ID NO: 8764642 - DNA, 22 bp, Homo sapiens
gctgcctctgcgactctgggcg

SEQ ID NO: 8764643 - DNA, 22 bp, Homo sapiens
gctgcctctgcacagctcactc

SEQ ID NO: 8764644 - DNA, 22 bp, Homo sapiens
gctgcctctgcacagctcactc

SEQ ID NO: 8764645 - DNA, 22 bp, Homo sapiens
gctgcctctgcacagctcactc

SEQ ID NO: 8764646 - DNA, 22 bp, Homo sapiens
gctgcctctgcacagctcactc

SEQ ID NO: 8764647 - DNA, 22 bp, Homo sapiens
gctgcctctcctgagttgacag

SEQ ID NO: 8764648 - DNA, 22 bp, Homo sapiens
gctgcctctcctgagttgacag

SEQ ID NO: 8764649 - DNA, 22 bp, Homo sapiens
gctgcctcctgaaagcgctctg

SEQ ID NO: 8764650 - DNA, 22 bp, Homo sapiens
gctgcctcctgaaagcgctctg

SEQ ID NO: 8764651 - DNA, 22 bp, Homo sapiens
gctgcctctcctgagttgacag

SEQ ID NO: 8764652 - DNA, 22 bp, Homo sapiens
gctgcctcctgaaagcgctctg

SEQ ID NO: 8764653 - DNA, 23 bp, Homo sapiens
gctgcctcctacaaaagcccagc

SEQ ID NO: 8764654 - DNA, 22 bp, Homo sapiens
gctgcctccactggctcccagt

SEQ ID NO: 8764655 - DNA, 22 bp, Homo sapiens
gctgcctcccagagccctgcag

SEQ ID NO: 8764656 - DNA, 22 bp, Homo sapiens
gctgcctccactggctcccagt

SEQ ID NO: 8764657 - DNA, 22 bp, Homo sapiens
gctgcctccaatctgtgccccg

SEQ ID NO: 8764658 - DNA, 22 bp, Homo sapiens
gctgcctcccccatggctggaa

SEQ ID NO: 8764659 - DNA, 22 bp, Homo sapiens
gctgcctcccccatggctggaa

SEQ ID NO: 8764660 - DNA, 22 bp, Homo sapiens
gctgcctccgccggctccacag

SEQ ID NO: 8764661 - DNA, 22 bp, Homo sapiens
gctgcaggctgtggcaggggag

SEQ ID NO: 8764662 - DNA, 22 bp, Homo sapiens
gctgcaggctgtggcaggggag

SEQ ID NO: 8764663 - DNA, 22 bp, Homo sapiens
gctgcagggagctggaaggctc

SEQ ID NO: 8764664 - DNA, 22 bp, Homo sapiens
gctgcagggagctggaaggctc

SEQ ID NO: 8764665 - DNA, 22 bp, Homo sapiens
gctgcaggctctgcaggaattg

SEQ ID NO: 8764666 - DNA, 22 bp, Homo sapiens
gctgcaggctctgcaggaattg

SEQ ID NO: 8764667 - DNA, 22 bp, Homo sapiens
gctgcaggcggccgtggtggcg

SEQ ID NO: 8764668 - DNA, 22 bp, Homo sapiens
gctgcaggcggccgtggtggcg

SEQ ID NO: 8764669 - DNA, 22 bp, Homo sapiens
gctgcaggggggtctggacttg

SEQ ID NO: 8764670 - DNA, 22 bp, Homo sapiens
gctgcagggctctcacaggggg

SEQ ID NO: 8764671 - DNA, 22 bp, Homo sapiens
gctgcagggctctcacaggggg

SEQ ID NO: 8764672 - DNA, 22 bp, Homo sapiens
gctgcagggctctcacaggggg

SEQ ID NO: 8764673 - DNA, 22 bp, Homo sapiens
gctgcagggagctggaaggctc

SEQ ID NO: 8764674 - DNA, 22 bp, Homo sapiens
gctgcagggagctggaaggctc

SEQ ID NO: 8764675 - DNA, 21 bp, Homo sapiens
gctgcagggcccagggcaccc

SEQ ID NO: 8764676 - DNA, 21 bp, Homo sapiens
gctgcagggcccagggcaccc

SEQ ID NO: 8764677 - DNA, 21 bp, Homo sapiens
gctgcagggcccagggcaccc

SEQ ID NO: 8764678 - DNA, 21 bp, Homo sapiens
gctgcagggcccagggcaccc

SEQ ID NO: 8764679 - DNA, 22 bp, Homo sapiens
gctgataagagggcaatgagtg

SEQ ID NO: 8764680 - DNA, 22 bp, Homo sapiens
gctgataagaagacccatcctg

SEQ ID NO: 8764681 - DNA, 22 bp, Homo sapiens
gctgataaatagttgatgtacc

SEQ ID NO: 8764682 - DNA, 22 bp, Homo sapiens
gctgcaggcagaatctcccaat

SEQ ID NO: 8764683 - DNA, 18 bp, Homo sapiens
gctgcaggcgcctgcggt

SEQ ID NO: 8764684 - DNA, 18 bp, Homo sapiens
gctgcaggcgcctgcggt

SEQ ID NO: 8764685 - DNA, 22 bp, Homo sapiens
gctgcaggcattttcctgggca

SEQ ID NO: 8764686 - DNA, 22 bp, Homo sapiens
gctgcaggcattttcctgggca

SEQ ID NO: 8764687 - DNA, 18 bp, Homo sapiens
gctgcaggccctccgagg

SEQ ID NO: 8764688 - DNA, 22 bp, Homo sapiens
gctgagtcttgcctgtgctgtc

SEQ ID NO: 8764689 - DNA, 22 bp, Homo sapiens
gctgagtgaaagtttgctgtgt

SEQ ID NO: 8764690 - DNA, 22 bp, Homo sapiens
gctgagtgaaagtttgctgtgt

SEQ ID NO: 8764691 - DNA, 22 bp, Homo sapiens
gctgagtgaggtccagagcttg

SEQ ID NO: 8764692 - DNA, 17 bp, Homo sapiens
gctgagtgcagggagtc

SEQ ID NO: 8764693 - DNA, 22 bp, Homo sapiens
gctgagtgtaatgatggcagag

SEQ ID NO: 8764694 - DNA, 22 bp, Homo sapiens
gctgagtgtaatgatggcagag

SEQ ID NO: 8764695 - DNA, 17 bp, Homo sapiens
gctgagtgcagggagtc

SEQ ID NO: 8764696 - DNA, 22 bp, Homo sapiens
gctgagtggagcagtcagcgct

SEQ ID NO: 8764697 - DNA, 17 bp, Homo sapiens
gctgagtgcagggagtc

SEQ ID NO: 8764698 - DNA, 22 bp, Homo sapiens
gctgagtcagattgcagtcttg

SEQ ID NO: 8764699 - DNA, 22 bp, Homo sapiens
gctgaggttttctgcctgctca

SEQ ID NO: 8764700 - DNA, 22 bp, Homo sapiens
gctgagtatacagactatgtta

SEQ ID NO: 8764701 - DNA, 22 bp, Homo sapiens
gctgagtacatatgatgcatca

SEQ ID NO: 8764702 - DNA, 22 bp, Homo sapiens
gctgaggttttctgcctgctca

SEQ ID NO: 8764703 - DNA, 20 bp, Homo sapiens
gctgaggtttcttcctatat

SEQ ID NO: 8764704 - DNA, 22 bp, Homo sapiens
gctgaggtggtgatggttcatc

SEQ ID NO: 8764705 - DNA, 22 bp, Homo sapiens
gctgaggtggctgccttagtaa

SEQ ID NO: 8764706 - DNA, 22 bp, Homo sapiens
gctgaggtggtgatggttcatc

SEQ ID NO: 8764707 - DNA, 22 bp, Homo sapiens
gctgaggtttcaggagtggcag

SEQ ID NO: 8764708 - DNA, 22 bp, Homo sapiens
gctgaggtgtcaccttgctggg

SEQ ID NO: 8764709 - DNA, 18 bp, Homo sapiens
gctgaggtggtgtcagag

SEQ ID NO: 8764710 - DNA, 20 bp, Homo sapiens
gctgaggggtctatggcata

SEQ ID NO: 8764711 - DNA, 22 bp, Homo sapiens
gctgagggtaacacttcgggat

SEQ ID NO: 8764712 - DNA, 22 bp, Homo sapiens
gctgagggtaacacttcgggat

SEQ ID NO: 8764713 - DNA, 22 bp, Homo sapiens
gctgagggtctgttcatgttgc

SEQ ID NO: 8764714 - DNA, 22 bp, Homo sapiens
gctctgtgtatgtggcaggtgc

SEQ ID NO: 8764715 - DNA, 22 bp, Homo sapiens
gctctgtgtaaatgtagggtcc

SEQ ID NO: 8764716 - DNA, 20 bp, Homo sapiens
gctctgtggtttgagtctcc

SEQ ID NO: 8764717 - DNA, 20 bp, Homo sapiens
gctctgtggtttgagtctcc

SEQ ID NO: 8764718 - DNA, 22 bp, Homo sapiens
gctctgtggtggggcagagttt

SEQ ID NO: 8764719 - DNA, 22 bp, Homo sapiens
gctctgtgggtgagtagaatct

SEQ ID NO: 8764720 - DNA, 22 bp, Homo sapiens
gctctgtgggggaaatcctggg

SEQ ID NO: 8764721 - DNA, 22 bp, Homo sapiens
gctctgtcttcagcacacagta

SEQ ID NO: 8764722 - DNA, 21 bp, Homo sapiens
gctctgtgaaatttcaccagg

SEQ ID NO: 8764723 - DNA, 22 bp, Homo sapiens
gctctgtgaagggtgttgctca

SEQ ID NO: 8764724 - DNA, 22 bp, Homo sapiens
gctctgtgaccttaggcaagtt

SEQ ID NO: 8764725 - DNA, 22 bp, Homo sapiens
gctctgtgagtattggccctgg

SEQ ID NO: 8764726 - DNA, 18 bp, Homo sapiens
gctctgtgaccttgagca

SEQ ID NO: 8764727 - DNA, 22 bp, Homo sapiens
gctctgtgagccacttgatgta

SEQ ID NO: 8764728 - DNA, 22 bp, Homo sapiens
gctctgtccagcgtgcacagaa

SEQ ID NO: 8764729 - DNA, 22 bp, Homo sapiens
gctctgtccagcgtgcacagaa

SEQ ID NO: 8764730 - DNA, 22 bp, Homo sapiens
gctctgtcattttgcagacact

SEQ ID NO: 8764731 - DNA, 20 bp, Homo sapiens
gctctgtctggcctactttt

SEQ ID NO: 8764732 - DNA, 22 bp, Homo sapiens
gctctgtcattttgcagacact

SEQ ID NO: 8764733 - DNA, 22 bp, Homo sapiens
gctctgtcaacagctagctgtg

SEQ ID NO: 8764734 - DNA, 22 bp, Homo sapiens
gctctgtggcaggaggtcttgt

SEQ ID NO: 8764735 - DNA, 22 bp, Homo sapiens
gctctgtgctagaactaagaat

SEQ ID NO: 8764736 - DNA, 22 bp, Homo sapiens
gctctgtgccagggctgggcca

SEQ ID NO: 8764737 - DNA, 22 bp, Homo sapiens
gctctgtgccacatgcagtgtt

SEQ ID NO: 8764738 - DNA, 22 bp, Homo sapiens
gctctgtgccacatgcagtgtt

SEQ ID NO: 8764739 - DNA, 22 bp, Homo sapiens
gctctgtgcaaatagcacccct

SEQ ID NO: 8764740 - DNA, 19 bp, Homo sapiens
gctctgtgatgctgagggg

SEQ ID NO: 8764741 - DNA, 19 bp, Homo sapiens
gctctgtgatgctgagggg

SEQ ID NO: 8764742 - DNA, 19 bp, Homo sapiens
gctctgtgatgctgagggg

SEQ ID NO: 8764743 - DNA, 22 bp, Homo sapiens
gctctgggtagccactgcctgg

SEQ ID NO: 8764744 - DNA, 22 bp, Homo sapiens
gctctgggtagccactgcctgg

SEQ ID NO: 8764745 - DNA, 22 bp, Homo sapiens
gctctgggtagccactgcctgg

SEQ ID NO: 8764746 - DNA, 22 bp, Homo sapiens
gctctctgtcgttatgcttcat

SEQ ID NO: 8764747 - DNA, 22 bp, Homo sapiens
gctctctgtcgttatgcttcat

SEQ ID NO: 8764748 - DNA, 22 bp, Homo sapiens
gctctcttgacagcttgctgtt

SEQ ID NO: 8764749 - DNA, 22 bp, Homo sapiens
gctctcttgacagcttgctgtt

SEQ ID NO: 8764750 - DNA, 22 bp, Homo sapiens
gctctcttgacagcttgctgtt

SEQ ID NO: 8764751 - DNA, 22 bp, Homo sapiens
gctctggggttggaaagtgatc

SEQ ID NO: 8764752 - DNA, 22 bp, Homo sapiens
gctctcttgacagcttgctgtt

SEQ ID NO: 8764753 - DNA, 22 bp, Homo sapiens
gctctcttggtggctgtcctgg

SEQ ID NO: 8764754 - DNA, 22 bp, Homo sapiens
gctctctggaggccatggacag

SEQ ID NO: 8764755 - DNA, 22 bp, Homo sapiens
gctctctggaaggtatcattat

SEQ ID NO: 8764756 - DNA, 22 bp, Homo sapiens
gctctctgccatatgaggatac

SEQ ID NO: 8764757 - DNA, 22 bp, Homo sapiens
gctctctgaggtgctggcagag

SEQ ID NO: 8764758 - DNA, 22 bp, Homo sapiens
gctctctgcaagtcagcagcct

SEQ ID NO: 8764759 - DNA, 22 bp, Homo sapiens
gctctctgcagcctccttggag

SEQ ID NO: 8764760 - DNA, 22 bp, Homo sapiens
gctctctgaggtgctggcagag

SEQ ID NO: 8764761 - DNA, 22 bp, Homo sapiens
gctctcccgcagcctggtgggc

SEQ ID NO: 8764762 - DNA, 22 bp, Homo sapiens
gctctcccgcagcctggtgggc

SEQ ID NO: 8764763 - DNA, 22 bp, Homo sapiens
gctctccaggtctcatgcactg

SEQ ID NO: 8764764 - DNA, 22 bp, Homo sapiens
gctctccaggtctcatgcactg

SEQ ID NO: 8764765 - DNA, 19 bp, Homo sapiens
gctctccctctcagttgag

SEQ ID NO: 8764766 - DNA, 22 bp, Homo sapiens
gctctcccgcagcctggtgggc

SEQ ID NO: 8764767 - DNA, 19 bp, Homo sapiens
gctctccctctcagttgag

SEQ ID NO: 8764768 - DNA, 19 bp, Homo sapiens
gctctccctctcagttgag

SEQ ID NO: 8764769 - DNA, 22 bp, Homo sapiens
gctccctctgctcaggcacttg

SEQ ID NO: 8764770 - DNA, 21 bp, Homo sapiens
gctctccagggccagcccagg

SEQ ID NO: 8764771 - DNA, 22 bp, Homo sapiens
gctccctctgctcaggcacttg

SEQ ID NO: 8764772 - DNA, 22 bp, Homo sapiens
gctctccaggtccaagaatcca

SEQ ID NO: 8764773 - DNA, 22 bp, Homo sapiens
gctcccaggaagagaagggcca

SEQ ID NO: 8764774 - DNA, 22 bp, Homo sapiens
gctcccagctggagcctcaaca

SEQ ID NO: 8764775 - DNA, 20 bp, Homo sapiens
gctcccagcctgcagtcccc

SEQ ID NO: 8764776 - DNA, 22 bp, Homo sapiens
gctcccagcattgctgctgaat

SEQ ID NO: 8764777 - DNA, 22 bp, Homo sapiens
gctcccagcattgctgctgaat

SEQ ID NO: 8764778 - DNA, 22 bp, Homo sapiens
gctcccagcattgctgctgaat

SEQ ID NO: 8764779 - DNA, 20 bp, Homo sapiens
gctccccttctctgggcctc

SEQ ID NO: 8764780 - DNA, 22 bp, Homo sapiens
gctccccattgatctgcaggct

SEQ ID NO: 8764781 - DNA, 22 bp, Homo sapiens
gctccccattgatctgcaggct

SEQ ID NO: 8764782 - DNA, 22 bp, Homo sapiens
gctccccattgatctgcaggct

SEQ ID NO: 8764783 - DNA, 22 bp, Homo sapiens
gctccctcatctgtgctgtttt

SEQ ID NO: 8764784 - DNA, 22 bp, Homo sapiens
gctccccttggtcctcctggga

SEQ ID NO: 8764785 - DNA, 22 bp, Homo sapiens
gctccccttggtcctcctggga

SEQ ID NO: 8764786 - DNA, 22 bp, Homo sapiens
gctccctccatgaggcagaccg

SEQ ID NO: 8764787 - DNA, 22 bp, Homo sapiens
gctccctcccaccagcctgcag

SEQ ID NO: 8764788 - DNA, 22 bp, Homo sapiens
gctccctcccaccagcctgcag

SEQ ID NO: 8764789 - DNA, 22 bp, Homo sapiens
gctccctcccaccagcctgcag

SEQ ID NO: 8764790 - DNA, 22 bp, Homo sapiens
gctccctcccaccagcctgcag

SEQ ID NO: 8764791 - DNA, 22 bp, Homo sapiens
gctccctccatgaggcagaccg

SEQ ID NO: 8764792 - DNA, 22 bp, Homo sapiens
gctccctccatgaggcagaccg

SEQ ID NO: 8764793 - DNA, 22 bp, Homo sapiens
gctccctccatgaggcagaccg

SEQ ID NO: 8764794 - DNA, 22 bp, Homo sapiens
gctcagggagagagggcagccg

SEQ ID NO: 8764795 - DNA, 22 bp, Homo sapiens
gctcagggagcgatttaccatg

SEQ ID NO: 8764796 - DNA, 22 bp, Homo sapiens
gctcagggagtttcacagtgta

SEQ ID NO: 8764797 - DNA, 22 bp, Homo sapiens
gctcagggagtttcacagtgta

SEQ ID NO: 8764798 - DNA, 22 bp, Homo sapiens
gctcagggagtttcacagtgta

SEQ ID NO: 8764799 - DNA, 22 bp, Homo sapiens
gctcagggagtttcacagtgta

SEQ ID NO: 8764800 - DNA, 22 bp, Homo sapiens
gctcagggagtttcacagtgta

SEQ ID NO: 8764801 - DNA, 22 bp, Homo sapiens
gctcagggccatggaccagcag

SEQ ID NO: 8764802 - DNA, 20 bp, Homo sapiens
gctcagggcctgggtctgga

SEQ ID NO: 8764803 - DNA, 20 bp, Homo sapiens
gctcagggcctgggtctgga

SEQ ID NO: 8764804 - DNA, 20 bp, Homo sapiens
gctcagggcctgggtctgga

SEQ ID NO: 8764805 - DNA, 22 bp, Homo sapiens
gctcagggccatggaccagcag

SEQ ID NO: 8764806 - DNA, 22 bp, Homo sapiens
gctcagggccatggaccagcag

SEQ ID NO: 8764807 - DNA, 22 bp, Homo sapiens
gctcagggcctggctgcggact

SEQ ID NO: 8764808 - DNA, 22 bp, Homo sapiens
gctcagggcctggctgcggact

SEQ ID NO: 8764809 - DNA, 22 bp, Homo sapiens
gctagtgagctctttgtcatct

SEQ ID NO: 8764810 - DNA, 22 bp, Homo sapiens
gctagtccacagccatccaggc

SEQ ID NO: 8764811 - DNA, 22 bp, Homo sapiens
gctatacaagtgtagaatagag

SEQ ID NO: 8764812 - DNA, 23 bp, Homo sapiens
gctaggtgcttccacacgtgctg

SEQ ID NO: 8764813 - DNA, 22 bp, Homo sapiens
gctaggtgcagcagacagctta

SEQ ID NO: 8764814 - DNA, 22 bp, Homo sapiens
gctaggtgcagcagacagctta

SEQ ID NO: 8764815 - DNA, 23 bp, Homo sapiens
gctaggtgcttccacacgtgctg

SEQ ID NO: 8764816 - DNA, 22 bp, Homo sapiens
gctcagggaatgagaagatgtt

SEQ ID NO: 8764817 - DNA, 22 bp, Homo sapiens
gctcagggaatgagaagatgtt

SEQ ID NO: 8764818 - DNA, 22 bp, Homo sapiens
gctcagggaaggccacgtgaga

SEQ ID NO: 8764819 - DNA, 22 bp, Homo sapiens
gctcagggaactttttgcaggc

SEQ ID NO: 8764820 - DNA, 22 bp, Homo sapiens
gctcagggaaggccacgtgaga

SEQ ID NO: 8764821 - DNA, 22 bp, Homo sapiens
gctcagggagagagggcagccg

SEQ ID NO: 8764822 - DNA, 18 bp, Homo sapiens
gctcatcccacaatcagg

SEQ ID NO: 8764823 - DNA, 22 bp, Homo sapiens
gctcatcccttaggaggaaggc

SEQ ID NO: 8764824 - DNA, 22 bp, Homo sapiens
gctcatccagcaagccagggcc

SEQ ID NO: 8764825 - DNA, 23 bp, Homo sapiens
gctcatccacggagaggggctcc

SEQ ID NO: 8764826 - DNA, 22 bp, Homo sapiens
gctcccagatttcagccttgtg

SEQ ID NO: 8764827 - DNA, 22 bp, Homo sapiens
gctcccagactgaccagaggtg

SEQ ID NO: 8764828 - DNA, 22 bp, Homo sapiens
gctcccagactgaccagaggtg

SEQ ID NO: 8764829 - DNA, 22 bp, Homo sapiens
gctcccagactgaccagaggtg

SEQ ID NO: 8764830 - DNA, 22 bp, Homo sapiens
gctcccagcaattgaggcagcc

SEQ ID NO: 8764831 - DNA, 22 bp, Homo sapiens
gctcccagcaattgaggcagcc

SEQ ID NO: 8764832 - DNA, 22 bp, Homo sapiens
gctcccagcaattgaggcagcc

SEQ ID NO: 8764833 - DNA, 22 bp, Homo sapiens
gctcccagcaattgaggcagcc

SEQ ID NO: 8764834 - DNA, 22 bp, Homo sapiens
gctcccagcaattgaggcagcc

SEQ ID NO: 8764835 - DNA, 22 bp, Homo sapiens
gctcccagatttcagccttgtg

SEQ ID NO: 8764836 - DNA, 18 bp, Homo sapiens
gctcagtgtgttaacact

SEQ ID NO: 8764837 - DNA, 22 bp, Homo sapiens
gctcagtttcttctattgtatt

SEQ ID NO: 8764838 - DNA, 18 bp, Homo sapiens
gctcagtgtgttaacact

SEQ ID NO: 8764839 - DNA, 23 bp, Homo sapiens
gctcatcaggcttagagtcaagg

SEQ ID NO: 8764840 - DNA, 22 bp, Homo sapiens
gctcagggcgcgagggacgtgg

SEQ ID NO: 8764841 - DNA, 22 bp, Homo sapiens
gctcagggcgcgagggacgtgg

SEQ ID NO: 8764842 - DNA, 22 bp, Homo sapiens
gctagcaaatgtcatttggaag

SEQ ID NO: 8764843 - DNA, 22 bp, Homo sapiens
gctagcagaaagcaggctgctc

SEQ ID NO: 8764844 - DNA, 22 bp, Homo sapiens
gctagaaatcgacttcagaatt

SEQ ID NO: 8764845 - DNA, 19 bp, Homo sapiens
gctagaagatagaatgaaa

SEQ ID NO: 8764846 - DNA, 22 bp, Homo sapiens
gctagaagttgggcctggtgct

SEQ ID NO: 8764847 - DNA, 22 bp, Homo sapiens
gctagaatattgggtaggcaag

SEQ ID NO: 8764848 - DNA, 22 bp, Homo sapiens
gctagagtggctaagcctgcag

SEQ ID NO: 8764849 - DNA, 22 bp, Homo sapiens
gctagctttataatgctgggcg

SEQ ID NO: 8764850 - DNA, 22 bp, Homo sapiens
gctagctttataatgctgggcg

SEQ ID NO: 8764851 - DNA, 22 bp, Homo sapiens
gctaggaaaggaagaactttga

SEQ ID NO: 8764852 - DNA, 22 bp, Homo sapiens
gctaggaatcggacccaggaag

SEQ ID NO: 8764853 - DNA, 22 bp, Homo sapiens
gctagctgggtttcactgtgga

SEQ ID NO: 8764854 - DNA, 17 bp, Homo sapiens
gctaggagagggaggag

SEQ ID NO: 8764855 - DNA, 22 bp, Homo sapiens
gctaggagccgctgcactaggt

SEQ ID NO: 8764856 - DNA, 22 bp, Homo sapiens
gctaggagattgagctctgaag

SEQ ID NO: 8764857 - DNA, 22 bp, Homo sapiens
gctaggagccgctgcactaggt

SEQ ID NO: 8764858 - DNA, 22 bp, Homo sapiens
gctaggaggaagaatgtgaatt

SEQ ID NO: 8764859 - DNA, 20 bp, Homo sapiens
gctaggctggtgattgtcaa

SEQ ID NO: 8764860 - DNA, 22 bp, Homo sapiens
gctaggagtggtgggtcaagga

SEQ ID NO: 8764861 - DNA, 22 bp, Homo sapiens
gctaggagtaaggagaccttca

SEQ ID NO: 8764862 - DNA, 22 bp, Homo sapiens
gctaggagtgggatggaagtcg

SEQ ID NO: 8764863 - DNA, 22 bp, Homo sapiens
gctaggagtgggatggaagtcg

SEQ ID NO: 8764864 - DNA, 16 bp, Homo sapiens
gctaggcaacaggctg

SEQ ID NO: 8764865 - DNA, 19 bp, Homo sapiens
gctaggtgaccagctggat

SEQ ID NO: 8764866 - DNA, 22 bp, Homo sapiens
gctaggtctgtgcgcagccgct

SEQ ID NO: 8764867 - DNA, 18 bp, Homo sapiens
gctagggcatgcatggtg

SEQ ID NO: 8764868 - DNA, 22 bp, Homo sapiens
gctagggcgggagtgctggaga

SEQ ID NO: 8764869 - DNA, 22 bp, Homo sapiens
gctagggactagggaaggagca

SEQ ID NO: 8764870 - DNA, 22 bp, Homo sapiens
gcctggcaggaatctcagtgct

SEQ ID NO: 8764871 - DNA, 22 bp, Homo sapiens
gcctggcaggcctcatgagggg

SEQ ID NO: 8764872 - DNA, 22 bp, Homo sapiens
gcctggcagcctccaaccttca

SEQ ID NO: 8764873 - DNA, 22 bp, Homo sapiens
gcctggcaggaatctcagtgct

SEQ ID NO: 8764874 - DNA, 22 bp, Homo sapiens
gcctggcagcccctagacattt

SEQ ID NO: 8764875 - DNA, 22 bp, Homo sapiens
gcctggcaggcctcatgagggg

SEQ ID NO: 8764876 - DNA, 22 bp, Homo sapiens
gcctggcaggcctcatgagggg

SEQ ID NO: 8764877 - DNA, 22 bp, Homo sapiens
gctagaaactgtttaatctctt

SEQ ID NO: 8764878 - DNA, 22 bp, Homo sapiens
gctagaaactgtttaatctctt

SEQ ID NO: 8764879 - DNA, 22 bp, Homo sapiens
gctagaaaatgaaagataattt

SEQ ID NO: 8764880 - DNA, 22 bp, Homo sapiens
gctagaaaatgaaagataattt

SEQ ID NO: 8764881 - DNA, 22 bp, Homo sapiens
gcctggcagattgacatagcca

SEQ ID NO: 8764882 - DNA, 22 bp, Homo sapiens
gcctggcagattgacatagcca

SEQ ID NO: 8764883 - DNA, 22 bp, Homo sapiens
gcctggcactgggctcctggcc

SEQ ID NO: 8764884 - DNA, 22 bp, Homo sapiens
gcctggcactgggctcctggcc

SEQ ID NO: 8764885 - DNA, 22 bp, Homo sapiens
gcctggcactgggctcctggcc

SEQ ID NO: 8764886 - DNA, 22 bp, Homo sapiens
gcctggcactcactgaagaggc

SEQ ID NO: 8764887 - DNA, 22 bp, Homo sapiens
gcctggcactcactgaagaggc

SEQ ID NO: 8764888 - DNA, 22 bp, Homo sapiens
gcctggcactcaatcatctgct

SEQ ID NO: 8764889 - DNA, 22 bp, Homo sapiens
gcctggcactcaatcatctgct

SEQ ID NO: 8764890 - DNA, 22 bp, Homo sapiens
gcctggcacgggctcggcccac

SEQ ID NO: 8764891 - DNA, 16 bp, Homo sapiens
gcctggcaccgtcggc

SEQ ID NO: 8764892 - DNA, 22 bp, Homo sapiens
gcctggcacgggctcggcccac

SEQ ID NO: 8764893 - DNA, 22 bp, Homo sapiens
gcctggcacgggctcggcccac

SEQ ID NO: 8764894 - DNA, 22 bp, Homo sapiens
gcctggagtggtcctgctgccc

SEQ ID NO: 8764895 - DNA, 20 bp, Homo sapiens
gcctggcacccggggctggc

SEQ ID NO: 8764896 - DNA, 20 bp, Homo sapiens
gcctggcacccggggctggc

SEQ ID NO: 8764897 - DNA, 20 bp, Homo sapiens
gcctggcacccggggctggc

SEQ ID NO: 8764898 - DNA, 22 bp, Homo sapiens
gcctggcaccacagcctttcag

SEQ ID NO: 8764899 - DNA, 22 bp, Homo sapiens
gcctggagttcagccaagtccc

SEQ ID NO: 8764900 - DNA, 22 bp, Homo sapiens
gcctggagttcagccaagtccc

SEQ ID NO: 8764901 - DNA, 22 bp, Homo sapiens
gcctggagttcagccaagtccc

SEQ ID NO: 8764902 - DNA, 22 bp, Homo sapiens
ggaaggctttgaggggtgctgg

SEQ ID NO: 8764903 - DNA, 22 bp, Homo sapiens
ggaaggctttaagcaccaaagc

SEQ ID NO: 8764904 - DNA, 22 bp, Homo sapiens
ggaaggctttctgttctgtgac

SEQ ID NO: 8764905 - DNA, 22 bp, Homo sapiens
ggaaggcttgagttcccaggtc

SEQ ID NO: 8764906 - DNA, 20 bp, Homo sapiens
ggaaggctgtttttccacca

SEQ ID NO: 8764907 - DNA, 22 bp, Homo sapiens
ggaaggcttgagttcccaggtc

SEQ ID NO: 8764908 - DNA, 22 bp, Homo sapiens
ggaaggctctgttccttgactt

SEQ ID NO: 8764909 - DNA, 22 bp, Homo sapiens
ggaaggctccatacacaaagca

SEQ ID NO: 8764910 - DNA, 22 bp, Homo sapiens
ggaaggctccacccaaggcgag

SEQ ID NO: 8764911 - DNA, 22 bp, Homo sapiens
ggaaggctccacccaaggcgag

SEQ ID NO: 8764912 - DNA, 22 bp, Homo sapiens
ggaaggctacaggaatccagcg

SEQ ID NO: 8764913 - DNA, 22 bp, Homo sapiens
ggaaggcagaggtgtcgtgggg

SEQ ID NO: 8764914 - DNA, 22 bp, Homo sapiens
ggaaggcagaggtgtcgtgggg

SEQ ID NO: 8764915 - DNA, 19 bp, Homo sapiens
ggaaggcagaggggctgtg

SEQ ID NO: 8764916 - DNA, 22 bp, Homo sapiens
ggaaggcagtgaaggggctgat

SEQ ID NO: 8764917 - DNA, 22 bp, Homo sapiens
ggaaggcagaggtgtcgtgggg

SEQ ID NO: 8764918 - DNA, 22 bp, Homo sapiens
ggaaggcagtgaaggggctgat

SEQ ID NO: 8764919 - DNA, 22 bp, Homo sapiens
ggaaggcagtgaaggggctgat

SEQ ID NO: 8764920 - DNA, 22 bp, Homo sapiens
ggaaggcagtgaaggggctgat

SEQ ID NO: 8764921 - DNA, 22 bp, Homo sapiens
ggaaggcagtgaaggggctgat

SEQ ID NO: 8764922 - DNA, 22 bp, Homo sapiens
ggaaggcagtgaaggggctgat

SEQ ID NO: 8764923 - DNA, 19 bp, Homo sapiens
ggaaggccacggcaggctt

SEQ ID NO: 8764924 - DNA, 22 bp, Homo sapiens
ggacagagggttgacagagtat

SEQ ID NO: 8764925 - DNA, 22 bp, Homo sapiens
ggacagagggttgacagagtat

SEQ ID NO: 8764926 - DNA, 22 bp, Homo sapiens
ggacagagggttgacagagtat

SEQ ID NO: 8764927 - DNA, 22 bp, Homo sapiens
ggacagagggttgacagagtat

SEQ ID NO: 8764928 - DNA, 18 bp, Homo sapiens
ggacaggagacatgggtg

SEQ ID NO: 8764929 - DNA, 22 bp, Homo sapiens
ggacaggataagagacactgcc

SEQ ID NO: 8764930 - DNA, 22 bp, Homo sapiens
ggacaggatgctgaagatgaag

SEQ ID NO: 8764931 - DNA, 22 bp, Homo sapiens
ggacagagggttgacagagtat

SEQ ID NO: 8764932 - DNA, 22 bp, Homo sapiens
ggacagagggttgacagagtat

SEQ ID NO: 8764933 - DNA, 22 bp, Homo sapiens
ggacagagggttgacagagtat

SEQ ID NO: 8764934 - DNA, 22 bp, Homo sapiens
ggaaggctttgtagaagtgcca

SEQ ID NO: 8764935 - DNA, 22 bp, Homo sapiens
ggaagggaaaattcattcggct

SEQ ID NO: 8764936 - DNA, 22 bp, Homo sapiens
ggaagggaaaattcattcggct

SEQ ID NO: 8764937 - DNA, 22 bp, Homo sapiens
ggaagggaaaattcattcggct

SEQ ID NO: 8764938 - DNA, 22 bp, Homo sapiens
ggaagggaaaattcattcggct

SEQ ID NO: 8764939 - DNA, 22 bp, Homo sapiens
ggaagggaatccatctggttag

SEQ ID NO: 8764940 - DNA, 22 bp, Homo sapiens
ggaagggaatccatctggttag

SEQ ID NO: 8764941 - DNA, 22 bp, Homo sapiens
ggaagggagtagttggaatgca

SEQ ID NO: 8764942 - DNA, 22 bp, Homo sapiens
ggaagggaatccatctggttag

SEQ ID NO: 8764943 - DNA, 18 bp, Homo sapiens
ggaaggagtggaccccag

SEQ ID NO: 8764944 - DNA, 22 bp, Homo sapiens
ggaaggagtctttaacacccat

SEQ ID NO: 8764945 - DNA, 19 bp, Homo sapiens
ggaaggcagaggggctgtg

SEQ ID NO: 8764946 - DNA, 19 bp, Homo sapiens
ggaaggcagaggggctgtg

SEQ ID NO: 8764947 - DNA, 19 bp, Homo sapiens
ggaaggcagaggggctgtg

SEQ ID NO: 8764948 - DNA, 19 bp, Homo sapiens
ggaaggcagaggggctgtg

SEQ ID NO: 8764949 - DNA, 22 bp, Homo sapiens
ggaaggaggggcaaagcagttc

SEQ ID NO: 8764950 - DNA, 19 bp, Homo sapiens
ggaaggcagaggggctgtg

SEQ ID NO: 8764951 - DNA, 18 bp, Homo sapiens
ggaaggagtggaccccag

SEQ ID NO: 8764952 - DNA, 22 bp, Homo sapiens
ggaaggatctggctgaaatcca

SEQ ID NO: 8764953 - DNA, 22 bp, Homo sapiens
ggaaggaggatgctctggcctt

SEQ ID NO: 8764954 - DNA, 22 bp, Homo sapiens
ggaaggagccatatcatatcca

SEQ ID NO: 8764955 - DNA, 22 bp, Homo sapiens
ggaaggaggggcaaagcagttc

SEQ ID NO: 8764956 - DNA, 22 bp, Homo sapiens
ggaaggaggatgctctggcctt

SEQ ID NO: 8764957 - DNA, 22 bp, Homo sapiens
ggaaaaatagagtatactttaa

SEQ ID NO: 8764958 - DNA, 22 bp, Homo sapiens
ggaaaaatagagtatactttaa

SEQ ID NO: 8764959 - DNA, 22 bp, Homo sapiens
ggaaggagcatttgccagttta

SEQ ID NO: 8764960 - DNA, 19 bp, Homo sapiens
ggaaggagagaaatgcatg

SEQ ID NO: 8764961 - DNA, 19 bp, Homo sapiens
ggaaggagagaaatgcatg

SEQ ID NO: 8764962 - DNA, 22 bp, Homo sapiens
ggaaggagcatttgccagttta

SEQ ID NO: 8764963 - DNA, 19 bp, Homo sapiens
ggaaggagagaaatgcatg

SEQ ID NO: 8764964 - DNA, 22 bp, Homo sapiens
ggacaggctgcatctgagcatg

SEQ ID NO: 8764965 - DNA, 22 bp, Homo sapiens
ggacaggctgcatctgagcatg

SEQ ID NO: 8764966 - DNA, 22 bp, Homo sapiens
ggacaggctgcatctgagcatg

SEQ ID NO: 8764967 - DNA, 22 bp, Homo sapiens
ggacaggctgcatctgagcatg

SEQ ID NO: 8764968 - DNA, 22 bp, Homo sapiens
ggacaggcctggcacagtactg

SEQ ID NO: 8764969 - DNA, 22 bp, Homo sapiens
ggacaggcgcagggccaaggaa

SEQ ID NO: 8764970 - DNA, 22 bp, Homo sapiens
ggacaggcgcagggccaaggaa

SEQ ID NO: 8764971 - DNA, 22 bp, Homo sapiens
ggacaggcgcagggccaaggaa

SEQ ID NO: 8764972 - DNA, 22 bp, Homo sapiens
ggacaggccgcctcggtggggg

SEQ ID NO: 8764973 - DNA, 22 bp, Homo sapiens
ggacaggccgcctcggtggggg

SEQ ID NO: 8764974 - DNA, 22 bp, Homo sapiens
ggacaggcaggtgatttccaga

SEQ ID NO: 8764975 - DNA, 22 bp, Homo sapiens
ggacaggccatatggaatacat

SEQ ID NO: 8764976 - DNA, 22 bp, Homo sapiens
ggacaggccatatggaatacat

SEQ ID NO: 8764977 - DNA, 22 bp, Homo sapiens
ggacaggcccggggagcctgga

SEQ ID NO: 8764978 - DNA, 22 bp, Homo sapiens
ggacaggcccggggagcctgga

SEQ ID NO: 8764979 - DNA, 22 bp, Homo sapiens
ggacaggcccggggagcctgga

SEQ ID NO: 8764980 - DNA, 22 bp, Homo sapiens
ggacaggccctctggtcagctt

SEQ ID NO: 8764981 - DNA, 22 bp, Homo sapiens
ggacaggcccggggagcctgga

SEQ ID NO: 8764982 - DNA, 22 bp, Homo sapiens
ggacaggcccggggagcctgga

SEQ ID NO: 8764983 - DNA, 22 bp, Homo sapiens
ggacaggcccggggagcctgga

SEQ ID NO: 8764984 - DNA, 22 bp, Homo sapiens
ggacaggccctctggtcagctt

SEQ ID NO: 8764985 - DNA, 22 bp, Homo sapiens
ggacaggccctctggtcagctt

SEQ ID NO: 8764986 - DNA, 22 bp, Homo sapiens
ggacaggccctctggtcagctt

SEQ ID NO: 8764987 - DNA, 22 bp, Homo sapiens
ggacagggctcttggcactcct

SEQ ID NO: 8764988 - DNA, 22 bp, Homo sapiens
ggacagggctcttggcactcct

SEQ ID NO: 8764989 - DNA, 23 bp, Homo sapiens
ggacagggccctgccctatggcc

SEQ ID NO: 8764990 - DNA, 22 bp, Homo sapiens
ggacagggatcattatctgagc

SEQ ID NO: 8764991 - DNA, 23 bp, Homo sapiens
ggacagggccctgccctatggcc

SEQ ID NO: 8764992 - DNA, 23 bp, Homo sapiens
ggacagggccctgccctatggcc

SEQ ID NO: 8764993 - DNA, 23 bp, Homo sapiens
ggacagggccctgccctatggcc

SEQ ID NO: 8764994 - DNA, 19 bp, Homo sapiens
ggacagggggagcttttat

SEQ ID NO: 8764995 - DNA, 19 bp, Homo sapiens
ggacagggggagcttttat

SEQ ID NO: 8764996 - DNA, 22 bp, Homo sapiens
ggacaggggcgtggggattgtt

SEQ ID NO: 8764997 - DNA, 22 bp, Homo sapiens
ggacaggggcgtggggattgtt

SEQ ID NO: 8764998 - DNA, 22 bp, Homo sapiens
ggacagggctcttggcactcct

SEQ ID NO: 8764999 - DNA, 22 bp, Homo sapiens
ggacaggggcgtggggattgtt

SEQ ID NO: 8765000 - DNA, 22 bp, Homo sapiens
ggacttggggaaggcacagtta

SEQ ID NO: 8765001 - DNA, 22 bp, Homo sapiens
ggacttggggaaggcacagtta

SEQ ID NO: 8765002 - DNA, 22 bp, Homo sapiens
ggacttggggaaggcacagtta

SEQ ID NO: 8765003 - DNA, 22 bp, Homo sapiens
ggactttagcagctggagagga

SEQ ID NO: 8765004 - DNA, 22 bp, Homo sapiens
ggagaaaattgatgaagttggc

SEQ ID NO: 8765005 - DNA, 22 bp, Homo sapiens
ggagaaagaagacgaacattgt

SEQ ID NO: 8765006 - DNA, 22 bp, Homo sapiens
ggagaaagaagacgaacattgt

SEQ ID NO: 8765007 - DNA, 22 bp, Homo sapiens
ggagaaagaaatttttgattgg

SEQ ID NO: 8765008 - DNA, 22 bp, Homo sapiens
ggagaaaattgatgaagttggc

SEQ ID NO: 8765009 - DNA, 22 bp, Homo sapiens
ggagaaaggcatagcagaacct

SEQ ID NO: 8765010 - DNA, 22 bp, Homo sapiens
ggagaaaggcatagcagaacct

SEQ ID NO: 8765011 - DNA, 22 bp, Homo sapiens
ggagaaaggcatagcagaacct

SEQ ID NO: 8765012 - DNA, 22 bp, Homo sapiens
ggactgggaatcagggagatgc

SEQ ID NO: 8765013 - DNA, 22 bp, Homo sapiens
ggactgggtcactaagatagta

SEQ ID NO: 8765014 - DNA, 22 bp, Homo sapiens
ggactgggaatcagggagatgc

SEQ ID NO: 8765015 - DNA, 22 bp, Homo sapiens
ggactggccggcgctgaggccc

SEQ ID NO: 8765016 - DNA, 22 bp, Homo sapiens
ggacagggtaagtactagtgtg

SEQ ID NO: 8765017 - DNA, 22 bp, Homo sapiens
ggactgcctctgtcaccccagc

SEQ ID NO: 8765018 - DNA, 22 bp, Homo sapiens
ggactggccggcgctgaggccc

SEQ ID NO: 8765019 - DNA, 22 bp, Homo sapiens
ggactggactctcaggctcaca

SEQ ID NO: 8765020 - DNA, 22 bp, Homo sapiens
ggactgtgaggtctgggtgagg

SEQ ID NO: 8765021 - DNA, 22 bp, Homo sapiens
ggactgtagacatcagcctgta

SEQ ID NO: 8765022 - DNA, 22 bp, Homo sapiens
ggactgtctccttgctggtagg

SEQ ID NO: 8765023 - DNA, 21 bp, Homo sapiens
ggacttggatggtggcagtag

SEQ ID NO: 8765024 - DNA, 21 bp, Homo sapiens
ggacttggatggtggcagtag

SEQ ID NO: 8765025 - DNA, 22 bp, Homo sapiens
ggacttggcttctttcagagac

SEQ ID NO: 8765026 - DNA, 22 bp, Homo sapiens
ggacttgcaggggagactgcgt

SEQ ID NO: 8765027 - DNA, 22 bp, Homo sapiens
ggagctggctacagagaactcc

SEQ ID NO: 8765028 - DNA, 22 bp, Homo sapiens
ggagctggctacagagaactcc

SEQ ID NO: 8765029 - DNA, 22 bp, Homo sapiens
ggagctggctacagagaactcc

SEQ ID NO: 8765030 - DNA, 22 bp, Homo sapiens
ggagctgggaattggatcatct

SEQ ID NO: 8765031 - DNA, 22 bp, Homo sapiens
ggagctgggaattggatcatct

SEQ ID NO: 8765032 - DNA, 22 bp, Homo sapiens
ggagctgggaattggatcatct

SEQ ID NO: 8765033 - DNA, 22 bp, Homo sapiens
ggagctgggaattggatcatct

SEQ ID NO: 8765034 - DNA, 22 bp, Homo sapiens
ggagctgggaattggatcatct

SEQ ID NO: 8765035 - DNA, 22 bp, Homo sapiens
ggagctgggaccctgtcatctg

SEQ ID NO: 8765036 - DNA, 22 bp, Homo sapiens
ggagctgggaccctgtcatctg

SEQ ID NO: 8765037 - DNA, 22 bp, Homo sapiens
ggagctggctacagagaactcc

SEQ ID NO: 8765038 - DNA, 22 bp, Homo sapiens
ggagctgggaccctgtcatctg

SEQ ID NO: 8765039 - DNA, 22 bp, Homo sapiens
ggagctgggaccctgtcatctg

SEQ ID NO: 8765040 - DNA, 18 bp, Homo sapiens
ggagctgggccccactcc

SEQ ID NO: 8765041 - DNA, 18 bp, Homo sapiens
ggagctgggccccactcc

SEQ ID NO: 8765042 - DNA, 21 bp, Homo sapiens
ggagctggggagctggcccca

SEQ ID NO: 8765043 - DNA, 21 bp, Homo sapiens
ggagctggggagctggcccca

SEQ ID NO: 8765044 - DNA, 22 bp, Homo sapiens
ggagctgcatttagggagcctt

SEQ ID NO: 8765045 - DNA, 20 bp, Homo sapiens
ggagctgccctgggctggag

SEQ ID NO: 8765046 - DNA, 20 bp, Homo sapiens
ggagctgccctgggctggag

SEQ ID NO: 8765047 - DNA, 22 bp, Homo sapiens
ggagctggccgcctatgtgcag

SEQ ID NO: 8765048 - DNA, 22 bp, Homo sapiens
ggagcctggcctggctctgtgt

SEQ ID NO: 8765049 - DNA, 22 bp, Homo sapiens
ggagcctggcctggctctgtgt

SEQ ID NO: 8765050 - DNA, 22 bp, Homo sapiens
ggagcctgggcctcctgccctt

SEQ ID NO: 8765051 - DNA, 22 bp, Homo sapiens
ggagcctgggcctcctgccctt

SEQ ID NO: 8765052 - DNA, 22 bp, Homo sapiens
ggagcctggtatagtgttgcat

SEQ ID NO: 8765053 - DNA, 22 bp, Homo sapiens
ggagcctggtatagtgttgcat

SEQ ID NO: 8765054 - DNA, 22 bp, Homo sapiens
ggagctgcatttagggagcctt

SEQ ID NO: 8765055 - DNA, 21 bp, Homo sapiens
ggagctgcaggagccgaaggc

SEQ ID NO: 8765056 - DNA, 22 bp, Homo sapiens
ggaggaggggtgactgaatgct

SEQ ID NO: 8765057 - DNA, 22 bp, Homo sapiens
ggaggaggggtgactgaatgct

SEQ ID NO: 8765058 - DNA, 22 bp, Homo sapiens
ggaggaggggcgctttgtctat

SEQ ID NO: 8765059 - DNA, 22 bp, Homo sapiens
ggaggaggggcgctttgtctat

SEQ ID NO: 8765060 - DNA, 21 bp, Homo sapiens
ggaggaaaaaggaatgacttg

SEQ ID NO: 8765061 - DNA, 22 bp, Homo sapiens
ggaggaggcggcagaagttcct

SEQ ID NO: 8765062 - DNA, 21 bp, Homo sapiens
ggaggaaaaaggaatgacttg

SEQ ID NO: 8765063 - DNA, 19 bp, Homo sapiens
ggagcttggtggctgtggc

SEQ ID NO: 8765064 - DNA, 19 bp, Homo sapiens
ggagcttggtggctgtggc

SEQ ID NO: 8765065 - DNA, 22 bp, Homo sapiens
ggagctgttgcgcatgcgctcg

SEQ ID NO: 8765066 - DNA, 22 bp, Homo sapiens
ggagctggtcagccttgagcat

SEQ ID NO: 8765067 - DNA, 22 bp, Homo sapiens
ggagctggggttggcatcttcc

SEQ ID NO: 8765068 - DNA, 22 bp, Homo sapiens
ggagctggtcagccttgagcat

SEQ ID NO: 8765069 - DNA, 22 bp, Homo sapiens
ggagctggtcagccttgagcat

SEQ ID NO: 8765070 - DNA, 22 bp, Homo sapiens
ggagctggtcagccttgagcat

SEQ ID NO: 8765071 - DNA, 22 bp, Homo sapiens
ggagctggggttggcatcttcc

SEQ ID NO: 8765072 - DNA, 22 bp, Homo sapiens
ggagctggggttggcatcttcc

SEQ ID NO: 8765073 - DNA, 22 bp, Homo sapiens
ggagctggggttggcatcttcc

SEQ ID NO: 8765074 - DNA, 21 bp, Homo sapiens
ggagctggggagctggcccca

SEQ ID NO: 8765075 - DNA, 22 bp, Homo sapiens
ggagctgttatggcataagcat

SEQ ID NO: 8765076 - DNA, 22 bp, Homo sapiens
ggagctgttaaatgcagaattt

SEQ ID NO: 8765077 - DNA, 22 bp, Homo sapiens
ggagctgtaacgagccattgct

SEQ ID NO: 8765078 - DNA, 22 bp, Homo sapiens
ggagctgtctgtagggcacagg

SEQ ID NO: 8765079 - DNA, 22 bp, Homo sapiens
ggagctgtgcagtgactacaga

SEQ ID NO: 8765080 - DNA, 22 bp, Homo sapiens
ggagaagaggagctggaagcct

SEQ ID NO: 8765081 - DNA, 22 bp, Homo sapiens
ggagaagaggagctggaagcct

SEQ ID NO: 8765082 - DNA, 22 bp, Homo sapiens
ggagaagaggagctggaagcct

SEQ ID NO: 8765083 - DNA, 22 bp, Homo sapiens
ggagaagaggagctggaagcct

SEQ ID NO: 8765084 - DNA, 22 bp, Homo sapiens
ggagaagaggagctggaagcct

SEQ ID NO: 8765085 - DNA, 22 bp, Homo sapiens
ggagaacaggcaagcatctggc

SEQ ID NO: 8765086 - DNA, 18 bp, Homo sapiens
ggagaagaacagatgtgg

SEQ ID NO: 8765087 - DNA, 18 bp, Homo sapiens
ggagaagaacagatgtgg

SEQ ID NO: 8765088 - DNA, 22 bp, Homo sapiens
ggagaagaggagctggaagcct

SEQ ID NO: 8765089 - DNA, 22 bp, Homo sapiens
ggagaacaggcaagcatctggc

SEQ ID NO: 8765090 - DNA, 18 bp, Homo sapiens
ggagaagaacagatgtgg

SEQ ID NO: 8765091 - DNA, 22 bp, Homo sapiens
ggagaaagtcagctccaagcag

SEQ ID NO: 8765092 - DNA, 22 bp, Homo sapiens
ggagaaagtacagcaggcaaca

SEQ ID NO: 8765093 - DNA, 22 bp, Homo sapiens
ggagaaagtacagcaggcaaca

SEQ ID NO: 8765094 - DNA, 22 bp, Homo sapiens
ggagaaagtacagcaggcaaca

SEQ ID NO: 8765095 - DNA, 22 bp, Homo sapiens
ggagaaagggactgatctgctc

SEQ ID NO: 8765096 - DNA, 22 bp, Homo sapiens
ggagccaggcaatctgtacttt

SEQ ID NO: 8765097 - DNA, 22 bp, Homo sapiens
ggagaagaggagctggaagcct

SEQ ID NO: 8765098 - DNA, 22 bp, Homo sapiens
ggagaagattggaattaagcac

SEQ ID NO: 8765099 - DNA, 22 bp, Homo sapiens
ggagccaggggaccttcacaga

SEQ ID NO: 8765100 - DNA, 22 bp, Homo sapiens
ggagccagggaagctgcttcct

SEQ ID NO: 8765101 - DNA, 18 bp, Homo sapiens
ggagcccagaggacagga

SEQ ID NO: 8765102 - DNA, 18 bp, Homo sapiens
ggagcccagaggacagga

SEQ ID NO: 8765103 - DNA, 18 bp, Homo sapiens
ggagcccagaggtgagtt

SEQ ID NO: 8765104 - DNA, 18 bp, Homo sapiens
ggagcccacggcgtccca

SEQ ID NO: 8765105 - DNA, 18 bp, Homo sapiens
ggagcccacggcgtccca

SEQ ID NO: 8765106 - DNA, 22 bp, Homo sapiens
ggagcccaagtctgcactcggc

SEQ ID NO: 8765107 - DNA, 22 bp, Homo sapiens
ggagccatgttttcagcatgat

SEQ ID NO: 8765108 - DNA, 22 bp, Homo sapiens
ggagcccaagtctgcactcggc

SEQ ID NO: 8765109 - DNA, 18 bp, Homo sapiens
ggagccagtctgtctctg

SEQ ID NO: 8765110 - DNA, 18 bp, Homo sapiens
ggagcccagaggtgagtt

SEQ ID NO: 8765111 - DNA, 22 bp, Homo sapiens
ggagcccagtcggggtgtaggt

SEQ ID NO: 8765112 - DNA, 22 bp, Homo sapiens
ggagcccagtcggggtgtaggt

SEQ ID NO: 8765113 - DNA, 22 bp, Homo sapiens
ggagcccaggttgtttgtgcag

SEQ ID NO: 8765114 - DNA, 22 bp, Homo sapiens
ggagccccaattgagcagtacg

SEQ ID NO: 8765115 - DNA, 22 bp, Homo sapiens
ggagccctcaccggcgagtgcc

SEQ ID NO: 8765116 - DNA, 19 bp, Homo sapiens
ggagcctggagcacgtgcc

SEQ ID NO: 8765117 - DNA, 19 bp, Homo sapiens
ggagcctggagcacgtgcc

SEQ ID NO: 8765118 - DNA, 22 bp, Homo sapiens
ggagccctcaccggcgagtgcc

SEQ ID NO: 8765119 - DNA, 22 bp, Homo sapiens
ggagcctggagtttctgatggg

SEQ ID NO: 8765120 - DNA, 22 bp, Homo sapiens
ggagcctggcaatgctgcgtcc

SEQ ID NO: 8765121 - DNA, 22 bp, Homo sapiens
ggagcctggcaatgctgcgtcc

SEQ ID NO: 8765122 - DNA, 22 bp, Homo sapiens
ggagcctggcaatgctgcgtcc

SEQ ID NO: 8765123 - DNA, 19 bp, Homo sapiens
ggagcctggcaggggcgtg

SEQ ID NO: 8765124 - DNA, 19 bp, Homo sapiens
ggagcctggcaggggcgtg

SEQ ID NO: 8765125 - DNA, 23 bp, Homo sapiens
ggagcctggcatatgagacgcat

SEQ ID NO: 8765126 - DNA, 22 bp, Homo sapiens
ggagcctggcccggcccttggc

SEQ ID NO: 8765127 - DNA, 22 bp, Homo sapiens
gctttacaagtggtgcagatta

SEQ ID NO: 8765128 - DNA, 22 bp, Homo sapiens
gctttacaacaaattgaatatg

SEQ ID NO: 8765129 - DNA, 22 bp, Homo sapiens
gctttacacagatgaatatttc

SEQ ID NO: 8765130 - DNA, 22 bp, Homo sapiens
gctttaatgcaatttcacctca

SEQ ID NO: 8765131 - DNA, 22 bp, Homo sapiens
gctttaatgcttcgtggggcca

SEQ ID NO: 8765132 - DNA, 22 bp, Homo sapiens
gctttacacagatgaatatttc

SEQ ID NO: 8765133 - DNA, 22 bp, Homo sapiens
gctttacagagaaagtttgcct

SEQ ID NO: 8765134 - DNA, 22 bp, Homo sapiens
gctttacagagaaagtttgcct

SEQ ID NO: 8765135 - DNA, 22 bp, Homo sapiens
gctttacacagctggttcttgt

SEQ ID NO: 8765136 - DNA, 22 bp, Homo sapiens
gctttacagggcacaaagggag

SEQ ID NO: 8765137 - DNA, 22 bp, Homo sapiens
gctttacataaacatttattat

SEQ ID NO: 8765138 - DNA, 22 bp, Homo sapiens
gctttacatgtttccctttaag

SEQ ID NO: 8765139 - DNA, 22 bp, Homo sapiens
gctttacatgatttctcaccct

SEQ ID NO: 8765140 - DNA, 22 bp, Homo sapiens
gctttacatgagatgaggacaa

SEQ ID NO: 8765141 - DNA, 22 bp, Homo sapiens
gcttgtttgtgatttctccaga

SEQ ID NO: 8765142 - DNA, 22 bp, Homo sapiens
gctttaaacctctactctgtcc

SEQ ID NO: 8765143 - DNA, 22 bp, Homo sapiens
gcttgtttgtgcctctgcagaa

SEQ ID NO: 8765144 - DNA, 22 bp, Homo sapiens
gcttgtcattactggtttctcg

SEQ ID NO: 8765145 - DNA, 22 bp, Homo sapiens
gctttaatgaagtcacgcaaag

SEQ ID NO: 8765146 - DNA, 22 bp, Homo sapiens
gctttaaatggcttgcccaagt

SEQ ID NO: 8765147 - DNA, 22 bp, Homo sapiens
gcttgtttgtgatttctccaga

SEQ ID NO: 8765148 - DNA, 21 bp, Homo sapiens
gcttggttttggttacttgcc

SEQ ID NO: 8765149 - DNA, 22 bp, Homo sapiens
gcttggtttctaacttttcata

SEQ ID NO: 8765150 - DNA, 22 bp, Homo sapiens
gcttggtttctaacttttcata

SEQ ID NO: 8765151 - DNA, 22 bp, Homo sapiens
gcttggttactgatggaaagga

SEQ ID NO: 8765152 - DNA, 18 bp, Homo sapiens
gcttggtttccacaaacc

SEQ ID NO: 8765153 - DNA, 22 bp, Homo sapiens
gcttggttactgatggaaagga

SEQ ID NO: 8765154 - DNA, 22 bp, Homo sapiens
gcttggtagtgtgaactgtctc

SEQ ID NO: 8765155 - DNA, 22 bp, Homo sapiens
gcttggggtcatgaggctgctg

SEQ ID NO: 8765156 - DNA, 22 bp, Homo sapiens
gcttggtttggcaaaggaagga

SEQ ID NO: 8765157 - DNA, 21 bp, Homo sapiens
gcttggttttggttacttgcc

SEQ ID NO: 8765158 - DNA, 21 bp, Homo sapiens
gcttggttttggttacttgcc

SEQ ID NO: 8765159 - DNA, 22 bp, Homo sapiens
gcttggcaggtctgggattgtt

SEQ ID NO: 8765160 - DNA, 22 bp, Homo sapiens
gcttggaagtaggattgggaga

SEQ ID NO: 8765161 - DNA, 22 bp, Homo sapiens
gctgtgtgctcacgtagtggaa

SEQ ID NO: 8765162 - DNA, 22 bp, Homo sapiens
gctgtgtgctctggtctttctt

SEQ ID NO: 8765163 - DNA, 22 bp, Homo sapiens
gctgtgtgctctggtctttctt

SEQ ID NO: 8765164 - DNA, 22 bp, Homo sapiens
gctgtgtggctgtgccgtcacg

SEQ ID NO: 8765165 - DNA, 22 bp, Homo sapiens
gctgtgtggctgtgccgtcacg

SEQ ID NO: 8765166 - DNA, 22 bp, Homo sapiens
gctgtgtggcaaagggattaca

SEQ ID NO: 8765167 - DNA, 22 bp, Homo sapiens
gctgtgtggcaaagggattaca

SEQ ID NO: 8765168 - DNA, 22 bp, Homo sapiens
gctgtgtgctcacgtagtggaa

SEQ ID NO: 8765169 - DNA, 22 bp, Homo sapiens
gctgtgtgctgggcatggcact

SEQ ID NO: 8765170 - DNA, 22 bp, Homo sapiens
gctgtgtgctgggcatggcact

SEQ ID NO: 8765171 - DNA, 22 bp, Homo sapiens
gctgtgtgctgggcatggcact

SEQ ID NO: 8765172 - DNA, 22 bp, Homo sapiens
gctgtgttcattttgcatatgt

SEQ ID NO: 8765173 - DNA, 22 bp, Homo sapiens
gctgtgttgggaatcatgtggg

SEQ ID NO: 8765174 - DNA, 22 bp, Homo sapiens
gctgtgtgttcaataatgtgat

SEQ ID NO: 8765175 - DNA, 22 bp, Homo sapiens
gctgtgtgttcaataatgtgat

SEQ ID NO: 8765176 - DNA, 22 bp, Homo sapiens
gctgtgtgttcaataatgtgat

SEQ ID NO: 8765177 - DNA, 22 bp, Homo sapiens
gctgttggcgaggagctcagct

SEQ ID NO: 8765178 - DNA, 22 bp, Homo sapiens
gctgttggcgaggagctcagct

SEQ ID NO: 8765179 - DNA, 21 bp, Homo sapiens
gctgtttaacaataaggagtc

SEQ ID NO: 8765180 - DNA, 22 bp, Homo sapiens
gctgtttaaatttaagtgtttc

SEQ ID NO: 8765181 - DNA, 22 bp, Homo sapiens
gctgtgttggtgaagctgtagc

SEQ ID NO: 8765182 - DNA, 22 bp, Homo sapiens
gctgtgttcattttgcatatgt

SEQ ID NO: 8765183 - DNA, 22 bp, Homo sapiens
gctgtgtttgacagtagcagac

SEQ ID NO: 8765184 - DNA, 17 bp, Homo sapiens
gctgtttctccagaagt

SEQ ID NO: 8765185 - DNA, 22 bp, Homo sapiens
gctgtttctaccagaagaatca

SEQ ID NO: 8765186 - DNA, 22 bp, Homo sapiens
gctgtttctaagctggttccta

SEQ ID NO: 8765187 - DNA, 22 bp, Homo sapiens
gctgtttcgggtggaggtggag

SEQ ID NO: 8765188 - DNA, 22 bp, Homo sapiens
gctgtttcggcctcctggggaa

SEQ ID NO: 8765189 - DNA, 22 bp, Homo sapiens
gctgtttcccgtgcgctgcgtc

SEQ ID NO: 8765190 - DNA, 22 bp, Homo sapiens
gctgtttccatttaagtgaatc

SEQ ID NO: 8765191 - DNA, 23 bp, Homo sapiens
gctgtttccccatgtgctgaagg

SEQ ID NO: 8765192 - DNA, 22 bp, Homo sapiens
gctgtttccccttcacagtggc

SEQ ID NO: 8765193 - DNA, 22 bp, Homo sapiens
gctgtttcctacatggtgttat

SEQ ID NO: 8765194 - DNA, 22 bp, Homo sapiens
gctgtttagatccacactgttg

SEQ ID NO: 8765195 - DNA, 22 bp, Homo sapiens
gctgtttagatccacactgttg

SEQ ID NO: 8765196 - DNA, 22 bp, Homo sapiens
gctgtttagtggcagagtcaga

SEQ ID NO: 8765197 - DNA, 23 bp, Homo sapiens
gctgtttcacaacagccgtgttt

SEQ ID NO: 8765198 - DNA, 22 bp, Homo sapiens
gctgtttccagacaatgtcttt

SEQ ID NO: 8765199 - DNA, 22 bp, Homo sapiens
gctgtttccagttacgtggata

SEQ ID NO: 8765200 - DNA, 22 bp, Homo sapiens
gctgtttctgagtagctaggct

SEQ ID NO: 8765201 - DNA, 22 bp, Homo sapiens
gctgtttctggttctgttccta

SEQ ID NO: 8765202 - DNA, 22 bp, Homo sapiens
gctgtttctgtggtgtatagcc

SEQ ID NO: 8765203 - DNA, 22 bp, Homo sapiens
gctgtttcttgaggctactcct

SEQ ID NO: 8765204 - DNA, 22 bp, Homo sapiens
gctgtttctttcctggcacttg

SEQ ID NO: 8765205 - DNA, 22 bp, Homo sapiens
gctgtttctttgatgatggaat

SEQ ID NO: 8765206 - DNA, 17 bp, Homo sapiens
gctgtttctccagaagt

SEQ ID NO: 8765207 - DNA, 22 bp, Homo sapiens
gctgtttctccaggtcaggaag

SEQ ID NO: 8765208 - DNA, 22 bp, Homo sapiens
gctgtttctcttgagtcaaaat

SEQ ID NO: 8765209 - DNA, 22 bp, Homo sapiens
gctgtttctcttgagtcaaaat

SEQ ID NO: 8765210 - DNA, 22 bp, Homo sapiens
gctgtttctctcccaccccttc

SEQ ID NO: 8765211 - DNA, 22 bp, Homo sapiens
gcttaaaagccacttagtctat

SEQ ID NO: 8765212 - DNA, 22 bp, Homo sapiens
gctgtttgcccccactccttca

SEQ ID NO: 8765213 - DNA, 22 bp, Homo sapiens
gctgtttgaggcacatgattaa

SEQ ID NO: 8765214 - DNA, 22 bp, Homo sapiens
gctgtttctttggcaaactgat

SEQ ID NO: 8765215 - DNA, 18 bp, Homo sapiens
gctttttagtgcatcttc

SEQ ID NO: 8765216 - DNA, 20 bp, Homo sapiens
gctttttctaatagcagtcc

SEQ ID NO: 8765217 - DNA, 22 bp, Homo sapiens
gctttttcaaatgaaagctggt

SEQ ID NO: 8765218 - DNA, 18 bp, Homo sapiens
gctttttagtgcatcttc

SEQ ID NO: 8765219 - DNA, 20 bp, Homo sapiens
gctttttctaatagcagtcc

SEQ ID NO: 8765220 - DNA, 20 bp, Homo sapiens
gctttttctaatagcagtcc

SEQ ID NO: 8765221 - DNA, 22 bp, Homo sapiens
gcttttttgctattgaagtggt

SEQ ID NO: 8765222 - DNA, 22 bp, Homo sapiens
gcttttttgggatgcctgcctt

SEQ ID NO: 8765223 - DNA, 19 bp, Homo sapiens
gctttttgttgtcaaaggt

SEQ ID NO: 8765224 - DNA, 22 bp, Homo sapiens
gcttttttaggtaagacccagg

SEQ ID NO: 8765225 - DNA, 22 bp, Homo sapiens
gcttttgaggtcctgctcagcc

SEQ ID NO: 8765226 - DNA, 22 bp, Homo sapiens
gcttttggacctctgatgtttc

SEQ ID NO: 8765227 - DNA, 22 bp, Homo sapiens
gcttttggacctctgatgtttc

SEQ ID NO: 8765228 - DNA, 22 bp, Homo sapiens
gcttttgtcatggtgactcagt

SEQ ID NO: 8765229 - DNA, 22 bp, Homo sapiens
gcttttgtggctgtcttcattg

SEQ ID NO: 8765230 - DNA, 22 bp, Homo sapiens
gcttttgtgagctctcactttg

SEQ ID NO: 8765231 - DNA, 22 bp, Homo sapiens
gcttttgttccacagttttgaa

SEQ ID NO: 8765232 - DNA, 22 bp, Homo sapiens
gcttttgtggctgtcttcattg

SEQ ID NO: 8765233 - DNA, 22 bp, Homo sapiens
gcttttgtggctgtcttcattg

SEQ ID NO: 8765234 - DNA, 22 bp, Homo sapiens
gcttttctagctagaacatccg

SEQ ID NO: 8765235 - DNA, 22 bp, Homo sapiens
gcttttctataagaactttcaa

SEQ ID NO: 8765236 - DNA, 22 bp, Homo sapiens
gcttttcctgactttccattag

SEQ ID NO: 8765237 - DNA, 22 bp, Homo sapiens
gcttttatttcttcacaaaagt

SEQ ID NO: 8765238 - DNA, 22 bp, Homo sapiens
gcttttatttcttcacaaaagt

SEQ ID NO: 8765239 - DNA, 22 bp, Homo sapiens
gcttttaattagttgcttccat

SEQ ID NO: 8765240 - DNA, 22 bp, Homo sapiens
gctttgtgtagaaggaggatgg

SEQ ID NO: 8765241 - DNA, 22 bp, Homo sapiens
gcttttattgtctttacgacga

SEQ ID NO: 8765242 - DNA, 22 bp, Homo sapiens
gctttgggagtcagatttgcgc

SEQ ID NO: 8765243 - DNA, 22 bp, Homo sapiens
gctttggcccaggagccaaggt

SEQ ID NO: 8765244 - DNA, 22 bp, Homo sapiens
gctttggctatcatagcatttg

SEQ ID NO: 8765245 - DNA, 22 bp, Homo sapiens
gctttgggggctgcagtgcgtg

SEQ ID NO: 8765246 - DNA, 22 bp, Homo sapiens
gctttatccgcttgacccttac

SEQ ID NO: 8765247 - DNA, 22 bp, Homo sapiens
gctttgggtgtcctctgggcct

SEQ ID NO: 8765248 - DNA, 17 bp, Homo sapiens
gctttggcagtttcaag

SEQ ID NO: 8765249 - DNA, 23 bp, Homo sapiens
gctttatagttctcccaacatta

SEQ ID NO: 8765250 - DNA, 22 bp, Homo sapiens
gctttagatactcccaatgtcc

SEQ ID NO: 8765251 - DNA, 22 bp, Homo sapiens
gctttagatagatttagtcttt

SEQ ID NO: 8765252 - DNA, 22 bp, Homo sapiens
gctttagatactcccaatgtcc

SEQ ID NO: 8765253 - DNA, 22 bp, Homo sapiens
gctttagagcccagcttggtgg

SEQ ID NO: 8765254 - DNA, 22 bp, Homo sapiens
gctttagatactcccaatgtcc

SEQ ID NO: 8765255 - DNA, 22 bp, Homo sapiens
gctttagatagatttagtcttt

SEQ ID NO: 8765256 - DNA, 22 bp, Homo sapiens
gctttagatctgactttctgtg

SEQ ID NO: 8765257 - DNA, 22 bp, Homo sapiens
gctttagatagatttagtcttt

SEQ ID NO: 8765258 - DNA, 22 bp, Homo sapiens
gctttagatctgactttctgtg

SEQ ID NO: 8765259 - DNA, 21 bp, Homo sapiens
gctttagatttagtgagccag

SEQ ID NO: 8765260 - DNA, 22 bp, Homo sapiens
gctttagaaatatcactgtgga

SEQ ID NO: 8765261 - DNA, 22 bp, Homo sapiens
gctttagaaatgagtaaattag

SEQ ID NO: 8765262 - DNA, 22 bp, Homo sapiens
gctttagaaatatcactgtgga

SEQ ID NO: 8765263 - DNA, 22 bp, Homo sapiens
gctttacattttggaaaggtga

SEQ ID NO: 8765264 - DNA, 22 bp, Homo sapiens
gctttagaagacactctgtttt

SEQ ID NO: 8765265 - DNA, 22 bp, Homo sapiens
gctttagacataaagttcttca

SEQ ID NO: 8765266 - DNA, 22 bp, Homo sapiens
gctttagaaatgtaggagatac

SEQ ID NO: 8765267 - DNA, 22 bp, Homo sapiens
gctttagaaatgagtaaattag

SEQ ID NO: 8765268 - DNA, 22 bp, Homo sapiens
gctttagaaatgtaggagatac

SEQ ID NO: 8765269 - DNA, 22 bp, Homo sapiens
gctttagagaagaaaggttgct

SEQ ID NO: 8765270 - DNA, 22 bp, Homo sapiens
gctttagagcccagcttggtgg

SEQ ID NO: 8765271 - DNA, 22 bp, Homo sapiens
gctttagagcccagcttggtgg

SEQ ID NO: 8765272 - DNA, 22 bp, Homo sapiens
gctttagagaagaaaggttgct

SEQ ID NO: 8765273 - DNA, 22 bp, Homo sapiens
gctttagaagacactctgtttt

SEQ ID NO: 8765274 - DNA, 22 bp, Homo sapiens
gctgtctggcatggcgtggctg

SEQ ID NO: 8765275 - DNA, 22 bp, Homo sapiens
gctgtctggcatggcgtggctg

SEQ ID NO: 8765276 - DNA, 20 bp, Homo sapiens
gctgtctggattagaagcct

SEQ ID NO: 8765277 - DNA, 20 bp, Homo sapiens
gctgtctggattagaagcct

SEQ ID NO: 8765278 - DNA, 22 bp, Homo sapiens
gctgtctgggatgtcactgctg

SEQ ID NO: 8765279 - DNA, 22 bp, Homo sapiens
gctgtctgggaggcctccactt

SEQ ID NO: 8765280 - DNA, 22 bp, Homo sapiens
gctgtctggaggctctgaggga

SEQ ID NO: 8765281 - DNA, 22 bp, Homo sapiens
gctgtctggaggctctgaggga

SEQ ID NO: 8765282 - DNA, 22 bp, Homo sapiens
gctgtctgctgtgcactgagca

SEQ ID NO: 8765283 - DNA, 22 bp, Homo sapiens
gctgtctgctgtgcactgagca

SEQ ID NO: 8765284 - DNA, 22 bp, Homo sapiens
gctgtctgctgtgcactgagca

SEQ ID NO: 8765285 - DNA, 22 bp, Homo sapiens
gctgtctgggatgtcactgctg

SEQ ID NO: 8765286 - DNA, 22 bp, Homo sapiens
gctgtctgggtgcccaaaagaa

SEQ ID NO: 8765287 - DNA, 22 bp, Homo sapiens
gctgtctgtctctgtcccacca

SEQ ID NO: 8765288 - DNA, 23 bp, Homo sapiens
gctgtctgtcatctctgcgggag

SEQ ID NO: 8765289 - DNA, 23 bp, Homo sapiens
gctgtctgtcatctctgcgggag

SEQ ID NO: 8765290 - DNA, 22 bp, Homo sapiens
gctgtgtgaccctagccagtag

SEQ ID NO: 8765291 - DNA, 22 bp, Homo sapiens
gctgtctgtggtgtcagctgac

SEQ ID NO: 8765292 - DNA, 22 bp, Homo sapiens
gctgtctgtggtgtcagctgac

SEQ ID NO: 8765293 - DNA, 22 bp, Homo sapiens
gctgtctgtcttcacatctcgc

SEQ ID NO: 8765294 - DNA, 22 bp, Homo sapiens
gctgtctgtctctgtgacttaa

SEQ ID NO: 8765295 - DNA, 22 bp, Homo sapiens
gctgtctgtcttcacatctcgc

SEQ ID NO: 8765296 - DNA, 22 bp, Homo sapiens
gctgtctgtcttcacatctcgc

SEQ ID NO: 8765297 - DNA, 22 bp, Homo sapiens
gctgtgtgccaggggaaggctg

SEQ ID NO: 8765298 - DNA, 22 bp, Homo sapiens
gctgtgtgccaggggaaggctg

SEQ ID NO: 8765299 - DNA, 18 bp, Homo sapiens
gctgtgtgcacctgataa

SEQ ID NO: 8765300 - DNA, 22 bp, Homo sapiens
gctgtgtgactgagagcctggc

SEQ ID NO: 8765301 - DNA, 18 bp, Homo sapiens
gctgtgtgcacctgataa

SEQ ID NO: 8765302 - DNA, 22 bp, Homo sapiens
gctgtgtgctcacgtagtggaa

SEQ ID NO: 8765303 - DNA, 22 bp, Homo sapiens
gctgtgtgctaggatatgtttt

SEQ ID NO: 8765304 - DNA, 22 bp, Homo sapiens
gctgtgtgctaggatatgtttt

SEQ ID NO: 8765305 - DNA, 22 bp, Homo sapiens
gctgtgtgctaggatatgtttt

SEQ ID NO: 8765306 - DNA, 22 bp, Homo sapiens
gctgtgtgactgagagcctggc

SEQ ID NO: 8765307 - DNA, 22 bp, Homo sapiens
gctgtgtgactgagagcctggc

SEQ ID NO: 8765308 - DNA, 19 bp, Homo sapiens
gctgtgtgaccttgggcaa

SEQ ID NO: 8765309 - DNA, 19 bp, Homo sapiens
gctgtgtgaccttgggcaa

SEQ ID NO: 8765310 - DNA, 19 bp, Homo sapiens
gctgtgtgaccttgggcaa

SEQ ID NO: 8765311 - DNA, 19 bp, Homo sapiens
gctgtgtgaccttgggcaa

SEQ ID NO: 8765312 - DNA, 22 bp, Homo sapiens
gctgtgtgacctgggcaagtct

SEQ ID NO: 8765313 - DNA, 22 bp, Homo sapiens
gctgtgtgacctgggcaagtct

SEQ ID NO: 8765314 - DNA, 22 bp, Homo sapiens
gctgtgtgacctgggcaagtct

SEQ ID NO: 8765315 - DNA, 22 bp, Homo sapiens
gctgtccacctccagagcctta

SEQ ID NO: 8765316 - DNA, 22 bp, Homo sapiens
gctgtcagtcacattgttacag

SEQ ID NO: 8765317 - DNA, 22 bp, Homo sapiens
gctgtccaacctgcactcgcgt

SEQ ID NO: 8765318 - DNA, 22 bp, Homo sapiens
gctgtccagctccagccagcca

SEQ ID NO: 8765319 - DNA, 22 bp, Homo sapiens
gctgtccaggttgtggagcaac

SEQ ID NO: 8765320 - DNA, 22 bp, Homo sapiens
gctgtcccgaacccctggtaat

SEQ ID NO: 8765321 - DNA, 22 bp, Homo sapiens
gctgtcccgaacccctggtaat

SEQ ID NO: 8765322 - DNA, 23 bp, Homo sapiens
gctgtccccatgctccatccctg

SEQ ID NO: 8765323 - DNA, 23 bp, Homo sapiens
gctgtccccatgctccatccctg

SEQ ID NO: 8765324 - DNA, 22 bp, Homo sapiens
gctgtcctctgatctctggagg

SEQ ID NO: 8765325 - DNA, 22 bp, Homo sapiens
gctgtcctcgtctctcacgcaa

SEQ ID NO: 8765326 - DNA, 22 bp, Homo sapiens
gctgtcctctgatctctggagg

SEQ ID NO: 8765327 - DNA, 22 bp, Homo sapiens
gctgtcctcttggactcagggc

SEQ ID NO: 8765328 - DNA, 22 bp, Homo sapiens
gctgtccctttcacaaggtttt

SEQ ID NO: 8765329 - DNA, 22 bp, Homo sapiens
gctgtcccttgtcccaccttgc

SEQ ID NO: 8765330 - DNA, 22 bp, Homo sapiens
gctgtcctggggagggagaatg

SEQ ID NO: 8765331 - DNA, 22 bp, Homo sapiens
gctgtcctgggaacaggcacta

SEQ ID NO: 8765332 - DNA, 22 bp, Homo sapiens
gctgtcgtgtgcaagtgacaga

SEQ ID NO: 8765333 - DNA, 22 bp, Homo sapiens
gctgtccttcctggctggggtg

SEQ ID NO: 8765334 - DNA, 22 bp, Homo sapiens
gctgtctcatacaaggccctgc

SEQ ID NO: 8765335 - DNA, 22 bp, Homo sapiens
gctgtctgctgggtcgctcagg

SEQ ID NO: 8765336 - DNA, 22 bp, Homo sapiens
gctgtctgctgggtcgctcagg

SEQ ID NO: 8765337 - DNA, 22 bp, Homo sapiens
gctgtatttatatgaaggcatg

SEQ ID NO: 8765338 - DNA, 22 bp, Homo sapiens
gctgtatgtttatttgggaatt

SEQ ID NO: 8765339 - DNA, 22 bp, Homo sapiens
gctgtaggtttttccaggagtt

SEQ ID NO: 8765340 - DNA, 22 bp, Homo sapiens
gctgtatgagttcatgtgtaga

SEQ ID NO: 8765341 - DNA, 22 bp, Homo sapiens
gctgtaggtttttccaggagtt

SEQ ID NO: 8765342 - DNA, 22 bp, Homo sapiens
gctgtagggctgagctggaccg

SEQ ID NO: 8765343 - DNA, 22 bp, Homo sapiens
gctgtcagtgaggtgagacatg

SEQ ID NO: 8765344 - DNA, 22 bp, Homo sapiens
gctgtcaggccatgtgggcctt

SEQ ID NO: 8765345 - DNA, 22 bp, Homo sapiens
gctgtcagccccaaagacaaag

SEQ ID NO: 8765346 - DNA, 22 bp, Homo sapiens
gctgtcacaagcatctggggca

SEQ ID NO: 8765347 - DNA, 22 bp, Homo sapiens
gctgtcaccaaagcaggcactg

SEQ ID NO: 8765348 - DNA, 22 bp, Homo sapiens
gctgtacattctgcacaggccc

SEQ ID NO: 8765349 - DNA, 22 bp, Homo sapiens
gctgtacctccatcagcacctc

SEQ ID NO: 8765350 - DNA, 22 bp, Homo sapiens
gctgtacatcacaatttgctgt

SEQ ID NO: 8765351 - DNA, 22 bp, Homo sapiens
gctgtacattctgtgggtttgg

SEQ ID NO: 8765352 - DNA, 22 bp, Homo sapiens
gctgtacagtttactaggtggg

SEQ ID NO: 8765353 - DNA, 22 bp, Homo sapiens
gctggtccactccctggaggct

SEQ ID NO: 8765354 - DNA, 22 bp, Homo sapiens
gctggtccactccctggaggct

SEQ ID NO: 8765355 - DNA, 22 bp, Homo sapiens
gctggtccacatcctggtacgt

SEQ ID NO: 8765356 - DNA, 22 bp, Homo sapiens
gctggccagggctgctcgcgga

SEQ ID NO: 8765357 - DNA, 22 bp, Homo sapiens
gctggccaggaagagtctcaga

SEQ ID NO: 8765358 - DNA, 22 bp, Homo sapiens
gctggccaggaagagtctcaga

SEQ ID NO: 8765359 - DNA, 22 bp, Homo sapiens
gctggccacactgctgatggag

SEQ ID NO: 8765360 - DNA, 22 bp, Homo sapiens
gctggccacagatccccaggga

SEQ ID NO: 8765361 - DNA, 22 bp, Homo sapiens
gctggccacagatccccaggga

SEQ ID NO: 8765362 - DNA, 22 bp, Homo sapiens
gctggccacagatccccaggga

SEQ ID NO: 8765363 - DNA, 22 bp, Homo sapiens
gctggccacagatccccaggga

SEQ ID NO: 8765364 - DNA, 22 bp, Homo sapiens
gctggccacagatccccaggga

SEQ ID NO: 8765365 - DNA, 22 bp, Homo sapiens
gctggccacactgctgatggag

SEQ ID NO: 8765366 - DNA, 22 bp, Homo sapiens
gctggccacactgctgatggag

SEQ ID NO: 8765367 - DNA, 22 bp, Homo sapiens
gctggccaaagtgtacctggag

SEQ ID NO: 8765368 - DNA, 22 bp, Homo sapiens
gctggccaaagtgtacctggag

SEQ ID NO: 8765369 - DNA, 22 bp, Homo sapiens
gctggccaaagtgtacctggag

SEQ ID NO: 8765370 - DNA, 22 bp, Homo sapiens
gctggccacactgctgatggag

SEQ ID NO: 8765371 - DNA, 22 bp, Homo sapiens
gctggccacattgtgccgtcct

SEQ ID NO: 8765372 - DNA, 19 bp, Homo sapiens
gctggccacgccccagttg

SEQ ID NO: 8765373 - DNA, 19 bp, Homo sapiens
gctggccacgccccagttg

SEQ ID NO: 8765374 - DNA, 22 bp, Homo sapiens
gctggccacattgtgccgtcct

SEQ ID NO: 8765375 - DNA, 19 bp, Homo sapiens
gctggccacgccccagttg

SEQ ID NO: 8765376 - DNA, 22 bp, Homo sapiens
gctggccagccctcttcctcca

SEQ ID NO: 8765377 - DNA, 19 bp, Homo sapiens
gctggccacgccccagttg

SEQ ID NO: 8765378 - DNA, 22 bp, Homo sapiens
gctggccaggaagagtctcaga

SEQ ID NO: 8765379 - DNA, 22 bp, Homo sapiens
gctggccaggaagagtctcaga

SEQ ID NO: 8765380 - DNA, 22 bp, Homo sapiens
gctggccagccctcttcctcca

SEQ ID NO: 8765381 - DNA, 22 bp, Homo sapiens
ggtccccgtggaggctggagcg

SEQ ID NO: 8765382 - DNA, 22 bp, Homo sapiens
ggtccccgtggaggctggagcg

SEQ ID NO: 8765383 - DNA, 22 bp, Homo sapiens
ggtccccgtggaggctggagcg

SEQ ID NO: 8765384 - DNA, 22 bp, Homo sapiens
ggtccccgtggaggctggagcg

SEQ ID NO: 8765385 - DNA, 22 bp, Homo sapiens
ggtccccgtggaggctggagcg

SEQ ID NO: 8765386 - DNA, 22 bp, Homo sapiens
ggtccccgtggaggctggagcg

SEQ ID NO: 8765387 - DNA, 22 bp, Homo sapiens
ggtccctgaagaggcctggggt

SEQ ID NO: 8765388 - DNA, 22 bp, Homo sapiens
ggtccctgaagaggcctggggt

SEQ ID NO: 8765389 - DNA, 22 bp, Homo sapiens
ggtccctgaagatgcctgagga

SEQ ID NO: 8765390 - DNA, 22 bp, Homo sapiens
ggtccctgcccaaagcccttgg

SEQ ID NO: 8765391 - DNA, 22 bp, Homo sapiens
ggtccctgcccacctgggagct

SEQ ID NO: 8765392 - DNA, 22 bp, Homo sapiens
ggtccccgtggaggctggagcg

SEQ ID NO: 8765393 - DNA, 23 bp, Homo sapiens
ggtccctgacagcgggcaagttg

SEQ ID NO: 8765394 - DNA, 20 bp, Homo sapiens
ggtccctgccctctgtcatc

SEQ ID NO: 8765395 - DNA, 22 bp, Homo sapiens
ggtcccagttgcccaggtcagg

SEQ ID NO: 8765396 - DNA, 22 bp, Homo sapiens
ggtccccagcagtggctgcttc

SEQ ID NO: 8765397 - DNA, 22 bp, Homo sapiens
ggtcccatgactgacacagcag

SEQ ID NO: 8765398 - DNA, 22 bp, Homo sapiens
ggtccccccatggtgagcactg

SEQ ID NO: 8765399 - DNA, 22 bp, Homo sapiens
ggtccccccatggtgagcactg

SEQ ID NO: 8765400 - DNA, 22 bp, Homo sapiens
ggtccccccatggtgagcactg

SEQ ID NO: 8765401 - DNA, 22 bp, Homo sapiens
ggtccccccatggtgagcactg

SEQ ID NO: 8765402 - DNA, 22 bp, Homo sapiens
ggtccccccatggtgagcactg

SEQ ID NO: 8765403 - DNA, 22 bp, Homo sapiens
ggtcccagtcctctccctgcta

SEQ ID NO: 8765404 - DNA, 22 bp, Homo sapiens
ggtcccaggttgacagggagac

SEQ ID NO: 8765405 - DNA, 22 bp, Homo sapiens
gggttggcagcaccagaggagg

SEQ ID NO: 8765406 - DNA, 22 bp, Homo sapiens
gggttgggactgtcatctggag

SEQ ID NO: 8765407 - DNA, 22 bp, Homo sapiens
gggttggggcccagcagtctgc

SEQ ID NO: 8765408 - DNA, 22 bp, Homo sapiens
gggttgaggcggatgtcggcgg

SEQ ID NO: 8765409 - DNA, 22 bp, Homo sapiens
gggtgtcctgtgccaagctggg

SEQ ID NO: 8765410 - DNA, 22 bp, Homo sapiens
gggtgtccagggcgtgtctgga

SEQ ID NO: 8765411 - DNA, 22 bp, Homo sapiens
gggtgtacagaggtaactgagg

SEQ ID NO: 8765412 - DNA, 23 bp, Homo sapiens
gggtttccttctggctcctcctt

SEQ ID NO: 8765413 - DNA, 22 bp, Homo sapiens
gggttggggcccagcagtctgc

SEQ ID NO: 8765414 - DNA, 22 bp, Homo sapiens
gggttttatggttcacttgcaa

SEQ ID NO: 8765415 - DNA, 17 bp, Homo sapiens
gggttttgggagcagct

SEQ ID NO: 8765416 - DNA, 22 bp, Homo sapiens
ggtaaaaatcacaaatacttta

SEQ ID NO: 8765417 - DNA, 22 bp, Homo sapiens
ggtcccagctggtcactgtcag

SEQ ID NO: 8765418 - DNA, 22 bp, Homo sapiens
ggtcccagctggtcactgtcag

SEQ ID NO: 8765419 - DNA, 18 bp, Homo sapiens
ggtgagggagctggaagc

SEQ ID NO: 8765420 - DNA, 22 bp, Homo sapiens
ggtgagggagtggaacgaggtg

SEQ ID NO: 8765421 - DNA, 18 bp, Homo sapiens
ggtgagggagctggaagc

SEQ ID NO: 8765422 - DNA, 22 bp, Homo sapiens
ggtgagggacatcactcagcca

SEQ ID NO: 8765423 - DNA, 18 bp, Homo sapiens
ggtgagggagctggaagc

SEQ ID NO: 8765424 - DNA, 18 bp, Homo sapiens
ggtgagggagctggaagc

SEQ ID NO: 8765425 - DNA, 18 bp, Homo sapiens
ggtgaggcggcggccagc

SEQ ID NO: 8765426 - DNA, 22 bp, Homo sapiens
ggtgagggacatcactcagcca

SEQ ID NO: 8765427 - DNA, 22 bp, Homo sapiens
ggtggaaggcagcagtctcagg

SEQ ID NO: 8765428 - DNA, 22 bp, Homo sapiens
ggtgcttctgggcatagcagga

SEQ ID NO: 8765429 - DNA, 22 bp, Homo sapiens
ggtggaagccttcagaacagca

SEQ ID NO: 8765430 - DNA, 22 bp, Homo sapiens
ggtggacaaatgaatgactgaa

SEQ ID NO: 8765431 - DNA, 17 bp, Homo sapiens
ggtggaagtttctagtt

SEQ ID NO: 8765432 - DNA, 22 bp, Homo sapiens
ggtggacagtgttagctctggg

SEQ ID NO: 8765433 - DNA, 22 bp, Homo sapiens
ggtggacagtgttagctctggg

SEQ ID NO: 8765434 - DNA, 21 bp, Homo sapiens
ggtgctcgctgatgaggagtg

SEQ ID NO: 8765435 - DNA, 21 bp, Homo sapiens
ggtgctcgctgatgaggagtg

SEQ ID NO: 8765436 - DNA, 22 bp, Homo sapiens
ggtgctcagagttagaccagga

SEQ ID NO: 8765437 - DNA, 22 bp, Homo sapiens
ggtgctcaaggtgacaggacat

SEQ ID NO: 8765438 - DNA, 19 bp, Homo sapiens
ggtgagccctcgcctgcct

SEQ ID NO: 8765439 - DNA, 22 bp, Homo sapiens
ggtgaggcaggtggctgctgag

SEQ ID NO: 8765440 - DNA, 22 bp, Homo sapiens
ggtgaggaaagatggtgacagt

SEQ ID NO: 8765441 - DNA, 22 bp, Homo sapiens
ggtgagaggcagtgctgtggaa

SEQ ID NO: 8765442 - DNA, 22 bp, Homo sapiens
ggtgagaggcagtgctgtggaa

SEQ ID NO: 8765443 - DNA, 22 bp, Homo sapiens
ggtgagaggcctgagagctgga

SEQ ID NO: 8765444 - DNA, 22 bp, Homo sapiens
ggtgagaggcctgagagctgga

SEQ ID NO: 8765445 - DNA, 21 bp, Homo sapiens
ggtgacacgtggccccgctct

SEQ ID NO: 8765446 - DNA, 22 bp, Homo sapiens
ggtgagaggcagtgctgtggaa

SEQ ID NO: 8765447 - DNA, 22 bp, Homo sapiens
ggtgacagcgggtcaagaggag

SEQ ID NO: 8765448 - DNA, 22 bp, Homo sapiens
ggtccctggaaggccaagcttg

SEQ ID NO: 8765449 - DNA, 22 bp, Homo sapiens
ggtccctgctgaagccttggtg

SEQ ID NO: 8765450 - DNA, 22 bp, Homo sapiens
ggtgacagccgcttggcgctag

SEQ ID NO: 8765451 - DNA, 21 bp, Homo sapiens
ggtgaatttctaggaagtggc

SEQ ID NO: 8765452 - DNA, 22 bp, Homo sapiens
ggtgacacagggaccagagtct

SEQ ID NO: 8765453 - DNA, 22 bp, Homo sapiens
gtacaaaagttattgcggtttt

SEQ ID NO: 8765454 - DNA, 22 bp, Homo sapiens
ggtttaaaagccatgcatgggg

SEQ ID NO: 8765455 - DNA, 22 bp, Homo sapiens
gtaatgcttttgatacagggac

SEQ ID NO: 8765456 - DNA, 22 bp, Homo sapiens
ggttccacctggcgaggggtat

SEQ ID NO: 8765457 - DNA, 22 bp, Homo sapiens
ggttcagagaaggctaaatagt

SEQ ID NO: 8765458 - DNA, 22 bp, Homo sapiens
ggttcagagtcaggatctaagt

SEQ ID NO: 8765459 - DNA, 22 bp, Homo sapiens
ggttggggcgagctggaggccc

SEQ ID NO: 8765460 - DNA, 22 bp, Homo sapiens
ggttggggcgagctggaggccc

SEQ ID NO: 8765461 - DNA, 17 bp, Homo sapiens
ggttggcttatcccagg

SEQ ID NO: 8765462 - DNA, 22 bp, Homo sapiens
ggttggtaactccctgtgcagt

SEQ ID NO: 8765463 - DNA, 22 bp, Homo sapiens
ggtggtggagccagctgggagt

SEQ ID NO: 8765464 - DNA, 22 bp, Homo sapiens
ggtggtggagccagctgggagt

SEQ ID NO: 8765465 - DNA, 22 bp, Homo sapiens
ggttaaaaataatttacttggc

SEQ ID NO: 8765466 - DNA, 22 bp, Homo sapiens
ggttaaaaataatttacttggc

SEQ ID NO: 8765467 - DNA, 22 bp, Homo sapiens
ggttaaaaataatttacttggc

SEQ ID NO: 8765468 - DNA, 19 bp, Homo sapiens
ggtgtttcttcattttcca

SEQ ID NO: 8765469 - DNA, 21 bp, Homo sapiens
ggttaaaagacacatctgttt

SEQ ID NO: 8765470 - DNA, 22 bp, Homo sapiens
ggttaaaactgatattatgggt

SEQ ID NO: 8765471 - DNA, 22 bp, Homo sapiens
ggttaaaactgatattatgggt

SEQ ID NO: 8765472 - DNA, 22 bp, Homo sapiens
ggttaaaactgatattatgggt

SEQ ID NO: 8765473 - DNA, 21 bp, Homo sapiens
ggttaaaagacacatctgttt

SEQ ID NO: 8765474 - DNA, 22 bp, Homo sapiens
ggttaaaatctaaaatgtgact

SEQ ID NO: 8765475 - DNA, 22 bp, Homo sapiens
ggttaaaatctaaaatgtgact

SEQ ID NO: 8765476 - DNA, 22 bp, Homo sapiens
ggttaagccatcagatggatct

SEQ ID NO: 8765477 - DNA, 22 bp, Homo sapiens
ggtggtggagccagctgggagt

SEQ ID NO: 8765478 - DNA, 22 bp, Homo sapiens
ggtggtggagccagctgggagt

SEQ ID NO: 8765479 - DNA, 22 bp, Homo sapiens
ggtggtggagccagctgggagt

SEQ ID NO: 8765480 - DNA, 22 bp, Homo sapiens
ggttatataattcagtgctttc

SEQ ID NO: 8765481 - DNA, 19 bp, Homo sapiens
ggttatttgagggttaaga

SEQ ID NO: 8765482 - DNA, 22 bp, Homo sapiens
ggttatttctgattatatgata

SEQ ID NO: 8765483 - DNA, 22 bp, Homo sapiens
ggttatttctgattatatgata

SEQ ID NO: 8765484 - DNA, 19 bp, Homo sapiens
ggttaccagtgtgtctggc

SEQ ID NO: 8765485 - DNA, 22 bp, Homo sapiens
ggttcactccgatctctgcctc

SEQ ID NO: 8765486 - DNA, 22 bp, Homo sapiens
ggttcacatattgagagtattc

SEQ ID NO: 8765487 - DNA, 22 bp, Homo sapiens
ggttcacaggtccgactgctgg

SEQ ID NO: 8765488 - DNA, 22 bp, Homo sapiens
ggttatttttgattctgtggat

SEQ ID NO: 8765489 - DNA, 22 bp, Homo sapiens
ggttatttttgattctgtggat

SEQ ID NO: 8765490 - DNA, 23 bp, Homo sapiens
ggttatttgcatcctgtaattat

SEQ ID NO: 8765491 - DNA, 23 bp, Homo sapiens
ggttatttgcatcctgtaattat

SEQ ID NO: 8765492 - DNA, 22 bp, Homo sapiens
ggttattttggttgtctaaggc

SEQ ID NO: 8765493 - DNA, 22 bp, Homo sapiens
ggtggggattcctgatcactgt

SEQ ID NO: 8765494 - DNA, 22 bp, Homo sapiens
ggtggggccagggctccaacct

SEQ ID NO: 8765495 - DNA, 22 bp, Homo sapiens
ggtggggccctggcactggtat

SEQ ID NO: 8765496 - DNA, 22 bp, Homo sapiens
ggtgggccaggaaggccgccag

SEQ ID NO: 8765497 - DNA, 22 bp, Homo sapiens
ggtggggagtcaggcattcttg

SEQ ID NO: 8765498 - DNA, 22 bp, Homo sapiens
ggtggggattcctgatcactgt

SEQ ID NO: 8765499 - DNA, 22 bp, Homo sapiens
ggtgggcaggtcactctgcctc

SEQ ID NO: 8765500 - DNA, 22 bp, Homo sapiens
ggtgggcaggtcactctgcctc

SEQ ID NO: 8765501 - DNA, 22 bp, Homo sapiens
ggtgggcgactgagaggggttt

SEQ ID NO: 8765502 - DNA, 22 bp, Homo sapiens
ggtgggccaggaaggccgccag

SEQ ID NO: 8765503 - DNA, 22 bp, Homo sapiens
ggtgggtgagccctgggagctg

SEQ ID NO: 8765504 - DNA, 22 bp, Homo sapiens
ggtgggtgagccctgggagctg

SEQ ID NO: 8765505 - DNA, 22 bp, Homo sapiens
ggtgggtgagccctgggagctg

SEQ ID NO: 8765506 - DNA, 22 bp, Homo sapiens
ggtgggtgcagggggcttctta

SEQ ID NO: 8765507 - DNA, 22 bp, Homo sapiens
ggtgggtgagccctgggagctg

SEQ ID NO: 8765508 - DNA, 22 bp, Homo sapiens
ggtggggcctgctccagcggcc

SEQ ID NO: 8765509 - DNA, 19 bp, Homo sapiens
ggtgggtgacctccccacc

SEQ ID NO: 8765510 - DNA, 22 bp, Homo sapiens
ggtggggctaggacctcaggat

SEQ ID NO: 8765511 - DNA, 22 bp, Homo sapiens
ggtggggcctgctccagcggcc

SEQ ID NO: 8765512 - DNA, 22 bp, Homo sapiens
ggtggggcctgctccagcggcc

SEQ ID NO: 8765513 - DNA, 22 bp, Homo sapiens
ggtggggcctgctccagcggcc

SEQ ID NO: 8765514 - DNA, 22 bp, Homo sapiens
ggtggggccctggcactggtat

SEQ ID NO: 8765515 - DNA, 22 bp, Homo sapiens
ggtggcagagacataggacata

SEQ ID NO: 8765516 - DNA, 22 bp, Homo sapiens
ggtggcagagacataggacata

SEQ ID NO: 8765517 - DNA, 22 bp, Homo sapiens
ggtgggcaggcgaggcccaggt

SEQ ID NO: 8765518 - DNA, 22 bp, Homo sapiens
ggtggcagagacataggacata

SEQ ID NO: 8765519 - DNA, 22 bp, Homo sapiens
ggtggcagaataattgaaggtc

SEQ ID NO: 8765520 - DNA, 19 bp, Homo sapiens
ggtggcagaacgtgggtcc

SEQ ID NO: 8765521 - DNA, 19 bp, Homo sapiens
ggtggcagaacgtgggtcc

SEQ ID NO: 8765522 - DNA, 19 bp, Homo sapiens
ggtggcagaacgtgggtcc

SEQ ID NO: 8765523 - DNA, 19 bp, Homo sapiens
ggtggcagaacgtgggtcc

SEQ ID NO: 8765524 - DNA, 19 bp, Homo sapiens
ggtggcagaacgtgggtcc

SEQ ID NO: 8765525 - DNA, 19 bp, Homo sapiens
ggtggcagaacgtgggtcc

SEQ ID NO: 8765526 - DNA, 22 bp, Homo sapiens
ggtggagctggaccaggagagg

SEQ ID NO: 8765527 - DNA, 22 bp, Homo sapiens
ggtggagcgcagggtgctggcg

SEQ ID NO: 8765528 - DNA, 22 bp, Homo sapiens
ggtggagagctggatgagaggt

SEQ ID NO: 8765529 - DNA, 22 bp, Homo sapiens
ggtggcaagggcagccagtaac

SEQ ID NO: 8765530 - DNA, 22 bp, Homo sapiens
ggtggcaccttaccctgcgcag

SEQ ID NO: 8765531 - DNA, 22 bp, Homo sapiens
ggtggagtaattcgcagaggtt

SEQ ID NO: 8765532 - DNA, 22 bp, Homo sapiens
ggtggagtaattcgcagaggtt

SEQ ID NO: 8765533 - DNA, 22 bp, Homo sapiens
ggggtggccaaggactctgacc

SEQ ID NO: 8765534 - DNA, 22 bp, Homo sapiens
ggggtggatttcaggcggtgtc

SEQ ID NO: 8765535 - DNA, 22 bp, Homo sapiens
ggggtggattcctacaggtcca

SEQ ID NO: 8765536 - DNA, 22 bp, Homo sapiens
ggggtggatttcaggcggtgtc

SEQ ID NO: 8765537 - DNA, 22 bp, Homo sapiens
ggggtggagctaaatgtctact

SEQ ID NO: 8765538 - DNA, 22 bp, Homo sapiens
ggggtggatcaggcaggcccag

SEQ ID NO: 8765539 - DNA, 22 bp, Homo sapiens
ggggtggagctaaatgtctact

SEQ ID NO: 8765540 - DNA, 22 bp, Homo sapiens
ggggtggagatggtggcccttt

SEQ ID NO: 8765541 - DNA, 22 bp, Homo sapiens
ggggtgctagagtggggccact

SEQ ID NO: 8765542 - DNA, 19 bp, Homo sapiens
ggggtgctagggagggatc

SEQ ID NO: 8765543 - DNA, 22 bp, Homo sapiens
ggggtgctgaagatgtcatggt

SEQ ID NO: 8765544 - DNA, 22 bp, Homo sapiens
ggggtggccctaccctctggaa

SEQ ID NO: 8765545 - DNA, 22 bp, Homo sapiens
ggggtgggagtgccatccttga

SEQ ID NO: 8765546 - DNA, 22 bp, Homo sapiens
ggggtgggagtgccatccttga

SEQ ID NO: 8765547 - DNA, 22 bp, Homo sapiens
ggggtgggagtgccatccttga

SEQ ID NO: 8765548 - DNA, 19 bp, Homo sapiens
ggggtggctggggctccag

SEQ ID NO: 8765549 - DNA, 19 bp, Homo sapiens
ggggtggctggggctccag

SEQ ID NO: 8765550 - DNA, 19 bp, Homo sapiens
ggggtggctggggctccag

SEQ ID NO: 8765551 - DNA, 22 bp, Homo sapiens
ggggcccttgtggctgcaggcc

SEQ ID NO: 8765552 - DNA, 22 bp, Homo sapiens
ggggtagggcgattgctgcttt

SEQ ID NO: 8765553 - DNA, 22 bp, Homo sapiens
ggggtagggcgattgctgcttt

SEQ ID NO: 8765554 - DNA, 22 bp, Homo sapiens
ggggtgagttagcgtcggcttg

SEQ ID NO: 8765555 - DNA, 22 bp, Homo sapiens
ggggtagggcgattgctgcttt

SEQ ID NO: 8765556 - DNA, 22 bp, Homo sapiens
ggggtagggtgattgtgaagta

SEQ ID NO: 8765557 - DNA, 22 bp, Homo sapiens
ggggcccagggcagcagtgcag

SEQ ID NO: 8765558 - DNA, 22 bp, Homo sapiens
ggggcccagggcagcagtgcag

SEQ ID NO: 8765559 - DNA, 22 bp, Homo sapiens
ggggcccagcacccctcctcgc

SEQ ID NO: 8765560 - DNA, 22 bp, Homo sapiens
ggggcccagcacccctcctcgc

SEQ ID NO: 8765561 - DNA, 22 bp, Homo sapiens
ggggcccagggcagcagtgcag

SEQ ID NO: 8765562 - DNA, 22 bp, Homo sapiens
ggggcccctcggacacgtgcgg

SEQ ID NO: 8765563 - DNA, 22 bp, Homo sapiens
ggggcccctgtggcttgatgcc

SEQ ID NO: 8765564 - DNA, 22 bp, Homo sapiens
ggggccaggtccagcttccaaa

SEQ ID NO: 8765565 - DNA, 22 bp, Homo sapiens
ggggccaggtccagcttccaaa

SEQ ID NO: 8765566 - DNA, 22 bp, Homo sapiens
ggggccaggtccagcttccaaa

SEQ ID NO: 8765567 - DNA, 22 bp, Homo sapiens
ggggccagtaggagtgatgtac

SEQ ID NO: 8765568 - DNA, 22 bp, Homo sapiens
ggggccagtaggagtgatgtac

SEQ ID NO: 8765569 - DNA, 20 bp, Homo sapiens
ggggcccaagccctcttgcc

SEQ ID NO: 8765570 - DNA, 22 bp, Homo sapiens
ggggccagcaatgttgaggaat

SEQ ID NO: 8765571 - DNA, 22 bp, Homo sapiens
ggggccagatatcactaaggtt

SEQ ID NO: 8765572 - DNA, 22 bp, Homo sapiens
ggggccagcaatgttgaggaat

SEQ ID NO: 8765573 - DNA, 22 bp, Homo sapiens
ggggccagcttcgcgtgctctt

SEQ ID NO: 8765574 - DNA, 22 bp, Homo sapiens
ggggccagcttcgcgtgctctt

SEQ ID NO: 8765575 - DNA, 22 bp, Homo sapiens
ggggccagcttcgcgtgctctt

SEQ ID NO: 8765576 - DNA, 22 bp, Homo sapiens
ggggccagcttcgcgtgctctt

SEQ ID NO: 8765577 - DNA, 18 bp, Homo sapiens
gggtgcaggcactgactg

SEQ ID NO: 8765578 - DNA, 22 bp, Homo sapiens
gggtgcagcagagctcctctgt

SEQ ID NO: 8765579 - DNA, 22 bp, Homo sapiens
gggtgcaggcagcccaggcagg

SEQ ID NO: 8765580 - DNA, 22 bp, Homo sapiens
gggtgcaggcagcccaggcagg

SEQ ID NO: 8765581 - DNA, 22 bp, Homo sapiens
gggtgcagcagagctcctctgt

SEQ ID NO: 8765582 - DNA, 21 bp, Homo sapiens
gggtgctgtggtcatgcagga

SEQ ID NO: 8765583 - DNA, 22 bp, Homo sapiens
gggtgctgggaggctgacatct

SEQ ID NO: 8765584 - DNA, 18 bp, Homo sapiens
gggtgctggggccccttg

SEQ ID NO: 8765585 - DNA, 22 bp, Homo sapiens
gggtgctgggaggctgacatct

SEQ ID NO: 8765586 - DNA, 22 bp, Homo sapiens
gggtgaggccttgctgccatca

SEQ ID NO: 8765587 - DNA, 22 bp, Homo sapiens
gggtgagggatgagccttcttc

SEQ ID NO: 8765588 - DNA, 22 bp, Homo sapiens
gggtgagggatgagccttcttc

SEQ ID NO: 8765589 - DNA, 22 bp, Homo sapiens
gggtgaggccttgctgccatca

SEQ ID NO: 8765590 - DNA, 22 bp, Homo sapiens
gggtgcagcagagctcctctgt

SEQ ID NO: 8765591 - DNA, 22 bp, Homo sapiens
gggtgaggcccatttgaggcca

SEQ ID NO: 8765592 - DNA, 22 bp, Homo sapiens
gggtgaggcccatttgaggcca

SEQ ID NO: 8765593 - DNA, 22 bp, Homo sapiens
gggtgaggcccatttgaggcca

SEQ ID NO: 8765594 - DNA, 20 bp, Homo sapiens
gggtgaggatggagaatttg

SEQ ID NO: 8765595 - DNA, 20 bp, Homo sapiens
gggtgaggatggagaatttg

SEQ ID NO: 8765596 - DNA, 20 bp, Homo sapiens
gggtgaggatggagaatttg

SEQ ID NO: 8765597 - DNA, 22 bp, Homo sapiens
ggggtgggagtgccatccttga

SEQ ID NO: 8765598 - DNA, 22 bp, Homo sapiens
gggtgaggagctgccagtcatg

SEQ ID NO: 8765599 - DNA, 22 bp, Homo sapiens
gggtggtgagatgtagctgatg

SEQ ID NO: 8765600 - DNA, 22 bp, Homo sapiens
gggtggtggccagcagtgggca

SEQ ID NO: 8765601 - DNA, 22 bp, Homo sapiens
gggtggtgagatgtagctgatg

SEQ ID NO: 8765602 - DNA, 22 bp, Homo sapiens
gggtggtgtattagagctgcag

SEQ ID NO: 8765603 - DNA, 22 bp, Homo sapiens
gggtggtgtattagagctgcag

SEQ ID NO: 8765604 - DNA, 22 bp, Homo sapiens
gggtggtgtattagagctgcag

SEQ ID NO: 8765605 - DNA, 22 bp, Homo sapiens
gggtggtggccagcagtgggca

SEQ ID NO: 8765606 - DNA, 22 bp, Homo sapiens
gggtggtggcggaggctccagg

SEQ ID NO: 8765607 - DNA, 22 bp, Homo sapiens
gggtggtggcggaggctccagg

SEQ ID NO: 8765608 - DNA, 22 bp, Homo sapiens
gggtggagaggctaagtccagt

SEQ ID NO: 8765609 - DNA, 22 bp, Homo sapiens
gggtggagagaaagaaacgtga

SEQ ID NO: 8765610 - DNA, 22 bp, Homo sapiens
gggtggagccagttgactctgt

SEQ ID NO: 8765611 - DNA, 22 bp, Homo sapiens
gggtggagaggctaagtccagt

SEQ ID NO: 8765612 - DNA, 22 bp, Homo sapiens
gggtggagccagttgactctgt

SEQ ID NO: 8765613 - DNA, 22 bp, Homo sapiens
gggtggagccagttgactctgt

SEQ ID NO: 8765614 - DNA, 21 bp, Homo sapiens
gggtggggttccagccttttc

SEQ ID NO: 8765615 - DNA, 22 bp, Homo sapiens
gggtgggtggcagcaccgaggc

SEQ ID NO: 8765616 - DNA, 22 bp, Homo sapiens
gggcttctattcaagtctgttt

SEQ ID NO: 8765617 - DNA, 22 bp, Homo sapiens
gggcttctagaccagcagtgag

SEQ ID NO: 8765618 - DNA, 22 bp, Homo sapiens
gggcttctagaatttctgatat

SEQ ID NO: 8765619 - DNA, 22 bp, Homo sapiens
gggcttctacttgcaaaggata

SEQ ID NO: 8765620 - DNA, 22 bp, Homo sapiens
gggcttctaagtgaaagtgtaa

SEQ ID NO: 8765621 - DNA, 18 bp, Homo sapiens
gggctgtgttcatgccca

SEQ ID NO: 8765622 - DNA, 22 bp, Homo sapiens
gggcttctggtcattcctcatc

SEQ ID NO: 8765623 - DNA, 22 bp, Homo sapiens
gggcttctgggcaccactccct

SEQ ID NO: 8765624 - DNA, 19 bp, Homo sapiens
gggcttctgggatcaagag

SEQ ID NO: 8765625 - DNA, 22 bp, Homo sapiens
gggcttctgggcaccactccct

SEQ ID NO: 8765626 - DNA, 22 bp, Homo sapiens
gggcttctggctactgtatgag

SEQ ID NO: 8765627 - DNA, 22 bp, Homo sapiens
gggcttctgctcttttggtgct

SEQ ID NO: 8765628 - DNA, 22 bp, Homo sapiens
gggcttctcttatgctaactgg

SEQ ID NO: 8765629 - DNA, 22 bp, Homo sapiens
gggcttctctgggagtcctggt

SEQ ID NO: 8765630 - DNA, 22 bp, Homo sapiens
gggcttctctttagtgagctga

SEQ ID NO: 8765631 - DNA, 22 bp, Homo sapiens
gggcttctctttagtgagctga

SEQ ID NO: 8765632 - DNA, 22 bp, Homo sapiens
gggcttctctgatcaatatttc

SEQ ID NO: 8765633 - DNA, 22 bp, Homo sapiens
gggcttctctcaggggcatgag

SEQ ID NO: 8765634 - DNA, 22 bp, Homo sapiens
gggcttctccctaaggactctg

SEQ ID NO: 8765635 - DNA, 22 bp, Homo sapiens
gggcttctccctaaggactctg

SEQ ID NO: 8765636 - DNA, 22 bp, Homo sapiens
gggcttctctcagaaactatca

SEQ ID NO: 8765637 - DNA, 22 bp, Homo sapiens
gggcttctctcaggggcatgag

SEQ ID NO: 8765638 - DNA, 22 bp, Homo sapiens
gggcttctcagagaggctttag

SEQ ID NO: 8765639 - DNA, 22 bp, Homo sapiens
gggcttctattctggcacaaga

SEQ ID NO: 8765640 - DNA, 22 bp, Homo sapiens
gggctctgggattcagagcaag

SEQ ID NO: 8765641 - DNA, 22 bp, Homo sapiens
gggctctggggtcagacagcct

SEQ ID NO: 8765642 - DNA, 22 bp, Homo sapiens
gggctctgggattcagagcaag

SEQ ID NO: 8765643 - DNA, 22 bp, Homo sapiens
gggctctgggattcagagcaag

SEQ ID NO: 8765644 - DNA, 22 bp, Homo sapiens
gggctctgggattcagagcaag

SEQ ID NO: 8765645 - DNA, 19 bp, Homo sapiens
gggctctggcctcagtggg

SEQ ID NO: 8765646 - DNA, 22 bp, Homo sapiens
gggctgtgtgcagtacgggtcc

SEQ ID NO: 8765647 - DNA, 22 bp, Homo sapiens
gggctgtgtgcccacttcccat

SEQ ID NO: 8765648 - DNA, 18 bp, Homo sapiens
gggctgtgttcatgccca

SEQ ID NO: 8765649 - DNA, 22 bp, Homo sapiens
gggctgtgttaggtgcggttac

SEQ ID NO: 8765650 - DNA, 18 bp, Homo sapiens
gggctgtgttcatgccca

SEQ ID NO: 8765651 - DNA, 22 bp, Homo sapiens
gggctctggggtgccctggcat

SEQ ID NO: 8765652 - DNA, 22 bp, Homo sapiens
gggctctggggtgccctggcat

SEQ ID NO: 8765653 - DNA, 22 bp, Homo sapiens
gggctctggggtgccctggcat

SEQ ID NO: 8765654 - DNA, 22 bp, Homo sapiens
ggggaggccagtggaccgtccc

SEQ ID NO: 8765655 - DNA, 22 bp, Homo sapiens
ggggaggccagtggaccgtccc

SEQ ID NO: 8765656 - DNA, 22 bp, Homo sapiens
ggggaggccagtggaccgtccc

SEQ ID NO: 8765657 - DNA, 22 bp, Homo sapiens
ggggaggacctttccaaggctt

SEQ ID NO: 8765658 - DNA, 22 bp, Homo sapiens
ggggaggacctttccaaggctt

SEQ ID NO: 8765659 - DNA, 22 bp, Homo sapiens
ggggaggagccatgtaactagt

SEQ ID NO: 8765660 - DNA, 22 bp, Homo sapiens
ggggaggaagctggaacacggg

SEQ ID NO: 8765661 - DNA, 22 bp, Homo sapiens
ggggaggaagctggaacacggg

SEQ ID NO: 8765662 - DNA, 22 bp, Homo sapiens
ggggaggaagctggaacacggg

SEQ ID NO: 8765663 - DNA, 22 bp, Homo sapiens
ggggaggaagctggaacacggg

SEQ ID NO: 8765664 - DNA, 22 bp, Homo sapiens
ggggaggaagctggaacacggg

SEQ ID NO: 8765665 - DNA, 22 bp, Homo sapiens
ggggagaataaatcagatttta

SEQ ID NO: 8765666 - DNA, 19 bp, Homo sapiens
ggggagaactagagacagc

SEQ ID NO: 8765667 - DNA, 22 bp, Homo sapiens
gggcttctgtacctacctggaa

SEQ ID NO: 8765668 - DNA, 22 bp, Homo sapiens
gggcttctgttcctttcacttg

SEQ ID NO: 8765669 - DNA, 22 bp, Homo sapiens
ggggagtgacgcagggccatag

SEQ ID NO: 8765670 - DNA, 22 bp, Homo sapiens
ggggagtgacgcagggccatag

SEQ ID NO: 8765671 - DNA, 22 bp, Homo sapiens
ggggagtgacgcagggccatag

SEQ ID NO: 8765672 - DNA, 19 bp, Homo sapiens
ggggaggtattgttttcat

SEQ ID NO: 8765673 - DNA, 22 bp, Homo sapiens
ggggaggctgatgtgggcaaag

SEQ ID NO: 8765674 - DNA, 22 bp, Homo sapiens
ggggagtgttttcatgggcttg

SEQ ID NO: 8765675 - DNA, 22 bp, Homo sapiens
ggggagtggttgcctgtgatcc

SEQ ID NO: 8765676 - DNA, 22 bp, Homo sapiens
ggggagtgttttcatgggcttg

SEQ ID NO: 8765677 - DNA, 22 bp, Homo sapiens
ggggagtgttttcatgggcttg

SEQ ID NO: 8765678 - DNA, 22 bp, Homo sapiens
ggggagtgttttcatgggcttg

SEQ ID NO: 8765679 - DNA, 22 bp, Homo sapiens
ggggatgagactagagctaaag

SEQ ID NO: 8765680 - DNA, 21 bp, Homo sapiens
ggggatgcgaccacaggctcc

SEQ ID NO: 8765681 - DNA, 22 bp, Homo sapiens
ggggcagggaggttatcgccga

SEQ ID NO: 8765682 - DNA, 22 bp, Homo sapiens
ggggcagggaggttatcgccga

SEQ ID NO: 8765683 - DNA, 20 bp, Homo sapiens
ggggcaggtttttatggcta

SEQ ID NO: 8765684 - DNA, 20 bp, Homo sapiens
ggggcaggtttttatggcta

SEQ ID NO: 8765685 - DNA, 22 bp, Homo sapiens
ggggccagatatcactaaggtt

SEQ ID NO: 8765686 - DNA, 22 bp, Homo sapiens
ggggccagagaggacccaggtg

SEQ ID NO: 8765687 - DNA, 22 bp, Homo sapiens
ggggccagagaggacccaggtg

SEQ ID NO: 8765688 - DNA, 22 bp, Homo sapiens
ggggccagagaggacccaggtg

SEQ ID NO: 8765689 - DNA, 22 bp, Homo sapiens
ggggccagagaggacccaggtg

SEQ ID NO: 8765690 - DNA, 22 bp, Homo sapiens
ggggccagagaggacccaggtg

SEQ ID NO: 8765691 - DNA, 22 bp, Homo sapiens
ggggccagagaggacccaggtg

SEQ ID NO: 8765692 - DNA, 22 bp, Homo sapiens
ggggccactggcaggaccttgg

SEQ ID NO: 8765693 - DNA, 22 bp, Homo sapiens
gtctttttctacgatagcgcct

SEQ ID NO: 8765694 - DNA, 22 bp, Homo sapiens
gtctttttctacgatagcgcct

SEQ ID NO: 8765695 - DNA, 22 bp, Homo sapiens
gtctttttgtctggcagaggtc

SEQ ID NO: 8765696 - DNA, 22 bp, Homo sapiens
gtctttttattatagagtggag

SEQ ID NO: 8765697 - DNA, 22 bp, Homo sapiens
gtctttttattatagagtggag

SEQ ID NO: 8765698 - DNA, 22 bp, Homo sapiens
gtctttttctacgatagcgcct

SEQ ID NO: 8765699 - DNA, 22 bp, Homo sapiens
gtcttttttacaccttacatca

SEQ ID NO: 8765700 - DNA, 22 bp, Homo sapiens
gtcttttttacaccttacatca

SEQ ID NO: 8765701 - DNA, 22 bp, Homo sapiens
gtctttttgtctggcagaggtc

SEQ ID NO: 8765702 - DNA, 22 bp, Homo sapiens
gtcttttttacaccttacatca

SEQ ID NO: 8765703 - DNA, 22 bp, Homo sapiens
gtcttttttacaccttacatca

SEQ ID NO: 8765704 - DNA, 22 bp, Homo sapiens
gtgaaaaatcatcatgacttga

SEQ ID NO: 8765705 - DNA, 22 bp, Homo sapiens
gtgaaaaatcatcatgacttga

SEQ ID NO: 8765706 - DNA, 22 bp, Homo sapiens
gtgagcagggcaggactgggga

SEQ ID NO: 8765707 - DNA, 22 bp, Homo sapiens
gtgaaaaatgatttgttaactg

SEQ ID NO: 8765708 - DNA, 22 bp, Homo sapiens
gtgaaaaatgatttgttaactg

SEQ ID NO: 8765709 - DNA, 22 bp, Homo sapiens
gtctttccttataatgccctaa

SEQ ID NO: 8765710 - DNA, 22 bp, Homo sapiens
gtctttcatggatattcagttt

SEQ ID NO: 8765711 - DNA, 22 bp, Homo sapiens
gtctttcatggatattcagttt

SEQ ID NO: 8765712 - DNA, 22 bp, Homo sapiens
gtctttctatgatgaactgttg

SEQ ID NO: 8765713 - DNA, 22 bp, Homo sapiens
gtctttcaggaggggcttagag

SEQ ID NO: 8765714 - DNA, 22 bp, Homo sapiens
gtctttcactgcggtttacatg

SEQ ID NO: 8765715 - DNA, 22 bp, Homo sapiens
gtctttgtggtagtcctcagcc

SEQ ID NO: 8765716 - DNA, 21 bp, Homo sapiens
gtcttttaagtgaagagaggc

SEQ ID NO: 8765717 - DNA, 21 bp, Homo sapiens
gtctttttaattgcgatttcc

SEQ ID NO: 8765718 - DNA, 21 bp, Homo sapiens
gtctttttaattgcgatttcc

SEQ ID NO: 8765719 - DNA, 22 bp, Homo sapiens
gtcttttgctagccagagagct

SEQ ID NO: 8765720 - DNA, 22 bp, Homo sapiens
gtgagcagttgtgagccccaaa

SEQ ID NO: 8765721 - DNA, 22 bp, Homo sapiens
gtgagccaataccatgctgttc

SEQ ID NO: 8765722 - DNA, 22 bp, Homo sapiens
gtgagccgagtatagttcatag

SEQ ID NO: 8765723 - DNA, 22 bp, Homo sapiens
gtgagccattctactcctaacc

SEQ ID NO: 8765724 - DNA, 22 bp, Homo sapiens
gtgagccgagtatagttcatag

SEQ ID NO: 8765725 - DNA, 17 bp, Homo sapiens
gtgagctgagtcaggac

SEQ ID NO: 8765726 - DNA, 22 bp, Homo sapiens
gtgagctggaatagtggagaaa

SEQ ID NO: 8765727 - DNA, 22 bp, Homo sapiens
gtgagctggaatagtggagaaa

SEQ ID NO: 8765728 - DNA, 22 bp, Homo sapiens
gtgaggaagtctgagagccaca

SEQ ID NO: 8765729 - DNA, 22 bp, Homo sapiens
gtgaggaagtctgagagccaca

SEQ ID NO: 8765730 - DNA, 22 bp, Homo sapiens
gtgagctttgtggtaatgaagt

SEQ ID NO: 8765731 - DNA, 19 bp, Homo sapiens
gtgagcttcttgtaagagg

SEQ ID NO: 8765732 - DNA, 22 bp, Homo sapiens
gtgagctgttttggacccatct

SEQ ID NO: 8765733 - DNA, 22 bp, Homo sapiens
gtgaggactggtaaggactgca

SEQ ID NO: 8765734 - DNA, 22 bp, Homo sapiens
gtgaggactggtaaggactgca

SEQ ID NO: 8765735 - DNA, 22 bp, Homo sapiens
gtgaggagctctttgactcacg

SEQ ID NO: 8765736 - DNA, 22 bp, Homo sapiens
gtgaggaagtggtcaggcatcc

SEQ ID NO: 8765737 - DNA, 22 bp, Homo sapiens
gtgaggaagtggtcaggcatcc

SEQ ID NO: 8765738 - DNA, 22 bp, Homo sapiens
gtgaggagggctggtcccaggc

SEQ ID NO: 8765739 - DNA, 22 bp, Homo sapiens
gtgaggagctgacactggggtg

SEQ ID NO: 8765740 - DNA, 22 bp, Homo sapiens
gtgaggagggctggtcccaggc

SEQ ID NO: 8765741 - DNA, 22 bp, Homo sapiens
gtgaggagtctgaagcacataa

SEQ ID NO: 8765742 - DNA, 22 bp, Homo sapiens
gtgaggagtctgaagcacataa

SEQ ID NO: 8765743 - DNA, 22 bp, Homo sapiens
gtgaggagctgacactggggtg

SEQ ID NO: 8765744 - DNA, 22 bp, Homo sapiens
gtgaggagctctttgactcacg

SEQ ID NO: 8765745 - DNA, 23 bp, Homo sapiens
gtctaagaaaggcatcaggatga

SEQ ID NO: 8765746 - DNA, 22 bp, Homo sapiens
gtctaagtgggtggcactgaca

SEQ ID NO: 8765747 - DNA, 22 bp, Homo sapiens
gtctaaggatctgttagctttt

SEQ ID NO: 8765748 - DNA, 22 bp, Homo sapiens
gtctaataactttcagtcattt

SEQ ID NO: 8765749 - DNA, 22 bp, Homo sapiens
gtctaaagcccttagaatagta

SEQ ID NO: 8765750 - DNA, 22 bp, Homo sapiens
gtctacaaagcttcaagtctct

SEQ ID NO: 8765751 - DNA, 22 bp, Homo sapiens
gtctacagtgaatgggtcctaa

SEQ ID NO: 8765752 - DNA, 22 bp, Homo sapiens
gtctactttttaatcttggcag

SEQ ID NO: 8765753 - DNA, 22 bp, Homo sapiens
gtctacatgtgttcttaagaga

SEQ ID NO: 8765754 - DNA, 22 bp, Homo sapiens
gtctagaaaatgccgagggatg

SEQ ID NO: 8765755 - DNA, 22 bp, Homo sapiens
gtctagaaatcatgtactgtga

SEQ ID NO: 8765756 - DNA, 22 bp, Homo sapiens
gtctagaaataggtttcagaaa

SEQ ID NO: 8765757 - DNA, 22 bp, Homo sapiens
gtctagaaatgccatacgtgcc

SEQ ID NO: 8765758 - DNA, 22 bp, Homo sapiens
gtctagaaatgttctcaggggt

SEQ ID NO: 8765759 - DNA, 22 bp, Homo sapiens
gtctagaaatgccatacgtgcc

SEQ ID NO: 8765760 - DNA, 22 bp, Homo sapiens
gtctagaatggatgagcatttt

SEQ ID NO: 8765761 - DNA, 22 bp, Homo sapiens
gtctagaatggatgagcatttt

SEQ ID NO: 8765762 - DNA, 22 bp, Homo sapiens
gtctagaatatctagaaagatc

SEQ ID NO: 8765763 - DNA, 19 bp, Homo sapiens
gtctagaacattgtaggtg

SEQ ID NO: 8765764 - DNA, 19 bp, Homo sapiens
gtctagaccaggctcctta

SEQ ID NO: 8765765 - DNA, 22 bp, Homo sapiens
gtctagaattgcttggcagatg

SEQ ID NO: 8765766 - DNA, 22 bp, Homo sapiens
gtctccagcccactctagatat

SEQ ID NO: 8765767 - DNA, 22 bp, Homo sapiens
gtctatatattgcttgaataat

SEQ ID NO: 8765768 - DNA, 22 bp, Homo sapiens
gtctatgatattttgttatagc

SEQ ID NO: 8765769 - DNA, 22 bp, Homo sapiens
gtctatgatattttgttatagc

SEQ ID NO: 8765770 - DNA, 22 bp, Homo sapiens
gtctaggccatcacaggcgcca

SEQ ID NO: 8765771 - DNA, 22 bp, Homo sapiens
gtctagagtgcttcctagtcat

SEQ ID NO: 8765772 - DNA, 22 bp, Homo sapiens
gtctagagcctgatgaggatga

SEQ ID NO: 8765773 - DNA, 22 bp, Homo sapiens
gtctttatatttactaaagaat

SEQ ID NO: 8765774 - DNA, 23 bp, Homo sapiens
gtctttatagtggggcactttgt

SEQ ID NO: 8765775 - DNA, 22 bp, Homo sapiens
gtctttagttgaaacatgtggt

SEQ ID NO: 8765776 - DNA, 22 bp, Homo sapiens
gtctttaagggactgaatttgg

SEQ ID NO: 8765777 - DNA, 22 bp, Homo sapiens
gtctttatggtatgaaaactga

SEQ ID NO: 8765778 - DNA, 22 bp, Homo sapiens
gtcttgtccattccatgctgct

SEQ ID NO: 8765779 - DNA, 22 bp, Homo sapiens
gtctttaagggactgaatttgg

SEQ ID NO: 8765780 - DNA, 22 bp, Homo sapiens
gtctccagttacagcagccagg

SEQ ID NO: 8765781 - DNA, 22 bp, Homo sapiens
gtctccagttacagcagccagg

SEQ ID NO: 8765782 - DNA, 22 bp, Homo sapiens
gtctccagggacacactagccg

SEQ ID NO: 8765783 - DNA, 22 bp, Homo sapiens
gtctccagggctgctggcgcct

SEQ ID NO: 8765784 - DNA, 22 bp, Homo sapiens
gtctccagggctgctggcgcct

SEQ ID NO: 8765785 - DNA, 22 bp, Homo sapiens
gtgcaggagtaggagagggctt

SEQ ID NO: 8765786 - DNA, 22 bp, Homo sapiens
gtgcaggatgttgggaatcagg

SEQ ID NO: 8765787 - DNA, 22 bp, Homo sapiens
gtgcaggagtaggagagggctt

SEQ ID NO: 8765788 - DNA, 22 bp, Homo sapiens
gtgcaggcattgggctagccat

SEQ ID NO: 8765789 - DNA, 22 bp, Homo sapiens
gtgcaggcaaaagggccaggcc

SEQ ID NO: 8765790 - DNA, 22 bp, Homo sapiens
gtgcaggctagatccttcctac

SEQ ID NO: 8765791 - DNA, 22 bp, Homo sapiens
gtgcaggcaaaagggccaggcc

SEQ ID NO: 8765792 - DNA, 22 bp, Homo sapiens
gtgcagggagcccagaaggtcc

SEQ ID NO: 8765793 - DNA, 22 bp, Homo sapiens
gtgcagcaaagtttgagatata

SEQ ID NO: 8765794 - DNA, 22 bp, Homo sapiens
gtgcagcaaagtttgagatata

SEQ ID NO: 8765795 - DNA, 22 bp, Homo sapiens
gtgcagcaaactagtgcgaggg

SEQ ID NO: 8765796 - DNA, 22 bp, Homo sapiens
gtgaggcagggaaagaggataa

SEQ ID NO: 8765797 - DNA, 22 bp, Homo sapiens
gtgaggcaggcattctcctttc

SEQ ID NO: 8765798 - DNA, 22 bp, Homo sapiens
gtgaggcagcaggagcctctgt

SEQ ID NO: 8765799 - DNA, 22 bp, Homo sapiens
gtgaggcagaagttccctttta

SEQ ID NO: 8765800 - DNA, 22 bp, Homo sapiens
gtgaggatgtactgagataaat

SEQ ID NO: 8765801 - DNA, 19 bp, Homo sapiens
gtgaggagtgtttacagaa

SEQ ID NO: 8765802 - DNA, 22 bp, Homo sapiens
gtgaggatacttaagagaacac

SEQ ID NO: 8765803 - DNA, 22 bp, Homo sapiens
gtgaggatacttaagagaacac

SEQ ID NO: 8765804 - DNA, 22 bp, Homo sapiens
gtgcagggcagccgaatgggct

SEQ ID NO: 8765805 - DNA, 22 bp, Homo sapiens
gtgcagggcagccgaatgggct

SEQ ID NO: 8765806 - DNA, 17 bp, Homo sapiens
gtgcagggatgaaggat

SEQ ID NO: 8765807 - DNA, 17 bp, Homo sapiens
gtgcagggatgaaggat

SEQ ID NO: 8765808 - DNA, 22 bp, Homo sapiens
gtgcagggcaggtgtccttcca

SEQ ID NO: 8765809 - DNA, 22 bp, Homo sapiens
gtgcaggggatcaggttgcagc

SEQ ID NO: 8765810 - DNA, 22 bp, Homo sapiens
gtgcagggccctcctaacatct

SEQ ID NO: 8765811 - DNA, 22 bp, Homo sapiens
gtgcagggctggcaccggaggc

SEQ ID NO: 8765812 - DNA, 22 bp, Homo sapiens
gtgcaggggatcaggttgcagc

SEQ ID NO: 8765813 - DNA, 22 bp, Homo sapiens
gtgcagggtagcgacggcagga

SEQ ID NO: 8765814 - DNA, 22 bp, Homo sapiens
gtgccaccttcaaatcacattg

SEQ ID NO: 8765815 - DNA, 22 bp, Homo sapiens
gtgccacttacctgggaggagt

SEQ ID NO: 8765816 - DNA, 22 bp, Homo sapiens
gtgcagggtagcgacggcagga

SEQ ID NO: 8765817 - DNA, 22 bp, Homo sapiens
gtgcagggtagcgacggcagga

SEQ ID NO: 8765818 - DNA, 22 bp, Homo sapiens
gtgccagagacatgactagctg

SEQ ID NO: 8765819 - DNA, 22 bp, Homo sapiens
gtgccagagattcctaaacttt

SEQ ID NO: 8765820 - DNA, 22 bp, Homo sapiens
gtgccagaggccccaaacaagt

SEQ ID NO: 8765821 - DNA, 22 bp, Homo sapiens
gtgcaggggcctccccttgctg

SEQ ID NO: 8765822 - DNA, 22 bp, Homo sapiens
gtgccagaggcagtgaggagtt

SEQ ID NO: 8765823 - DNA, 22 bp, Homo sapiens
gtgccagggggcactgaacaga

SEQ ID NO: 8765824 - DNA, 22 bp, Homo sapiens
gtgccaggtgctaagctgtgct

SEQ ID NO: 8765825 - DNA, 22 bp, Homo sapiens
gtgccagggagtggaggagctt

SEQ ID NO: 8765826 - DNA, 22 bp, Homo sapiens
gtgccaggtgctaagctgtgct

SEQ ID NO: 8765827 - DNA, 22 bp, Homo sapiens
gtgcccagcagcagcgtccccg

SEQ ID NO: 8765828 - DNA, 22 bp, Homo sapiens
gtgcccaccggtgccctgagct

SEQ ID NO: 8765829 - DNA, 22 bp, Homo sapiens
gtgccattgcactccagcctgg

SEQ ID NO: 8765830 - DNA, 22 bp, Homo sapiens
gtgcccagctccacctcacaga

SEQ ID NO: 8765831 - DNA, 18 bp, Homo sapiens
gtgccaggaggcgcagcc

SEQ ID NO: 8765832 - DNA, 22 bp, Homo sapiens
gtgccagcctggtgcgcctggg

SEQ ID NO: 8765833 - DNA, 22 bp, Homo sapiens
gtgccaggcctattgttaaact

SEQ ID NO: 8765834 - DNA, 22 bp, Homo sapiens
gtgccaggcccagggagcgggg

SEQ ID NO: 8765835 - DNA, 22 bp, Homo sapiens
gtgccagggagtggaggagctt

SEQ ID NO: 8765836 - DNA, 20 bp, Homo sapiens
gtgccaggcaagacaggtgg

SEQ ID NO: 8765837 - DNA, 20 bp, Homo sapiens
gtgccaggcaagacaggtgg

SEQ ID NO: 8765838 - DNA, 22 bp, Homo sapiens
gtgctgccagacagtgagaggg

SEQ ID NO: 8765839 - DNA, 22 bp, Homo sapiens
gtgctgccggcatagcagtgaa

SEQ ID NO: 8765840 - DNA, 22 bp, Homo sapiens
gtgctggcacccctctccagtt

SEQ ID NO: 8765841 - DNA, 22 bp, Homo sapiens
gtgctggccctgtcctcgagct

SEQ ID NO: 8765842 - DNA, 22 bp, Homo sapiens
gtgctgacaggagcctggcggt

SEQ ID NO: 8765843 - DNA, 22 bp, Homo sapiens
gtgctgacaggagcctggcggt

SEQ ID NO: 8765844 - DNA, 16 bp, Homo sapiens
gtgctgacagctctgg

SEQ ID NO: 8765845 - DNA, 22 bp, Homo sapiens
gtgctgacaggagcctggcggt

SEQ ID NO: 8765846 - DNA, 22 bp, Homo sapiens
gtgcccaggcccaaggcaccac

SEQ ID NO: 8765847 - DNA, 22 bp, Homo sapiens
gtgcccaggcccaaggcaccac

SEQ ID NO: 8765848 - DNA, 22 bp, Homo sapiens
gtgctgagtgcagagtgcagag

SEQ ID NO: 8765849 - DNA, 22 bp, Homo sapiens
gtgctgatagcatcataaagtc

SEQ ID NO: 8765850 - DNA, 22 bp, Homo sapiens
gtgctgagtgcagagtgcagag

SEQ ID NO: 8765851 - DNA, 22 bp, Homo sapiens
gtgctgagtgcagagtgcagag

SEQ ID NO: 8765852 - DNA, 20 bp, Homo sapiens
gtgctgagtgaaatgagatt

SEQ ID NO: 8765853 - DNA, 22 bp, Homo sapiens
gtgctgagaacaaaagtggaca

SEQ ID NO: 8765854 - DNA, 22 bp, Homo sapiens
gtgctgagaacaaaagtggaca

SEQ ID NO: 8765855 - DNA, 22 bp, Homo sapiens
gtgctgattgggagctgggatt

SEQ ID NO: 8765856 - DNA, 22 bp, Homo sapiens
gtgctgatcttcacttggctgc

SEQ ID NO: 8765857 - DNA, 23 bp, Homo sapiens
gtgctgcaaaatcggccactgca

SEQ ID NO: 8765858 - DNA, 22 bp, Homo sapiens
gtgctgcagggtcagcaccctc

SEQ ID NO: 8765859 - DNA, 22 bp, Homo sapiens
gtgctgcagggtcagcaccctc

SEQ ID NO: 8765860 - DNA, 22 bp, Homo sapiens
gtgctgcatgacttgctcctga

SEQ ID NO: 8765861 - DNA, 22 bp, Homo sapiens
gtgctgcagggtcagcaccctc

SEQ ID NO: 8765862 - DNA, 22 bp, Homo sapiens
gtgctgcagggcctcctgcacc

SEQ ID NO: 8765863 - DNA, 22 bp, Homo sapiens
gtacaatagcagttttcccttt

SEQ ID NO: 8765864 - DNA, 19 bp, Homo sapiens
gtacaatgtgttgttggta

SEQ ID NO: 8765865 - DNA, 22 bp, Homo sapiens
gtacaatagtccctgtttggat

SEQ ID NO: 8765866 - DNA, 22 bp, Homo sapiens
gtacaattaagtgcacaaatag

SEQ ID NO: 8765867 - DNA, 22 bp, Homo sapiens
gtacaattatttaaatggtgaa

SEQ ID NO: 8765868 - DNA, 22 bp, Homo sapiens
gtacaattaagtgcacaaatag

SEQ ID NO: 8765869 - DNA, 22 bp, Homo sapiens
gtaggaagctctgaggctagtt

SEQ ID NO: 8765870 - DNA, 22 bp, Homo sapiens
gtacaattcctgtcaagctggc

SEQ ID NO: 8765871 - DNA, 22 bp, Homo sapiens
gtaggaagctctgaggctagtt

SEQ ID NO: 8765872 - DNA, 22 bp, Homo sapiens
gtaggagcattgagggtatgga

SEQ ID NO: 8765873 - DNA, 23 bp, Homo sapiens
gtaggaattttcacttcctcttg

SEQ ID NO: 8765874 - DNA, 22 bp, Homo sapiens
gtaggggtcaggtagggactct

SEQ ID NO: 8765875 - DNA, 22 bp, Homo sapiens
gtaggcagataggagtgcagcc

SEQ ID NO: 8765876 - DNA, 22 bp, Homo sapiens
gtaggcagaataattcctcctt

SEQ ID NO: 8765877 - DNA, 22 bp, Homo sapiens
gtaggcagaccagtggatgggt

SEQ ID NO: 8765878 - DNA, 22 bp, Homo sapiens
gtaggcagaccagtggatgggt

SEQ ID NO: 8765879 - DNA, 22 bp, Homo sapiens
gtagtcccagctaccccggagg

SEQ ID NO: 8765880 - DNA, 22 bp, Homo sapiens
gtagtacatgaagcacttggca

SEQ ID NO: 8765881 - DNA, 22 bp, Homo sapiens
gtagtattttctgtgatgtagg

SEQ ID NO: 8765882 - DNA, 22 bp, Homo sapiens
gtagtcacaaaccattcatatg

SEQ ID NO: 8765883 - DNA, 22 bp, Homo sapiens
gtagtctgagcaagcagtgtgt

SEQ ID NO: 8765884 - DNA, 22 bp, Homo sapiens
gtagtctgaacagtaattttgt

SEQ ID NO: 8765885 - DNA, 22 bp, Homo sapiens
gtaggtcagacataagaggaca

SEQ ID NO: 8765886 - DNA, 22 bp, Homo sapiens
gtaggtgagtgatgctcagatt

SEQ ID NO: 8765887 - DNA, 22 bp, Homo sapiens
gtagtaaagcaggttttgctgt

SEQ ID NO: 8765888 - DNA, 22 bp, Homo sapiens
gtagtacatcgttatgtaatat

SEQ ID NO: 8765889 - DNA, 22 bp, Homo sapiens
gtacaaaagttattgcggtttt

SEQ ID NO: 8765890 - DNA, 22 bp, Homo sapiens
gtacaaaagttattgcggtttt

SEQ ID NO: 8765891 - DNA, 22 bp, Homo sapiens
gtacaaaagttattgcggtttt

SEQ ID NO: 8765892 - DNA, 22 bp, Homo sapiens
gtacaaaagttattgcggtttt

SEQ ID NO: 8765893 - DNA, 22 bp, Homo sapiens
gtacaaattaggaagctttgtg

SEQ ID NO: 8765894 - DNA, 22 bp, Homo sapiens
gtacaaatgtacacttgtataa

SEQ ID NO: 8765895 - DNA, 22 bp, Homo sapiens
gtacaaatgcaggtttgttaca

SEQ ID NO: 8765896 - DNA, 22 bp, Homo sapiens
gtacaaattttgacatctagga

SEQ ID NO: 8765897 - DNA, 22 bp, Homo sapiens
gtacaaattgatacaggttttc

SEQ ID NO: 8765898 - DNA, 22 bp, Homo sapiens
gtacaaattgatacagatttga

SEQ ID NO: 8765899 - DNA, 22 bp, Homo sapiens
gtacaagtgctgtgagggaaaa

SEQ ID NO: 8765900 - DNA, 22 bp, Homo sapiens
gtacaagaggagaaaatggagt

SEQ ID NO: 8765901 - DNA, 22 bp, Homo sapiens
gtacaagttctactctataaat

SEQ ID NO: 8765902 - DNA, 22 bp, Homo sapiens
gtacaagtgtgtgtttgagcag

SEQ ID NO: 8765903 - DNA, 22 bp, Homo sapiens
gtacaataactagtcttatagt

SEQ ID NO: 8765904 - DNA, 22 bp, Homo sapiens
gtacaataactagtcttatagt

SEQ ID NO: 8765905 - DNA, 20 bp, Homo sapiens
gtcaaactactggcagtgcc

SEQ ID NO: 8765906 - DNA, 22 bp, Homo sapiens
gtcaaacatagggactttgtgg

SEQ ID NO: 8765907 - DNA, 22 bp, Homo sapiens
gtcaaagatcctatgagttaaa

SEQ ID NO: 8765908 - DNA, 22 bp, Homo sapiens
gtcaaacaaattaacatatcca

SEQ ID NO: 8765909 - DNA, 22 bp, Homo sapiens
gtcaaacaaattaacatatcca

SEQ ID NO: 8765910 - DNA, 22 bp, Homo sapiens
gtcaaacagcctcctgttctaa

SEQ ID NO: 8765911 - DNA, 22 bp, Homo sapiens
gtcaaacagcctcctgttctaa

SEQ ID NO: 8765912 - DNA, 22 bp, Homo sapiens
gtcaaatatactaagaggtaaa

SEQ ID NO: 8765913 - DNA, 22 bp, Homo sapiens
gtcaccatctacagctccaaac

SEQ ID NO: 8765914 - DNA, 16 bp, Homo sapiens
gtcaccatcatgtagt

SEQ ID NO: 8765915 - DNA, 23 bp, Homo sapiens
gtcaccataatccgttagaccag

SEQ ID NO: 8765916 - DNA, 22 bp, Homo sapiens
gtcaaatatatgcaaaactatt

SEQ ID NO: 8765917 - DNA, 22 bp, Homo sapiens
gtcaaatgcacagaaccattaa

SEQ ID NO: 8765918 - DNA, 22 bp, Homo sapiens
gtcaacaaagaaaattgttaat

SEQ ID NO: 8765919 - DNA, 22 bp, Homo sapiens
gtcaccattgcccactccatgg

SEQ ID NO: 8765920 - DNA, 22 bp, Homo sapiens
gtcaccatctacagctccaaac

SEQ ID NO: 8765921 - DNA, 22 bp, Homo sapiens
gtcaccatggataagaatcact

SEQ ID NO: 8765922 - DNA, 19 bp, Homo sapiens
gtcaccatttccaaatgcc

SEQ ID NO: 8765923 - DNA, 22 bp, Homo sapiens
gtcaaaaagtagtcatttctgt

SEQ ID NO: 8765924 - DNA, 22 bp, Homo sapiens
gtatttttcattccaagtgaga

SEQ ID NO: 8765925 - DNA, 22 bp, Homo sapiens
gtatttttcattccaagtgaga

SEQ ID NO: 8765926 - DNA, 22 bp, Homo sapiens
gtatttttcattccaagtgaga

SEQ ID NO: 8765927 - DNA, 22 bp, Homo sapiens
gtatttttcattccaagtgaga

SEQ ID NO: 8765928 - DNA, 22 bp, Homo sapiens
gtatttttcattccaagtgaga

SEQ ID NO: 8765929 - DNA, 22 bp, Homo sapiens
gtatttttagtagagtcggggt

SEQ ID NO: 8765930 - DNA, 22 bp, Homo sapiens
gtatttttagtagagtcggggt

SEQ ID NO: 8765931 - DNA, 22 bp, Homo sapiens
gtatttttaggtaaggaaagta

SEQ ID NO: 8765932 - DNA, 22 bp, Homo sapiens
gtatttttaggtaaggaaagta

SEQ ID NO: 8765933 - DNA, 22 bp, Homo sapiens
gtatttttaggtaaggaaagta

SEQ ID NO: 8765934 - DNA, 22 bp, Homo sapiens
gtatttttaggtaaggaaagta

SEQ ID NO: 8765935 - DNA, 22 bp, Homo sapiens
gtatttttcagttaggagctta

SEQ ID NO: 8765936 - DNA, 22 bp, Homo sapiens
gtatttttcagttaggagctta

SEQ ID NO: 8765937 - DNA, 22 bp, Homo sapiens
gtatttttagtagagtcggggt

SEQ ID NO: 8765938 - DNA, 22 bp, Homo sapiens
gtatttttagtagagtcggggt

SEQ ID NO: 8765939 - DNA, 22 bp, Homo sapiens
gtatttttcagttaggagctta

SEQ ID NO: 8765940 - DNA, 22 bp, Homo sapiens
gtatttttcagttaggagctta

SEQ ID NO: 8765941 - DNA, 22 bp, Homo sapiens
gtagttatcatcatactccaga

SEQ ID NO: 8765942 - DNA, 22 bp, Homo sapiens
gtagttatcagtatgacaccag

SEQ ID NO: 8765943 - DNA, 22 bp, Homo sapiens
gtagttatttatttaccactcc

SEQ ID NO: 8765944 - DNA, 22 bp, Homo sapiens
gtagttattgctgtttacttct

SEQ ID NO: 8765945 - DNA, 22 bp, Homo sapiens
gtagttattctgcctttaagga

SEQ ID NO: 8765946 - DNA, 22 bp, Homo sapiens
gtagttatgtttacatgccatc

SEQ ID NO: 8765947 - DNA, 22 bp, Homo sapiens
gtagtgtgtaggcactgtgctc

SEQ ID NO: 8765948 - DNA, 22 bp, Homo sapiens
gtagttctttctcaatgttcaa

SEQ ID NO: 8765949 - DNA, 20 bp, Homo sapiens
gtataagatttcacacatta

SEQ ID NO: 8765950 - DNA, 20 bp, Homo sapiens
gtataagatttcacacatta

SEQ ID NO: 8765951 - DNA, 22 bp, Homo sapiens
gtatacaactattgttgggtaa

SEQ ID NO: 8765952 - DNA, 22 bp, Homo sapiens
gtataaagtataagcttgtttt

SEQ ID NO: 8765953 - DNA, 22 bp, Homo sapiens
gtatacaactattgttgggtaa

SEQ ID NO: 8765954 - DNA, 22 bp, Homo sapiens
gtatacaatacacaatgctctg

SEQ ID NO: 8765955 - DNA, 22 bp, Homo sapiens
gtatacactgtctcctctaggt

SEQ ID NO: 8765956 - DNA, 22 bp, Homo sapiens
gtatacagatacttagacgtgc

SEQ ID NO: 8765957 - DNA, 22 bp, Homo sapiens
gtatacactggtaagatttgtc

SEQ ID NO: 8765958 - DNA, 22 bp, Homo sapiens
gtatacactgtctcctctaggt

SEQ ID NO: 8765959 - DNA, 22 bp, Homo sapiens
gtatttttaggtaaggaaagta

SEQ ID NO: 8765960 - DNA, 22 bp, Homo sapiens
gtattttgttagggtgtggtat

SEQ ID NO: 8765961 - DNA, 22 bp, Homo sapiens
gtatttttaggtaaggaaagta

SEQ ID NO: 8765962 - DNA, 22 bp, Homo sapiens
gtattttcatgatttcagacca

SEQ ID NO: 8765963 - DNA, 22 bp, Homo sapiens
gtattttcaagagcagtagtat

SEQ ID NO: 8765964 - DNA, 22 bp, Homo sapiens
gtatttccctgagttctgtgag

SEQ ID NO: 8765965 - DNA, 22 bp, Homo sapiens
gtattttatggcatgcagtggc

SEQ ID NO: 8765966 - DNA, 22 bp, Homo sapiens
gtcctggcccaggagtacacat

SEQ ID NO: 8765967 - DNA, 22 bp, Homo sapiens
gtcctggctggttctgtggggc

SEQ ID NO: 8765968 - DNA, 19 bp, Homo sapiens
gtcctggcgccgccacacc

SEQ ID NO: 8765969 - DNA, 22 bp, Homo sapiens
gtcctggcccactggcaggctg

SEQ ID NO: 8765970 - DNA, 22 bp, Homo sapiens
gtcctggcccactggcaggctg

SEQ ID NO: 8765971 - DNA, 22 bp, Homo sapiens
gtcctggcacctcactggctac

SEQ ID NO: 8765972 - DNA, 22 bp, Homo sapiens
gtcctggcacctcactggctac

SEQ ID NO: 8765973 - DNA, 22 bp, Homo sapiens
gtcgtggagctcacagtgtgcc

SEQ ID NO: 8765974 - DNA, 22 bp, Homo sapiens
gtcgtggagctcacagtgtgcc

SEQ ID NO: 8765975 - DNA, 22 bp, Homo sapiens
gtcctggcttagttcgctgtaa

SEQ ID NO: 8765976 - DNA, 22 bp, Homo sapiens
gtcctggctggttctgtggggc

SEQ ID NO: 8765977 - DNA, 22 bp, Homo sapiens
gtcctctgggctttgagcagtc

SEQ ID NO: 8765978 - DNA, 22 bp, Homo sapiens
gtcctctgggctttgagcagtc

SEQ ID NO: 8765979 - DNA, 22 bp, Homo sapiens
gtcctctgggctttgagcagtc

SEQ ID NO: 8765980 - DNA, 22 bp, Homo sapiens
gtcctctggtgaaagcattccc

SEQ ID NO: 8765981 - DNA, 22 bp, Homo sapiens
gtcctctgtagggctgggccac

SEQ ID NO: 8765982 - DNA, 22 bp, Homo sapiens
gtcctctgtccctggggcacgg

SEQ ID NO: 8765983 - DNA, 22 bp, Homo sapiens
gtcctctgtccctggggcacgg

SEQ ID NO: 8765984 - DNA, 22 bp, Homo sapiens
gtcctctgtccctggggcacgg

SEQ ID NO: 8765985 - DNA, 22 bp, Homo sapiens
gtcctgcttgttaggcctagtc

SEQ ID NO: 8765986 - DNA, 22 bp, Homo sapiens
gtcctgcggcctcagtggtgag

SEQ ID NO: 8765987 - DNA, 22 bp, Homo sapiens
gtcctgcaggagttgtactctg

SEQ ID NO: 8765988 - DNA, 22 bp, Homo sapiens
gtcctgcacatggagggcaatg

SEQ ID NO: 8765989 - DNA, 22 bp, Homo sapiens
gtcctctgtgtaggctgcagac

SEQ ID NO: 8765990 - DNA, 22 bp, Homo sapiens
gtccaggctaagtcccttctgc

SEQ ID NO: 8765991 - DNA, 22 bp, Homo sapiens
gtccaggctaagtcccttctgc

SEQ ID NO: 8765992 - DNA, 22 bp, Homo sapiens
gtccaggctaagtcccttctgc

SEQ ID NO: 8765993 - DNA, 22 bp, Homo sapiens
gtccaggctaagtcccttctgc

SEQ ID NO: 8765994 - DNA, 22 bp, Homo sapiens
gtccaggctcaaaaggttgtta

SEQ ID NO: 8765995 - DNA, 22 bp, Homo sapiens
gtccaggctcaaaaggttgtta

SEQ ID NO: 8765996 - DNA, 22 bp, Homo sapiens
gtccaggctgacccctagagga

SEQ ID NO: 8765997 - DNA, 22 bp, Homo sapiens
gtccaggccatggtggacacag

SEQ ID NO: 8765998 - DNA, 22 bp, Homo sapiens
gtccaggccatggtggacacag

SEQ ID NO: 8765999 - DNA, 22 bp, Homo sapiens
gtccaggccccagggattcttg

SEQ ID NO: 8766000 - DNA, 22 bp, Homo sapiens
gtccaggcctgcctctgaggag

SEQ ID NO: 8766001 - DNA, 20 bp, Homo sapiens
gtccaggacccagcaggagg

SEQ ID NO: 8766002 - DNA, 20 bp, Homo sapiens
gtccaggacccagcaggagg

SEQ ID NO: 8766003 - DNA, 22 bp, Homo sapiens
gtccaggaatcaaaagatggaa

SEQ ID NO: 8766004 - DNA, 19 bp, Homo sapiens
gtccaggcattgggttggt

SEQ ID NO: 8766005 - DNA, 19 bp, Homo sapiens
gtccaggcattgggttggt

SEQ ID NO: 8766006 - DNA, 22 bp, Homo sapiens
gtccaggcacctcccttgtgct

SEQ ID NO: 8766007 - DNA, 22 bp, Homo sapiens
gtccaggcacctcccttgtgct

SEQ ID NO: 8766008 - DNA, 22 bp, Homo sapiens
gtccaggcacctcccttgtgct

SEQ ID NO: 8766009 - DNA, 22 bp, Homo sapiens
gtccaggctgcccagggtcctg

SEQ ID NO: 8766010 - DNA, 22 bp, Homo sapiens
gtcctctgcttcatgccctgat

SEQ ID NO: 8766011 - DNA, 22 bp, Homo sapiens
gtcctctggaagatgagttctt

SEQ ID NO: 8766012 - DNA, 22 bp, Homo sapiens
gtccaggctgcccagggtcctg

SEQ ID NO: 8766013 - DNA, 22 bp, Homo sapiens
gtccaggctgcccagggtcctg

SEQ ID NO: 8766014 - DNA, 22 bp, Homo sapiens
gtccaggctgcccagggtcctg

SEQ ID NO: 8766015 - DNA, 22 bp, Homo sapiens
gtccaggctgacccctagagga

SEQ ID NO: 8766016 - DNA, 22 bp, Homo sapiens
gtccaggctgcccagggtcctg

SEQ ID NO: 8766017 - DNA, 22 bp, Homo sapiens
gtccaggctgacccctagagga

SEQ ID NO: 8766018 - DNA, 22 bp, Homo sapiens
gtccaggctgacccctagagga

SEQ ID NO: 8766019 - DNA, 22 bp, Homo sapiens
gtcctctgggcagctgccccac

SEQ ID NO: 8766020 - DNA, 23 bp, Homo sapiens
gtcctctggagagaaaggcagta

SEQ ID NO: 8766021 - DNA, 22 bp, Homo sapiens
gtcctctgggagccttgagcct

SEQ ID NO: 8766022 - DNA, 23 bp, Homo sapiens
gtcctctggagagaaaggcagta

SEQ ID NO: 8766023 - DNA, 22 bp, Homo sapiens
gtcctctggcctttcccaggac

SEQ ID NO: 8766024 - DNA, 22 bp, Homo sapiens
gtcctctggcctttcccaggac

SEQ ID NO: 8766025 - DNA, 22 bp, Homo sapiens
gtccagctgatcttgacccagc

SEQ ID NO: 8766026 - DNA, 22 bp, Homo sapiens
gtccagctccagggaggcaggc

SEQ ID NO: 8766027 - DNA, 19 bp, Homo sapiens
gtccagcctttgggtctta

SEQ ID NO: 8766028 - DNA, 22 bp, Homo sapiens
gtccagcctgaagagtgggggc

SEQ ID NO: 8766029 - DNA, 22 bp, Homo sapiens
gtccagcccttgcagcttcttt

SEQ ID NO: 8766030 - DNA, 22 bp, Homo sapiens
gtccagcccgggctccgccagc

SEQ ID NO: 8766031 - DNA, 22 bp, Homo sapiens
gtccagccctctgcctccaggt

SEQ ID NO: 8766032 - DNA, 22 bp, Homo sapiens
gtccagcccctgactcccaggc

SEQ ID NO: 8766033 - DNA, 22 bp, Homo sapiens
gtccagccaggcctgtctctgg

SEQ ID NO: 8766034 - DNA, 22 bp, Homo sapiens
gtcagaggaggctgagtaggaa

SEQ ID NO: 8766035 - DNA, 22 bp, Homo sapiens
gtccagaagctcaagttgaact

SEQ ID NO: 8766036 - DNA, 22 bp, Homo sapiens
gtccagaaggaggtcaagttgg

SEQ ID NO: 8766037 - DNA, 22 bp, Homo sapiens
gtccagagaagggaggggactc

SEQ ID NO: 8766038 - DNA, 21 bp, Homo sapiens
gtccagagagccggctcctga

SEQ ID NO: 8766039 - DNA, 22 bp, Homo sapiens
gtcagagaactggattttccaa

SEQ ID NO: 8766040 - DNA, 22 bp, Homo sapiens
gtcagagctgtgcaaggctgag

SEQ ID NO: 8766041 - DNA, 22 bp, Homo sapiens
gtcagaggaatggatgagtgat

SEQ ID NO: 8766042 - DNA, 22 bp, Homo sapiens
gtcagaggaatggatgagtgat

SEQ ID NO: 8766043 - DNA, 20 bp, Homo sapiens
gtcagaggaccctagagcga

SEQ ID NO: 8766044 - DNA, 22 bp, Homo sapiens
gtcactcttccccatagcctac

SEQ ID NO: 8766045 - DNA, 22 bp, Homo sapiens
gtcactactgaagtcaatgttg

SEQ ID NO: 8766046 - DNA, 22 bp, Homo sapiens
gtcacctctcatcacatgctac

SEQ ID NO: 8766047 - DNA, 22 bp, Homo sapiens
gtcaccctgctgtttgtccatt

SEQ ID NO: 8766048 - DNA, 22 bp, Homo sapiens
gtcaccctcacggggactcctt

SEQ ID NO: 8766049 - DNA, 22 bp, Homo sapiens
gtcaccctgctggctgttcagc

SEQ ID NO: 8766050 - DNA, 22 bp, Homo sapiens
gtcactgacaagagagaagaac

SEQ ID NO: 8766051 - DNA, 22 bp, Homo sapiens
gtcactgactctgggagatgtg

SEQ ID NO: 8766052 - DNA, 22 bp, Homo sapiens
gtcactgtatccaggttccagc

SEQ ID NO: 8766053 - DNA, 22 bp, Homo sapiens
gtcactttattaattttggtga

SEQ ID NO: 8766054 - DNA, 22 bp, Homo sapiens
gtcactttaaagggttaacagg

SEQ ID NO: 8766055 - DNA, 22 bp, Homo sapiens
gtcactttggcctctacagcca

SEQ ID NO: 8766056 - DNA, 22 bp, Homo sapiens
gtcactttggcctctacagcca

SEQ ID NO: 8766057 - DNA, 22 bp, Homo sapiens
gtcagaatttacttaatagcca

SEQ ID NO: 8766058 - DNA, 22 bp, Homo sapiens
gtcagactgcactcaaggacag

SEQ ID NO: 8766059 - DNA, 22 bp, Homo sapiens
ggcccagttgagaatgaatgat

SEQ ID NO: 8766060 - DNA, 22 bp, Homo sapiens
ggcccagtgttgccagacctga

SEQ ID NO: 8766061 - DNA, 22 bp, Homo sapiens
ggcccatctcttgctctgggtt

SEQ ID NO: 8766062 - DNA, 22 bp, Homo sapiens
ggcccagtgtcccggtcgtggc

SEQ ID NO: 8766063 - DNA, 22 bp, Homo sapiens
ggcccagtgtgggtggatgttg

SEQ ID NO: 8766064 - DNA, 22 bp, Homo sapiens
ggcccagtgtaccccaggcagt

SEQ ID NO: 8766065 - DNA, 22 bp, Homo sapiens
ggcccagtctggggccctgtga

SEQ ID NO: 8766066 - DNA, 20 bp, Homo sapiens
ggcccagtgaaccaggacgg

SEQ ID NO: 8766067 - DNA, 22 bp, Homo sapiens
ggcccagtgctgttcacccagt

SEQ ID NO: 8766068 - DNA, 22 bp, Homo sapiens
ggcccaggctggagtgcggtgg

SEQ ID NO: 8766069 - DNA, 22 bp, Homo sapiens
ggcccaggctggagtgcggtgg

SEQ ID NO: 8766070 - DNA, 22 bp, Homo sapiens
ggcccaggctggagtgcggtgg

SEQ ID NO: 8766071 - DNA, 22 bp, Homo sapiens
ggcccaggtccagcgagtacct

SEQ ID NO: 8766072 - DNA, 22 bp, Homo sapiens
ggcccaggatgcaagaactgaa

SEQ ID NO: 8766073 - DNA, 22 bp, Homo sapiens
ggcccagctttcattccttgct

SEQ ID NO: 8766074 - DNA, 22 bp, Homo sapiens
ggcccaggctggagtgcagtgg

SEQ ID NO: 8766075 - DNA, 22 bp, Homo sapiens
ggcccagctgtgcttccagccc

SEQ ID NO: 8766076 - DNA, 22 bp, Homo sapiens
ggcccagctgtgcttccagccc

SEQ ID NO: 8766077 - DNA, 22 bp, Homo sapiens
ggcccagctgtatattacagtt

SEQ ID NO: 8766078 - DNA, 22 bp, Homo sapiens
ggcccagctgggcggggacacg

SEQ ID NO: 8766079 - DNA, 22 bp, Homo sapiens
ggccagctgccaccagccctat

SEQ ID NO: 8766080 - DNA, 22 bp, Homo sapiens
ggccagctgccaccagccctat

SEQ ID NO: 8766081 - DNA, 22 bp, Homo sapiens
ggccagctgctcagtgtctctg

SEQ ID NO: 8766082 - DNA, 22 bp, Homo sapiens
ggccagctgctcagtgtctctg

SEQ ID NO: 8766083 - DNA, 22 bp, Homo sapiens
ggcccagcgaggccacctacag

SEQ ID NO: 8766084 - DNA, 22 bp, Homo sapiens
ggccagctggatgtgggtgacg

SEQ ID NO: 8766085 - DNA, 22 bp, Homo sapiens
ggccagctggatgtgggtgacg

SEQ ID NO: 8766086 - DNA, 22 bp, Homo sapiens
ggccagctggatgtgggtgacg

SEQ ID NO: 8766087 - DNA, 22 bp, Homo sapiens
ggccagctcttgtccacggagg

SEQ ID NO: 8766088 - DNA, 22 bp, Homo sapiens
ggccagctgagctgctgcacag

SEQ ID NO: 8766089 - DNA, 22 bp, Homo sapiens
ggccagctctgcacagcagctg

SEQ ID NO: 8766090 - DNA, 22 bp, Homo sapiens
ggccagctctgcacagcagctg

SEQ ID NO: 8766091 - DNA, 22 bp, Homo sapiens
ggccagcccagtggtcctctct

SEQ ID NO: 8766092 - DNA, 22 bp, Homo sapiens
ggccagcatggcaagaccaact

SEQ ID NO: 8766093 - DNA, 19 bp, Homo sapiens
ggccagccacctcgcctgg

SEQ ID NO: 8766094 - DNA, 19 bp, Homo sapiens
ggccagccacctcgcctgg

SEQ ID NO: 8766095 - DNA, 22 bp, Homo sapiens
ggccagcccagtggtcctctct

SEQ ID NO: 8766096 - DNA, 22 bp, Homo sapiens
ggccagcaggccctgtgatcct

SEQ ID NO: 8766097 - DNA, 21 bp, Homo sapiens
ggccagcagcgtccactgtgg

SEQ ID NO: 8766098 - DNA, 22 bp, Homo sapiens
ggccagcaggccctgtgatcct

SEQ ID NO: 8766099 - DNA, 22 bp, Homo sapiens
ggccagcagtatatagctaatt

SEQ ID NO: 8766100 - DNA, 22 bp, Homo sapiens
ggccagcatatagagtgaagta

SEQ ID NO: 8766101 - DNA, 22 bp, Homo sapiens
ggccagcagtatatagctaatt

SEQ ID NO: 8766102 - DNA, 22 bp, Homo sapiens
ggccagcagtcacagggtcaga

SEQ ID NO: 8766103 - DNA, 22 bp, Homo sapiens
ggccagagtctatatgcagaca

SEQ ID NO: 8766104 - DNA, 22 bp, Homo sapiens
ggccagaggtgtcctcagttct

SEQ ID NO: 8766105 - DNA, 22 bp, Homo sapiens
ggccacctctgccctaccgagt

SEQ ID NO: 8766106 - DNA, 22 bp, Homo sapiens
ggccacctccgtgaaggaatga

SEQ ID NO: 8766107 - DNA, 19 bp, Homo sapiens
ggccacctctcttcccagg

SEQ ID NO: 8766108 - DNA, 22 bp, Homo sapiens
ggccagagttgatggcatcttg

SEQ ID NO: 8766109 - DNA, 19 bp, Homo sapiens
ggccagcacagggctctgt

SEQ ID NO: 8766110 - DNA, 22 bp, Homo sapiens
ggccagcagacctcagggactc

SEQ ID NO: 8766111 - DNA, 22 bp, Homo sapiens
ggccagcagacctcagggactc

SEQ ID NO: 8766112 - DNA, 22 bp, Homo sapiens
ggccagcagacctcagggactc

SEQ ID NO: 8766113 - DNA, 22 bp, Homo sapiens
ggccagcagacctcagggactc

SEQ ID NO: 8766114 - DNA, 22 bp, Homo sapiens
ggccaccagtcctctggcaggg

SEQ ID NO: 8766115 - DNA, 22 bp, Homo sapiens
ggccaccaaagtcctgtggctt

SEQ ID NO: 8766116 - DNA, 22 bp, Homo sapiens
ggccaccaaagtcctgtggctt

SEQ ID NO: 8766117 - DNA, 22 bp, Homo sapiens
ggccaccagtcctctggcaggg

SEQ ID NO: 8766118 - DNA, 22 bp, Homo sapiens
ggccaccagtcctctggcaggg

SEQ ID NO: 8766119 - DNA, 22 bp, Homo sapiens
ggccacctaggagccacagtga

SEQ ID NO: 8766120 - DNA, 22 bp, Homo sapiens
ggccacatgtggctgctcgtat

SEQ ID NO: 8766121 - DNA, 22 bp, Homo sapiens
ggccaccaaagtcctgtggctt

SEQ ID NO: 8766122 - DNA, 21 bp, Homo sapiens
ggccacagttagggctcagga

SEQ ID NO: 8766123 - DNA, 21 bp, Homo sapiens
ggccacagttagggctcagga

SEQ ID NO: 8766124 - DNA, 21 bp, Homo sapiens
ggccacagttagggctcagga

SEQ ID NO: 8766125 - DNA, 21 bp, Homo sapiens
ggccacagttagggctcagga

SEQ ID NO: 8766126 - DNA, 22 bp, Homo sapiens
ggccacagtctctggaaggatg

SEQ ID NO: 8766127 - DNA, 22 bp, Homo sapiens
ggccacagtgggaaatcctggg

SEQ ID NO: 8766128 - DNA, 21 bp, Homo sapiens
ggccacagttagggctcagga

SEQ ID NO: 8766129 - DNA, 20 bp, Homo sapiens
ggccacagggtgctggtgga

SEQ ID NO: 8766130 - DNA, 20 bp, Homo sapiens
ggccacagggtgctggtgga

SEQ ID NO: 8766131 - DNA, 20 bp, Homo sapiens
ggccacagggtgctggtgga

SEQ ID NO: 8766132 - DNA, 20 bp, Homo sapiens
ggccacagggtgctggtgga

SEQ ID NO: 8766133 - DNA, 22 bp, Homo sapiens
ggccacagggctgaacgtggac

SEQ ID NO: 8766134 - DNA, 22 bp, Homo sapiens
ggccacagcagatgcttcagat

SEQ ID NO: 8766135 - DNA, 22 bp, Homo sapiens
ggccacagcaatgctgtgatgt

SEQ ID NO: 8766136 - DNA, 22 bp, Homo sapiens
ggccacagcagatgcttcagat

SEQ ID NO: 8766137 - DNA, 22 bp, Homo sapiens
ggccacagcagatgcttcagat

SEQ ID NO: 8766138 - DNA, 22 bp, Homo sapiens
ggccacagcagatgcttcagat

SEQ ID NO: 8766139 - DNA, 22 bp, Homo sapiens
ggcagtggctgtagtctcttgg

SEQ ID NO: 8766140 - DNA, 22 bp, Homo sapiens
ggcagtgggaaataagtgagaa

SEQ ID NO: 8766141 - DNA, 22 bp, Homo sapiens
ggcagtggctgtagtctcttgg

SEQ ID NO: 8766142 - DNA, 22 bp, Homo sapiens
ggcagtggctgtagtctcttgg

SEQ ID NO: 8766143 - DNA, 22 bp, Homo sapiens
ggcagtggcatgtgggtagtgg

SEQ ID NO: 8766144 - DNA, 22 bp, Homo sapiens
ggcagtggcagagcttggtcta

SEQ ID NO: 8766145 - DNA, 22 bp, Homo sapiens
ggcagtggctcctctctactcc

SEQ ID NO: 8766146 - DNA, 22 bp, Homo sapiens
ggcagtggcatgtgggtagtgg

SEQ ID NO: 8766147 - DNA, 22 bp, Homo sapiens
ggcagtgggtggatctcaggga

SEQ ID NO: 8766148 - DNA, 17 bp, Homo sapiens
ggccacagagcttgggg

SEQ ID NO: 8766149 - DNA, 17 bp, Homo sapiens
ggccacagagcttgggg

SEQ ID NO: 8766150 - DNA, 22 bp, Homo sapiens
ggccacagagggcgggatgctg

SEQ ID NO: 8766151 - DNA, 22 bp, Homo sapiens
ggccacagagggcgggatgctg

SEQ ID NO: 8766152 - DNA, 22 bp, Homo sapiens
ggccacagagggcgggatgctg

SEQ ID NO: 8766153 - DNA, 22 bp, Homo sapiens
ggcagtgggtggatctcaggga

SEQ ID NO: 8766154 - DNA, 17 bp, Homo sapiens
ggccacagagcttgggg

SEQ ID NO: 8766155 - DNA, 22 bp, Homo sapiens
ggctcactttggggtcagctgg

SEQ ID NO: 8766156 - DNA, 22 bp, Homo sapiens
ggctcactgcaacttccgcctc

SEQ ID NO: 8766157 - DNA, 22 bp, Homo sapiens
ggctcagaggttgaggccggca

SEQ ID NO: 8766158 - DNA, 22 bp, Homo sapiens
ggctcagaaggccatgctctgc

SEQ ID NO: 8766159 - DNA, 22 bp, Homo sapiens
ggctcagcaatgatgagcccct

SEQ ID NO: 8766160 - DNA, 22 bp, Homo sapiens
ggctcagcacagggctggcatc

SEQ ID NO: 8766161 - DNA, 22 bp, Homo sapiens
ggctcagcaatgatgagcccct

SEQ ID NO: 8766162 - DNA, 22 bp, Homo sapiens
ggctcagattccgagtggccct

SEQ ID NO: 8766163 - DNA, 22 bp, Homo sapiens
ggctctgaaggagacagctgct

SEQ ID NO: 8766164 - DNA, 22 bp, Homo sapiens
ggctctgaacatggggaggagt

SEQ ID NO: 8766165 - DNA, 22 bp, Homo sapiens
ggctctgaaattctcactttta

SEQ ID NO: 8766166 - DNA, 22 bp, Homo sapiens
ggctctctggaggagctcaccc

SEQ ID NO: 8766167 - DNA, 22 bp, Homo sapiens
ggctctctggaggagctcaccc

SEQ ID NO: 8766168 - DNA, 22 bp, Homo sapiens
ggctctgcagtgacttgagggg

SEQ ID NO: 8766169 - DNA, 22 bp, Homo sapiens
ggctctgcagtgacttgagggg

SEQ ID NO: 8766170 - DNA, 22 bp, Homo sapiens
ggctctgcagcttggggtcctg

SEQ ID NO: 8766171 - DNA, 22 bp, Homo sapiens
ggctctgcagcttgctaactgt

SEQ ID NO: 8766172 - DNA, 22 bp, Homo sapiens
ggctctgcagagggcccagctt

SEQ ID NO: 8766173 - DNA, 22 bp, Homo sapiens
ggctctgcagagggcccagctt

SEQ ID NO: 8766174 - DNA, 22 bp, Homo sapiens
ggctctgagtttagaagggtgg

SEQ ID NO: 8766175 - DNA, 22 bp, Homo sapiens
ggctctgaggctatgctttaca

SEQ ID NO: 8766176 - DNA, 23 bp, Homo sapiens
ggctctgaggatggagctggtgg

SEQ ID NO: 8766177 - DNA, 22 bp, Homo sapiens
ggctctgaggcagatcgatggg

SEQ ID NO: 8766178 - DNA, 22 bp, Homo sapiens
ggctctgaattattcctgagtc

SEQ ID NO: 8766179 - DNA, 22 bp, Homo sapiens
ggctctgaagggtgacaggttt

SEQ ID NO: 8766180 - DNA, 22 bp, Homo sapiens
ggctctgacctcccaggcagtt

SEQ ID NO: 8766181 - DNA, 22 bp, Homo sapiens
ggctctgccacttcttggctgt

SEQ ID NO: 8766182 - DNA, 22 bp, Homo sapiens
ggctctgcatgtgagtgggtgg

SEQ ID NO: 8766183 - DNA, 22 bp, Homo sapiens
ggctctgccatttcctagctgc

SEQ ID NO: 8766184 - DNA, 22 bp, Homo sapiens
ggctctgccatttcctagctgc

SEQ ID NO: 8766185 - DNA, 22 bp, Homo sapiens
ggctctgcccgcggctgcccac

SEQ ID NO: 8766186 - DNA, 22 bp, Homo sapiens
ggctctgcccaggtggacagca

SEQ ID NO: 8766187 - DNA, 22 bp, Homo sapiens
ggctctgcccaggtggacagca

SEQ ID NO: 8766188 - DNA, 22 bp, Homo sapiens
ggctctgcctgcccagcagcac

SEQ ID NO: 8766189 - DNA, 22 bp, Homo sapiens
ggctctgcctgcccagcagcac

SEQ ID NO: 8766190 - DNA, 22 bp, Homo sapiens
ggctctgccgtgtgctcacatg

SEQ ID NO: 8766191 - DNA, 22 bp, Homo sapiens
ggcctctggcaggcaggccctc

SEQ ID NO: 8766192 - DNA, 18 bp, Homo sapiens
ggcctctggactggcagc

SEQ ID NO: 8766193 - DNA, 22 bp, Homo sapiens
ggcctctgcttatgctgatgac

SEQ ID NO: 8766194 - DNA, 18 bp, Homo sapiens
ggcctctggactggcagc

SEQ ID NO: 8766195 - DNA, 22 bp, Homo sapiens
ggcctctggggtcctgagccca

SEQ ID NO: 8766196 - DNA, 22 bp, Homo sapiens
ggcctctggtcaagacaagcat

SEQ ID NO: 8766197 - DNA, 22 bp, Homo sapiens
ggctaggctcacctggagagtt

SEQ ID NO: 8766198 - DNA, 22 bp, Homo sapiens
ggctcacgcaattatcccggcc

SEQ ID NO: 8766199 - DNA, 22 bp, Homo sapiens
ggctcacgcaattatcccggcc

SEQ ID NO: 8766200 - DNA, 22 bp, Homo sapiens
ggctcactgcaaactgtgcctc

SEQ ID NO: 8766201 - DNA, 22 bp, Homo sapiens
ggctcactgcaacctccacctc

SEQ ID NO: 8766202 - DNA, 22 bp, Homo sapiens
ggctcactgcaacttccgcctc

SEQ ID NO: 8766203 - DNA, 22 bp, Homo sapiens
ggctagggacacagctctgctc

SEQ ID NO: 8766204 - DNA, 22 bp, Homo sapiens
ggctcacgcaattatcccggcc

SEQ ID NO: 8766205 - DNA, 22 bp, Homo sapiens
ggctagggaaaatgattggata

SEQ ID NO: 8766206 - DNA, 20 bp, Homo sapiens
ggcctctgaggacaaggaga

SEQ ID NO: 8766207 - DNA, 22 bp, Homo sapiens
ggcctctcttgggacagctgtc

SEQ ID NO: 8766208 - DNA, 22 bp, Homo sapiens
ggcctctgaggacagccttggc

SEQ ID NO: 8766209 - DNA, 22 bp, Homo sapiens
ggcctctctgagagcagacgtt

SEQ ID NO: 8766210 - DNA, 22 bp, Homo sapiens
ggcctctctggcatggctgccc

SEQ ID NO: 8766211 - DNA, 21 bp, Homo sapiens
ggcctcctacagtcatgggcc

SEQ ID NO: 8766212 - DNA, 21 bp, Homo sapiens
ggcctcctacagtcatgggcc

SEQ ID NO: 8766213 - DNA, 21 bp, Homo sapiens
ggcctcctacagtcatgggcc

SEQ ID NO: 8766214 - DNA, 22 bp, Homo sapiens
ggcctctctgagagcagacgtt

SEQ ID NO: 8766215 - DNA, 19 bp, Homo sapiens
ggcctctgcaggccgcccc

SEQ ID NO: 8766216 - DNA, 22 bp, Homo sapiens
ggcctctgcaactggctgtggc

SEQ ID NO: 8766217 - DNA, 22 bp, Homo sapiens
ggcctctgccccagccacacct

SEQ ID NO: 8766218 - DNA, 22 bp, Homo sapiens
ggcctctgccccagccacacct

SEQ ID NO: 8766219 - DNA, 22 bp, Homo sapiens
ggcctctgccctcactcctgtc

SEQ ID NO: 8766220 - DNA, 22 bp, Homo sapiens
ggcctctgccctcactcctgtc

SEQ ID NO: 8766221 - DNA, 21 bp, Homo sapiens
ggcctctgccttgccccactc

SEQ ID NO: 8766222 - DNA, 22 bp, Homo sapiens
ggcctctgcctcatctgggcac

SEQ ID NO: 8766223 - DNA, 17 bp, Homo sapiens
ggcagtggaggaagaga

SEQ ID NO: 8766224 - DNA, 17 bp, Homo sapiens
ggcagtggaggaagaga

SEQ ID NO: 8766225 - DNA, 17 bp, Homo sapiens
ggcagtggaggaagaga

SEQ ID NO: 8766226 - DNA, 22 bp, Homo sapiens
ggcagtgccttagaatctgtgg

SEQ ID NO: 8766227 - DNA, 17 bp, Homo sapiens
ggcagtggaggaagaga

SEQ ID NO: 8766228 - DNA, 22 bp, Homo sapiens
ggcagtgcctgatgctgcagga

SEQ ID NO: 8766229 - DNA, 22 bp, Homo sapiens
ggcagtggaggaccctgtgtct

SEQ ID NO: 8766230 - DNA, 22 bp, Homo sapiens
ggcagtggaggaccctgtgtct

SEQ ID NO: 8766231 - DNA, 18 bp, Homo sapiens
ggcagtgcagtctcaggg

SEQ ID NO: 8766232 - DNA, 22 bp, Homo sapiens
ggcagtgcctgatgctgcagga

SEQ ID NO: 8766233 - DNA, 22 bp, Homo sapiens
ggcagtgcctgatgctgcagga

SEQ ID NO: 8766234 - DNA, 22 bp, Homo sapiens
ggcagtgcctgatgctgcagga

SEQ ID NO: 8766235 - DNA, 22 bp, Homo sapiens
ggcagtgccactaagctctgct

SEQ ID NO: 8766236 - DNA, 18 bp, Homo sapiens
ggcagtgcagtctcaggg

SEQ ID NO: 8766237 - DNA, 22 bp, Homo sapiens
ggcagtgccactaagctctgct

SEQ ID NO: 8766238 - DNA, 22 bp, Homo sapiens
ggcagtgccactaagctctgct

SEQ ID NO: 8766239 - DNA, 22 bp, Homo sapiens
ggcagtgatgtcaaacagtgaa

SEQ ID NO: 8766240 - DNA, 22 bp, Homo sapiens
ggcagtgcaaggcagcctggat

SEQ ID NO: 8766241 - DNA, 22 bp, Homo sapiens
ggcagtgcaaggcagcctggat

SEQ ID NO: 8766242 - DNA, 22 bp, Homo sapiens
ggcagtgcaaggcagcctggat

SEQ ID NO: 8766243 - DNA, 22 bp, Homo sapiens
ggcagtgagtcccggagaggcc

SEQ ID NO: 8766244 - DNA, 22 bp, Homo sapiens
ggcagtgagtcccggagaggcc

SEQ ID NO: 8766245 - DNA, 22 bp, Homo sapiens
ggcagtgagtcccggagaggcc

SEQ ID NO: 8766246 - DNA, 22 bp, Homo sapiens
ggcagtgagtcccggagaggcc

SEQ ID NO: 8766247 - DNA, 19 bp, Homo sapiens
ggcagtgagaagactcctg

SEQ ID NO: 8766248 - DNA, 22 bp, Homo sapiens
ggcagtgactggggacccccaa

SEQ ID NO: 8766249 - DNA, 22 bp, Homo sapiens
ggcagtgagctggagggaagga

SEQ ID NO: 8766250 - DNA, 22 bp, Homo sapiens
ggcagggagagcatgctgataa

SEQ ID NO: 8766251 - DNA, 22 bp, Homo sapiens
ggcagggagagcatgctgataa

SEQ ID NO: 8766252 - DNA, 22 bp, Homo sapiens
ggcagggagagcatgctgataa

SEQ ID NO: 8766253 - DNA, 20 bp, Homo sapiens
ggcagggcatcaacagctct

SEQ ID NO: 8766254 - DNA, 20 bp, Homo sapiens
ggcagggcatcaacagctct

SEQ ID NO: 8766255 - DNA, 22 bp, Homo sapiens
ggcagggccctgattcctgggg

SEQ ID NO: 8766256 - DNA, 22 bp, Homo sapiens
ggcagggccctgattcctgggg

SEQ ID NO: 8766257 - DNA, 22 bp, Homo sapiens
ggcagggccctgattcctgggg

SEQ ID NO: 8766258 - DNA, 22 bp, Homo sapiens
ggcagggccctgattcctgggg

SEQ ID NO: 8766259 - DNA, 22 bp, Homo sapiens
ggcagggcttgtctctgtgatg

SEQ ID NO: 8766260 - DNA, 22 bp, Homo sapiens
ggcagggcttgtctctgtgatg

SEQ ID NO: 8766261 - DNA, 22 bp, Homo sapiens
ggcagggcttgtctctgtgatg

SEQ ID NO: 8766262 - DNA, 22 bp, Homo sapiens
ggcagggactttgcaaatcttt

SEQ ID NO: 8766263 - DNA, 22 bp, Homo sapiens
ggcagggagagcatgctgataa

SEQ ID NO: 8766264 - DNA, 22 bp, Homo sapiens
ggcagggactttgcaaatcttt

SEQ ID NO: 8766265 - DNA, 22 bp, Homo sapiens
ggcagggactatgtttcatgga

SEQ ID NO: 8766266 - DNA, 22 bp, Homo sapiens
ggcagggactatgtttcatgga

SEQ ID NO: 8766267 - DNA, 22 bp, Homo sapiens
ggcagggactatgtttcatgga

SEQ ID NO: 8766268 - DNA, 22 bp, Homo sapiens
ggcagggaagctggcatcacgg

SEQ ID NO: 8766269 - DNA, 22 bp, Homo sapiens
ggcagggaagctggcatcacgg

SEQ ID NO: 8766270 - DNA, 22 bp, Homo sapiens
ggcagggaagctggcatcacgg

SEQ ID NO: 8766271 - DNA, 22 bp, Homo sapiens
ggcagggacaggatagggtttt

SEQ ID NO: 8766272 - DNA, 22 bp, Homo sapiens
ggcagggaagctggcatcacgg

SEQ ID NO: 8766273 - DNA, 22 bp, Homo sapiens
ggcagggacaggatagggtttt

SEQ ID NO: 8766274 - DNA, 22 bp, Homo sapiens
ggcagggacaggatagggtttt

SEQ ID NO: 8766275 - DNA, 22 bp, Homo sapiens
ggcagggaaacagctgatccca

SEQ ID NO: 8766276 - DNA, 18 bp, Homo sapiens
ggcagggaaaagataggg

SEQ ID NO: 8766277 - DNA, 18 bp, Homo sapiens
ggcagggaaaagataggg

SEQ ID NO: 8766278 - DNA, 22 bp, Homo sapiens
ggcagggaaacagctgatccca

SEQ ID NO: 8766279 - DNA, 22 bp, Homo sapiens
ggcagggaaacagctgatccca

SEQ ID NO: 8766280 - DNA, 22 bp, Homo sapiens
ggcagggaaacagctgatccca

SEQ ID NO: 8766281 - DNA, 22 bp, Homo sapiens
ggcagggaaacagctgatccca

SEQ ID NO: 8766282 - DNA, 22 bp, Homo sapiens
ggcagggaagctggcatcacgg

SEQ ID NO: 8766283 - DNA, 22 bp, Homo sapiens
ggcagggaagctggcatcacgg

SEQ ID NO: 8766284 - DNA, 22 bp, Homo sapiens
ggcagggaagctggcatcacgg

SEQ ID NO: 8766285 - DNA, 22 bp, Homo sapiens
ggcagggaaacagctgatccca

SEQ ID NO: 8766286 - DNA, 22 bp, Homo sapiens
ggcagggaaacagctgatccca

SEQ ID NO: 8766287 - DNA, 22 bp, Homo sapiens
ggcagcccaccagcccacgtct

SEQ ID NO: 8766288 - DNA, 22 bp, Homo sapiens
ggcagccatgtgggcagcgagt

SEQ ID NO: 8766289 - DNA, 22 bp, Homo sapiens
ggcagccatgtgggcagcgagt

SEQ ID NO: 8766290 - DNA, 22 bp, Homo sapiens
ggcagccatgtgggcagcgagt

SEQ ID NO: 8766291 - DNA, 22 bp, Homo sapiens
ggcagccatgtgggcagcgagt

SEQ ID NO: 8766292 - DNA, 22 bp, Homo sapiens
ggcagccatgtcccagggcttc

SEQ ID NO: 8766293 - DNA, 22 bp, Homo sapiens
ggcagccatgtcccagggcttc

SEQ ID NO: 8766294 - DNA, 22 bp, Homo sapiens
ggcagccatgtcccagggcttc

SEQ ID NO: 8766295 - DNA, 22 bp, Homo sapiens
ggcagccatgtcccagggcttc

SEQ ID NO: 8766296 - DNA, 22 bp, Homo sapiens
ggcagccctttctggccagctc

SEQ ID NO: 8766297 - DNA, 17 bp, Homo sapiens
ggcagcctcaggcgttt

SEQ ID NO: 8766298 - DNA, 17 bp, Homo sapiens
ggcagcctcaggcgttt

SEQ ID NO: 8766299 - DNA, 22 bp, Homo sapiens
ggcagcctccagggcactggtg

SEQ ID NO: 8766300 - DNA, 21 bp, Homo sapiens
ggcagcctgacccccagagag

SEQ ID NO: 8766301 - DNA, 21 bp, Homo sapiens
ggcagcctctgtggaagggga

SEQ ID NO: 8766302 - DNA, 19 bp, Homo sapiens
ggcagcctgcacgggctgc

SEQ ID NO: 8766303 - DNA, 18 bp, Homo sapiens
ggcagcctggacatgctc

SEQ ID NO: 8766304 - DNA, 18 bp, Homo sapiens
ggcagcctggacatgctc

SEQ ID NO: 8766305 - DNA, 22 bp, Homo sapiens
ggcagccttgagggaggcctgg

SEQ ID NO: 8766306 - DNA, 22 bp, Homo sapiens
ggcagccttgactagtgactta

SEQ ID NO: 8766307 - DNA, 20 bp, Homo sapiens
ggcagcgggttcgggcgcag

SEQ ID NO: 8766308 - DNA, 22 bp, Homo sapiens
ggcagcgcccgagtccgcagct

SEQ ID NO: 8766309 - DNA, 22 bp, Homo sapiens
ggcagctcacctctggtccagg

SEQ ID NO: 8766310 - DNA, 22 bp, Homo sapiens
ggcagctaggggcagggaattc

SEQ ID NO: 8766311 - DNA, 22 bp, Homo sapiens
ggcagctagtttaagaaagagg

SEQ ID NO: 8766312 - DNA, 22 bp, Homo sapiens
ggcagctattccaagcagcact

SEQ ID NO: 8766313 - DNA, 22 bp, Homo sapiens
ggcagctagaattgtgatgctg

SEQ ID NO: 8766314 - DNA, 22 bp, Homo sapiens
ggcagctagaattgtgatgctg

SEQ ID NO: 8766315 - DNA, 20 bp, Homo sapiens
ggcagcgggttcgggcgcag

SEQ ID NO: 8766316 - DNA, 21 bp, Homo sapiens
ggcagctcagcagatggggac

SEQ ID NO: 8766317 - DNA, 22 bp, Homo sapiens
ggcagctcactgattagcaatt

SEQ ID NO: 8766318 - DNA, 22 bp, Homo sapiens
ggcagctcacgggcatggggtg

SEQ ID NO: 8766319 - DNA, 20 bp, Homo sapiens
ggcagctcactactttctgt

SEQ ID NO: 8766320 - DNA, 22 bp, Homo sapiens
ggcagctcacgggcatggggtg

SEQ ID NO: 8766321 - DNA, 22 bp, Homo sapiens
ggcagctccaaaaggaaacact

SEQ ID NO: 8766322 - DNA, 21 bp, Homo sapiens
ggcagctcccagtttgggtgt

SEQ ID NO: 8766323 - DNA, 22 bp, Homo sapiens
ggcagctcctcctagtctgccc

SEQ ID NO: 8766324 - DNA, 22 bp, Homo sapiens
ggcagctcctcctagtctgccc

SEQ ID NO: 8766325 - DNA, 22 bp, Homo sapiens
ggcaggctttgagaaagagcat

SEQ ID NO: 8766326 - DNA, 22 bp, Homo sapiens
ggcaggctttcagcatcaagtc

SEQ ID NO: 8766327 - DNA, 18 bp, Homo sapiens
ggcagggaaaagataggg

SEQ ID NO: 8766328 - DNA, 18 bp, Homo sapiens
ggcagggaaaagataggg

SEQ ID NO: 8766329 - DNA, 18 bp, Homo sapiens
ggcagggaaaagataggg

SEQ ID NO: 8766330 - DNA, 22 bp, Homo sapiens
ggcaggctttcagcatcaagtc

SEQ ID NO: 8766331 - DNA, 22 bp, Homo sapiens
ggcaggcttggtggcaccggtt

SEQ ID NO: 8766332 - DNA, 20 bp, Homo sapiens
ggcaggctttatatggaggg

SEQ ID NO: 8766333 - DNA, 20 bp, Homo sapiens
ggcaggctttatatggaggg

SEQ ID NO: 8766334 - DNA, 22 bp, Homo sapiens
ggcaggcttgatatggggggac

SEQ ID NO: 8766335 - DNA, 22 bp, Homo sapiens
ggcaggcttgatatggggggac

SEQ ID NO: 8766336 - DNA, 22 bp, Homo sapiens
ggcaggcttggtggcaccggtt

SEQ ID NO: 8766337 - DNA, 22 bp, Homo sapiens
ggcaggcttggtggcaccggtt

SEQ ID NO: 8766338 - DNA, 22 bp, Homo sapiens
ggcagctcgatgacttctgcat

SEQ ID NO: 8766339 - DNA, 22 bp, Homo sapiens
ggcaggctgttcacctgctttt

SEQ ID NO: 8766340 - DNA, 22 bp, Homo sapiens
ggaggatttgtcatctgaagat

SEQ ID NO: 8766341 - DNA, 22 bp, Homo sapiens
ggaggcaaagcactttgcttgg

SEQ ID NO: 8766342 - DNA, 17 bp, Homo sapiens
ggaggcaacagacaggg

SEQ ID NO: 8766343 - DNA, 17 bp, Homo sapiens
ggaggcaacagacaggg

SEQ ID NO: 8766344 - DNA, 22 bp, Homo sapiens
ggaggcaacacagggtgtgttt

SEQ ID NO: 8766345 - DNA, 22 bp, Homo sapiens
ggaggatgccaagctgtgcaca

SEQ ID NO: 8766346 - DNA, 22 bp, Homo sapiens
ggaggatgccaagctgtgcaca

SEQ ID NO: 8766347 - DNA, 22 bp, Homo sapiens
ggaggatgagctacgaggagct

SEQ ID NO: 8766348 - DNA, 22 bp, Homo sapiens
ggaggatgccaagctgtgcaca

SEQ ID NO: 8766349 - DNA, 22 bp, Homo sapiens
ggaggcacacctcagactggga

SEQ ID NO: 8766350 - DNA, 22 bp, Homo sapiens
ggaggcaacatgcttgtttcta

SEQ ID NO: 8766351 - DNA, 23 bp, Homo sapiens
ggaggcacttaggcagagcagag

SEQ ID NO: 8766352 - DNA, 23 bp, Homo sapiens
ggaggcacttaggcagagcagag

SEQ ID NO: 8766353 - DNA, 23 bp, Homo sapiens
ggaggcacttaggcagagcagag

SEQ ID NO: 8766354 - DNA, 22 bp, Homo sapiens
ggaggcaccactcatcatcctc

SEQ ID NO: 8766355 - DNA, 22 bp, Homo sapiens
ggaggcaccctatttgaggcct

SEQ ID NO: 8766356 - DNA, 22 bp, Homo sapiens
ggaggcacccttcattgagttt

SEQ ID NO: 8766357 - DNA, 22 bp, Homo sapiens
ggaggcacccttcattgagttt

SEQ ID NO: 8766358 - DNA, 22 bp, Homo sapiens
ggaggaggtgggttaagttgta

SEQ ID NO: 8766359 - DNA, 22 bp, Homo sapiens
ggaggaggtgggttaagttgta

SEQ ID NO: 8766360 - DNA, 22 bp, Homo sapiens
ggaggaggtgggttaagttgta

SEQ ID NO: 8766361 - DNA, 22 bp, Homo sapiens
ggaggaggggtttacattggaa

SEQ ID NO: 8766362 - DNA, 22 bp, Homo sapiens
ggaggaggggtgactgaatgct

SEQ ID NO: 8766363 - DNA, 22 bp, Homo sapiens
ggaggaggggtgactgaatgct

SEQ ID NO: 8766364 - DNA, 22 bp, Homo sapiens
ggaggaggggtttacattggaa

SEQ ID NO: 8766365 - DNA, 22 bp, Homo sapiens
ggaggaggggtttacattggaa

SEQ ID NO: 8766366 - DNA, 22 bp, Homo sapiens
ggaggaggggtttacattggaa

SEQ ID NO: 8766367 - DNA, 22 bp, Homo sapiens
ggaggcacttcccgtctcagcc

SEQ ID NO: 8766368 - DNA, 22 bp, Homo sapiens
ggaggcacttcatgctgacccg

SEQ ID NO: 8766369 - DNA, 22 bp, Homo sapiens
ggaggcacttgttaaactacta

SEQ ID NO: 8766370 - DNA, 22 bp, Homo sapiens
ggaggcagaacttcccgtcagt

SEQ ID NO: 8766371 - DNA, 22 bp, Homo sapiens
ggcaccaggctgggcataggcc

SEQ ID NO: 8766372 - DNA, 22 bp, Homo sapiens
ggcaccagggaaggaaggctgg

SEQ ID NO: 8766373 - DNA, 22 bp, Homo sapiens
ggcaccaggctgggcataggcc

SEQ ID NO: 8766374 - DNA, 22 bp, Homo sapiens
ggaggcagaacttcccgtcagt

SEQ ID NO: 8766375 - DNA, 22 bp, Homo sapiens
ggaggcagaacttcccgtcagt

SEQ ID NO: 8766376 - DNA, 22 bp, Homo sapiens
ggaggcagaacttcccgtcagt

SEQ ID NO: 8766377 - DNA, 18 bp, Homo sapiens
ggcacctctcttgcctta

SEQ ID NO: 8766378 - DNA, 22 bp, Homo sapiens
ggcaccatcagctgtgcagggg

SEQ ID NO: 8766379 - DNA, 22 bp, Homo sapiens
ggcaccagggaaggaaggctgg

SEQ ID NO: 8766380 - DNA, 22 bp, Homo sapiens
ggcacctggatgtagcagtgaa

SEQ ID NO: 8766381 - DNA, 22 bp, Homo sapiens
ggcacctggatgtagcagtgaa

SEQ ID NO: 8766382 - DNA, 22 bp, Homo sapiens
ggcacctggatgtagcagtgaa

SEQ ID NO: 8766383 - DNA, 22 bp, Homo sapiens
ggcacctgctcatctggactca

SEQ ID NO: 8766384 - DNA, 22 bp, Homo sapiens
ggcacctgctcatctggactca

SEQ ID NO: 8766385 - DNA, 22 bp, Homo sapiens
ggcacctctgggctctgttagg

SEQ ID NO: 8766386 - DNA, 22 bp, Homo sapiens
ggcacctggtaagtgctcagta

SEQ ID NO: 8766387 - DNA, 22 bp, Homo sapiens
ggcacctggtaagtgctcagta

SEQ ID NO: 8766388 - DNA, 22 bp, Homo sapiens
ggcacctgtctgctcacagtga

SEQ ID NO: 8766389 - DNA, 22 bp, Homo sapiens
ggcacctgtgtaagatctggaa

SEQ ID NO: 8766390 - DNA, 19 bp, Homo sapiens
ggcaccttggctatgcctg

SEQ ID NO: 8766391 - DNA, 19 bp, Homo sapiens
ggcaccttggctatgcctg

SEQ ID NO: 8766392 - DNA, 19 bp, Homo sapiens
ggcacctttctgctgtgtc

SEQ ID NO: 8766393 - DNA, 19 bp, Homo sapiens
ggcaccttggtcttggact

SEQ ID NO: 8766394 - DNA, 19 bp, Homo sapiens
ggcaccttggtcttggact

SEQ ID NO: 8766395 - DNA, 19 bp, Homo sapiens
ggcaccttggtcttggact

SEQ ID NO: 8766396 - DNA, 22 bp, Homo sapiens
ggcagcaatgctgtgcaggcat

SEQ ID NO: 8766397 - DNA, 22 bp, Homo sapiens
ggcagcaattcttcagaatcat

SEQ ID NO: 8766398 - DNA, 22 bp, Homo sapiens
ggcagcaattcttcagaatcat

SEQ ID NO: 8766399 - DNA, 22 bp, Homo sapiens
ggcagcacgacaggagtggaag

SEQ ID NO: 8766400 - DNA, 22 bp, Homo sapiens
ggcagcactgcagcttgttggg

SEQ ID NO: 8766401 - DNA, 22 bp, Homo sapiens
ggcagcagaactggccctgtat

SEQ ID NO: 8766402 - DNA, 22 bp, Homo sapiens
ggcagcagaactggccctgtat

SEQ ID NO: 8766403 - DNA, 22 bp, Homo sapiens
ggcagcagacccctaagtctac

SEQ ID NO: 8766404 - DNA, 22 bp, Homo sapiens
ggcagcactgcagcttgttggg

SEQ ID NO: 8766405 - DNA, 22 bp, Homo sapiens
ggcagcagaactggccctgtat

SEQ ID NO: 8766406 - DNA, 20 bp, Homo sapiens
ggcagcaaccatatgctaca

SEQ ID NO: 8766407 - DNA, 22 bp, Homo sapiens
ggcagcaactcggagagaagag

SEQ ID NO: 8766408 - DNA, 22 bp, Homo sapiens
ggcagcaagagaggttcagctt

SEQ ID NO: 8766409 - DNA, 22 bp, Homo sapiens
ggcagcaaggcctcgggtgagc

SEQ ID NO: 8766410 - DNA, 19 bp, Homo sapiens
ggcagcaagctctgaaggc

SEQ ID NO: 8766411 - DNA, 22 bp, Homo sapiens
ggcagcaaagtcacatggaaaa

SEQ ID NO: 8766412 - DNA, 22 bp, Homo sapiens
ggcagatgttgcagtgagcaga

SEQ ID NO: 8766413 - DNA, 22 bp, Homo sapiens
ggcagcaaatattgtcagctgt

SEQ ID NO: 8766414 - DNA, 22 bp, Homo sapiens
ggcagcaaccaaccaggcattt

SEQ ID NO: 8766415 - DNA, 22 bp, Homo sapiens
ggcagcaaccaaccaggcattt

SEQ ID NO: 8766416 - DNA, 22 bp, Homo sapiens
ggcagcaaccaaccaggcattt

SEQ ID NO: 8766417 - DNA, 22 bp, Homo sapiens
ggcagatgttgcagtgagcaga

SEQ ID NO: 8766418 - DNA, 22 bp, Homo sapiens
ggcagatggggtgacaagagag

SEQ ID NO: 8766419 - DNA, 22 bp, Homo sapiens
ggcagatgttgcagtgagcaga

SEQ ID NO: 8766420 - DNA, 22 bp, Homo sapiens
ggcagatggggtgacaagagag

SEQ ID NO: 8766421 - DNA, 22 bp, Homo sapiens
ggcagatggggtgacaagagag

SEQ ID NO: 8766422 - DNA, 22 bp, Homo sapiens
ggcagatggggtgacaagagag

SEQ ID NO: 8766423 - DNA, 22 bp, Homo sapiens
ggcagatgttgcagtgagcaga

SEQ ID NO: 8766424 - DNA, 22 bp, Homo sapiens
ggcagatggaatgagctgtcta

SEQ ID NO: 8766425 - DNA, 22 bp, Homo sapiens
ggcagatggaatgagctgtcta

SEQ ID NO: 8766426 - DNA, 22 bp, Homo sapiens
ggcagatggagaagcagcaggt

SEQ ID NO: 8766427 - DNA, 22 bp, Homo sapiens
ggcagatggagaagcagcaggt

SEQ ID NO: 8766428 - DNA, 22 bp, Homo sapiens
ggcagatggagaagcagcaggt

SEQ ID NO: 8766429 - DNA, 22 bp, Homo sapiens
ggcagaggtgacagtgtctttt

SEQ ID NO: 8766430 - DNA, 22 bp, Homo sapiens
ggcagaggtgaagttcacaagg

SEQ ID NO: 8766431 - DNA, 22 bp, Homo sapiens
ggcagaggtgaagttcacaagg

SEQ ID NO: 8766432 - DNA, 22 bp, Homo sapiens
ggcactgactgtgcagcgcacc

SEQ ID NO: 8766433 - DNA, 22 bp, Homo sapiens
ggcacgttatagtaacgcgcat

SEQ ID NO: 8766434 - DNA, 19 bp, Homo sapiens
gggagttgttctgatccta

SEQ ID NO: 8766435 - DNA, 22 bp, Homo sapiens
gggataggaaacttaggtacac

SEQ ID NO: 8766436 - DNA, 22 bp, Homo sapiens
gggagtgtgcagaagctggggg

SEQ ID NO: 8766437 - DNA, 22 bp, Homo sapiens
gggagtgttgagcgccctgcca

SEQ ID NO: 8766438 - DNA, 22 bp, Homo sapiens
gggagtgtgcagaagctggggg

SEQ ID NO: 8766439 - DNA, 22 bp, Homo sapiens
gggataggagattgggagtgtt

SEQ ID NO: 8766440 - DNA, 22 bp, Homo sapiens
gggataggagattgggagtgtt

SEQ ID NO: 8766441 - DNA, 19 bp, Homo sapiens
gggatcagcccagggctct

SEQ ID NO: 8766442 - DNA, 22 bp, Homo sapiens
gggagtggttgatggtgaaaat

SEQ ID NO: 8766443 - DNA, 22 bp, Homo sapiens
gggagtggggcttaccttgaag

SEQ ID NO: 8766444 - DNA, 22 bp, Homo sapiens
gggagtggattatgtggaccca

SEQ ID NO: 8766445 - DNA, 22 bp, Homo sapiens
gggagtggattatgtggaccca

SEQ ID NO: 8766446 - DNA, 22 bp, Homo sapiens
gggagtgggtttggcctaggcc

SEQ ID NO: 8766447 - DNA, 22 bp, Homo sapiens
gggagtgggtttggcctaggcc

SEQ ID NO: 8766448 - DNA, 22 bp, Homo sapiens
gggagtgggtttggcctaggcc

SEQ ID NO: 8766449 - DNA, 22 bp, Homo sapiens
gggagtgggtttggcctaggcc

SEQ ID NO: 8766450 - DNA, 22 bp, Homo sapiens
gggagtggattatgtggaccca

SEQ ID NO: 8766451 - DNA, 22 bp, Homo sapiens
gggaggttgaggctgcagtgag

SEQ ID NO: 8766452 - DNA, 22 bp, Homo sapiens
gggaggttgaggctgcagtgag

SEQ ID NO: 8766453 - DNA, 22 bp, Homo sapiens
gggaggttgaggctgcagtgag

SEQ ID NO: 8766454 - DNA, 22 bp, Homo sapiens
gggagctgaatggcaatggaga

SEQ ID NO: 8766455 - DNA, 22 bp, Homo sapiens
gggaggttgaggctgcagtgag

SEQ ID NO: 8766456 - DNA, 22 bp, Homo sapiens
gggaggttgaggctgcagtgag

SEQ ID NO: 8766457 - DNA, 22 bp, Homo sapiens
gggaggttgaggctgcagtgag

SEQ ID NO: 8766458 - DNA, 22 bp, Homo sapiens
gggagtcagagaggtaatggga

SEQ ID NO: 8766459 - DNA, 22 bp, Homo sapiens
gggaggttgaggctgcagtgag

SEQ ID NO: 8766460 - DNA, 22 bp, Homo sapiens
gggagtggattatgtggaccca

SEQ ID NO: 8766461 - DNA, 22 bp, Homo sapiens
gggagtctgggctagactcctt

SEQ ID NO: 8766462 - DNA, 22 bp, Homo sapiens
gggagtccaaattggtacaata

SEQ ID NO: 8766463 - DNA, 22 bp, Homo sapiens
gggagtcctcagaagttcccgg

SEQ ID NO: 8766464 - DNA, 22 bp, Homo sapiens
gggagctgaactgctgaagttg

SEQ ID NO: 8766465 - DNA, 22 bp, Homo sapiens
gggagctctccctgaggcctgg

SEQ ID NO: 8766466 - DNA, 22 bp, Homo sapiens
gggagcgggactgcgcaggctt

SEQ ID NO: 8766467 - DNA, 21 bp, Homo sapiens
gggcagaggggcctcctgggt

SEQ ID NO: 8766468 - DNA, 21 bp, Homo sapiens
gggcagaggggcctcctgggt

SEQ ID NO: 8766469 - DNA, 21 bp, Homo sapiens
gggcagaggggcctcctgggt

SEQ ID NO: 8766470 - DNA, 21 bp, Homo sapiens
gggcagaggggcctcctgggt

SEQ ID NO: 8766471 - DNA, 17 bp, Homo sapiens
gggcagggactcctggg

SEQ ID NO: 8766472 - DNA, 21 bp, Homo sapiens
gggcagaggggcctcctgggt

SEQ ID NO: 8766473 - DNA, 21 bp, Homo sapiens
gggcagaggggcctcctgggt

SEQ ID NO: 8766474 - DNA, 21 bp, Homo sapiens
gggcagaggggcctcctgggt

SEQ ID NO: 8766475 - DNA, 21 bp, Homo sapiens
gggcagaggggcctcctgggt

SEQ ID NO: 8766476 - DNA, 22 bp, Homo sapiens
gggcagaggctctggcccatcc

SEQ ID NO: 8766477 - DNA, 22 bp, Homo sapiens
gggcagaggctctggcccatcc

SEQ ID NO: 8766478 - DNA, 20 bp, Homo sapiens
gggcagagccagccagtccc

SEQ ID NO: 8766479 - DNA, 22 bp, Homo sapiens
gggcagaggctctggcccatcc

SEQ ID NO: 8766480 - DNA, 22 bp, Homo sapiens
gggcaggtctgggtcagcctga

SEQ ID NO: 8766481 - DNA, 17 bp, Homo sapiens
gggcagggactcctggg

SEQ ID NO: 8766482 - DNA, 21 bp, Homo sapiens
gggcaggtctctgatgtcaac

SEQ ID NO: 8766483 - DNA, 22 bp, Homo sapiens
gggcaggtgattttggctccat

SEQ ID NO: 8766484 - DNA, 22 bp, Homo sapiens
gggcaggtgattttggctccat

SEQ ID NO: 8766485 - DNA, 22 bp, Homo sapiens
gggcaggtgccagctccctgtc

SEQ ID NO: 8766486 - DNA, 22 bp, Homo sapiens
gggcaggtgccagctccctgtc

SEQ ID NO: 8766487 - DNA, 22 bp, Homo sapiens
gggcaggtgcccagggccagag

SEQ ID NO: 8766488 - DNA, 22 bp, Homo sapiens
gggcaggtgcccagggccagag

SEQ ID NO: 8766489 - DNA, 20 bp, Homo sapiens
gggcagagccagccagtccc

SEQ ID NO: 8766490 - DNA, 22 bp, Homo sapiens
gggcagaggctctggcccatcc

SEQ ID NO: 8766491 - DNA, 20 bp, Homo sapiens
gggcagagccagccagtccc

SEQ ID NO: 8766492 - DNA, 20 bp, Homo sapiens
gggcagagccagccagtccc

SEQ ID NO: 8766493 - DNA, 20 bp, Homo sapiens
gggcagagccagccagtccc

SEQ ID NO: 8766494 - DNA, 22 bp, Homo sapiens
gggcagagagctggaactcctt

SEQ ID NO: 8766495 - DNA, 22 bp, Homo sapiens
gggcagagagctggaactcctt

SEQ ID NO: 8766496 - DNA, 22 bp, Homo sapiens
gggcagagagctggaactcctt

SEQ ID NO: 8766497 - DNA, 20 bp, Homo sapiens
gggcagagccagccagtccc

SEQ ID NO: 8766498 - DNA, 22 bp, Homo sapiens
gggcagagagctggaactcctt

SEQ ID NO: 8766499 - DNA, 22 bp, Homo sapiens
gggcactgtacactgtgcatgg

SEQ ID NO: 8766500 - DNA, 22 bp, Homo sapiens
gggcactgtgctaggtgctgag

SEQ ID NO: 8766501 - DNA, 22 bp, Homo sapiens
gggcactgtacactgtgcatgg

SEQ ID NO: 8766502 - DNA, 22 bp, Homo sapiens
gggcactgggtcttctccacgc

SEQ ID NO: 8766503 - DNA, 22 bp, Homo sapiens
gggcactggtgctgccatcttg

SEQ ID NO: 8766504 - DNA, 20 bp, Homo sapiens
gggatcaggaaaggaggcta

SEQ ID NO: 8766505 - DNA, 22 bp, Homo sapiens
gggcactggtgctgccatcttg

SEQ ID NO: 8766506 - DNA, 22 bp, Homo sapiens
gggcagagagctggaactcctt

SEQ ID NO: 8766507 - DNA, 22 bp, Homo sapiens
gggcagagactcagaaacagaa

SEQ ID NO: 8766508 - DNA, 22 bp, Homo sapiens
gggcagagactcagaaacagaa

SEQ ID NO: 8766509 - DNA, 22 bp, Homo sapiens
gggctatagcactatgtatggg

SEQ ID NO: 8766510 - DNA, 18 bp, Homo sapiens
gggctcacacaggtcatc

SEQ ID NO: 8766511 - DNA, 22 bp, Homo sapiens
gggcctcacctctccaccgcct

SEQ ID NO: 8766512 - DNA, 19 bp, Homo sapiens
gggcctcacccacacctcc

SEQ ID NO: 8766513 - DNA, 22 bp, Homo sapiens
gggcctcacctctccaccgcct

SEQ ID NO: 8766514 - DNA, 22 bp, Homo sapiens
gggcctcagagatggtcagtga

SEQ ID NO: 8766515 - DNA, 22 bp, Homo sapiens
gggcctcactatgtggtccagg

SEQ ID NO: 8766516 - DNA, 22 bp, Homo sapiens
gggccctggggcctgatttgca

SEQ ID NO: 8766517 - DNA, 22 bp, Homo sapiens
gggccctgtgatttcttgagga

SEQ ID NO: 8766518 - DNA, 22 bp, Homo sapiens
gggccctggggcctgatttgca

SEQ ID NO: 8766519 - DNA, 22 bp, Homo sapiens
gggccggagctgggtcccgcgc

SEQ ID NO: 8766520 - DNA, 22 bp, Homo sapiens
gggccctgtgatttcttgagga

SEQ ID NO: 8766521 - DNA, 22 bp, Homo sapiens
gggccggagctgggtcccgcgc

SEQ ID NO: 8766522 - DNA, 22 bp, Homo sapiens
gggccggagctgggtcccgcgc

SEQ ID NO: 8766523 - DNA, 22 bp, Homo sapiens
gggccctgccccgtggctctga

SEQ ID NO: 8766524 - DNA, 22 bp, Homo sapiens
gggccctgcgactcgcggcgga

SEQ ID NO: 8766525 - DNA, 22 bp, Homo sapiens
gggccctgcctaaggaacacac

SEQ ID NO: 8766526 - DNA, 22 bp, Homo sapiens
gggccctgcctaaggaacacac

SEQ ID NO: 8766527 - DNA, 22 bp, Homo sapiens
gggccctggggatgtggacgcg

SEQ ID NO: 8766528 - DNA, 22 bp, Homo sapiens
gggccctgggattcagagcaag

SEQ ID NO: 8766529 - DNA, 22 bp, Homo sapiens
gggccctggggatgtggacgcg

SEQ ID NO: 8766530 - DNA, 22 bp, Homo sapiens
gggccctgggattcagagcaag

SEQ ID NO: 8766531 - DNA, 22 bp, Homo sapiens
gggccctgccccgtggctctga

SEQ ID NO: 8766532 - DNA, 22 bp, Homo sapiens
gggccctgccccgtggctctga

SEQ ID NO: 8766533 - DNA, 22 bp, Homo sapiens
gggccctgatctgtgagcgcag

SEQ ID NO: 8766534 - DNA, 22 bp, Homo sapiens
gggccctgatctgtgagcgcag

SEQ ID NO: 8766535 - DNA, 22 bp, Homo sapiens
gggcccggaccttcctctctga

SEQ ID NO: 8766536 - DNA, 22 bp, Homo sapiens
gggccccttgtatctctggctc

SEQ ID NO: 8766537 - DNA, 22 bp, Homo sapiens
gggccctctgcagctgcccagg

SEQ ID NO: 8766538 - DNA, 22 bp, Homo sapiens
gggccctgatctgtgagcgcag

SEQ ID NO: 8766539 - DNA, 22 bp, Homo sapiens
gggcaggtggcctcttgtacta

SEQ ID NO: 8766540 - DNA, 22 bp, Homo sapiens
gggcaggtggcagggtctctgg

SEQ ID NO: 8766541 - DNA, 22 bp, Homo sapiens
gggcaggtggcagggtctctgg

SEQ ID NO: 8766542 - DNA, 22 bp, Homo sapiens
gggcaggtggagggcccagcca

SEQ ID NO: 8766543 - DNA, 22 bp, Homo sapiens
gggcaggtgtttccaaggtgag

SEQ ID NO: 8766544 - DNA, 22 bp, Homo sapiens
gggcaggtgtttccaaggtgag

SEQ ID NO: 8766545 - DNA, 22 bp, Homo sapiens
gggcaggtgtgcagagctgttg

SEQ ID NO: 8766546 - DNA, 22 bp, Homo sapiens
gggcaggtgtgcagagctgttg

SEQ ID NO: 8766547 - DNA, 22 bp, Homo sapiens
gggcaggtgtgcagagctgttg

SEQ ID NO: 8766548 - DNA, 22 bp, Homo sapiens
gggccccttgctgctctgctgg

SEQ ID NO: 8766549 - DNA, 22 bp, Homo sapiens
gggccccttgctgctctgctgg

SEQ ID NO: 8766550 - DNA, 22 bp, Homo sapiens
gggccccttgctgctctgctgg

SEQ ID NO: 8766551 - DNA, 22 bp, Homo sapiens
gggccccttgtatctctggctc

SEQ ID NO: 8766552 - DNA, 22 bp, Homo sapiens
gggccccttgtatctctggctc

SEQ ID NO: 8766553 - DNA, 22 bp, Homo sapiens
gggccccactggggctgcctgc

SEQ ID NO: 8766554 - DNA, 22 bp, Homo sapiens
gggcccctgggaattctgtgat

SEQ ID NO: 8766555 - DNA, 22 bp, Homo sapiens
gggcccctgggaattctgtgat

SEQ ID NO: 8766556 - DNA, 22 bp, Homo sapiens
gggcccagtaccctctgccaag

SEQ ID NO: 8766557 - DNA, 22 bp, Homo sapiens
gggcccaggcctccttccttcc

SEQ ID NO: 8766558 - DNA, 22 bp, Homo sapiens
gggcccagtaccctctgccaag

SEQ ID NO: 8766559 - DNA, 22 bp, Homo sapiens
gggctcagagcatttgggttgg

SEQ ID NO: 8766560 - DNA, 22 bp, Homo sapiens
gggctcagcctcctcacttcga

SEQ ID NO: 8766561 - DNA, 22 bp, Homo sapiens
gggctcagcctcctcacttcga

SEQ ID NO: 8766562 - DNA, 23 bp, Homo sapiens
gggctcagatttcattctgtgcc

SEQ ID NO: 8766563 - DNA, 22 bp, Homo sapiens
gggctcagaggagtggcctggg

SEQ ID NO: 8766564 - DNA, 22 bp, Homo sapiens
gggctcagctccttccttccta

SEQ ID NO: 8766565 - DNA, 21 bp, Homo sapiens
gggctcagcgctcggctcctc

SEQ ID NO: 8766566 - DNA, 21 bp, Homo sapiens
gggctcagcgctcggctcctc

SEQ ID NO: 8766567 - DNA, 22 bp, Homo sapiens
gggctcagctccttccttccta

SEQ ID NO: 8766568 - DNA, 22 bp, Homo sapiens
gggctcagttctgcttcatgct

SEQ ID NO: 8766569 - DNA, 22 bp, Homo sapiens
gggctcagttctgcttcatgct

SEQ ID NO: 8766570 - DNA, 22 bp, Homo sapiens
gggctcaggagtttgaggctgc

SEQ ID NO: 8766571 - DNA, 21 bp, Homo sapiens
gggctcagtggaaaagagtgt

SEQ ID NO: 8766572 - DNA, 21 bp, Homo sapiens
gggctcagtggaaaagagtgt

SEQ ID NO: 8766573 - DNA, 21 bp, Homo sapiens
gggctcagtggaaaagagtgt

SEQ ID NO: 8766574 - DNA, 22 bp, Homo sapiens
gggctcagttctgcttcatgct

SEQ ID NO: 8766575 - DNA, 18 bp, Homo sapiens
gggctctggcatctgggt

SEQ ID NO: 8766576 - DNA, 18 bp, Homo sapiens
gggctctggcatctgggt

SEQ ID NO: 8766577 - DNA, 22 bp, Homo sapiens
gggctctggagttctagaaaga

SEQ ID NO: 8766578 - DNA, 22 bp, Homo sapiens
gggctctggagttctagaaaga

SEQ ID NO: 8766579 - DNA, 22 bp, Homo sapiens
gggctctggacccaggcaagag

SEQ ID NO: 8766580 - DNA, 22 bp, Homo sapiens
gggctctggatggagcctgcag

SEQ ID NO: 8766581 - DNA, 22 bp, Homo sapiens
gggctctggatggagcctgcag

SEQ ID NO: 8766582 - DNA, 22 bp, Homo sapiens
gggctctggacccaggcaagag

SEQ ID NO: 8766583 - DNA, 22 bp, Homo sapiens
gggctctggacccaggcaagag

SEQ ID NO: 8766584 - DNA, 22 bp, Homo sapiens
gggctctggacccaggcaagag

SEQ ID NO: 8766585 - DNA, 22 bp, Homo sapiens
gggctctggacccaggcaagag

SEQ ID NO: 8766586 - DNA, 22 bp, Homo sapiens
gggctctggaaggtgcaccatg

SEQ ID NO: 8766587 - DNA, 22 bp, Homo sapiens
gggctctggaaatgggagctcc

SEQ ID NO: 8766588 - DNA, 22 bp, Homo sapiens
gggctctggaaatgggagctcc

SEQ ID NO: 8766589 - DNA, 22 bp, Homo sapiens
gggctctggaaggtgcaccatg

SEQ ID NO: 8766590 - DNA, 22 bp, Homo sapiens
gggctccaacggtgagcatgga

SEQ ID NO: 8766591 - DNA, 22 bp, Homo sapiens
gggctccaacggtgagcatgga

SEQ ID NO: 8766592 - DNA, 22 bp, Homo sapiens
gggctccaaagtaagctttagt

SEQ ID NO: 8766593 - DNA, 22 bp, Homo sapiens
gggctccaaccccagtgaactc

SEQ ID NO: 8766594 - DNA, 22 bp, Homo sapiens
gggctccaaccccagtgaactc

SEQ ID NO: 8766595 - DNA, 22 bp, Homo sapiens
gggctccaaaatctatgtcttc

SEQ ID NO: 8766596 - DNA, 22 bp, Homo sapiens
gggctccaaaatctatgtcttc

SEQ ID NO: 8766597 - DNA, 22 bp, Homo sapiens
gggctccaaaatcctgtagcct

SEQ ID NO: 8766598 - DNA, 22 bp, Homo sapiens
gggctccaaaatcctgtagcct

SEQ ID NO: 8766599 - DNA, 22 bp, Homo sapiens
gggctctgactgaatattgaat

SEQ ID NO: 8766600 - DNA, 22 bp, Homo sapiens
gggctctgaatgagttaccaag

SEQ ID NO: 8766601 - DNA, 22 bp, Homo sapiens
gggctccaaggaggccagcctg

SEQ ID NO: 8766602 - DNA, 22 bp, Homo sapiens
gggctccaaggaggccagcctg

SEQ ID NO: 8766603 - DNA, 22 bp, Homo sapiens
gggctctgaatcccaggtctgc

SEQ ID NO: 8766604 - DNA, 22 bp, Homo sapiens
gggctccaactacatcagcctt

SEQ ID NO: 8766605 - DNA, 22 bp, Homo sapiens
gggctccaactacatcagcctt

SEQ ID NO: 8766606 - DNA, 22 bp, Homo sapiens
gggctccaactacatcagcctt

SEQ ID NO: 8766607 - DNA, 17 bp, Homo sapiens
ggctgcagtccaggagg

SEQ ID NO: 8766608 - DNA, 20 bp, Homo sapiens
ggctgcagtgcacctcatct

SEQ ID NO: 8766609 - DNA, 20 bp, Homo sapiens
ggctgcagtgcacctcatct

SEQ ID NO: 8766610 - DNA, 17 bp, Homo sapiens
ggctgcagtccaggagg

SEQ ID NO: 8766611 - DNA, 17 bp, Homo sapiens
ggctgcagtccaggagg

SEQ ID NO: 8766612 - DNA, 17 bp, Homo sapiens
ggctgcagtccaggagg

SEQ ID NO: 8766613 - DNA, 22 bp, Homo sapiens
ggctgcaggttggttggcagct

SEQ ID NO: 8766614 - DNA, 22 bp, Homo sapiens
ggctgcagggcagctggtgtgg

SEQ ID NO: 8766615 - DNA, 22 bp, Homo sapiens
ggctgcagggcagctggtgtgg

SEQ ID NO: 8766616 - DNA, 22 bp, Homo sapiens
ggctgcagggcagctggtgtgg

SEQ ID NO: 8766617 - DNA, 22 bp, Homo sapiens
ggctgcaggcttccctccagca

SEQ ID NO: 8766618 - DNA, 22 bp, Homo sapiens
ggctgcaggcttccctccagca

SEQ ID NO: 8766619 - DNA, 22 bp, Homo sapiens
ggctgcaggcttccctccagca

SEQ ID NO: 8766620 - DNA, 21 bp, Homo sapiens
ggctgcagggagccctggggt

SEQ ID NO: 8766621 - DNA, 21 bp, Homo sapiens
ggctgcagggagccctggggt

SEQ ID NO: 8766622 - DNA, 21 bp, Homo sapiens
ggctgcagggagccctggggt

SEQ ID NO: 8766623 - DNA, 22 bp, Homo sapiens
ggctgcaggcagggtatccact

SEQ ID NO: 8766624 - DNA, 22 bp, Homo sapiens
ggctctgctcacagcccgcagc

SEQ ID NO: 8766625 - DNA, 22 bp, Homo sapiens
ggctctgcgcggtaaagtgact

SEQ ID NO: 8766626 - DNA, 22 bp, Homo sapiens
ggctgcaggcagggtatccact

SEQ ID NO: 8766627 - DNA, 22 bp, Homo sapiens
ggctgcaggcttccctccagca

SEQ ID NO: 8766628 - DNA, 22 bp, Homo sapiens
ggctgcaggcttccctccagca

SEQ ID NO: 8766629 - DNA, 22 bp, Homo sapiens
ggctgcaggcttccctccagca

SEQ ID NO: 8766630 - DNA, 22 bp, Homo sapiens
ggctgcctcctgctgggctgga

SEQ ID NO: 8766631 - DNA, 22 bp, Homo sapiens
ggctgccaggagggaggccagt

SEQ ID NO: 8766632 - DNA, 22 bp, Homo sapiens
ggctgccaggagggaggccagt

SEQ ID NO: 8766633 - DNA, 22 bp, Homo sapiens
ggctgccaggagggaggccagt

SEQ ID NO: 8766634 - DNA, 22 bp, Homo sapiens
ggctgccagtgagtgcagaccg

SEQ ID NO: 8766635 - DNA, 22 bp, Homo sapiens
ggctgccagtgagtgcagaccg

SEQ ID NO: 8766636 - DNA, 22 bp, Homo sapiens
ggctgccaggagaagctcagtg

SEQ ID NO: 8766637 - DNA, 22 bp, Homo sapiens
ggctgccaggagaagctcagtg

SEQ ID NO: 8766638 - DNA, 22 bp, Homo sapiens
ggctgccaggagaagctcagtg

SEQ ID NO: 8766639 - DNA, 22 bp, Homo sapiens
ggctgccacatgccatgtcctc

SEQ ID NO: 8766640 - DNA, 22 bp, Homo sapiens
ggctgccacatgccatgtcctc

SEQ ID NO: 8766641 - DNA, 22 bp, Homo sapiens
ggctgccacatgccatgtcctc

SEQ ID NO: 8766642 - DNA, 22 bp, Homo sapiens
ggctgccaccctcggacttccg

SEQ ID NO: 8766643 - DNA, 22 bp, Homo sapiens
ggctgccacgtcgagggtccaa

SEQ ID NO: 8766644 - DNA, 22 bp, Homo sapiens
ggctgcagttgtgtgaaggccg

SEQ ID NO: 8766645 - DNA, 22 bp, Homo sapiens
ggctgcagttgtgtgaaggccg

SEQ ID NO: 8766646 - DNA, 22 bp, Homo sapiens
ggctgcagttgtgtgaaggccg

SEQ ID NO: 8766647 - DNA, 22 bp, Homo sapiens
ggctgcagtttgtcttttgctt

SEQ ID NO: 8766648 - DNA, 22 bp, Homo sapiens
ggctgcagttgtgtgaaggccg

SEQ ID NO: 8766649 - DNA, 22 bp, Homo sapiens
ggctggcagaggggagtctgtg

SEQ ID NO: 8766650 - DNA, 22 bp, Homo sapiens
ggctggcagaggggagtctgtg

SEQ ID NO: 8766651 - DNA, 22 bp, Homo sapiens
ggctggcagaagtgtgctggct

SEQ ID NO: 8766652 - DNA, 22 bp, Homo sapiens
ggctggcagaagtgtgctggct

SEQ ID NO: 8766653 - DNA, 22 bp, Homo sapiens
ggctggcagcttcatcccagat

SEQ ID NO: 8766654 - DNA, 22 bp, Homo sapiens
ggctggcagcttcatcccagat

SEQ ID NO: 8766655 - DNA, 22 bp, Homo sapiens
ggctggcaggcacagtatgcaa

SEQ ID NO: 8766656 - DNA, 22 bp, Homo sapiens
ggctggcaggcacagtatgcaa

SEQ ID NO: 8766657 - DNA, 22 bp, Homo sapiens
ggctggcagtgtgagagaggga

SEQ ID NO: 8766658 - DNA, 22 bp, Homo sapiens
ggctggcagtgtgagagaggga

SEQ ID NO: 8766659 - DNA, 22 bp, Homo sapiens
ggctggcagttaatacctgaag

SEQ ID NO: 8766660 - DNA, 22 bp, Homo sapiens
ggctggcattgctctattgcct

SEQ ID NO: 8766661 - DNA, 22 bp, Homo sapiens
ggctggcatttacacaatgcat

SEQ ID NO: 8766662 - DNA, 22 bp, Homo sapiens
ggctggcatttacacaatgcat

SEQ ID NO: 8766663 - DNA, 22 bp, Homo sapiens
ggctggagtgggctccagagtt

SEQ ID NO: 8766664 - DNA, 19 bp, Homo sapiens
ggctggagtggccatctgt

SEQ ID NO: 8766665 - DNA, 19 bp, Homo sapiens
ggctggagtggccatctgt

SEQ ID NO: 8766666 - DNA, 22 bp, Homo sapiens
ggctggagtgggctccagagtt

SEQ ID NO: 8766667 - DNA, 22 bp, Homo sapiens
ggctggagtgggctccagagtt

SEQ ID NO: 8766668 - DNA, 22 bp, Homo sapiens
ggctggagtgggctccagagtt

SEQ ID NO: 8766669 - DNA, 22 bp, Homo sapiens
ggctggcagaagtgtgctggct

SEQ ID NO: 8766670 - DNA, 22 bp, Homo sapiens
ggctggaggtagaagaacactt

SEQ ID NO: 8766671 - DNA, 17 bp, Homo sapiens
ggctggaggggacccgg

SEQ ID NO: 8766672 - DNA, 17 bp, Homo sapiens
ggctggaggggacccgg

SEQ ID NO: 8766673 - DNA, 17 bp, Homo sapiens
ggctggaggggacccgg

SEQ ID NO: 8766674 - DNA, 22 bp, Homo sapiens
ggctggaggagaatgggtgtga

SEQ ID NO: 8766675 - DNA, 19 bp, Homo sapiens
ggctggagtggccatctgt

SEQ ID NO: 8766676 - DNA, 19 bp, Homo sapiens
ggctggagtggccatctgt

SEQ ID NO: 8766677 - DNA, 22 bp, Homo sapiens
ggctggaggtagaagaacactt

SEQ ID NO: 8766678 - DNA, 22 bp, Homo sapiens
ggctggaggtagaagaacactt

SEQ ID NO: 8766679 - DNA, 22 bp, Homo sapiens
ggctggagacaacgtcctgccc

SEQ ID NO: 8766680 - DNA, 22 bp, Homo sapiens
ggctggagacaacgtcctgccc

SEQ ID NO: 8766681 - DNA, 22 bp, Homo sapiens
ggctggagacaacgtcctgccc

SEQ ID NO: 8766682 - DNA, 22 bp, Homo sapiens
ggctggagatatgtctggaaca

SEQ ID NO: 8766683 - DNA, 17 bp, Homo sapiens
ggctggagcagctcccc

SEQ ID NO: 8766684 - DNA, 17 bp, Homo sapiens
ggctggagcagctcccc

SEQ ID NO: 8766685 - DNA, 17 bp, Homo sapiens
ggctggagcagctcccc

SEQ ID NO: 8766686 - DNA, 17 bp, Homo sapiens
ggctggagcagctcccc

SEQ ID NO: 8766687 - DNA, 17 bp, Homo sapiens
ggctggagcagctcccc

SEQ ID NO: 8766688 - DNA, 22 bp, Homo sapiens
ggctgcctgctcaggtgcggcg

SEQ ID NO: 8766689 - DNA, 22 bp, Homo sapiens
ggctgcctctgatgtgcagacg

SEQ ID NO: 8766690 - DNA, 22 bp, Homo sapiens
ggctgtggcagctggaagtggt

SEQ ID NO: 8766691 - DNA, 22 bp, Homo sapiens
ggctgtggcagctggaagtggt

SEQ ID NO: 8766692 - DNA, 22 bp, Homo sapiens
ggctgtggcagctggaagtggt

SEQ ID NO: 8766693 - DNA, 21 bp, Homo sapiens
ggctgtggagccatgactcac

SEQ ID NO: 8766694 - DNA, 21 bp, Homo sapiens
ggctgtggagccatgactcac

SEQ ID NO: 8766695 - DNA, 21 bp, Homo sapiens
ggctgtggagccatgactcac

SEQ ID NO: 8766696 - DNA, 22 bp, Homo sapiens
ggctgtggcattaggtgaggcc

SEQ ID NO: 8766697 - DNA, 22 bp, Homo sapiens
ggctgtggcattaggtgaggcc

SEQ ID NO: 8766698 - DNA, 22 bp, Homo sapiens
ggctgtggccagcggggctgag

SEQ ID NO: 8766699 - DNA, 18 bp, Homo sapiens
ggctgtgcgtggaggctg

SEQ ID NO: 8766700 - DNA, 22 bp, Homo sapiens
ggctgtgcgtcatccggctgca

SEQ ID NO: 8766701 - DNA, 22 bp, Homo sapiens
ggctggcatccagggaaatcca

SEQ ID NO: 8766702 - DNA, 22 bp, Homo sapiens
ggctgtgcgtcatccggctgca

SEQ ID NO: 8766703 - DNA, 22 bp, Homo sapiens
ggctgtgcgggcagccgtggga

SEQ ID NO: 8766704 - DNA, 23 bp, Homo sapiens
ggctggcccggggctgctcctga

SEQ ID NO: 8766705 - DNA, 22 bp, Homo sapiens
ggctggccagggccctcgctgg

SEQ ID NO: 8766706 - DNA, 22 bp, Homo sapiens
ggctggccagggccctcgctgg

SEQ ID NO: 8766707 - DNA, 22 bp, Homo sapiens
ggctggccagggccctcgctgg

SEQ ID NO: 8766708 - DNA, 22 bp, Homo sapiens
ggctggcatttacacaatgcat

SEQ ID NO: 8766709 - DNA, 22 bp, Homo sapiens
ggctgtggacactgagctcaga

SEQ ID NO: 8766710 - DNA, 22 bp, Homo sapiens
ggctgtgcttggtgtccttgga

SEQ ID NO: 8766711 - DNA, 22 bp, Homo sapiens
gggaagagggagctggaatgat

SEQ ID NO: 8766712 - DNA, 22 bp, Homo sapiens
gggaagagggagctggaatgat

SEQ ID NO: 8766713 - DNA, 22 bp, Homo sapiens
gggaagagggagctggaatgat

SEQ ID NO: 8766714 - DNA, 22 bp, Homo sapiens
gggaagagggagctggaatgat

SEQ ID NO: 8766715 - DNA, 22 bp, Homo sapiens
gggaagagggagctggaatgat

SEQ ID NO: 8766716 - DNA, 22 bp, Homo sapiens
ggctgtggtcattaggaggttg

SEQ ID NO: 8766717 - DNA, 22 bp, Homo sapiens
ggctgtggtctgggtgctcccc

SEQ ID NO: 8766718 - DNA, 22 bp, Homo sapiens
ggctgtggtctgggtgctcccc

SEQ ID NO: 8766719 - DNA, 22 bp, Homo sapiens
ggctgtggtctcatctagcctt

SEQ ID NO: 8766720 - DNA, 22 bp, Homo sapiens
ggctgtggtctcatctagcctt

SEQ ID NO: 8766721 - DNA, 22 bp, Homo sapiens
ggctgtggggggagcctgcccg

SEQ ID NO: 8766722 - DNA, 22 bp, Homo sapiens
ggctgtggggggagcctgcccg

SEQ ID NO: 8766723 - DNA, 22 bp, Homo sapiens
ggctgtggggccgggtacagtg

SEQ ID NO: 8766724 - DNA, 22 bp, Homo sapiens
ggctgtggggaccaacaggact

SEQ ID NO: 8766725 - DNA, 22 bp, Homo sapiens
ggctgtggccagcggggctgag

SEQ ID NO: 8766726 - DNA, 22 bp, Homo sapiens
ggctgtggccagcggggctgag

SEQ ID NO: 8766727 - DNA, 22 bp, Homo sapiens
ggctgtgggatgcataggagct

SEQ ID NO: 8766728 - DNA, 22 bp, Homo sapiens
ggctgtgggatgcataggagct

SEQ ID NO: 8766729 - DNA, 22 bp, Homo sapiens
ggctgtgggatgcataggagct

SEQ ID NO: 8766730 - DNA, 22 bp, Homo sapiens
gggaaggccttgtcagcggatt

SEQ ID NO: 8766731 - DNA, 22 bp, Homo sapiens
gggaaggccggtccagtcaggt

SEQ ID NO: 8766732 - DNA, 22 bp, Homo sapiens
gggaaggccggtccagtcaggt

SEQ ID NO: 8766733 - DNA, 22 bp, Homo sapiens
gggaaggccttgtcagcggatt

SEQ ID NO: 8766734 - DNA, 22 bp, Homo sapiens
gggagatgactcagtgacctcg

SEQ ID NO: 8766735 - DNA, 22 bp, Homo sapiens
gggagatggctcagaggccgcg

SEQ ID NO: 8766736 - DNA, 22 bp, Homo sapiens
gggagatggctcagaggccgcg

SEQ ID NO: 8766737 - DNA, 22 bp, Homo sapiens
gggagatggctcagaggccgcg

SEQ ID NO: 8766738 - DNA, 22 bp, Homo sapiens
gggagatggctcagaggccgcg

SEQ ID NO: 8766739 - DNA, 22 bp, Homo sapiens
gggagccacagtgaggtgcatg

SEQ ID NO: 8766740 - DNA, 22 bp, Homo sapiens
gggagccacagtgaggtgcatg

SEQ ID NO: 8766741 - DNA, 22 bp, Homo sapiens
gggagccacagtgaggtgcatg

SEQ ID NO: 8766742 - DNA, 22 bp, Homo sapiens
gggagccacagtgaggtgcatg

SEQ ID NO: 8766743 - DNA, 23 bp, Homo sapiens
gggagatgggaaatgaaggctct

SEQ ID NO: 8766744 - DNA, 23 bp, Homo sapiens
gggagatgggaaatgaaggctct

SEQ ID NO: 8766745 - DNA, 22 bp, Homo sapiens
gggagccagcagggcatggagc

SEQ ID NO: 8766746 - DNA, 22 bp, Homo sapiens
gggagccagagtcacctagaga

SEQ ID NO: 8766747 - DNA, 22 bp, Homo sapiens
gggagccactcagctgagagtt

SEQ ID NO: 8766748 - DNA, 22 bp, Homo sapiens
gggaaggcaggcctctgttgga

SEQ ID NO: 8766749 - DNA, 22 bp, Homo sapiens
gggaaggcaggattctctggtg

SEQ ID NO: 8766750 - DNA, 22 bp, Homo sapiens
gggaaggcaggattctctggtg

SEQ ID NO: 8766751 - DNA, 22 bp, Homo sapiens
gggaaggcaggattctctggtg

SEQ ID NO: 8766752 - DNA, 22 bp, Homo sapiens
gggaaggcaccatggtgttcca

SEQ ID NO: 8766753 - DNA, 22 bp, Homo sapiens
gggaaggcaccatggtgttcca

SEQ ID NO: 8766754 - DNA, 22 bp, Homo sapiens
gggaagccctgtgcttgcctgg

SEQ ID NO: 8766755 - DNA, 22 bp, Homo sapiens
gggaaggaggtggcttgaagtg

SEQ ID NO: 8766756 - DNA, 22 bp, Homo sapiens
gggaaggcatacctgagggaga

SEQ ID NO: 8766757 - DNA, 22 bp, Homo sapiens
gggaaggcatacctgagggaga

SEQ ID NO: 8766758 - DNA, 22 bp, Homo sapiens
gggaaggcatacctgagggaga

SEQ ID NO: 8766759 - DNA, 22 bp, Homo sapiens
gggaaggcatacctgagggaga

SEQ ID NO: 8766760 - DNA, 22 bp, Homo sapiens
gggaaggcatacctgagggaga

SEQ ID NO: 8766761 - DNA, 22 bp, Homo sapiens
gggaaggcagtgtctggttgaa

SEQ ID NO: 8766762 - DNA, 22 bp, Homo sapiens
gggaaggcagtgggaggaactg

SEQ ID NO: 8766763 - DNA, 22 bp, Homo sapiens
gggaaggcaggcctctgttgga

SEQ ID NO: 8766764 - DNA, 22 bp, Homo sapiens
gggaaggcagtgggaggaactg

SEQ ID NO: 8766765 - DNA, 22 bp, Homo sapiens
gggaaggcagtgggaggaactg

SEQ ID NO: 8766766 - DNA, 22 bp, Homo sapiens
gggaaggcagtgtctggttgaa

SEQ ID NO: 8766767 - DNA, 22 bp, Homo sapiens
gggaagatagtgttgagggccc

SEQ ID NO: 8766768 - DNA, 22 bp, Homo sapiens
gggaagatagtgttgagggccc

SEQ ID NO: 8766769 - DNA, 22 bp, Homo sapiens
gggaagatagtgttgagggccc

SEQ ID NO: 8766770 - DNA, 22 bp, Homo sapiens
gggaagatagtgttgagggccc

SEQ ID NO: 8766771 - DNA, 22 bp, Homo sapiens
gggaagagtgtcggttgaagtg

SEQ ID NO: 8766772 - DNA, 22 bp, Homo sapiens
gggaagatagtgttgagggccc

SEQ ID NO: 8766773 - DNA, 22 bp, Homo sapiens
gggaagatagtgttgagggccc

SEQ ID NO: 8766774 - DNA, 22 bp, Homo sapiens
gggaagcagatcataccagacc

SEQ ID NO: 8766775 - DNA, 22 bp, Homo sapiens
gggaagcagatcataccagacc

SEQ ID NO: 8766776 - DNA, 22 bp, Homo sapiens
gggaagagtaactagcccatgt

SEQ ID NO: 8766777 - DNA, 22 bp, Homo sapiens
gggaagagtaactagcccatgt

SEQ ID NO: 8766778 - DNA, 22 bp, Homo sapiens
tatttgctttgctttatagaga

SEQ ID NO: 8766779 - DNA, 22 bp, Homo sapiens
tatttgctttgctttatagaga

SEQ ID NO: 8766780 - DNA, 22 bp, Homo sapiens
tatttgcttggaaacctaatcc

SEQ ID NO: 8766781 - DNA, 22 bp, Homo sapiens
tatttgctttgctttatagaga

SEQ ID NO: 8766782 - DNA, 22 bp, Homo sapiens
tatttgctgtgcttattccatt

SEQ ID NO: 8766783 - DNA, 22 bp, Homo sapiens
tatttgcttgaagcctggttct

SEQ ID NO: 8766784 - DNA, 22 bp, Homo sapiens
tatttgcttttgtgccacagat

SEQ ID NO: 8766785 - DNA, 22 bp, Homo sapiens
tatttgctttggtcctccaagc

SEQ ID NO: 8766786 - DNA, 22 bp, Homo sapiens
tatttgctgaatctgattcaga

SEQ ID NO: 8766787 - DNA, 22 bp, Homo sapiens
tatttgctccttaggcatattt

SEQ ID NO: 8766788 - DNA, 22 bp, Homo sapiens
tatttgctccttaggcatattt

SEQ ID NO: 8766789 - DNA, 22 bp, Homo sapiens
tatttgctctcggcccggcccc

SEQ ID NO: 8766790 - DNA, 22 bp, Homo sapiens
tatttgctgaatctgattcaga

SEQ ID NO: 8766791 - DNA, 21 bp, Homo sapiens
tatttgctgccatctttgagg

SEQ ID NO: 8766792 - DNA, 22 bp, Homo sapiens
tatttgctgacagtgctggagc

SEQ ID NO: 8766793 - DNA, 21 bp, Homo sapiens
tatttgctgccatctttgagg

SEQ ID NO: 8766794 - DNA, 21 bp, Homo sapiens
tatttgctgccatctttgagg

SEQ ID NO: 8766795 - DNA, 22 bp, Homo sapiens
tatttgctgacagtgctggagc

SEQ ID NO: 8766796 - DNA, 21 bp, Homo sapiens
tatttgctgccatctttgagg

SEQ ID NO: 8766797 - DNA, 22 bp, Homo sapiens
tatttgctgtgcttattccatt

SEQ ID NO: 8766798 - DNA, 22 bp, Homo sapiens
tattttgaaagtctgttttgaa

SEQ ID NO: 8766799 - DNA, 22 bp, Homo sapiens
tattttctgtggaggaccagat

SEQ ID NO: 8766800 - DNA, 22 bp, Homo sapiens
tattttctgtggaggaccagat

SEQ ID NO: 8766801 - DNA, 22 bp, Homo sapiens
tattttctggggagagtgaacc

SEQ ID NO: 8766802 - DNA, 22 bp, Homo sapiens
tattttctggggagagtgaacc

SEQ ID NO: 8766803 - DNA, 22 bp, Homo sapiens
tattttctggacagtcttgctt

SEQ ID NO: 8766804 - DNA, 22 bp, Homo sapiens
tattttctggacagtcttgctt

SEQ ID NO: 8766805 - DNA, 19 bp, Homo sapiens
tattttcgtggaggcctat

SEQ ID NO: 8766806 - DNA, 22 bp, Homo sapiens
tattttccttggtggacccagt

SEQ ID NO: 8766807 - DNA, 23 bp, Homo sapiens
tattttccaaatgatgactacat

SEQ ID NO: 8766808 - DNA, 22 bp, Homo sapiens
tatttaataaaactatggcatg

SEQ ID NO: 8766809 - DNA, 22 bp, Homo sapiens
tatttaattagtgattgtagag

SEQ ID NO: 8766810 - DNA, 22 bp, Homo sapiens
tatttaattagtgattgtagag

SEQ ID NO: 8766811 - DNA, 22 bp, Homo sapiens
tatttcttgttattctcgttga

SEQ ID NO: 8766812 - DNA, 22 bp, Homo sapiens
tatttcttgttattctcgttga

SEQ ID NO: 8766813 - DNA, 22 bp, Homo sapiens
tatttgatagagataaatgata

SEQ ID NO: 8766814 - DNA, 22 bp, Homo sapiens
tatttgatagagataaatgata

SEQ ID NO: 8766815 - DNA, 22 bp, Homo sapiens
tatttgatagagataaatgata

SEQ ID NO: 8766816 - DNA, 22 bp, Homo sapiens
tatttgatagagataaatgata

SEQ ID NO: 8766817 - DNA, 22 bp, Homo sapiens
tatttgaaggcatacattttga

SEQ ID NO: 8766818 - DNA, 22 bp, Homo sapiens
tatttgaagggagaaagtgcca

SEQ ID NO: 8766819 - DNA, 22 bp, Homo sapiens
tatttgatgaaggtaaagtctt

SEQ ID NO: 8766820 - DNA, 22 bp, Homo sapiens
tatttgatagagataaatgata

SEQ ID NO: 8766821 - DNA, 22 bp, Homo sapiens
tatttgatggttctaaaacagc

SEQ ID NO: 8766822 - DNA, 22 bp, Homo sapiens
tatttgctcaataatagtttta

SEQ ID NO: 8766823 - DNA, 22 bp, Homo sapiens
tatttgctcaaccctgcctcca

SEQ ID NO: 8766824 - DNA, 22 bp, Homo sapiens
tatttgctcaataatagtttta

SEQ ID NO: 8766825 - DNA, 23 bp, Homo sapiens
tatttgctactggtaattctgga

SEQ ID NO: 8766826 - DNA, 22 bp, Homo sapiens
tatttgcaggcttttgtcatgg

SEQ ID NO: 8766827 - DNA, 22 bp, Homo sapiens
tatttgcaggacatagatatgg

SEQ ID NO: 8766828 - DNA, 22 bp, Homo sapiens
tatttgcaggcttttgtcatgg

SEQ ID NO: 8766829 - DNA, 22 bp, Homo sapiens
tatttgcaggcttttgtcatgg

SEQ ID NO: 8766830 - DNA, 23 bp, Homo sapiens
tattacaattggtcttattaaga

SEQ ID NO: 8766831 - DNA, 23 bp, Homo sapiens
tattacaattggtcttattaaga

SEQ ID NO: 8766832 - DNA, 23 bp, Homo sapiens
tattacaattggtcttattaaga

SEQ ID NO: 8766833 - DNA, 22 bp, Homo sapiens
tattacaatttacattgcactt

SEQ ID NO: 8766834 - DNA, 22 bp, Homo sapiens
tattacaatttacattgcactt

SEQ ID NO: 8766835 - DNA, 21 bp, Homo sapiens
tattaatttttcttcccacta

SEQ ID NO: 8766836 - DNA, 22 bp, Homo sapiens
tattaatttaatctccatggta

SEQ ID NO: 8766837 - DNA, 22 bp, Homo sapiens
tattacaagaaagggcatgaat

SEQ ID NO: 8766838 - DNA, 22 bp, Homo sapiens
tattacaagaaagggcatgaat

SEQ ID NO: 8766839 - DNA, 22 bp, Homo sapiens
tattacaaattataatgggaga

SEQ ID NO: 8766840 - DNA, 22 bp, Homo sapiens
tattacaaattataatgggaga

SEQ ID NO: 8766841 - DNA, 22 bp, Homo sapiens
tattacaatttacattgcactt

SEQ ID NO: 8766842 - DNA, 22 bp, Homo sapiens
tattacaatttacattgcactt

SEQ ID NO: 8766843 - DNA, 22 bp, Homo sapiens
tattgtcaagaagtttatagtg

SEQ ID NO: 8766844 - DNA, 22 bp, Homo sapiens
tattgtctctgcgttgttctat

SEQ ID NO: 8766845 - DNA, 22 bp, Homo sapiens
tattgtctatcgctgctttcat

SEQ ID NO: 8766846 - DNA, 22 bp, Homo sapiens
tattgtctaggaattgtttaaa

SEQ ID NO: 8766847 - DNA, 22 bp, Homo sapiens
tattgtctaggaattgtttaaa

SEQ ID NO: 8766848 - DNA, 22 bp, Homo sapiens
tattgtctcacagttttggagg

SEQ ID NO: 8766849 - DNA, 22 bp, Homo sapiens
tattgtctgcaaaggtttataa

SEQ ID NO: 8766850 - DNA, 22 bp, Homo sapiens
tattgtccaataggatgttcct

SEQ ID NO: 8766851 - DNA, 22 bp, Homo sapiens
tattgtcacgtcttaattctag

SEQ ID NO: 8766852 - DNA, 22 bp, Homo sapiens
tatttaataaaactatggcatg

SEQ ID NO: 8766853 - DNA, 22 bp, Homo sapiens
tatttaagatgtgtcataaaga

SEQ ID NO: 8766854 - DNA, 22 bp, Homo sapiens
tattgttgttgtgagggggatg

SEQ ID NO: 8766855 - DNA, 22 bp, Homo sapiens
tatttaaaatagtgctccagca

SEQ ID NO: 8766856 - DNA, 22 bp, Homo sapiens
tatttaaaaagaggccagctgg

SEQ ID NO: 8766857 - DNA, 22 bp, Homo sapiens
tatttaaaaagaggccagctgg

SEQ ID NO: 8766858 - DNA, 22 bp, Homo sapiens
tattgttcttcactggtcttat

SEQ ID NO: 8766859 - DNA, 22 bp, Homo sapiens
tattgtttctggctgtggcagc

SEQ ID NO: 8766860 - DNA, 22 bp, Homo sapiens
tattgtttctggctgtggcagc

SEQ ID NO: 8766861 - DNA, 22 bp, Homo sapiens
tattgtctgtccgggtcaaagc

SEQ ID NO: 8766862 - DNA, 22 bp, Homo sapiens
tattgtctatcgctgctttcat

SEQ ID NO: 8766863 - DNA, 22 bp, Homo sapiens
tattgtcttcaactctactttt

SEQ ID NO: 8766864 - DNA, 22 bp, Homo sapiens
tattgtcttcaactctactttt

SEQ ID NO: 8766865 - DNA, 20 bp, Homo sapiens
tcaaagcaaagggagatgat

SEQ ID NO: 8766866 - DNA, 22 bp, Homo sapiens
tcaaagatgggttttgtttgat

SEQ ID NO: 8766867 - DNA, 22 bp, Homo sapiens
tcaaagattgaaactaaggaga

SEQ ID NO: 8766868 - DNA, 22 bp, Homo sapiens
tcaaagatgggttttgtttgat

SEQ ID NO: 8766869 - DNA, 22 bp, Homo sapiens
tcaaagatgatgctgaagttat

SEQ ID NO: 8766870 - DNA, 20 bp, Homo sapiens
tcaaagcaaagggagatgat

SEQ ID NO: 8766871 - DNA, 20 bp, Homo sapiens
tcaaagcaaagggagatgat

SEQ ID NO: 8766872 - DNA, 19 bp, Homo sapiens
tcaaagcaagcatgttctg

SEQ ID NO: 8766873 - DNA, 19 bp, Homo sapiens
tcaaagcaagcatgttctg

SEQ ID NO: 8766874 - DNA, 22 bp, Homo sapiens
tcaaagatcagatggttgtagg

SEQ ID NO: 8766875 - DNA, 22 bp, Homo sapiens
tcaaagatcagatggttgtagg

SEQ ID NO: 8766876 - DNA, 22 bp, Homo sapiens
tcaaagatgatgctgaagttat

SEQ ID NO: 8766877 - DNA, 22 bp, Homo sapiens
tcaaagagctctatcttcaaaa

SEQ ID NO: 8766878 - DNA, 22 bp, Homo sapiens
tcaaagagctattcagttgtgg

SEQ ID NO: 8766879 - DNA, 22 bp, Homo sapiens
tcaaagatagatgttgagaaat

SEQ ID NO: 8766880 - DNA, 22 bp, Homo sapiens
tcaaagacatctggtagctgag

SEQ ID NO: 8766881 - DNA, 22 bp, Homo sapiens
tcaaagacagacatcagtcaaa

SEQ ID NO: 8766882 - DNA, 22 bp, Homo sapiens
tcaaagacatggggaagctgag

SEQ ID NO: 8766883 - DNA, 22 bp, Homo sapiens
tcaaagactatatattttattt

SEQ ID NO: 8766884 - DNA, 22 bp, Homo sapiens
tcaaagactatatattttattt

SEQ ID NO: 8766885 - DNA, 21 bp, Homo sapiens
tcaaagactggggctgtgtgc

SEQ ID NO: 8766886 - DNA, 22 bp, Homo sapiens
tcaaagagctattcagttgtgg

SEQ ID NO: 8766887 - DNA, 22 bp, Homo sapiens
tcaaagaacatcatctgaaatg

SEQ ID NO: 8766888 - DNA, 20 bp, Homo sapiens
tcaaagaagattcagctcaa

SEQ ID NO: 8766889 - DNA, 22 bp, Homo sapiens
tcaaagaagattaccctcccat

SEQ ID NO: 8766890 - DNA, 20 bp, Homo sapiens
tcaaagaagattcagctcaa

SEQ ID NO: 8766891 - DNA, 22 bp, Homo sapiens
tcaaagaagtgcaaacctcatc

SEQ ID NO: 8766892 - DNA, 17 bp, Homo sapiens
tcaaagaatgcatgcag

SEQ ID NO: 8766893 - DNA, 17 bp, Homo sapiens
tcaaagaatgcatgcag

SEQ ID NO: 8766894 - DNA, 22 bp, Homo sapiens
tcaaagaagtgcaaacctcatc

SEQ ID NO: 8766895 - DNA, 20 bp, Homo sapiens
tcaaagacaagctctcatcc

SEQ ID NO: 8766896 - DNA, 20 bp, Homo sapiens
tcaaagacaagctctcatcc

SEQ ID NO: 8766897 - DNA, 22 bp, Homo sapiens
tcaaagaatgttatgagggtag

SEQ ID NO: 8766898 - DNA, 22 bp, Homo sapiens
tcaaagaatgttatgagggtag

SEQ ID NO: 8766899 - DNA, 22 bp, Homo sapiens
tcaaactgttcagaactccttt

SEQ ID NO: 8766900 - DNA, 22 bp, Homo sapiens
tcaaactgttcagaactccttt

SEQ ID NO: 8766901 - DNA, 23 bp, Homo sapiens
tcaaactgttatattgccagagt

SEQ ID NO: 8766902 - DNA, 23 bp, Homo sapiens
tcaaactgttatattgccagagt

SEQ ID NO: 8766903 - DNA, 22 bp, Homo sapiens
tcaaactgttagatttcagctc

SEQ ID NO: 8766904 - DNA, 22 bp, Homo sapiens
tcaaactgttcagaactccttt

SEQ ID NO: 8766905 - DNA, 22 bp, Homo sapiens
tcaaagaacatcatctgaaatg

SEQ ID NO: 8766906 - DNA, 22 bp, Homo sapiens
tcaaagaacatcatctgaaatg

SEQ ID NO: 8766907 - DNA, 22 bp, Homo sapiens
tcaaacttctattctctgtttt

SEQ ID NO: 8766908 - DNA, 22 bp, Homo sapiens
tcaaactgtttacagtgagata

SEQ ID NO: 8766909 - DNA, 22 bp, Homo sapiens
tcaaactgaattaaacacttgt

SEQ ID NO: 8766910 - DNA, 22 bp, Homo sapiens
tcaaactgctaccttttatgtg

SEQ ID NO: 8766911 - DNA, 22 bp, Homo sapiens
tcaaactgaattaaacacttgt

SEQ ID NO: 8766912 - DNA, 22 bp, Homo sapiens
tcaaactgaactaagatccaac

SEQ ID NO: 8766913 - DNA, 22 bp, Homo sapiens
tcaaactgaactaagatccaac

SEQ ID NO: 8766914 - DNA, 18 bp, Homo sapiens
tcaaactgtcattggtga

SEQ ID NO: 8766915 - DNA, 18 bp, Homo sapiens
tcaaactgtcattggtga

SEQ ID NO: 8766916 - DNA, 22 bp, Homo sapiens
tcaaactggggaacttatttat

SEQ ID NO: 8766917 - DNA, 22 bp, Homo sapiens
tcaaactggcagacttctactt

SEQ ID NO: 8766918 - DNA, 22 bp, Homo sapiens
tatttttgcctctcagataaaa

SEQ ID NO: 8766919 - DNA, 22 bp, Homo sapiens
tatttttgcctctcagataaaa

SEQ ID NO: 8766920 - DNA, 22 bp, Homo sapiens
tatttttgcctctcagataaaa

SEQ ID NO: 8766921 - DNA, 22 bp, Homo sapiens
tcaaaaataagatattctggac

SEQ ID NO: 8766922 - DNA, 22 bp, Homo sapiens
tattttgttaataatccagtcc

SEQ ID NO: 8766923 - DNA, 22 bp, Homo sapiens
tattttgttaataatccagtcc

SEQ ID NO: 8766924 - DNA, 22 bp, Homo sapiens
tattttgttttgtatccactgt

SEQ ID NO: 8766925 - DNA, 22 bp, Homo sapiens
tattttgtatttatgcaagaaa

SEQ ID NO: 8766926 - DNA, 22 bp, Homo sapiens
tattttgctttagctgactgtt

SEQ ID NO: 8766927 - DNA, 22 bp, Homo sapiens
tattttgtaattggtcatagct

SEQ ID NO: 8766928 - DNA, 22 bp, Homo sapiens
tattttgtaattggtcatagct

SEQ ID NO: 8766929 - DNA, 22 bp, Homo sapiens
tattttgctttagctgactgtt

SEQ ID NO: 8766930 - DNA, 22 bp, Homo sapiens
tattttgcaaacctgagtttga

SEQ ID NO: 8766931 - DNA, 22 bp, Homo sapiens
tattttgcaaacctgagtttga

SEQ ID NO: 8766932 - DNA, 20 bp, Homo sapiens
tattttgcaattatggttca

SEQ ID NO: 8766933 - DNA, 22 bp, Homo sapiens
tattttgagcccctgacatcta

SEQ ID NO: 8766934 - DNA, 22 bp, Homo sapiens
tattttgaggtatttttgagct

SEQ ID NO: 8766935 - DNA, 22 bp, Homo sapiens
tattttgacgattttatgcaaa

SEQ ID NO: 8766936 - DNA, 22 bp, Homo sapiens
tattttgacgattttatgcaaa

SEQ ID NO: 8766937 - DNA, 22 bp, Homo sapiens
tattttgacgattttatgcaaa

SEQ ID NO: 8766938 - DNA, 22 bp, Homo sapiens
tcaaagtattttaactgtatcc

SEQ ID NO: 8766939 - DNA, 22 bp, Homo sapiens
tcaaagtataattgcttttttg

SEQ ID NO: 8766940 - DNA, 22 bp, Homo sapiens
tcaaagtatatcccttcgaaac

SEQ ID NO: 8766941 - DNA, 17 bp, Homo sapiens
tcaaagtattctgatgc

SEQ ID NO: 8766942 - DNA, 22 bp, Homo sapiens
tcaaagtatctcatggagagca

SEQ ID NO: 8766943 - DNA, 22 bp, Homo sapiens
tcaaagtatgctttctttggga

SEQ ID NO: 8766944 - DNA, 22 bp, Homo sapiens
tcaaagtttgtggcaatttatt

SEQ ID NO: 8766945 - DNA, 22 bp, Homo sapiens
tcaaagttacttgtggttttct

SEQ ID NO: 8766946 - DNA, 22 bp, Homo sapiens
tcaaataatgccattcatcatc

SEQ ID NO: 8766947 - DNA, 22 bp, Homo sapiens
tcaaagtagccggatggaattt

SEQ ID NO: 8766948 - DNA, 22 bp, Homo sapiens
tcaaagtagagttcagtgcagc

SEQ ID NO: 8766949 - DNA, 23 bp, Homo sapiens
tcaaagtagttttatccaataaa

SEQ ID NO: 8766950 - DNA, 22 bp, Homo sapiens
tcaaagtaggggtaagccaggc

SEQ ID NO: 8766951 - DNA, 22 bp, Homo sapiens
tcaaagtaagaatttattacaa

SEQ ID NO: 8766952 - DNA, 22 bp, Homo sapiens
tcaaagtaagattgttgaagct

SEQ ID NO: 8766953 - DNA, 22 bp, Homo sapiens
tcaaagtactactcagttcagc

SEQ ID NO: 8766954 - DNA, 22 bp, Homo sapiens
tcaaagtaccattatcagtgga

SEQ ID NO: 8766955 - DNA, 22 bp, Homo sapiens
tcaaagtaccagagtgaactga

SEQ ID NO: 8766956 - DNA, 22 bp, Homo sapiens
tcaaagtaaaagtatagagttt

SEQ ID NO: 8766957 - DNA, 22 bp, Homo sapiens
tcaaagtaaacgctttgggcca

SEQ ID NO: 8766958 - DNA, 22 bp, Homo sapiens
tcaaagggtagcccagggaaga

SEQ ID NO: 8766959 - DNA, 22 bp, Homo sapiens
tcaaagggtccttaacatgaga

SEQ ID NO: 8766960 - DNA, 22 bp, Homo sapiens
tcaaagggtaatgtaatagtct

SEQ ID NO: 8766961 - DNA, 22 bp, Homo sapiens
tcaaatatgtgatagaagctaa

SEQ ID NO: 8766962 - DNA, 22 bp, Homo sapiens
tcaaatagttgacattaacttg

SEQ ID NO: 8766963 - DNA, 22 bp, Homo sapiens
tcaaatatgtgatagaagctaa

SEQ ID NO: 8766964 - DNA, 22 bp, Homo sapiens
tcaaatatgtgatagaagctaa

SEQ ID NO: 8766965 - DNA, 22 bp, Homo sapiens
tcaaatacagaagatcctttcc

SEQ ID NO: 8766966 - DNA, 22 bp, Homo sapiens
tcaaatacagaagatcctttcc

SEQ ID NO: 8766967 - DNA, 22 bp, Homo sapiens
tcaaatacatggtcaatcaact

SEQ ID NO: 8766968 - DNA, 22 bp, Homo sapiens
tcaaatacatggtcaatcaact

SEQ ID NO: 8766969 - DNA, 22 bp, Homo sapiens
tcaaatacatggtcaatcaact

SEQ ID NO: 8766970 - DNA, 21 bp, Homo sapiens
tcaaatcaggtatcactattg

SEQ ID NO: 8766971 - DNA, 22 bp, Homo sapiens
tcaaatcagcaagcagcttccc

SEQ ID NO: 8766972 - DNA, 22 bp, Homo sapiens
tcaaatattggctatttcacat

SEQ ID NO: 8766973 - DNA, 22 bp, Homo sapiens
tcaaatcaccaaactcactggc

SEQ ID NO: 8766974 - DNA, 22 bp, Homo sapiens
tcaaatattggctatttcacat

SEQ ID NO: 8766975 - DNA, 22 bp, Homo sapiens
tcaaatattggctatttcacat

SEQ ID NO: 8766976 - DNA, 21 bp, Homo sapiens
tcaaatcctgctgttaccact

SEQ ID NO: 8766977 - DNA, 22 bp, Homo sapiens
tcaaatctcactctgcatttct

SEQ ID NO: 8766978 - DNA, 23 bp, Homo sapiens
tcaaatcccagctctaccacttc

SEQ ID NO: 8766979 - DNA, 23 bp, Homo sapiens
tcaaatcccagctctaccacttc

SEQ ID NO: 8766980 - DNA, 17 bp, Homo sapiens
tcaaatcctctgtctgg

SEQ ID NO: 8766981 - DNA, 17 bp, Homo sapiens
tcaaatcctctgtctgg

SEQ ID NO: 8766982 - DNA, 22 bp, Homo sapiens
tcaaatcccagctcagcctctc

SEQ ID NO: 8766983 - DNA, 21 bp, Homo sapiens
tcaaatcatgtactgaccaca

SEQ ID NO: 8766984 - DNA, 21 bp, Homo sapiens
tcaaatcatgtactgaccaca

SEQ ID NO: 8766985 - DNA, 22 bp, Homo sapiens
tcaaatgaagacagttgacttg

SEQ ID NO: 8766986 - DNA, 22 bp, Homo sapiens
tcaaatgaagacagttgacttg

SEQ ID NO: 8766987 - DNA, 22 bp, Homo sapiens
tcaaatgagaggcagggcagct

SEQ ID NO: 8766988 - DNA, 22 bp, Homo sapiens
tcaaatgacaagcacttttggg

SEQ ID NO: 8766989 - DNA, 22 bp, Homo sapiens
tattaataagtgactactagct

SEQ ID NO: 8766990 - DNA, 21 bp, Homo sapiens
tattaatatgtctaagctgat

SEQ ID NO: 8766991 - DNA, 22 bp, Homo sapiens
tattaataagtgactactagct

SEQ ID NO: 8766992 - DNA, 22 bp, Homo sapiens
tattaattcttgccaattctcc

SEQ ID NO: 8766993 - DNA, 22 bp, Homo sapiens
tattaattcttgccaattctcc

SEQ ID NO: 8766994 - DNA, 22 bp, Homo sapiens
tattaattcttgccaattctcc

SEQ ID NO: 8766995 - DNA, 22 bp, Homo sapiens
tattaattcttgccaattctcc

SEQ ID NO: 8766996 - DNA, 22 bp, Homo sapiens
tattaatatgtgtgtgcatgta

SEQ ID NO: 8766997 - DNA, 22 bp, Homo sapiens
tattaagagatgtatgaagaga

SEQ ID NO: 8766998 - DNA, 22 bp, Homo sapiens
tattaagagatgtatgaagaga

SEQ ID NO: 8766999 - DNA, 22 bp, Homo sapiens
tattaataaatatgtaggggcc

SEQ ID NO: 8767000 - DNA, 22 bp, Homo sapiens
tattaacattttatgaaaataa

SEQ ID NO: 8767001 - DNA, 22 bp, Homo sapiens
tattaacattttatgaaaataa

SEQ ID NO: 8767002 - DNA, 22 bp, Homo sapiens
tattaacacgtataaagtgttt

SEQ ID NO: 8767003 - DNA, 22 bp, Homo sapiens
tattaacattttatgaaaataa

SEQ ID NO: 8767004 - DNA, 22 bp, Homo sapiens
tattaacatgaactgacttttc

SEQ ID NO: 8767005 - DNA, 22 bp, Homo sapiens
tattaacatgaactgacttttc

SEQ ID NO: 8767006 - DNA, 22 bp, Homo sapiens
tatgtttcctgagcttacacca

SEQ ID NO: 8767007 - DNA, 22 bp, Homo sapiens
tatgtttcattcttttctggta

SEQ ID NO: 8767008 - DNA, 22 bp, Homo sapiens
tatgtttcttccttttcataca

SEQ ID NO: 8767009 - DNA, 22 bp, Homo sapiens
tattaacatgaactgacttttc

SEQ ID NO: 8767010 - DNA, 22 bp, Homo sapiens
tattaacacgtataaagtgttt

SEQ ID NO: 8767011 - DNA, 22 bp, Homo sapiens
tattaaattatggatttaggag

SEQ ID NO: 8767012 - DNA, 22 bp, Homo sapiens
tatgtataaatgcatgtgtgga

SEQ ID NO: 8767013 - DNA, 22 bp, Homo sapiens
tatgtataaatgcatgtgtgga

SEQ ID NO: 8767014 - DNA, 18 bp, Homo sapiens
tatgtataacatagttca

SEQ ID NO: 8767015 - DNA, 22 bp, Homo sapiens
tatgtataatcacagagtgtca

SEQ ID NO: 8767016 - DNA, 22 bp, Homo sapiens
tatgtataatcacagagtgtca

SEQ ID NO: 8767017 - DNA, 22 bp, Homo sapiens
tatgtataatcacagagtgtca

SEQ ID NO: 8767018 - DNA, 22 bp, Homo sapiens
tatgtattctcagatttactaa

SEQ ID NO: 8767019 - DNA, 23 bp, Homo sapiens
tatgtatgtatgtttgtatggaa

SEQ ID NO: 8767020 - DNA, 23 bp, Homo sapiens
tatgtatgtatgtttgtatggaa

SEQ ID NO: 8767021 - DNA, 22 bp, Homo sapiens
tatgtattattcatcagtggga

SEQ ID NO: 8767022 - DNA, 22 bp, Homo sapiens
tatgtattctcagatttactaa

SEQ ID NO: 8767023 - DNA, 22 bp, Homo sapiens
tatgtatatgtgtgttgacaac

SEQ ID NO: 8767024 - DNA, 20 bp, Homo sapiens
tatgtatgcctacatgctat

SEQ ID NO: 8767025 - DNA, 22 bp, Homo sapiens
tatgtatatggtagaagtatgt

SEQ ID NO: 8767026 - DNA, 22 bp, Homo sapiens
tatggtcaaagatatgaagccc

SEQ ID NO: 8767027 - DNA, 22 bp, Homo sapiens
tatggctttttattcatcttac

SEQ ID NO: 8767028 - DNA, 22 bp, Homo sapiens
tatggcttttcattcctatgtg

SEQ ID NO: 8767029 - DNA, 22 bp, Homo sapiens
tatggcttttcttcctccccca

SEQ ID NO: 8767030 - DNA, 22 bp, Homo sapiens
tatggcttttggcttctctctg

SEQ ID NO: 8767031 - DNA, 22 bp, Homo sapiens
tatggcttttctttcctagtgt

SEQ ID NO: 8767032 - DNA, 22 bp, Homo sapiens
tatggctttaaacaacttaggt

SEQ ID NO: 8767033 - DNA, 22 bp, Homo sapiens
tatggctttaaacttttcattt

SEQ ID NO: 8767034 - DNA, 22 bp, Homo sapiens
tatggctttaaattgaaggagt

SEQ ID NO: 8767035 - DNA, 22 bp, Homo sapiens
tatggcttgtggagagttgtag

SEQ ID NO: 8767036 - DNA, 22 bp, Homo sapiens
tatggcttgtctttataccagg

SEQ ID NO: 8767037 - DNA, 22 bp, Homo sapiens
tatggcttgtccctggtcagtc

SEQ ID NO: 8767038 - DNA, 21 bp, Homo sapiens
tatggctttactaagctgcac

SEQ ID NO: 8767039 - DNA, 22 bp, Homo sapiens
tatggctttgaaagggcttttc

SEQ ID NO: 8767040 - DNA, 22 bp, Homo sapiens
tatggctttctccatagggcag

SEQ ID NO: 8767041 - DNA, 22 bp, Homo sapiens
tatggctttcaaaggaactcgg

SEQ ID NO: 8767042 - DNA, 22 bp, Homo sapiens
tatggcttttaaggagatctga

SEQ ID NO: 8767043 - DNA, 22 bp, Homo sapiens
tatggcttttaactgtcgtatg

SEQ ID NO: 8767044 - DNA, 22 bp, Homo sapiens
tatggctttgggccaaatctac

SEQ ID NO: 8767045 - DNA, 22 bp, Homo sapiens
tatggtcatggttgcacaattt

SEQ ID NO: 8767046 - DNA, 22 bp, Homo sapiens
tatggtcatttgttagtgcttt

SEQ ID NO: 8767047 - DNA, 22 bp, Homo sapiens
tatgtaaaaattcatcaggctg

SEQ ID NO: 8767048 - DNA, 22 bp, Homo sapiens
tatgtaaaggattgagatgaat

SEQ ID NO: 8767049 - DNA, 22 bp, Homo sapiens
tatgtaaaggattgagatgaat

SEQ ID NO: 8767050 - DNA, 22 bp, Homo sapiens
tatgtaaagtagatggcaggta

SEQ ID NO: 8767051 - DNA, 22 bp, Homo sapiens
tatgtacatacatgtgcatacg

SEQ ID NO: 8767052 - DNA, 22 bp, Homo sapiens
tatgtacatacatgtgcatacg

SEQ ID NO: 8767053 - DNA, 22 bp, Homo sapiens
tatgtacatatacacgtgtgtg

SEQ ID NO: 8767054 - DNA, 22 bp, Homo sapiens
tatgctttgatttcctcagctg

SEQ ID NO: 8767055 - DNA, 22 bp, Homo sapiens
tatgctttgcaattggaaaagg

SEQ ID NO: 8767056 - DNA, 22 bp, Homo sapiens
tatgctttggtagagagttgtg

SEQ ID NO: 8767057 - DNA, 22 bp, Homo sapiens
tatgctttggtagagagttgtg

SEQ ID NO: 8767058 - DNA, 22 bp, Homo sapiens
tatgcttttaacctgtaactga

SEQ ID NO: 8767059 - DNA, 22 bp, Homo sapiens
tatgcttttctcttggaatgtg

SEQ ID NO: 8767060 - DNA, 17 bp, Homo sapiens
tatgcttttcttctcca

SEQ ID NO: 8767061 - DNA, 17 bp, Homo sapiens
tatgcttttcttctcca

SEQ ID NO: 8767062 - DNA, 22 bp, Homo sapiens
tatgctttaaccctcttatatt

SEQ ID NO: 8767063 - DNA, 22 bp, Homo sapiens
tatgctttacttttcattgtga

SEQ ID NO: 8767064 - DNA, 22 bp, Homo sapiens
tatgctttgaaaatgtgctgaa

SEQ ID NO: 8767065 - DNA, 22 bp, Homo sapiens
tatgctttgaaaatgtgctgaa

SEQ ID NO: 8767066 - DNA, 22 bp, Homo sapiens
tatgctttcattcatatgtgag

SEQ ID NO: 8767067 - DNA, 22 bp, Homo sapiens
tatgctttcattcatatgtgag

SEQ ID NO: 8767068 - DNA, 22 bp, Homo sapiens
tatggaaagggagtttaatttg

SEQ ID NO: 8767069 - DNA, 22 bp, Homo sapiens
tatggaaaaatgtatcttgtca

SEQ ID NO: 8767070 - DNA, 22 bp, Homo sapiens
tatggaaactaattcatttttc

SEQ ID NO: 8767071 - DNA, 22 bp, Homo sapiens
tatggaaactaattcatttttc

SEQ ID NO: 8767072 - DNA, 22 bp, Homo sapiens
tatggacatctgaagttgcaga

SEQ ID NO: 8767073 - DNA, 22 bp, Homo sapiens
tatggcttctgggccaaattta

SEQ ID NO: 8767074 - DNA, 22 bp, Homo sapiens
tatggcttctgggccaaattta

SEQ ID NO: 8767075 - DNA, 22 bp, Homo sapiens
tatggcttcttttgcaactact

SEQ ID NO: 8767076 - DNA, 22 bp, Homo sapiens
tatggcttcttttgcaactact

SEQ ID NO: 8767077 - DNA, 22 bp, Homo sapiens
tatggcttcttgtgttactgtg

SEQ ID NO: 8767078 - DNA, 20 bp, Homo sapiens
tatggcttgcagccaccctt

SEQ ID NO: 8767079 - DNA, 22 bp, Homo sapiens
tatggcttgagtttcagactat

SEQ ID NO: 8767080 - DNA, 20 bp, Homo sapiens
tatggcttggcaaagcttca

SEQ ID NO: 8767081 - DNA, 22 bp, Homo sapiens
tatggcttgacttgcaccggca

SEQ ID NO: 8767082 - DNA, 21 bp, Homo sapiens
tatcacagtagaataggatct

SEQ ID NO: 8767083 - DNA, 21 bp, Homo sapiens
tatcacagtagaataggatct

SEQ ID NO: 8767084 - DNA, 21 bp, Homo sapiens
tatcacagtagaataggatct

SEQ ID NO: 8767085 - DNA, 22 bp, Homo sapiens
tatcacaggtgtgatttacatt

SEQ ID NO: 8767086 - DNA, 22 bp, Homo sapiens
tatcacatagtgtttagtaaat

SEQ ID NO: 8767087 - DNA, 22 bp, Homo sapiens
tatcacatacttctcatccagg

SEQ ID NO: 8767088 - DNA, 22 bp, Homo sapiens
tatcacatacttctcatccagg

SEQ ID NO: 8767089 - DNA, 22 bp, Homo sapiens
tatcacatcaatgttttaaaat

SEQ ID NO: 8767090 - DNA, 22 bp, Homo sapiens
tatcacatcaatgttttaaaat

SEQ ID NO: 8767091 - DNA, 22 bp, Homo sapiens
tatcacatcaatgttttaaaat

SEQ ID NO: 8767092 - DNA, 22 bp, Homo sapiens
tatcacatttggagatttatga

SEQ ID NO: 8767093 - DNA, 22 bp, Homo sapiens
tatcactacactaagatacaga

SEQ ID NO: 8767094 - DNA, 22 bp, Homo sapiens
tatcaccctacataagaaataa

SEQ ID NO: 8767095 - DNA, 22 bp, Homo sapiens
tatcactacacctggctaatta

SEQ ID NO: 8767096 - DNA, 19 bp, Homo sapiens
tatcactgggcactgagga

SEQ ID NO: 8767097 - DNA, 22 bp, Homo sapiens
tatcactgacctgtatcagttg

SEQ ID NO: 8767098 - DNA, 22 bp, Homo sapiens
tatcagaagacttacagtatcg

SEQ ID NO: 8767099 - DNA, 17 bp, Homo sapiens
tatcagaatgtgtttac

SEQ ID NO: 8767100 - DNA, 22 bp, Homo sapiens
tatcagaaggaagtgcctttaa

SEQ ID NO: 8767101 - DNA, 21 bp, Homo sapiens
tatcagaagagaaagaatgat

SEQ ID NO: 8767102 - DNA, 22 bp, Homo sapiens
tatcagaagacttacagtatcg

SEQ ID NO: 8767103 - DNA, 22 bp, Homo sapiens
tatcagcaagatggcagtatag

SEQ ID NO: 8767104 - DNA, 22 bp, Homo sapiens
tatcagcaagatggcagtatag

SEQ ID NO: 8767105 - DNA, 22 bp, Homo sapiens
tatcagcaccgcggacagcatc

SEQ ID NO: 8767106 - DNA, 22 bp, Homo sapiens
tatcagcatatttactttcttg

SEQ ID NO: 8767107 - DNA, 22 bp, Homo sapiens
tatcagcatctcctcaaagata

SEQ ID NO: 8767108 - DNA, 18 bp, Homo sapiens
tataaacacacttaggtt

SEQ ID NO: 8767109 - DNA, 18 bp, Homo sapiens
tataaacacacttaggtt

SEQ ID NO: 8767110 - DNA, 18 bp, Homo sapiens
tataaacacacttaggtt

SEQ ID NO: 8767111 - DNA, 22 bp, Homo sapiens
tataaactcctcttgcattcct

SEQ ID NO: 8767112 - DNA, 22 bp, Homo sapiens
tataaactatatgttagccaga

SEQ ID NO: 8767113 - DNA, 22 bp, Homo sapiens
tataaactatatgttagccaga

SEQ ID NO: 8767114 - DNA, 22 bp, Homo sapiens
tataaactttaaccaggatgtc

SEQ ID NO: 8767115 - DNA, 22 bp, Homo sapiens
tataaagaaatgatttccagaa

SEQ ID NO: 8767116 - DNA, 22 bp, Homo sapiens
tataaagaaatgatttccagaa

SEQ ID NO: 8767117 - DNA, 22 bp, Homo sapiens
tataaagaaggcacagcaagac

SEQ ID NO: 8767118 - DNA, 22 bp, Homo sapiens
tataaagaaggcacagcaagac

SEQ ID NO: 8767119 - DNA, 22 bp, Homo sapiens
tataaagaaggcacagcaagac

SEQ ID NO: 8767120 - DNA, 22 bp, Homo sapiens
tataaagaaggcacagcaagac

SEQ ID NO: 8767121 - DNA, 22 bp, Homo sapiens
tataaaatggcatcagctccaa

SEQ ID NO: 8767122 - DNA, 22 bp, Homo sapiens
tataaaatggcatcagctccaa

SEQ ID NO: 8767123 - DNA, 22 bp, Homo sapiens
tataaaattctcagtttggggt

SEQ ID NO: 8767124 - DNA, 18 bp, Homo sapiens
tataaacacacttaggtt

SEQ ID NO: 8767125 - DNA, 22 bp, Homo sapiens
tataaaacagaaagcactacct

SEQ ID NO: 8767126 - DNA, 22 bp, Homo sapiens
tagttttttcaacaaatggtgc

SEQ ID NO: 8767127 - DNA, 22 bp, Homo sapiens
tataaagagtctcaaagaagtt

SEQ ID NO: 8767128 - DNA, 22 bp, Homo sapiens
tataaagtgtgaactgtgagta

SEQ ID NO: 8767129 - DNA, 22 bp, Homo sapiens
tataaagagtctcaaagaagtt

SEQ ID NO: 8767130 - DNA, 22 bp, Homo sapiens
tataaagctgactcatgaaact

SEQ ID NO: 8767131 - DNA, 22 bp, Homo sapiens
tataaagttggggctgaagtaa

SEQ ID NO: 8767132 - DNA, 22 bp, Homo sapiens
tataaagagtctcaaagaagtt

SEQ ID NO: 8767133 - DNA, 22 bp, Homo sapiens
tataaagaatccagaagagaca

SEQ ID NO: 8767134 - DNA, 22 bp, Homo sapiens
tataaagagtctatctggtggc

SEQ ID NO: 8767135 - DNA, 22 bp, Homo sapiens
tataaagagtctatctggtggc

SEQ ID NO: 8767136 - DNA, 22 bp, Homo sapiens
tataaagagtctcaaagaagtt

SEQ ID NO: 8767137 - DNA, 22 bp, Homo sapiens
tataaagagtctcaaagaagtt

SEQ ID NO: 8767138 - DNA, 22 bp, Homo sapiens
tataaagagtctcaaagaagtt

SEQ ID NO: 8767139 - DNA, 22 bp, Homo sapiens
tataaagagtctcaaagaagtt

SEQ ID NO: 8767140 - DNA, 22 bp, Homo sapiens
tataaagaatccagaagagaca

SEQ ID NO: 8767141 - DNA, 22 bp, Homo sapiens
tataaagaatccagaagagaca

SEQ ID NO: 8767142 - DNA, 22 bp, Homo sapiens
tataaagaatccagaagagaca

SEQ ID NO: 8767143 - DNA, 22 bp, Homo sapiens
tataaagaagtgtaaacaggaa

SEQ ID NO: 8767144 - DNA, 22 bp, Homo sapiens
tataaagaagtgtaaacaggaa

SEQ ID NO: 8767145 - DNA, 22 bp, Homo sapiens
tataaagaagtgtaaacaggaa

SEQ ID NO: 8767146 - DNA, 22 bp, Homo sapiens
tataaagaagtgtaaacaggaa

SEQ ID NO: 8767147 - DNA, 22 bp, Homo sapiens
tataaagaagtgtaaacaggaa

SEQ ID NO: 8767148 - DNA, 22 bp, Homo sapiens
tataaagaaggcacagcaagac

SEQ ID NO: 8767149 - DNA, 22 bp, Homo sapiens
tatgaaatgatggggaaaatag

SEQ ID NO: 8767150 - DNA, 22 bp, Homo sapiens
tatgaaatttaaacacagatca

SEQ ID NO: 8767151 - DNA, 22 bp, Homo sapiens
tatgaacacactttggaagtga

SEQ ID NO: 8767152 - DNA, 20 bp, Homo sapiens
tatgaagatatgtgaacagc

SEQ ID NO: 8767153 - DNA, 22 bp, Homo sapiens
tatgaatataccacaatttagg

SEQ ID NO: 8767154 - DNA, 22 bp, Homo sapiens
tatgaaatttaaacacagatca

SEQ ID NO: 8767155 - DNA, 22 bp, Homo sapiens
tatgaagattgcggtctggaat

SEQ ID NO: 8767156 - DNA, 22 bp, Homo sapiens
tatgaagctgataatcactgat

SEQ ID NO: 8767157 - DNA, 22 bp, Homo sapiens
tatgaagctctcactgtgtgtc

SEQ ID NO: 8767158 - DNA, 22 bp, Homo sapiens
tatgaagctctcactgtgtgtc

SEQ ID NO: 8767159 - DNA, 22 bp, Homo sapiens
tatgaagctttgaaaagcttac

SEQ ID NO: 8767160 - DNA, 22 bp, Homo sapiens
tatgaagctttgaaaagcttac

SEQ ID NO: 8767161 - DNA, 22 bp, Homo sapiens
tatgacaaatgatatatttggc

SEQ ID NO: 8767162 - DNA, 22 bp, Homo sapiens
tatgacaaggtggagtatgagt

SEQ ID NO: 8767163 - DNA, 22 bp, Homo sapiens
tatgaattctgttcattgatga

SEQ ID NO: 8767164 - DNA, 22 bp, Homo sapiens
tatccaaaggaacaatcacagc

SEQ ID NO: 8767165 - DNA, 22 bp, Homo sapiens
tatccaaagtggcatattatag

SEQ ID NO: 8767166 - DNA, 22 bp, Homo sapiens
tatccaaagtggcatattatag

SEQ ID NO: 8767167 - DNA, 22 bp, Homo sapiens
tatccaaagagattcatgttct

SEQ ID NO: 8767168 - DNA, 22 bp, Homo sapiens
tatccaaagagattcatgttct

SEQ ID NO: 8767169 - DNA, 22 bp, Homo sapiens
tatcattttactgtgacatttt

SEQ ID NO: 8767170 - DNA, 22 bp, Homo sapiens
tatcattttactgtgacatttt

SEQ ID NO: 8767171 - DNA, 22 bp, Homo sapiens
tatcattttactgtgacatttt

SEQ ID NO: 8767172 - DNA, 22 bp, Homo sapiens
tatcaggaattgaatggcttca

SEQ ID NO: 8767173 - DNA, 23 bp, Homo sapiens
tatcatttcagctctctgcctgg

SEQ ID NO: 8767174 - DNA, 22 bp, Homo sapiens
tatcatttagagtatttcttca

SEQ ID NO: 8767175 - DNA, 22 bp, Homo sapiens
tatcatttgttattattagtgg

SEQ ID NO: 8767176 - DNA, 22 bp, Homo sapiens
tatcatttgttattattagtgg

SEQ ID NO: 8767177 - DNA, 23 bp, Homo sapiens
tatcatttcagctctctgcctgg

SEQ ID NO: 8767178 - DNA, 22 bp, Homo sapiens
tatcttttgagttctcaagatg

SEQ ID NO: 8767179 - DNA, 22 bp, Homo sapiens
tatcttttgagttctcaagatg

SEQ ID NO: 8767180 - DNA, 18 bp, Homo sapiens
tatcttttccagtggtat

SEQ ID NO: 8767181 - DNA, 18 bp, Homo sapiens
tatcttttccagtggtat

SEQ ID NO: 8767182 - DNA, 18 bp, Homo sapiens
tatcttttccagtggtat

SEQ ID NO: 8767183 - DNA, 18 bp, Homo sapiens
tatcttttccagtggtat

SEQ ID NO: 8767184 - DNA, 23 bp, Homo sapiens
tatctttttcaatgttggaaata

SEQ ID NO: 8767185 - DNA, 23 bp, Homo sapiens
tatctttttcaatgttggaaata

SEQ ID NO: 8767186 - DNA, 22 bp, Homo sapiens
tatgaaacattcatacaaataa

SEQ ID NO: 8767187 - DNA, 22 bp, Homo sapiens
tatgaaagaatctcagagcaca

SEQ ID NO: 8767188 - DNA, 22 bp, Homo sapiens
tatgaaaaggtggccaatgtag

SEQ ID NO: 8767189 - DNA, 22 bp, Homo sapiens
tatgaaaatttagctgaagcat

SEQ ID NO: 8767190 - DNA, 22 bp, Homo sapiens
tatgaaaatttagctgaagcat

SEQ ID NO: 8767191 - DNA, 22 bp, Homo sapiens
tatgaaaaggtggccaatgtag

SEQ ID NO: 8767192 - DNA, 22 bp, Homo sapiens
tatgaaaatttagctgaagcat

SEQ ID NO: 8767193 - DNA, 22 bp, Homo sapiens
tagttctctattcaaggatcaa

SEQ ID NO: 8767194 - DNA, 22 bp, Homo sapiens
tagttctgtgtagctcaagagt

SEQ ID NO: 8767195 - DNA, 22 bp, Homo sapiens
tagttgaaagggattattgtgg

SEQ ID NO: 8767196 - DNA, 22 bp, Homo sapiens
tagttgaagagatgaatgacca

SEQ ID NO: 8767197 - DNA, 22 bp, Homo sapiens
tagttcttggttcttagttctt

SEQ ID NO: 8767198 - DNA, 22 bp, Homo sapiens
tagtttaatggtcaactaatga

SEQ ID NO: 8767199 - DNA, 22 bp, Homo sapiens
tagtttaatggtcaactaatga

SEQ ID NO: 8767200 - DNA, 22 bp, Homo sapiens
tagtttaatggtcaactaatga

SEQ ID NO: 8767201 - DNA, 20 bp, Homo sapiens
tagttgccaaaatgccctgc

SEQ ID NO: 8767202 - DNA, 22 bp, Homo sapiens
tagtttaatggtcaactaatga

SEQ ID NO: 8767203 - DNA, 22 bp, Homo sapiens
tagtttactgttcactttgccc

SEQ ID NO: 8767204 - DNA, 23 bp, Homo sapiens
tagttacattattgtcagagctg

SEQ ID NO: 8767205 - DNA, 22 bp, Homo sapiens
tagttacagtgcatagcaagat

SEQ ID NO: 8767206 - DNA, 22 bp, Homo sapiens
tagttacagcaggcaggatata

SEQ ID NO: 8767207 - DNA, 22 bp, Homo sapiens
tagttaggaatagcagcgactc

SEQ ID NO: 8767208 - DNA, 22 bp, Homo sapiens
tagttagagaagccacagtgga

SEQ ID NO: 8767209 - DNA, 22 bp, Homo sapiens
tagttaggggaaaaacgacagg

SEQ ID NO: 8767210 - DNA, 22 bp, Homo sapiens
tagttcaacgagttggggttgc

SEQ ID NO: 8767211 - DNA, 23 bp, Homo sapiens
tagttattttctctgtaatttgc

SEQ ID NO: 8767212 - DNA, 22 bp, Homo sapiens
tagttcaaccgtcttctcccct

SEQ ID NO: 8767213 - DNA, 22 bp, Homo sapiens
tagttcaaagtctgtcaaagga

SEQ ID NO: 8767214 - DNA, 22 bp, Homo sapiens
tagttattattgttactatcag

SEQ ID NO: 8767215 - DNA, 22 bp, Homo sapiens
tagttattgcctaggagcagct

SEQ ID NO: 8767216 - DNA, 21 bp, Homo sapiens
tagttcaagttctttcagttc

SEQ ID NO: 8767217 - DNA, 22 bp, Homo sapiens
tagttctagccagtgaaatgta

SEQ ID NO: 8767218 - DNA, 22 bp, Homo sapiens
tagttctataagcagatagagt

SEQ ID NO: 8767219 - DNA, 22 bp, Homo sapiens
tagttctataagcagatagagt

SEQ ID NO: 8767220 - DNA, 22 bp, Homo sapiens
tagttctagaccagttaatagt

SEQ ID NO: 8767221 - DNA, 22 bp, Homo sapiens
tagtttatagttagcgagcacg

SEQ ID NO: 8767222 - DNA, 22 bp, Homo sapiens
tagtttatgattttttggaagg

SEQ ID NO: 8767223 - DNA, 22 bp, Homo sapiens
tagtttatgattttttggaagg

SEQ ID NO: 8767224 - DNA, 22 bp, Homo sapiens
tagtttatgctgctgcagtgag

SEQ ID NO: 8767225 - DNA, 22 bp, Homo sapiens
tagtttatgctgctgcagtgag

SEQ ID NO: 8767226 - DNA, 22 bp, Homo sapiens
tagtttcatatgcaaaatagta

SEQ ID NO: 8767227 - DNA, 22 bp, Homo sapiens
tagtttcatatgcaaaatagta

SEQ ID NO: 8767228 - DNA, 22 bp, Homo sapiens
tagtttcagattgctttcatat

SEQ ID NO: 8767229 - DNA, 22 bp, Homo sapiens
tagtttcagattgctttcatat

SEQ ID NO: 8767230 - DNA, 22 bp, Homo sapiens
tagtttcagctccttcatcctg

SEQ ID NO: 8767231 - DNA, 22 bp, Homo sapiens
tagtttcagattgctttcatat

SEQ ID NO: 8767232 - DNA, 22 bp, Homo sapiens
tagtttcatctccaccctgccc

SEQ ID NO: 8767233 - DNA, 22 bp, Homo sapiens
tagtttcatatgcaaaatagta

SEQ ID NO: 8767234 - DNA, 22 bp, Homo sapiens
tagtttcagctccttcatcctg

SEQ ID NO: 8767235 - DNA, 22 bp, Homo sapiens
tagtttcctaggctgtattgtt

SEQ ID NO: 8767236 - DNA, 22 bp, Homo sapiens
tagtttttaagtgtacaatttc

SEQ ID NO: 8767237 - DNA, 22 bp, Homo sapiens
tagtttttaagtgtacaatttc

SEQ ID NO: 8767238 - DNA, 22 bp, Homo sapiens
tagtttttaagtgtacaatttc

SEQ ID NO: 8767239 - DNA, 22 bp, Homo sapiens
tagtttttaagtgtacaatttc

SEQ ID NO: 8767240 - DNA, 22 bp, Homo sapiens
tagttttatgaattggtataat

SEQ ID NO: 8767241 - DNA, 22 bp, Homo sapiens
tagtttttaagtgtacaatttc

SEQ ID NO: 8767242 - DNA, 22 bp, Homo sapiens
tagttttgattagtattgtctt

SEQ ID NO: 8767243 - DNA, 22 bp, Homo sapiens
tagtttttaagtgtacaatttc

SEQ ID NO: 8767244 - DNA, 22 bp, Homo sapiens
tagttttataatgttaacatct

SEQ ID NO: 8767245 - DNA, 22 bp, Homo sapiens
tagtttctaaagcttcctaggt

SEQ ID NO: 8767246 - DNA, 22 bp, Homo sapiens
tagtttctaaagcttcctaggt

SEQ ID NO: 8767247 - DNA, 22 bp, Homo sapiens
tagtttctaaactgaactgtca

SEQ ID NO: 8767248 - DNA, 18 bp, Homo sapiens
tagtttctaatggccttt

SEQ ID NO: 8767249 - DNA, 18 bp, Homo sapiens
tagtttctaatggccttt

SEQ ID NO: 8767250 - DNA, 22 bp, Homo sapiens
tagttacaaaccaacaggcagc

SEQ ID NO: 8767251 - DNA, 22 bp, Homo sapiens
tagttacagagaaatgatttga

SEQ ID NO: 8767252 - DNA, 22 bp, Homo sapiens
tagtggaactgtgtcatacaaa

SEQ ID NO: 8767253 - DNA, 22 bp, Homo sapiens
tagtggagaagtggagtctgtg

SEQ ID NO: 8767254 - DNA, 22 bp, Homo sapiens
tagtgctttattgttcctgaaa

SEQ ID NO: 8767255 - DNA, 22 bp, Homo sapiens
tagtgcttaataaatttcagaa

SEQ ID NO: 8767256 - DNA, 22 bp, Homo sapiens
tagtgccctcccctttgggata

SEQ ID NO: 8767257 - DNA, 22 bp, Homo sapiens
tagtgccatcttgagctgcttt

SEQ ID NO: 8767258 - DNA, 22 bp, Homo sapiens
tagtgccattcaagaggtagtt

SEQ ID NO: 8767259 - DNA, 22 bp, Homo sapiens
taggggagctcgggtgcaatcg

SEQ ID NO: 8767260 - DNA, 22 bp, Homo sapiens
taggggagctcgggtgcaatcg

SEQ ID NO: 8767261 - DNA, 22 bp, Homo sapiens
taggggaattgcagtgtgtcca

SEQ ID NO: 8767262 - DNA, 22 bp, Homo sapiens
taggggaactggcacagggcag

SEQ ID NO: 8767263 - DNA, 22 bp, Homo sapiens
taggggaggggatcatgtgctg

SEQ ID NO: 8767264 - DNA, 22 bp, Homo sapiens
taggggaggccaggaagtttta

SEQ ID NO: 8767265 - DNA, 22 bp, Homo sapiens
taggggcagaagcggcggtcca

SEQ ID NO: 8767266 - DNA, 22 bp, Homo sapiens
taggggcagaagcggcggtcca

SEQ ID NO: 8767267 - DNA, 21 bp, Homo sapiens
tagggggcagtgggatgctta

SEQ ID NO: 8767268 - DNA, 18 bp, Homo sapiens
tagtgcatgaaaggttca

SEQ ID NO: 8767269 - DNA, 22 bp, Homo sapiens
tagtgcatacctaacatttttg

SEQ ID NO: 8767270 - DNA, 22 bp, Homo sapiens
tagtgcaaaggccctgagatgg

SEQ ID NO: 8767271 - DNA, 22 bp, Homo sapiens
tagtctctgttcccacaatgcc

SEQ ID NO: 8767272 - DNA, 22 bp, Homo sapiens
tagtctctgttgctgctttcat

SEQ ID NO: 8767273 - DNA, 22 bp, Homo sapiens
tagtctctgtggtcctgaggaa

SEQ ID NO: 8767274 - DNA, 22 bp, Homo sapiens
tagtctctgtggtcctgaggaa

SEQ ID NO: 8767275 - DNA, 22 bp, Homo sapiens
tagtctctggagactctagggg

SEQ ID NO: 8767276 - DNA, 22 bp, Homo sapiens
tagtctctggagactctagggg

SEQ ID NO: 8767277 - DNA, 22 bp, Homo sapiens
taggggtcttgttggcatcacg

SEQ ID NO: 8767278 - DNA, 22 bp, Homo sapiens
taggggtcccactctcagagtt

SEQ ID NO: 8767279 - DNA, 19 bp, Homo sapiens
tagtctctgatgaggcttt

SEQ ID NO: 8767280 - DNA, 22 bp, Homo sapiens
tagtctctatgagtgaatcaca

SEQ ID NO: 8767281 - DNA, 22 bp, Homo sapiens
tagtctctgctttgcccttggc

SEQ ID NO: 8767282 - DNA, 19 bp, Homo sapiens
tagtctctgatgaggcttt

SEQ ID NO: 8767283 - DNA, 19 bp, Homo sapiens
tagtctctgatgaggcttt

SEQ ID NO: 8767284 - DNA, 21 bp, Homo sapiens
taggcagaggagcaggtatct

SEQ ID NO: 8767285 - DNA, 21 bp, Homo sapiens
taggcagaggagcaggtatct

SEQ ID NO: 8767286 - DNA, 22 bp, Homo sapiens
taggcagaggtatggtaaggac

SEQ ID NO: 8767287 - DNA, 22 bp, Homo sapiens
taggcagagtttaatggttaag

SEQ ID NO: 8767288 - DNA, 22 bp, Homo sapiens
taggcagatgttaacaggaaaa

SEQ ID NO: 8767289 - DNA, 23 bp, Homo sapiens
taggcaggactcagatatgacag

SEQ ID NO: 8767290 - DNA, 20 bp, Homo sapiens
taggcagcttgacccttggt

SEQ ID NO: 8767291 - DNA, 22 bp, Homo sapiens
taggcagcgcttggctgtgctt

SEQ ID NO: 8767292 - DNA, 22 bp, Homo sapiens
taggcagattccatattttggc

SEQ ID NO: 8767293 - DNA, 22 bp, Homo sapiens
taggccaggaatcagcaagctt

SEQ ID NO: 8767294 - DNA, 22 bp, Homo sapiens
taggccaggagtcagacagatt

SEQ ID NO: 8767295 - DNA, 22 bp, Homo sapiens
taggccagcccttagtcctgtc

SEQ ID NO: 8767296 - DNA, 22 bp, Homo sapiens
taggccaggaatcagcaagctt

SEQ ID NO: 8767297 - DNA, 22 bp, Homo sapiens
taggccagcccttagtcctgtc

SEQ ID NO: 8767298 - DNA, 22 bp, Homo sapiens
taggcagggattagggttgatt

SEQ ID NO: 8767299 - DNA, 22 bp, Homo sapiens
taggcaggctgaatgtagattt

SEQ ID NO: 8767300 - DNA, 22 bp, Homo sapiens
taggcaggctgaatgtagattt

SEQ ID NO: 8767301 - DNA, 20 bp, Homo sapiens
taggcagagctgtgcagcct

SEQ ID NO: 8767302 - DNA, 22 bp, Homo sapiens
taggcagagaggccataagaat

SEQ ID NO: 8767303 - DNA, 22 bp, Homo sapiens
taggcagagaggccataagaat

SEQ ID NO: 8767304 - DNA, 22 bp, Homo sapiens
taggcagaattgttgaatgaag

SEQ ID NO: 8767305 - DNA, 22 bp, Homo sapiens
taggcagaattgtgggctctaa

SEQ ID NO: 8767306 - DNA, 22 bp, Homo sapiens
taggcagaattcattgtgctgc

SEQ ID NO: 8767307 - DNA, 22 bp, Homo sapiens
tagctgtgtagacactcagagc

SEQ ID NO: 8767308 - DNA, 22 bp, Homo sapiens
tagctgtggccttgctggtctg

SEQ ID NO: 8767309 - DNA, 22 bp, Homo sapiens
tagctgtccagtgagtcccttt

SEQ ID NO: 8767310 - DNA, 22 bp, Homo sapiens
tagctgggttgaggtcatctac

SEQ ID NO: 8767311 - DNA, 22 bp, Homo sapiens
tagctgggttgaggtcatctac

SEQ ID NO: 8767312 - DNA, 22 bp, Homo sapiens
tagctggttaatgcagaaggag

SEQ ID NO: 8767313 - DNA, 22 bp, Homo sapiens
tagctggggctttcattcttgc

SEQ ID NO: 8767314 - DNA, 22 bp, Homo sapiens
tagctggggctttcattcttgc

SEQ ID NO: 8767315 - DNA, 22 bp, Homo sapiens
tagctgggtctctgttttctca

SEQ ID NO: 8767316 - DNA, 22 bp, Homo sapiens
tagctgggtctctgttttctca

SEQ ID NO: 8767317 - DNA, 22 bp, Homo sapiens
tagctgggagtgtctgatgggt

SEQ ID NO: 8767318 - DNA, 22 bp, Homo sapiens
tagctgggagtgtctgatgggt

SEQ ID NO: 8767319 - DNA, 22 bp, Homo sapiens
tagctgggaattatctggttgc

SEQ ID NO: 8767320 - DNA, 22 bp, Homo sapiens
tagctgggactactggccctgc

SEQ ID NO: 8767321 - DNA, 22 bp, Homo sapiens
tagctgggagtgtctgatgggt

SEQ ID NO: 8767322 - DNA, 22 bp, Homo sapiens
tagggcagagtccaggatgggc

SEQ ID NO: 8767323 - DNA, 22 bp, Homo sapiens
tagggcagccacccaggctgct

SEQ ID NO: 8767324 - DNA, 22 bp, Homo sapiens
tagggcagccacccaggctgct

SEQ ID NO: 8767325 - DNA, 22 bp, Homo sapiens
tagggcagattcggtggagttt

SEQ ID NO: 8767326 - DNA, 22 bp, Homo sapiens
taggccatgcagcaaagaggct

SEQ ID NO: 8767327 - DNA, 22 bp, Homo sapiens
tagggcagagtccaggatgggc

SEQ ID NO: 8767328 - DNA, 22 bp, Homo sapiens
tagggcagctgcatcaggcact

SEQ ID NO: 8767329 - DNA, 22 bp, Homo sapiens
tagggcagccttatagctccca

SEQ ID NO: 8767330 - DNA, 22 bp, Homo sapiens
tagggctgaggcaacaagggag

SEQ ID NO: 8767331 - DNA, 21 bp, Homo sapiens
tagggctctatttttatttca

SEQ ID NO: 8767332 - DNA, 23 bp, Homo sapiens
tagggcagctgggagggacatgc

SEQ ID NO: 8767333 - DNA, 22 bp, Homo sapiens
tagggcagctgcatcaggcact

SEQ ID NO: 8767334 - DNA, 22 bp, Homo sapiens
tagggctgtggtcagtcctcta

SEQ ID NO: 8767335 - DNA, 16 bp, Homo sapiens
tagggctgggaaggag

SEQ ID NO: 8767336 - DNA, 22 bp, Homo sapiens
tagggctggcgtgctcagggaa

SEQ ID NO: 8767337 - DNA, 22 bp, Homo sapiens
tagggctggcgtgctcagggaa

SEQ ID NO: 8767338 - DNA, 22 bp, Homo sapiens
tagggctgggtacactcttgcc

SEQ ID NO: 8767339 - DNA, 22 bp, Homo sapiens
tagggctgtgtctccaggacca

SEQ ID NO: 8767340 - DNA, 22 bp, Homo sapiens
tagggctgttagtaattctcag

SEQ ID NO: 8767341 - DNA, 22 bp, Homo sapiens
tagggctgtttaaaagtgaggt

SEQ ID NO: 8767342 - DNA, 22 bp, Homo sapiens
tagggctgtttaaaagtgaggt

SEQ ID NO: 8767343 - DNA, 22 bp, Homo sapiens
tagggcttagaaaagaatttac

SEQ ID NO: 8767344 - DNA, 22 bp, Homo sapiens
tagggcttcaggtgtgaggcag

SEQ ID NO: 8767345 - DNA, 22 bp, Homo sapiens
tagggctggcgtgctcagggaa

SEQ ID NO: 8767346 - DNA, 22 bp, Homo sapiens
tagggctgctgcagatgacagg

SEQ ID NO: 8767347 - DNA, 22 bp, Homo sapiens
tagggctgctttgtattctgct

SEQ ID NO: 8767348 - DNA, 19 bp, Homo sapiens
tagggctggccgggcggtg

SEQ ID NO: 8767349 - DNA, 22 bp, Homo sapiens
tagggctgcagaacaatggcct

SEQ ID NO: 8767350 - DNA, 22 bp, Homo sapiens
tagggctgccatttgcttttct

SEQ ID NO: 8767351 - DNA, 22 bp, Homo sapiens
tagggctgcctatggctagata

SEQ ID NO: 8767352 - DNA, 22 bp, Homo sapiens
tagcagggtctcaggagtcagg

SEQ ID NO: 8767353 - DNA, 20 bp, Homo sapiens
tagctgcacagccctaggag

SEQ ID NO: 8767354 - DNA, 22 bp, Homo sapiens
tagctgagagctcacttgagga

SEQ ID NO: 8767355 - DNA, 22 bp, Homo sapiens
tagctgagaggccaattgaact

SEQ ID NO: 8767356 - DNA, 22 bp, Homo sapiens
tagcagggtaaatgtagatgga

SEQ ID NO: 8767357 - DNA, 18 bp, Homo sapiens
tagcagggcttgtccttt

SEQ ID NO: 8767358 - DNA, 22 bp, Homo sapiens
tagcaggggtagatagagtgtg

SEQ ID NO: 8767359 - DNA, 22 bp, Homo sapiens
tagcagggtccaatgtgaggca

SEQ ID NO: 8767360 - DNA, 22 bp, Homo sapiens
tagctgcttctcacatgggcaa

SEQ ID NO: 8767361 - DNA, 22 bp, Homo sapiens
tagctgcttcagtctaggtctc

SEQ ID NO: 8767362 - DNA, 22 bp, Homo sapiens
tagctgcttcagtctaggtctc

SEQ ID NO: 8767363 - DNA, 22 bp, Homo sapiens
tagctgggaattatctggttgc

SEQ ID NO: 8767364 - DNA, 22 bp, Homo sapiens
tagcagggaaggtgtgctgagc

SEQ ID NO: 8767365 - DNA, 22 bp, Homo sapiens
tagcagggagggccagtgtcaa

SEQ ID NO: 8767366 - DNA, 22 bp, Homo sapiens
tagcagggaagatgatcagaat

SEQ ID NO: 8767367 - DNA, 22 bp, Homo sapiens
tagcagggatacaaggtcgcct

SEQ ID NO: 8767368 - DNA, 22 bp, Homo sapiens
tagcagggccaggctgggaacc

SEQ ID NO: 8767369 - DNA, 22 bp, Homo sapiens
tagcagctggggctattcatca

SEQ ID NO: 8767370 - DNA, 22 bp, Homo sapiens
tagcagctgtcagtttcacata

SEQ ID NO: 8767371 - DNA, 22 bp, Homo sapiens
tagcagctgtgagtaaaagcca

SEQ ID NO: 8767372 - DNA, 22 bp, Homo sapiens
tagcagctgtcagtttcacata

SEQ ID NO: 8767373 - DNA, 22 bp, Homo sapiens
tagcagctgtggaggggctgtg

SEQ ID NO: 8767374 - DNA, 22 bp, Homo sapiens
tagcagctgtcagtttcacata

SEQ ID NO: 8767375 - DNA, 22 bp, Homo sapiens
tagcagcttaagtaattagaat

SEQ ID NO: 8767376 - DNA, 22 bp, Homo sapiens
tagcagctgcatcattttacag

SEQ ID NO: 8767377 - DNA, 22 bp, Homo sapiens
tagcagctggggctattcatca

SEQ ID NO: 8767378 - DNA, 19 bp, Homo sapiens
tagcagctgccaaaggaga

SEQ ID NO: 8767379 - DNA, 19 bp, Homo sapiens
tagcagctgccaaaggaga

SEQ ID NO: 8767380 - DNA, 22 bp, Homo sapiens
tagcagctgcatcattttacag

SEQ ID NO: 8767381 - DNA, 22 bp, Homo sapiens
tagcagcttccagagagggcag

SEQ ID NO: 8767382 - DNA, 22 bp, Homo sapiens
tagcagcttaagtaattagaat

SEQ ID NO: 8767383 - DNA, 22 bp, Homo sapiens
tagcaggaaggttcagggccct

SEQ ID NO: 8767384 - DNA, 22 bp, Homo sapiens
tagatctgatacaattcatctg

SEQ ID NO: 8767385 - DNA, 22 bp, Homo sapiens
tagatctgatacaattcatctg

SEQ ID NO: 8767386 - DNA, 22 bp, Homo sapiens
tagatgaaaggtctagcacagt

SEQ ID NO: 8767387 - DNA, 22 bp, Homo sapiens
tagatgaaatgtgtgttattat

SEQ ID NO: 8767388 - DNA, 22 bp, Homo sapiens
tagatgaaatttgtgtgtatgc

SEQ ID NO: 8767389 - DNA, 21 bp, Homo sapiens
tagatgaaatcagagtatttc

SEQ ID NO: 8767390 - DNA, 22 bp, Homo sapiens
tagatgaaagagggcctgtgag

SEQ ID NO: 8767391 - DNA, 22 bp, Homo sapiens
tagatgaattagcaattatctt

SEQ ID NO: 8767392 - DNA, 22 bp, Homo sapiens
tagatgaattagcaattatctt

SEQ ID NO: 8767393 - DNA, 22 bp, Homo sapiens
tagatgaccttgtgttaggcaa

SEQ ID NO: 8767394 - DNA, 22 bp, Homo sapiens
tagatgaagcaacatgtgtaat

SEQ ID NO: 8767395 - DNA, 22 bp, Homo sapiens
tagatgaagagggtaggtagat

SEQ ID NO: 8767396 - DNA, 22 bp, Homo sapiens
tagatgaactgcctctcagcaa

SEQ ID NO: 8767397 - DNA, 22 bp, Homo sapiens
tagatgaacagaaagccactgt

SEQ ID NO: 8767398 - DNA, 22 bp, Homo sapiens
tagatgaaggctgagcacctgt

SEQ ID NO: 8767399 - DNA, 22 bp, Homo sapiens
tagatgaatgacttatatgtca

SEQ ID NO: 8767400 - DNA, 22 bp, Homo sapiens
tagatgaatgtgaaaggctctt

SEQ ID NO: 8767401 - DNA, 22 bp, Homo sapiens
tagatgaaggggttcagcatgg

SEQ ID NO: 8767402 - DNA, 22 bp, Homo sapiens
tagcaaagaggagacctaggca

SEQ ID NO: 8767403 - DNA, 22 bp, Homo sapiens
tagcaaagaggagacctaggca

SEQ ID NO: 8767404 - DNA, 18 bp, Homo sapiens
tagcaaagatgtggattg

SEQ ID NO: 8767405 - DNA, 22 bp, Homo sapiens
tagcaaagaccaaagctagttg

SEQ ID NO: 8767406 - DNA, 21 bp, Homo sapiens
tagcaaagccagatgtatatt

SEQ ID NO: 8767407 - DNA, 22 bp, Homo sapiens
tagcaaagctccgtagttattt

SEQ ID NO: 8767408 - DNA, 22 bp, Homo sapiens
tagcaaagcgaaagagatttat

SEQ ID NO: 8767409 - DNA, 22 bp, Homo sapiens
tagcaaaatgtggatgtagttg

SEQ ID NO: 8767410 - DNA, 22 bp, Homo sapiens
tagcaaaatgtggatgtagttg

SEQ ID NO: 8767411 - DNA, 22 bp, Homo sapiens
tagcaaactcatacatgtgggt

SEQ ID NO: 8767412 - DNA, 22 bp, Homo sapiens
tagcaaaatgtggatgtagttg

SEQ ID NO: 8767413 - DNA, 22 bp, Homo sapiens
tagcaaaatgtggatgtagttg

SEQ ID NO: 8767414 - DNA, 21 bp, Homo sapiens
tagcaaatggagagtaagaga

SEQ ID NO: 8767415 - DNA, 22 bp, Homo sapiens
tagcaaatgggcttgttttcca

SEQ ID NO: 8767416 - DNA, 22 bp, Homo sapiens
tagcaaatacatgatgtaattt

SEQ ID NO: 8767417 - DNA, 22 bp, Homo sapiens
tagcaaataaaacagtattgaa

SEQ ID NO: 8767418 - DNA, 23 bp, Homo sapiens
tagcaaagttgtttgggaaattt

SEQ ID NO: 8767419 - DNA, 22 bp, Homo sapiens
tagcaaagggaaagaagggcct

SEQ ID NO: 8767420 - DNA, 22 bp, Homo sapiens
tagcaaaggccttggacacgct

SEQ ID NO: 8767421 - DNA, 22 bp, Homo sapiens
tagcaaaggatgactatgtacc

SEQ ID NO: 8767422 - DNA, 21 bp, Homo sapiens
tagcaaattgctattaaggca

SEQ ID NO: 8767423 - DNA, 22 bp, Homo sapiens
tagcaacaagtgactatctata

SEQ ID NO: 8767424 - DNA, 22 bp, Homo sapiens
tagcaacaatggaagtaacttc

SEQ ID NO: 8767425 - DNA, 22 bp, Homo sapiens
tagcaacagaaaataggagtgc

SEQ ID NO: 8767426 - DNA, 22 bp, Homo sapiens
tagcaacagcaatagtggtatt

SEQ ID NO: 8767427 - DNA, 22 bp, Homo sapiens
tagcagctcctaaacagtggtg

SEQ ID NO: 8767428 - DNA, 22 bp, Homo sapiens
tagcaagaagggagatggggtt

SEQ ID NO: 8767429 - DNA, 22 bp, Homo sapiens
tagcaagaagctgtcacaggtg

SEQ ID NO: 8767430 - DNA, 22 bp, Homo sapiens
tagcaagaagggagatggggtt

SEQ ID NO: 8767431 - DNA, 22 bp, Homo sapiens
tagcaagaagctgtcacaggtg

SEQ ID NO: 8767432 - DNA, 22 bp, Homo sapiens
tagcagctctttactaaccagt

SEQ ID NO: 8767433 - DNA, 22 bp, Homo sapiens
tagcagctctgattctgggccc

SEQ ID NO: 8767434 - DNA, 22 bp, Homo sapiens
tagcaaccagaacagcactcta

SEQ ID NO: 8767435 - DNA, 22 bp, Homo sapiens
tagcaacctatggatagagaag

SEQ ID NO: 8767436 - DNA, 22 bp, Homo sapiens
tagcaacctatggatagagaag

SEQ ID NO: 8767437 - DNA, 22 bp, Homo sapiens
tagcaactgctctattctagga

SEQ ID NO: 8767438 - DNA, 22 bp, Homo sapiens
tagagaggccgcgggtcccctc

SEQ ID NO: 8767439 - DNA, 22 bp, Homo sapiens
tagagagagctgtggtggctct

SEQ ID NO: 8767440 - DNA, 22 bp, Homo sapiens
tagagtaacacaaacgaattgg

SEQ ID NO: 8767441 - DNA, 22 bp, Homo sapiens
tagagaggtttgaattggctgc

SEQ ID NO: 8767442 - DNA, 22 bp, Homo sapiens
tagagtatagctaactgtatta

SEQ ID NO: 8767443 - DNA, 22 bp, Homo sapiens
tagagtatataggcctttgtgt

SEQ ID NO: 8767444 - DNA, 22 bp, Homo sapiens
tagagtccattaatgcaagttt

SEQ ID NO: 8767445 - DNA, 22 bp, Homo sapiens
tagagacaccagtaccattctg

SEQ ID NO: 8767446 - DNA, 22 bp, Homo sapiens
tagagaatggccttgaagtagt

SEQ ID NO: 8767447 - DNA, 22 bp, Homo sapiens
tagagagagctgtggtggctct

SEQ ID NO: 8767448 - DNA, 22 bp, Homo sapiens
tagagagagatatatacacaca

SEQ ID NO: 8767449 - DNA, 22 bp, Homo sapiens
tagagagagatatatacacaca

SEQ ID NO: 8767450 - DNA, 22 bp, Homo sapiens
tagagagagctgtggtggctct

SEQ ID NO: 8767451 - DNA, 20 bp, Homo sapiens
tagagagaggatattaaagt

SEQ ID NO: 8767452 - DNA, 20 bp, Homo sapiens
tagacttttcatcaacctta

SEQ ID NO: 8767453 - DNA, 20 bp, Homo sapiens
tagacttttcatcaacctta

SEQ ID NO: 8767454 - DNA, 22 bp, Homo sapiens
tagacttttcaaaatctagacc

SEQ ID NO: 8767455 - DNA, 22 bp, Homo sapiens
tagacttttcaaaatctagacc

SEQ ID NO: 8767456 - DNA, 19 bp, Homo sapiens
tagacttttccagcaggca

SEQ ID NO: 8767457 - DNA, 22 bp, Homo sapiens
tagacttttcaaaatctagacc

SEQ ID NO: 8767458 - DNA, 22 bp, Homo sapiens
tagacttttaagtccctcttta

SEQ ID NO: 8767459 - DNA, 22 bp, Homo sapiens
tagactttgatattgtacaccc

SEQ ID NO: 8767460 - DNA, 22 bp, Homo sapiens
tagagaaaaccactggtgagct

SEQ ID NO: 8767461 - DNA, 22 bp, Homo sapiens
tagagaaaaccactggtgagct

SEQ ID NO: 8767462 - DNA, 21 bp, Homo sapiens
tagagaaaagaagctgttcct

SEQ ID NO: 8767463 - DNA, 22 bp, Homo sapiens
tagagaaacagaaccaacaggg

SEQ ID NO: 8767464 - DNA, 22 bp, Homo sapiens
tagagaaacagaaccaacaggg

SEQ ID NO: 8767465 - DNA, 22 bp, Homo sapiens
tagagaaaagcagggatcagga

SEQ ID NO: 8767466 - DNA, 22 bp, Homo sapiens
tagagaaataagctttgccttg

SEQ ID NO: 8767467 - DNA, 22 bp, Homo sapiens
tagagaaataagctttgccttg

SEQ ID NO: 8767468 - DNA, 22 bp, Homo sapiens
tagagaaacagaaccaacaggg

SEQ ID NO: 8767469 - DNA, 22 bp, Homo sapiens
tagagaaacagaaccaacaggg

SEQ ID NO: 8767470 - DNA, 23 bp, Homo sapiens
tagagaaagccaccgagtctctc

SEQ ID NO: 8767471 - DNA, 22 bp, Homo sapiens
tagagtcctgtgtgctctgtgg

SEQ ID NO: 8767472 - DNA, 22 bp, Homo sapiens
tagagtcctgtgtgctctgtgg

SEQ ID NO: 8767473 - DNA, 22 bp, Homo sapiens
tagagtccttcattctgtgcag

SEQ ID NO: 8767474 - DNA, 22 bp, Homo sapiens
tagagtccttcattctgtgcag

SEQ ID NO: 8767475 - DNA, 22 bp, Homo sapiens
tagagtctagtgtatacaaagt

SEQ ID NO: 8767476 - DNA, 22 bp, Homo sapiens
tagatacatacattttaaaatg

SEQ ID NO: 8767477 - DNA, 22 bp, Homo sapiens
tagagtctagtgtatacaaagt

SEQ ID NO: 8767478 - DNA, 22 bp, Homo sapiens
tagatacagtgttaagtgtgga

SEQ ID NO: 8767479 - DNA, 22 bp, Homo sapiens
tagatacatgaaatggcagata

SEQ ID NO: 8767480 - DNA, 22 bp, Homo sapiens
tagatacatttttctttcctgt

SEQ ID NO: 8767481 - DNA, 22 bp, Homo sapiens
tagatagataaaatgttgcaga

SEQ ID NO: 8767482 - DNA, 19 bp, Homo sapiens
tagatactgatgaactcca

SEQ ID NO: 8767483 - DNA, 22 bp, Homo sapiens
tagatacctgctggacctcatt

SEQ ID NO: 8767484 - DNA, 22 bp, Homo sapiens
tagatacctgctggacctcatt

SEQ ID NO: 8767485 - DNA, 22 bp, Homo sapiens
tagatcagtgcataaaggaatg

SEQ ID NO: 8767486 - DNA, 22 bp, Homo sapiens
tagatccagctgttatgttatg

SEQ ID NO: 8767487 - DNA, 22 bp, Homo sapiens
tagatccagctgttatgttatg

SEQ ID NO: 8767488 - DNA, 21 bp, Homo sapiens
tagatcatggtattctttggc

SEQ ID NO: 8767489 - DNA, 22 bp, Homo sapiens
tagatatatctgtcatactggt

SEQ ID NO: 8767490 - DNA, 22 bp, Homo sapiens
tagatatgacagcagaacaagc

SEQ ID NO: 8767491 - DNA, 22 bp, Homo sapiens
tagatatcagaaatagaattta

SEQ ID NO: 8767492 - DNA, 22 bp, Homo sapiens
tagatataggacagtactgtat

SEQ ID NO: 8767493 - DNA, 22 bp, Homo sapiens
tagatataaggtccttagaaca

SEQ ID NO: 8767494 - DNA, 22 bp, Homo sapiens
tagacagatttcttgttagaca

SEQ ID NO: 8767495 - DNA, 22 bp, Homo sapiens
tagacagatttcttgttagaca

SEQ ID NO: 8767496 - DNA, 21 bp, Homo sapiens
tagaagcacataggttcaaag

SEQ ID NO: 8767497 - DNA, 22 bp, Homo sapiens
tagacaggaaacattaggatgg

SEQ ID NO: 8767498 - DNA, 22 bp, Homo sapiens
tagaccaggttgaccaggtagg

SEQ ID NO: 8767499 - DNA, 22 bp, Homo sapiens
tagaccaggggagtcaacaggt

SEQ ID NO: 8767500 - DNA, 22 bp, Homo sapiens
tagaccaggcccacacacgggg

SEQ ID NO: 8767501 - DNA, 22 bp, Homo sapiens
tagaccaggttgaccaggtagg

SEQ ID NO: 8767502 - DNA, 22 bp, Homo sapiens
tagacctgaaatatggacctgg

SEQ ID NO: 8767503 - DNA, 22 bp, Homo sapiens
tagacctgcagacctgggcccc

SEQ ID NO: 8767504 - DNA, 22 bp, Homo sapiens
tagactagaggatcagcaaggg

SEQ ID NO: 8767505 - DNA, 22 bp, Homo sapiens
tagactggtgaattagggggaa

SEQ ID NO: 8767506 - DNA, 18 bp, Homo sapiens
tagactgctttctcagag

SEQ ID NO: 8767507 - DNA, 22 bp, Homo sapiens
tagactttccagcctgctgctt

SEQ ID NO: 8767508 - DNA, 22 bp, Homo sapiens
tagactgtgagctccttgaggg

SEQ ID NO: 8767509 - DNA, 22 bp, Homo sapiens
tagactatagctcacagtgctt

SEQ ID NO: 8767510 - DNA, 22 bp, Homo sapiens
tagactatagctcacagtgctt

SEQ ID NO: 8767511 - DNA, 22 bp, Homo sapiens
tagactatttcttttgcatagg

SEQ ID NO: 8767512 - DNA, 19 bp, Homo sapiens
tagactctaatgttaagct

SEQ ID NO: 8767513 - DNA, 22 bp, Homo sapiens
tagactctgcatttacctccca

SEQ ID NO: 8767514 - DNA, 22 bp, Homo sapiens
tagactcagacagaaaatgtgt

SEQ ID NO: 8767515 - DNA, 23 bp, Homo sapiens
tagactgcaggctccttgagggc

SEQ ID NO: 8767516 - DNA, 22 bp, Homo sapiens
tagaagcacagcctgatggaca

SEQ ID NO: 8767517 - DNA, 22 bp, Homo sapiens
tagaagattctaaagtggagag

SEQ ID NO: 8767518 - DNA, 22 bp, Homo sapiens
tagaagattccagaggcaaagc

SEQ ID NO: 8767519 - DNA, 22 bp, Homo sapiens
tagaagatgccttaaagttgaa

SEQ ID NO: 8767520 - DNA, 22 bp, Homo sapiens
tagaagaaaagcacttagagat

SEQ ID NO: 8767521 - DNA, 20 bp, Homo sapiens
tagaacttttcagtatggat

SEQ ID NO: 8767522 - DNA, 22 bp, Homo sapiens
tagaactttcagaaattccaaa

SEQ ID NO: 8767523 - DNA, 22 bp, Homo sapiens
tagaagataagacaagtgctgc

SEQ ID NO: 8767524 - DNA, 22 bp, Homo sapiens
tagaagaacatgtcaaactata

SEQ ID NO: 8767525 - DNA, 22 bp, Homo sapiens
tagaacatgggatagagttttt

SEQ ID NO: 8767526 - DNA, 22 bp, Homo sapiens
tagaacatgggatagagttttt

SEQ ID NO: 8767527 - DNA, 22 bp, Homo sapiens
tagaacatgctcatgtataaat

SEQ ID NO: 8767528 - DNA, 22 bp, Homo sapiens
tagaacatgctcatgtataaat

SEQ ID NO: 8767529 - DNA, 22 bp, Homo sapiens
tagaacatgctcatgtataaat

SEQ ID NO: 8767530 - DNA, 22 bp, Homo sapiens
tagaacatgtgaaaatatagcc

SEQ ID NO: 8767531 - DNA, 22 bp, Homo sapiens
tagaacatgtgaaaatatagcc

SEQ ID NO: 8767532 - DNA, 22 bp, Homo sapiens
tagaaccaccttctcctttacc

SEQ ID NO: 8767533 - DNA, 22 bp, Homo sapiens
tagaacatgtgaaaatatagcc

SEQ ID NO: 8767534 - DNA, 22 bp, Homo sapiens
tagaacatgacttatttttgga

SEQ ID NO: 8767535 - DNA, 22 bp, Homo sapiens
tagaacatgacttatttttgga

SEQ ID NO: 8767536 - DNA, 23 bp, Homo sapiens
tagaacatcggtgtcttggagca

SEQ ID NO: 8767537 - DNA, 22 bp, Homo sapiens
tagaaatgggttacatttagag

SEQ ID NO: 8767538 - DNA, 22 bp, Homo sapiens
tagaaatggggaagtagttagg

SEQ ID NO: 8767539 - DNA, 22 bp, Homo sapiens
tagaaatgggttacatttagag

SEQ ID NO: 8767540 - DNA, 22 bp, Homo sapiens
tagaaatgggttacatttagag

SEQ ID NO: 8767541 - DNA, 22 bp, Homo sapiens
tagaaatggggaagtagttagg

SEQ ID NO: 8767542 - DNA, 22 bp, Homo sapiens
tagaactctggtcttctcatcc

SEQ ID NO: 8767543 - DNA, 22 bp, Homo sapiens
tagaactaagagttatcattta

SEQ ID NO: 8767544 - DNA, 22 bp, Homo sapiens
tagaactaaagaacaactttga

SEQ ID NO: 8767545 - DNA, 22 bp, Homo sapiens
tagaactaagagttatcattta

SEQ ID NO: 8767546 - DNA, 22 bp, Homo sapiens
tagaacctctgattatgttact

SEQ ID NO: 8767547 - DNA, 19 bp, Homo sapiens
tagaacctggatttcagga

SEQ ID NO: 8767548 - DNA, 22 bp, Homo sapiens
tagaacctcataagaatcgaaa

SEQ ID NO: 8767549 - DNA, 22 bp, Homo sapiens
tagaacctccacaggacctcca

SEQ ID NO: 8767550 - DNA, 22 bp, Homo sapiens
tagaacctccagagtggccccc

SEQ ID NO: 8767551 - DNA, 22 bp, Homo sapiens
tagaacctattagaaatgtatt

SEQ ID NO: 8767552 - DNA, 22 bp, Homo sapiens
tagaaccagtccacagaatttg

SEQ ID NO: 8767553 - DNA, 22 bp, Homo sapiens
tagaacttcttacagctaagtt

SEQ ID NO: 8767554 - DNA, 22 bp, Homo sapiens
tagaacttccaattcagggctg

SEQ ID NO: 8767555 - DNA, 22 bp, Homo sapiens
tagaacttattagaaaggctca

SEQ ID NO: 8767556 - DNA, 22 bp, Homo sapiens
tagaacttatttggcattattt

SEQ ID NO: 8767557 - DNA, 22 bp, Homo sapiens
tagaacttgaatgtgaaatcag

SEQ ID NO: 8767558 - DNA, 22 bp, Homo sapiens
tagaacttgagatcaggtcttc

SEQ ID NO: 8767559 - DNA, 22 bp, Homo sapiens
tagaacttgtgaaatatcaatg

SEQ ID NO: 8767560 - DNA, 22 bp, Homo sapiens
tagaacttgatagacagtacaa

SEQ ID NO: 8767561 - DNA, 22 bp, Homo sapiens
tagaacttaaatatgttttccc

SEQ ID NO: 8767562 - DNA, 22 bp, Homo sapiens
tagaacttagcactagacttgt

SEQ ID NO: 8767563 - DNA, 22 bp, Homo sapiens
tagaacttagcactagacttgt

SEQ ID NO: 8767564 - DNA, 22 bp, Homo sapiens
taatatatacctttgttaggaa

SEQ ID NO: 8767565 - DNA, 22 bp, Homo sapiens
taatataccaaactgtaatttt

SEQ ID NO: 8767566 - DNA, 22 bp, Homo sapiens
taatatacttcccatagtttga

SEQ ID NO: 8767567 - DNA, 22 bp, Homo sapiens
taatagtttcataatgtgcttc

SEQ ID NO: 8767568 - DNA, 22 bp, Homo sapiens
taatagtttcataatgtgcttc

SEQ ID NO: 8767569 - DNA, 22 bp, Homo sapiens
taatatacttcccatagtttga

SEQ ID NO: 8767570 - DNA, 22 bp, Homo sapiens
taatataccaaactgtaatttt

SEQ ID NO: 8767571 - DNA, 22 bp, Homo sapiens
taaggaatatcataagaagtag

SEQ ID NO: 8767572 - DNA, 22 bp, Homo sapiens
taaggaggctgctgtgaagaaa

SEQ ID NO: 8767573 - DNA, 22 bp, Homo sapiens
taatagtcacatttaagtttgg

SEQ ID NO: 8767574 - DNA, 22 bp, Homo sapiens
taaggattaaataagaatattt

SEQ ID NO: 8767575 - DNA, 22 bp, Homo sapiens
taaggattaaataagaatattt

SEQ ID NO: 8767576 - DNA, 22 bp, Homo sapiens
taaggattaaataagaatattt

SEQ ID NO: 8767577 - DNA, 22 bp, Homo sapiens
taatagttgtgactttgtaaag

SEQ ID NO: 8767578 - DNA, 22 bp, Homo sapiens
taatagtcattgtataccttgg

SEQ ID NO: 8767579 - DNA, 22 bp, Homo sapiens
taatagttatggttggttctca

SEQ ID NO: 8767580 - DNA, 22 bp, Homo sapiens
taaggaaggggaaagacatgtc

SEQ ID NO: 8767581 - DNA, 22 bp, Homo sapiens
taaggaaggggaaagacatgtc

SEQ ID NO: 8767582 - DNA, 22 bp, Homo sapiens
taaggaagtcacaagaatcgct

SEQ ID NO: 8767583 - DNA, 22 bp, Homo sapiens
taaggaaagtgccatgatttct

SEQ ID NO: 8767584 - DNA, 21 bp, Homo sapiens
taaggaagagcattttaggtc

SEQ ID NO: 8767585 - DNA, 22 bp, Homo sapiens
taaggaaagtacatgttttgac

SEQ ID NO: 8767586 - DNA, 22 bp, Homo sapiens
taaggaaacaacttgtattttt

SEQ ID NO: 8767587 - DNA, 22 bp, Homo sapiens
taaggaaagtacatgttttgac

SEQ ID NO: 8767588 - DNA, 22 bp, Homo sapiens
taaggaaagtgccatgatttct

SEQ ID NO: 8767589 - DNA, 22 bp, Homo sapiens
taaggaaacaacttgtattttt

SEQ ID NO: 8767590 - DNA, 22 bp, Homo sapiens
taaggaaacaacttgtattttt

SEQ ID NO: 8767591 - DNA, 22 bp, Homo sapiens
taagcattatggtaaagaagta

SEQ ID NO: 8767592 - DNA, 22 bp, Homo sapiens
taagcattaactctgctgcaag

SEQ ID NO: 8767593 - DNA, 22 bp, Homo sapiens
taagcatggtggtaaaagaggt

SEQ ID NO: 8767594 - DNA, 22 bp, Homo sapiens
taagcattcaatgcttagcact

SEQ ID NO: 8767595 - DNA, 22 bp, Homo sapiens
taagcccacatttttctgaaga

SEQ ID NO: 8767596 - DNA, 22 bp, Homo sapiens
taagccagatacaccactgaaa

SEQ ID NO: 8767597 - DNA, 22 bp, Homo sapiens
taagcccaggaatgcacttcag

SEQ ID NO: 8767598 - DNA, 22 bp, Homo sapiens
taagccagatacaccactgaaa

SEQ ID NO: 8767599 - DNA, 22 bp, Homo sapiens
taagcgtttgggagttatgaac

SEQ ID NO: 8767600 - DNA, 21 bp, Homo sapiens
taagctaaacattcagttaac

SEQ ID NO: 8767601 - DNA, 22 bp, Homo sapiens
taagcttcaaagaacatattgg

SEQ ID NO: 8767602 - DNA, 22 bp, Homo sapiens
taagcttcaaagaacatattgg

SEQ ID NO: 8767603 - DNA, 22 bp, Homo sapiens
taaggaaaatggacatcaaaca

SEQ ID NO: 8767604 - DNA, 22 bp, Homo sapiens
taattccacctttttccaactt

SEQ ID NO: 8767605 - DNA, 22 bp, Homo sapiens
taattccaagttgagacatgca

SEQ ID NO: 8767606 - DNA, 22 bp, Homo sapiens
taattccacctttttccaactt

SEQ ID NO: 8767607 - DNA, 21 bp, Homo sapiens
taattccagaggtcactgaag

SEQ ID NO: 8767608 - DNA, 22 bp, Homo sapiens
taattctagattgacattttga

SEQ ID NO: 8767609 - DNA, 22 bp, Homo sapiens
taattatttgaagacattagag

SEQ ID NO: 8767610 - DNA, 22 bp, Homo sapiens
taattattgtctgaagagttat

SEQ ID NO: 8767611 - DNA, 22 bp, Homo sapiens
taattcatgggcccagtgatat

SEQ ID NO: 8767612 - DNA, 22 bp, Homo sapiens
taatttatgatgcaaagaaaag

SEQ ID NO: 8767613 - DNA, 22 bp, Homo sapiens
taattgaactaacatgcaaaca

SEQ ID NO: 8767614 - DNA, 22 bp, Homo sapiens
taattgcagctatcattttagt

SEQ ID NO: 8767615 - DNA, 22 bp, Homo sapiens
taattgaactaacatgcaaaca

SEQ ID NO: 8767616 - DNA, 22 bp, Homo sapiens
taattgcagggagcctgggggc

SEQ ID NO: 8767617 - DNA, 22 bp, Homo sapiens
taattgcagggtgtcagaatac

SEQ ID NO: 8767618 - DNA, 23 bp, Homo sapiens
taattgcttgagttagtaataca

SEQ ID NO: 8767619 - DNA, 22 bp, Homo sapiens
taatttacttgcaaataacaat

SEQ ID NO: 8767620 - DNA, 22 bp, Homo sapiens
taatttacttgcaaataacaat

SEQ ID NO: 8767621 - DNA, 22 bp, Homo sapiens
taattgctgaactactatccct

SEQ ID NO: 8767622 - DNA, 22 bp, Homo sapiens
taattattctagtcacatagca

SEQ ID NO: 8767623 - DNA, 22 bp, Homo sapiens
taattattctagtcacatagca

SEQ ID NO: 8767624 - DNA, 22 bp, Homo sapiens
taattattatgacaacaattgc

SEQ ID NO: 8767625 - DNA, 22 bp, Homo sapiens
taattattatgacaacaattgc

SEQ ID NO: 8767626 - DNA, 22 bp, Homo sapiens
taattattatgacaacaattgc

SEQ ID NO: 8767627 - DNA, 21 bp, Homo sapiens
taatcttcgaaaatgtattag

SEQ ID NO: 8767628 - DNA, 21 bp, Homo sapiens
taatcttcgaaaatgtattag

SEQ ID NO: 8767629 - DNA, 22 bp, Homo sapiens
taatctgttgttaatattgact

SEQ ID NO: 8767630 - DNA, 22 bp, Homo sapiens
taatctgttaatatttgtatcc

SEQ ID NO: 8767631 - DNA, 22 bp, Homo sapiens
taatctgttgactaacttggga

SEQ ID NO: 8767632 - DNA, 22 bp, Homo sapiens
taatctgttgactaacttggga

SEQ ID NO: 8767633 - DNA, 22 bp, Homo sapiens
taatctgtaatttttgcaatag

SEQ ID NO: 8767634 - DNA, 22 bp, Homo sapiens
taatctgtaatttttgcaatag

SEQ ID NO: 8767635 - DNA, 22 bp, Homo sapiens
taatctgtgtaccttcatcgga

SEQ ID NO: 8767636 - DNA, 22 bp, Homo sapiens
taatctgtattcctactttgca

SEQ ID NO: 8767637 - DNA, 22 bp, Homo sapiens
taatctctttatgagaagaagg

SEQ ID NO: 8767638 - DNA, 22 bp, Homo sapiens
taatcctttaggttaaaagagg

SEQ ID NO: 8767639 - DNA, 22 bp, Homo sapiens
taatcctttatggttttcctcc

SEQ ID NO: 8767640 - DNA, 22 bp, Homo sapiens
taatcctttatggttttcctcc

SEQ ID NO: 8767641 - DNA, 22 bp, Homo sapiens
taatccttcttgtgttcattag

SEQ ID NO: 8767642 - DNA, 22 bp, Homo sapiens
taatccttgcttagtgtggggc

SEQ ID NO: 8767643 - DNA, 22 bp, Homo sapiens
taatctagaacatatgagagca

SEQ ID NO: 8767644 - DNA, 22 bp, Homo sapiens
taatctctctaagtttccattt

SEQ ID NO: 8767645 - DNA, 22 bp, Homo sapiens
taatctctctaagtttccattt

SEQ ID NO: 8767646 - DNA, 22 bp, Homo sapiens
taatctcttttaggacagagcc

SEQ ID NO: 8767647 - DNA, 22 bp, Homo sapiens
taatctctagcccatgcaaaga

SEQ ID NO: 8767648 - DNA, 22 bp, Homo sapiens
taatctatcaagcaacaaagtg

SEQ ID NO: 8767649 - DNA, 22 bp, Homo sapiens
taatctagtcccacatggaatt

SEQ ID NO: 8767650 - DNA, 22 bp, Homo sapiens
taatatatttctgctaagctca

SEQ ID NO: 8767651 - DNA, 22 bp, Homo sapiens
taatatctacttcatagagttt

SEQ ID NO: 8767652 - DNA, 22 bp, Homo sapiens
tacacaatgacttaagatgtca

SEQ ID NO: 8767653 - DNA, 22 bp, Homo sapiens
tacacaatgacttaagatgtca

SEQ ID NO: 8767654 - DNA, 22 bp, Homo sapiens
tacacaactgacaaccattctg

SEQ ID NO: 8767655 - DNA, 22 bp, Homo sapiens
tacaagattaaaacttatacca

SEQ ID NO: 8767656 - DNA, 22 bp, Homo sapiens
tacaagattaaaacttatacca

SEQ ID NO: 8767657 - DNA, 22 bp, Homo sapiens
tacaagctcacaaatttttaag

SEQ ID NO: 8767658 - DNA, 21 bp, Homo sapiens
tacaagatagaggtaatatat

SEQ ID NO: 8767659 - DNA, 21 bp, Homo sapiens
tacaagatagaggtaatatat

SEQ ID NO: 8767660 - DNA, 22 bp, Homo sapiens
tacaagataagaattggcaagg

SEQ ID NO: 8767661 - DNA, 22 bp, Homo sapiens
tacaagatgacaggtgcatgat

SEQ ID NO: 8767662 - DNA, 22 bp, Homo sapiens
tacaagatgtactaaaaattat

SEQ ID NO: 8767663 - DNA, 22 bp, Homo sapiens
tacaagagtgagattatcatgt

SEQ ID NO: 8767664 - DNA, 22 bp, Homo sapiens
tacaagataagaattggcaagg

SEQ ID NO: 8767665 - DNA, 22 bp, Homo sapiens
tacaagaggtatatagaaacag

SEQ ID NO: 8767666 - DNA, 22 bp, Homo sapiens
tacaagaggtatatagaaacag

SEQ ID NO: 8767667 - DNA, 22 bp, Homo sapiens
tacaagaggatgtggacatgga

SEQ ID NO: 8767668 - DNA, 22 bp, Homo sapiens
tacaagacgagggaagttcttt

SEQ ID NO: 8767669 - DNA, 21 bp, Homo sapiens
tacaagaccggattcgggccc

SEQ ID NO: 8767670 - DNA, 22 bp, Homo sapiens
tacaagaatgtcttaaaagctc

SEQ ID NO: 8767671 - DNA, 22 bp, Homo sapiens
tacaagaatgtcttaaaagctc

SEQ ID NO: 8767672 - DNA, 22 bp, Homo sapiens
tacaagaatgtcttaaaagctc

SEQ ID NO: 8767673 - DNA, 22 bp, Homo sapiens
tacaagaatttctttctggttg

SEQ ID NO: 8767674 - DNA, 22 bp, Homo sapiens
tacaagaatttctttctggttg

SEQ ID NO: 8767675 - DNA, 22 bp, Homo sapiens
tacaagagaactaatgtaagtc

SEQ ID NO: 8767676 - DNA, 22 bp, Homo sapiens
tacaagagacaccagggaggct

SEQ ID NO: 8767677 - DNA, 22 bp, Homo sapiens
tacaagagaactaatgtaagtc

SEQ ID NO: 8767678 - DNA, 22 bp, Homo sapiens
tacaagagaactaatgtaagtc

SEQ ID NO: 8767679 - DNA, 22 bp, Homo sapiens
tacaagagcagtaagcttgtcc

SEQ ID NO: 8767680 - DNA, 22 bp, Homo sapiens
tacaagaggatgtggacatgga

SEQ ID NO: 8767681 - DNA, 22 bp, Homo sapiens
tacaagagacaccagggaggct

SEQ ID NO: 8767682 - DNA, 22 bp, Homo sapiens
tacaagagacaccagggaggct

SEQ ID NO: 8767683 - DNA, 22 bp, Homo sapiens
tacaagagacaccagggaggct

SEQ ID NO: 8767684 - DNA, 22 bp, Homo sapiens
tacaagaaggaaaactagcaat

SEQ ID NO: 8767685 - DNA, 22 bp, Homo sapiens
tacaagaagaggcagagctgga

SEQ ID NO: 8767686 - DNA, 22 bp, Homo sapiens
tacaagaaggaaaactagcaat

SEQ ID NO: 8767687 - DNA, 22 bp, Homo sapiens
tacaagaaggatggagcccact

SEQ ID NO: 8767688 - DNA, 22 bp, Homo sapiens
tacaagaaggaaaactagcaat

SEQ ID NO: 8767689 - DNA, 22 bp, Homo sapiens
tacaagaaggaaaactagcaat

SEQ ID NO: 8767690 - DNA, 22 bp, Homo sapiens
tacaagaatgtcttaaaagctc

SEQ ID NO: 8767691 - DNA, 22 bp, Homo sapiens
tacaagaatgtcttaaaagctc

SEQ ID NO: 8767692 - DNA, 22 bp, Homo sapiens
tacaagaaggatggagcccact

SEQ ID NO: 8767693 - DNA, 22 bp, Homo sapiens
tacaagaaggatggagcccact

SEQ ID NO: 8767694 - DNA, 22 bp, Homo sapiens
tacaagaaggatggagcccact

SEQ ID NO: 8767695 - DNA, 20 bp, Homo sapiens
tacaagaatccccagttgtc

SEQ ID NO: 8767696 - DNA, 20 bp, Homo sapiens
tacaagaatccccagttgtc

SEQ ID NO: 8767697 - DNA, 22 bp, Homo sapiens
tacaagaaatttctgcatatat

SEQ ID NO: 8767698 - DNA, 22 bp, Homo sapiens
tacaagaaagtccagtgggttt

SEQ ID NO: 8767699 - DNA, 22 bp, Homo sapiens
tacaagaagaggcagagctgga

SEQ ID NO: 8767700 - DNA, 22 bp, Homo sapiens
tacaagaaagtccagtgggttt

SEQ ID NO: 8767701 - DNA, 22 bp, Homo sapiens
tacaagaaatttctgcatatat

SEQ ID NO: 8767702 - DNA, 22 bp, Homo sapiens
tacaagaaagtccagtgggttt

SEQ ID NO: 8767703 - DNA, 22 bp, Homo sapiens
tacaagaaactacatgaatgca

SEQ ID NO: 8767704 - DNA, 22 bp, Homo sapiens
tacaagaaactacatgaatgca

SEQ ID NO: 8767705 - DNA, 22 bp, Homo sapiens
tacaagaaactacatgaatgca

SEQ ID NO: 8767706 - DNA, 22 bp, Homo sapiens
tacaagaaactacatgaatgca

SEQ ID NO: 8767707 - DNA, 22 bp, Homo sapiens
tacaactgcacatctgaatcac

SEQ ID NO: 8767708 - DNA, 22 bp, Homo sapiens
tacaactgtgtgaaggaatctg

SEQ ID NO: 8767709 - DNA, 17 bp, Homo sapiens
tacaactgttgtttata

SEQ ID NO: 8767710 - DNA, 22 bp, Homo sapiens
tacaacattgtgttgcttcata

SEQ ID NO: 8767711 - DNA, 22 bp, Homo sapiens
tacaacattgtgttgcttcata

SEQ ID NO: 8767712 - DNA, 22 bp, Homo sapiens
tacaacatttacgttaggctgt

SEQ ID NO: 8767713 - DNA, 22 bp, Homo sapiens
taatttatgatgcaaagaaaag

SEQ ID NO: 8767714 - DNA, 22 bp, Homo sapiens
taatttatggtatgtgtgtaat

SEQ ID NO: 8767715 - DNA, 21 bp, Homo sapiens
taatttattcagcacagtgtt

SEQ ID NO: 8767716 - DNA, 21 bp, Homo sapiens
taatttattcagcacagtgtt

SEQ ID NO: 8767717 - DNA, 21 bp, Homo sapiens
taatttattcagcacagtgtt

SEQ ID NO: 8767718 - DNA, 21 bp, Homo sapiens
taatttattcagcacagtgtt

SEQ ID NO: 8767719 - DNA, 22 bp, Homo sapiens
taatttatttcaactgccaagg

SEQ ID NO: 8767720 - DNA, 22 bp, Homo sapiens
tacaacatgtggtcctttatga

SEQ ID NO: 8767721 - DNA, 22 bp, Homo sapiens
tacaacatgtggtcctttatga

SEQ ID NO: 8767722 - DNA, 22 bp, Homo sapiens
tacaacataacgggcattcagt

SEQ ID NO: 8767723 - DNA, 22 bp, Homo sapiens
tacacagtaaatggtaaataca

SEQ ID NO: 8767724 - DNA, 22 bp, Homo sapiens
tacacagtagagtataatgcgt

SEQ ID NO: 8767725 - DNA, 22 bp, Homo sapiens
tacacagaaattgtgtagggat

SEQ ID NO: 8767726 - DNA, 22 bp, Homo sapiens
tacacagaaattgtgtagggat

SEQ ID NO: 8767727 - DNA, 22 bp, Homo sapiens
tacacagaaattgtgtagggat

SEQ ID NO: 8767728 - DNA, 22 bp, Homo sapiens
tacacagaacctggtgtacagt

SEQ ID NO: 8767729 - DNA, 22 bp, Homo sapiens
tacacagaacctggtgtacagt

SEQ ID NO: 8767730 - DNA, 22 bp, Homo sapiens
tacacagaacctggtgtacagt

SEQ ID NO: 8767731 - DNA, 22 bp, Homo sapiens
tacacagaacctggtgtacagt

SEQ ID NO: 8767732 - DNA, 22 bp, Homo sapiens
tacacagttttgctcccatgat

SEQ ID NO: 8767733 - DNA, 22 bp, Homo sapiens
tacacataaaatgctcatggta

SEQ ID NO: 8767734 - DNA, 22 bp, Homo sapiens
tacacataaaatgctcatggta

SEQ ID NO: 8767735 - DNA, 22 bp, Homo sapiens
tacacataaaatgctcatggta

SEQ ID NO: 8767736 - DNA, 22 bp, Homo sapiens
tacacatacattgcttacaagg

SEQ ID NO: 8767737 - DNA, 22 bp, Homo sapiens
tacacatacattgcttacaagg

SEQ ID NO: 8767738 - DNA, 22 bp, Homo sapiens
tacacatacaccaatgtggtca

SEQ ID NO: 8767739 - DNA, 22 bp, Homo sapiens
tacacacagaggccatgggatt

SEQ ID NO: 8767740 - DNA, 22 bp, Homo sapiens
tacacacagaggccatgggatt

SEQ ID NO: 8767741 - DNA, 22 bp, Homo sapiens
tacacacagaggccatgggatt

SEQ ID NO: 8767742 - DNA, 22 bp, Homo sapiens
tacacaattctggatgcatgtc

SEQ ID NO: 8767743 - DNA, 22 bp, Homo sapiens
tacacaatgacttaagatgtca

SEQ ID NO: 8767744 - DNA, 22 bp, Homo sapiens
tacacaattagttgcaaagtga

SEQ ID NO: 8767745 - DNA, 22 bp, Homo sapiens
tacacacatgcatttgccttat

SEQ ID NO: 8767746 - DNA, 22 bp, Homo sapiens
tacacacatgcatttgccttat

SEQ ID NO: 8767747 - DNA, 22 bp, Homo sapiens
tacacacatgcatttgccttat

SEQ ID NO: 8767748 - DNA, 22 bp, Homo sapiens
tacacacatgcatttgccttat

SEQ ID NO: 8767749 - DNA, 22 bp, Homo sapiens
tacacactgtgataatgaagca

SEQ ID NO: 8767750 - DNA, 22 bp, Homo sapiens
tacacactgtgataatgaagca

SEQ ID NO: 8767751 - DNA, 22 bp, Homo sapiens
tacacataggagggtaataaaa

SEQ ID NO: 8767752 - DNA, 22 bp, Homo sapiens
tacacatacattgcttacaagg

SEQ ID NO: 8767753 - DNA, 22 bp, Homo sapiens
tacacatacattgcttacaagg

SEQ ID NO: 8767754 - DNA, 22 bp, Homo sapiens
tacacataggagggtaataaaa

SEQ ID NO: 8767755 - DNA, 22 bp, Homo sapiens
tacacataggagggtaataaaa

SEQ ID NO: 8767756 - DNA, 22 bp, Homo sapiens
tacagaataaagcgtgaagctt

SEQ ID NO: 8767757 - DNA, 22 bp, Homo sapiens
tacacataggtctgaataaaaa

SEQ ID NO: 8767758 - DNA, 22 bp, Homo sapiens
tacagaataaagcgtgaagctt

SEQ ID NO: 8767759 - DNA, 22 bp, Homo sapiens
tacagaatagaatagggacagg

SEQ ID NO: 8767760 - DNA, 22 bp, Homo sapiens
tacacataggtctgaataaaaa

SEQ ID NO: 8767761 - DNA, 22 bp, Homo sapiens
tacacataggtctgaataaaaa

SEQ ID NO: 8767762 - DNA, 22 bp, Homo sapiens
tacacataggtctgaataaaaa

SEQ ID NO: 8767763 - DNA, 22 bp, Homo sapiens
tacagaatatttctgccctgag

SEQ ID NO: 8767764 - DNA, 22 bp, Homo sapiens
tacagaatatagaagctggaag

SEQ ID NO: 8767765 - DNA, 22 bp, Homo sapiens
tacagaatatagaagctggaag

SEQ ID NO: 8767766 - DNA, 22 bp, Homo sapiens
tacagaatctatgcttcacagt

SEQ ID NO: 8767767 - DNA, 20 bp, Homo sapiens
tacagaatgcaataaaatgg

SEQ ID NO: 8767768 - DNA, 20 bp, Homo sapiens
tacagaatgcaataaaatgg

SEQ ID NO: 8767769 - DNA, 20 bp, Homo sapiens
tacagaatgcaataaaatgg

SEQ ID NO: 8767770 - DNA, 22 bp, Homo sapiens
tacagaatgatgtgtttaaata

SEQ ID NO: 8767771 - DNA, 22 bp, Homo sapiens
tacagacaaagtgctatagggt

SEQ ID NO: 8767772 - DNA, 22 bp, Homo sapiens
tacagacaaagtgctatagggt

SEQ ID NO: 8767773 - DNA, 22 bp, Homo sapiens
tacagacaaagagcatgcggta

SEQ ID NO: 8767774 - DNA, 22 bp, Homo sapiens
tacagaattagattattagaga

SEQ ID NO: 8767775 - DNA, 22 bp, Homo sapiens
tacagaattagattattagaga

SEQ ID NO: 8767776 - DNA, 22 bp, Homo sapiens
tacagaattagattattagaga

SEQ ID NO: 8767777 - DNA, 22 bp, Homo sapiens
tacagaattagattattagaga

SEQ ID NO: 8767778 - DNA, 22 bp, Homo sapiens
tacagaatgtgtatcattacca

SEQ ID NO: 8767779 - DNA, 22 bp, Homo sapiens
tacagaatgtgtatcattacca

SEQ ID NO: 8767780 - DNA, 21 bp, Homo sapiens
tacagaatgcgcttcagtctg

SEQ ID NO: 8767781 - DNA, 21 bp, Homo sapiens
tacagaatgcgcttcagtctg

SEQ ID NO: 8767782 - DNA, 22 bp, Homo sapiens
tacagaattagattattagaga

SEQ ID NO: 8767783 - DNA, 22 bp, Homo sapiens
tacagaatgttatgaagcatag

SEQ ID NO: 8767784 - DNA, 22 bp, Homo sapiens
tacagaatgttatgaagcatag

SEQ ID NO: 8767785 - DNA, 22 bp, Homo sapiens
tacagaatgttatgaagcatag

SEQ ID NO: 8767786 - DNA, 22 bp, Homo sapiens
tactataacttcgaagtcctgg

SEQ ID NO: 8767787 - DNA, 23 bp, Homo sapiens
tactataacgctgtgtcagctcc

SEQ ID NO: 8767788 - DNA, 22 bp, Homo sapiens
tactagtttttaggaaaagtga

SEQ ID NO: 8767789 - DNA, 22 bp, Homo sapiens
tactataaagtcttaatgagtc

SEQ ID NO: 8767790 - DNA, 22 bp, Homo sapiens
tactataaagtcttaatgagtc

SEQ ID NO: 8767791 - DNA, 22 bp, Homo sapiens
tactataaagtcttaatgagtc

SEQ ID NO: 8767792 - DNA, 22 bp, Homo sapiens
tactaggaagcagctgcattgg

SEQ ID NO: 8767793 - DNA, 22 bp, Homo sapiens
tactaggaagcagctgcattgg

SEQ ID NO: 8767794 - DNA, 22 bp, Homo sapiens
tactagaagctgtaatttttca

SEQ ID NO: 8767795 - DNA, 22 bp, Homo sapiens
tactagaaaaacacatgctctg

SEQ ID NO: 8767796 - DNA, 22 bp, Homo sapiens
taccattttgaaacatttcatc

SEQ ID NO: 8767797 - DNA, 22 bp, Homo sapiens
taccattttgaaacatttcatc

SEQ ID NO: 8767798 - DNA, 22 bp, Homo sapiens
tactacaagggccctaaaaggt

SEQ ID NO: 8767799 - DNA, 22 bp, Homo sapiens
taccatttgagagagaacataa

SEQ ID NO: 8767800 - DNA, 22 bp, Homo sapiens
taccatttctacatatcttgtc

SEQ ID NO: 8767801 - DNA, 22 bp, Homo sapiens
tactacatacagaatttagaga

SEQ ID NO: 8767802 - DNA, 22 bp, Homo sapiens
taccatttgagagagaacataa

SEQ ID NO: 8767803 - DNA, 22 bp, Homo sapiens
tactacattaataaaacattca

SEQ ID NO: 8767804 - DNA, 22 bp, Homo sapiens
tactactttcccccacatattt

SEQ ID NO: 8767805 - DNA, 22 bp, Homo sapiens
taccagggaacagggatattaa

SEQ ID NO: 8767806 - DNA, 22 bp, Homo sapiens
taccagtaatagtatgtgagat

SEQ ID NO: 8767807 - DNA, 22 bp, Homo sapiens
taccaggtctgtgcaggtgtca

SEQ ID NO: 8767808 - DNA, 22 bp, Homo sapiens
taccagtaatgtaactttgcaa

SEQ ID NO: 8767809 - DNA, 22 bp, Homo sapiens
taccagtaatgtaactttgcaa

SEQ ID NO: 8767810 - DNA, 22 bp, Homo sapiens
taccagtaattgcttgtgctgt

SEQ ID NO: 8767811 - DNA, 22 bp, Homo sapiens
taccataacgtaatgaacttga

SEQ ID NO: 8767812 - DNA, 19 bp, Homo sapiens
taccatccaagctggtttg

SEQ ID NO: 8767813 - DNA, 22 bp, Homo sapiens
taccattgtaccaaggtaattt

SEQ ID NO: 8767814 - DNA, 22 bp, Homo sapiens
taccatttacttgaaaataaaa

SEQ ID NO: 8767815 - DNA, 22 bp, Homo sapiens
taccatgatgtttgagttacta

SEQ ID NO: 8767816 - DNA, 19 bp, Homo sapiens
taccatgttgactttcctg

SEQ ID NO: 8767817 - DNA, 22 bp, Homo sapiens
taccatgtcaagcgagacatgt

SEQ ID NO: 8767818 - DNA, 22 bp, Homo sapiens
taccatgtcttcaataagtcta

SEQ ID NO: 8767819 - DNA, 22 bp, Homo sapiens
taccagcttccttcaagatgtg

SEQ ID NO: 8767820 - DNA, 22 bp, Homo sapiens
taccagctcacacaatctttgt

SEQ ID NO: 8767821 - DNA, 22 bp, Homo sapiens
taccagcctcagttgtgagccc

SEQ ID NO: 8767822 - DNA, 22 bp, Homo sapiens
taccagccttttaacatgggcc

SEQ ID NO: 8767823 - DNA, 22 bp, Homo sapiens
taccagcctgaccctgtctgac

SEQ ID NO: 8767824 - DNA, 22 bp, Homo sapiens
taccagcctctgttgggggtgg

SEQ ID NO: 8767825 - DNA, 22 bp, Homo sapiens
taccaatgataagacagataat

SEQ ID NO: 8767826 - DNA, 22 bp, Homo sapiens
taccacagtctgccattagatg

SEQ ID NO: 8767827 - DNA, 22 bp, Homo sapiens
taccaccatttgcctgctgtat

SEQ ID NO: 8767828 - DNA, 22 bp, Homo sapiens
taccacagtttatctattcagc

SEQ ID NO: 8767829 - DNA, 22 bp, Homo sapiens
tacttaaaactgatagaatctc

SEQ ID NO: 8767830 - DNA, 22 bp, Homo sapiens
tacttaaaactgatagaatctc

SEQ ID NO: 8767831 - DNA, 22 bp, Homo sapiens
tacttaaaaattatcaaagtgg

SEQ ID NO: 8767832 - DNA, 22 bp, Homo sapiens
tacttaatgccactgaattgta

SEQ ID NO: 8767833 - DNA, 22 bp, Homo sapiens
tacttaaataattgctgctatt

SEQ ID NO: 8767834 - DNA, 20 bp, Homo sapiens
tactgttgttgctgttgcca

SEQ ID NO: 8767835 - DNA, 22 bp, Homo sapiens
tactgtttcaagccctcacaga

SEQ ID NO: 8767836 - DNA, 22 bp, Homo sapiens
tactgtttcctgaagcagatgc

SEQ ID NO: 8767837 - DNA, 22 bp, Homo sapiens
tactgtttcaagccctcacaga

SEQ ID NO: 8767838 - DNA, 22 bp, Homo sapiens
tactgttacagggagtgttcaa

SEQ ID NO: 8767839 - DNA, 22 bp, Homo sapiens
tactgttttctataatggctgt

SEQ ID NO: 8767840 - DNA, 22 bp, Homo sapiens
tactgtttcctgaagcagatgc

SEQ ID NO: 8767841 - DNA, 22 bp, Homo sapiens
tactgtttgcagtttgcagtat

SEQ ID NO: 8767842 - DNA, 22 bp, Homo sapiens
tacttaaaaattatcaaagtgg

SEQ ID NO: 8767843 - DNA, 22 bp, Homo sapiens
tactgttttctttatagtacag

SEQ ID NO: 8767844 - DNA, 22 bp, Homo sapiens
tactgaaaatcctgcctgtcct

SEQ ID NO: 8767845 - DNA, 22 bp, Homo sapiens
tactgaaaaagaatccagacct

SEQ ID NO: 8767846 - DNA, 22 bp, Homo sapiens
tactgaaactcttgtaaatatc

SEQ ID NO: 8767847 - DNA, 22 bp, Homo sapiens
tactgaaactcttgtaaatatc

SEQ ID NO: 8767848 - DNA, 22 bp, Homo sapiens
tactgaaactcttgtaaatatc

SEQ ID NO: 8767849 - DNA, 22 bp, Homo sapiens
tactcttttagccccacagaga

SEQ ID NO: 8767850 - DNA, 22 bp, Homo sapiens
tactcttttagccccacagaga

SEQ ID NO: 8767851 - DNA, 22 bp, Homo sapiens
tactgaaaaagaatccagacct

SEQ ID NO: 8767852 - DNA, 22 bp, Homo sapiens
tactgaaaactgagtcttccgt

SEQ ID NO: 8767853 - DNA, 22 bp, Homo sapiens
tactgaaaagccacaaggacca

SEQ ID NO: 8767854 - DNA, 22 bp, Homo sapiens
tactcccaccatggctgatttc

SEQ ID NO: 8767855 - DNA, 22 bp, Homo sapiens
tactctaaaaagaagcagatct

SEQ ID NO: 8767856 - DNA, 22 bp, Homo sapiens
tactctctggaaattatagtga

SEQ ID NO: 8767857 - DNA, 22 bp, Homo sapiens
tactctcagggttagtacagga

SEQ ID NO: 8767858 - DNA, 22 bp, Homo sapiens
tactgaaagaatacataatttc

SEQ ID NO: 8767859 - DNA, 22 bp, Homo sapiens
tactgaaacttttcttcaactg

SEQ ID NO: 8767860 - DNA, 22 bp, Homo sapiens
tactgaaacttttcttcaactg

SEQ ID NO: 8767861 - DNA, 22 bp, Homo sapiens
tactgaaagaatacataatttc

SEQ ID NO: 8767862 - DNA, 22 bp, Homo sapiens
tactgtgtcttaggatgtggaa

SEQ ID NO: 8767863 - DNA, 22 bp, Homo sapiens
tactgtgtgaccctgggtaggt

SEQ ID NO: 8767864 - DNA, 22 bp, Homo sapiens
tactgtgtgcccagccgagctg

SEQ ID NO: 8767865 - DNA, 22 bp, Homo sapiens
tactgtgtggtgagctgtctcc

SEQ ID NO: 8767866 - DNA, 22 bp, Homo sapiens
tactgtgtgcccagccgagctg

SEQ ID NO: 8767867 - DNA, 22 bp, Homo sapiens
tactgtgttgtgctgaaaggga

SEQ ID NO: 8767868 - DNA, 22 bp, Homo sapiens
tacagtgtatgtatttgtaggt

SEQ ID NO: 8767869 - DNA, 22 bp, Homo sapiens
tacagtgtccctttttcagaca

SEQ ID NO: 8767870 - DNA, 22 bp, Homo sapiens
tacagtgtatgtatttgtaggt

SEQ ID NO: 8767871 - DNA, 22 bp, Homo sapiens
tacagtggggagctcaggagag

SEQ ID NO: 8767872 - DNA, 22 bp, Homo sapiens
tacagtgatagagagtagctat

SEQ ID NO: 8767873 - DNA, 22 bp, Homo sapiens
tacagtgatagagagtagctat

SEQ ID NO: 8767874 - DNA, 22 bp, Homo sapiens
tacagtgatttctactggtgtt

SEQ ID NO: 8767875 - DNA, 22 bp, Homo sapiens
tacagtgcatagaggcatgata

SEQ ID NO: 8767876 - DNA, 21 bp, Homo sapiens
tacagtgaggtgttaggatgt

SEQ ID NO: 8767877 - DNA, 22 bp, Homo sapiens
tacagtgaggtggtttccttta

SEQ ID NO: 8767878 - DNA, 22 bp, Homo sapiens
tacagtgagtggcagagccaga

SEQ ID NO: 8767879 - DNA, 22 bp, Homo sapiens
tacagtgatagagagtagctat

SEQ ID NO: 8767880 - DNA, 22 bp, Homo sapiens
tacagtgactggactttgtcat

SEQ ID NO: 8767881 - DNA, 22 bp, Homo sapiens
tacagtgactggactttgtcat

SEQ ID NO: 8767882 - DNA, 22 bp, Homo sapiens
tacagtgacagatagggataga

SEQ ID NO: 8767883 - DNA, 22 bp, Homo sapiens
tacagtgacctagaataaatac

SEQ ID NO: 8767884 - DNA, 22 bp, Homo sapiens
tacagtctctttgagtgattgt

SEQ ID NO: 8767885 - DNA, 22 bp, Homo sapiens
tacagtgaatgaatggctgtgc

SEQ ID NO: 8767886 - DNA, 22 bp, Homo sapiens
tacagtctctgataactgtcag

SEQ ID NO: 8767887 - DNA, 21 bp, Homo sapiens
tacagtctcccctgttgtcca

SEQ ID NO: 8767888 - DNA, 22 bp, Homo sapiens
tacagtcagagtgcctttctaa

SEQ ID NO: 8767889 - DNA, 22 bp, Homo sapiens
tacagtcagagtgcctttctaa

SEQ ID NO: 8767890 - DNA, 22 bp, Homo sapiens
tacagtatttgaagaatatgag

SEQ ID NO: 8767891 - DNA, 18 bp, Homo sapiens
tacagtattttctcgcct

SEQ ID NO: 8767892 - DNA, 18 bp, Homo sapiens
tacagtattttctcgcct

SEQ ID NO: 8767893 - DNA, 22 bp, Homo sapiens
tacagtcaacattgatgatgat

SEQ ID NO: 8767894 - DNA, 22 bp, Homo sapiens
tacagtcagagtgcctttctaa

SEQ ID NO: 8767895 - DNA, 22 bp, Homo sapiens
tacagtaggattttcagggtct

SEQ ID NO: 8767896 - DNA, 22 bp, Homo sapiens
tacagagtaatttgcatgggga

SEQ ID NO: 8767897 - DNA, 22 bp, Homo sapiens
tacagtagtatcttcatttgtt

SEQ ID NO: 8767898 - DNA, 22 bp, Homo sapiens
tacagtagtaagaatgccttat

SEQ ID NO: 8767899 - DNA, 22 bp, Homo sapiens
tacagtagtatcttcatttgtt

SEQ ID NO: 8767900 - DNA, 22 bp, Homo sapiens
tacagtatagaatgtgtattaa

SEQ ID NO: 8767901 - DNA, 22 bp, Homo sapiens
tacagagggtaattgatcaagg

SEQ ID NO: 8767902 - DNA, 22 bp, Homo sapiens
tacagagggtaattgatcaagg

SEQ ID NO: 8767903 - DNA, 22 bp, Homo sapiens
tacagaggggacatggaagaca

SEQ ID NO: 8767904 - DNA, 22 bp, Homo sapiens
tacagaggggacatggaagaca

SEQ ID NO: 8767905 - DNA, 22 bp, Homo sapiens
tacagaggggacatggaagaca

SEQ ID NO: 8767906 - DNA, 22 bp, Homo sapiens
tacagagggattatctaagggt

SEQ ID NO: 8767907 - DNA, 22 bp, Homo sapiens
tacagaggctgggttttcaggg

SEQ ID NO: 8767908 - DNA, 22 bp, Homo sapiens
tacagagggattatctaagggt

SEQ ID NO: 8767909 - DNA, 22 bp, Homo sapiens
tacagaggcacatgcaattttc

SEQ ID NO: 8767910 - DNA, 22 bp, Homo sapiens
tacagaggctgggttttcaggg

SEQ ID NO: 8767911 - DNA, 22 bp, Homo sapiens
tacagtatggaaaatgtatagt

SEQ ID NO: 8767912 - DNA, 22 bp, Homo sapiens
tacagtatggaaaatgtatagt

SEQ ID NO: 8767913 - DNA, 22 bp, Homo sapiens
tacagtatggaaaatgtatagt

SEQ ID NO: 8767914 - DNA, 22 bp, Homo sapiens
tacagtatggaaaatgtatagt

SEQ ID NO: 8767915 - DNA, 22 bp, Homo sapiens
tacagtatatactgtgtgtaga

SEQ ID NO: 8767916 - DNA, 22 bp, Homo sapiens
tacagtatatactgtgtgtaga

SEQ ID NO: 8767917 - DNA, 22 bp, Homo sapiens
tacagtatagaatgtgtattaa

SEQ ID NO: 8767918 - DNA, 22 bp, Homo sapiens
tacagtagtcgtcttattttga

SEQ ID NO: 8767919 - DNA, 22 bp, Homo sapiens
tacagtatcttctggcaagcat

SEQ ID NO: 8767920 - DNA, 22 bp, Homo sapiens
tacagtattatgagtgattgaa

SEQ ID NO: 8767921 - DNA, 22 bp, Homo sapiens
tacagtattatgagtgattgaa

SEQ ID NO: 8767922 - DNA, 22 bp, Homo sapiens
tacagtatttgaagaatatgag

SEQ ID NO: 8767923 - DNA, 22 bp, Homo sapiens
tacagtattactgtgttgtttt

SEQ ID NO: 8767924 - DNA, 22 bp, Homo sapiens
tacagtattactgtgttgtttt

SEQ ID NO: 8767925 - DNA, 22 bp, Homo sapiens
tacagtattactgtgttgtttt

SEQ ID NO: 8767926 - DNA, 22 bp, Homo sapiens
tacagtatgttcttgaatttgg

SEQ ID NO: 8767927 - DNA, 22 bp, Homo sapiens
tacagtatgttcttgaatttgg

SEQ ID NO: 8767928 - DNA, 22 bp, Homo sapiens
tacagaggagaccaaggctcag

SEQ ID NO: 8767929 - DNA, 22 bp, Homo sapiens
tacagaggaggggattttaata

SEQ ID NO: 8767930 - DNA, 22 bp, Homo sapiens
tacagaggagaccaaggctcag

SEQ ID NO: 8767931 - DNA, 22 bp, Homo sapiens
tacagaggagaccaaggctcag

SEQ ID NO: 8767932 - DNA, 22 bp, Homo sapiens
tacagaggaggtggttgggagt

SEQ ID NO: 8767933 - DNA, 22 bp, Homo sapiens
tacagaggcacatgcaattttc

SEQ ID NO: 8767934 - DNA, 22 bp, Homo sapiens
tacagaggaggggattttaata

SEQ ID NO: 8767935 - DNA, 22 bp, Homo sapiens
tacagaggaggtggttgggagt

SEQ ID NO: 8767936 - DNA, 22 bp, Homo sapiens
tacagaggaggtggttgggagt

SEQ ID NO: 8767937 - DNA, 22 bp, Homo sapiens
tacagagatttattgctaaggc

SEQ ID NO: 8767938 - DNA, 22 bp, Homo sapiens
tacagagatttattgctaaggc

SEQ ID NO: 8767939 - DNA, 22 bp, Homo sapiens
tacagagatttattgctaaggc

SEQ ID NO: 8767940 - DNA, 22 bp, Homo sapiens
tacagagatgtgaaaagctcta

SEQ ID NO: 8767941 - DNA, 22 bp, Homo sapiens
tacagagatgccgaagagtgaa

SEQ ID NO: 8767942 - DNA, 22 bp, Homo sapiens
tacagagatactctagatcaaa

SEQ ID NO: 8767943 - DNA, 22 bp, Homo sapiens
tacagagatactctagatcaaa

SEQ ID NO: 8767944 - DNA, 22 bp, Homo sapiens
tacagagatgccgaagagtgaa

SEQ ID NO: 8767945 - DNA, 22 bp, Homo sapiens
tacagagatgccgaagagtgaa

SEQ ID NO: 8767946 - DNA, 22 bp, Homo sapiens
tacagagatgccgaagagtgaa

SEQ ID NO: 8767947 - DNA, 22 bp, Homo sapiens
tacagagatgccgaagagtgaa

SEQ ID NO: 8767948 - DNA, 22 bp, Homo sapiens
tacagagatactctagatcaaa

SEQ ID NO: 8767949 - DNA, 22 bp, Homo sapiens
tacagagagtacagcatccaca

SEQ ID NO: 8767950 - DNA, 20 bp, Homo sapiens
tacagacatgacaataatgg

SEQ ID NO: 8767951 - DNA, 20 bp, Homo sapiens
tacagacatgacaataatgg

SEQ ID NO: 8767952 - DNA, 22 bp, Homo sapiens
tacagtgtgacatttctacaaa

SEQ ID NO: 8767953 - DNA, 22 bp, Homo sapiens
tacagtgtctggatatcaaagg

SEQ ID NO: 8767954 - DNA, 22 bp, Homo sapiens
tacagtgtctggatatcaaagg

SEQ ID NO: 8767955 - DNA, 22 bp, Homo sapiens
tacagttaaaaagttcaatggt

SEQ ID NO: 8767956 - DNA, 22 bp, Homo sapiens
tacagttaaaaagttcaatggt

SEQ ID NO: 8767957 - DNA, 22 bp, Homo sapiens
tacagttaaaaagttcaatggt

SEQ ID NO: 8767958 - DNA, 22 bp, Homo sapiens
tacatgaacaaaatagcagaaa

SEQ ID NO: 8767959 - DNA, 22 bp, Homo sapiens
tacatgaacaaaatagcagaaa

SEQ ID NO: 8767960 - DNA, 22 bp, Homo sapiens
tacatgaagaaaattaagcagt

SEQ ID NO: 8767961 - DNA, 22 bp, Homo sapiens
tacatgaagatgaatgtatggc

SEQ ID NO: 8767962 - DNA, 22 bp, Homo sapiens
tacatgaacctttatgtgtgat

SEQ ID NO: 8767963 - DNA, 22 bp, Homo sapiens
tacatgaagaaaattaagcagt

SEQ ID NO: 8767964 - DNA, 22 bp, Homo sapiens
tacatgaagttgtctaaactgg

SEQ ID NO: 8767965 - DNA, 21 bp, Homo sapiens
tacatgaagctggtgtttgtc

SEQ ID NO: 8767966 - DNA, 22 bp, Homo sapiens
tacatgaatgtttcaatattgt

SEQ ID NO: 8767967 - DNA, 22 bp, Homo sapiens
tacatgaatgtttcaatattgt

SEQ ID NO: 8767968 - DNA, 22 bp, Homo sapiens
tacatgcacatgaacatgtgtg

SEQ ID NO: 8767969 - DNA, 22 bp, Homo sapiens
tacatgacctagacttgctaaa

SEQ ID NO: 8767970 - DNA, 22 bp, Homo sapiens
tacatgacctagacttgctaaa

SEQ ID NO: 8767971 - DNA, 21 bp, Homo sapiens
tacatgagtgtatgagcatat

SEQ ID NO: 8767972 - DNA, 20 bp, Homo sapiens
tacatgagccctggcctcac

SEQ ID NO: 8767973 - DNA, 22 bp, Homo sapiens
tacatgaatttgagtcagagga

SEQ ID NO: 8767974 - DNA, 22 bp, Homo sapiens
tacatgaatttgagtcagagga

SEQ ID NO: 8767975 - DNA, 22 bp, Homo sapiens
tacatgaatgtttcaatattgt

SEQ ID NO: 8767976 - DNA, 22 bp, Homo sapiens
tacatgaatgtttcaatattgt

SEQ ID NO: 8767977 - DNA, 18 bp, Homo sapiens
tacatgcataaatgaagc

SEQ ID NO: 8767978 - DNA, 22 bp, Homo sapiens
tacatgtaattttcatagtaag

SEQ ID NO: 8767979 - DNA, 22 bp, Homo sapiens
tacatggtggtggcacttgact

SEQ ID NO: 8767980 - DNA, 22 bp, Homo sapiens
tacatgtaagacatgagactct

SEQ ID NO: 8767981 - DNA, 18 bp, Homo sapiens
tacatgccagagagttac

SEQ ID NO: 8767982 - DNA, 22 bp, Homo sapiens
tacatgcatgtgtgtaaatata

SEQ ID NO: 8767983 - DNA, 22 bp, Homo sapiens
tacatgcatgtgtgtaaatata

SEQ ID NO: 8767984 - DNA, 22 bp, Homo sapiens
tacatgcatgtcacagaatgaa

SEQ ID NO: 8767985 - DNA, 22 bp, Homo sapiens
tacatgtatgtgttaatatctg

SEQ ID NO: 8767986 - DNA, 22 bp, Homo sapiens
tacatgtatgtgtacgtgcatg

SEQ ID NO: 8767987 - DNA, 22 bp, Homo sapiens
tacatgtagttcactggtggca

SEQ ID NO: 8767988 - DNA, 22 bp, Homo sapiens
tacatgtaggtgacattttaat

SEQ ID NO: 8767989 - DNA, 22 bp, Homo sapiens
tacatgtacattgggcattaat

SEQ ID NO: 8767990 - DNA, 22 bp, Homo sapiens
tacatgtaggtgacattttaat

SEQ ID NO: 8767991 - DNA, 19 bp, Homo sapiens
taccaatcccttggtttac

SEQ ID NO: 8767992 - DNA, 22 bp, Homo sapiens
taccaaggtagtggagacagaa

SEQ ID NO: 8767993 - DNA, 22 bp, Homo sapiens
taccaaggtagtggagacagaa

SEQ ID NO: 8767994 - DNA, 22 bp, Homo sapiens
taccaagtgataataggaaagc

SEQ ID NO: 8767995 - DNA, 21 bp, Homo sapiens
taccaagaagtttgggaaagc

SEQ ID NO: 8767996 - DNA, 22 bp, Homo sapiens
taccaaatgtaatcattctaat

SEQ ID NO: 8767997 - DNA, 19 bp, Homo sapiens
taccaaattgcattatggc

SEQ ID NO: 8767998 - DNA, 18 bp, Homo sapiens
taccaaattctggatgtc

SEQ ID NO: 8767999 - DNA, 22 bp, Homo sapiens
taagagaactggatagatagga

SEQ ID NO: 8768000 - DNA, 22 bp, Homo sapiens
taagagaactggatagatagga

SEQ ID NO: 8768001 - DNA, 22 bp, Homo sapiens
taagacttgatccaaagaacta

SEQ ID NO: 8768002 - DNA, 22 bp, Homo sapiens
taagacttcattagtaatatgg

SEQ ID NO: 8768003 - DNA, 22 bp, Homo sapiens
taagagaaggatctgttccagg

SEQ ID NO: 8768004 - DNA, 22 bp, Homo sapiens
taagagaatgtcaggagtggat

SEQ ID NO: 8768005 - DNA, 22 bp, Homo sapiens
taagagaatgttgtggctaggt

SEQ ID NO: 8768006 - DNA, 22 bp, Homo sapiens
taagagaatgtcaggagtggat

SEQ ID NO: 8768007 - DNA, 22 bp, Homo sapiens
taagagaatgtcaggagtggat

SEQ ID NO: 8768008 - DNA, 22 bp, Homo sapiens
taagagattctaaagctactgg

SEQ ID NO: 8768009 - DNA, 22 bp, Homo sapiens
taagagattctaaagctactgg

SEQ ID NO: 8768010 - DNA, 22 bp, Homo sapiens
taagagattctaaagctactgg

SEQ ID NO: 8768011 - DNA, 22 bp, Homo sapiens
taagagattaaagatgtaattt

SEQ ID NO: 8768012 - DNA, 22 bp, Homo sapiens
taagagatgcttttctaaataa

SEQ ID NO: 8768013 - DNA, 22 bp, Homo sapiens
taagagattaaagatgtaattt

SEQ ID NO: 8768014 - DNA, 22 bp, Homo sapiens
taagagcagaacagcaacatat

SEQ ID NO: 8768015 - DNA, 22 bp, Homo sapiens
taagagatggttatcaaaagca

SEQ ID NO: 8768016 - DNA, 22 bp, Homo sapiens
taagagatggttatcaaaagca

SEQ ID NO: 8768017 - DNA, 22 bp, Homo sapiens
taagagatggttatcaaaagca

SEQ ID NO: 8768018 - DNA, 22 bp, Homo sapiens
taagagatgcttttctaaataa

SEQ ID NO: 8768019 - DNA, 22 bp, Homo sapiens
taagagatgcttttctaaataa

SEQ ID NO: 8768020 - DNA, 22 bp, Homo sapiens
taagagactattgagcatcttg

SEQ ID NO: 8768021 - DNA, 22 bp, Homo sapiens
taagagactattgagcatcttg

SEQ ID NO: 8768022 - DNA, 22 bp, Homo sapiens
taagagcataggcttgaaaata

SEQ ID NO: 8768023 - DNA, 22 bp, Homo sapiens
taagagcataggcttgaaaata

SEQ ID NO: 8768024 - DNA, 22 bp, Homo sapiens
taagagcagaggttgaataaat

SEQ ID NO: 8768025 - DNA, 22 bp, Homo sapiens
taagagcagaggttgaataaat

SEQ ID NO: 8768026 - DNA, 22 bp, Homo sapiens
taagagcattgtaaaataatct

SEQ ID NO: 8768027 - DNA, 21 bp, Homo sapiens
taagagctattattgcaaacc

SEQ ID NO: 8768028 - DNA, 21 bp, Homo sapiens
taagcatatcagatagactct

SEQ ID NO: 8768029 - DNA, 22 bp, Homo sapiens
taagacagggagggctctcagc

SEQ ID NO: 8768030 - DNA, 22 bp, Homo sapiens
taagacagggagggctctcagc

SEQ ID NO: 8768031 - DNA, 22 bp, Homo sapiens
taagacagggtctattcttagt

SEQ ID NO: 8768032 - DNA, 22 bp, Homo sapiens
taagacagggtctattcttagt

SEQ ID NO: 8768033 - DNA, 22 bp, Homo sapiens
taagacaaatactatttcaaga

SEQ ID NO: 8768034 - DNA, 22 bp, Homo sapiens
taagacaaatactatttcaaga

SEQ ID NO: 8768035 - DNA, 22 bp, Homo sapiens
taacatgcatagatttgtatta

SEQ ID NO: 8768036 - DNA, 22 bp, Homo sapiens
taacatgcatagatttgtatta

SEQ ID NO: 8768037 - DNA, 22 bp, Homo sapiens
taacatgcagagtttagctttt

SEQ ID NO: 8768038 - DNA, 22 bp, Homo sapiens
taacatgctaatttgcagatag

SEQ ID NO: 8768039 - DNA, 22 bp, Homo sapiens
taacatgttaagaaattagata

SEQ ID NO: 8768040 - DNA, 22 bp, Homo sapiens
taacatgtgtattggtttccta

SEQ ID NO: 8768041 - DNA, 22 bp, Homo sapiens
taacatgttcagactacctgtg

SEQ ID NO: 8768042 - DNA, 22 bp, Homo sapiens
taacatgtttgtacactgaaac

SEQ ID NO: 8768043 - DNA, 18 bp, Homo sapiens
taacatgttttcattaag

SEQ ID NO: 8768044 - DNA, 22 bp, Homo sapiens
taagacaggtagtaagaacatt

SEQ ID NO: 8768045 - DNA, 22 bp, Homo sapiens
taagacataaataggcttttta

SEQ ID NO: 8768046 - DNA, 22 bp, Homo sapiens
taagacataccaagttgtgtga

SEQ ID NO: 8768047 - DNA, 22 bp, Homo sapiens
taagacataaataggcttttta

SEQ ID NO: 8768048 - DNA, 22 bp, Homo sapiens
taagacatagccaagagcatcc

SEQ ID NO: 8768049 - DNA, 22 bp, Homo sapiens
taagacatccgttgcttataat

SEQ ID NO: 8768050 - DNA, 22 bp, Homo sapiens
taagacatcctggatgttcaaa

SEQ ID NO: 8768051 - DNA, 22 bp, Homo sapiens
taagacatcattaaacagcaat

SEQ ID NO: 8768052 - DNA, 22 bp, Homo sapiens
taagacatttgaaatgtgatcc

SEQ ID NO: 8768053 - DNA, 22 bp, Homo sapiens
taagacttaggtcgagtttggc

SEQ ID NO: 8768054 - DNA, 22 bp, Homo sapiens
taagacatgagactcagccagt

SEQ ID NO: 8768055 - DNA, 22 bp, Homo sapiens
taagacatggttgatctagtgt

SEQ ID NO: 8768056 - DNA, 22 bp, Homo sapiens
taagacatggttgatctagtgt

SEQ ID NO: 8768057 - DNA, 22 bp, Homo sapiens
taagacatcctggatgttcaaa

SEQ ID NO: 8768058 - DNA, 22 bp, Homo sapiens
taagacatttgacaaaccattt

SEQ ID NO: 8768059 - DNA, 22 bp, Homo sapiens
taaatgttatgcccatcatcca

SEQ ID NO: 8768060 - DNA, 22 bp, Homo sapiens
taaatgtgttgtggatgaagtt

SEQ ID NO: 8768061 - DNA, 22 bp, Homo sapiens
taaatgttactttcctttcaca

SEQ ID NO: 8768062 - DNA, 22 bp, Homo sapiens
taaatgttactttcctttcaca

SEQ ID NO: 8768063 - DNA, 22 bp, Homo sapiens
taaatgtgttagtcatggtttt

SEQ ID NO: 8768064 - DNA, 22 bp, Homo sapiens
taaatgtgtgtagccatctgtg

SEQ ID NO: 8768065 - DNA, 22 bp, Homo sapiens
taaatgtgtgtagccatctgtg

SEQ ID NO: 8768066 - DNA, 22 bp, Homo sapiens
taaatgtgtaaacctccattac

SEQ ID NO: 8768067 - DNA, 22 bp, Homo sapiens
taaatgtgtaaacctccattac

SEQ ID NO: 8768068 - DNA, 22 bp, Homo sapiens
taaatgtgtctttttaaggcct

SEQ ID NO: 8768069 - DNA, 22 bp, Homo sapiens
taaatgtgtctttttaaggcct

SEQ ID NO: 8768070 - DNA, 22 bp, Homo sapiens
taaatgtgtctatggacccgcc

SEQ ID NO: 8768071 - DNA, 22 bp, Homo sapiens
taaatgtggagactcaggagtc

SEQ ID NO: 8768072 - DNA, 22 bp, Homo sapiens
taaatgtgggggccacgggctt

SEQ ID NO: 8768073 - DNA, 22 bp, Homo sapiens
taaatgctcagaccttattcca

SEQ ID NO: 8768074 - DNA, 22 bp, Homo sapiens
taaatgtgcactttacttttca

SEQ ID NO: 8768075 - DNA, 22 bp, Homo sapiens
taaatgtgcactttacttttca

SEQ ID NO: 8768076 - DNA, 22 bp, Homo sapiens
taaatgctcaataaatgttgct

SEQ ID NO: 8768077 - DNA, 22 bp, Homo sapiens
taacagctctgtgtggctgtaa

SEQ ID NO: 8768078 - DNA, 22 bp, Homo sapiens
taacagctggcgttataggaat

SEQ ID NO: 8768079 - DNA, 19 bp, Homo sapiens
taacaggggaaaatgatca

SEQ ID NO: 8768080 - DNA, 20 bp, Homo sapiens
taacagggccctagaaagag

SEQ ID NO: 8768081 - DNA, 22 bp, Homo sapiens
taacaggctgatcatatatcct

SEQ ID NO: 8768082 - DNA, 22 bp, Homo sapiens
taacagcatttgaatgagtaac

SEQ ID NO: 8768083 - DNA, 22 bp, Homo sapiens
taacagccctccctccatcctg

SEQ ID NO: 8768084 - DNA, 22 bp, Homo sapiens
taacagcatatgaaattactgg

SEQ ID NO: 8768085 - DNA, 22 bp, Homo sapiens
taacagcagtcctcttctcatg

SEQ ID NO: 8768086 - DNA, 22 bp, Homo sapiens
taaattaaagattggagaagga

SEQ ID NO: 8768087 - DNA, 22 bp, Homo sapiens
taaatgttgtaagtacatctaa

SEQ ID NO: 8768088 - DNA, 22 bp, Homo sapiens
taaatgttggcattggaggccg

SEQ ID NO: 8768089 - DNA, 22 bp, Homo sapiens
taaatgttggcattggaggccg

SEQ ID NO: 8768090 - DNA, 22 bp, Homo sapiens
taaatgttgtaagtacatctaa

SEQ ID NO: 8768091 - DNA, 22 bp, Homo sapiens
taaatgtttagtcttatttggg

SEQ ID NO: 8768092 - DNA, 22 bp, Homo sapiens
taaatgtttagtcttatttggg

SEQ ID NO: 8768093 - DNA, 22 bp, Homo sapiens
taaatgttttgtgggttgagtt

SEQ ID NO: 8768094 - DNA, 22 bp, Homo sapiens
taaattaaagattggagaagga

SEQ ID NO: 8768095 - DNA, 22 bp, Homo sapiens
taacagtacatccttttctctt

SEQ ID NO: 8768096 - DNA, 22 bp, Homo sapiens
taacagtaaagtaagttagctt

SEQ ID NO: 8768097 - DNA, 22 bp, Homo sapiens
taacagggtaggagggcatgaa

SEQ ID NO: 8768098 - DNA, 22 bp, Homo sapiens
taacagtatagcctaacatttc

SEQ ID NO: 8768099 - DNA, 22 bp, Homo sapiens
taacagtatagcctaacatttc

SEQ ID NO: 8768100 - DNA, 22 bp, Homo sapiens
taacagtatagcctaacatttc

SEQ ID NO: 8768101 - DNA, 22 bp, Homo sapiens
taacagtagccttatgtggtct

SEQ ID NO: 8768102 - DNA, 22 bp, Homo sapiens
taacagtaccattaactttgat

SEQ ID NO: 8768103 - DNA, 22 bp, Homo sapiens
taacagtatccccatttgcaag

SEQ ID NO: 8768104 - DNA, 22 bp, Homo sapiens
taacagtattgaagataaacta

SEQ ID NO: 8768105 - DNA, 22 bp, Homo sapiens
taacagtattgaagataaacta

SEQ ID NO: 8768106 - DNA, 22 bp, Homo sapiens
taacaggcaaggtcacaccttg

SEQ ID NO: 8768107 - DNA, 22 bp, Homo sapiens
taacagtatccccatttgcaag

SEQ ID NO: 8768108 - DNA, 22 bp, Homo sapiens
taacagtatatttaccaaacct

SEQ ID NO: 8768109 - DNA, 22 bp, Homo sapiens
taacagtgtggacttgagatct

SEQ ID NO: 8768110 - DNA, 22 bp, Homo sapiens
taacagtgtgaggtctcaggcg

SEQ ID NO: 8768111 - DNA, 22 bp, Homo sapiens
taacagtgacctgaatgtcaat

SEQ ID NO: 8768112 - DNA, 22 bp, Homo sapiens
taacagtgacctgaatgtcaat

SEQ ID NO: 8768113 - DNA, 22 bp, Homo sapiens
taacagtattgaagataaacta

SEQ ID NO: 8768114 - DNA, 22 bp, Homo sapiens
taacatgagagctaagacatta

SEQ ID NO: 8768115 - DNA, 22 bp, Homo sapiens
taacatgagagctaagacatta

SEQ ID NO: 8768116 - DNA, 22 bp, Homo sapiens
taacatctttagcagctcgaac

SEQ ID NO: 8768117 - DNA, 22 bp, Homo sapiens
taacatgagagctaagacatta

SEQ ID NO: 8768118 - DNA, 22 bp, Homo sapiens
taacatgaaactccaaatggta

SEQ ID NO: 8768119 - DNA, 22 bp, Homo sapiens
taacatcttaactggatacttc

SEQ ID NO: 8768120 - DNA, 22 bp, Homo sapiens
taacatctccctgacttttgct

SEQ ID NO: 8768121 - DNA, 22 bp, Homo sapiens
taacatctccctgacttttgct

SEQ ID NO: 8768122 - DNA, 22 bp, Homo sapiens
taacatctccctgacttttgct

SEQ ID NO: 8768123 - DNA, 22 bp, Homo sapiens
taacatctaagggagagaaagt

SEQ ID NO: 8768124 - DNA, 22 bp, Homo sapiens
taacatcttgcagtagcagaac

SEQ ID NO: 8768125 - DNA, 22 bp, Homo sapiens
taacatcttaactggatacttc

SEQ ID NO: 8768126 - DNA, 22 bp, Homo sapiens
taacagttttgagttttgcttc

SEQ ID NO: 8768127 - DNA, 22 bp, Homo sapiens
taacagttttgagttttgcttc

SEQ ID NO: 8768128 - DNA, 22 bp, Homo sapiens
taacagtgtgtccagtcagttt

SEQ ID NO: 8768129 - DNA, 22 bp, Homo sapiens
taacagttggtgtaatttcttg

SEQ ID NO: 8768130 - DNA, 18 bp, Homo sapiens
taacatcggctatgcatc

SEQ ID NO: 8768131 - DNA, 22 bp, Homo sapiens
taacatcaaactgcattttcta

SEQ ID NO: 8768132 - DNA, 22 bp, Homo sapiens
taacatcaaacatgttttaaag

SEQ ID NO: 8768133 - DNA, 22 bp, Homo sapiens
taaagattgctcaaaactgtga

SEQ ID NO: 8768134 - DNA, 22 bp, Homo sapiens
taaagattgctcaaaactgtga

SEQ ID NO: 8768135 - DNA, 22 bp, Homo sapiens
taaagattgctcaaaactgtga

SEQ ID NO: 8768136 - DNA, 22 bp, Homo sapiens
taaagatgttctcatttcatag

SEQ ID NO: 8768137 - DNA, 22 bp, Homo sapiens
taaagatgttctcatttcatag

SEQ ID NO: 8768138 - DNA, 22 bp, Homo sapiens
taaagatggagatgacctagga

SEQ ID NO: 8768139 - DNA, 22 bp, Homo sapiens
taaagatgctatagtgaaggag

SEQ ID NO: 8768140 - DNA, 22 bp, Homo sapiens
taaagatgctatagtgaaggag

SEQ ID NO: 8768141 - DNA, 22 bp, Homo sapiens
taaagatgcccacattgcaggt

SEQ ID NO: 8768142 - DNA, 22 bp, Homo sapiens
taaagcaaaaatgaactgccat

SEQ ID NO: 8768143 - DNA, 22 bp, Homo sapiens
taaagcaaaaatgaactgccat

SEQ ID NO: 8768144 - DNA, 22 bp, Homo sapiens
taaagcaaaaatgaactgccat

SEQ ID NO: 8768145 - DNA, 22 bp, Homo sapiens
taaagcaaaaatgaactgccat

SEQ ID NO: 8768146 - DNA, 22 bp, Homo sapiens
taaagcaaaaatgaactgccat

SEQ ID NO: 8768147 - DNA, 23 bp, Homo sapiens
taaagcaaagtcaagtgcactcc

SEQ ID NO: 8768148 - DNA, 23 bp, Homo sapiens
taaagcaaagtcaagtgcactcc

SEQ ID NO: 8768149 - DNA, 23 bp, Homo sapiens
taaagcaaagtcaagtgcactcc

SEQ ID NO: 8768150 - DNA, 22 bp, Homo sapiens
taaagacatggtgtaggtgaac

SEQ ID NO: 8768151 - DNA, 22 bp, Homo sapiens
taaagacatggtgtaggtgaac

SEQ ID NO: 8768152 - DNA, 22 bp, Homo sapiens
taaagataagacatcaactgag

SEQ ID NO: 8768153 - DNA, 22 bp, Homo sapiens
taaagataagacatcaactgag

SEQ ID NO: 8768154 - DNA, 22 bp, Homo sapiens
taaagcaattactcagtggctt

SEQ ID NO: 8768155 - DNA, 22 bp, Homo sapiens
taaagcaattactcagtggctt

SEQ ID NO: 8768156 - DNA, 22 bp, Homo sapiens
taaagcaatttgagcaagttct

SEQ ID NO: 8768157 - DNA, 22 bp, Homo sapiens
taaagcaatttgagcaagttct

SEQ ID NO: 8768158 - DNA, 22 bp, Homo sapiens
taaagcaatttgagcaagttct

SEQ ID NO: 8768159 - DNA, 22 bp, Homo sapiens
taaagcaatttgagcaagttct

SEQ ID NO: 8768160 - DNA, 22 bp, Homo sapiens
taaagcaatgaaagttttgcag

SEQ ID NO: 8768161 - DNA, 22 bp, Homo sapiens
taaagcaaggcaaattgttggt

SEQ ID NO: 8768162 - DNA, 22 bp, Homo sapiens
taaagcaaggcaaattgttggt

SEQ ID NO: 8768163 - DNA, 22 bp, Homo sapiens
taaagcaaggcaaattgttggt

SEQ ID NO: 8768164 - DNA, 22 bp, Homo sapiens
taaagcaatgaaagttttgcag

SEQ ID NO: 8768165 - DNA, 22 bp, Homo sapiens
taaagcaatgaaagttttgcag

SEQ ID NO: 8768166 - DNA, 22 bp, Homo sapiens
taaagcaatgaaagttttgcag

SEQ ID NO: 8768167 - DNA, 22 bp, Homo sapiens
taaagcaattactcagtggctt

SEQ ID NO: 8768168 - DNA, 22 bp, Homo sapiens
taaagcaaggcaaattgttggt

SEQ ID NO: 8768169 - DNA, 22 bp, Homo sapiens
taaagcaaggcaaattgttggt

SEQ ID NO: 8768170 - DNA, 22 bp, Homo sapiens
taaagcaaggaatagagtagtc

SEQ ID NO: 8768171 - DNA, 22 bp, Homo sapiens
taaagcaaggaatagagtagtc

SEQ ID NO: 8768172 - DNA, 22 bp, Homo sapiens
taaagcaaggaatagagtagtc

SEQ ID NO: 8768173 - DNA, 22 bp, Homo sapiens
taaagcaaggaatagagtagtc

SEQ ID NO: 8768174 - DNA, 22 bp, Homo sapiens
taaagcaaggaatagagtagtc

SEQ ID NO: 8768175 - DNA, 22 bp, Homo sapiens
taaagcaaggaatagagtagtc

SEQ ID NO: 8768176 - DNA, 22 bp, Homo sapiens
taaagcaagacacacccatagc

SEQ ID NO: 8768177 - DNA, 22 bp, Homo sapiens
taaagcaagacacacccatagc

SEQ ID NO: 8768178 - DNA, 22 bp, Homo sapiens
taaagcaagacacacccatagc

SEQ ID NO: 8768179 - DNA, 23 bp, Homo sapiens
taaagcaaagtcaagtgcactcc

SEQ ID NO: 8768180 - DNA, 22 bp, Homo sapiens
taaatgatttatgtatgtgaaa

SEQ ID NO: 8768181 - DNA, 20 bp, Homo sapiens
taaagcagccgtggagggta

SEQ ID NO: 8768182 - DNA, 22 bp, Homo sapiens
taaagcagccagggtctaagcc

SEQ ID NO: 8768183 - DNA, 22 bp, Homo sapiens
taaagcagccagggtctaagcc

SEQ ID NO: 8768184 - DNA, 22 bp, Homo sapiens
taaagcacgtctatttaatgat

SEQ ID NO: 8768185 - DNA, 22 bp, Homo sapiens
taaagcacgtctatttaatgat

SEQ ID NO: 8768186 - DNA, 22 bp, Homo sapiens
taaagcacatatcttacaataa

SEQ ID NO: 8768187 - DNA, 22 bp, Homo sapiens
taaagcacatatcttacaataa

SEQ ID NO: 8768188 - DNA, 22 bp, Homo sapiens
taaatgatttatgtatgtgaaa

SEQ ID NO: 8768189 - DNA, 22 bp, Homo sapiens
taaatgatttatgtatgtgaaa

SEQ ID NO: 8768190 - DNA, 22 bp, Homo sapiens
taaatgcaagggaaaggcaaga

SEQ ID NO: 8768191 - DNA, 22 bp, Homo sapiens
taaatgcagttagtacttgcca

SEQ ID NO: 8768192 - DNA, 22 bp, Homo sapiens
taaaagagaatggataacagag

SEQ ID NO: 8768193 - DNA, 22 bp, Homo sapiens
taaaagatatcttagggatttg

SEQ ID NO: 8768194 - DNA, 22 bp, Homo sapiens
taaaagatatcttagggatttg

SEQ ID NO: 8768195 - DNA, 22 bp, Homo sapiens
taaaagatatcttagggatttg

SEQ ID NO: 8768196 - DNA, 22 bp, Homo sapiens
taaaagatcactggctgcttta

SEQ ID NO: 8768197 - DNA, 22 bp, Homo sapiens
taaaagattttataggaacaag

SEQ ID NO: 8768198 - DNA, 22 bp, Homo sapiens
taaaagattttataggaacaag

SEQ ID NO: 8768199 - DNA, 21 bp, Homo sapiens
taaaagatgacaagacagctc

SEQ ID NO: 8768200 - DNA, 21 bp, Homo sapiens
taaaagatgacaagacagctc

SEQ ID NO: 8768201 - DNA, 21 bp, Homo sapiens
taaaagatgacaagacagctc

SEQ ID NO: 8768202 - DNA, 22 bp, Homo sapiens
taaaagaccctctagagtccca

SEQ ID NO: 8768203 - DNA, 22 bp, Homo sapiens
taaaagaccacaaggtggtaat

SEQ ID NO: 8768204 - DNA, 22 bp, Homo sapiens
taaaagaccacaaggtggtaat

SEQ ID NO: 8768205 - DNA, 22 bp, Homo sapiens
taaaagacatataactgtagga

SEQ ID NO: 8768206 - DNA, 22 bp, Homo sapiens
taaaagaccctctagagtccca

SEQ ID NO: 8768207 - DNA, 22 bp, Homo sapiens
taaaagaccctctagagtccca

SEQ ID NO: 8768208 - DNA, 22 bp, Homo sapiens
taaaagaccctctagagtccca

SEQ ID NO: 8768209 - DNA, 22 bp, Homo sapiens
taaaagacatataactgtagga

SEQ ID NO: 8768210 - DNA, 22 bp, Homo sapiens
taaaagaagcttcaaggccggc

SEQ ID NO: 8768211 - DNA, 22 bp, Homo sapiens
taaaagaagcttcaaggccggc

SEQ ID NO: 8768212 - DNA, 22 bp, Homo sapiens
taaaacttctcatttttatggt

SEQ ID NO: 8768213 - DNA, 22 bp, Homo sapiens
taaaacttctcatttttatggt

SEQ ID NO: 8768214 - DNA, 22 bp, Homo sapiens
taaaacttctcatttttatggt

SEQ ID NO: 8768215 - DNA, 22 bp, Homo sapiens
taaaactttgaaggtgctcagt

SEQ ID NO: 8768216 - DNA, 22 bp, Homo sapiens
taaaacttaactatccagatta

SEQ ID NO: 8768217 - DNA, 22 bp, Homo sapiens
taaaacttaactatccagatta

SEQ ID NO: 8768218 - DNA, 22 bp, Homo sapiens
taaaacttctcatttttatggt

SEQ ID NO: 8768219 - DNA, 22 bp, Homo sapiens
taaaacttctcatttttatggt

SEQ ID NO: 8768220 - DNA, 21 bp, Homo sapiens
taaaactgtaactttgtcctg

SEQ ID NO: 8768221 - DNA, 22 bp, Homo sapiens
taaaacttaactatccagatta

SEQ ID NO: 8768222 - DNA, 22 bp, Homo sapiens
taaaactgaatacatactgagg

SEQ ID NO: 8768223 - DNA, 22 bp, Homo sapiens
taaaactgcttggtatggtcta

SEQ ID NO: 8768224 - DNA, 22 bp, Homo sapiens
taaagacataggatcagggaga

SEQ ID NO: 8768225 - DNA, 22 bp, Homo sapiens
taaagacataggatcagggaga

SEQ ID NO: 8768226 - DNA, 22 bp, Homo sapiens
taaagacatgcaaagtctaatt

SEQ ID NO: 8768227 - DNA, 22 bp, Homo sapiens
taaagacatgcaaagtctaatt

SEQ ID NO: 8768228 - DNA, 22 bp, Homo sapiens
taaagacatgcaaagtctaatt

SEQ ID NO: 8768229 - DNA, 22 bp, Homo sapiens
taaaagtggataagctgtagga

SEQ ID NO: 8768230 - DNA, 22 bp, Homo sapiens
taaaagttagctaggacaaagt

SEQ ID NO: 8768231 - DNA, 22 bp, Homo sapiens
taaaagtggataagctgtagga

SEQ ID NO: 8768232 - DNA, 22 bp, Homo sapiens
taaagacactggttttaatcat

SEQ ID NO: 8768233 - DNA, 22 bp, Homo sapiens
taaagacactggttttaatcat

SEQ ID NO: 8768234 - DNA, 22 bp, Homo sapiens
taaagacactggttttaatcat

SEQ ID NO: 8768235 - DNA, 23 bp, Homo sapiens
taaagacagccttcaggattctg

SEQ ID NO: 8768236 - DNA, 23 bp, Homo sapiens
taaagacagccttcaggattctg

SEQ ID NO: 8768237 - DNA, 22 bp, Homo sapiens
taaagacactggttttaatcat

SEQ ID NO: 8768238 - DNA, 22 bp, Homo sapiens
taaagacagatggaccagccat

SEQ ID NO: 8768239 - DNA, 22 bp, Homo sapiens
taaaagtaggaatgaaacgcat

SEQ ID NO: 8768240 - DNA, 22 bp, Homo sapiens
taaaaggcacttggatgctgag

SEQ ID NO: 8768241 - DNA, 22 bp, Homo sapiens
taaaaggcacttggatgctgag

SEQ ID NO: 8768242 - DNA, 22 bp, Homo sapiens
taaaaggcaatactagatgagt

SEQ ID NO: 8768243 - DNA, 22 bp, Homo sapiens
taaaaggcaatactagatgagt

SEQ ID NO: 8768244 - DNA, 22 bp, Homo sapiens
taaaaggattagcaggatgggc

SEQ ID NO: 8768245 - DNA, 22 bp, Homo sapiens
taaaagtatactttcaaaggag

SEQ ID NO: 8768246 - DNA, 22 bp, Homo sapiens
taaaagtaggaatgaaacgcat

SEQ ID NO: 8768247 - DNA, 22 bp, Homo sapiens
taaaagtaggaatgaaacgcat

SEQ ID NO: 8768248 - DNA, 22 bp, Homo sapiens
taaaagtatactttcaaaggag

SEQ ID NO: 8768249 - DNA, 22 bp, Homo sapiens
taaaagtatactttcaaaggag

SEQ ID NO: 8768250 - DNA, 22 bp, Homo sapiens
taaaagtatactttcaaaggag

SEQ ID NO: 8768251 - DNA, 19 bp, Homo sapiens
taaaaggatgtggaaggat

SEQ ID NO: 8768252 - DNA, 19 bp, Homo sapiens
taaaaggatgtggaaggat

SEQ ID NO: 8768253 - DNA, 22 bp, Homo sapiens
taaaaggaggttgaagctgtca

SEQ ID NO: 8768254 - DNA, 22 bp, Homo sapiens
taaaagctgagatatcctgtac

SEQ ID NO: 8768255 - DNA, 22 bp, Homo sapiens
taaaagattttataggaacaag

SEQ ID NO: 8768256 - DNA, 22 bp, Homo sapiens
taaaagattttataggaacaag

SEQ ID NO: 8768257 - DNA, 22 bp, Homo sapiens
gtttcaaaggtgtcaggcagtt

SEQ ID NO: 8768258 - DNA, 22 bp, Homo sapiens
gtttcaaagtcagaaaaggagg

SEQ ID NO: 8768259 - DNA, 22 bp, Homo sapiens
gtttcaaagggaagacgctgga

SEQ ID NO: 8768260 - DNA, 22 bp, Homo sapiens
gtttattatacaacaaaagcta

SEQ ID NO: 8768261 - DNA, 22 bp, Homo sapiens
gtttatcagagagcagaggtgg

SEQ ID NO: 8768262 - DNA, 22 bp, Homo sapiens
gtttattaactgtcaagtgatt

SEQ ID NO: 8768263 - DNA, 22 bp, Homo sapiens
gtttattaactgtcaagtgatt

SEQ ID NO: 8768264 - DNA, 22 bp, Homo sapiens
gtttatgcacttggtttgtgtc

SEQ ID NO: 8768265 - DNA, 22 bp, Homo sapiens
gtttatcattattattagcaac

SEQ ID NO: 8768266 - DNA, 22 bp, Homo sapiens
gtttatctgcactctcttgtag

SEQ ID NO: 8768267 - DNA, 22 bp, Homo sapiens
gtttatattcaacggagtatct

SEQ ID NO: 8768268 - DNA, 22 bp, Homo sapiens
gtttatattcaacggagtatct

SEQ ID NO: 8768269 - DNA, 22 bp, Homo sapiens
gttgagaagcctcaaagaagga

SEQ ID NO: 8768270 - DNA, 22 bp, Homo sapiens
gttgaacatgtgagtctcagga

SEQ ID NO: 8768271 - DNA, 22 bp, Homo sapiens
gttgaatatacctgcatttgtg

SEQ ID NO: 8768272 - DNA, 22 bp, Homo sapiens
gttgaaaatgactttataccat

SEQ ID NO: 8768273 - DNA, 22 bp, Homo sapiens
gttgaaaatgactttataccat

SEQ ID NO: 8768274 - DNA, 22 bp, Homo sapiens
gttgaaacttagttgaaattta

SEQ ID NO: 8768275 - DNA, 22 bp, Homo sapiens
gttgaaagagcatggacttgaa

SEQ ID NO: 8768276 - DNA, 20 bp, Homo sapiens
gttgaaagtaatatgatgct

SEQ ID NO: 8768277 - DNA, 22 bp, Homo sapiens
gttgaaatcctaaccccctagt

SEQ ID NO: 8768278 - DNA, 22 bp, Homo sapiens
gttgaaagtggagaacctggtt

SEQ ID NO: 8768279 - DNA, 21 bp, Homo sapiens
gttcttgcaggatttccttcc

SEQ ID NO: 8768280 - DNA, 21 bp, Homo sapiens
gttcttcatttaggtgggctt

SEQ ID NO: 8768281 - DNA, 19 bp, Homo sapiens
gttcttttcacctctgtgc

SEQ ID NO: 8768282 - DNA, 22 bp, Homo sapiens
gttgaaaatacagattcctagg

SEQ ID NO: 8768283 - DNA, 22 bp, Homo sapiens
gttcttttggtagagtgtgcat

SEQ ID NO: 8768284 - DNA, 22 bp, Homo sapiens
gttctttgactccaagaaagta

SEQ ID NO: 8768285 - DNA, 22 bp, Homo sapiens
gttctttaggggcccaatttcc

SEQ ID NO: 8768286 - DNA, 22 bp, Homo sapiens
gttctttaagtggagaaggaaa

SEQ ID NO: 8768287 - DNA, 22 bp, Homo sapiens
gtttcaaagtcagaaaaggagg

SEQ ID NO: 8768288 - DNA, 22 bp, Homo sapiens
gtttcaaagtcagaaaaggagg

SEQ ID NO: 8768289 - DNA, 22 bp, Homo sapiens
gtttcaaataggtttcagcaaa

SEQ ID NO: 8768290 - DNA, 22 bp, Homo sapiens
gtttcaagagtggctcaaaact

SEQ ID NO: 8768291 - DNA, 22 bp, Homo sapiens
gtttcaaataggtttcagcaaa

SEQ ID NO: 8768292 - DNA, 22 bp, Homo sapiens
gtttcaagagtggctcaaaact

SEQ ID NO: 8768293 - DNA, 22 bp, Homo sapiens
gtttcaagggaactgttttggt

SEQ ID NO: 8768294 - DNA, 22 bp, Homo sapiens
gtttcaagggaactgttttggt

SEQ ID NO: 8768295 - DNA, 22 bp, Homo sapiens
gtttcacacatcctgcacatag

SEQ ID NO: 8768296 - DNA, 22 bp, Homo sapiens
gtttcacacatcctgcacatag

SEQ ID NO: 8768297 - DNA, 22 bp, Homo sapiens
gtttcaagtagctgctgattat

SEQ ID NO: 8768298 - DNA, 22 bp, Homo sapiens
gtttcaagtagctgctgattat

SEQ ID NO: 8768299 - DNA, 22 bp, Homo sapiens
gtttcacagatggggagacacg

SEQ ID NO: 8768300 - DNA, 22 bp, Homo sapiens
gtttcacatgaaacttggggaa

SEQ ID NO: 8768301 - DNA, 22 bp, Homo sapiens
gtttcacataattttaaattgt

SEQ ID NO: 8768302 - DNA, 22 bp, Homo sapiens
gtttcacagtctgcagaatttt

SEQ ID NO: 8768303 - DNA, 22 bp, Homo sapiens
gtttcacagtctgcagaatttt

SEQ ID NO: 8768304 - DNA, 22 bp, Homo sapiens
gtttctttctattgactgaaca

SEQ ID NO: 8768305 - DNA, 22 bp, Homo sapiens
gtttctttctattgactgaaca

SEQ ID NO: 8768306 - DNA, 22 bp, Homo sapiens
gtttctttctattgactgaaca

SEQ ID NO: 8768307 - DNA, 22 bp, Homo sapiens
gtttctttctattgactgaaca

SEQ ID NO: 8768308 - DNA, 22 bp, Homo sapiens
gtttcttatttgcaggttgctt

SEQ ID NO: 8768309 - DNA, 22 bp, Homo sapiens
gtttcttagacagacattatct

SEQ ID NO: 8768310 - DNA, 22 bp, Homo sapiens
gtttcagaaatggtttatgcaa

SEQ ID NO: 8768311 - DNA, 22 bp, Homo sapiens
gtttcttagacatatgccatga

SEQ ID NO: 8768312 - DNA, 22 bp, Homo sapiens
gtttcttaggtaaattctttga

SEQ ID NO: 8768313 - DNA, 22 bp, Homo sapiens
gtttcttaggtaaattctttga

SEQ ID NO: 8768314 - DNA, 22 bp, Homo sapiens
gtttcttatttcaactggaaca

SEQ ID NO: 8768315 - DNA, 22 bp, Homo sapiens
gtttctttctattgactgaaca

SEQ ID NO: 8768316 - DNA, 22 bp, Homo sapiens
gtttcttttaaaatatgtagac

SEQ ID NO: 8768317 - DNA, 22 bp, Homo sapiens
gtttcttttaaaatatgtagac

SEQ ID NO: 8768318 - DNA, 22 bp, Homo sapiens
gtttcttttaaaatatgtagac

SEQ ID NO: 8768319 - DNA, 22 bp, Homo sapiens
gtttcttttaaaatatgtagac

SEQ ID NO: 8768320 - DNA, 22 bp, Homo sapiens
gtttcttttaaaatatgtagac

SEQ ID NO: 8768321 - DNA, 22 bp, Homo sapiens
gtttcttttaaaatatgtagac

SEQ ID NO: 8768322 - DNA, 22 bp, Homo sapiens
gtttcttttaaaatatgtagac

SEQ ID NO: 8768323 - DNA, 22 bp, Homo sapiens
gtttcttttgtgatcaccaacc

SEQ ID NO: 8768324 - DNA, 22 bp, Homo sapiens
gtttcttttgtgatcaccaacc

SEQ ID NO: 8768325 - DNA, 22 bp, Homo sapiens
gtttcttttgtgatcaccaacc

SEQ ID NO: 8768326 - DNA, 22 bp, Homo sapiens
gtttcttttgtgatcaccaacc

SEQ ID NO: 8768327 - DNA, 22 bp, Homo sapiens
gtttgtgtaacatgatgatgat

SEQ ID NO: 8768328 - DNA, 22 bp, Homo sapiens
gtttgtttatacaaaagatcct

SEQ ID NO: 8768329 - DNA, 22 bp, Homo sapiens
gtttgtttatacaaaagatcct

SEQ ID NO: 8768330 - DNA, 22 bp, Homo sapiens
gtttgtgtcaatgacttctgca

SEQ ID NO: 8768331 - DNA, 22 bp, Homo sapiens
gtttgtgtcaatgacttctgca

SEQ ID NO: 8768332 - DNA, 22 bp, Homo sapiens
gtttgttgatatgcccctttgt

SEQ ID NO: 8768333 - DNA, 22 bp, Homo sapiens
gtttgtcatttgtacttctagc

SEQ ID NO: 8768334 - DNA, 22 bp, Homo sapiens
gtttgtgtaacatgatgatgat

SEQ ID NO: 8768335 - DNA, 22 bp, Homo sapiens
gtttgtcaggaggttgaagtca

SEQ ID NO: 8768336 - DNA, 17 bp, Homo sapiens
gtttgcatggtgttaac

SEQ ID NO: 8768337 - DNA, 22 bp, Homo sapiens
gtttgattcaagaacaaagagt

SEQ ID NO: 8768338 - DNA, 22 bp, Homo sapiens
gtttgcagttgtcatcctcctg

SEQ ID NO: 8768339 - DNA, 22 bp, Homo sapiens
gtttgcataaagtggatgcagg

SEQ ID NO: 8768340 - DNA, 22 bp, Homo sapiens
gtttgcaggaactctggggaga

SEQ ID NO: 8768341 - DNA, 22 bp, Homo sapiens
gtttgcagggagagatgtggtg

SEQ ID NO: 8768342 - DNA, 21 bp, Homo sapiens
gtttgcagttgagtccttccc

SEQ ID NO: 8768343 - DNA, 22 bp, Homo sapiens
gtttgcatatttgcacaggaat

SEQ ID NO: 8768344 - DNA, 22 bp, Homo sapiens
gtttgaaagaccaattagattt

SEQ ID NO: 8768345 - DNA, 22 bp, Homo sapiens
gtttgaatgcagtatgcatttt

SEQ ID NO: 8768346 - DNA, 22 bp, Homo sapiens
gtttgaatgcagtatgcatttt

SEQ ID NO: 8768347 - DNA, 22 bp, Homo sapiens
gtttgaaagttcaacaggaaaa

SEQ ID NO: 8768348 - DNA, 22 bp, Homo sapiens
gttattttaacttctcagtaat

SEQ ID NO: 8768349 - DNA, 22 bp, Homo sapiens
gttatttcagccacagagtgca

SEQ ID NO: 8768350 - DNA, 22 bp, Homo sapiens
gttctgctgtgtctcagcaggt

SEQ ID NO: 8768351 - DNA, 22 bp, Homo sapiens
gttcttcatcttaaccatctgt

SEQ ID NO: 8768352 - DNA, 22 bp, Homo sapiens
gttcttcatcttaaccatctgt

SEQ ID NO: 8768353 - DNA, 22 bp, Homo sapiens
gttcttcattacaagggaacca

SEQ ID NO: 8768354 - DNA, 22 bp, Homo sapiens
gttcttcagttcaggctgttca

SEQ ID NO: 8768355 - DNA, 22 bp, Homo sapiens
gttcttcatcattaacactctg

SEQ ID NO: 8768356 - DNA, 22 bp, Homo sapiens
gttcttcatcattttagatagg

SEQ ID NO: 8768357 - DNA, 22 bp, Homo sapiens
gttcttcatcattttagatagg

SEQ ID NO: 8768358 - DNA, 22 bp, Homo sapiens
gttcttcatcattaacactctg

SEQ ID NO: 8768359 - DNA, 22 bp, Homo sapiens
gttcttcatcattaacactctg

SEQ ID NO: 8768360 - DNA, 22 bp, Homo sapiens
gttcttcagtcacatcacagaa

SEQ ID NO: 8768361 - DNA, 22 bp, Homo sapiens
gttcttcagtcacatcacagaa

SEQ ID NO: 8768362 - DNA, 22 bp, Homo sapiens
gttcttcagtaaaattaaatgt

SEQ ID NO: 8768363 - DNA, 22 bp, Homo sapiens
gttcttcaggctgtgctctaga

SEQ ID NO: 8768364 - DNA, 22 bp, Homo sapiens
gttatttaactttgtagcatgg

SEQ ID NO: 8768365 - DNA, 22 bp, Homo sapiens
gttatcttagggtacaaaggac

SEQ ID NO: 8768366 - DNA, 22 bp, Homo sapiens
gttatcttagggtacaaaggac

SEQ ID NO: 8768367 - DNA, 22 bp, Homo sapiens
gttatcttagggtacaaaggac

SEQ ID NO: 8768368 - DNA, 22 bp, Homo sapiens
gttatcttccctttgatgattt

SEQ ID NO: 8768369 - DNA, 22 bp, Homo sapiens
gttatctagaccaaaagcctaa

SEQ ID NO: 8768370 - DNA, 22 bp, Homo sapiens
gttatcatgcttcatcatcact

SEQ ID NO: 8768371 - DNA, 19 bp, Homo sapiens
gttatcaaggggctacttt

SEQ ID NO: 8768372 - DNA, 19 bp, Homo sapiens
gttatcaaggggctacttt

SEQ ID NO: 8768373 - DNA, 22 bp, Homo sapiens
gttatccatagaataagtcatc

SEQ ID NO: 8768374 - DNA, 22 bp, Homo sapiens
gttatattgccaagtatattgt

SEQ ID NO: 8768375 - DNA, 22 bp, Homo sapiens
gttatattgccaagtatattgt

SEQ ID NO: 8768376 - DNA, 22 bp, Homo sapiens
gttatattggcagaagagaaga

SEQ ID NO: 8768377 - DNA, 22 bp, Homo sapiens
gttatattggcagaagagaaga

SEQ ID NO: 8768378 - DNA, 22 bp, Homo sapiens
gttattgctatacatgtacact

SEQ ID NO: 8768379 - DNA, 22 bp, Homo sapiens
gttatcttctatttctcatact

SEQ ID NO: 8768380 - DNA, 22 bp, Homo sapiens
gttatacatatgtgttaacaaa

SEQ ID NO: 8768381 - DNA, 21 bp, Homo sapiens
gttatacattctatggatttg

SEQ ID NO: 8768382 - DNA, 22 bp, Homo sapiens
gttatacttatgtgcaaaaata

SEQ ID NO: 8768383 - DNA, 22 bp, Homo sapiens
gttatataagacaaatcagagt

SEQ ID NO: 8768384 - DNA, 22 bp, Homo sapiens
gttatataattcctgtggtagt

SEQ ID NO: 8768385 - DNA, 22 bp, Homo sapiens
gttatataagacaaatcagagt

SEQ ID NO: 8768386 - DNA, 22 bp, Homo sapiens
gttatataattcctgtggtagt

SEQ ID NO: 8768387 - DNA, 22 bp, Homo sapiens
gttatattcaaaatgaggctgt

SEQ ID NO: 8768388 - DNA, 22 bp, Homo sapiens
gttatatatagtatttctctga

SEQ ID NO: 8768389 - DNA, 22 bp, Homo sapiens
gttatattcaaaatgaggctgt

SEQ ID NO: 8768390 - DNA, 22 bp, Homo sapiens
gttatatatagtatttctctga

SEQ ID NO: 8768391 - DNA, 22 bp, Homo sapiens
gtgctggctggggcatcaggca

SEQ ID NO: 8768392 - DNA, 22 bp, Homo sapiens
gtgttcatggatgtcaatttga

SEQ ID NO: 8768393 - DNA, 22 bp, Homo sapiens
gtgttctgggatgattgtagtg

SEQ ID NO: 8768394 - DNA, 22 bp, Homo sapiens
gtgttcatgtgtcctggatata

SEQ ID NO: 8768395 - DNA, 22 bp, Homo sapiens
gtgttcatgccccagtgcagga

SEQ ID NO: 8768396 - DNA, 22 bp, Homo sapiens
gtgttcttttgcttcacagaaa

SEQ ID NO: 8768397 - DNA, 22 bp, Homo sapiens
gtgttgctctgtttgggggttg

SEQ ID NO: 8768398 - DNA, 22 bp, Homo sapiens
gtgttgctctgtttgggggttg

SEQ ID NO: 8768399 - DNA, 22 bp, Homo sapiens
gtgttgtggagcttgtcagggg

SEQ ID NO: 8768400 - DNA, 22 bp, Homo sapiens
gtgctggcctcagagggtcatg

SEQ ID NO: 8768401 - DNA, 21 bp, Homo sapiens
gtgctgggacacagccaggct

SEQ ID NO: 8768402 - DNA, 21 bp, Homo sapiens
gtgctgggacacagccaggct

SEQ ID NO: 8768403 - DNA, 22 bp, Homo sapiens
gtgctggctggacatggagcac

SEQ ID NO: 8768404 - DNA, 21 bp, Homo sapiens
gtgctgggacacagccaggct

SEQ ID NO: 8768405 - DNA, 22 bp, Homo sapiens
gtgctgggattacaggtgtgag

SEQ ID NO: 8768406 - DNA, 21 bp, Homo sapiens
gtgctgggacacagccaggct

SEQ ID NO: 8768407 - DNA, 21 bp, Homo sapiens
gtgctgggacacagccaggct

SEQ ID NO: 8768408 - DNA, 22 bp, Homo sapiens
gtgttattagagcattaatttt

SEQ ID NO: 8768409 - DNA, 22 bp, Homo sapiens
gtgtttctggggcattcatagt

SEQ ID NO: 8768410 - DNA, 22 bp, Homo sapiens
gtgtttctggggcattcatagt

SEQ ID NO: 8768411 - DNA, 21 bp, Homo sapiens
gtgtttcctgtttatggcttg

SEQ ID NO: 8768412 - DNA, 22 bp, Homo sapiens
gtgtttcctcacttctctgact

SEQ ID NO: 8768413 - DNA, 22 bp, Homo sapiens
gtgtttccctggcacaagaacc

SEQ ID NO: 8768414 - DNA, 22 bp, Homo sapiens
gttaaataacctcatgtccgtt

SEQ ID NO: 8768415 - DNA, 22 bp, Homo sapiens
gtgtttctggggcattcatagt

SEQ ID NO: 8768416 - DNA, 22 bp, Homo sapiens
gtgtttcttgcactccccggac

SEQ ID NO: 8768417 - DNA, 22 bp, Homo sapiens
gtgtttcttgcactccccggac

SEQ ID NO: 8768418 - DNA, 22 bp, Homo sapiens
gtgtttcttgcactccccggac

SEQ ID NO: 8768419 - DNA, 20 bp, Homo sapiens
gtgtttcatgtgatacaatg

SEQ ID NO: 8768420 - DNA, 22 bp, Homo sapiens
gtgtttccagttcagaaagcaa

SEQ ID NO: 8768421 - DNA, 18 bp, Homo sapiens
gttaacaattactaacgc

SEQ ID NO: 8768422 - DNA, 18 bp, Homo sapiens
gttaacaattactaacgc

SEQ ID NO: 8768423 - DNA, 22 bp, Homo sapiens
gttaacaagaattactctggaa

SEQ ID NO: 8768424 - DNA, 22 bp, Homo sapiens
gttaacaaccaaacagaagttc

SEQ ID NO: 8768425 - DNA, 22 bp, Homo sapiens
gttaaataacctcatgtccgtt

SEQ ID NO: 8768426 - DNA, 22 bp, Homo sapiens
gttaacaaatgtaaagcaatta

SEQ ID NO: 8768427 - DNA, 22 bp, Homo sapiens
gttaaattcgatgatggataaa

SEQ ID NO: 8768428 - DNA, 22 bp, Homo sapiens
tcaacactaaagaataatcttt

SEQ ID NO: 8768429 - DNA, 22 bp, Homo sapiens
tcaaatgaggctgatgaatgtg

SEQ ID NO: 8768430 - DNA, 22 bp, Homo sapiens
tcaaatgagtgactcacacagg

SEQ ID NO: 8768431 - DNA, 22 bp, Homo sapiens
tcaaatgagtgactcacacagg

SEQ ID NO: 8768432 - DNA, 22 bp, Homo sapiens
tcaaatgcacgtagagaaaata

SEQ ID NO: 8768433 - DNA, 22 bp, Homo sapiens
tcaaatgcacctctcatttgtt

SEQ ID NO: 8768434 - DNA, 22 bp, Homo sapiens
tcaacaagagcccatgcttttt

SEQ ID NO: 8768435 - DNA, 22 bp, Homo sapiens
tcaaatgaggctgatgaatgtg

SEQ ID NO: 8768436 - DNA, 19 bp, Homo sapiens
tcaaatgccaatgtcacag

SEQ ID NO: 8768437 - DNA, 22 bp, Homo sapiens
tcaaccaggaaactattttgct

SEQ ID NO: 8768438 - DNA, 22 bp, Homo sapiens
tcaacattgagtccctgggtct

SEQ ID NO: 8768439 - DNA, 22 bp, Homo sapiens
tcaacattggaggcaacattca

SEQ ID NO: 8768440 - DNA, 22 bp, Homo sapiens
tcaacatacatacatggtcagg

SEQ ID NO: 8768441 - DNA, 22 bp, Homo sapiens
tcaacagttgcactggagaggt

SEQ ID NO: 8768442 - DNA, 22 bp, Homo sapiens
tcaacatacatacatggtcagg

SEQ ID NO: 8768443 - DNA, 22 bp, Homo sapiens
tcaacagctagaaatatagaga

SEQ ID NO: 8768444 - DNA, 19 bp, Homo sapiens
tcaacagtggtgctgtgga

SEQ ID NO: 8768445 - DNA, 22 bp, Homo sapiens
tcaacagtggcaaagaggcacg

SEQ ID NO: 8768446 - DNA, 22 bp, Homo sapiens
tcaacactctttggcacagtta

SEQ ID NO: 8768447 - DNA, 22 bp, Homo sapiens
tcaacactggctacagttatgc

SEQ ID NO: 8768448 - DNA, 22 bp, Homo sapiens
tcaacagccagaaatattagcc

SEQ ID NO: 8768449 - DNA, 22 bp, Homo sapiens
tcaacagattgtattaaggtta

SEQ ID NO: 8768450 - DNA, 23 bp, Homo sapiens
tcaacagagcagagggaggcttt

SEQ ID NO: 8768451 - DNA, 22 bp, Homo sapiens
tcaacccttgtgcaacagtgat

SEQ ID NO: 8768452 - DNA, 22 bp, Homo sapiens
tcaacctctggagaaatcagga

SEQ ID NO: 8768453 - DNA, 22 bp, Homo sapiens
tcaaccttgtgagaactgagtc

SEQ ID NO: 8768454 - DNA, 22 bp, Homo sapiens
tcaacgtttgttaaatgagtat

SEQ ID NO: 8768455 - DNA, 19 bp, Homo sapiens
tcaaccctctttgcctagc

SEQ ID NO: 8768456 - DNA, 22 bp, Homo sapiens
tcaaccatccggcttatcctgc

SEQ ID NO: 8768457 - DNA, 22 bp, Homo sapiens
tcaaccctggtgggaatatttg

SEQ ID NO: 8768458 - DNA, 21 bp, Homo sapiens
tcaacccttgcgtcaccaagc

SEQ ID NO: 8768459 - DNA, 22 bp, Homo sapiens
tcaaccctgttttctttgcaat

SEQ ID NO: 8768460 - DNA, 22 bp, Homo sapiens
tcaacccttcctccatatttcc

SEQ ID NO: 8768461 - DNA, 22 bp, Homo sapiens
tcaacgtagatcttctgtgtat

SEQ ID NO: 8768462 - DNA, 22 bp, Homo sapiens
tcaactaaggcacaatctctaa

SEQ ID NO: 8768463 - DNA, 22 bp, Homo sapiens
tcaactcacaagaatgagcaag

SEQ ID NO: 8768464 - DNA, 22 bp, Homo sapiens
tcaacttggctttttaaagtcc

SEQ ID NO: 8768465 - DNA, 22 bp, Homo sapiens
tcaacttggagcacatttggct

SEQ ID NO: 8768466 - DNA, 22 bp, Homo sapiens
tcaactttagtgtagctattta

SEQ ID NO: 8768467 - DNA, 22 bp, Homo sapiens
tcaagaaaatgcctgctggtgt

SEQ ID NO: 8768468 - DNA, 22 bp, Homo sapiens
tcaagaaactgtagcaatgggt

SEQ ID NO: 8768469 - DNA, 22 bp, Homo sapiens
tcaagaaactgtgctacagagt

SEQ ID NO: 8768470 - DNA, 22 bp, Homo sapiens
tcaagaaaatgacgccaacctt

SEQ ID NO: 8768471 - DNA, 22 bp, Homo sapiens
tcaagaaaatgcctgctggtgt

SEQ ID NO: 8768472 - DNA, 22 bp, Homo sapiens
tcaagaaactgtagcaatgggt

SEQ ID NO: 8768473 - DNA, 22 bp, Homo sapiens
tcaagaaagggcttcaccagga

SEQ ID NO: 8768474 - DNA, 22 bp, Homo sapiens
tcaagaaactgtgctacagagt

SEQ ID NO: 8768475 - DNA, 22 bp, Homo sapiens
tcaagaaactgtgctacagagt

SEQ ID NO: 8768476 - DNA, 22 bp, Homo sapiens
tcacagtgacagccaatgtttt

SEQ ID NO: 8768477 - DNA, 22 bp, Homo sapiens
tcacagtgacttacagagattg

SEQ ID NO: 8768478 - DNA, 22 bp, Homo sapiens
tcacagtgagaaatttgttggc

SEQ ID NO: 8768479 - DNA, 22 bp, Homo sapiens
tcacagtattcatgaacatgga

SEQ ID NO: 8768480 - DNA, 22 bp, Homo sapiens
tcacagtattcatgaacatgga

SEQ ID NO: 8768481 - DNA, 22 bp, Homo sapiens
tcaagaacttaggagcaagcca

SEQ ID NO: 8768482 - DNA, 22 bp, Homo sapiens
tcaagaactggaaattgatatg

SEQ ID NO: 8768483 - DNA, 22 bp, Homo sapiens
tcaagaaatgtgcttggatata

SEQ ID NO: 8768484 - DNA, 22 bp, Homo sapiens
tcaagaaatgtgcttggatata

SEQ ID NO: 8768485 - DNA, 22 bp, Homo sapiens
tcacagtatcacacaaggatta

SEQ ID NO: 8768486 - DNA, 22 bp, Homo sapiens
tcacagtatcacacaaggatta

SEQ ID NO: 8768487 - DNA, 22 bp, Homo sapiens
tcacagtatcaggtggagtgga

SEQ ID NO: 8768488 - DNA, 22 bp, Homo sapiens
tcacagtatctagaaatgaggg

SEQ ID NO: 8768489 - DNA, 22 bp, Homo sapiens
tcacagtatctagaaatgaggg

SEQ ID NO: 8768490 - DNA, 22 bp, Homo sapiens
tcacagtatctagaaatgaggg

SEQ ID NO: 8768491 - DNA, 22 bp, Homo sapiens
tcacatttctttatgtagtctt

SEQ ID NO: 8768492 - DNA, 22 bp, Homo sapiens
tcacatttgataatgcccattg

SEQ ID NO: 8768493 - DNA, 22 bp, Homo sapiens
tcacatttgataatgcccattg

SEQ ID NO: 8768494 - DNA, 22 bp, Homo sapiens
tcacatttctgattataccaaa

SEQ ID NO: 8768495 - DNA, 22 bp, Homo sapiens
tcacatttctgattataccaaa

SEQ ID NO: 8768496 - DNA, 22 bp, Homo sapiens
tcacatttctgattataccaaa

SEQ ID NO: 8768497 - DNA, 21 bp, Homo sapiens
tcacatttctcatgggtaaat

SEQ ID NO: 8768498 - DNA, 22 bp, Homo sapiens
tcacatttatttcaaagttact

SEQ ID NO: 8768499 - DNA, 22 bp, Homo sapiens
tcacatttatttcaaagttact

SEQ ID NO: 8768500 - DNA, 22 bp, Homo sapiens
tcacatttatttcaaagttact

SEQ ID NO: 8768501 - DNA, 22 bp, Homo sapiens
tcacatttcaagtgctcaaaag

SEQ ID NO: 8768502 - DNA, 22 bp, Homo sapiens
tcacatttcaagtgctcaaaag

SEQ ID NO: 8768503 - DNA, 22 bp, Homo sapiens
tcacatttctcagcactgatga

SEQ ID NO: 8768504 - DNA, 22 bp, Homo sapiens
tcacatttcacatgggaggagg

SEQ ID NO: 8768505 - DNA, 22 bp, Homo sapiens
tcacatttcgcatcagtccgat

SEQ ID NO: 8768506 - DNA, 22 bp, Homo sapiens
tcacatttctcagcactgatga

SEQ ID NO: 8768507 - DNA, 22 bp, Homo sapiens
tcacatgctactgagccagacc

SEQ ID NO: 8768508 - DNA, 22 bp, Homo sapiens
tcacatgctactgagccagacc

SEQ ID NO: 8768509 - DNA, 22 bp, Homo sapiens
tcacatgctcacctaagccaca

SEQ ID NO: 8768510 - DNA, 22 bp, Homo sapiens
tcacatgccttttactctgcac

SEQ ID NO: 8768511 - DNA, 22 bp, Homo sapiens
tcacatgcttgaggaaagaaaa

SEQ ID NO: 8768512 - DNA, 21 bp, Homo sapiens
tcacatgcttattcctggaat

SEQ ID NO: 8768513 - DNA, 22 bp, Homo sapiens
tcacatgctgtgggatctgtat

SEQ ID NO: 8768514 - DNA, 23 bp, Homo sapiens
tcacatttaacccctcagacctc

SEQ ID NO: 8768515 - DNA, 23 bp, Homo sapiens
tcacatttaacccctcagacctc

SEQ ID NO: 8768516 - DNA, 22 bp, Homo sapiens
tcacatttatactccatttgca

SEQ ID NO: 8768517 - DNA, 22 bp, Homo sapiens
tcacatttatactccatttgca

SEQ ID NO: 8768518 - DNA, 22 bp, Homo sapiens
tcacatttatttcaaagttact

SEQ ID NO: 8768519 - DNA, 22 bp, Homo sapiens
tcacatttaaacaggaggatta

SEQ ID NO: 8768520 - DNA, 22 bp, Homo sapiens
tcacattgttatgtaaatgttt

SEQ ID NO: 8768521 - DNA, 22 bp, Homo sapiens
tcacattgtaggatagcagaga

SEQ ID NO: 8768522 - DNA, 22 bp, Homo sapiens
tcacattgtaggtcatttgcaa

SEQ ID NO: 8768523 - DNA, 22 bp, Homo sapiens
tcacagtgagccatgtcagaga

SEQ ID NO: 8768524 - DNA, 22 bp, Homo sapiens
tcacagtgaggagttacagttt

SEQ ID NO: 8768525 - DNA, 22 bp, Homo sapiens
tcacagtgaggcagttcttgta

SEQ ID NO: 8768526 - DNA, 22 bp, Homo sapiens
tcacagtgcaccagtgtgaagc

SEQ ID NO: 8768527 - DNA, 22 bp, Homo sapiens
tcacagtgataactaagtcctg

SEQ ID NO: 8768528 - DNA, 22 bp, Homo sapiens
tcacagtgatgacgtgggagca

SEQ ID NO: 8768529 - DNA, 22 bp, Homo sapiens
tcacagtgatgacgtgggagca

SEQ ID NO: 8768530 - DNA, 22 bp, Homo sapiens
tcacagtgcaggatcagttaat

SEQ ID NO: 8768531 - DNA, 18 bp, Homo sapiens
tcacagtgctcttgccta

SEQ ID NO: 8768532 - DNA, 22 bp, Homo sapiens
tcacagtgctctgggtggcaga

SEQ ID NO: 8768533 - DNA, 22 bp, Homo sapiens
tcacagtggagccaccaaggta

SEQ ID NO: 8768534 - DNA, 19 bp, Homo sapiens
tcacagtgcagaaccctcc

SEQ ID NO: 8768535 - DNA, 19 bp, Homo sapiens
tcacagtgcagaaccctcc

SEQ ID NO: 8768536 - DNA, 22 bp, Homo sapiens
tcacagtgcacccctcacaggg

SEQ ID NO: 8768537 - DNA, 22 bp, Homo sapiens
tcacagtgtcacaatgcctgga

SEQ ID NO: 8768538 - DNA, 22 bp, Homo sapiens
tcacagtgtcacaatgcctgga

SEQ ID NO: 8768539 - DNA, 22 bp, Homo sapiens
tcacagtttccataggtcagca

SEQ ID NO: 8768540 - DNA, 22 bp, Homo sapiens
tcacagtttccataggtcagca

SEQ ID NO: 8768541 - DNA, 22 bp, Homo sapiens
tcacagtgtgaaggtcagtcac

SEQ ID NO: 8768542 - DNA, 22 bp, Homo sapiens
tcacagttttagaaaatagata

SEQ ID NO: 8768543 - DNA, 22 bp, Homo sapiens
tcacataaattatacaatttca

SEQ ID NO: 8768544 - DNA, 23 bp, Homo sapiens
tcacataatccttcatccacagg

SEQ ID NO: 8768545 - DNA, 23 bp, Homo sapiens
tcacataatccttcatccacagg

SEQ ID NO: 8768546 - DNA, 22 bp, Homo sapiens
tcacatacactaggatattttt

SEQ ID NO: 8768547 - DNA, 22 bp, Homo sapiens
tcagaagttgataaagtagttg

SEQ ID NO: 8768548 - DNA, 22 bp, Homo sapiens
tcagaagtttcaatcccagctg

SEQ ID NO: 8768549 - DNA, 22 bp, Homo sapiens
tcagaataagttatgaaatgaa

SEQ ID NO: 8768550 - DNA, 22 bp, Homo sapiens
tcagaatggacccagactatag

SEQ ID NO: 8768551 - DNA, 22 bp, Homo sapiens
tcagaatggcccataaatagtc

SEQ ID NO: 8768552 - DNA, 21 bp, Homo sapiens
tcagaatgaaaaggcaatctg

SEQ ID NO: 8768553 - DNA, 22 bp, Homo sapiens
tcagaatgaaatttctttcaga

SEQ ID NO: 8768554 - DNA, 22 bp, Homo sapiens
tcagaatctttctagagtctag

SEQ ID NO: 8768555 - DNA, 22 bp, Homo sapiens
tcagaatctctggaggcttggc

SEQ ID NO: 8768556 - DNA, 22 bp, Homo sapiens
tcagaatctgaaaagcgcttgg

SEQ ID NO: 8768557 - DNA, 22 bp, Homo sapiens
tcagaatctgaaaagcgcttgg

SEQ ID NO: 8768558 - DNA, 21 bp, Homo sapiens
tcagaatctgtgagctatctc

SEQ ID NO: 8768559 - DNA, 21 bp, Homo sapiens
tcagaatctgtgagctatctc

SEQ ID NO: 8768560 - DNA, 22 bp, Homo sapiens
tcagaatctgcatttaacaaaa

SEQ ID NO: 8768561 - DNA, 22 bp, Homo sapiens
tcagaatctaaataggctccag

SEQ ID NO: 8768562 - DNA, 22 bp, Homo sapiens
tcagaatatgctaatgacattt

SEQ ID NO: 8768563 - DNA, 22 bp, Homo sapiens
tcagaagccaccttttgttggg

SEQ ID NO: 8768564 - DNA, 22 bp, Homo sapiens
tcagaagccgggcaggttttgg

SEQ ID NO: 8768565 - DNA, 22 bp, Homo sapiens
tcagaagccttgattatctaga

SEQ ID NO: 8768566 - DNA, 22 bp, Homo sapiens
tcagaacagcacagggtgattt

SEQ ID NO: 8768567 - DNA, 22 bp, Homo sapiens
tcagaacagcagggtgtggctg

SEQ ID NO: 8768568 - DNA, 22 bp, Homo sapiens
tcagaacagctctcagatatcc

SEQ ID NO: 8768569 - DNA, 22 bp, Homo sapiens
tcagaaacagaaactaagaacc

SEQ ID NO: 8768570 - DNA, 22 bp, Homo sapiens
tcagaaaccccaacaatggaga

SEQ ID NO: 8768571 - DNA, 22 bp, Homo sapiens
tcagaaacagaaactaagaacc

SEQ ID NO: 8768572 - DNA, 22 bp, Homo sapiens
tcagaaagaacacaggcagtag

SEQ ID NO: 8768573 - DNA, 22 bp, Homo sapiens
tcagaaactaaatgtggatttg

SEQ ID NO: 8768574 - DNA, 22 bp, Homo sapiens
tcagaaagcttagtgtcttgca

SEQ ID NO: 8768575 - DNA, 22 bp, Homo sapiens
tcagaaagctatatggtgtgtc

SEQ ID NO: 8768576 - DNA, 22 bp, Homo sapiens
tcagaaagctgattcttgatac

SEQ ID NO: 8768577 - DNA, 22 bp, Homo sapiens
tcagaaagctatatggtgtgtc

SEQ ID NO: 8768578 - DNA, 22 bp, Homo sapiens
tcagaaagacgaaacagatggg

SEQ ID NO: 8768579 - DNA, 22 bp, Homo sapiens
tcagaaagacgaaacagatggg

SEQ ID NO: 8768580 - DNA, 22 bp, Homo sapiens
tcagaacaattcctttataaca

SEQ ID NO: 8768581 - DNA, 22 bp, Homo sapiens
tcagaaaggttctatgttttac

SEQ ID NO: 8768582 - DNA, 22 bp, Homo sapiens
tcagaaagcttttacttaaaca

SEQ ID NO: 8768583 - DNA, 22 bp, Homo sapiens
tcagaaaggttctatgttttac

SEQ ID NO: 8768584 - DNA, 22 bp, Homo sapiens
tcagaacagcacagggtgattt

SEQ ID NO: 8768585 - DNA, 22 bp, Homo sapiens
tcagaacagaagaaggaacacg

SEQ ID NO: 8768586 - DNA, 22 bp, Homo sapiens
tcagaacagaagaaggaacacg

SEQ ID NO: 8768587 - DNA, 22 bp, Homo sapiens
tcagaacaattgggaaccatta

SEQ ID NO: 8768588 - DNA, 22 bp, Homo sapiens
tcagaacactttctctactgac

SEQ ID NO: 8768589 - DNA, 22 bp, Homo sapiens
tcagaaaataactgttagtttg

SEQ ID NO: 8768590 - DNA, 23 bp, Homo sapiens
tcactgctactcagcctgagatt

SEQ ID NO: 8768591 - DNA, 23 bp, Homo sapiens
tcactgctactcagcctgagatt

SEQ ID NO: 8768592 - DNA, 22 bp, Homo sapiens
tcactgcaacctccacctcctg

SEQ ID NO: 8768593 - DNA, 22 bp, Homo sapiens
tcactgccattagttggttaat

SEQ ID NO: 8768594 - DNA, 22 bp, Homo sapiens
tcactgcgcttcagcctgggtg

SEQ ID NO: 8768595 - DNA, 22 bp, Homo sapiens
tcactgcaacctccacctcctg

SEQ ID NO: 8768596 - DNA, 22 bp, Homo sapiens
tcactgcaacctccacctcctg

SEQ ID NO: 8768597 - DNA, 22 bp, Homo sapiens
tcactgcaacctccacctcccg

SEQ ID NO: 8768598 - DNA, 22 bp, Homo sapiens
tcactgcaacctccacctcccg

SEQ ID NO: 8768599 - DNA, 22 bp, Homo sapiens
tcacattttatatctctggttt

SEQ ID NO: 8768600 - DNA, 22 bp, Homo sapiens
tcacattttatctattttaagt

SEQ ID NO: 8768601 - DNA, 22 bp, Homo sapiens
tcacattttatctattttaagt

SEQ ID NO: 8768602 - DNA, 22 bp, Homo sapiens
tcacattttatctattttaagt

SEQ ID NO: 8768603 - DNA, 22 bp, Homo sapiens
tcactgattatgaaaatgaagg

SEQ ID NO: 8768604 - DNA, 22 bp, Homo sapiens
tcactgattatgaaaatgaagg

SEQ ID NO: 8768605 - DNA, 22 bp, Homo sapiens
tcactgcaacctccacctcccg

SEQ ID NO: 8768606 - DNA, 22 bp, Homo sapiens
tcactgatttgcccttatcctg

SEQ ID NO: 8768607 - DNA, 22 bp, Homo sapiens
tcactgcaacctccacctcccg

SEQ ID NO: 8768608 - DNA, 22 bp, Homo sapiens
tcactgcaacctccacctcccg

SEQ ID NO: 8768609 - DNA, 22 bp, Homo sapiens
tcacatttggagaaagcctgcc

SEQ ID NO: 8768610 - DNA, 22 bp, Homo sapiens
tcacatttgtgttttattagag

SEQ ID NO: 8768611 - DNA, 22 bp, Homo sapiens
tcacatttgcaattgcattgtt

SEQ ID NO: 8768612 - DNA, 22 bp, Homo sapiens
tcacatttgcaattgcattgtt

SEQ ID NO: 8768613 - DNA, 22 bp, Homo sapiens
tcacatttgcaattgcattgtt

SEQ ID NO: 8768614 - DNA, 22 bp, Homo sapiens
tcacatttgttcttgaatctaa

SEQ ID NO: 8768615 - DNA, 22 bp, Homo sapiens
tcacatttgttcctctgcactt

SEQ ID NO: 8768616 - DNA, 22 bp, Homo sapiens
tcagcaggcccatcctccaggc

SEQ ID NO: 8768617 - DNA, 22 bp, Homo sapiens
tcagcaggcccatcctccaggc

SEQ ID NO: 8768618 - DNA, 22 bp, Homo sapiens
tcagcaggcagtgggtcacaat

SEQ ID NO: 8768619 - DNA, 22 bp, Homo sapiens
tcagcaggcaggaggcatgcca

SEQ ID NO: 8768620 - DNA, 22 bp, Homo sapiens
tcagcaggcggttccttgtggg

SEQ ID NO: 8768621 - DNA, 22 bp, Homo sapiens
tcagcaggctgtcagcaggggc

SEQ ID NO: 8768622 - DNA, 22 bp, Homo sapiens
tcagcaggctctggttgaccat

SEQ ID NO: 8768623 - DNA, 22 bp, Homo sapiens
tcagcaacctgcttgaggaggc

SEQ ID NO: 8768624 - DNA, 17 bp, Homo sapiens
tcagcaaagacaaagga

SEQ ID NO: 8768625 - DNA, 22 bp, Homo sapiens
tcagcaaaggaccagcacaggc

SEQ ID NO: 8768626 - DNA, 17 bp, Homo sapiens
tcagcaaagacaaagga

SEQ ID NO: 8768627 - DNA, 22 bp, Homo sapiens
tcagcaaaggcaattcattatt

SEQ ID NO: 8768628 - DNA, 22 bp, Homo sapiens
tcagcaaaggaccagcacaggc

SEQ ID NO: 8768629 - DNA, 22 bp, Homo sapiens
tcagcaaaatgtggctagtgct

SEQ ID NO: 8768630 - DNA, 22 bp, Homo sapiens
tcagcagggccatgctctctct

SEQ ID NO: 8768631 - DNA, 22 bp, Homo sapiens
tcagcagggccatgctctctct

SEQ ID NO: 8768632 - DNA, 22 bp, Homo sapiens
tcagcagggcatactgagccta

SEQ ID NO: 8768633 - DNA, 22 bp, Homo sapiens
tcagcagggcatactgagccta

SEQ ID NO: 8768634 - DNA, 22 bp, Homo sapiens
tcagcagggaggctctgtgccc

SEQ ID NO: 8768635 - DNA, 22 bp, Homo sapiens
tcagcagggagaggagaatgca

SEQ ID NO: 8768636 - DNA, 22 bp, Homo sapiens
tcagcagggctgggagctgtga

SEQ ID NO: 8768637 - DNA, 22 bp, Homo sapiens
tcagcagggcctccttgtgcag

SEQ ID NO: 8768638 - DNA, 22 bp, Homo sapiens
tcagcagggctgggagctgtga

SEQ ID NO: 8768639 - DNA, 17 bp, Homo sapiens
tcagcaggggccaagct

SEQ ID NO: 8768640 - DNA, 17 bp, Homo sapiens
tcagcaggggccaagct

SEQ ID NO: 8768641 - DNA, 22 bp, Homo sapiens
tcagattgttggagccaaacag

SEQ ID NO: 8768642 - DNA, 22 bp, Homo sapiens
tcagatttactgcagagcagat

SEQ ID NO: 8768643 - DNA, 20 bp, Homo sapiens
tcagatgggagtgagccatc

SEQ ID NO: 8768644 - DNA, 22 bp, Homo sapiens
tcagatggtcattcactagggt

SEQ ID NO: 8768645 - DNA, 22 bp, Homo sapiens
tcagatgtccttccagagattt

SEQ ID NO: 8768646 - DNA, 22 bp, Homo sapiens
tcagatggattcattacatgac

SEQ ID NO: 8768647 - DNA, 22 bp, Homo sapiens
tcagatggaggcaatgttacct

SEQ ID NO: 8768648 - DNA, 22 bp, Homo sapiens
tcagatggcacacagagcctgc

SEQ ID NO: 8768649 - DNA, 22 bp, Homo sapiens
tcagatgcttagtgactacaca

SEQ ID NO: 8768650 - DNA, 19 bp, Homo sapiens
tcagatgcttctcgtctca

SEQ ID NO: 8768651 - DNA, 22 bp, Homo sapiens
tcagatgctgttttcttatata

SEQ ID NO: 8768652 - DNA, 22 bp, Homo sapiens
tcagatgcttagagattagact

SEQ ID NO: 8768653 - DNA, 22 bp, Homo sapiens
tcagagttctctgtccagatga

SEQ ID NO: 8768654 - DNA, 22 bp, Homo sapiens
tcagagttctctgtccagatga

SEQ ID NO: 8768655 - DNA, 22 bp, Homo sapiens
tcagagttctctgtccagatga

SEQ ID NO: 8768656 - DNA, 22 bp, Homo sapiens
tcagatgctagggctgagctat

SEQ ID NO: 8768657 - DNA, 22 bp, Homo sapiens
tcagattttattttcctgttac

SEQ ID NO: 8768658 - DNA, 22 bp, Homo sapiens
tcagattttccagcctttctct

SEQ ID NO: 8768659 - DNA, 22 bp, Homo sapiens
tcagatttggacacaggaactt

SEQ ID NO: 8768660 - DNA, 22 bp, Homo sapiens
tcagatttgaatattcctttcg

SEQ ID NO: 8768661 - DNA, 22 bp, Homo sapiens
tcagatttccttgcagtttgga

SEQ ID NO: 8768662 - DNA, 22 bp, Homo sapiens
tcagatttcctgttgaagaagt

SEQ ID NO: 8768663 - DNA, 22 bp, Homo sapiens
tcagaattctgaccttgggtca

SEQ ID NO: 8768664 - DNA, 22 bp, Homo sapiens
tcagaattctgaagggcacaaa

SEQ ID NO: 8768665 - DNA, 22 bp, Homo sapiens
tcagaattctagctcttccctt

SEQ ID NO: 8768666 - DNA, 22 bp, Homo sapiens
tcagaattctacaatagatcag

SEQ ID NO: 8768667 - DNA, 22 bp, Homo sapiens
tcagaattctacaatagatcag

SEQ ID NO: 8768668 - DNA, 23 bp, Homo sapiens
tcagaattccagtttctttgaag

SEQ ID NO: 8768669 - DNA, 22 bp, Homo sapiens
tcagaattagagctcttcttga

SEQ ID NO: 8768670 - DNA, 22 bp, Homo sapiens
tcagaattatgtaggcctggtt

SEQ ID NO: 8768671 - DNA, 22 bp, Homo sapiens
tcagaattcagagggagtgggg

SEQ ID NO: 8768672 - DNA, 22 bp, Homo sapiens
tcagaattaagctcttggtcag

SEQ ID NO: 8768673 - DNA, 22 bp, Homo sapiens
tcagaattacacagggccttga

SEQ ID NO: 8768674 - DNA, 21 bp, Homo sapiens
tcagaattacccctggatctg

SEQ ID NO: 8768675 - DNA, 22 bp, Homo sapiens
tcagaatgttcctgctgtcagt

SEQ ID NO: 8768676 - DNA, 22 bp, Homo sapiens
tcagaatgtgcagaggaacagt

SEQ ID NO: 8768677 - DNA, 22 bp, Homo sapiens
tcagaatgtgcagaggaacagt

SEQ ID NO: 8768678 - DNA, 22 bp, Homo sapiens
tcagaattttggtttggttggt

SEQ ID NO: 8768679 - DNA, 22 bp, Homo sapiens
tcagaatttttgttacccttga

SEQ ID NO: 8768680 - DNA, 22 bp, Homo sapiens
tcagaattttctggaatggagc

SEQ ID NO: 8768681 - DNA, 22 bp, Homo sapiens
tcagaattttaaaccaaggaaa

SEQ ID NO: 8768682 - DNA, 22 bp, Homo sapiens
tcagaatttaaaatgtgtagat

SEQ ID NO: 8768683 - DNA, 22 bp, Homo sapiens
tcagaattggacaatagaagca

SEQ ID NO: 8768684 - DNA, 22 bp, Homo sapiens
tcagaattgtggagaaagggga

SEQ ID NO: 8768685 - DNA, 22 bp, Homo sapiens
tcagaatttgattcctgggata

SEQ ID NO: 8768686 - DNA, 22 bp, Homo sapiens
tcagaatttaaaatgtgtagat

SEQ ID NO: 8768687 - DNA, 22 bp, Homo sapiens
tcagaattggaacgtgaagatt

SEQ ID NO: 8768688 - DNA, 22 bp, Homo sapiens
tcagaattgcagggagggcagg

SEQ ID NO: 8768689 - DNA, 22 bp, Homo sapiens
tcagaattggaacgtgaagatt

SEQ ID NO: 8768690 - DNA, 22 bp, Homo sapiens
tcagaattgtctggggaatgtt

SEQ ID NO: 8768691 - DNA, 19 bp, Homo sapiens
tcagaattctgtctcttga

SEQ ID NO: 8768692 - DNA, 22 bp, Homo sapiens
tcagaattgattttcaaaacag

SEQ ID NO: 8768693 - DNA, 22 bp, Homo sapiens
tcagagtgttttactaaacaag

SEQ ID NO: 8768694 - DNA, 22 bp, Homo sapiens
tcagagttcctcatagatccag

SEQ ID NO: 8768695 - DNA, 21 bp, Homo sapiens
tcagagtgtgttacagcaagc

SEQ ID NO: 8768696 - DNA, 22 bp, Homo sapiens
tcagagtgtggtgagatgtgca

SEQ ID NO: 8768697 - DNA, 22 bp, Homo sapiens
tcagacagagaagtacaatgag

SEQ ID NO: 8768698 - DNA, 22 bp, Homo sapiens
tcagacagaggagctcgtgcag

SEQ ID NO: 8768699 - DNA, 22 bp, Homo sapiens
tcagacagaggagctcgtgcag

SEQ ID NO: 8768700 - DNA, 22 bp, Homo sapiens
tcagacagaaggactatttgaa

SEQ ID NO: 8768701 - DNA, 22 bp, Homo sapiens
tcagacagaaagatgagtatgg

SEQ ID NO: 8768702 - DNA, 22 bp, Homo sapiens
tcagacaagtaaaataatgtaa

SEQ ID NO: 8768703 - DNA, 18 bp, Homo sapiens
tcagacaagttagacagg

SEQ ID NO: 8768704 - DNA, 18 bp, Homo sapiens
tcagacaagttagacagg

SEQ ID NO: 8768705 - DNA, 22 bp, Homo sapiens
tcagctggatgtggaagtgcta

SEQ ID NO: 8768706 - DNA, 22 bp, Homo sapiens
tcagctggatgtggaagtgcta

SEQ ID NO: 8768707 - DNA, 19 bp, Homo sapiens
tcagctggcaggcctcctc

SEQ ID NO: 8768708 - DNA, 22 bp, Homo sapiens
tcagctggagatccttgttgtg

SEQ ID NO: 8768709 - DNA, 22 bp, Homo sapiens
tcagctggagatgagaaccgaa

SEQ ID NO: 8768710 - DNA, 22 bp, Homo sapiens
tcagctggagatccttgttgtg

SEQ ID NO: 8768711 - DNA, 22 bp, Homo sapiens
tcagctggagactgctcaatga

SEQ ID NO: 8768712 - DNA, 22 bp, Homo sapiens
tcagctggaagatggtgcagaa

SEQ ID NO: 8768713 - DNA, 23 bp, Homo sapiens
tcagctgcttcctcctgcctgcc

SEQ ID NO: 8768714 - DNA, 22 bp, Homo sapiens
tcagctggaagatggtgcagaa

SEQ ID NO: 8768715 - DNA, 22 bp, Homo sapiens
tcagctggcaggttctgggaag

SEQ ID NO: 8768716 - DNA, 22 bp, Homo sapiens
tcagctgggaagttctcgcttg

SEQ ID NO: 8768717 - DNA, 22 bp, Homo sapiens
tcagctggggccccctctgtcc

SEQ ID NO: 8768718 - DNA, 22 bp, Homo sapiens
tcagctggtgagtggatagaca

SEQ ID NO: 8768719 - DNA, 22 bp, Homo sapiens
tcagctggtgagtggatagaca

SEQ ID NO: 8768720 - DNA, 18 bp, Homo sapiens
tcagctgggtttctgggt

SEQ ID NO: 8768721 - DNA, 22 bp, Homo sapiens
tcagctgtactgtgccatagct

SEQ ID NO: 8768722 - DNA, 18 bp, Homo sapiens
tcagctggggctgcagcc

SEQ ID NO: 8768723 - DNA, 22 bp, Homo sapiens
tcagctgggtgagtgttctgca

SEQ ID NO: 8768724 - DNA, 22 bp, Homo sapiens
tcagctggtgaatggactcatc

SEQ ID NO: 8768725 - DNA, 22 bp, Homo sapiens
tcaggaagggctcagtctgtgc

SEQ ID NO: 8768726 - DNA, 22 bp, Homo sapiens
tcaggaagggctcagtctgtgc

SEQ ID NO: 8768727 - DNA, 22 bp, Homo sapiens
tcaggaagggtggtccacaggg

SEQ ID NO: 8768728 - DNA, 22 bp, Homo sapiens
tcaggaagggtggtccacaggg

SEQ ID NO: 8768729 - DNA, 22 bp, Homo sapiens
tcaggaagggtggtccacaggg

SEQ ID NO: 8768730 - DNA, 22 bp, Homo sapiens
tcaggaagtataatcagattca

SEQ ID NO: 8768731 - DNA, 22 bp, Homo sapiens
tcaggacaacaagacttgttta

SEQ ID NO: 8768732 - DNA, 22 bp, Homo sapiens
tcaggacacttggcacaaggtc

SEQ ID NO: 8768733 - DNA, 22 bp, Homo sapiens
tcaggacacttggcacaaggtc

SEQ ID NO: 8768734 - DNA, 22 bp, Homo sapiens
tcaggacagaaggctgccaggg

SEQ ID NO: 8768735 - DNA, 22 bp, Homo sapiens
tcaggacaacctgttttcagac

SEQ ID NO: 8768736 - DNA, 22 bp, Homo sapiens
tcaggacagccagggtgcagac

SEQ ID NO: 8768737 - DNA, 22 bp, Homo sapiens
tcaggacagggatcacatcatc

SEQ ID NO: 8768738 - DNA, 22 bp, Homo sapiens
tcaggacagggatcacatcatc

SEQ ID NO: 8768739 - DNA, 22 bp, Homo sapiens
tcaggacatttgtcagcaggag

SEQ ID NO: 8768740 - DNA, 22 bp, Homo sapiens
tcaggacagttccctgcaaatt

SEQ ID NO: 8768741 - DNA, 22 bp, Homo sapiens
tcaggacagttccctgcaaatt

SEQ ID NO: 8768742 - DNA, 22 bp, Homo sapiens
tcaggagacattcttaaagtag

SEQ ID NO: 8768743 - DNA, 22 bp, Homo sapiens
tcaggagactggcagtgcccac

SEQ ID NO: 8768744 - DNA, 18 bp, Homo sapiens
tcaggagacacagacgca

SEQ ID NO: 8768745 - DNA, 22 bp, Homo sapiens
tcaggagaatcagggctgtcct

SEQ ID NO: 8768746 - DNA, 22 bp, Homo sapiens
tcaggagaatcagggctgtcct

SEQ ID NO: 8768747 - DNA, 22 bp, Homo sapiens
tcaggagaatcagggctgtcct

SEQ ID NO: 8768748 - DNA, 22 bp, Homo sapiens
tcaggagaacttccttctaccc

SEQ ID NO: 8768749 - DNA, 22 bp, Homo sapiens
tcaggagaacttccttctaccc

SEQ ID NO: 8768750 - DNA, 22 bp, Homo sapiens
tcaggagaaggcaatgtggaaa

SEQ ID NO: 8768751 - DNA, 22 bp, Homo sapiens
tcaggacatttgtcagcaggag

SEQ ID NO: 8768752 - DNA, 19 bp, Homo sapiens
tcaggactgacttgaagtc

SEQ ID NO: 8768753 - DNA, 22 bp, Homo sapiens
tcaggactagacatgaggaagg

SEQ ID NO: 8768754 - DNA, 22 bp, Homo sapiens
tcaggagaaaatatcaggaagt

SEQ ID NO: 8768755 - DNA, 22 bp, Homo sapiens
tcaggagaaaatatcaggaagt

SEQ ID NO: 8768756 - DNA, 22 bp, Homo sapiens
tcaggagaaagccaattagagt

SEQ ID NO: 8768757 - DNA, 22 bp, Homo sapiens
tcagccacttccctctggtcag

SEQ ID NO: 8768758 - DNA, 22 bp, Homo sapiens
tcagccagaaagtgattttcag

SEQ ID NO: 8768759 - DNA, 22 bp, Homo sapiens
tcagccagaggcttcttggttt

SEQ ID NO: 8768760 - DNA, 19 bp, Homo sapiens
tcagccaccagaagagata

SEQ ID NO: 8768761 - DNA, 22 bp, Homo sapiens
tcagcatttcagaagtggcata

SEQ ID NO: 8768762 - DNA, 22 bp, Homo sapiens
tcagccagagggggcaaaggaa

SEQ ID NO: 8768763 - DNA, 22 bp, Homo sapiens
tcagccagaggtggatgagtca

SEQ ID NO: 8768764 - DNA, 22 bp, Homo sapiens
tcagccagaggtggatgagtca

SEQ ID NO: 8768765 - DNA, 22 bp, Homo sapiens
tcagccagaggtggatgagtca

SEQ ID NO: 8768766 - DNA, 22 bp, Homo sapiens
tcagccagcattacccctgact

SEQ ID NO: 8768767 - DNA, 22 bp, Homo sapiens
tcagccagccagctacaggctt

SEQ ID NO: 8768768 - DNA, 22 bp, Homo sapiens
tcagccagcattacccctgact

SEQ ID NO: 8768769 - DNA, 22 bp, Homo sapiens
tcagccagcatcagctaagtgc

SEQ ID NO: 8768770 - DNA, 19 bp, Homo sapiens
tcagcatcaatttggtcct

SEQ ID NO: 8768771 - DNA, 19 bp, Homo sapiens
tcagcatcaatttggtcct

SEQ ID NO: 8768772 - DNA, 22 bp, Homo sapiens
tcagcatctacagctttgctat

SEQ ID NO: 8768773 - DNA, 22 bp, Homo sapiens
tcagcatcagtattgtttagga

SEQ ID NO: 8768774 - DNA, 22 bp, Homo sapiens
tcagctgccccgggcactgccc

SEQ ID NO: 8768775 - DNA, 22 bp, Homo sapiens
tcagctgcctttcccatgctag

SEQ ID NO: 8768776 - DNA, 22 bp, Homo sapiens
tcagctgcctttcccatgctag

SEQ ID NO: 8768777 - DNA, 22 bp, Homo sapiens
tcagctgcctctccctggaaga

SEQ ID NO: 8768778 - DNA, 22 bp, Homo sapiens
tcagctgcgacaggggcctgag

SEQ ID NO: 8768779 - DNA, 22 bp, Homo sapiens
tcagctgctctgttgagctgaa

SEQ ID NO: 8768780 - DNA, 22 bp, Homo sapiens
tcagccaggcacaatggcagct

SEQ ID NO: 8768781 - DNA, 22 bp, Homo sapiens
tcagccagctgtgtgcttctgc

SEQ ID NO: 8768782 - DNA, 20 bp, Homo sapiens
tcagccagctaacatgggga

SEQ ID NO: 8768783 - DNA, 22 bp, Homo sapiens
tcagccagccagctacaggctt

SEQ ID NO: 8768784 - DNA, 20 bp, Homo sapiens
tcagccagctaacatgggga

SEQ ID NO: 8768785 - DNA, 22 bp, Homo sapiens
tcagccaggccaccttcagctt

SEQ ID NO: 8768786 - DNA, 22 bp, Homo sapiens
tcagctctgcactccactgtgg

SEQ ID NO: 8768787 - DNA, 22 bp, Homo sapiens
tcagctctgcctgtggaggcac

SEQ ID NO: 8768788 - DNA, 22 bp, Homo sapiens
tcagccaggccaccttcagctt

SEQ ID NO: 8768789 - DNA, 22 bp, Homo sapiens
tcagtgtttgtggcaaatgtta

SEQ ID NO: 8768790 - DNA, 22 bp, Homo sapiens
tcagtgtttgtggcaaatgtta

SEQ ID NO: 8768791 - DNA, 22 bp, Homo sapiens
tcagtgttttaactgtctttta

SEQ ID NO: 8768792 - DNA, 22 bp, Homo sapiens
tcagtgtttcctgtggtacagc

SEQ ID NO: 8768793 - DNA, 22 bp, Homo sapiens
tcagttaacaactatttattga

SEQ ID NO: 8768794 - DNA, 22 bp, Homo sapiens
tcagttaacggaaaggggtgtg

SEQ ID NO: 8768795 - DNA, 22 bp, Homo sapiens
tcagttaagactgcactggact

SEQ ID NO: 8768796 - DNA, 23 bp, Homo sapiens
tcagttaactgtgttacctgtgc

SEQ ID NO: 8768797 - DNA, 22 bp, Homo sapiens
tcagttaatatgggtaaagcat

SEQ ID NO: 8768798 - DNA, 22 bp, Homo sapiens
tcagttaatcaatgtggtctaa

SEQ ID NO: 8768799 - DNA, 22 bp, Homo sapiens
tcagttaatggattctgtcaga

SEQ ID NO: 8768800 - DNA, 22 bp, Homo sapiens
tcagttaagcactataccctaa

SEQ ID NO: 8768801 - DNA, 20 bp, Homo sapiens
tcagttaagttgctgaatct

SEQ ID NO: 8768802 - DNA, 22 bp, Homo sapiens
tcagttaagaggccacggcagt

SEQ ID NO: 8768803 - DNA, 22 bp, Homo sapiens
tcagttaatggtaagggtgaaa

SEQ ID NO: 8768804 - DNA, 22 bp, Homo sapiens
tcataaagcttgcctgcagtgt

SEQ ID NO: 8768805 - DNA, 22 bp, Homo sapiens
tcataaagcttgcctgcagtgt

SEQ ID NO: 8768806 - DNA, 22 bp, Homo sapiens
tcataaagtgaaggatgatggg

SEQ ID NO: 8768807 - DNA, 22 bp, Homo sapiens
tcataaagttatcaccaaatcc

SEQ ID NO: 8768808 - DNA, 22 bp, Homo sapiens
tcataaagttacccaaatttta

SEQ ID NO: 8768809 - DNA, 22 bp, Homo sapiens
tcataaagttgttttaatggga

SEQ ID NO: 8768810 - DNA, 22 bp, Homo sapiens
tcataaagttctaagaattgta

SEQ ID NO: 8768811 - DNA, 22 bp, Homo sapiens
tcataaagttgttttaatggga

SEQ ID NO: 8768812 - DNA, 23 bp, Homo sapiens
tcataaatattagcacagtagga

SEQ ID NO: 8768813 - DNA, 23 bp, Homo sapiens
tcataaatattagcacagtagga

SEQ ID NO: 8768814 - DNA, 23 bp, Homo sapiens
tcataaatattagcacagtagga

SEQ ID NO: 8768815 - DNA, 23 bp, Homo sapiens
tcataaatattagcacagtagga

SEQ ID NO: 8768816 - DNA, 22 bp, Homo sapiens
tcataaatcatactccatttgc

SEQ ID NO: 8768817 - DNA, 23 bp, Homo sapiens
tcataaatattagcacagtagga

SEQ ID NO: 8768818 - DNA, 23 bp, Homo sapiens
tcataaatattagcacagtagga

SEQ ID NO: 8768819 - DNA, 22 bp, Homo sapiens
tcagtgttggtcaagaatcagt

SEQ ID NO: 8768820 - DNA, 22 bp, Homo sapiens
tcagtgttcttatttaattagg

SEQ ID NO: 8768821 - DNA, 22 bp, Homo sapiens
tcagtgttggcattcagaaatg

SEQ ID NO: 8768822 - DNA, 22 bp, Homo sapiens
tcagtgttggagataattgcac

SEQ ID NO: 8768823 - DNA, 22 bp, Homo sapiens
tcagtctcatcaactctattcc

SEQ ID NO: 8768824 - DNA, 22 bp, Homo sapiens
tcagtctcatcaactctattcc

SEQ ID NO: 8768825 - DNA, 22 bp, Homo sapiens
tcagtctccatctgcttgtctt

SEQ ID NO: 8768826 - DNA, 22 bp, Homo sapiens
tcagtcctcacttggttctaag

SEQ ID NO: 8768827 - DNA, 22 bp, Homo sapiens
tcagtccttggcatttaggagc

SEQ ID NO: 8768828 - DNA, 22 bp, Homo sapiens
tcagtccttatctggtgttcag

SEQ ID NO: 8768829 - DNA, 22 bp, Homo sapiens
tcagtcgtgtagaagttgatcc

SEQ ID NO: 8768830 - DNA, 19 bp, Homo sapiens
tcagtctaggaatgagcta

SEQ ID NO: 8768831 - DNA, 18 bp, Homo sapiens
tcagtctattgtataaga

SEQ ID NO: 8768832 - DNA, 22 bp, Homo sapiens
tcagtcctctctgggtttctta

SEQ ID NO: 8768833 - DNA, 22 bp, Homo sapiens
tcatcttgctgccattgcttta

SEQ ID NO: 8768834 - DNA, 22 bp, Homo sapiens
tcatctttaccccttgcttcaa

SEQ ID NO: 8768835 - DNA, 22 bp, Homo sapiens
tcatcttgcagtgtgtgttctg

SEQ ID NO: 8768836 - DNA, 22 bp, Homo sapiens
tcatctttaccccttgcttcaa

SEQ ID NO: 8768837 - DNA, 22 bp, Homo sapiens
tcatctttcctcaaaagatcca

SEQ ID NO: 8768838 - DNA, 22 bp, Homo sapiens
tcatctttcctcaaaagatcca

SEQ ID NO: 8768839 - DNA, 22 bp, Homo sapiens
tcatctttcctcaaaagatcca

SEQ ID NO: 8768840 - DNA, 22 bp, Homo sapiens
tcatctttcctcaaaagatcca

SEQ ID NO: 8768841 - DNA, 22 bp, Homo sapiens
tcatctttaccccttgcttcaa

SEQ ID NO: 8768842 - DNA, 22 bp, Homo sapiens
tcatgaaaaattttccatgtca

SEQ ID NO: 8768843 - DNA, 22 bp, Homo sapiens
tcatctttgtatccctaacaca

SEQ ID NO: 8768844 - DNA, 22 bp, Homo sapiens
tcatgcagaggaaggctagttt

SEQ ID NO: 8768845 - DNA, 22 bp, Homo sapiens
tcatgaaaatagatcagaaatt

SEQ ID NO: 8768846 - DNA, 19 bp, Homo sapiens
tcatgcactttgatgtaac

SEQ ID NO: 8768847 - DNA, 23 bp, Homo sapiens
tcatcttcctcatttctccaggg

SEQ ID NO: 8768848 - DNA, 22 bp, Homo sapiens
tcatcttcctcatttctccagg

SEQ ID NO: 8768849 - DNA, 22 bp, Homo sapiens
tcatcttcctcatttctccagg

SEQ ID NO: 8768850 - DNA, 22 bp, Homo sapiens
tcatcttcctcatttctccagg

SEQ ID NO: 8768851 - DNA, 22 bp, Homo sapiens
tcatcttaggtgatgagacagt

SEQ ID NO: 8768852 - DNA, 22 bp, Homo sapiens
tcatctgttgattttaagtctt

SEQ ID NO: 8768853 - DNA, 22 bp, Homo sapiens
tcatctgtttctctgtagttct

SEQ ID NO: 8768854 - DNA, 22 bp, Homo sapiens
tcatctgtttctctgtagttct

SEQ ID NO: 8768855 - DNA, 22 bp, Homo sapiens
tcatctgttcatacacatgcgt

SEQ ID NO: 8768856 - DNA, 22 bp, Homo sapiens
tcatctgttcatacacatgcgt

SEQ ID NO: 8768857 - DNA, 22 bp, Homo sapiens
tcatctgttatgggagtttttg

SEQ ID NO: 8768858 - DNA, 22 bp, Homo sapiens
tcatctgttatttatgcctgag

SEQ ID NO: 8768859 - DNA, 22 bp, Homo sapiens
tcatctgttatttatgcctgag

SEQ ID NO: 8768860 - DNA, 22 bp, Homo sapiens
tcatctgttatttatgcctgag

SEQ ID NO: 8768861 - DNA, 22 bp, Homo sapiens
tcatctgtggctgcttttgtgc

SEQ ID NO: 8768862 - DNA, 22 bp, Homo sapiens
tcatctgtggctgcttttgtgc

SEQ ID NO: 8768863 - DNA, 22 bp, Homo sapiens
tcatctgtggctgcttttgtgc

SEQ ID NO: 8768864 - DNA, 22 bp, Homo sapiens
tcatctgtcccaggcttttttc

SEQ ID NO: 8768865 - DNA, 22 bp, Homo sapiens
tcatctgttatgggagtttttg

SEQ ID NO: 8768866 - DNA, 22 bp, Homo sapiens
tcatctgtgcaggactcagaag

SEQ ID NO: 8768867 - DNA, 22 bp, Homo sapiens
tcatctgtgaataatgaactgg

SEQ ID NO: 8768868 - DNA, 22 bp, Homo sapiens
tcatctgaggcaccagagcata

SEQ ID NO: 8768869 - DNA, 22 bp, Homo sapiens
tcatctgaggcaccagagcata

SEQ ID NO: 8768870 - DNA, 22 bp, Homo sapiens
tcatctgaccccatctattctc

SEQ ID NO: 8768871 - DNA, 23 bp, Homo sapiens
tcatctgtaacagcctatgaaat

SEQ ID NO: 8768872 - DNA, 23 bp, Homo sapiens
tcatctgtaagtatctgtggagt

SEQ ID NO: 8768873 - DNA, 22 bp, Homo sapiens
tcatctgtcaaattgcaataag

SEQ ID NO: 8768874 - DNA, 22 bp, Homo sapiens
tcatctgtcaaattgcaataag

SEQ ID NO: 8768875 - DNA, 23 bp, Homo sapiens
tcatctgtaagtatctgtggagt

SEQ ID NO: 8768876 - DNA, 22 bp, Homo sapiens
tcatctgtcccaggcttttttc

SEQ ID NO: 8768877 - DNA, 22 bp, Homo sapiens
tcatctgtctgagagacttctg

SEQ ID NO: 8768878 - DNA, 22 bp, Homo sapiens
tcatctgtctgagagacttctg

SEQ ID NO: 8768879 - DNA, 22 bp, Homo sapiens
tcatacattcagcagatatttg

SEQ ID NO: 8768880 - DNA, 22 bp, Homo sapiens
tcatacattcagcagatatttg

SEQ ID NO: 8768881 - DNA, 22 bp, Homo sapiens
tcatagaaatatcacgtctttt

SEQ ID NO: 8768882 - DNA, 22 bp, Homo sapiens
tcatagaaatggaaagtatatt

SEQ ID NO: 8768883 - DNA, 22 bp, Homo sapiens
tcatagaaatgtggccagaaac

SEQ ID NO: 8768884 - DNA, 22 bp, Homo sapiens
tcatagaagcaccagaagatat

SEQ ID NO: 8768885 - DNA, 22 bp, Homo sapiens
tcatagaagcaccagaagatat

SEQ ID NO: 8768886 - DNA, 22 bp, Homo sapiens
tcatagatgtgctgtgcacaaa

SEQ ID NO: 8768887 - DNA, 22 bp, Homo sapiens
tcatagatgtgctgtgcacaaa

SEQ ID NO: 8768888 - DNA, 22 bp, Homo sapiens
tcatctgaccactttatctctc

SEQ ID NO: 8768889 - DNA, 22 bp, Homo sapiens
tcatctgaacatgcagcctgtg

SEQ ID NO: 8768890 - DNA, 22 bp, Homo sapiens
tcatagaagtagtatccacatt

SEQ ID NO: 8768891 - DNA, 22 bp, Homo sapiens
tcatagaagtagtatccacatt

SEQ ID NO: 8768892 - DNA, 22 bp, Homo sapiens
tcatagaatgagttaatgaact

SEQ ID NO: 8768893 - DNA, 18 bp, Homo sapiens
tcatagaagtgaatcaga

SEQ ID NO: 8768894 - DNA, 18 bp, Homo sapiens
tcatagaagtgaatcaga

SEQ ID NO: 8768895 - DNA, 22 bp, Homo sapiens
tcataaatgcagtgtcataaat

SEQ ID NO: 8768896 - DNA, 22 bp, Homo sapiens
tcataaattagctgtctttgaa

SEQ ID NO: 8768897 - DNA, 22 bp, Homo sapiens
tcataaattctggtgctgtgag

SEQ ID NO: 8768898 - DNA, 22 bp, Homo sapiens
tcataaattagctgtctttgaa

SEQ ID NO: 8768899 - DNA, 22 bp, Homo sapiens
tcatacatgttgtgttcaaatg

SEQ ID NO: 8768900 - DNA, 22 bp, Homo sapiens
tcatacatctgtcctggagctc

SEQ ID NO: 8768901 - DNA, 22 bp, Homo sapiens
tcataaattgattatgtgcttt

SEQ ID NO: 8768902 - DNA, 22 bp, Homo sapiens
tcataaattgattatgtgcttt

SEQ ID NO: 8768903 - DNA, 22 bp, Homo sapiens
tcataaattgattatgtgcttt

SEQ ID NO: 8768904 - DNA, 22 bp, Homo sapiens
tcagggctgcatacaggagata

SEQ ID NO: 8768905 - DNA, 22 bp, Homo sapiens
tcagggctgcagaagaggcagg

SEQ ID NO: 8768906 - DNA, 22 bp, Homo sapiens
tcagggctgactgctactctcc

SEQ ID NO: 8768907 - DNA, 22 bp, Homo sapiens
tcagggctcagcatctggcatt

SEQ ID NO: 8768908 - DNA, 23 bp, Homo sapiens
tcagggctcacacgttttctggc

SEQ ID NO: 8768909 - DNA, 22 bp, Homo sapiens
tcagggcctttgcagttgtttt

SEQ ID NO: 8768910 - DNA, 22 bp, Homo sapiens
tcagggcctttgcagttgtttt

SEQ ID NO: 8768911 - DNA, 22 bp, Homo sapiens
tcagggccctggacaaccctcc

SEQ ID NO: 8768912 - DNA, 19 bp, Homo sapiens
tcagggccgcagagggtac

SEQ ID NO: 8768913 - DNA, 22 bp, Homo sapiens
tcagggccctggcaggaaacag

SEQ ID NO: 8768914 - DNA, 22 bp, Homo sapiens
tcagggccgccggggatctcgc

SEQ ID NO: 8768915 - DNA, 22 bp, Homo sapiens
tcagggccgccggggatctcgc

SEQ ID NO: 8768916 - DNA, 22 bp, Homo sapiens
tcagggccggggctgtggcgag

SEQ ID NO: 8768917 - DNA, 22 bp, Homo sapiens
tcagggcctgagcttttaatta

SEQ ID NO: 8768918 - DNA, 22 bp, Homo sapiens
tcagggcatcatcatgaatata

SEQ ID NO: 8768919 - DNA, 22 bp, Homo sapiens
tcagtatccacaaatgctcaaa

SEQ ID NO: 8768920 - DNA, 22 bp, Homo sapiens
tcagtatcatgcggtagccatg

SEQ ID NO: 8768921 - DNA, 22 bp, Homo sapiens
tcagtatcaatagcgtcacaat

SEQ ID NO: 8768922 - DNA, 19 bp, Homo sapiens
tcagtatataattacacca

SEQ ID NO: 8768923 - DNA, 22 bp, Homo sapiens
tcagtatagcttctaaactaac

SEQ ID NO: 8768924 - DNA, 22 bp, Homo sapiens
tcagtatagcttctaaactaac

SEQ ID NO: 8768925 - DNA, 22 bp, Homo sapiens
tcagtatagctaaaagtttgtc

SEQ ID NO: 8768926 - DNA, 22 bp, Homo sapiens
tcagtataattgctggcactga

SEQ ID NO: 8768927 - DNA, 22 bp, Homo sapiens
tcagtaatattctttaaaatac

SEQ ID NO: 8768928 - DNA, 22 bp, Homo sapiens
tcagtacacttcagtatttgtg

SEQ ID NO: 8768929 - DNA, 22 bp, Homo sapiens
tcagtacacttcagtatttgtg

SEQ ID NO: 8768930 - DNA, 22 bp, Homo sapiens
tcagtacttctgcatcttccag

SEQ ID NO: 8768931 - DNA, 23 bp, Homo sapiens
tcagtactctgctgggtatagag

SEQ ID NO: 8768932 - DNA, 18 bp, Homo sapiens
tcagtactgcagagagaa

SEQ ID NO: 8768933 - DNA, 22 bp, Homo sapiens
tcagtacttcccattctgagct

SEQ ID NO: 8768934 - DNA, 22 bp, Homo sapiens
tcagtacttcagtagatggagc

SEQ ID NO: 8768935 - DNA, 22 bp, Homo sapiens
tcagtagcagaaagcaatgagt

SEQ ID NO: 8768936 - DNA, 22 bp, Homo sapiens
tcagtacttgcatcctctcctt

SEQ ID NO: 8768937 - DNA, 22 bp, Homo sapiens
tcagtaaataactcagatgctc

SEQ ID NO: 8768938 - DNA, 22 bp, Homo sapiens
tcagtaaataactcagatgctc

SEQ ID NO: 8768939 - DNA, 22 bp, Homo sapiens
tcagtaaaggctaggttatgct

SEQ ID NO: 8768940 - DNA, 22 bp, Homo sapiens
tcagtaaaggggaggtgatggg

SEQ ID NO: 8768941 - DNA, 22 bp, Homo sapiens
tcagtaaacaggtttaagtcct

SEQ ID NO: 8768942 - DNA, 22 bp, Homo sapiens
tcagtaaccctgctgttcagag

SEQ ID NO: 8768943 - DNA, 22 bp, Homo sapiens
tcagtaaatgcttgcaggccga

SEQ ID NO: 8768944 - DNA, 22 bp, Homo sapiens
tcagtaaatgagcaaaaatttc

SEQ ID NO: 8768945 - DNA, 22 bp, Homo sapiens
tcaggctgtaaatggtgtgggt

SEQ ID NO: 8768946 - DNA, 22 bp, Homo sapiens
tcaggctgtaaatggtgtgggt

SEQ ID NO: 8768947 - DNA, 22 bp, Homo sapiens
tcaggctgtaaatggtgtgggt

SEQ ID NO: 8768948 - DNA, 22 bp, Homo sapiens
tcaggctggtggtcagatggct

SEQ ID NO: 8768949 - DNA, 22 bp, Homo sapiens
tcaggctggtggtcagatggct

SEQ ID NO: 8768950 - DNA, 22 bp, Homo sapiens
tcaggctggtccccacagtgga

SEQ ID NO: 8768951 - DNA, 22 bp, Homo sapiens
tcaggctggtccccacagtgga

SEQ ID NO: 8768952 - DNA, 22 bp, Homo sapiens
tcaggctggtccccacagtgga

SEQ ID NO: 8768953 - DNA, 22 bp, Homo sapiens
tcaggctggtccccacagtgga

SEQ ID NO: 8768954 - DNA, 20 bp, Homo sapiens
tcaggctggtgggctttccc

SEQ ID NO: 8768955 - DNA, 22 bp, Homo sapiens
tcaggctggtccccacagtgga

SEQ ID NO: 8768956 - DNA, 22 bp, Homo sapiens
tcaggctggtggtcagatggct

SEQ ID NO: 8768957 - DNA, 17 bp, Homo sapiens
tcaggctgggtgcagtg

SEQ ID NO: 8768958 - DNA, 17 bp, Homo sapiens
tcaggctgggtgcagtg

SEQ ID NO: 8768959 - DNA, 22 bp, Homo sapiens
tcaggagagagaaattggggct

SEQ ID NO: 8768960 - DNA, 21 bp, Homo sapiens
tcaggagagcccatctacaaa

SEQ ID NO: 8768961 - DNA, 22 bp, Homo sapiens
tcaggagacttatgtcacagtg

SEQ ID NO: 8768962 - DNA, 22 bp, Homo sapiens
tcaggagacttatgtcacagtg

SEQ ID NO: 8768963 - DNA, 22 bp, Homo sapiens
tcaggagacttatgtcacagtg

SEQ ID NO: 8768964 - DNA, 22 bp, Homo sapiens
tcaggagacttatgtcacagtg

SEQ ID NO: 8768965 - DNA, 22 bp, Homo sapiens
tcaggagacttatgtcacagtg

SEQ ID NO: 8768966 - DNA, 22 bp, Homo sapiens
tcaggctgtagggcccctggag

SEQ ID NO: 8768967 - DNA, 22 bp, Homo sapiens
tcaggctgttcctgtccaaaat

SEQ ID NO: 8768968 - DNA, 22 bp, Homo sapiens
tcaggcttccaacaatgatgtt

SEQ ID NO: 8768969 - DNA, 22 bp, Homo sapiens
tcatttctccgacctgctgtcc

SEQ ID NO: 8768970 - DNA, 22 bp, Homo sapiens
tcatttctattgctactgtctg

SEQ ID NO: 8768971 - DNA, 22 bp, Homo sapiens
tcatttctattgctactgtctg

SEQ ID NO: 8768972 - DNA, 22 bp, Homo sapiens
tcatttctcctaagtgaaatat

SEQ ID NO: 8768973 - DNA, 22 bp, Homo sapiens
tcatttctctgagtctgataat

SEQ ID NO: 8768974 - DNA, 21 bp, Homo sapiens
tcatttctctatgtatttcac

SEQ ID NO: 8768975 - DNA, 21 bp, Homo sapiens
tcatttctctatgtatttcac

SEQ ID NO: 8768976 - DNA, 21 bp, Homo sapiens
tcatttctctatgtatttcac

SEQ ID NO: 8768977 - DNA, 22 bp, Homo sapiens
tcatttctgagccttccatgat

SEQ ID NO: 8768978 - DNA, 22 bp, Homo sapiens
tcatttctgagccttccatgat

SEQ ID NO: 8768979 - DNA, 22 bp, Homo sapiens
tcatttctgagccttccatgat

SEQ ID NO: 8768980 - DNA, 22 bp, Homo sapiens
tcatttctctgagtctgataat

SEQ ID NO: 8768981 - DNA, 22 bp, Homo sapiens
tcatttctgagccttccatgat

SEQ ID NO: 8768982 - DNA, 22 bp, Homo sapiens
tcatttctgagccttccatgat

SEQ ID NO: 8768983 - DNA, 22 bp, Homo sapiens
tcatttctgagccttccatgat

SEQ ID NO: 8768984 - DNA, 22 bp, Homo sapiens
tcatttctgttgtgcatcactg

SEQ ID NO: 8768985 - DNA, 22 bp, Homo sapiens
tcatttcttaactagagtgaac

SEQ ID NO: 8768986 - DNA, 22 bp, Homo sapiens
tcatttctgttgtgcatcactg

SEQ ID NO: 8768987 - DNA, 20 bp, Homo sapiens
tcatttcttggggttccaag

SEQ ID NO: 8768988 - DNA, 22 bp, Homo sapiens
tcatttggagccttcctgtttt

SEQ ID NO: 8768989 - DNA, 22 bp, Homo sapiens
tcatttggtattaattttcaga

SEQ ID NO: 8768990 - DNA, 22 bp, Homo sapiens
tcatttgggtcagttttccata

SEQ ID NO: 8768991 - DNA, 22 bp, Homo sapiens
tcatttctatctatgcagcttc

SEQ ID NO: 8768992 - DNA, 22 bp, Homo sapiens
tcatttctatctatgcagcttc

SEQ ID NO: 8768993 - DNA, 17 bp, Homo sapiens
tcatttctaggcactcc

SEQ ID NO: 8768994 - DNA, 17 bp, Homo sapiens
tcatttctaggcactcc

SEQ ID NO: 8768995 - DNA, 23 bp, Homo sapiens
tcatttcatccagccttgagagt

SEQ ID NO: 8768996 - DNA, 23 bp, Homo sapiens
tcatttcatccagccttgagagt

SEQ ID NO: 8768997 - DNA, 23 bp, Homo sapiens
tcatttcatccagccttgagagt

SEQ ID NO: 8768998 - DNA, 22 bp, Homo sapiens
tcatttccctcctacaaagagg

SEQ ID NO: 8768999 - DNA, 22 bp, Homo sapiens
tcatttccctcctacaaagagg

SEQ ID NO: 8769000 - DNA, 22 bp, Homo sapiens
tcatttcagtcctctgtgtgag

SEQ ID NO: 8769001 - DNA, 17 bp, Homo sapiens
tcatttcagtaaatcca

SEQ ID NO: 8769002 - DNA, 22 bp, Homo sapiens
tcatttcagtggcacagaagat

SEQ ID NO: 8769003 - DNA, 23 bp, Homo sapiens
tcatttcatccagccttgagagt

SEQ ID NO: 8769004 - DNA, 22 bp, Homo sapiens
tcatttcacttctctagggaga

SEQ ID NO: 8769005 - DNA, 22 bp, Homo sapiens
tcatttcacttctctagggaga

SEQ ID NO: 8769006 - DNA, 22 bp, Homo sapiens
tcatttcagccatttttaaatg

SEQ ID NO: 8769007 - DNA, 22 bp, Homo sapiens
tcatttcagccatttttaaatg

SEQ ID NO: 8769008 - DNA, 22 bp, Homo sapiens
tcatttcaatgatactactaag

SEQ ID NO: 8769009 - DNA, 22 bp, Homo sapiens
tcatttcaatgatactactaag

SEQ ID NO: 8769010 - DNA, 23 bp, Homo sapiens
tcatttcacagtgagcttcctag

SEQ ID NO: 8769011 - DNA, 22 bp, Homo sapiens
tcatttatattgtattctgtag

SEQ ID NO: 8769012 - DNA, 22 bp, Homo sapiens
tcatttatattgtattctgtag

SEQ ID NO: 8769013 - DNA, 22 bp, Homo sapiens
tcatttatattgtattctgtag

SEQ ID NO: 8769014 - DNA, 22 bp, Homo sapiens
tcatttactgtaggcaaaaatt

SEQ ID NO: 8769015 - DNA, 22 bp, Homo sapiens
tcatttactgtaggcaaaaatt

SEQ ID NO: 8769016 - DNA, 19 bp, Homo sapiens
tcatttacggttttgatga

SEQ ID NO: 8769017 - DNA, 22 bp, Homo sapiens
tcatttacttctatgacaacat

SEQ ID NO: 8769018 - DNA, 22 bp, Homo sapiens
tcatttacttctatgacaacat

SEQ ID NO: 8769019 - DNA, 22 bp, Homo sapiens
tcatttacttggttttaatctt

SEQ ID NO: 8769020 - DNA, 22 bp, Homo sapiens
tcatttacatagaaacaatata

SEQ ID NO: 8769021 - DNA, 22 bp, Homo sapiens
tcatttacatagaaacaatata

SEQ ID NO: 8769022 - DNA, 22 bp, Homo sapiens
tcatttacatgtctttctctga

SEQ ID NO: 8769023 - DNA, 22 bp, Homo sapiens
tcatttataaggatgcaattaa

SEQ ID NO: 8769024 - DNA, 22 bp, Homo sapiens
tcatttataaggatgcaattaa

SEQ ID NO: 8769025 - DNA, 22 bp, Homo sapiens
tcatttatagctaaccttgaat

SEQ ID NO: 8769026 - DNA, 22 bp, Homo sapiens
tcatttatagctaaccttgaat

SEQ ID NO: 8769027 - DNA, 22 bp, Homo sapiens
tcatttatagctaaccttgaat

SEQ ID NO: 8769028 - DNA, 22 bp, Homo sapiens
tcatttatagaagtgggcagta

SEQ ID NO: 8769029 - DNA, 22 bp, Homo sapiens
tcattgttgcgttaatgtcttc

SEQ ID NO: 8769030 - DNA, 22 bp, Homo sapiens
tcattgttgcgttaatgtcttc

SEQ ID NO: 8769031 - DNA, 22 bp, Homo sapiens
tcattgtttctgcttttcatga

SEQ ID NO: 8769032 - DNA, 22 bp, Homo sapiens
tcattgtttctgcttttcatga

SEQ ID NO: 8769033 - DNA, 22 bp, Homo sapiens
tcatttaaaatgtaccaggatt

SEQ ID NO: 8769034 - DNA, 22 bp, Homo sapiens
tcattgttttgattccttcatg

SEQ ID NO: 8769035 - DNA, 22 bp, Homo sapiens
tcattgttttgattccttcatg

SEQ ID NO: 8769036 - DNA, 22 bp, Homo sapiens
tcatttacacttcacaaatgga

SEQ ID NO: 8769037 - DNA, 22 bp, Homo sapiens
tcatttacacttcacaaatgga

SEQ ID NO: 8769038 - DNA, 22 bp, Homo sapiens
tcatttacaggtgaagcaacta

SEQ ID NO: 8769039 - DNA, 22 bp, Homo sapiens
tcatttaatagcttttgtcttt

SEQ ID NO: 8769040 - DNA, 22 bp, Homo sapiens
tcattgttaattgtatgatctg

SEQ ID NO: 8769041 - DNA, 22 bp, Homo sapiens
tcattgttatgttttgctgtct

SEQ ID NO: 8769042 - DNA, 22 bp, Homo sapiens
tcattgttcctatttggcaaga

SEQ ID NO: 8769043 - DNA, 22 bp, Homo sapiens
tcattgttactgtttagttgcc

SEQ ID NO: 8769044 - DNA, 22 bp, Homo sapiens
tcattgtcgctctgcggtgttc

SEQ ID NO: 8769045 - DNA, 22 bp, Homo sapiens
tcattgcttcaggacctaccat

SEQ ID NO: 8769046 - DNA, 22 bp, Homo sapiens
tcattgtaattatctgtggtat

SEQ ID NO: 8769047 - DNA, 22 bp, Homo sapiens
tcattgctggctctggagtatg

SEQ ID NO: 8769048 - DNA, 22 bp, Homo sapiens
tcattgccatggcatttgcaga

SEQ ID NO: 8769049 - DNA, 22 bp, Homo sapiens
tcattgtagggcatttagagag

SEQ ID NO: 8769050 - DNA, 22 bp, Homo sapiens
tcattgtatactttatttatga

SEQ ID NO: 8769051 - DNA, 22 bp, Homo sapiens
tccaaattctatgttctttcca

SEQ ID NO: 8769052 - DNA, 22 bp, Homo sapiens
tccaaattctatgttctttcca

SEQ ID NO: 8769053 - DNA, 22 bp, Homo sapiens
tccaaatttaccttacagatat

SEQ ID NO: 8769054 - DNA, 22 bp, Homo sapiens
tccaaatttaccttacagatat

SEQ ID NO: 8769055 - DNA, 22 bp, Homo sapiens
tccaacatttatcaaggttgtt

SEQ ID NO: 8769056 - DNA, 22 bp, Homo sapiens
tccaacatgcagtcaggcctag

SEQ ID NO: 8769057 - DNA, 22 bp, Homo sapiens
tccaactaggcacacagctggt

SEQ ID NO: 8769058 - DNA, 22 bp, Homo sapiens
tccaacatttatcaaggttgtt

SEQ ID NO: 8769059 - DNA, 22 bp, Homo sapiens
tccaactttctcctccggcttg

SEQ ID NO: 8769060 - DNA, 22 bp, Homo sapiens
tccaaattctagggccttggtt

SEQ ID NO: 8769061 - DNA, 22 bp, Homo sapiens
tccaaatataggatgtgatata

SEQ ID NO: 8769062 - DNA, 22 bp, Homo sapiens
tccaagctttccatgccctcac

SEQ ID NO: 8769063 - DNA, 22 bp, Homo sapiens
tccaagctttccatgccctcac

SEQ ID NO: 8769064 - DNA, 22 bp, Homo sapiens
tccaagcttgctttagccacag

SEQ ID NO: 8769065 - DNA, 22 bp, Homo sapiens
tccaagctctctatgccatgat

SEQ ID NO: 8769066 - DNA, 22 bp, Homo sapiens
tccaagctctctatgccatgat

SEQ ID NO: 8769067 - DNA, 22 bp, Homo sapiens
tccaagctgtatgttcctagag

SEQ ID NO: 8769068 - DNA, 22 bp, Homo sapiens
tccaagctgtatgttcctagag

SEQ ID NO: 8769069 - DNA, 22 bp, Homo sapiens
tccaagctactgaaggtttggg

SEQ ID NO: 8769070 - DNA, 21 bp, Homo sapiens
tccaagctcaactcccttcct

SEQ ID NO: 8769071 - DNA, 20 bp, Homo sapiens
tccaattaaaaattgtatgc

SEQ ID NO: 8769072 - DNA, 22 bp, Homo sapiens
tccaatgttcctgctttcagct

SEQ ID NO: 8769073 - DNA, 20 bp, Homo sapiens
tccaatgtaggataaatgtg

SEQ ID NO: 8769074 - DNA, 22 bp, Homo sapiens
tccaatattcattaaaatgcag

SEQ ID NO: 8769075 - DNA, 22 bp, Homo sapiens
tccaatatttctcatatatgga

SEQ ID NO: 8769076 - DNA, 22 bp, Homo sapiens
tccaatcagggaaagccaggtc

SEQ ID NO: 8769077 - DNA, 22 bp, Homo sapiens
tccaatcagctcctatgagaat

SEQ ID NO: 8769078 - DNA, 22 bp, Homo sapiens
tccaatcaactctggactcctg

SEQ ID NO: 8769079 - DNA, 22 bp, Homo sapiens
tccaataacatctaaaaactta

SEQ ID NO: 8769080 - DNA, 22 bp, Homo sapiens
tccaagttgatgtttcttaaat

SEQ ID NO: 8769081 - DNA, 22 bp, Homo sapiens
tccaaggagtcttaagttacat

SEQ ID NO: 8769082 - DNA, 22 bp, Homo sapiens
tccaaggctccggccctggcgt

SEQ ID NO: 8769083 - DNA, 22 bp, Homo sapiens
tccaaggctccggccctggcgt

SEQ ID NO: 8769084 - DNA, 22 bp, Homo sapiens
tccaagtccattatggtggtct

SEQ ID NO: 8769085 - DNA, 22 bp, Homo sapiens
tccaagtcttccttcccaaacc

SEQ ID NO: 8769086 - DNA, 18 bp, Homo sapiens
tccaaaatcatgtatttt

SEQ ID NO: 8769087 - DNA, 22 bp, Homo sapiens
tccaaacaccctccatgctgca

SEQ ID NO: 8769088 - DNA, 18 bp, Homo sapiens
tccaaaatcatgtatttt

SEQ ID NO: 8769089 - DNA, 21 bp, Homo sapiens
tccaaacctgtctctggctct

SEQ ID NO: 8769090 - DNA, 22 bp, Homo sapiens
tccaaacaccctccatgctgca

SEQ ID NO: 8769091 - DNA, 22 bp, Homo sapiens
tccaaacaccctccatgctgca

SEQ ID NO: 8769092 - DNA, 22 bp, Homo sapiens
tccaaacaccctccatgctgca

SEQ ID NO: 8769093 - DNA, 22 bp, Homo sapiens
tccaaagaacattgctgagacc

SEQ ID NO: 8769094 - DNA, 23 bp, Homo sapiens
tccaaactcaagacattaataag

SEQ ID NO: 8769095 - DNA, 22 bp, Homo sapiens
tccaaagaacctggctactgtc

SEQ ID NO: 8769096 - DNA, 18 bp, Homo sapiens
tccaaagccagagaagtt

SEQ ID NO: 8769097 - DNA, 22 bp, Homo sapiens
tccaaagcatctgagtgtgcat

SEQ ID NO: 8769098 - DNA, 22 bp, Homo sapiens
tccaaagaggattcagggacct

SEQ ID NO: 8769099 - DNA, 22 bp, Homo sapiens
tccaaagaggttaagaacgaga

SEQ ID NO: 8769100 - DNA, 22 bp, Homo sapiens
tccaaagacttgctgtatgtaa

SEQ ID NO: 8769101 - DNA, 22 bp, Homo sapiens
tccaaagaagtcacaaacgaag

SEQ ID NO: 8769102 - DNA, 19 bp, Homo sapiens
tccaaagaagttcacattt

SEQ ID NO: 8769103 - DNA, 19 bp, Homo sapiens
tccaaagaagttcacattt

SEQ ID NO: 8769104 - DNA, 22 bp, Homo sapiens
tccaaatacatttactgtattt

SEQ ID NO: 8769105 - DNA, 22 bp, Homo sapiens
tccaaaggaagaggctgtcagt

SEQ ID NO: 8769106 - DNA, 18 bp, Homo sapiens
tccaaagctgctggtttt

SEQ ID NO: 8769107 - DNA, 21 bp, Homo sapiens
tccaaaggagactgagtgtgt

SEQ ID NO: 8769108 - DNA, 22 bp, Homo sapiens
tccaaagtaatttcacttctgt

SEQ ID NO: 8769109 - DNA, 22 bp, Homo sapiens
tccaaaggccctaataagcttg

SEQ ID NO: 8769110 - DNA, 22 bp, Homo sapiens
tccaaaggggcagtgtccagcc

SEQ ID NO: 8769111 - DNA, 18 bp, Homo sapiens
tccaaaggtcccctccca

SEQ ID NO: 8769112 - DNA, 19 bp, Homo sapiens
tcatttgttagtagaagtt

SEQ ID NO: 8769113 - DNA, 19 bp, Homo sapiens
tcatttgttagtagaagtt

SEQ ID NO: 8769114 - DNA, 22 bp, Homo sapiens
tcatttgttcatctgctcttct

SEQ ID NO: 8769115 - DNA, 22 bp, Homo sapiens
tcatttgttctcattctctact

SEQ ID NO: 8769116 - DNA, 22 bp, Homo sapiens
tcatttttagcgcgcaaaagtt

SEQ ID NO: 8769117 - DNA, 22 bp, Homo sapiens
tcatttttagcgcgcaaaagtt

SEQ ID NO: 8769118 - DNA, 22 bp, Homo sapiens
tcatttttagcgcgcaaaagtt

SEQ ID NO: 8769119 - DNA, 21 bp, Homo sapiens
tcatttttattgctaccttgc

SEQ ID NO: 8769120 - DNA, 21 bp, Homo sapiens
tcatttttattgctaccttgc

SEQ ID NO: 8769121 - DNA, 21 bp, Homo sapiens
tcatttttattgctaccttgc

SEQ ID NO: 8769122 - DNA, 21 bp, Homo sapiens
tcatttttattgctaccttgc

SEQ ID NO: 8769123 - DNA, 22 bp, Homo sapiens
tcatttgtctggcacagggaat

SEQ ID NO: 8769124 - DNA, 21 bp, Homo sapiens
tcatttgtgatctgatttcca

SEQ ID NO: 8769125 - DNA, 22 bp, Homo sapiens
tcatttgtaccattttttaaga

SEQ ID NO: 8769126 - DNA, 22 bp, Homo sapiens
tcatttgtaccattttttaaga

SEQ ID NO: 8769127 - DNA, 22 bp, Homo sapiens
tcatttgtgcaatgtagatgaa

SEQ ID NO: 8769128 - DNA, 22 bp, Homo sapiens
tcatttgtggaagtgattgtgg

SEQ ID NO: 8769129 - DNA, 22 bp, Homo sapiens
tcatttgtgtgagtgatttgac

SEQ ID NO: 8769130 - DNA, 22 bp, Homo sapiens
tcatttgtggaagtgattgtgg

SEQ ID NO: 8769131 - DNA, 22 bp, Homo sapiens
tcatttgttacagccacatacc

SEQ ID NO: 8769132 - DNA, 22 bp, Homo sapiens
tcattttttgcatacctgtgtc

SEQ ID NO: 8769133 - DNA, 22 bp, Homo sapiens
tcattttttgcatacctgtgtc

SEQ ID NO: 8769134 - DNA, 22 bp, Homo sapiens
tcattttttgcatacctgtgtc

SEQ ID NO: 8769135 - DNA, 22 bp, Homo sapiens
tcatttttttccggtaggaata

SEQ ID NO: 8769136 - DNA, 22 bp, Homo sapiens
tcatttttttccggtaggaata

SEQ ID NO: 8769137 - DNA, 22 bp, Homo sapiens
tcatttttttccggtaggaata

SEQ ID NO: 8769138 - DNA, 18 bp, Homo sapiens
tccaaaatcatgtatttt

SEQ ID NO: 8769139 - DNA, 22 bp, Homo sapiens
tccaaaacagaactctgtgaat

SEQ ID NO: 8769140 - DNA, 22 bp, Homo sapiens
tccaaaaaacgtttgaatagtt

SEQ ID NO: 8769141 - DNA, 22 bp, Homo sapiens
tccaaaaaacgtttgaatagtt

SEQ ID NO: 8769142 - DNA, 22 bp, Homo sapiens
tcatttttctcttacacgtaga

SEQ ID NO: 8769143 - DNA, 22 bp, Homo sapiens
tcatttttcacacagggtcacc

SEQ ID NO: 8769144 - DNA, 22 bp, Homo sapiens
tcatttttcacacagggtcacc

SEQ ID NO: 8769145 - DNA, 22 bp, Homo sapiens
tcatttttcacacagggtcacc

SEQ ID NO: 8769146 - DNA, 22 bp, Homo sapiens
tcatttttctcttacacgtaga

SEQ ID NO: 8769147 - DNA, 22 bp, Homo sapiens
tcatttttcacacagggtcacc

SEQ ID NO: 8769148 - DNA, 22 bp, Homo sapiens
tcatttttctcttacacgtaga

SEQ ID NO: 8769149 - DNA, 22 bp, Homo sapiens
tcatttttgtctccggtttgtg

SEQ ID NO: 8769150 - DNA, 22 bp, Homo sapiens
tcatttttgtctccggtttgtg

SEQ ID NO: 8769151 - DNA, 22 bp, Homo sapiens
tcatttttgaccatgggtagga

SEQ ID NO: 8769152 - DNA, 22 bp, Homo sapiens
tcatttttgtctccggtttgtg

SEQ ID NO: 8769153 - DNA, 22 bp, Homo sapiens
tcatttttgaccatgggtagga

SEQ ID NO: 8769154 - DNA, 22 bp, Homo sapiens
tcatttttgaccatgggtagga

SEQ ID NO: 8769155 - DNA, 22 bp, Homo sapiens
tcccagcctgacagtgcatcaa

SEQ ID NO: 8769156 - DNA, 22 bp, Homo sapiens
tcccagcctggaccctgccagt

SEQ ID NO: 8769157 - DNA, 22 bp, Homo sapiens
tcccagcctggaccctgccagt

SEQ ID NO: 8769158 - DNA, 22 bp, Homo sapiens
tcccagcctggaccctgccagt

SEQ ID NO: 8769159 - DNA, 22 bp, Homo sapiens
tcccagcctggaccctgccagt

SEQ ID NO: 8769160 - DNA, 22 bp, Homo sapiens
tcccagccttccagtctggttt

SEQ ID NO: 8769161 - DNA, 22 bp, Homo sapiens
tcccagccttatctcccctggc

SEQ ID NO: 8769162 - DNA, 22 bp, Homo sapiens
tcccagccttatctcccctggc

SEQ ID NO: 8769163 - DNA, 22 bp, Homo sapiens
tcccaggccataaaactcagag

SEQ ID NO: 8769164 - DNA, 22 bp, Homo sapiens
tcccaggcgcctggtggggagc

SEQ ID NO: 8769165 - DNA, 22 bp, Homo sapiens
tcccaggcgcctggtggggagc

SEQ ID NO: 8769166 - DNA, 16 bp, Homo sapiens
tcccaggccaggtgga

SEQ ID NO: 8769167 - DNA, 22 bp, Homo sapiens
tcccaggccacacttggggaac

SEQ ID NO: 8769168 - DNA, 22 bp, Homo sapiens
tcccaggcaggtgacaggggga

SEQ ID NO: 8769169 - DNA, 22 bp, Homo sapiens
tcccaggccacacttggggaac

SEQ ID NO: 8769170 - DNA, 16 bp, Homo sapiens
tcccaggccaggtgga

SEQ ID NO: 8769171 - DNA, 22 bp, Homo sapiens
tcccagcctttctttctccagc

SEQ ID NO: 8769172 - DNA, 22 bp, Homo sapiens
tcccagccttccttgtggtgaa

SEQ ID NO: 8769173 - DNA, 22 bp, Homo sapiens
tcccagccttccttgtggtgaa

SEQ ID NO: 8769174 - DNA, 22 bp, Homo sapiens
tcccagccttccttgtggtgaa

SEQ ID NO: 8769175 - DNA, 23 bp, Homo sapiens
tcccagcctcttctcttgcatac

SEQ ID NO: 8769176 - DNA, 23 bp, Homo sapiens
tcccagcctcttctcttgcatac

SEQ ID NO: 8769177 - DNA, 22 bp, Homo sapiens
tcccagcctcctgacagttttg

SEQ ID NO: 8769178 - DNA, 22 bp, Homo sapiens
tcccagcctcctgacagttttg

SEQ ID NO: 8769179 - DNA, 22 bp, Homo sapiens
tcccagccggtgcctgggtccc

SEQ ID NO: 8769180 - DNA, 22 bp, Homo sapiens
tcccagccggtgcctgggtccc

SEQ ID NO: 8769181 - DNA, 22 bp, Homo sapiens
tcccagccggtgcctgggtccc

SEQ ID NO: 8769182 - DNA, 22 bp, Homo sapiens
tcccagcccaggtatgatgata

SEQ ID NO: 8769183 - DNA, 22 bp, Homo sapiens
tcccagcattaatgcctgtcag

SEQ ID NO: 8769184 - DNA, 22 bp, Homo sapiens
tcccagaggtctctgctggttc

SEQ ID NO: 8769185 - DNA, 22 bp, Homo sapiens
tcccagcataacaaactgcccg

SEQ ID NO: 8769186 - DNA, 22 bp, Homo sapiens
tcccagagacagagcctcctcc

SEQ ID NO: 8769187 - DNA, 22 bp, Homo sapiens
tcccagagccaagctatggatg

SEQ ID NO: 8769188 - DNA, 22 bp, Homo sapiens
tcccagagcagtactccaggag

SEQ ID NO: 8769189 - DNA, 22 bp, Homo sapiens
tcccagagcagtactccaggag

SEQ ID NO: 8769190 - DNA, 22 bp, Homo sapiens
tcccagagaagagctggatgga

SEQ ID NO: 8769191 - DNA, 22 bp, Homo sapiens
tcccagagaaagtcaaggtctt

SEQ ID NO: 8769192 - DNA, 22 bp, Homo sapiens
tcccaagatgacacagtggacg

SEQ ID NO: 8769193 - DNA, 22 bp, Homo sapiens
tcccaagattattgagggaggg

SEQ ID NO: 8769194 - DNA, 22 bp, Homo sapiens
tcccaaatataatgcaagagac

SEQ ID NO: 8769195 - DNA, 22 bp, Homo sapiens
tcccaagacgatgtgcttggcc

SEQ ID NO: 8769196 - DNA, 21 bp, Homo sapiens
tcccaagaatatgcataagtt

SEQ ID NO: 8769197 - DNA, 22 bp, Homo sapiens
tcccaaagaactgaatagtaat

SEQ ID NO: 8769198 - DNA, 22 bp, Homo sapiens
tccattcttttgctgtcttcct

SEQ ID NO: 8769199 - DNA, 22 bp, Homo sapiens
tccattctttttacctctcaga

SEQ ID NO: 8769200 - DNA, 22 bp, Homo sapiens
tccattcattcattgatgaaca

SEQ ID NO: 8769201 - DNA, 22 bp, Homo sapiens
tccattcattcaggtatttagt

SEQ ID NO: 8769202 - DNA, 20 bp, Homo sapiens
tccattcagcattgtggaaa

SEQ ID NO: 8769203 - DNA, 22 bp, Homo sapiens
tccattcaattctaaagccctt

SEQ ID NO: 8769204 - DNA, 22 bp, Homo sapiens
tccattatacttctgattcaaa

SEQ ID NO: 8769205 - DNA, 22 bp, Homo sapiens
tccattatacttctgattcaaa

SEQ ID NO: 8769206 - DNA, 22 bp, Homo sapiens
tccatgttggtgattctaatgt

SEQ ID NO: 8769207 - DNA, 22 bp, Homo sapiens
tccatgttgagaatgctataat

SEQ ID NO: 8769208 - DNA, 22 bp, Homo sapiens
tccatgttttctctgacaccta

SEQ ID NO: 8769209 - DNA, 22 bp, Homo sapiens
tccatgttgagaatgctataat

SEQ ID NO: 8769210 - DNA, 22 bp, Homo sapiens
tccatgttggtgattctaatgt

SEQ ID NO: 8769211 - DNA, 22 bp, Homo sapiens
tccatgtttcagcatctacatc

SEQ ID NO: 8769212 - DNA, 22 bp, Homo sapiens
tccatgtgttttcctgtccaca

SEQ ID NO: 8769213 - DNA, 19 bp, Homo sapiens
tccatgtgtttcagacctg

SEQ ID NO: 8769214 - DNA, 22 bp, Homo sapiens
tccattatacttctgattcaaa

SEQ ID NO: 8769215 - DNA, 22 bp, Homo sapiens
tccattatacttctgattcaaa

SEQ ID NO: 8769216 - DNA, 22 bp, Homo sapiens
tccatgtgcttcctcaggggaa

SEQ ID NO: 8769217 - DNA, 22 bp, Homo sapiens
tccatgtggcaataggagacag

SEQ ID NO: 8769218 - DNA, 22 bp, Homo sapiens
tccatgtgccaaggggcagagg

SEQ ID NO: 8769219 - DNA, 22 bp, Homo sapiens
tccaggctggcctcgcgtgaca

SEQ ID NO: 8769220 - DNA, 22 bp, Homo sapiens
tccaggctggctcttcaaaatt

SEQ ID NO: 8769221 - DNA, 22 bp, Homo sapiens
tccaggctggacatgaggcggg

SEQ ID NO: 8769222 - DNA, 22 bp, Homo sapiens
tccaggctggagtgcagtggca

SEQ ID NO: 8769223 - DNA, 22 bp, Homo sapiens
tccaggctggagtgcagtggca

SEQ ID NO: 8769224 - DNA, 22 bp, Homo sapiens
tccaggctggagtgcagtggca

SEQ ID NO: 8769225 - DNA, 22 bp, Homo sapiens
tccaggctggagtgcagtggca

SEQ ID NO: 8769226 - DNA, 22 bp, Homo sapiens
tccaggctggagtgcagtggcg

SEQ ID NO: 8769227 - DNA, 22 bp, Homo sapiens
tccaggctggagtgcagtggcg

SEQ ID NO: 8769228 - DNA, 22 bp, Homo sapiens
tccaggctggagtgcagtggcg

SEQ ID NO: 8769229 - DNA, 22 bp, Homo sapiens
tccaggctggagtgcagtggcg

SEQ ID NO: 8769230 - DNA, 21 bp, Homo sapiens
tccaggctggaaggggcgttg

SEQ ID NO: 8769231 - DNA, 22 bp, Homo sapiens
tccaggctagcctggtagagaa

SEQ ID NO: 8769232 - DNA, 22 bp, Homo sapiens
tccaggctagcctggtagagaa

SEQ ID NO: 8769233 - DNA, 22 bp, Homo sapiens
tccaggctagaagtcacaggcc

SEQ ID NO: 8769234 - DNA, 22 bp, Homo sapiens
tccaggctagaagtcacaggcc

SEQ ID NO: 8769235 - DNA, 22 bp, Homo sapiens
tccaggctagagtgcagtggcc

SEQ ID NO: 8769236 - DNA, 22 bp, Homo sapiens
tccaggctagagtgcagtggcc

SEQ ID NO: 8769237 - DNA, 22 bp, Homo sapiens
tccaggctagagtgcagtggcc

SEQ ID NO: 8769238 - DNA, 22 bp, Homo sapiens
tccaggctagagtgcagtggcc

SEQ ID NO: 8769239 - DNA, 22 bp, Homo sapiens
tccaggctaattttgcattgtt

SEQ ID NO: 8769240 - DNA, 22 bp, Homo sapiens
tccaggctacttggattcctgg

SEQ ID NO: 8769241 - DNA, 22 bp, Homo sapiens
tccaggcctttgcacatgttgt

SEQ ID NO: 8769242 - DNA, 18 bp, Homo sapiens
tccaggcgttgctttctc

SEQ ID NO: 8769243 - DNA, 22 bp, Homo sapiens
tccaggctaattttgcattgtt

SEQ ID NO: 8769244 - DNA, 20 bp, Homo sapiens
tccaggccttgttctcagat

SEQ ID NO: 8769245 - DNA, 22 bp, Homo sapiens
tccaggcctggctccattcagt

SEQ ID NO: 8769246 - DNA, 22 bp, Homo sapiens
tccaggcctggctccattcagt

SEQ ID NO: 8769247 - DNA, 22 bp, Homo sapiens
tccaggccttgacaggtcagtt

SEQ ID NO: 8769248 - DNA, 18 bp, Homo sapiens
tccaggcctgaagtgtcc

SEQ ID NO: 8769249 - DNA, 18 bp, Homo sapiens
tccaggcctgaagtgtcc

SEQ ID NO: 8769250 - DNA, 22 bp, Homo sapiens
tccaggcctgcctggtgtttgc

SEQ ID NO: 8769251 - DNA, 22 bp, Homo sapiens
tccaggcctgactataaatgta

SEQ ID NO: 8769252 - DNA, 22 bp, Homo sapiens
tccaggcctgcaatgacaaagc

SEQ ID NO: 8769253 - DNA, 22 bp, Homo sapiens
tccaggcctctagcccctatct

SEQ ID NO: 8769254 - DNA, 22 bp, Homo sapiens
tccaggcctctagccctctctt

SEQ ID NO: 8769255 - DNA, 22 bp, Homo sapiens
tccacaagatgataaagagagg

SEQ ID NO: 8769256 - DNA, 22 bp, Homo sapiens
tccacaaggcagctcctccagg

SEQ ID NO: 8769257 - DNA, 22 bp, Homo sapiens
tccacaaggcagctcctccagg

SEQ ID NO: 8769258 - DNA, 22 bp, Homo sapiens
tccaggctttttcatgctgtct

SEQ ID NO: 8769259 - DNA, 21 bp, Homo sapiens
tccagggaacttctcaggaat

SEQ ID NO: 8769260 - DNA, 22 bp, Homo sapiens
tccagggaagagcagaggctac

SEQ ID NO: 8769261 - DNA, 21 bp, Homo sapiens
tccagggaacttctcaggaat

SEQ ID NO: 8769262 - DNA, 22 bp, Homo sapiens
tccagggaaggtgtgaggctgg

SEQ ID NO: 8769263 - DNA, 22 bp, Homo sapiens
tccagggaaggtgtgaggctgg

SEQ ID NO: 8769264 - DNA, 21 bp, Homo sapiens
tccagggaatttcaactttta

SEQ ID NO: 8769265 - DNA, 22 bp, Homo sapiens
tccagggaaggtgtgaggctgg

SEQ ID NO: 8769266 - DNA, 22 bp, Homo sapiens
tccagggaagagcagaggctac

SEQ ID NO: 8769267 - DNA, 22 bp, Homo sapiens
tccagggaagagcagaggctac

SEQ ID NO: 8769268 - DNA, 22 bp, Homo sapiens
tccagggacagcgctggagcta

SEQ ID NO: 8769269 - DNA, 22 bp, Homo sapiens
tccagggacacagagtccttct

SEQ ID NO: 8769270 - DNA, 22 bp, Homo sapiens
tccagggacacagagtccttct

SEQ ID NO: 8769271 - DNA, 22 bp, Homo sapiens
tccagggctgacttgggagagg

SEQ ID NO: 8769272 - DNA, 23 bp, Homo sapiens
tccagggctggccagacctcggt

SEQ ID NO: 8769273 - DNA, 22 bp, Homo sapiens
tccagggctgacttgggagagg

SEQ ID NO: 8769274 - DNA, 18 bp, Homo sapiens
tccagggcttcctcctct

SEQ ID NO: 8769275 - DNA, 22 bp, Homo sapiens
tccagggctgttactttacata

SEQ ID NO: 8769276 - DNA, 22 bp, Homo sapiens
tccagggctgggttggctcagc

SEQ ID NO: 8769277 - DNA, 22 bp, Homo sapiens
tccaggtgccggggactgaggc

SEQ ID NO: 8769278 - DNA, 19 bp, Homo sapiens
tccaggtggagagacaccc

SEQ ID NO: 8769279 - DNA, 22 bp, Homo sapiens
tccaggtgggctgcacccaggc

SEQ ID NO: 8769280 - DNA, 22 bp, Homo sapiens
tccaggtgtatttactgaagta

SEQ ID NO: 8769281 - DNA, 19 bp, Homo sapiens
tccaggtggagagacaccc

SEQ ID NO: 8769282 - DNA, 22 bp, Homo sapiens
tccaggtgagtgcaggtgcaga

SEQ ID NO: 8769283 - DNA, 22 bp, Homo sapiens
tccaggtgacagagacaggata

SEQ ID NO: 8769284 - DNA, 22 bp, Homo sapiens
tccaggtcttcctattccaggt

SEQ ID NO: 8769285 - DNA, 22 bp, Homo sapiens
tccaggtctggttggacaggtt

SEQ ID NO: 8769286 - DNA, 19 bp, Homo sapiens
tccatgcccaggcaccaag

SEQ ID NO: 8769287 - DNA, 22 bp, Homo sapiens
tccagtcacttcattttacaga

SEQ ID NO: 8769288 - DNA, 20 bp, Homo sapiens
tccagtatgttatttggtgt

SEQ ID NO: 8769289 - DNA, 22 bp, Homo sapiens
tccagtcaacttaatctcttta

SEQ ID NO: 8769290 - DNA, 22 bp, Homo sapiens
tccagtcaagcttgagaatttc

SEQ ID NO: 8769291 - DNA, 22 bp, Homo sapiens
tccagtatgactgatgtccttc

SEQ ID NO: 8769292 - DNA, 22 bp, Homo sapiens
tccagtatcaaagtcctagtcc

SEQ ID NO: 8769293 - DNA, 22 bp, Homo sapiens
tccaggtgtgctctgtgccctg

SEQ ID NO: 8769294 - DNA, 22 bp, Homo sapiens
tccaggtgggctgcacccaggc

SEQ ID NO: 8769295 - DNA, 22 bp, Homo sapiens
tccaggtgtgctctgtgccctg

SEQ ID NO: 8769296 - DNA, 22 bp, Homo sapiens
tccaggtgtatttactgaagta

SEQ ID NO: 8769297 - DNA, 22 bp, Homo sapiens
tccaggtctggttggacaggtt

SEQ ID NO: 8769298 - DNA, 22 bp, Homo sapiens
tccaggtctggcctgctaggca

SEQ ID NO: 8769299 - DNA, 19 bp, Homo sapiens
tccagggctttatggcttt

SEQ ID NO: 8769300 - DNA, 21 bp, Homo sapiens
tccagggctttgattctctca

SEQ ID NO: 8769301 - DNA, 22 bp, Homo sapiens
tccagggcttggctgggacggt

SEQ ID NO: 8769302 - DNA, 22 bp, Homo sapiens
tccagggcttgacagggtgcct

SEQ ID NO: 8769303 - DNA, 22 bp, Homo sapiens
tccagggcttgacagggtgcct

SEQ ID NO: 8769304 - DNA, 18 bp, Homo sapiens
tccagggcttcctcctct

SEQ ID NO: 8769305 - DNA, 22 bp, Homo sapiens
tcccctggcacctagtcctact

SEQ ID NO: 8769306 - DNA, 22 bp, Homo sapiens
tcccctggtgccacgatctgct

SEQ ID NO: 8769307 - DNA, 22 bp, Homo sapiens
tcccagggactggatgatgcag

SEQ ID NO: 8769308 - DNA, 22 bp, Homo sapiens
tcccagggactctctgccttcc

SEQ ID NO: 8769309 - DNA, 22 bp, Homo sapiens
tcccagggacccagcctgatac

SEQ ID NO: 8769310 - DNA, 22 bp, Homo sapiens
tcccagggacaccaagctgttt

SEQ ID NO: 8769311 - DNA, 22 bp, Homo sapiens
tcccagggacccagcctgatac

SEQ ID NO: 8769312 - DNA, 22 bp, Homo sapiens
tcccagggacccagcctgatac

SEQ ID NO: 8769313 - DNA, 21 bp, Homo sapiens
tccctcagaaggtagccaagc

SEQ ID NO: 8769314 - DNA, 21 bp, Homo sapiens
tccctcagaaggtagccaagc

SEQ ID NO: 8769315 - DNA, 22 bp, Homo sapiens
tcccgcttcttccgaatcgcga

SEQ ID NO: 8769316 - DNA, 22 bp, Homo sapiens
tcccctttgtaagatggaaacg

SEQ ID NO: 8769317 - DNA, 22 bp, Homo sapiens
tccccttggcttggtcaagagg

SEQ ID NO: 8769318 - DNA, 22 bp, Homo sapiens
tccccttggcttggtcaagagg

SEQ ID NO: 8769319 - DNA, 22 bp, Homo sapiens
tcccctttgtaagatggaaacg

SEQ ID NO: 8769320 - DNA, 22 bp, Homo sapiens
tcccgcccttgtacttgccgag

SEQ ID NO: 8769321 - DNA, 22 bp, Homo sapiens
tcccgattcttcctatacagga

SEQ ID NO: 8769322 - DNA, 22 bp, Homo sapiens
tccctcagatgagctcctagca

SEQ ID NO: 8769323 - DNA, 20 bp, Homo sapiens
tccctcagcacttctacctc

SEQ ID NO: 8769324 - DNA, 22 bp, Homo sapiens
tccctcagattggcaattagat

SEQ ID NO: 8769325 - DNA, 22 bp, Homo sapiens
tccctcagcaggaactggcctg

SEQ ID NO: 8769326 - DNA, 20 bp, Homo sapiens
tccctcagcacttctacctc

SEQ ID NO: 8769327 - DNA, 20 bp, Homo sapiens
tccctcagcacttctacctc

SEQ ID NO: 8769328 - DNA, 22 bp, Homo sapiens
tccctcagagggcaagcgcaga

SEQ ID NO: 8769329 - DNA, 22 bp, Homo sapiens
tccctcagagaccgtggtgcag

SEQ ID NO: 8769330 - DNA, 21 bp, Homo sapiens
tccctcagacagggtgcctat

SEQ ID NO: 8769331 - DNA, 21 bp, Homo sapiens
tccctcagacagggtgcctat

SEQ ID NO: 8769332 - DNA, 20 bp, Homo sapiens
tcccaggctccaccctagac

SEQ ID NO: 8769333 - DNA, 20 bp, Homo sapiens
tcccaggctccaccctagac

SEQ ID NO: 8769334 - DNA, 22 bp, Homo sapiens
tcccaggctcttcaaggaagac

SEQ ID NO: 8769335 - DNA, 22 bp, Homo sapiens
tcccaggctcttcaaggaagac

SEQ ID NO: 8769336 - DNA, 22 bp, Homo sapiens
tcccaggctggcaggcagcagt

SEQ ID NO: 8769337 - DNA, 22 bp, Homo sapiens
tcccaggctaccagtgaggtca

SEQ ID NO: 8769338 - DNA, 22 bp, Homo sapiens
tcccaggctaggcctctgcgtt

SEQ ID NO: 8769339 - DNA, 22 bp, Homo sapiens
tcccaggctggggccaggtgac

SEQ ID NO: 8769340 - DNA, 22 bp, Homo sapiens
tcccaggctggggccaggtgac

SEQ ID NO: 8769341 - DNA, 22 bp, Homo sapiens
tcccaggctggggccaggtgac

SEQ ID NO: 8769342 - DNA, 20 bp, Homo sapiens
tcccaggctgggctccagct

SEQ ID NO: 8769343 - DNA, 22 bp, Homo sapiens
tcccaggctgggggcctgaagt

SEQ ID NO: 8769344 - DNA, 22 bp, Homo sapiens
tcccagggacaccaagctgttt

SEQ ID NO: 8769345 - DNA, 23 bp, Homo sapiens
tcccagggaaggtgagcgaggct

SEQ ID NO: 8769346 - DNA, 23 bp, Homo sapiens
tcccagggaaggtgagcgaggct

SEQ ID NO: 8769347 - DNA, 23 bp, Homo sapiens
tcccagggaaggtgagcgaggct

SEQ ID NO: 8769348 - DNA, 22 bp, Homo sapiens
tcccagggacaccaagctgttt

SEQ ID NO: 8769349 - DNA, 22 bp, Homo sapiens
tccctcagcttgtctccatgca

SEQ ID NO: 8769350 - DNA, 22 bp, Homo sapiens
tccctcaggacccaacttgtaa

SEQ ID NO: 8769351 - DNA, 22 bp, Homo sapiens
tccctcagcttgtctccatgca

SEQ ID NO: 8769352 - DNA, 22 bp, Homo sapiens
tccctcagtccctggacaggca

SEQ ID NO: 8769353 - DNA, 22 bp, Homo sapiens
tccctcagtccctggacaggca

SEQ ID NO: 8769354 - DNA, 22 bp, Homo sapiens
tccctcagtccctggacaggca

SEQ ID NO: 8769355 - DNA, 22 bp, Homo sapiens
tccctcagggtgcagttgcttt

SEQ ID NO: 8769356 - DNA, 23 bp, Homo sapiens
tccctcaggccttatctccatct

SEQ ID NO: 8769357 - DNA, 20 bp, Homo sapiens
tccctcagtttccagccctg

SEQ ID NO: 8769358 - DNA, 20 bp, Homo sapiens
tccctcagtttccagccctg

SEQ ID NO: 8769359 - DNA, 20 bp, Homo sapiens
tccctcagtttccagccctg

SEQ ID NO: 8769360 - DNA, 19 bp, Homo sapiens
tccctcagtctgccaggcc

SEQ ID NO: 8769361 - DNA, 20 bp, Homo sapiens
tccctcagtcctggctttgt

SEQ ID NO: 8769362 - DNA, 19 bp, Homo sapiens
tccctcagtctgccaggcc

SEQ ID NO: 8769363 - DNA, 22 bp, Homo sapiens
tccctccccacttctgagcttt

SEQ ID NO: 8769364 - DNA, 22 bp, Homo sapiens
tccctccccacttctgagcttt

SEQ ID NO: 8769365 - DNA, 22 bp, Homo sapiens
tccctccccacttctgagcttt

SEQ ID NO: 8769366 - DNA, 22 bp, Homo sapiens
tccctccccacttctgagcttt

SEQ ID NO: 8769367 - DNA, 22 bp, Homo sapiens
tccctgagaaagcccaggaggt

SEQ ID NO: 8769368 - DNA, 22 bp, Homo sapiens
tccctgccctgccttcatggtt

SEQ ID NO: 8769369 - DNA, 22 bp, Homo sapiens
tccctgccctgccttcatggtt

SEQ ID NO: 8769370 - DNA, 22 bp, Homo sapiens
tccctgccctgccttcatggtt

SEQ ID NO: 8769371 - DNA, 22 bp, Homo sapiens
tccctctgtgttgggcatgcct

SEQ ID NO: 8769372 - DNA, 22 bp, Homo sapiens
tccctctgtggttggttctgtc

SEQ ID NO: 8769373 - DNA, 22 bp, Homo sapiens
tccctctgtggttggttctgtc

SEQ ID NO: 8769374 - DNA, 22 bp, Homo sapiens
tccctctgtgttgggcatgcct

SEQ ID NO: 8769375 - DNA, 22 bp, Homo sapiens
tccctctgtgttgggcatgcct

SEQ ID NO: 8769376 - DNA, 22 bp, Homo sapiens
tccctgaaacatctctgtggat

SEQ ID NO: 8769377 - DNA, 18 bp, Homo sapiens
tccctccctgctgtggcc

SEQ ID NO: 8769378 - DNA, 18 bp, Homo sapiens
tccctccctgctgtggcc

SEQ ID NO: 8769379 - DNA, 18 bp, Homo sapiens
tccctccctgctgtggcc

SEQ ID NO: 8769380 - DNA, 18 bp, Homo sapiens
tccctccctgctgtggcc

SEQ ID NO: 8769381 - DNA, 20 bp, Homo sapiens
tccctccctccagctctggg

SEQ ID NO: 8769382 - DNA, 20 bp, Homo sapiens
tccctccctccagctctggg

SEQ ID NO: 8769383 - DNA, 20 bp, Homo sapiens
tccctccctccagctctggg

SEQ ID NO: 8769384 - DNA, 20 bp, Homo sapiens
tccctccctccagctctggg

SEQ ID NO: 8769385 - DNA, 22 bp, Homo sapiens
tccctctggaggctctagggga

SEQ ID NO: 8769386 - DNA, 22 bp, Homo sapiens
tccctctggaggctctagggga

SEQ ID NO: 8769387 - DNA, 22 bp, Homo sapiens
tccctctgctagtgcttgagct

SEQ ID NO: 8769388 - DNA, 19 bp, Homo sapiens
tccctccctgtaatctcac

SEQ ID NO: 8769389 - DNA, 22 bp, Homo sapiens
tccctctcttgggcgtggctca

SEQ ID NO: 8769390 - DNA, 22 bp, Homo sapiens
tccctctgctagtgcttgagct

SEQ ID NO: 8769391 - DNA, 22 bp, Homo sapiens
tccctctgggctggagcagggt

SEQ ID NO: 8769392 - DNA, 22 bp, Homo sapiens
tccctctgggctggagcagggt

SEQ ID NO: 8769393 - DNA, 22 bp, Homo sapiens
tccctctgggctccagcacgga

SEQ ID NO: 8769394 - DNA, 22 bp, Homo sapiens
tccctctggtcctcggtggaga

SEQ ID NO: 8769395 - DNA, 22 bp, Homo sapiens
tccctctggtcctcggtggaga

SEQ ID NO: 8769396 - DNA, 22 bp, Homo sapiens
tccctctggtctggacgccata

SEQ ID NO: 8769397 - DNA, 22 bp, Homo sapiens
tccctctggtctggacgccata

SEQ ID NO: 8769398 - DNA, 22 bp, Homo sapiens
tccctggcagctgtcctttcag

SEQ ID NO: 8769399 - DNA, 23 bp, Homo sapiens
tccctggccgcaatggccgcctt

SEQ ID NO: 8769400 - DNA, 22 bp, Homo sapiens
tccctggctgggggctgccttg

SEQ ID NO: 8769401 - DNA, 22 bp, Homo sapiens
tccctggctgggggctgccttg

SEQ ID NO: 8769402 - DNA, 22 bp, Homo sapiens
tccctggctgtgttcaggtgcg

SEQ ID NO: 8769403 - DNA, 22 bp, Homo sapiens
tccctgggaaatgtcagtttca

SEQ ID NO: 8769404 - DNA, 22 bp, Homo sapiens
tccctgggaacaaaggatgaga

SEQ ID NO: 8769405 - DNA, 22 bp, Homo sapiens
tccctgggaacaaaggatgaga

SEQ ID NO: 8769406 - DNA, 22 bp, Homo sapiens
tccctgggaccggcagctcaca

SEQ ID NO: 8769407 - DNA, 22 bp, Homo sapiens
tccctgggaacaaaggatgaga

SEQ ID NO: 8769408 - DNA, 22 bp, Homo sapiens
tccctggcacaagaaggctgtc

SEQ ID NO: 8769409 - DNA, 22 bp, Homo sapiens
tccctggcacaagaaggctgtc

SEQ ID NO: 8769410 - DNA, 22 bp, Homo sapiens
tccctggcactgctgtgattag

SEQ ID NO: 8769411 - DNA, 22 bp, Homo sapiens
tccctggcacaagaaggctgtc

SEQ ID NO: 8769412 - DNA, 20 bp, Homo sapiens
tccctggaggtggtggcatc

SEQ ID NO: 8769413 - DNA, 22 bp, Homo sapiens
tccctggcacaagaaggctgtc

SEQ ID NO: 8769414 - DNA, 22 bp, Homo sapiens
tccctggaggtgtttgctcagg

SEQ ID NO: 8769415 - DNA, 22 bp, Homo sapiens
tccctgcctcctggcagtgcca

SEQ ID NO: 8769416 - DNA, 22 bp, Homo sapiens
tccctgcctcctggcagtgcca

SEQ ID NO: 8769417 - DNA, 22 bp, Homo sapiens
tccctggacaacagacttcact

SEQ ID NO: 8769418 - DNA, 22 bp, Homo sapiens
tccctggagataacttctggga

SEQ ID NO: 8769419 - DNA, 22 bp, Homo sapiens
tccctggacagccttgcctggg

SEQ ID NO: 8769420 - DNA, 20 bp, Homo sapiens
tcctagcttctctctgtaca

SEQ ID NO: 8769421 - DNA, 22 bp, Homo sapiens
tcctagctggcctctcaccagc

SEQ ID NO: 8769422 - DNA, 22 bp, Homo sapiens
tcctagaggatggtaggaagct

SEQ ID NO: 8769423 - DNA, 22 bp, Homo sapiens
tcctagaggatggtaggaagct

SEQ ID NO: 8769424 - DNA, 22 bp, Homo sapiens
tcctagcttgtcagttctctaa

SEQ ID NO: 8769425 - DNA, 22 bp, Homo sapiens
tcctagggtaatcagcatacat

SEQ ID NO: 8769426 - DNA, 22 bp, Homo sapiens
tcctagggttggagacagtgac

SEQ ID NO: 8769427 - DNA, 22 bp, Homo sapiens
tcctaggcccagcctgagctgt

SEQ ID NO: 8769428 - DNA, 22 bp, Homo sapiens
tcctaggcctggcctggtggat

SEQ ID NO: 8769429 - DNA, 22 bp, Homo sapiens
tcctaggcctggcctggtggat

SEQ ID NO: 8769430 - DNA, 22 bp, Homo sapiens
tcctaggctccagaactgtgaa

SEQ ID NO: 8769431 - DNA, 22 bp, Homo sapiens
tcctaggctccagaactgtgaa

SEQ ID NO: 8769432 - DNA, 22 bp, Homo sapiens
tcctagaatgcacctctgctgt

SEQ ID NO: 8769433 - DNA, 22 bp, Homo sapiens
tcctagagcctccagagggaga

SEQ ID NO: 8769434 - DNA, 22 bp, Homo sapiens
tcctagagcctccagagggaga

SEQ ID NO: 8769435 - DNA, 22 bp, Homo sapiens
tcctagaatgcacctctgctgt

SEQ ID NO: 8769436 - DNA, 22 bp, Homo sapiens
tcctagaataatctttgactgc

SEQ ID NO: 8769437 - DNA, 22 bp, Homo sapiens
tcctagaataagtaacaggaca

SEQ ID NO: 8769438 - DNA, 22 bp, Homo sapiens
tcctagaataagtaacaggaca

SEQ ID NO: 8769439 - DNA, 22 bp, Homo sapiens
tcctagaatctttgtaagattg

SEQ ID NO: 8769440 - DNA, 22 bp, Homo sapiens
tccctgggagatgatgatgagg

SEQ ID NO: 8769441 - DNA, 22 bp, Homo sapiens
tccctgggactcagacatggaa

SEQ ID NO: 8769442 - DNA, 22 bp, Homo sapiens
tccctgggactcagacatggaa

SEQ ID NO: 8769443 - DNA, 22 bp, Homo sapiens
tccctgggacggccttttggag

SEQ ID NO: 8769444 - DNA, 22 bp, Homo sapiens
tccctgggaccggcagctcaca

SEQ ID NO: 8769445 - DNA, 18 bp, Homo sapiens
tccctgggatataattac

SEQ ID NO: 8769446 - DNA, 22 bp, Homo sapiens
tccggtgccagagtgggatcag

SEQ ID NO: 8769447 - DNA, 22 bp, Homo sapiens
tccgtgcccctggcactaggtc

SEQ ID NO: 8769448 - DNA, 22 bp, Homo sapiens
tccggtgctgaaggcccaggtg

SEQ ID NO: 8769449 - DNA, 22 bp, Homo sapiens
tccggtgctgaaggcccaggtg

SEQ ID NO: 8769450 - DNA, 22 bp, Homo sapiens
tccctgggcaagtttactcttc

SEQ ID NO: 8769451 - DNA, 22 bp, Homo sapiens
tccgttttcacactgctataaa

SEQ ID NO: 8769452 - DNA, 22 bp, Homo sapiens
tcctaaagtccaggtgggaatt

SEQ ID NO: 8769453 - DNA, 22 bp, Homo sapiens
tcctcagggggccaacccagcc

SEQ ID NO: 8769454 - DNA, 19 bp, Homo sapiens
tcctcaggggctcacagac

SEQ ID NO: 8769455 - DNA, 22 bp, Homo sapiens
tcctcaggggtttcaggtgtac

SEQ ID NO: 8769456 - DNA, 22 bp, Homo sapiens
tcctcaggtcaaagcaggagaa

SEQ ID NO: 8769457 - DNA, 21 bp, Homo sapiens
tcctcagggccccagagcact

SEQ ID NO: 8769458 - DNA, 21 bp, Homo sapiens
tcctcagggccccagagcact

SEQ ID NO: 8769459 - DNA, 22 bp, Homo sapiens
tcctcagggcggcctccgtctt

SEQ ID NO: 8769460 - DNA, 22 bp, Homo sapiens
tcctcagcaaacacttcactct

SEQ ID NO: 8769461 - DNA, 22 bp, Homo sapiens
tcctcagcaaacacttcactct

SEQ ID NO: 8769462 - DNA, 22 bp, Homo sapiens
tcctcagcaaacacttcactct

SEQ ID NO: 8769463 - DNA, 22 bp, Homo sapiens
tcctcagcaggtctgtgtacca

SEQ ID NO: 8769464 - DNA, 23 bp, Homo sapiens
tcctcagcatgttttgtcatgta

SEQ ID NO: 8769465 - DNA, 22 bp, Homo sapiens
tcctcagcatggaatctggact

SEQ ID NO: 8769466 - DNA, 22 bp, Homo sapiens
tcctcagatacctggcagatca

SEQ ID NO: 8769467 - DNA, 22 bp, Homo sapiens
tcctcacagctggttcattcag

SEQ ID NO: 8769468 - DNA, 22 bp, Homo sapiens
tcctcacagatgggtgcatagc

SEQ ID NO: 8769469 - DNA, 22 bp, Homo sapiens
tcctcacactatagatgaggat

SEQ ID NO: 8769470 - DNA, 22 bp, Homo sapiens
tcctagttctctgccagtcgct

SEQ ID NO: 8769471 - DNA, 22 bp, Homo sapiens
tcctataattagaagcaatttg

SEQ ID NO: 8769472 - DNA, 22 bp, Homo sapiens
tcctcacaagcaagcacaggta

SEQ ID NO: 8769473 - DNA, 22 bp, Homo sapiens
tcctcaaatatttacttactga

SEQ ID NO: 8769474 - DNA, 22 bp, Homo sapiens
tcctcaaatatttacttactga

SEQ ID NO: 8769475 - DNA, 22 bp, Homo sapiens
tcctcaaagttgtataaatatt

SEQ ID NO: 8769476 - DNA, 22 bp, Homo sapiens
tcctcacatggtgagccacaca

SEQ ID NO: 8769477 - DNA, 22 bp, Homo sapiens
tcctcacatggtgagccacaca

SEQ ID NO: 8769478 - DNA, 22 bp, Homo sapiens
tcctcacagggcaggaaggagg

SEQ ID NO: 8769479 - DNA, 22 bp, Homo sapiens
tcctcacagtcaacactttgag

SEQ ID NO: 8769480 - DNA, 22 bp, Homo sapiens
tcctcagaaacccctgtgaggt

SEQ ID NO: 8769481 - DNA, 22 bp, Homo sapiens
tcctgagacatctctgctggtc

SEQ ID NO: 8769482 - DNA, 22 bp, Homo sapiens
tcctgagacatctctgctggtc

SEQ ID NO: 8769483 - DNA, 22 bp, Homo sapiens
tcctgaagctctcttaaggaaa

SEQ ID NO: 8769484 - DNA, 22 bp, Homo sapiens
tcctgaagcagttagcatgagc

SEQ ID NO: 8769485 - DNA, 22 bp, Homo sapiens
tcctgaagcctgagtgatgact

SEQ ID NO: 8769486 - DNA, 22 bp, Homo sapiens
tcctgaaggcagatggggatca

SEQ ID NO: 8769487 - DNA, 22 bp, Homo sapiens
tcctgaaggcagatggggatca

SEQ ID NO: 8769488 - DNA, 22 bp, Homo sapiens
tcctgaaggagcagttgctggg

SEQ ID NO: 8769489 - DNA, 22 bp, Homo sapiens
tcctgagagcagctgctttgga

SEQ ID NO: 8769490 - DNA, 20 bp, Homo sapiens
tcctgagacctgggaaggtt

SEQ ID NO: 8769491 - DNA, 22 bp, Homo sapiens
tcctgagagcagagtccaggtg

SEQ ID NO: 8769492 - DNA, 22 bp, Homo sapiens
tcctgagacatctctgctggtc

SEQ ID NO: 8769493 - DNA, 22 bp, Homo sapiens
tcctgaagaacgaagtcatgta

SEQ ID NO: 8769494 - DNA, 22 bp, Homo sapiens
tcctgaagaacgaagtcatgta

SEQ ID NO: 8769495 - DNA, 22 bp, Homo sapiens
tcctgaagaaggcagatatttg

SEQ ID NO: 8769496 - DNA, 22 bp, Homo sapiens
tcctgaagagccctgctctgtg

SEQ ID NO: 8769497 - DNA, 19 bp, Homo sapiens
tcctgaagatttcctcagc

SEQ ID NO: 8769498 - DNA, 19 bp, Homo sapiens
tcctgaagatttcctcagc

SEQ ID NO: 8769499 - DNA, 22 bp, Homo sapiens
tcctgaagatgaaaagagaggt

SEQ ID NO: 8769500 - DNA, 22 bp, Homo sapiens
tcctgaagatgaaaagagaggt

SEQ ID NO: 8769501 - DNA, 22 bp, Homo sapiens
tcctgaagaggttgtctttata

SEQ ID NO: 8769502 - DNA, 22 bp, Homo sapiens
tcctgaagaggctacactgctt

SEQ ID NO: 8769503 - DNA, 22 bp, Homo sapiens
tcctgaagaggctacactgctt

SEQ ID NO: 8769504 - DNA, 22 bp, Homo sapiens
tcctgaagaggctacactgctt

SEQ ID NO: 8769505 - DNA, 22 bp, Homo sapiens
tcctgaaaaattacatgttcag

SEQ ID NO: 8769506 - DNA, 22 bp, Homo sapiens
tcctctttctcaacattagtta

SEQ ID NO: 8769507 - DNA, 22 bp, Homo sapiens
tcctgaaaataatttcacaaga

SEQ ID NO: 8769508 - DNA, 22 bp, Homo sapiens
tcctgaaattctggttgtcact

SEQ ID NO: 8769509 - DNA, 22 bp, Homo sapiens
tcctgaaatttgttttaattct

SEQ ID NO: 8769510 - DNA, 22 bp, Homo sapiens
tcctgaaatttgttttaattct

SEQ ID NO: 8769511 - DNA, 22 bp, Homo sapiens
tcctcttctgcctatatctgcc

SEQ ID NO: 8769512 - DNA, 22 bp, Homo sapiens
tcctcttctgtggattccctga

SEQ ID NO: 8769513 - DNA, 22 bp, Homo sapiens
tcctctttaaatgcttttatct

SEQ ID NO: 8769514 - DNA, 22 bp, Homo sapiens
tcctctttaaatgcttttatct

SEQ ID NO: 8769515 - DNA, 22 bp, Homo sapiens
tcctctttaaatgcttttatct

SEQ ID NO: 8769516 - DNA, 22 bp, Homo sapiens
tcctcttcaaaatagctctgaa

SEQ ID NO: 8769517 - DNA, 22 bp, Homo sapiens
tcctcttccttctgtccaaatg

SEQ ID NO: 8769518 - DNA, 22 bp, Homo sapiens
tcctcttctaagctcattcagg

SEQ ID NO: 8769519 - DNA, 22 bp, Homo sapiens
tcctctggggtcagggcactac

SEQ ID NO: 8769520 - DNA, 19 bp, Homo sapiens
tcctctggtaccacccttg

SEQ ID NO: 8769521 - DNA, 19 bp, Homo sapiens
tcctctggtaccacccttg

SEQ ID NO: 8769522 - DNA, 22 bp, Homo sapiens
tcctctggtacttaaagtgctt

SEQ ID NO: 8769523 - DNA, 22 bp, Homo sapiens
tcctctggtacttaaagtgctt

SEQ ID NO: 8769524 - DNA, 22 bp, Homo sapiens
tcctctggtcttcggtgtggac

SEQ ID NO: 8769525 - DNA, 22 bp, Homo sapiens
tcctctggttatacttgcaccc

SEQ ID NO: 8769526 - DNA, 22 bp, Homo sapiens
tcctcaggtgactaggtatctt

SEQ ID NO: 8769527 - DNA, 22 bp, Homo sapiens
tcctctgggctccctgcaacag

SEQ ID NO: 8769528 - DNA, 22 bp, Homo sapiens
tcctctggggcgtggtcctgga

SEQ ID NO: 8769529 - DNA, 22 bp, Homo sapiens
tcctctggggcgtggtcctgga

SEQ ID NO: 8769530 - DNA, 22 bp, Homo sapiens
tcctctggggcgtggtcctgga

SEQ ID NO: 8769531 - DNA, 22 bp, Homo sapiens
tcctctggggcgtggtcctgga

SEQ ID NO: 8769532 - DNA, 22 bp, Homo sapiens
tcctgagattctgcatttctaa

SEQ ID NO: 8769533 - DNA, 22 bp, Homo sapiens
tcctgagatgtggagctccatg

SEQ ID NO: 8769534 - DNA, 22 bp, Homo sapiens
tcctgagcacagagacaaggaa

SEQ ID NO: 8769535 - DNA, 22 bp, Homo sapiens
tcctgagcacagagacaaggaa

SEQ ID NO: 8769536 - DNA, 22 bp, Homo sapiens
tcctgagcaacacagctaagtg

SEQ ID NO: 8769537 - DNA, 22 bp, Homo sapiens
tcctgagccctactctagacga

SEQ ID NO: 8769538 - DNA, 22 bp, Homo sapiens
tcctgagccctggggtcagtgt

SEQ ID NO: 8769539 - DNA, 22 bp, Homo sapiens
tcctgagcacctatgccatggc

SEQ ID NO: 8769540 - DNA, 22 bp, Homo sapiens
tcctgagcacctatgccatggc

SEQ ID NO: 8769541 - DNA, 22 bp, Homo sapiens
tcctgagccctgtaggaccctg

SEQ ID NO: 8769542 - DNA, 22 bp, Homo sapiens
tcctgagccctgtaggaccctg

SEQ ID NO: 8769543 - DNA, 22 bp, Homo sapiens
tcctgagctacagtagtatgat

SEQ ID NO: 8769544 - DNA, 22 bp, Homo sapiens
tcctgagcctgacaatcaccat

SEQ ID NO: 8769545 - DNA, 22 bp, Homo sapiens
tcctgagatgagacagtgctgc

SEQ ID NO: 8769546 - DNA, 22 bp, Homo sapiens
tcctgagatgagacagtgctgc

SEQ ID NO: 8769547 - DNA, 22 bp, Homo sapiens
tcctgagatgagacagtgctgc

SEQ ID NO: 8769548 - DNA, 22 bp, Homo sapiens
tcctgagatgagacagtgctgc

SEQ ID NO: 8769549 - DNA, 22 bp, Homo sapiens
tcctgagatccttttagggatc

SEQ ID NO: 8769550 - DNA, 22 bp, Homo sapiens
tcctgagataggagttgaaggc

SEQ ID NO: 8769551 - DNA, 23 bp, Homo sapiens
tcctgagatgagacagtgctgcc

SEQ ID NO: 8769552 - DNA, 23 bp, Homo sapiens
tcctgagatgagacagtgctgcc

SEQ ID NO: 8769553 - DNA, 23 bp, Homo sapiens
tcctgagatgagacagtgctgcc

SEQ ID NO: 8769554 - DNA, 22 bp, Homo sapiens
tcctgagatgagacagtgctgc

SEQ ID NO: 8769555 - DNA, 23 bp, Homo sapiens
tcctgagatgagacagtgctgcc

SEQ ID NO: 8769556 - DNA, 22 bp, Homo sapiens
tcctgagatgctgatttcgggg

SEQ ID NO: 8769557 - DNA, 23 bp, Homo sapiens
tcctgagatgagacagtgctgcc

SEQ ID NO: 8769558 - DNA, 22 bp, Homo sapiens
tcctgagagtcaagaatgcagg

SEQ ID NO: 8769559 - DNA, 22 bp, Homo sapiens
tcctgagataggagttgaaggc

SEQ ID NO: 8769560 - DNA, 22 bp, Homo sapiens
tcctgagaggtgtgaggtgcag

SEQ ID NO: 8769561 - DNA, 20 bp, Homo sapiens
tcctgagaggctcttggaga

SEQ ID NO: 8769562 - DNA, 20 bp, Homo sapiens
tcctgagaggctcttggaga

SEQ ID NO: 8769563 - DNA, 22 bp, Homo sapiens
tcctgagagtcaagaatgcagg

SEQ ID NO: 8769564 - DNA, 22 bp, Homo sapiens
tcctgagaggtttataacgcag

SEQ ID NO: 8769565 - DNA, 22 bp, Homo sapiens
tcctgaggcctctgtgatgtga

SEQ ID NO: 8769566 - DNA, 22 bp, Homo sapiens
tcctgaggccctgttagggtct

SEQ ID NO: 8769567 - DNA, 22 bp, Homo sapiens
tcctgaggccctgttagggtct

SEQ ID NO: 8769568 - DNA, 22 bp, Homo sapiens
tcctgaggagaagagtgctagg

SEQ ID NO: 8769569 - DNA, 22 bp, Homo sapiens
tcctgaggatggttgaagtgca

SEQ ID NO: 8769570 - DNA, 22 bp, Homo sapiens
tcctgaggagaagagtgctagg

SEQ ID NO: 8769571 - DNA, 22 bp, Homo sapiens
tcctgaggcacaatcctagaat

SEQ ID NO: 8769572 - DNA, 22 bp, Homo sapiens
tcctgaggctaaagtgcagtgg

SEQ ID NO: 8769573 - DNA, 22 bp, Homo sapiens
tcctgaggctaaagtgcagtgg

SEQ ID NO: 8769574 - DNA, 22 bp, Homo sapiens
tcctgaggtggattgagcagag

SEQ ID NO: 8769575 - DNA, 22 bp, Homo sapiens
tcctgaggttttaaaactattc

SEQ ID NO: 8769576 - DNA, 22 bp, Homo sapiens
tcctgagtgagagctgggaggt

SEQ ID NO: 8769577 - DNA, 22 bp, Homo sapiens
tcctgagtgtttggccaggcca

SEQ ID NO: 8769578 - DNA, 20 bp, Homo sapiens
tcctgagtgcagttggcttg

SEQ ID NO: 8769579 - DNA, 22 bp, Homo sapiens
tcctgaggaccctgtcaggggc

SEQ ID NO: 8769580 - DNA, 22 bp, Homo sapiens
tcctgaggaatgtgaagagaac

SEQ ID NO: 8769581 - DNA, 22 bp, Homo sapiens
tcctgaggaatgtgaagagaac

SEQ ID NO: 8769582 - DNA, 22 bp, Homo sapiens
tcctgaggaatgtgaagagaac

SEQ ID NO: 8769583 - DNA, 22 bp, Homo sapiens
tcctgaggaccctgtcaggggc

SEQ ID NO: 8769584 - DNA, 22 bp, Homo sapiens
tcctgaggaccctgtcaggggc

SEQ ID NO: 8769585 - DNA, 22 bp, Homo sapiens
tcctgaggactaacaggaagga

SEQ ID NO: 8769586 - DNA, 22 bp, Homo sapiens
tcctgaggactaacaggaagga

SEQ ID NO: 8769587 - DNA, 22 bp, Homo sapiens
tcctgaggactaacaggaagga

SEQ ID NO: 8769588 - DNA, 22 bp, Homo sapiens
tcctgaggaaagttcatgaatg

SEQ ID NO: 8769589 - DNA, 22 bp, Homo sapiens
tcctgaggaaagttcatgaatg

SEQ ID NO: 8769590 - DNA, 22 bp, Homo sapiens
tcctgagctgccgcatcagcag

SEQ ID NO: 8769591 - DNA, 22 bp, Homo sapiens
tcctgagctttacagtaaggac

SEQ ID NO: 8769592 - DNA, 22 bp, Homo sapiens
tcctgagctcccatgaacaggc

SEQ ID NO: 8769593 - DNA, 22 bp, Homo sapiens
tcctgagctcccatgaacaggc

SEQ ID NO: 8769594 - DNA, 22 bp, Homo sapiens
tcctgagctacagtagtatgat

SEQ ID NO: 8769595 - DNA, 22 bp, Homo sapiens
tcctgagctgccgcatcagcag

SEQ ID NO: 8769596 - DNA, 22 bp, Homo sapiens
tcctgagctgccgcatcagcag

SEQ ID NO: 8769597 - DNA, 22 bp, Homo sapiens
tcctgagctgacacttggggag

SEQ ID NO: 8769598 - DNA, 19 bp, Homo sapiens
tcctgcagaccagacctgt

SEQ ID NO: 8769599 - DNA, 22 bp, Homo sapiens
tcctgcagacctcagtcaggtc

SEQ ID NO: 8769600 - DNA, 21 bp, Homo sapiens
tcctgagtgtgcccaggctct

SEQ ID NO: 8769601 - DNA, 21 bp, Homo sapiens
tcctgcagaatgccttcctac

SEQ ID NO: 8769602 - DNA, 22 bp, Homo sapiens
tcctgcacattagtatttttta

SEQ ID NO: 8769603 - DNA, 22 bp, Homo sapiens
tcctgcacagttggtgcttgaa

SEQ ID NO: 8769604 - DNA, 22 bp, Homo sapiens
tcctgcacactgatgagatcac

SEQ ID NO: 8769605 - DNA, 22 bp, Homo sapiens
tcctgcacaccttgagcttgga

SEQ ID NO: 8769606 - DNA, 20 bp, Homo sapiens
tcctgcaaaaggacaagttt

SEQ ID NO: 8769607 - DNA, 22 bp, Homo sapiens
tcctgcagccaagggtcatcga

SEQ ID NO: 8769608 - DNA, 22 bp, Homo sapiens
tcctgcagccactgcaggcaga

SEQ ID NO: 8769609 - DNA, 22 bp, Homo sapiens
tcctgcaggcttgagtcctcag

SEQ ID NO: 8769610 - DNA, 22 bp, Homo sapiens
tcctgccctaagatgttatatt

SEQ ID NO: 8769611 - DNA, 22 bp, Homo sapiens
tcctgccctcgggggtgttcca

SEQ ID NO: 8769612 - DNA, 22 bp, Homo sapiens
tcctgccctcgggggtgttcca

SEQ ID NO: 8769613 - DNA, 22 bp, Homo sapiens
tcctgccccactgtttgaaaga

SEQ ID NO: 8769614 - DNA, 22 bp, Homo sapiens
tcctgccctaagatgttatatt

SEQ ID NO: 8769615 - DNA, 22 bp, Homo sapiens
tcctgccgtcctccggggcctc

SEQ ID NO: 8769616 - DNA, 22 bp, Homo sapiens
tcctgccctgaaaagtcagtct

SEQ ID NO: 8769617 - DNA, 22 bp, Homo sapiens
tcctgcagctgaagctcatgtg

SEQ ID NO: 8769618 - DNA, 22 bp, Homo sapiens
tcctgcctagcaggtgacctat

SEQ ID NO: 8769619 - DNA, 22 bp, Homo sapiens
tcctgcctcacagttgaagttt

SEQ ID NO: 8769620 - DNA, 22 bp, Homo sapiens
tcctgcctagcaggtgacctat

SEQ ID NO: 8769621 - DNA, 22 bp, Homo sapiens
tcctgcctagcaggtgacctat

SEQ ID NO: 8769622 - DNA, 22 bp, Homo sapiens
tcctgcctaccttgcggaggtg

SEQ ID NO: 8769623 - DNA, 22 bp, Homo sapiens
tcctgccgtcctccggggcctc

SEQ ID NO: 8769624 - DNA, 22 bp, Homo sapiens
tcctgccctgaaaagtcagtct

SEQ ID NO: 8769625 - DNA, 22 bp, Homo sapiens
tcctgccgtcctccggggcctc

SEQ ID NO: 8769626 - DNA, 22 bp, Homo sapiens
tcctgcctaccttgcggaggtg

SEQ ID NO: 8769627 - DNA, 22 bp, Homo sapiens
tcctgcctaccttgcggaggtg

SEQ ID NO: 8769628 - DNA, 22 bp, Homo sapiens
tcctgcctagcaggtgacctat

SEQ ID NO: 8769629 - DNA, 22 bp, Homo sapiens
tcctgcctagcaggtgacctat

SEQ ID NO: 8769630 - DNA, 22 bp, Homo sapiens
tcctgcctcacagttgaagttt

SEQ ID NO: 8769631 - DNA, 22 bp, Homo sapiens
tcctgcctcaggctctggagta

SEQ ID NO: 8769632 - DNA, 22 bp, Homo sapiens
tcctgcctcacagttgaagttt

SEQ ID NO: 8769633 - DNA, 22 bp, Homo sapiens
tcctgcctcaggctctggagta

SEQ ID NO: 8769634 - DNA, 22 bp, Homo sapiens
tcctgcctcaggctctggagta

SEQ ID NO: 8769635 - DNA, 22 bp, Homo sapiens
tcctgcctcaggctctggagta

SEQ ID NO: 8769636 - DNA, 22 bp, Homo sapiens
tcctgcctcttgccttcttcac

SEQ ID NO: 8769637 - DNA, 22 bp, Homo sapiens
tcctgcctcttgccttcttcac

SEQ ID NO: 8769638 - DNA, 22 bp, Homo sapiens
tcctgcctcttgccttcttcac

SEQ ID NO: 8769639 - DNA, 22 bp, Homo sapiens
tcctgcctctccatgctaacta

SEQ ID NO: 8769640 - DNA, 22 bp, Homo sapiens
tcctgcctctccatgctaacta

SEQ ID NO: 8769641 - DNA, 22 bp, Homo sapiens
tcctgcctcttttcttattcca

SEQ ID NO: 8769642 - DNA, 22 bp, Homo sapiens
tcctgcctcacagttgaagttt

SEQ ID NO: 8769643 - DNA, 22 bp, Homo sapiens
tcctgcctcttttcttattcca

SEQ ID NO: 8769644 - DNA, 22 bp, Homo sapiens
tcctgcctgcaatcccagcact

SEQ ID NO: 8769645 - DNA, 22 bp, Homo sapiens
tcctgcctgcaatcccagcact

SEQ ID NO: 8769646 - DNA, 22 bp, Homo sapiens
tcctgcctgagcgtggaggagg

SEQ ID NO: 8769647 - DNA, 22 bp, Homo sapiens
tcctgcctgagcgtggaggagg

SEQ ID NO: 8769648 - DNA, 22 bp, Homo sapiens
tcctgcctgagcgtggaggagg

SEQ ID NO: 8769649 - DNA, 22 bp, Homo sapiens
tcctgcctgcaatcccagcact

SEQ ID NO: 8769650 - DNA, 22 bp, Homo sapiens
tcctgcctcttttcttattcca

SEQ ID NO: 8769651 - DNA, 22 bp, Homo sapiens
gagtaaaagttggattacaaag

SEQ ID NO: 8769652 - DNA, 22 bp, Homo sapiens
gagtaaaagatgaggcagtaga

SEQ ID NO: 8769653 - DNA, 22 bp, Homo sapiens
gagtaaaagatgaggcagtaga

SEQ ID NO: 8769654 - DNA, 22 bp, Homo sapiens
gaggttggtgaggggacacggt

SEQ ID NO: 8769655 - DNA, 22 bp, Homo sapiens
gaggtgggagggcagtccctaa

SEQ ID NO: 8769656 - DNA, 22 bp, Homo sapiens
gaggtgggagggcagtccctaa

SEQ ID NO: 8769657 - DNA, 22 bp, Homo sapiens
gaggtgggagggcagtccctaa

SEQ ID NO: 8769658 - DNA, 22 bp, Homo sapiens
gaggtgggagggcagtccctaa

SEQ ID NO: 8769659 - DNA, 19 bp, Homo sapiens
gagtacaggtgcagaaatg

SEQ ID NO: 8769660 - DNA, 22 bp, Homo sapiens
gagtaattttcttgatttctta

SEQ ID NO: 8769661 - DNA, 22 bp, Homo sapiens
gagtaattttcttaaaacatca

SEQ ID NO: 8769662 - DNA, 22 bp, Homo sapiens
gagtaatttatccagtgaagta

SEQ ID NO: 8769663 - DNA, 22 bp, Homo sapiens
gagtaattttcttaaaacatca

SEQ ID NO: 8769664 - DNA, 22 bp, Homo sapiens
gagtaattttcttgatttctta

SEQ ID NO: 8769665 - DNA, 22 bp, Homo sapiens
gagtaattccttagtgtgctta

SEQ ID NO: 8769666 - DNA, 22 bp, Homo sapiens
gagtaattccaatataaatcac

SEQ ID NO: 8769667 - DNA, 22 bp, Homo sapiens
gagtaattccttagtgtgctta

SEQ ID NO: 8769668 - DNA, 22 bp, Homo sapiens
gagtaattctggtaaatcattg

SEQ ID NO: 8769669 - DNA, 22 bp, Homo sapiens
gagtaattgtgtctggcacact

SEQ ID NO: 8769670 - DNA, 22 bp, Homo sapiens
gagtaattgatttctgcttcta

SEQ ID NO: 8769671 - DNA, 22 bp, Homo sapiens
gagtaattgtgtctggcacact

SEQ ID NO: 8769672 - DNA, 22 bp, Homo sapiens
gagtaattctggtaaatcattg

SEQ ID NO: 8769673 - DNA, 22 bp, Homo sapiens
gagtaattcttgggagactcca

SEQ ID NO: 8769674 - DNA, 22 bp, Homo sapiens
gagtaatggccgtaggttggga

SEQ ID NO: 8769675 - DNA, 22 bp, Homo sapiens
gagtaattagagcaatgacttt

SEQ ID NO: 8769676 - DNA, 22 bp, Homo sapiens
gagtaattccaatataaatcac

SEQ ID NO: 8769677 - DNA, 22 bp, Homo sapiens
gagtaaaataggtgagaatcaa

SEQ ID NO: 8769678 - DNA, 22 bp, Homo sapiens
gagtaaaagttggattacaaag

SEQ ID NO: 8769679 - DNA, 22 bp, Homo sapiens
gagtaaaataggtgagaatcaa

SEQ ID NO: 8769680 - DNA, 22 bp, Homo sapiens
gagtaacaaatacttcagtagt

SEQ ID NO: 8769681 - DNA, 22 bp, Homo sapiens
gagtaaaagttggattacaaag

SEQ ID NO: 8769682 - DNA, 22 bp, Homo sapiens
gagtaaggctgctgatggagtg

SEQ ID NO: 8769683 - DNA, 21 bp, Homo sapiens
gagtaacatttcctctccaca

SEQ ID NO: 8769684 - DNA, 22 bp, Homo sapiens
gagtaaggctgctgatggagtg

SEQ ID NO: 8769685 - DNA, 22 bp, Homo sapiens
gaggtgatggttgcacaatgct

SEQ ID NO: 8769686 - DNA, 22 bp, Homo sapiens
gaggtgagtggatcacgaggtc

SEQ ID NO: 8769687 - DNA, 22 bp, Homo sapiens
gaggtgattttcaaaagaactt

SEQ ID NO: 8769688 - DNA, 22 bp, Homo sapiens
gaggtgagtggatcacgaggtc

SEQ ID NO: 8769689 - DNA, 22 bp, Homo sapiens
gaggtgagtggatcacgaggtc

SEQ ID NO: 8769690 - DNA, 22 bp, Homo sapiens
gaggtgcctggcgatgtctctg

SEQ ID NO: 8769691 - DNA, 22 bp, Homo sapiens
gaggtgcccttgtgtattgctg

SEQ ID NO: 8769692 - DNA, 22 bp, Homo sapiens
gaggtgctgctgtacttcttgc

SEQ ID NO: 8769693 - DNA, 22 bp, Homo sapiens
gaggtgcttcctttgggctctg

SEQ ID NO: 8769694 - DNA, 22 bp, Homo sapiens
gaggtgctgctgtacttcttgc

SEQ ID NO: 8769695 - DNA, 22 bp, Homo sapiens
gaggtgctgctgtacttcttgc

SEQ ID NO: 8769696 - DNA, 22 bp, Homo sapiens
gaggtgagaagggggtcagatg

SEQ ID NO: 8769697 - DNA, 22 bp, Homo sapiens
gaggtcttgctggccatgctca

SEQ ID NO: 8769698 - DNA, 22 bp, Homo sapiens
gaggtgaaagttattcatttat

SEQ ID NO: 8769699 - DNA, 22 bp, Homo sapiens
gaggtgagaagggggtcagatg

SEQ ID NO: 8769700 - DNA, 22 bp, Homo sapiens
gaggtgagaagggggtcagatg

SEQ ID NO: 8769701 - DNA, 22 bp, Homo sapiens
gaggtctgtgtcactttagtgc

SEQ ID NO: 8769702 - DNA, 22 bp, Homo sapiens
gaggtggaaggcaggaacaaat

SEQ ID NO: 8769703 - DNA, 22 bp, Homo sapiens
gaggtggaggggaaaaatagat

SEQ ID NO: 8769704 - DNA, 22 bp, Homo sapiens
gaggtggatgttgcagtgagct

SEQ ID NO: 8769705 - DNA, 22 bp, Homo sapiens
gaggtggctgcttgctgggaaa

SEQ ID NO: 8769706 - DNA, 22 bp, Homo sapiens
gaggtggctccttcagggaata

SEQ ID NO: 8769707 - DNA, 22 bp, Homo sapiens
gaggtggctggctcagagccag

SEQ ID NO: 8769708 - DNA, 22 bp, Homo sapiens
gagggtggggaatagactgcta

SEQ ID NO: 8769709 - DNA, 22 bp, Homo sapiens
gagggtggggaatagactgcta

SEQ ID NO: 8769710 - DNA, 22 bp, Homo sapiens
gagggtggggaatagactgcta

SEQ ID NO: 8769711 - DNA, 22 bp, Homo sapiens
gagggtggggaatagactgcta

SEQ ID NO: 8769712 - DNA, 22 bp, Homo sapiens
gagggtggggaatagactgcta

SEQ ID NO: 8769713 - DNA, 22 bp, Homo sapiens
gagggtgggctcctatctgggt

SEQ ID NO: 8769714 - DNA, 22 bp, Homo sapiens
gagggtgggctcctatctgggt

SEQ ID NO: 8769715 - DNA, 22 bp, Homo sapiens
gagggtgggctttgttcctcca

SEQ ID NO: 8769716 - DNA, 22 bp, Homo sapiens
gaggtctgagtgcggaaagcct

SEQ ID NO: 8769717 - DNA, 22 bp, Homo sapiens
gaggtcctctgtgtccgcgggc

SEQ ID NO: 8769718 - DNA, 22 bp, Homo sapiens
gaggtctggaccaagtcgcccc

SEQ ID NO: 8769719 - DNA, 22 bp, Homo sapiens
gaggtctgccttcaggagagtt

SEQ ID NO: 8769720 - DNA, 22 bp, Homo sapiens
gaggtctggaccaagtcgcccc

SEQ ID NO: 8769721 - DNA, 22 bp, Homo sapiens
gaggtctgggatggggcctgaa

SEQ ID NO: 8769722 - DNA, 22 bp, Homo sapiens
gaggtctgggatggggcctgaa

SEQ ID NO: 8769723 - DNA, 22 bp, Homo sapiens
gaggtctgggcttgggcctggt

SEQ ID NO: 8769724 - DNA, 22 bp, Homo sapiens
gaggtctgggcttgggcctggt

SEQ ID NO: 8769725 - DNA, 22 bp, Homo sapiens
gagggtcttacctaagcagggt

SEQ ID NO: 8769726 - DNA, 22 bp, Homo sapiens
gagggtccctgctcagggccag

SEQ ID NO: 8769727 - DNA, 22 bp, Homo sapiens
gagggtcctggctaagtctgac

SEQ ID NO: 8769728 - DNA, 22 bp, Homo sapiens
gagggtcctggctaagtctgac

SEQ ID NO: 8769729 - DNA, 22 bp, Homo sapiens
gagggctgatgcttacttattt

SEQ ID NO: 8769730 - DNA, 22 bp, Homo sapiens
gagggtgcaggaggatggtagt

SEQ ID NO: 8769731 - DNA, 22 bp, Homo sapiens
gagggtgcagctgggccccacg

SEQ ID NO: 8769732 - DNA, 22 bp, Homo sapiens
gagggtggcctttagagcccat

SEQ ID NO: 8769733 - DNA, 22 bp, Homo sapiens
gagggtggcctttagagcccat

SEQ ID NO: 8769734 - DNA, 22 bp, Homo sapiens
gagggtggcctttagagcccat

SEQ ID NO: 8769735 - DNA, 22 bp, Homo sapiens
gagggtggctcctccctgggcc

SEQ ID NO: 8769736 - DNA, 22 bp, Homo sapiens
gagggtggaagagctgctgaga

SEQ ID NO: 8769737 - DNA, 22 bp, Homo sapiens
gagggtggaagagctgctgaga

SEQ ID NO: 8769738 - DNA, 22 bp, Homo sapiens
gagggtggagctccagaatctg

SEQ ID NO: 8769739 - DNA, 22 bp, Homo sapiens
gagggtggagctccagaatctg

SEQ ID NO: 8769740 - DNA, 19 bp, Homo sapiens
gaggcgaggcgtgcaggag

SEQ ID NO: 8769741 - DNA, 19 bp, Homo sapiens
gaggcgaggcgtgcaggag

SEQ ID NO: 8769742 - DNA, 22 bp, Homo sapiens
gaggcgcagcccggaggagaca

SEQ ID NO: 8769743 - DNA, 19 bp, Homo sapiens
gaggcgaggcgtgcaggag

SEQ ID NO: 8769744 - DNA, 18 bp, Homo sapiens
gaggcgagctcttcagaa

SEQ ID NO: 8769745 - DNA, 22 bp, Homo sapiens
gaggcgagaagctggagatggt

SEQ ID NO: 8769746 - DNA, 22 bp, Homo sapiens
gaggcgagaagctggagatggt

SEQ ID NO: 8769747 - DNA, 22 bp, Homo sapiens
gaggcgagaagctggagatggt

SEQ ID NO: 8769748 - DNA, 22 bp, Homo sapiens
gaggcgagaagctggagatggt

SEQ ID NO: 8769749 - DNA, 22 bp, Homo sapiens
gaggccttgggatgtgccacgg

SEQ ID NO: 8769750 - DNA, 22 bp, Homo sapiens
gaggccttgggatgtgccacgg

SEQ ID NO: 8769751 - DNA, 22 bp, Homo sapiens
gaggcgagaagctggagatggt

SEQ ID NO: 8769752 - DNA, 22 bp, Homo sapiens
gaggcctgtcgctaggcctctg

SEQ ID NO: 8769753 - DNA, 22 bp, Homo sapiens
gaggcctgtcgctaggcctctg

SEQ ID NO: 8769754 - DNA, 22 bp, Homo sapiens
gaggcctgtagtcatggatgta

SEQ ID NO: 8769755 - DNA, 22 bp, Homo sapiens
gaggcctgtagtcatggatgta

SEQ ID NO: 8769756 - DNA, 22 bp, Homo sapiens
gaggcctgtcgctaggcctctg

SEQ ID NO: 8769757 - DNA, 22 bp, Homo sapiens
gaggcctgtcgctaggcctctg

SEQ ID NO: 8769758 - DNA, 22 bp, Homo sapiens
gaggcctgtcgctaggcctctg

SEQ ID NO: 8769759 - DNA, 22 bp, Homo sapiens
gaggcctggtgtgtctcccgct

SEQ ID NO: 8769760 - DNA, 22 bp, Homo sapiens
gaggcctggtttccagcatcct

SEQ ID NO: 8769761 - DNA, 22 bp, Homo sapiens
gaggcctggtttgcatgagaat

SEQ ID NO: 8769762 - DNA, 22 bp, Homo sapiens
gaggcctggtttgcatgagaat

SEQ ID NO: 8769763 - DNA, 22 bp, Homo sapiens
gaggcctggtctatgagatgtt

SEQ ID NO: 8769764 - DNA, 22 bp, Homo sapiens
gaggcctggtagccgagcccca

SEQ ID NO: 8769765 - DNA, 22 bp, Homo sapiens
gaggcctggtagccgagcccca

SEQ ID NO: 8769766 - DNA, 22 bp, Homo sapiens
gaggcctggtctatgagatgtt

SEQ ID NO: 8769767 - DNA, 22 bp, Homo sapiens
gaggcctggtgctgtgtccaca

SEQ ID NO: 8769768 - DNA, 22 bp, Homo sapiens
gaggcctggtgtgtctcccgct

SEQ ID NO: 8769769 - DNA, 22 bp, Homo sapiens
gaggctggtcagccctaagatc

SEQ ID NO: 8769770 - DNA, 22 bp, Homo sapiens
gaggctggtggttagttccatt

SEQ ID NO: 8769771 - DNA, 22 bp, Homo sapiens
gaggctggtggttagttccatt

SEQ ID NO: 8769772 - DNA, 22 bp, Homo sapiens
gaggctaaggtgccagacgaat

SEQ ID NO: 8769773 - DNA, 22 bp, Homo sapiens
gaggctaaggttctgccagaag

SEQ ID NO: 8769774 - DNA, 22 bp, Homo sapiens
gaggcggcggccgagcctggct

SEQ ID NO: 8769775 - DNA, 22 bp, Homo sapiens
gaggcggccagcgaggccgcaa

SEQ ID NO: 8769776 - DNA, 22 bp, Homo sapiens
gaggcggaggttgcagtgagcc

SEQ ID NO: 8769777 - DNA, 22 bp, Homo sapiens
gaggcggcggccgagcctggct

SEQ ID NO: 8769778 - DNA, 22 bp, Homo sapiens
gaggcggaggttgcagtgagct

SEQ ID NO: 8769779 - DNA, 22 bp, Homo sapiens
gaggctggggtctgcctttctg

SEQ ID NO: 8769780 - DNA, 22 bp, Homo sapiens
gaggctggtaggaaaggaaaca

SEQ ID NO: 8769781 - DNA, 22 bp, Homo sapiens
gaggctggggtctgcctttctg

SEQ ID NO: 8769782 - DNA, 22 bp, Homo sapiens
gaggctggggtctgcctttctg

SEQ ID NO: 8769783 - DNA, 22 bp, Homo sapiens
gagggaaggtcacccttgtagc

SEQ ID NO: 8769784 - DNA, 22 bp, Homo sapiens
gagggaagtcataatgttctag

SEQ ID NO: 8769785 - DNA, 22 bp, Homo sapiens
gagggaagtcataatgttctag

SEQ ID NO: 8769786 - DNA, 22 bp, Homo sapiens
gagggaagtcataatgttctag

SEQ ID NO: 8769787 - DNA, 22 bp, Homo sapiens
gagggaatggtgtgcaagaggt

SEQ ID NO: 8769788 - DNA, 22 bp, Homo sapiens
gagggacagctaaagagaaatt

SEQ ID NO: 8769789 - DNA, 22 bp, Homo sapiens
gagggagaaggactatcaggct

SEQ ID NO: 8769790 - DNA, 22 bp, Homo sapiens
gagggacctttacacagacatt

SEQ ID NO: 8769791 - DNA, 22 bp, Homo sapiens
gagggaccccaggctggccctt

SEQ ID NO: 8769792 - DNA, 22 bp, Homo sapiens
gagggacagctaaagagaaatt

SEQ ID NO: 8769793 - DNA, 22 bp, Homo sapiens
gagggaccccaggctggccctt

SEQ ID NO: 8769794 - DNA, 22 bp, Homo sapiens
gagggagaattgcagccagcgt

SEQ ID NO: 8769795 - DNA, 22 bp, Homo sapiens
gagggagaaggactatcaggct

SEQ ID NO: 8769796 - DNA, 22 bp, Homo sapiens
gagggagaattgcagccagcgt

SEQ ID NO: 8769797 - DNA, 22 bp, Homo sapiens
gagggccacgttcagggctctc

SEQ ID NO: 8769798 - DNA, 22 bp, Homo sapiens
gagggccagagtcctggggtca

SEQ ID NO: 8769799 - DNA, 22 bp, Homo sapiens
gagggaagaggcctgacatttt

SEQ ID NO: 8769800 - DNA, 22 bp, Homo sapiens
gagggaagaggcctgacatttt

SEQ ID NO: 8769801 - DNA, 22 bp, Homo sapiens
gagggaagattccccatatggg

SEQ ID NO: 8769802 - DNA, 22 bp, Homo sapiens
gagggaagattccccatatggg

SEQ ID NO: 8769803 - DNA, 22 bp, Homo sapiens
gagggaagagggtttgaattca

SEQ ID NO: 8769804 - DNA, 22 bp, Homo sapiens
gagggaaggtcacccttgtagc

SEQ ID NO: 8769805 - DNA, 22 bp, Homo sapiens
gagggaaggacccattttaagt

SEQ ID NO: 8769806 - DNA, 22 bp, Homo sapiens
gagggaaggagagttgtagctg

SEQ ID NO: 8769807 - DNA, 22 bp, Homo sapiens
gaggctgtaacttgggcactgg

SEQ ID NO: 8769808 - DNA, 22 bp, Homo sapiens
gaggctgtaacttgggcactgg

SEQ ID NO: 8769809 - DNA, 22 bp, Homo sapiens
gagggaagaggcctgacatttt

SEQ ID NO: 8769810 - DNA, 21 bp, Homo sapiens
gaggctgtctgctgctggcct

SEQ ID NO: 8769811 - DNA, 21 bp, Homo sapiens
gaggctgtctgctgctggcct

SEQ ID NO: 8769812 - DNA, 22 bp, Homo sapiens
gagggccagatcccaggaggaa

SEQ ID NO: 8769813 - DNA, 22 bp, Homo sapiens
gagggccagatcccaggaggaa

SEQ ID NO: 8769814 - DNA, 22 bp, Homo sapiens
gagggccagatcccaggaggaa

SEQ ID NO: 8769815 - DNA, 22 bp, Homo sapiens
gagggccagcagcctcagcatg

SEQ ID NO: 8769816 - DNA, 22 bp, Homo sapiens
gagggccaggcggagacaggcg

SEQ ID NO: 8769817 - DNA, 22 bp, Homo sapiens
gagggccagcctgccaagggcc

SEQ ID NO: 8769818 - DNA, 22 bp, Homo sapiens
gagggccagcctgccaagggcc

SEQ ID NO: 8769819 - DNA, 22 bp, Homo sapiens
gagggcctagaagctccatatg

SEQ ID NO: 8769820 - DNA, 22 bp, Homo sapiens
gagggcctactggacatgtcag

SEQ ID NO: 8769821 - DNA, 22 bp, Homo sapiens
gagggccctggctggctccagc

SEQ ID NO: 8769822 - DNA, 22 bp, Homo sapiens
gagggcctctgctgctccacat

SEQ ID NO: 8769823 - DNA, 22 bp, Homo sapiens
gagggcctctgctgctccacat

SEQ ID NO: 8769824 - DNA, 22 bp, Homo sapiens
gagggcctctgctgctccacat

SEQ ID NO: 8769825 - DNA, 22 bp, Homo sapiens
gagggctgataacaggaataca

SEQ ID NO: 8769826 - DNA, 22 bp, Homo sapiens
gagggctgataaatgcgcatgg

SEQ ID NO: 8769827 - DNA, 22 bp, Homo sapiens
gagggctgataaatgcgcatgg

SEQ ID NO: 8769828 - DNA, 22 bp, Homo sapiens
gagggctgaagtgttttatgag

SEQ ID NO: 8769829 - DNA, 22 bp, Homo sapiens
gagcaggacgtgggaatgggaa

SEQ ID NO: 8769830 - DNA, 22 bp, Homo sapiens
gagcaggatgggagctggggcc

SEQ ID NO: 8769831 - DNA, 22 bp, Homo sapiens
gagcaggcaaagatgaaaggag

SEQ ID NO: 8769832 - DNA, 19 bp, Homo sapiens
gagcaggccacacatgtgt

SEQ ID NO: 8769833 - DNA, 22 bp, Homo sapiens
gagcaggcattctagtggctga

SEQ ID NO: 8769834 - DNA, 19 bp, Homo sapiens
gagcaggccacacatgtgt

SEQ ID NO: 8769835 - DNA, 19 bp, Homo sapiens
gagcaggccacacatgtgt

SEQ ID NO: 8769836 - DNA, 22 bp, Homo sapiens
gagcaggcattctagtggctga

SEQ ID NO: 8769837 - DNA, 22 bp, Homo sapiens
gagcaggcattctagtggctga

SEQ ID NO: 8769838 - DNA, 22 bp, Homo sapiens
gagcaggcattctagtggctga

SEQ ID NO: 8769839 - DNA, 22 bp, Homo sapiens
gagcaggcattctagtggctga

SEQ ID NO: 8769840 - DNA, 22 bp, Homo sapiens
gagcaggcaactctgcagtgcc

SEQ ID NO: 8769841 - DNA, 22 bp, Homo sapiens
gagcaggcaactctgcagtgcc

SEQ ID NO: 8769842 - DNA, 22 bp, Homo sapiens
gagcaggcaactctgcagtgcc

SEQ ID NO: 8769843 - DNA, 22 bp, Homo sapiens
gagcaggcctggggtgaggcct

SEQ ID NO: 8769844 - DNA, 22 bp, Homo sapiens
gagcaggcctggggtgaggcct

SEQ ID NO: 8769845 - DNA, 22 bp, Homo sapiens
gagcaggcctggggtgaggcct

SEQ ID NO: 8769846 - DNA, 22 bp, Homo sapiens
gagcaggcctggggtgaggcct

SEQ ID NO: 8769847 - DNA, 22 bp, Homo sapiens
gagcaggccagcaatggaaggg

SEQ ID NO: 8769848 - DNA, 22 bp, Homo sapiens
gagctcagactcgggcctgggg

SEQ ID NO: 8769849 - DNA, 22 bp, Homo sapiens
gagctcagagcctatagttggt

SEQ ID NO: 8769850 - DNA, 22 bp, Homo sapiens
gagctcagaggattctggggag

SEQ ID NO: 8769851 - DNA, 22 bp, Homo sapiens
gagctcagactcgggcctgggg

SEQ ID NO: 8769852 - DNA, 22 bp, Homo sapiens
gagctcagactcgggcctgggg

SEQ ID NO: 8769853 - DNA, 22 bp, Homo sapiens
gagcaggctctgcctgtgtgtc

SEQ ID NO: 8769854 - DNA, 22 bp, Homo sapiens
gagcaggctctgcctgtgtgtc

SEQ ID NO: 8769855 - DNA, 22 bp, Homo sapiens
gagcaggctctgcctgtgtgtc

SEQ ID NO: 8769856 - DNA, 22 bp, Homo sapiens
gagcaggcctggggtgaggcct

SEQ ID NO: 8769857 - DNA, 22 bp, Homo sapiens
gagctcagcccaaagagcagtg

SEQ ID NO: 8769858 - DNA, 22 bp, Homo sapiens
gagctcagcccaaagagcagtg

SEQ ID NO: 8769859 - DNA, 22 bp, Homo sapiens
gagctcagcccaaagagcagtg

SEQ ID NO: 8769860 - DNA, 22 bp, Homo sapiens
gagctcagcctgaggcctggct

SEQ ID NO: 8769861 - DNA, 22 bp, Homo sapiens
gagctcagcccaaagagcagtg

SEQ ID NO: 8769862 - DNA, 22 bp, Homo sapiens
gagctcaggagcatcagaagaa

SEQ ID NO: 8769863 - DNA, 22 bp, Homo sapiens
gagctcagcctgaggcctggct

SEQ ID NO: 8769864 - DNA, 22 bp, Homo sapiens
gagctcagcctgaggcctggct

SEQ ID NO: 8769865 - DNA, 22 bp, Homo sapiens
gagctcagcaaaggtctgtgtg

SEQ ID NO: 8769866 - DNA, 22 bp, Homo sapiens
gagctcagaggattctggggag

SEQ ID NO: 8769867 - DNA, 22 bp, Homo sapiens
gagctcagattctggtgtcaga

SEQ ID NO: 8769868 - DNA, 22 bp, Homo sapiens
gagctcaggagcatcagaagaa

SEQ ID NO: 8769869 - DNA, 22 bp, Homo sapiens
gagctcataccctcttctcttt

SEQ ID NO: 8769870 - DNA, 22 bp, Homo sapiens
gagctccaccaccttcaggcag

SEQ ID NO: 8769871 - DNA, 22 bp, Homo sapiens
gagctccagcatctctgccaaa

SEQ ID NO: 8769872 - DNA, 22 bp, Homo sapiens
gagctccagagttagacacccg

SEQ ID NO: 8769873 - DNA, 22 bp, Homo sapiens
gagctccacttagcaaggccac

SEQ ID NO: 8769874 - DNA, 22 bp, Homo sapiens
gagctccaccaccttcaggcag

SEQ ID NO: 8769875 - DNA, 22 bp, Homo sapiens
gagctgggcacacgccacttga

SEQ ID NO: 8769876 - DNA, 22 bp, Homo sapiens
gagctgggatttgaacctggga

SEQ ID NO: 8769877 - DNA, 22 bp, Homo sapiens
gagctgggcacacgccacttga

SEQ ID NO: 8769878 - DNA, 22 bp, Homo sapiens
gagctgggcacacgccacttga

SEQ ID NO: 8769879 - DNA, 22 bp, Homo sapiens
gagctgggattcatctatgtct

SEQ ID NO: 8769880 - DNA, 22 bp, Homo sapiens
gagctgggatttgaacctggga

SEQ ID NO: 8769881 - DNA, 22 bp, Homo sapiens
gagctggtgatcagctggagga

SEQ ID NO: 8769882 - DNA, 22 bp, Homo sapiens
gagctggtcgaaatgggctgac

SEQ ID NO: 8769883 - DNA, 22 bp, Homo sapiens
gagctggtcgaaatgggctgac

SEQ ID NO: 8769884 - DNA, 22 bp, Homo sapiens
gagctggtgatcagctggagga

SEQ ID NO: 8769885 - DNA, 22 bp, Homo sapiens
gagctggtcagtttcagggcca

SEQ ID NO: 8769886 - DNA, 22 bp, Homo sapiens
gagctggtcagtttcaggagag

SEQ ID NO: 8769887 - DNA, 22 bp, Homo sapiens
gagctgggtctccaccttggca

SEQ ID NO: 8769888 - DNA, 22 bp, Homo sapiens
gagctgggtctccaccttggca

SEQ ID NO: 8769889 - DNA, 17 bp, Homo sapiens
gaggacagggaagtagg

SEQ ID NO: 8769890 - DNA, 17 bp, Homo sapiens
gaggacagggaagtagg

SEQ ID NO: 8769891 - DNA, 17 bp, Homo sapiens
gaggacagggaagtagg

SEQ ID NO: 8769892 - DNA, 17 bp, Homo sapiens
gaggacagggaagtagg

SEQ ID NO: 8769893 - DNA, 22 bp, Homo sapiens
gagctgtgtgcctggatggtct

SEQ ID NO: 8769894 - DNA, 22 bp, Homo sapiens
gaggacaggagactcactgttt

SEQ ID NO: 8769895 - DNA, 22 bp, Homo sapiens
gaggacaggagactcactgttt

SEQ ID NO: 8769896 - DNA, 22 bp, Homo sapiens
gaggacaggagactcactgttt

SEQ ID NO: 8769897 - DNA, 22 bp, Homo sapiens
gagctgtgattggtgtctcact

SEQ ID NO: 8769898 - DNA, 22 bp, Homo sapiens
gagctgtgccaatctgtctggg

SEQ ID NO: 8769899 - DNA, 22 bp, Homo sapiens
gagctgtgccaatctgtctggg

SEQ ID NO: 8769900 - DNA, 20 bp, Homo sapiens
gagctgtgctctcaggagcc

SEQ ID NO: 8769901 - DNA, 20 bp, Homo sapiens
gagctgtgctctcaggagcc

SEQ ID NO: 8769902 - DNA, 22 bp, Homo sapiens
gagctgtgccaatctgtctggg

SEQ ID NO: 8769903 - DNA, 22 bp, Homo sapiens
gagctgtggaaggcagggacca

SEQ ID NO: 8769904 - DNA, 22 bp, Homo sapiens
gagctgtggaaggcagggacca

SEQ ID NO: 8769905 - DNA, 18 bp, Homo sapiens
gagctgtctgagctggtc

SEQ ID NO: 8769906 - DNA, 22 bp, Homo sapiens
gagctgtctggggactctgggt

SEQ ID NO: 8769907 - DNA, 22 bp, Homo sapiens
gagctgtgaaaagtgcctgggg

SEQ ID NO: 8769908 - DNA, 22 bp, Homo sapiens
gagctgtgaaaagtgcctgggg

SEQ ID NO: 8769909 - DNA, 22 bp, Homo sapiens
gagctgtgagggacacattgct

SEQ ID NO: 8769910 - DNA, 22 bp, Homo sapiens
gagctgtgattggtgtctcact

SEQ ID NO: 8769911 - DNA, 22 bp, Homo sapiens
gagctgtgacacgcagcccagg

SEQ ID NO: 8769912 - DNA, 22 bp, Homo sapiens
gagctgtgacacgcagcccagg

SEQ ID NO: 8769913 - DNA, 22 bp, Homo sapiens
gagctgtccaagatggtcgtaa

SEQ ID NO: 8769914 - DNA, 22 bp, Homo sapiens
gagctggttctgtccagggaat

SEQ ID NO: 8769915 - DNA, 22 bp, Homo sapiens
gagctggtgtgtgcccgagcac

SEQ ID NO: 8769916 - DNA, 22 bp, Homo sapiens
gagctggttctgtccagggaat

SEQ ID NO: 8769917 - DNA, 22 bp, Homo sapiens
gagctgtccgcccctgggccga

SEQ ID NO: 8769918 - DNA, 22 bp, Homo sapiens
gagctgtcctaccaggagtcct

SEQ ID NO: 8769919 - DNA, 22 bp, Homo sapiens
gagctgtcctaccaggagtcct

SEQ ID NO: 8769920 - DNA, 22 bp, Homo sapiens
gagctgtctctttgggcctttt

SEQ ID NO: 8769921 - DNA, 22 bp, Homo sapiens
gagctgtctctatatgaatgct

SEQ ID NO: 8769922 - DNA, 22 bp, Homo sapiens
gaggacagtgtgatctgccagc

SEQ ID NO: 8769923 - DNA, 22 bp, Homo sapiens
gaggacagtgtgatctgccagc

SEQ ID NO: 8769924 - DNA, 22 bp, Homo sapiens
gaggacagtgtgatctgccagc

SEQ ID NO: 8769925 - DNA, 22 bp, Homo sapiens
gaggacagtgtgatctgccagc

SEQ ID NO: 8769926 - DNA, 22 bp, Homo sapiens
gaggacagtgtgatctgccagc

SEQ ID NO: 8769927 - DNA, 22 bp, Homo sapiens
gaggaccagcattttcagagtg

SEQ ID NO: 8769928 - DNA, 22 bp, Homo sapiens
gaggactacatgagccacatca

SEQ ID NO: 8769929 - DNA, 22 bp, Homo sapiens
gaggactctgggcgtgtatggg

SEQ ID NO: 8769930 - DNA, 22 bp, Homo sapiens
gaggaccacagatgagcctgca

SEQ ID NO: 8769931 - DNA, 22 bp, Homo sapiens
gaggaccacagatgagcctgca

SEQ ID NO: 8769932 - DNA, 22 bp, Homo sapiens
gaggaccacagatgagcctgca

SEQ ID NO: 8769933 - DNA, 22 bp, Homo sapiens
gaggagagaagctaacggtgct

SEQ ID NO: 8769934 - DNA, 22 bp, Homo sapiens
gaggagagaagctaacggtgct

SEQ ID NO: 8769935 - DNA, 22 bp, Homo sapiens
gaggagagaagctaacggtgct

SEQ ID NO: 8769936 - DNA, 22 bp, Homo sapiens
gaggagacggggtgcctggagc

SEQ ID NO: 8769937 - DNA, 22 bp, Homo sapiens
gaggagactgacagcagattct

SEQ ID NO: 8769938 - DNA, 22 bp, Homo sapiens
gaggagactgacagcagattct

SEQ ID NO: 8769939 - DNA, 22 bp, Homo sapiens
gaggagagaacattcctccata

SEQ ID NO: 8769940 - DNA, 22 bp, Homo sapiens
gaggagagaacattcctccata

SEQ ID NO: 8769941 - DNA, 22 bp, Homo sapiens
gaggactgcagatgggtgcatc

SEQ ID NO: 8769942 - DNA, 22 bp, Homo sapiens
gaggactgcagatgggtgcatc

SEQ ID NO: 8769943 - DNA, 21 bp, Homo sapiens
gaggactgcacactctgattg

SEQ ID NO: 8769944 - DNA, 22 bp, Homo sapiens
gaggactgaaacttacaggaaa

SEQ ID NO: 8769945 - DNA, 22 bp, Homo sapiens
gaggagacggggtgcctggagc

SEQ ID NO: 8769946 - DNA, 22 bp, Homo sapiens
gaggagacagtggagccgctac

SEQ ID NO: 8769947 - DNA, 22 bp, Homo sapiens
gaggagaaagcagtgatttgtg

SEQ ID NO: 8769948 - DNA, 22 bp, Homo sapiens
gaggagaaagcagtgatttgtg

SEQ ID NO: 8769949 - DNA, 18 bp, Homo sapiens
gaggatggaaggagatgc

SEQ ID NO: 8769950 - DNA, 18 bp, Homo sapiens
gaggatggaaggagatgc

SEQ ID NO: 8769951 - DNA, 22 bp, Homo sapiens
gaggatggaggcagttagggcc

SEQ ID NO: 8769952 - DNA, 22 bp, Homo sapiens
gaggatggaggcagttagggcc

SEQ ID NO: 8769953 - DNA, 18 bp, Homo sapiens
gaggatggaaggagatgc

SEQ ID NO: 8769954 - DNA, 18 bp, Homo sapiens
gaggatggaaggagatgc

SEQ ID NO: 8769955 - DNA, 22 bp, Homo sapiens
gaggatgctgcagtgcaggaca

SEQ ID NO: 8769956 - DNA, 19 bp, Homo sapiens
gaggatgctcggtcccagg

SEQ ID NO: 8769957 - DNA, 19 bp, Homo sapiens
gaggatgctcggtcccagg

SEQ ID NO: 8769958 - DNA, 20 bp, Homo sapiens
gaggatgcagacagagggca

SEQ ID NO: 8769959 - DNA, 20 bp, Homo sapiens
gaggatgcagacagagggca

SEQ ID NO: 8769960 - DNA, 18 bp, Homo sapiens
gaggatcagaaatctgta

SEQ ID NO: 8769961 - DNA, 22 bp, Homo sapiens
gaggagtggagttgctgggttg

SEQ ID NO: 8769962 - DNA, 22 bp, Homo sapiens
gaggagtggagttgctgggttg

SEQ ID NO: 8769963 - DNA, 22 bp, Homo sapiens
gaggagtgccagccgtggagtc

SEQ ID NO: 8769964 - DNA, 22 bp, Homo sapiens
gaggagtgccagccgtggagtc

SEQ ID NO: 8769965 - DNA, 22 bp, Homo sapiens
gaggagtgccagccgtggagtc

SEQ ID NO: 8769966 - DNA, 22 bp, Homo sapiens
gaggagtgccagccgtggagtc

SEQ ID NO: 8769967 - DNA, 22 bp, Homo sapiens
gaggaggttgacggcactgtga

SEQ ID NO: 8769968 - DNA, 22 bp, Homo sapiens
gaggagagagggactgtctgca

SEQ ID NO: 8769969 - DNA, 22 bp, Homo sapiens
gaggagagaagctaacggtgct

SEQ ID NO: 8769970 - DNA, 22 bp, Homo sapiens
gaggagagaagctaacggtgct

SEQ ID NO: 8769971 - DNA, 22 bp, Homo sapiens
gaggagagagggactgtctgca

SEQ ID NO: 8769972 - DNA, 22 bp, Homo sapiens
gaggaggttccgggtggagaag

SEQ ID NO: 8769973 - DNA, 22 bp, Homo sapiens
gaggaggtggagtcatgcagag

SEQ ID NO: 8769974 - DNA, 22 bp, Homo sapiens
gaggaggtggagtcatgcagag

SEQ ID NO: 8769975 - DNA, 22 bp, Homo sapiens
gaggaggtggagtcatgcagag

SEQ ID NO: 8769976 - DNA, 22 bp, Homo sapiens
gaggatggaggtgtgagctatg

SEQ ID NO: 8769977 - DNA, 22 bp, Homo sapiens
gaggatggaggtgtgagctatg

SEQ ID NO: 8769978 - DNA, 22 bp, Homo sapiens
gaggatggaggtgtgagctatg

SEQ ID NO: 8769979 - DNA, 22 bp, Homo sapiens
gaggatggtgagcaggacccag

SEQ ID NO: 8769980 - DNA, 22 bp, Homo sapiens
gaggatggtatgaggcaagcaa

SEQ ID NO: 8769981 - DNA, 22 bp, Homo sapiens
gaggatggtatgaggcaagcaa

SEQ ID NO: 8769982 - DNA, 22 bp, Homo sapiens
gaggatggtgagcaggacccag

SEQ ID NO: 8769983 - DNA, 22 bp, Homo sapiens
gaggcaacttcctgtcctctcc

SEQ ID NO: 8769984 - DNA, 22 bp, Homo sapiens
gaggcaactggaacactggtca

SEQ ID NO: 8769985 - DNA, 22 bp, Homo sapiens
gaggcaacattgagcttctgta

SEQ ID NO: 8769986 - DNA, 22 bp, Homo sapiens
gaggcaacattgagcttctgta

SEQ ID NO: 8769987 - DNA, 22 bp, Homo sapiens
gaggcaactgcttttcctcctt

SEQ ID NO: 8769988 - DNA, 22 bp, Homo sapiens
gaggcaacacatttggaaagca

SEQ ID NO: 8769989 - DNA, 22 bp, Homo sapiens
gaggcaacaatgatggtgtgta

SEQ ID NO: 8769990 - DNA, 22 bp, Homo sapiens
gaggatgtccacatggacggtg

SEQ ID NO: 8769991 - DNA, 22 bp, Homo sapiens
gaggatttgatggctttctccc

SEQ ID NO: 8769992 - DNA, 22 bp, Homo sapiens
gaggatggtgagcaggacccag

SEQ ID NO: 8769993 - DNA, 22 bp, Homo sapiens
gaggcatgcagagctggagcag

SEQ ID NO: 8769994 - DNA, 22 bp, Homo sapiens
gaggcatggcctgaggctagga

SEQ ID NO: 8769995 - DNA, 22 bp, Homo sapiens
gaggcatgcagagctggagcag

SEQ ID NO: 8769996 - DNA, 21 bp, Homo sapiens
gaggccactaataggggcaga

SEQ ID NO: 8769997 - DNA, 22 bp, Homo sapiens
gaggccagaagtctgagatcag

SEQ ID NO: 8769998 - DNA, 22 bp, Homo sapiens
gaggccagaagtctgagatcag

SEQ ID NO: 8769999 - DNA, 22 bp, Homo sapiens
gaggccagaagtgcctcgggct

SEQ ID NO: 8770000 - DNA, 22 bp, Homo sapiens
gaggccagaatgagctgaatgc

SEQ ID NO: 8770001 - DNA, 22 bp, Homo sapiens
gaggccagaagtgcctcgggct

SEQ ID NO: 8770002 - DNA, 22 bp, Homo sapiens
gaggccagaatgagtctctggg

SEQ ID NO: 8770003 - DNA, 22 bp, Homo sapiens
gaggccagaatgagtctctggg

SEQ ID NO: 8770004 - DNA, 22 bp, Homo sapiens
gaggccagagttccccgagtca

SEQ ID NO: 8770005 - DNA, 22 bp, Homo sapiens
gaggcctggaattccagcctgg

SEQ ID NO: 8770006 - DNA, 22 bp, Homo sapiens
gaggcctggaattccagcctgg

SEQ ID NO: 8770007 - DNA, 22 bp, Homo sapiens
gaggcctggaattccagcctgg

SEQ ID NO: 8770008 - DNA, 22 bp, Homo sapiens
gaggcctggaattccagcctgg

SEQ ID NO: 8770009 - DNA, 22 bp, Homo sapiens
gaggcctggagccgcctaggcg

SEQ ID NO: 8770010 - DNA, 22 bp, Homo sapiens
gaggcctggaccagccacagag

SEQ ID NO: 8770011 - DNA, 22 bp, Homo sapiens
gaggcctggaccagccacagag

SEQ ID NO: 8770012 - DNA, 22 bp, Homo sapiens
gaggcctggaccagccacagag

SEQ ID NO: 8770013 - DNA, 22 bp, Homo sapiens
gagaggagaagcctgcgcttca

SEQ ID NO: 8770014 - DNA, 22 bp, Homo sapiens
gagaggagaagcctgcgcttca

SEQ ID NO: 8770015 - DNA, 22 bp, Homo sapiens
gagagctgtcagcgtagcaccg

SEQ ID NO: 8770016 - DNA, 22 bp, Homo sapiens
gagaggagaagcctgcgcttca

SEQ ID NO: 8770017 - DNA, 22 bp, Homo sapiens
gagaggagacttatccagattg

SEQ ID NO: 8770018 - DNA, 22 bp, Homo sapiens
gagaggagacttatccagattg

SEQ ID NO: 8770019 - DNA, 22 bp, Homo sapiens
gagaggagacttatccagattg

SEQ ID NO: 8770020 - DNA, 22 bp, Homo sapiens
gagaggagaagcctgcgcttca

SEQ ID NO: 8770021 - DNA, 22 bp, Homo sapiens
gagagctgtccggctgagcagc

SEQ ID NO: 8770022 - DNA, 22 bp, Homo sapiens
gagagctgtcagcgtagcaccg

SEQ ID NO: 8770023 - DNA, 22 bp, Homo sapiens
gagagccctcactccttccctg

SEQ ID NO: 8770024 - DNA, 22 bp, Homo sapiens
gagagccctgctcctatcccag

SEQ ID NO: 8770025 - DNA, 22 bp, Homo sapiens
gagagctgtaatagtcatgtct

SEQ ID NO: 8770026 - DNA, 18 bp, Homo sapiens
gagaggagccagaatttt

SEQ ID NO: 8770027 - DNA, 18 bp, Homo sapiens
gagaggagccagaatttt

SEQ ID NO: 8770028 - DNA, 18 bp, Homo sapiens
gagaggagccagaatttt

SEQ ID NO: 8770029 - DNA, 22 bp, Homo sapiens
gagaggaggtggctatgacagc

SEQ ID NO: 8770030 - DNA, 22 bp, Homo sapiens
gagaggaggtggctatgacagc

SEQ ID NO: 8770031 - DNA, 22 bp, Homo sapiens
gagaggaggtggctatgacagc

SEQ ID NO: 8770032 - DNA, 22 bp, Homo sapiens
gagaggaggtggctatgacagc

SEQ ID NO: 8770033 - DNA, 22 bp, Homo sapiens
gagaggaggtggctatgacagc

SEQ ID NO: 8770034 - DNA, 22 bp, Homo sapiens
gagaggagtaggctgatggtgc

SEQ ID NO: 8770035 - DNA, 22 bp, Homo sapiens
gagaggagtaggctgatggtgc

SEQ ID NO: 8770036 - DNA, 22 bp, Homo sapiens
gagaggagtccctatcacagtt

SEQ ID NO: 8770037 - DNA, 22 bp, Homo sapiens
gagaggagtccctatcacagtt

SEQ ID NO: 8770038 - DNA, 22 bp, Homo sapiens
gagaggagtccctatcacagtt

SEQ ID NO: 8770039 - DNA, 22 bp, Homo sapiens
gagaggagtaggctgatggtgc

SEQ ID NO: 8770040 - DNA, 22 bp, Homo sapiens
gagaggagtagacactttggtt

SEQ ID NO: 8770041 - DNA, 22 bp, Homo sapiens
gagaggagtagacactttggtt

SEQ ID NO: 8770042 - DNA, 22 bp, Homo sapiens
gagaggagtaggctgatggtgc

SEQ ID NO: 8770043 - DNA, 22 bp, Homo sapiens
gagaggagtagacactttggtt

SEQ ID NO: 8770044 - DNA, 22 bp, Homo sapiens
gagaggagtaggctgatggtgc

SEQ ID NO: 8770045 - DNA, 22 bp, Homo sapiens
gagagagaaggcctgtgggtgt

SEQ ID NO: 8770046 - DNA, 22 bp, Homo sapiens
gagagagaaggcctgtgggtgt

SEQ ID NO: 8770047 - DNA, 22 bp, Homo sapiens
gagagagaaccccgtgcccttc

SEQ ID NO: 8770048 - DNA, 22 bp, Homo sapiens
gagagagaaccccgtgcccttc

SEQ ID NO: 8770049 - DNA, 22 bp, Homo sapiens
gagagagaaaatgactccggac

SEQ ID NO: 8770050 - DNA, 22 bp, Homo sapiens
gagagacagcagaacgtgcagc

SEQ ID NO: 8770051 - DNA, 22 bp, Homo sapiens
gagagacagcagaacgtgcagc

SEQ ID NO: 8770052 - DNA, 22 bp, Homo sapiens
gagagacagcagaacgtgcagc

SEQ ID NO: 8770053 - DNA, 22 bp, Homo sapiens
gagagacagcacacagtgtggg

SEQ ID NO: 8770054 - DNA, 22 bp, Homo sapiens
gagagacagcagaacgtgcagc

SEQ ID NO: 8770055 - DNA, 22 bp, Homo sapiens
gagagaatgtacatgctagggg

SEQ ID NO: 8770056 - DNA, 22 bp, Homo sapiens
gagagacagcacacagtgtggg

SEQ ID NO: 8770057 - DNA, 18 bp, Homo sapiens
gagagcccagcaggtggt

SEQ ID NO: 8770058 - DNA, 18 bp, Homo sapiens
gagagcccagcaggtggt

SEQ ID NO: 8770059 - DNA, 23 bp, Homo sapiens
gagagcccattggcaggggtacc

SEQ ID NO: 8770060 - DNA, 22 bp, Homo sapiens
gagagccatggtggagatgggg

SEQ ID NO: 8770061 - DNA, 22 bp, Homo sapiens
gagagccagctcactccagggc

SEQ ID NO: 8770062 - DNA, 22 bp, Homo sapiens
gagagccagctcactccagggc

SEQ ID NO: 8770063 - DNA, 22 bp, Homo sapiens
gagagcaggaggcagcgggacg

SEQ ID NO: 8770064 - DNA, 22 bp, Homo sapiens
gagagcaggaggcagcgggacg

SEQ ID NO: 8770065 - DNA, 22 bp, Homo sapiens
gagagcaggctctcgggggcca

SEQ ID NO: 8770066 - DNA, 22 bp, Homo sapiens
gagagcaggaggcagcgggacg

SEQ ID NO: 8770067 - DNA, 22 bp, Homo sapiens
gagagagaaggcctgtgggtgt

SEQ ID NO: 8770068 - DNA, 22 bp, Homo sapiens
gagagcatgtggtctagtttta

SEQ ID NO: 8770069 - DNA, 22 bp, Homo sapiens
gagagcaggctctcgggggcca

SEQ ID NO: 8770070 - DNA, 22 bp, Homo sapiens
gagaaggaagttgagccagcat

SEQ ID NO: 8770071 - DNA, 22 bp, Homo sapiens
gagaaggaagttgagccagcat

SEQ ID NO: 8770072 - DNA, 18 bp, Homo sapiens
gagaagctgattgaatgc

SEQ ID NO: 8770073 - DNA, 22 bp, Homo sapiens
gagaagccgagtcagctgagcc

SEQ ID NO: 8770074 - DNA, 22 bp, Homo sapiens
gagagaagaacaatgtcattca

SEQ ID NO: 8770075 - DNA, 22 bp, Homo sapiens
gagagaagaacaatgtcattca

SEQ ID NO: 8770076 - DNA, 22 bp, Homo sapiens
gagagaagaaagccatggtcct

SEQ ID NO: 8770077 - DNA, 22 bp, Homo sapiens
gagagaagaaagccatggtcct

SEQ ID NO: 8770078 - DNA, 22 bp, Homo sapiens
gagagaagaatgttccgaggcc

SEQ ID NO: 8770079 - DNA, 22 bp, Homo sapiens
gagagaagaatgttccgaggcc

SEQ ID NO: 8770080 - DNA, 22 bp, Homo sapiens
gagagaagaatgttccgaggcc

SEQ ID NO: 8770081 - DNA, 22 bp, Homo sapiens
gagagaatgtacatgctagggg

SEQ ID NO: 8770082 - DNA, 22 bp, Homo sapiens
gagagaagaatgttccgaggcc

SEQ ID NO: 8770083 - DNA, 22 bp, Homo sapiens
gagaagcaggtttagcagacaa

SEQ ID NO: 8770084 - DNA, 22 bp, Homo sapiens
gagaagcaggtttagcagacaa

SEQ ID NO: 8770085 - DNA, 22 bp, Homo sapiens
gagaagcaggtttagcagacaa

SEQ ID NO: 8770086 - DNA, 22 bp, Homo sapiens
gagaagcaggtttagcagacaa

SEQ ID NO: 8770087 - DNA, 22 bp, Homo sapiens
gagaagcaatcagtggccaccc

SEQ ID NO: 8770088 - DNA, 22 bp, Homo sapiens
gagaagcaatcgtgacatctcc

SEQ ID NO: 8770089 - DNA, 22 bp, Homo sapiens
gagaagcaatcgtgacatctcc

SEQ ID NO: 8770090 - DNA, 22 bp, Homo sapiens
gagaagcaatcgtgacatctcc

SEQ ID NO: 8770091 - DNA, 22 bp, Homo sapiens
gagaaagggaacttacagagtg

SEQ ID NO: 8770092 - DNA, 22 bp, Homo sapiens
gagaaagggaacttacagagtg

SEQ ID NO: 8770093 - DNA, 22 bp, Homo sapiens
gagaaagggaacttacagagtg

SEQ ID NO: 8770094 - DNA, 22 bp, Homo sapiens
gagaaagggaacttacagagtg

SEQ ID NO: 8770095 - DNA, 22 bp, Homo sapiens
gagaacaggctctggagtcaga

SEQ ID NO: 8770096 - DNA, 22 bp, Homo sapiens
gagaacaggctctggagtcaga

SEQ ID NO: 8770097 - DNA, 22 bp, Homo sapiens
gagaacaggctctggagtcaga

SEQ ID NO: 8770098 - DNA, 19 bp, Homo sapiens
gactcacaccttccgctgt

SEQ ID NO: 8770099 - DNA, 22 bp, Homo sapiens
gactcagtgatttgacatgcct

SEQ ID NO: 8770100 - DNA, 19 bp, Homo sapiens
gactccaactttaagcatg

SEQ ID NO: 8770101 - DNA, 19 bp, Homo sapiens
gactccaactttaagcatg

SEQ ID NO: 8770102 - DNA, 22 bp, Homo sapiens
gagaagacgtgatggccaagaa

SEQ ID NO: 8770103 - DNA, 22 bp, Homo sapiens
gagaagcaatcagcagccaccc

SEQ ID NO: 8770104 - DNA, 22 bp, Homo sapiens
gagaagcaatcagcagccaccc

SEQ ID NO: 8770105 - DNA, 16 bp, Homo sapiens
gagaagagcccggcag

SEQ ID NO: 8770106 - DNA, 22 bp, Homo sapiens
gagaacttcaggattattcaag

SEQ ID NO: 8770107 - DNA, 22 bp, Homo sapiens
gagaacttcaggattattcaag

SEQ ID NO: 8770108 - DNA, 22 bp, Homo sapiens
gagaacttgaacttttcctctg

SEQ ID NO: 8770109 - DNA, 22 bp, Homo sapiens
gagaactcagacgcaggtcatg

SEQ ID NO: 8770110 - DNA, 22 bp, Homo sapiens
gagaacctactgtatactatat

SEQ ID NO: 8770111 - DNA, 22 bp, Homo sapiens
gagaacctctccacaagtctgg

SEQ ID NO: 8770112 - DNA, 22 bp, Homo sapiens
gagaacagtgttgtattttttc

SEQ ID NO: 8770113 - DNA, 22 bp, Homo sapiens
gagcaaggatggccggggccgt

SEQ ID NO: 8770114 - DNA, 22 bp, Homo sapiens
gagcaaggatgggtctatagta

SEQ ID NO: 8770115 - DNA, 22 bp, Homo sapiens
gagcaaggagggtggggccttt

SEQ ID NO: 8770116 - DNA, 22 bp, Homo sapiens
gagcaaggagggtggggccttt

SEQ ID NO: 8770117 - DNA, 22 bp, Homo sapiens
gagcaaggcggcatctctctga

SEQ ID NO: 8770118 - DNA, 22 bp, Homo sapiens
gagcaaggtagctctctggggc

SEQ ID NO: 8770119 - DNA, 22 bp, Homo sapiens
gagcaaggcggcatctctctga

SEQ ID NO: 8770120 - DNA, 22 bp, Homo sapiens
gagcaagattaaaaggctgggt

SEQ ID NO: 8770121 - DNA, 22 bp, Homo sapiens
gagcaagattaaaaggctgggt

SEQ ID NO: 8770122 - DNA, 22 bp, Homo sapiens
gagcaagactacaggcagatga

SEQ ID NO: 8770123 - DNA, 22 bp, Homo sapiens
gagcaagagtgttggactttga

SEQ ID NO: 8770124 - DNA, 22 bp, Homo sapiens
gagcaagactcactgcatcttg

SEQ ID NO: 8770125 - DNA, 22 bp, Homo sapiens
gagcacacagtgtgcctgtgta

SEQ ID NO: 8770126 - DNA, 22 bp, Homo sapiens
gagcaatggaagatagataaca

SEQ ID NO: 8770127 - DNA, 22 bp, Homo sapiens
gagcaatggaagatagataaca

SEQ ID NO: 8770128 - DNA, 22 bp, Homo sapiens
gagcaatgcccttcaccagccc

SEQ ID NO: 8770129 - DNA, 22 bp, Homo sapiens
gagcacagatcctggagccaca

SEQ ID NO: 8770130 - DNA, 22 bp, Homo sapiens
gagcacagatcctggagccaca

SEQ ID NO: 8770131 - DNA, 22 bp, Homo sapiens
gagcacagatcctggagccaca

SEQ ID NO: 8770132 - DNA, 22 bp, Homo sapiens
gagcacagatcctggagccaca

SEQ ID NO: 8770133 - DNA, 22 bp, Homo sapiens
gagcacagaatcttcccatgca

SEQ ID NO: 8770134 - DNA, 22 bp, Homo sapiens
gagcacagaatcttcccatgca

SEQ ID NO: 8770135 - DNA, 22 bp, Homo sapiens
gagcacagatcctggagccaca

SEQ ID NO: 8770136 - DNA, 22 bp, Homo sapiens
gagcacagaactaaatgctggt

SEQ ID NO: 8770137 - DNA, 22 bp, Homo sapiens
gagcacagaactaaatgctggt

SEQ ID NO: 8770138 - DNA, 22 bp, Homo sapiens
gagcacagaaggagaaatatgg

SEQ ID NO: 8770139 - DNA, 22 bp, Homo sapiens
gagcacagaatcttcccatgca

SEQ ID NO: 8770140 - DNA, 22 bp, Homo sapiens
gagatttaggggggaagatacg

SEQ ID NO: 8770141 - DNA, 22 bp, Homo sapiens
gagaggcaggcgctgcaatggt

SEQ ID NO: 8770142 - DNA, 22 bp, Homo sapiens
gagattttcagcttgactggga

SEQ ID NO: 8770143 - DNA, 22 bp, Homo sapiens
gagatttccatattttgtaaca

SEQ ID NO: 8770144 - DNA, 22 bp, Homo sapiens
gagatttcacccctcttaacct

SEQ ID NO: 8770145 - DNA, 22 bp, Homo sapiens
gagatttattgacttaacagta

SEQ ID NO: 8770146 - DNA, 22 bp, Homo sapiens
gagaggcagaggcctgaaaccg

SEQ ID NO: 8770147 - DNA, 22 bp, Homo sapiens
gagaggcaggaatcctgggtga

SEQ ID NO: 8770148 - DNA, 22 bp, Homo sapiens
gagaggcaggaatcctgggtga

SEQ ID NO: 8770149 - DNA, 22 bp, Homo sapiens
gagaggcagaggcctgaaaccg

SEQ ID NO: 8770150 - DNA, 22 bp, Homo sapiens
gagaggcaggaatcctgggtga

SEQ ID NO: 8770151 - DNA, 22 bp, Homo sapiens
gagaggcaggaatcctgggtga

SEQ ID NO: 8770152 - DNA, 22 bp, Homo sapiens
gagaggatccacaaaccaggaa

SEQ ID NO: 8770153 - DNA, 22 bp, Homo sapiens
gagaggagtccctatcacagtt

SEQ ID NO: 8770154 - DNA, 22 bp, Homo sapiens
gagaggagttactatttccgag

SEQ ID NO: 8770155 - DNA, 23 bp, Homo sapiens
gagcaaacccgtctatgccctcc

SEQ ID NO: 8770156 - DNA, 22 bp, Homo sapiens
gagatttttcaacaagaatagg

SEQ ID NO: 8770157 - DNA, 22 bp, Homo sapiens
gagatttttcaacaagaatagg

SEQ ID NO: 8770158 - DNA, 22 bp, Homo sapiens
gagcaaacatcagtgatgtctg

SEQ ID NO: 8770159 - DNA, 22 bp, Homo sapiens
gagcaacagggcgaggagaact

SEQ ID NO: 8770160 - DNA, 22 bp, Homo sapiens
gagcaacagggcgaggagaact

SEQ ID NO: 8770161 - DNA, 22 bp, Homo sapiens
gagcaacaggtgatggggctgt

SEQ ID NO: 8770162 - DNA, 22 bp, Homo sapiens
gagcaacactccacattgctag

SEQ ID NO: 8770163 - DNA, 22 bp, Homo sapiens
gagcaacactccacattgctag

SEQ ID NO: 8770164 - DNA, 22 bp, Homo sapiens
gagcaacactccacattgctag

SEQ ID NO: 8770165 - DNA, 22 bp, Homo sapiens
gagcaacacgcagtagtatacg

SEQ ID NO: 8770166 - DNA, 22 bp, Homo sapiens
gagcaacacattgaatgaggat

SEQ ID NO: 8770167 - DNA, 22 bp, Homo sapiens
gagcaacacgcagtagtatacg

SEQ ID NO: 8770168 - DNA, 22 bp, Homo sapiens
gagcaagactacaggcagatga

SEQ ID NO: 8770169 - DNA, 22 bp, Homo sapiens
gagcaacagtttatggtttttc

SEQ ID NO: 8770170 - DNA, 19 bp, Homo sapiens
gagcaacatatgtaaactc

SEQ ID NO: 8770171 - DNA, 19 bp, Homo sapiens
gagcaacatatgtaaactc

SEQ ID NO: 8770172 - DNA, 19 bp, Homo sapiens
gagcaacatatgtaaactc

SEQ ID NO: 8770173 - DNA, 22 bp, Homo sapiens
gagcacttagatgctatgaatg

SEQ ID NO: 8770174 - DNA, 22 bp, Homo sapiens
gagcacttaatcctgttattca

SEQ ID NO: 8770175 - DNA, 22 bp, Homo sapiens
gagcactgtactcatttgcact

SEQ ID NO: 8770176 - DNA, 22 bp, Homo sapiens
gagcacttcagaattgggcaat

SEQ ID NO: 8770177 - DNA, 22 bp, Homo sapiens
gagcacgttgaagcgcactgtc

SEQ ID NO: 8770178 - DNA, 22 bp, Homo sapiens
gagcaccgcctccacgatgccc

SEQ ID NO: 8770179 - DNA, 22 bp, Homo sapiens
gagcactgaggaaagctggtta

SEQ ID NO: 8770180 - DNA, 22 bp, Homo sapiens
gagcactgagctggaattggag

SEQ ID NO: 8770181 - DNA, 22 bp, Homo sapiens
gagcactgatttatttttgtct

SEQ ID NO: 8770182 - DNA, 22 bp, Homo sapiens
gagcacagatcctggagccaca

SEQ ID NO: 8770183 - DNA, 22 bp, Homo sapiens
gagcacagtaaagcagtgtcac

SEQ ID NO: 8770184 - DNA, 22 bp, Homo sapiens
gagcacagtaaagcagtgtcac

SEQ ID NO: 8770185 - DNA, 20 bp, Homo sapiens
gagcacagtaatgactgcta

SEQ ID NO: 8770186 - DNA, 22 bp, Homo sapiens
gagcacagtccttttgttaaaa

SEQ ID NO: 8770187 - DNA, 22 bp, Homo sapiens
gagcacagtgcagtttctgcta

SEQ ID NO: 8770188 - DNA, 22 bp, Homo sapiens
gagcaccctttgcacatcagtc

SEQ ID NO: 8770189 - DNA, 22 bp, Homo sapiens
gagcaccagcagtcccctggca

SEQ ID NO: 8770190 - DNA, 22 bp, Homo sapiens
gagcaggaactgaaaatgagac

SEQ ID NO: 8770191 - DNA, 22 bp, Homo sapiens
gagcaggaactgaaaatgagac

SEQ ID NO: 8770192 - DNA, 22 bp, Homo sapiens
gagcaggaaggccagaagggtc

SEQ ID NO: 8770193 - DNA, 22 bp, Homo sapiens
gagcagcttgcgctgtcttcac

SEQ ID NO: 8770194 - DNA, 22 bp, Homo sapiens
gagcagcttgcgctgtcttcac

SEQ ID NO: 8770195 - DNA, 22 bp, Homo sapiens
gagcaggaactgaaaatgagac

SEQ ID NO: 8770196 - DNA, 22 bp, Homo sapiens
gagcaggacagcagcttcctgg

SEQ ID NO: 8770197 - DNA, 22 bp, Homo sapiens
gagcaggaaggccagaagggtc

SEQ ID NO: 8770198 - DNA, 22 bp, Homo sapiens
gagcaggaaggccagaagggtc

SEQ ID NO: 8770199 - DNA, 22 bp, Homo sapiens
gagcaggacgtgggaatgggaa

SEQ ID NO: 8770200 - DNA, 22 bp, Homo sapiens
gagcaggacgtgggaatgggaa

SEQ ID NO: 8770201 - DNA, 22 bp, Homo sapiens
gagcagagaatccagctaagtg

SEQ ID NO: 8770202 - DNA, 22 bp, Homo sapiens
gagcagagaatccagctaagtg

SEQ ID NO: 8770203 - DNA, 22 bp, Homo sapiens
gagcagagaatccagctaagtg

SEQ ID NO: 8770204 - DNA, 22 bp, Homo sapiens
gagcagagacagtacaactggc

SEQ ID NO: 8770205 - DNA, 22 bp, Homo sapiens
gagcagagacagtacaactggc

SEQ ID NO: 8770206 - DNA, 22 bp, Homo sapiens
gagcagagacagtacaactggc

SEQ ID NO: 8770207 - DNA, 22 bp, Homo sapiens
gagcagagacagtacaactggc

SEQ ID NO: 8770208 - DNA, 23 bp, Homo sapiens
gagcagagcgggcgggggtcctg

SEQ ID NO: 8770209 - DNA, 22 bp, Homo sapiens
gagcagagacagtacaactggc

SEQ ID NO: 8770210 - DNA, 22 bp, Homo sapiens
gagcagagcttctcaaagtaaa

SEQ ID NO: 8770211 - DNA, 18 bp, Homo sapiens
gagcagaggctcaactgg

SEQ ID NO: 8770212 - DNA, 18 bp, Homo sapiens
gagcagaggagggttttt

SEQ ID NO: 8770213 - DNA, 19 bp, Homo sapiens
gagcagcttcctatctggt

SEQ ID NO: 8770214 - DNA, 22 bp, Homo sapiens
gaatttacagggtgagcttcag

SEQ ID NO: 8770215 - DNA, 22 bp, Homo sapiens
gaatttacaagttgaataacaa

SEQ ID NO: 8770216 - DNA, 22 bp, Homo sapiens
gaatttacaagttgaataacaa

SEQ ID NO: 8770217 - DNA, 22 bp, Homo sapiens
gaatttatctacgttaagtatg

SEQ ID NO: 8770218 - DNA, 22 bp, Homo sapiens
gaatttatctacgttaagtatg

SEQ ID NO: 8770219 - DNA, 22 bp, Homo sapiens
gaatttatctacgttaagtatg

SEQ ID NO: 8770220 - DNA, 20 bp, Homo sapiens
gaattttatgaacactacca

SEQ ID NO: 8770221 - DNA, 20 bp, Homo sapiens
gaattttatgaacactacca

SEQ ID NO: 8770222 - DNA, 22 bp, Homo sapiens
gaattttattactagtcaactg

SEQ ID NO: 8770223 - DNA, 20 bp, Homo sapiens
gaattttatgaacactacca

SEQ ID NO: 8770224 - DNA, 20 bp, Homo sapiens
gaattttatgaacactacca

SEQ ID NO: 8770225 - DNA, 22 bp, Homo sapiens
gaattttattactagtcaactg

SEQ ID NO: 8770226 - DNA, 22 bp, Homo sapiens
gaattttattactagtcaactg

SEQ ID NO: 8770227 - DNA, 22 bp, Homo sapiens
gacaaaacacattagtttaaaa

SEQ ID NO: 8770228 - DNA, 22 bp, Homo sapiens
gaatttttctggaagcaattat

SEQ ID NO: 8770229 - DNA, 21 bp, Homo sapiens
gacaaacatttcatagcttta

SEQ ID NO: 8770230 - DNA, 21 bp, Homo sapiens
gacaaacatttcatagcttta

SEQ ID NO: 8770231 - DNA, 21 bp, Homo sapiens
gacaaacatttcatagcttta

SEQ ID NO: 8770232 - DNA, 22 bp, Homo sapiens
gacaaaagtgttttgaacaagg

SEQ ID NO: 8770233 - DNA, 22 bp, Homo sapiens
gacaaaagtgttttgaacaagg

SEQ ID NO: 8770234 - DNA, 22 bp, Homo sapiens
gacaaaagtgttttgaacaagg

SEQ ID NO: 8770235 - DNA, 22 bp, Homo sapiens
gacaaagagaagtaacagtacc

SEQ ID NO: 8770236 - DNA, 22 bp, Homo sapiens
gacaaagagaagtaacagtacc

SEQ ID NO: 8770237 - DNA, 18 bp, Homo sapiens
gacaaaagtacagacaga

SEQ ID NO: 8770238 - DNA, 18 bp, Homo sapiens
gacaaaagtacagacaga

SEQ ID NO: 8770239 - DNA, 18 bp, Homo sapiens
gacaaaagtacagacaga

SEQ ID NO: 8770240 - DNA, 18 bp, Homo sapiens
gacaaaagtacagacaga

SEQ ID NO: 8770241 - DNA, 18 bp, Homo sapiens
gacaaaagtacagacaga

SEQ ID NO: 8770242 - DNA, 22 bp, Homo sapiens
gacaaaagtgttttgaacaagg

SEQ ID NO: 8770243 - DNA, 22 bp, Homo sapiens
gacaaaactgagatcacactgt

SEQ ID NO: 8770244 - DNA, 22 bp, Homo sapiens
gaattttattactagtcaactg

SEQ ID NO: 8770245 - DNA, 22 bp, Homo sapiens
gacaaaactgagatcacactgt

SEQ ID NO: 8770246 - DNA, 18 bp, Homo sapiens
gacaaaagtacagacaga

SEQ ID NO: 8770247 - DNA, 22 bp, Homo sapiens
gacagcaggatgtgaggggatg

SEQ ID NO: 8770248 - DNA, 22 bp, Homo sapiens
gacagcaggatgtgaggggatg

SEQ ID NO: 8770249 - DNA, 22 bp, Homo sapiens
gacagcaggatgtgaggggatg

SEQ ID NO: 8770250 - DNA, 22 bp, Homo sapiens
gacagcaggatgtgaggggatg

SEQ ID NO: 8770251 - DNA, 22 bp, Homo sapiens
gacagcaggagatcatgataga

SEQ ID NO: 8770252 - DNA, 22 bp, Homo sapiens
gacagcaggagatcatgataga

SEQ ID NO: 8770253 - DNA, 22 bp, Homo sapiens
gacagcaggagatcatgataga

SEQ ID NO: 8770254 - DNA, 22 bp, Homo sapiens
gacagcaggatgtgaggggatg

SEQ ID NO: 8770255 - DNA, 22 bp, Homo sapiens
gacagcagggaaagtccagacc

SEQ ID NO: 8770256 - DNA, 22 bp, Homo sapiens
gacagcagggaaagtccagacc

SEQ ID NO: 8770257 - DNA, 22 bp, Homo sapiens
gacagcagccacagggagaggg

SEQ ID NO: 8770258 - DNA, 22 bp, Homo sapiens
gacagcagccacagggagaggg

SEQ ID NO: 8770259 - DNA, 22 bp, Homo sapiens
gacagcagccacagggagaggg

SEQ ID NO: 8770260 - DNA, 22 bp, Homo sapiens
gacagcagccacagggagaggg

SEQ ID NO: 8770261 - DNA, 18 bp, Homo sapiens
gacagcagcttttgttct

SEQ ID NO: 8770262 - DNA, 20 bp, Homo sapiens
gacaacagagtaccaggaag

SEQ ID NO: 8770263 - DNA, 22 bp, Homo sapiens
gacagcagccacagggagaggg

SEQ ID NO: 8770264 - DNA, 22 bp, Homo sapiens
gacaaatgaagtcactgacctt

SEQ ID NO: 8770265 - DNA, 22 bp, Homo sapiens
gacaaatcattctctgtgtctg

SEQ ID NO: 8770266 - DNA, 22 bp, Homo sapiens
gacaaataggtcaacaggaggg

SEQ ID NO: 8770267 - DNA, 22 bp, Homo sapiens
gacaaataggtcaacaggaggg

SEQ ID NO: 8770268 - DNA, 21 bp, Homo sapiens
gacaaagtgaagcaggcagga

SEQ ID NO: 8770269 - DNA, 21 bp, Homo sapiens
gacaaagtgaagcaggcagga

SEQ ID NO: 8770270 - DNA, 22 bp, Homo sapiens
gacaaagtcaacagtactctca

SEQ ID NO: 8770271 - DNA, 22 bp, Homo sapiens
gacaaaggatcagaggttggga

SEQ ID NO: 8770272 - DNA, 22 bp, Homo sapiens
gacaaagcgcctgctcgcgggc

SEQ ID NO: 8770273 - DNA, 22 bp, Homo sapiens
gacaaagctttggcatccttac

SEQ ID NO: 8770274 - DNA, 22 bp, Homo sapiens
gacaaagcctaagaagtattta

SEQ ID NO: 8770275 - DNA, 22 bp, Homo sapiens
gacaaagcagacaagataattc

SEQ ID NO: 8770276 - DNA, 22 bp, Homo sapiens
gacaaatgagtctcatacccgg

SEQ ID NO: 8770277 - DNA, 22 bp, Homo sapiens
gacaaatgagacatcaattccc

SEQ ID NO: 8770278 - DNA, 22 bp, Homo sapiens
gacaaatgaatgatgaacacca

SEQ ID NO: 8770279 - DNA, 22 bp, Homo sapiens
gacaaatgtacccctagagtct

SEQ ID NO: 8770280 - DNA, 18 bp, Homo sapiens
gacaaatgcaatttaaag

SEQ ID NO: 8770281 - DNA, 22 bp, Homo sapiens
gacaacaataatgtggagctga

SEQ ID NO: 8770282 - DNA, 22 bp, Homo sapiens
gacaacaataatgtggagctga

SEQ ID NO: 8770283 - DNA, 22 bp, Homo sapiens
gaatgcaagttgcatgaaggca

SEQ ID NO: 8770284 - DNA, 22 bp, Homo sapiens
gaatgcaaatatatggatcagt

SEQ ID NO: 8770285 - DNA, 22 bp, Homo sapiens
gaatgcaaatatatggatcagt

SEQ ID NO: 8770286 - DNA, 21 bp, Homo sapiens
gaagacaaatgggaatagctg

SEQ ID NO: 8770287 - DNA, 22 bp, Homo sapiens
gaatgcagtgacggaggcttac

SEQ ID NO: 8770288 - DNA, 22 bp, Homo sapiens
gaatgcagctgacagtcgtttt

SEQ ID NO: 8770289 - DNA, 19 bp, Homo sapiens
gaatgcagaagagagtgga

SEQ ID NO: 8770290 - DNA, 19 bp, Homo sapiens
gaatgcagaagagagtgga

SEQ ID NO: 8770291 - DNA, 22 bp, Homo sapiens
gaatgcatgtgaagcaaagaat

SEQ ID NO: 8770292 - DNA, 22 bp, Homo sapiens
gaatgcatgtgaagcaaagaat

SEQ ID NO: 8770293 - DNA, 22 bp, Homo sapiens
gaatgcagtggtgagatcttgg

SEQ ID NO: 8770294 - DNA, 22 bp, Homo sapiens
gaatgctgagactaaagagctt

SEQ ID NO: 8770295 - DNA, 22 bp, Homo sapiens
gaatgctctcattttccaacat

SEQ ID NO: 8770296 - DNA, 22 bp, Homo sapiens
gaatgctaagcatgtgggagtt

SEQ ID NO: 8770297 - DNA, 22 bp, Homo sapiens
gaatgcattccacggtagtgat

SEQ ID NO: 8770298 - DNA, 22 bp, Homo sapiens
gaatgcattctcttagcatcta

SEQ ID NO: 8770299 - DNA, 22 bp, Homo sapiens
gaagaattgcccatttctgtct

SEQ ID NO: 8770300 - DNA, 22 bp, Homo sapiens
gaagaatctgaggacagtcatt

SEQ ID NO: 8770301 - DNA, 22 bp, Homo sapiens
gaagaatctgaggacagtcatt

SEQ ID NO: 8770302 - DNA, 22 bp, Homo sapiens
gaagaatattcttgatcttaga

SEQ ID NO: 8770303 - DNA, 22 bp, Homo sapiens
gaagaatattcttgatcttaga

SEQ ID NO: 8770304 - DNA, 22 bp, Homo sapiens
gaagaatatggctctcagcaat

SEQ ID NO: 8770305 - DNA, 22 bp, Homo sapiens
gaagaatatataatgattttgt

SEQ ID NO: 8770306 - DNA, 22 bp, Homo sapiens
gaagaaggtggcccaggggtag

SEQ ID NO: 8770307 - DNA, 22 bp, Homo sapiens
gaagaagtgtaagtctgtttca

SEQ ID NO: 8770308 - DNA, 22 bp, Homo sapiens
gaatgtaaaattgcctacaaga

SEQ ID NO: 8770309 - DNA, 21 bp, Homo sapiens
gaatggctcgcgcgccacact

SEQ ID NO: 8770310 - DNA, 19 bp, Homo sapiens
gaatgggaatgggaaagct

SEQ ID NO: 8770311 - DNA, 23 bp, Homo sapiens
gaatggctaagcacatagacttg

SEQ ID NO: 8770312 - DNA, 22 bp, Homo sapiens
gaatggctgaatgtcttaaatt

SEQ ID NO: 8770313 - DNA, 22 bp, Homo sapiens
gaatgctctttggtcctagact

SEQ ID NO: 8770314 - DNA, 22 bp, Homo sapiens
gaatgctggtgttcagaatttt

SEQ ID NO: 8770315 - DNA, 22 bp, Homo sapiens
gaatggaaactgggagatggcc

SEQ ID NO: 8770316 - DNA, 21 bp, Homo sapiens
gaatggcaccattagcatata

SEQ ID NO: 8770317 - DNA, 21 bp, Homo sapiens
gaatggcaccattagcatata

SEQ ID NO: 8770318 - DNA, 22 bp, Homo sapiens
gaatggaaactgggagatggcc

SEQ ID NO: 8770319 - DNA, 22 bp, Homo sapiens
gaattaaaatagttttggtcga

SEQ ID NO: 8770320 - DNA, 22 bp, Homo sapiens
gaattacagccagaagaatgaa

SEQ ID NO: 8770321 - DNA, 22 bp, Homo sapiens
gaattacagccagaagaatgaa

SEQ ID NO: 8770322 - DNA, 22 bp, Homo sapiens
gaattacaaagtgagacaagct

SEQ ID NO: 8770323 - DNA, 22 bp, Homo sapiens
gaattacaaagtgagacaagct

SEQ ID NO: 8770324 - DNA, 22 bp, Homo sapiens
gaattacataataaaatgagag

SEQ ID NO: 8770325 - DNA, 22 bp, Homo sapiens
gaattacataataaaatgagag

SEQ ID NO: 8770326 - DNA, 22 bp, Homo sapiens
gaattacataataaaatgagag

SEQ ID NO: 8770327 - DNA, 22 bp, Homo sapiens
gaatttaaggaccaagcatttt

SEQ ID NO: 8770328 - DNA, 22 bp, Homo sapiens
gaatttaaggaccaagcatttt

SEQ ID NO: 8770329 - DNA, 22 bp, Homo sapiens
gaatttaaggaccaagcatttt

SEQ ID NO: 8770330 - DNA, 22 bp, Homo sapiens
gacattaatttctttggtaatt

SEQ ID NO: 8770331 - DNA, 22 bp, Homo sapiens
gacctgagattttgaggctcat

SEQ ID NO: 8770332 - DNA, 22 bp, Homo sapiens
gacctgagattttgaggctcat

SEQ ID NO: 8770333 - DNA, 22 bp, Homo sapiens
gacattaaatgtcttagttgcc

SEQ ID NO: 8770334 - DNA, 22 bp, Homo sapiens
gacctgcctgagctgcctctgc

SEQ ID NO: 8770335 - DNA, 22 bp, Homo sapiens
gacctggaagaactgaggcctt

SEQ ID NO: 8770336 - DNA, 22 bp, Homo sapiens
gacctgcctgagctgcctctgc

SEQ ID NO: 8770337 - DNA, 19 bp, Homo sapiens
gacctggccaagttactta

SEQ ID NO: 8770338 - DNA, 22 bp, Homo sapiens
gacctggcatattcattggcac

SEQ ID NO: 8770339 - DNA, 22 bp, Homo sapiens
gacatgaacctaccataatgat

SEQ ID NO: 8770340 - DNA, 22 bp, Homo sapiens
gacatcttccggatcgccaccc

SEQ ID NO: 8770341 - DNA, 22 bp, Homo sapiens
gacatgatgcttggaactacat

SEQ ID NO: 8770342 - DNA, 22 bp, Homo sapiens
gacatgatggaaaaaaatgctc

SEQ ID NO: 8770343 - DNA, 22 bp, Homo sapiens
gacatgcaacaatttggcattt

SEQ ID NO: 8770344 - DNA, 22 bp, Homo sapiens
gacatggatacttgataagggg

SEQ ID NO: 8770345 - DNA, 22 bp, Homo sapiens
gacatgcattaagacacactga

SEQ ID NO: 8770346 - DNA, 22 bp, Homo sapiens
gacatgtaaatggcaattatgg

SEQ ID NO: 8770347 - DNA, 22 bp, Homo sapiens
gacatgtacttcaatttctctt

SEQ ID NO: 8770348 - DNA, 22 bp, Homo sapiens
gacatgtacttcaatttctctt

SEQ ID NO: 8770349 - DNA, 22 bp, Homo sapiens
gacatgtattagtacatatggt

SEQ ID NO: 8770350 - DNA, 22 bp, Homo sapiens
gaccttgtgatccacccgcctt

SEQ ID NO: 8770351 - DNA, 22 bp, Homo sapiens
gaccttcttgctgtgtcctaac

SEQ ID NO: 8770352 - DNA, 22 bp, Homo sapiens
gaccttcttgctgtgtcctaac

SEQ ID NO: 8770353 - DNA, 22 bp, Homo sapiens
gacctgggtaaggggctgacaa

SEQ ID NO: 8770354 - DNA, 22 bp, Homo sapiens
gacctggggtggaaggaaggca

SEQ ID NO: 8770355 - DNA, 22 bp, Homo sapiens
gacctgggtaaggggctgacaa

SEQ ID NO: 8770356 - DNA, 22 bp, Homo sapiens
gacctggggtggaaggaaggca

SEQ ID NO: 8770357 - DNA, 22 bp, Homo sapiens
gacctggggtggaaggaaggca

SEQ ID NO: 8770358 - DNA, 22 bp, Homo sapiens
gacctggggtaagcttggcaac

SEQ ID NO: 8770359 - DNA, 22 bp, Homo sapiens
gacctggctttgggccccggca

SEQ ID NO: 8770360 - DNA, 22 bp, Homo sapiens
gacctggcctgcacagccctta

SEQ ID NO: 8770361 - DNA, 22 bp, Homo sapiens
gacctggcctgcacagccctta

SEQ ID NO: 8770362 - DNA, 22 bp, Homo sapiens
gaccttcaagcaccatatttat

SEQ ID NO: 8770363 - DNA, 22 bp, Homo sapiens
gaccttcagtgtgtttctcaca

SEQ ID NO: 8770364 - DNA, 22 bp, Homo sapiens
gaccttcagtgtgtttctcaca

SEQ ID NO: 8770365 - DNA, 22 bp, Homo sapiens
gaccttagaacgtgacacaaga

SEQ ID NO: 8770366 - DNA, 20 bp, Homo sapiens
gacctgtgtctgggatgcgg

SEQ ID NO: 8770367 - DNA, 22 bp, Homo sapiens
gacctgtgcagtgactggtggc

SEQ ID NO: 8770368 - DNA, 22 bp, Homo sapiens
gacctggtccttgtactttgaa

SEQ ID NO: 8770369 - DNA, 22 bp, Homo sapiens
gacctggtccttgtactttgaa

SEQ ID NO: 8770370 - DNA, 22 bp, Homo sapiens
gacagcaggtgcttgggaaagg

SEQ ID NO: 8770371 - DNA, 22 bp, Homo sapiens
gacagcaggtgcttgggaaagg

SEQ ID NO: 8770372 - DNA, 22 bp, Homo sapiens
gacagcagtcctggagttccca

SEQ ID NO: 8770373 - DNA, 22 bp, Homo sapiens
gacagcagggaaagtccagacc

SEQ ID NO: 8770374 - DNA, 22 bp, Homo sapiens
gacagcaggtaattagttaaca

SEQ ID NO: 8770375 - DNA, 22 bp, Homo sapiens
gacagcagggacatgtaggaag

SEQ ID NO: 8770376 - DNA, 22 bp, Homo sapiens
gacagcatccaagagggaggga

SEQ ID NO: 8770377 - DNA, 22 bp, Homo sapiens
gacagcagtttttctctagggt

SEQ ID NO: 8770378 - DNA, 22 bp, Homo sapiens
gacagcagtttttctctagggt

SEQ ID NO: 8770379 - DNA, 22 bp, Homo sapiens
gacagcagtttttctctagggt

SEQ ID NO: 8770380 - DNA, 22 bp, Homo sapiens
gacagcatgatcaaggagccca

SEQ ID NO: 8770381 - DNA, 22 bp, Homo sapiens
gacagcaggtgcttgggaaagg

SEQ ID NO: 8770382 - DNA, 22 bp, Homo sapiens
gacagcatctgtgtggcaggag

SEQ ID NO: 8770383 - DNA, 22 bp, Homo sapiens
gacagccaactggggagggcat

SEQ ID NO: 8770384 - DNA, 22 bp, Homo sapiens
gacagccaggtctgatgaccca

SEQ ID NO: 8770385 - DNA, 22 bp, Homo sapiens
gacagctcctttctgaggatga

SEQ ID NO: 8770386 - DNA, 22 bp, Homo sapiens
gacagctgaaaaatgtaaggta

SEQ ID NO: 8770387 - DNA, 22 bp, Homo sapiens
gacagcctcatgtgcatgaact

SEQ ID NO: 8770388 - DNA, 22 bp, Homo sapiens
gacagcctcatgaggagcaaaa

SEQ ID NO: 8770389 - DNA, 22 bp, Homo sapiens
gacagccatcagcacacgctgc

SEQ ID NO: 8770390 - DNA, 22 bp, Homo sapiens
gacagccagtgcgatggattca

SEQ ID NO: 8770391 - DNA, 22 bp, Homo sapiens
gacagctgaaggatgattcagg

SEQ ID NO: 8770392 - DNA, 22 bp, Homo sapiens
gacagctgaacaggtgggataa

SEQ ID NO: 8770393 - DNA, 22 bp, Homo sapiens
gacagctgaaggatgattcagg

SEQ ID NO: 8770394 - DNA, 22 bp, Homo sapiens
gacagctgcatcctcagacaca

SEQ ID NO: 8770395 - DNA, 22 bp, Homo sapiens
gacagctgcatcctcagacaca

SEQ ID NO: 8770396 - DNA, 22 bp, Homo sapiens
gacagctggacagacactgatg

SEQ ID NO: 8770397 - DNA, 22 bp, Homo sapiens
gacagctgctcccgtttctgct

SEQ ID NO: 8770398 - DNA, 22 bp, Homo sapiens
gacagctggacagacactgatg

SEQ ID NO: 8770399 - DNA, 22 bp, Homo sapiens
gacagctggacagacactgatg

SEQ ID NO: 8770400 - DNA, 22 bp, Homo sapiens
gacagtctgggcacacatgaaa

SEQ ID NO: 8770401 - DNA, 22 bp, Homo sapiens
gacagtgaacaggttcccactg

SEQ ID NO: 8770402 - DNA, 22 bp, Homo sapiens
gacagtgagtacctcaaaggcc

SEQ ID NO: 8770403 - DNA, 22 bp, Homo sapiens
gacagtgattagttactataaa

SEQ ID NO: 8770404 - DNA, 22 bp, Homo sapiens
gacagtgagagtctacaccctc

SEQ ID NO: 8770405 - DNA, 22 bp, Homo sapiens
gacagtgacagcttggaaagca

SEQ ID NO: 8770406 - DNA, 22 bp, Homo sapiens
gacagtgacagcttggaaagca

SEQ ID NO: 8770407 - DNA, 22 bp, Homo sapiens
gacatacagcatggtctatgaa

SEQ ID NO: 8770408 - DNA, 17 bp, Homo sapiens
gacagctgggcgcacgc

SEQ ID NO: 8770409 - DNA, 22 bp, Homo sapiens
gacagctggcagtggaaaggtg

SEQ ID NO: 8770410 - DNA, 22 bp, Homo sapiens
gacagctgggaggatgacataa

SEQ ID NO: 8770411 - DNA, 22 bp, Homo sapiens
gacagctggcagtggaaaggtg

SEQ ID NO: 8770412 - DNA, 22 bp, Homo sapiens
gacagctggcagtggaaaggtg

SEQ ID NO: 8770413 - DNA, 22 bp, Homo sapiens
gacagctggcagtggaaaggtg

SEQ ID NO: 8770414 - DNA, 17 bp, Homo sapiens
gacagctggttcctggc

SEQ ID NO: 8770415 - DNA, 17 bp, Homo sapiens
gacagctgggcgcacgc

SEQ ID NO: 8770416 - DNA, 22 bp, Homo sapiens
gacatcatgttctgctaatagt

SEQ ID NO: 8770417 - DNA, 22 bp, Homo sapiens
gacatcatatcaggaggcatgt

SEQ ID NO: 8770418 - DNA, 17 bp, Homo sapiens
gacatcagtacttacag

SEQ ID NO: 8770419 - DNA, 22 bp, Homo sapiens
gacatctgaatttagcagtttt

SEQ ID NO: 8770420 - DNA, 22 bp, Homo sapiens
gacatctgaatttagcagtttt

SEQ ID NO: 8770421 - DNA, 22 bp, Homo sapiens
gacatctgaatattagagagaa

SEQ ID NO: 8770422 - DNA, 22 bp, Homo sapiens
gacatctgaggccctcagagcc

SEQ ID NO: 8770423 - DNA, 22 bp, Homo sapiens
gacatctgaatttagcagtttt

SEQ ID NO: 8770424 - DNA, 22 bp, Homo sapiens
gacatctggaggagatgaatgg

SEQ ID NO: 8770425 - DNA, 22 bp, Homo sapiens
gacatctgaggccctcagagcc

SEQ ID NO: 8770426 - DNA, 22 bp, Homo sapiens
gacatagtctctgtcttcatgg

SEQ ID NO: 8770427 - DNA, 22 bp, Homo sapiens
gacatatactatggatggttct

SEQ ID NO: 8770428 - DNA, 22 bp, Homo sapiens
gacatagctcagagctcagcac

SEQ ID NO: 8770429 - DNA, 18 bp, Homo sapiens
gacatagctcagagctca

SEQ ID NO: 8770430 - DNA, 22 bp, Homo sapiens
gacatagactgagtttagctga

SEQ ID NO: 8770431 - DNA, 22 bp, Homo sapiens
gacatagacaaagtcattgtca

SEQ ID NO: 8770432 - DNA, 22 bp, Homo sapiens
gacatcaggaagacatgagagg

SEQ ID NO: 8770433 - DNA, 22 bp, Homo sapiens
gacatcaggcctgcagtctggg

SEQ ID NO: 8770434 - DNA, 22 bp, Homo sapiens
gacatcaggcctgcagtctggg

SEQ ID NO: 8770435 - DNA, 22 bp, Homo sapiens
cttcttcaagaggaccatccag

SEQ ID NO: 8770436 - DNA, 22 bp, Homo sapiens
cttcttcaagaggaccatccag

SEQ ID NO: 8770437 - DNA, 22 bp, Homo sapiens
cttcttcaagaggaccatccag

SEQ ID NO: 8770438 - DNA, 22 bp, Homo sapiens
cttcttcaagagaatgggagac

SEQ ID NO: 8770439 - DNA, 22 bp, Homo sapiens
cttctgtgagtcagtgtttctg

SEQ ID NO: 8770440 - DNA, 22 bp, Homo sapiens
cttcttcaacctgaaagtttca

SEQ ID NO: 8770441 - DNA, 22 bp, Homo sapiens
cttctgtgaatgaagtgtggga

SEQ ID NO: 8770442 - DNA, 22 bp, Homo sapiens
cttctgtgacgtatgtgaggac

SEQ ID NO: 8770443 - DNA, 22 bp, Homo sapiens
cttctgtagccagtaacatata

SEQ ID NO: 8770444 - DNA, 22 bp, Homo sapiens
cttctgtagccagtaacatata

SEQ ID NO: 8770445 - DNA, 22 bp, Homo sapiens
cttctgtagccagtaacatata

SEQ ID NO: 8770446 - DNA, 22 bp, Homo sapiens
cttcccttctgtgcagggcaga

SEQ ID NO: 8770447 - DNA, 20 bp, Homo sapiens
cttcttcagcctatgcttca

SEQ ID NO: 8770448 - DNA, 22 bp, Homo sapiens
cttcttcagaggccagcctctg

SEQ ID NO: 8770449 - DNA, 22 bp, Homo sapiens
cttcttcagcacaatattgatg

SEQ ID NO: 8770450 - DNA, 22 bp, Homo sapiens
cttcttcagaggccagcctctg

SEQ ID NO: 8770451 - DNA, 22 bp, Homo sapiens
cttcttcaatagcaagcgcata

SEQ ID NO: 8770452 - DNA, 22 bp, Homo sapiens
cttcttcaatagcaagcgcata

SEQ ID NO: 8770453 - DNA, 22 bp, Homo sapiens
cttcttcacactggtctgaagc

SEQ ID NO: 8770454 - DNA, 22 bp, Homo sapiens
cttcttcagaggccagcctctg

SEQ ID NO: 8770455 - DNA, 22 bp, Homo sapiens
cttcttcagaggccagcctctg

SEQ ID NO: 8770456 - DNA, 22 bp, Homo sapiens
cttcttcataggcagtcctgtt

SEQ ID NO: 8770457 - DNA, 22 bp, Homo sapiens
cttcttcataggcagtcctgtt

SEQ ID NO: 8770458 - DNA, 22 bp, Homo sapiens
cttcttcataggcagtcctgtt

SEQ ID NO: 8770459 - DNA, 22 bp, Homo sapiens
cttcttcatctgtaaaacttgg

SEQ ID NO: 8770460 - DNA, 22 bp, Homo sapiens
cttcttcagttgcatgtattgg

SEQ ID NO: 8770461 - DNA, 20 bp, Homo sapiens
cttcttcagtagtttgttct

SEQ ID NO: 8770462 - DNA, 20 bp, Homo sapiens
cttcttcagcctatgcttca

SEQ ID NO: 8770463 - DNA, 19 bp, Homo sapiens
cttcccctgttacctcact

SEQ ID NO: 8770464 - DNA, 22 bp, Homo sapiens
cttccctcctggattccagact

SEQ ID NO: 8770465 - DNA, 18 bp, Homo sapiens
cttccctcttcctttgtc

SEQ ID NO: 8770466 - DNA, 22 bp, Homo sapiens
cttccctctgctccttggtcca

SEQ ID NO: 8770467 - DNA, 19 bp, Homo sapiens
cttcccctgttacctcact

SEQ ID NO: 8770468 - DNA, 19 bp, Homo sapiens
cttcccctgttacctcact

SEQ ID NO: 8770469 - DNA, 19 bp, Homo sapiens
cttcccctgttacctcact

SEQ ID NO: 8770470 - DNA, 21 bp, Homo sapiens
cttccccaggctggtctgtat

SEQ ID NO: 8770471 - DNA, 22 bp, Homo sapiens
cttccctgataagagcctcaga

SEQ ID NO: 8770472 - DNA, 22 bp, Homo sapiens
cttccctgagctttctcaggct

SEQ ID NO: 8770473 - DNA, 22 bp, Homo sapiens
cttccctgagctttctcaggct

SEQ ID NO: 8770474 - DNA, 22 bp, Homo sapiens
cttcccagaccttagagtgcag

SEQ ID NO: 8770475 - DNA, 22 bp, Homo sapiens
cttcccagaccttagagtgcag

SEQ ID NO: 8770476 - DNA, 22 bp, Homo sapiens
cttccaggtccttcttgagaag

SEQ ID NO: 8770477 - DNA, 22 bp, Homo sapiens
cttcccagcacctcagtctggc

SEQ ID NO: 8770478 - DNA, 22 bp, Homo sapiens
cttcccagacggggtggcagcc

SEQ ID NO: 8770479 - DNA, 22 bp, Homo sapiens
cttcccagacggggtggcagcc

SEQ ID NO: 8770480 - DNA, 22 bp, Homo sapiens
cttcccatataactaatttctg

SEQ ID NO: 8770481 - DNA, 22 bp, Homo sapiens
cttcccatataactaatttctg

SEQ ID NO: 8770482 - DNA, 22 bp, Homo sapiens
cttcccagttctgcttgagggg

SEQ ID NO: 8770483 - DNA, 22 bp, Homo sapiens
cttccccaaccccgactgtgtg

SEQ ID NO: 8770484 - DNA, 22 bp, Homo sapiens
cttccccaagtagagaggggag

SEQ ID NO: 8770485 - DNA, 22 bp, Homo sapiens
cttcccaggtgctcttagcatg

SEQ ID NO: 8770486 - DNA, 22 bp, Homo sapiens
cttcccagttctgcttgagggg

SEQ ID NO: 8770487 - DNA, 22 bp, Homo sapiens
cttcccagttctgcttgagggg

SEQ ID NO: 8770488 - DNA, 22 bp, Homo sapiens
cttcccaggtgctcttagcatg

SEQ ID NO: 8770489 - DNA, 22 bp, Homo sapiens
cttcaaatacaagtagattatg

SEQ ID NO: 8770490 - DNA, 22 bp, Homo sapiens
cttcaaatacaagtagattatg

SEQ ID NO: 8770491 - DNA, 22 bp, Homo sapiens
cttcaaagggtcactatttatc

SEQ ID NO: 8770492 - DNA, 22 bp, Homo sapiens
cttcaaatccccctgagtttga

SEQ ID NO: 8770493 - DNA, 20 bp, Homo sapiens
cttcaaaggcagtaacagcc

SEQ ID NO: 8770494 - DNA, 22 bp, Homo sapiens
cttcaaagatttgataaagcca

SEQ ID NO: 8770495 - DNA, 22 bp, Homo sapiens
cttcaaagattattgaaaacaa

SEQ ID NO: 8770496 - DNA, 20 bp, Homo sapiens
ctgttaaaaggtatgaattc

SEQ ID NO: 8770497 - DNA, 20 bp, Homo sapiens
ctgttaaaaggtatgaattc

SEQ ID NO: 8770498 - DNA, 20 bp, Homo sapiens
ctgttaaaaggtatgaattc

SEQ ID NO: 8770499 - DNA, 22 bp, Homo sapiens
ctgttaaaatgtggtcttaaaa

SEQ ID NO: 8770500 - DNA, 22 bp, Homo sapiens
ctgttaaagatagttaagcttc

SEQ ID NO: 8770501 - DNA, 22 bp, Homo sapiens
ctgttaaaatgtggtcttaaaa

SEQ ID NO: 8770502 - DNA, 22 bp, Homo sapiens
ctgttaaagatagttaagcttc

SEQ ID NO: 8770503 - DNA, 22 bp, Homo sapiens
ctgttaaatagactgcagtgca

SEQ ID NO: 8770504 - DNA, 16 bp, Homo sapiens
cttcacagaggagagt

SEQ ID NO: 8770505 - DNA, 22 bp, Homo sapiens
cttcacagaataaactcattat

SEQ ID NO: 8770506 - DNA, 22 bp, Homo sapiens
cttcacagagtccctgattgtt

SEQ ID NO: 8770507 - DNA, 22 bp, Homo sapiens
cttcaaatgtgattttaataac

SEQ ID NO: 8770508 - DNA, 22 bp, Homo sapiens
cttcaaatgtgattttaataac

SEQ ID NO: 8770509 - DNA, 22 bp, Homo sapiens
cttcacagcatgagctttggag

SEQ ID NO: 8770510 - DNA, 22 bp, Homo sapiens
cttcacagcatgagctttggag

SEQ ID NO: 8770511 - DNA, 22 bp, Homo sapiens
cttcacagcatgagctttggag

SEQ ID NO: 8770512 - DNA, 22 bp, Homo sapiens
cttcacagcatgagctttggag

SEQ ID NO: 8770513 - DNA, 22 bp, Homo sapiens
cttcacagagtccctgattgtt

SEQ ID NO: 8770514 - DNA, 22 bp, Homo sapiens
cttcacagccaacatgggcaca

SEQ ID NO: 8770515 - DNA, 22 bp, Homo sapiens
cttcacagccaacatgggcaca

SEQ ID NO: 8770516 - DNA, 22 bp, Homo sapiens
cttcacagtaaatccagaagaa

SEQ ID NO: 8770517 - DNA, 22 bp, Homo sapiens
cttcacagtaaatccagaagaa

SEQ ID NO: 8770518 - DNA, 23 bp, Homo sapiens
cttcacaggttcaggggattaag

SEQ ID NO: 8770519 - DNA, 22 bp, Homo sapiens
cttcacaggcaagtctgttttt

SEQ ID NO: 8770520 - DNA, 22 bp, Homo sapiens
cttcacaggcaagtctgttttt

SEQ ID NO: 8770521 - DNA, 22 bp, Homo sapiens
cttcacaggcaagtctgttttt

SEQ ID NO: 8770522 - DNA, 22 bp, Homo sapiens
cttcacagtcaccctgctgtgt

SEQ ID NO: 8770523 - DNA, 22 bp, Homo sapiens
cttcacagtcaccctgctgtgt

SEQ ID NO: 8770524 - DNA, 22 bp, Homo sapiens
cttcacagtcaccctgctgtgt

SEQ ID NO: 8770525 - DNA, 22 bp, Homo sapiens
cttcacagtcaccctgctgtgt

SEQ ID NO: 8770526 - DNA, 22 bp, Homo sapiens
cttcacagtataggtccctgag

SEQ ID NO: 8770527 - DNA, 22 bp, Homo sapiens
cttcacagtataggtccctgag

SEQ ID NO: 8770528 - DNA, 22 bp, Homo sapiens
cttcacagtaaatccagaagaa

SEQ ID NO: 8770529 - DNA, 22 bp, Homo sapiens
cttcagaaataacaacaattac

SEQ ID NO: 8770530 - DNA, 22 bp, Homo sapiens
cttcagaaataacaacaattac

SEQ ID NO: 8770531 - DNA, 22 bp, Homo sapiens
cttcagaaataacaacaattac

SEQ ID NO: 8770532 - DNA, 22 bp, Homo sapiens
cttccaggacaccagggtagta

SEQ ID NO: 8770533 - DNA, 22 bp, Homo sapiens
cttccagggtccaggaagagcc

SEQ ID NO: 8770534 - DNA, 22 bp, Homo sapiens
cttccagggtccaggaagagcc

SEQ ID NO: 8770535 - DNA, 22 bp, Homo sapiens
cttccaggtccttcttgagaag

SEQ ID NO: 8770536 - DNA, 22 bp, Homo sapiens
cttccaggtaggcctaaggcag

SEQ ID NO: 8770537 - DNA, 22 bp, Homo sapiens
cttcactgcagtcatggctctg

SEQ ID NO: 8770538 - DNA, 22 bp, Homo sapiens
cttcactgcagtcatggctctg

SEQ ID NO: 8770539 - DNA, 22 bp, Homo sapiens
cttcactgggctcctgagaggg

SEQ ID NO: 8770540 - DNA, 22 bp, Homo sapiens
cttcactgtgcttcaagcagct

SEQ ID NO: 8770541 - DNA, 22 bp, Homo sapiens
cttcactgtgcttcaagcagct

SEQ ID NO: 8770542 - DNA, 22 bp, Homo sapiens
cttcactgtgcttcaagcagct

SEQ ID NO: 8770543 - DNA, 22 bp, Homo sapiens
cttcactgtttggttcacagca

SEQ ID NO: 8770544 - DNA, 22 bp, Homo sapiens
cttcagaaactagtaacagcta

SEQ ID NO: 8770545 - DNA, 22 bp, Homo sapiens
cttcagaaactagtaacagcta

SEQ ID NO: 8770546 - DNA, 22 bp, Homo sapiens
cttcacttgctcatcatgctat

SEQ ID NO: 8770547 - DNA, 22 bp, Homo sapiens
cttcacttcacagatgccaaga

SEQ ID NO: 8770548 - DNA, 22 bp, Homo sapiens
cttcactgcagtcatggctctg

SEQ ID NO: 8770549 - DNA, 22 bp, Homo sapiens
cttcacctcctcctctgtgggc

SEQ ID NO: 8770550 - DNA, 22 bp, Homo sapiens
cttcactaatcactgaactcca

SEQ ID NO: 8770551 - DNA, 22 bp, Homo sapiens
cttcacattagtttggatcaaa

SEQ ID NO: 8770552 - DNA, 22 bp, Homo sapiens
cttcacattagtttggatcaaa

SEQ ID NO: 8770553 - DNA, 22 bp, Homo sapiens
cttcacattgggcttgatatga

SEQ ID NO: 8770554 - DNA, 22 bp, Homo sapiens
cttcacattgggcttgatatga

SEQ ID NO: 8770555 - DNA, 22 bp, Homo sapiens
cttcacattgggcttgatatga

SEQ ID NO: 8770556 - DNA, 22 bp, Homo sapiens
cttcacatttgcgaaggccaaa

SEQ ID NO: 8770557 - DNA, 22 bp, Homo sapiens
cttcacatttgcgaaggccaaa

SEQ ID NO: 8770558 - DNA, 22 bp, Homo sapiens
cttcacagtctttatttcctcc

SEQ ID NO: 8770559 - DNA, 22 bp, Homo sapiens
cttcacagtcaccctgctgtgt

SEQ ID NO: 8770560 - DNA, 22 bp, Homo sapiens
cttcacagtctttatttcctcc

SEQ ID NO: 8770561 - DNA, 22 bp, Homo sapiens
cttcacagtctttatttcctcc

SEQ ID NO: 8770562 - DNA, 22 bp, Homo sapiens
cttcacataaacaaagggccat

SEQ ID NO: 8770563 - DNA, 22 bp, Homo sapiens
cttcacataaacaaagggccat

SEQ ID NO: 8770564 - DNA, 22 bp, Homo sapiens
cttcacatctccctaaaacagc

SEQ ID NO: 8770565 - DNA, 22 bp, Homo sapiens
cttcacatctccctaaaacagc

SEQ ID NO: 8770566 - DNA, 22 bp, Homo sapiens
cttcacatctccctaaaacagc

SEQ ID NO: 8770567 - DNA, 19 bp, Homo sapiens
cttcacatctgtgagggga

SEQ ID NO: 8770568 - DNA, 22 bp, Homo sapiens
cttcacatgatgtccgtgctgt

SEQ ID NO: 8770569 - DNA, 22 bp, Homo sapiens
cttcacatgatgtccgtgctgt

SEQ ID NO: 8770570 - DNA, 22 bp, Homo sapiens
cttcacatgggtactgctgatc

SEQ ID NO: 8770571 - DNA, 22 bp, Homo sapiens
cttcacatgggtactgctgatc

SEQ ID NO: 8770572 - DNA, 22 bp, Homo sapiens
cttcacatgttggagtcctttg

SEQ ID NO: 8770573 - DNA, 22 bp, Homo sapiens
cttcttcatgtattgatagtct

SEQ ID NO: 8770574 - DNA, 20 bp, Homo sapiens
cttcttcattaaccctactg

SEQ ID NO: 8770575 - DNA, 20 bp, Homo sapiens
cttcttcattaaccctactg

SEQ ID NO: 8770576 - DNA, 22 bp, Homo sapiens
cttcttcccagcttccctcacc

SEQ ID NO: 8770577 - DNA, 22 bp, Homo sapiens
cttcttccagttataagagctt

SEQ ID NO: 8770578 - DNA, 22 bp, Homo sapiens
cttcttccagttataagagctt

SEQ ID NO: 8770579 - DNA, 22 bp, Homo sapiens
cttcttccagttataagagctt

SEQ ID NO: 8770580 - DNA, 22 bp, Homo sapiens
cttcttcccagcttccctcacc

SEQ ID NO: 8770581 - DNA, 22 bp, Homo sapiens
cttcttctctacatcctttgat

SEQ ID NO: 8770582 - DNA, 22 bp, Homo sapiens
cttcttctcaaggggcaggtgg

SEQ ID NO: 8770583 - DNA, 22 bp, Homo sapiens
cttcttctcaaggggcaggtgg

SEQ ID NO: 8770584 - DNA, 22 bp, Homo sapiens
cttcttcctgctgcagcctcca

SEQ ID NO: 8770585 - DNA, 22 bp, Homo sapiens
cttgcctccctcagctcacagc

SEQ ID NO: 8770586 - DNA, 22 bp, Homo sapiens
cttgcctccctcagctcacagc

SEQ ID NO: 8770587 - DNA, 22 bp, Homo sapiens
cttcttcttcccccttcagggg

SEQ ID NO: 8770588 - DNA, 22 bp, Homo sapiens
cttcttctggtttatgtggcaa

SEQ ID NO: 8770589 - DNA, 22 bp, Homo sapiens
cttcttcttcccccttcagggg

SEQ ID NO: 8770590 - DNA, 22 bp, Homo sapiens
cttcttctggacaggcagctcc

SEQ ID NO: 8770591 - DNA, 22 bp, Homo sapiens
cttcttctggtttatgtggcaa

SEQ ID NO: 8770592 - DNA, 22 bp, Homo sapiens
cttgcctgccactacagctgaa

SEQ ID NO: 8770593 - DNA, 22 bp, Homo sapiens
cttgcctgaggaacagagggta

SEQ ID NO: 8770594 - DNA, 22 bp, Homo sapiens
cttgcctctgctaatggtttct

SEQ ID NO: 8770595 - DNA, 22 bp, Homo sapiens
cttgcctgccactacagctgaa

SEQ ID NO: 8770596 - DNA, 22 bp, Homo sapiens
cttgcctgaggaacagagggta

SEQ ID NO: 8770597 - DNA, 22 bp, Homo sapiens
cttgcctgccactacagctgaa

SEQ ID NO: 8770598 - DNA, 22 bp, Homo sapiens
cttggactggacccgaggaatg

SEQ ID NO: 8770599 - DNA, 22 bp, Homo sapiens
cttggaattgatgattttcata

SEQ ID NO: 8770600 - DNA, 22 bp, Homo sapiens
cttggaattgatgattttcata

SEQ ID NO: 8770601 - DNA, 22 bp, Homo sapiens
cttggactttagtctctctcca

SEQ ID NO: 8770602 - DNA, 22 bp, Homo sapiens
cttggactttccagcttctaaa

SEQ ID NO: 8770603 - DNA, 22 bp, Homo sapiens
cttggaatggggcagaaaatgg

SEQ ID NO: 8770604 - DNA, 22 bp, Homo sapiens
cttggaatggggcagaaaatgg

SEQ ID NO: 8770605 - DNA, 22 bp, Homo sapiens
cttggaatcaagtttttggaga

SEQ ID NO: 8770606 - DNA, 21 bp, Homo sapiens
cttggaacgggtagaactcac

SEQ ID NO: 8770607 - DNA, 22 bp, Homo sapiens
cttggagacaggacaggcagaa

SEQ ID NO: 8770608 - DNA, 22 bp, Homo sapiens
cttggagatacagaggacattt

SEQ ID NO: 8770609 - DNA, 22 bp, Homo sapiens
cttggagagagcctcagctgtt

SEQ ID NO: 8770610 - DNA, 22 bp, Homo sapiens
cttggagacaggacaggcagaa

SEQ ID NO: 8770611 - DNA, 22 bp, Homo sapiens
cttggagagggagaaaaataac

SEQ ID NO: 8770612 - DNA, 22 bp, Homo sapiens
cttggaaactttccctgggcac

SEQ ID NO: 8770613 - DNA, 22 bp, Homo sapiens
cttggaaaggttttacaaagcg

SEQ ID NO: 8770614 - DNA, 22 bp, Homo sapiens
cttggaaaggttttacaaagcg

SEQ ID NO: 8770615 - DNA, 22 bp, Homo sapiens
cttgctgttttctaccctcaag

SEQ ID NO: 8770616 - DNA, 22 bp, Homo sapiens
cttgcttctgctgcactatcct

SEQ ID NO: 8770617 - DNA, 22 bp, Homo sapiens
cttgcttcattagtgtcttagt

SEQ ID NO: 8770618 - DNA, 22 bp, Homo sapiens
cttgctgtgtgccatcagggct

SEQ ID NO: 8770619 - DNA, 22 bp, Homo sapiens
cttgctgttgtgggagactggg

SEQ ID NO: 8770620 - DNA, 22 bp, Homo sapiens
cttgctgtgtggtgttctcaga

SEQ ID NO: 8770621 - DNA, 22 bp, Homo sapiens
cttgctgttgtgggagactggg

SEQ ID NO: 8770622 - DNA, 22 bp, Homo sapiens
cttgctttcagtctcggcctca

SEQ ID NO: 8770623 - DNA, 22 bp, Homo sapiens
cttgctttatctggtttctcat

SEQ ID NO: 8770624 - DNA, 22 bp, Homo sapiens
cttgctttatctggtttctcat

SEQ ID NO: 8770625 - DNA, 22 bp, Homo sapiens
cttgcttgtttagttcacagat

SEQ ID NO: 8770626 - DNA, 22 bp, Homo sapiens
cttgcttgtttagttcacagat

SEQ ID NO: 8770627 - DNA, 22 bp, Homo sapiens
cttgcttgttttgaagaaagat

SEQ ID NO: 8770628 - DNA, 22 bp, Homo sapiens
cttgcttggagaagagatcagt

SEQ ID NO: 8770629 - DNA, 22 bp, Homo sapiens
cttgcttgattatgatcataaa

SEQ ID NO: 8770630 - DNA, 22 bp, Homo sapiens
ctttctaaatgttccttgatta

SEQ ID NO: 8770631 - DNA, 23 bp, Homo sapiens
ctttcctttctttgacacccagc

SEQ ID NO: 8770632 - DNA, 22 bp, Homo sapiens
ctttccttctcgtggttctcac

SEQ ID NO: 8770633 - DNA, 22 bp, Homo sapiens
ctttccttctcgtggttctcac

SEQ ID NO: 8770634 - DNA, 22 bp, Homo sapiens
ctttccttaataagcaggtata

SEQ ID NO: 8770635 - DNA, 22 bp, Homo sapiens
ctttcctggctggcagttgtgg

SEQ ID NO: 8770636 - DNA, 22 bp, Homo sapiens
ctttccttaataagcaggtata

SEQ ID NO: 8770637 - DNA, 22 bp, Homo sapiens
ctttcctgaaatctcttctgca

SEQ ID NO: 8770638 - DNA, 22 bp, Homo sapiens
ctttcctgagaaaggagaagga

SEQ ID NO: 8770639 - DNA, 22 bp, Homo sapiens
ctttcctgaggagtatggctgt

SEQ ID NO: 8770640 - DNA, 22 bp, Homo sapiens
ctttcctgccttattcattcat

SEQ ID NO: 8770641 - DNA, 22 bp, Homo sapiens
ctttcctgccttattcattcat

SEQ ID NO: 8770642 - DNA, 22 bp, Homo sapiens
ctttcctgaggagtatggctgt

SEQ ID NO: 8770643 - DNA, 22 bp, Homo sapiens
ctttcctgccttattcattcat

SEQ ID NO: 8770644 - DNA, 22 bp, Homo sapiens
ctttcctggctggcagttgtgg

SEQ ID NO: 8770645 - DNA, 22 bp, Homo sapiens
ctttcctgaggagtatggctgt

SEQ ID NO: 8770646 - DNA, 22 bp, Homo sapiens
ctttcctctggcactgtctggt

SEQ ID NO: 8770647 - DNA, 22 bp, Homo sapiens
ctttcctgaaatctcttctgca

SEQ ID NO: 8770648 - DNA, 22 bp, Homo sapiens
ctttcctctggcactgtctggt

SEQ ID NO: 8770649 - DNA, 22 bp, Homo sapiens
ctttcctccactccctaggctt

SEQ ID NO: 8770650 - DNA, 22 bp, Homo sapiens
cttggagcaacacatgacatct

SEQ ID NO: 8770651 - DNA, 22 bp, Homo sapiens
cttggaggaaggggctcttctg

SEQ ID NO: 8770652 - DNA, 22 bp, Homo sapiens
ctttcctagtagttacagaatg

SEQ ID NO: 8770653 - DNA, 22 bp, Homo sapiens
ctttccagacctccttgtagct

SEQ ID NO: 8770654 - DNA, 22 bp, Homo sapiens
cttggagtcaataagatctaga

SEQ ID NO: 8770655 - DNA, 20 bp, Homo sapiens
ctttctctaatttataagta

SEQ ID NO: 8770656 - DNA, 20 bp, Homo sapiens
ctttctctaatttataagta

SEQ ID NO: 8770657 - DNA, 22 bp, Homo sapiens
ctttctagactgtccagatgat

SEQ ID NO: 8770658 - DNA, 22 bp, Homo sapiens
ctttctaattctcccatagtct

SEQ ID NO: 8770659 - DNA, 22 bp, Homo sapiens
ctttctaattctcccatagtct

SEQ ID NO: 8770660 - DNA, 22 bp, Homo sapiens
ctttctcagtgttaattacttt

SEQ ID NO: 8770661 - DNA, 22 bp, Homo sapiens
ctttctctggaggggagtggtt

SEQ ID NO: 8770662 - DNA, 22 bp, Homo sapiens
ctttctctggaggggagtggtt

SEQ ID NO: 8770663 - DNA, 22 bp, Homo sapiens
ctttctctgtgtggtaaagggc

SEQ ID NO: 8770664 - DNA, 22 bp, Homo sapiens
ctttctctgtgtggtaaagggc

SEQ ID NO: 8770665 - DNA, 22 bp, Homo sapiens
ctttctctgtggtgaggagggt

SEQ ID NO: 8770666 - DNA, 22 bp, Homo sapiens
ctttctctgtggtgaggagggt

SEQ ID NO: 8770667 - DNA, 21 bp, Homo sapiens
ctttgcatacagatgccaatt

SEQ ID NO: 8770668 - DNA, 22 bp, Homo sapiens
ctttgcataatgaatgatcata

SEQ ID NO: 8770669 - DNA, 21 bp, Homo sapiens
ctttgcatacagatgccaatt

SEQ ID NO: 8770670 - DNA, 22 bp, Homo sapiens
ctttgcatgtggtagaaggttc

SEQ ID NO: 8770671 - DNA, 22 bp, Homo sapiens
ctttggaacaagaagaaatggc

SEQ ID NO: 8770672 - DNA, 22 bp, Homo sapiens
ctttctctgtgtttcacatgct

SEQ ID NO: 8770673 - DNA, 22 bp, Homo sapiens
ctttctctgtgtttcacatgct

SEQ ID NO: 8770674 - DNA, 22 bp, Homo sapiens
ctttctctgtgtttcacatgct

SEQ ID NO: 8770675 - DNA, 22 bp, Homo sapiens
ctttctcttacccaaggatctg

SEQ ID NO: 8770676 - DNA, 22 bp, Homo sapiens
ctttctcttacccaaggatctg

SEQ ID NO: 8770677 - DNA, 22 bp, Homo sapiens
ctttctcttcactgtcatgatc

SEQ ID NO: 8770678 - DNA, 22 bp, Homo sapiens
ctttctcttcactgtcatgatc

SEQ ID NO: 8770679 - DNA, 22 bp, Homo sapiens
ctttttcctcgtagagcctaat

SEQ ID NO: 8770680 - DNA, 22 bp, Homo sapiens
ctttttcctcgtagagcctaat

SEQ ID NO: 8770681 - DNA, 22 bp, Homo sapiens
ctttttctaatcataattgtct

SEQ ID NO: 8770682 - DNA, 22 bp, Homo sapiens
ctttttctaatcataattgtct

SEQ ID NO: 8770683 - DNA, 22 bp, Homo sapiens
ctttttctaatcataattgtct

SEQ ID NO: 8770684 - DNA, 20 bp, Homo sapiens
ctttttctccagctctgagc

SEQ ID NO: 8770685 - DNA, 20 bp, Homo sapiens
ctttttctccagctctgagc

SEQ ID NO: 8770686 - DNA, 22 bp, Homo sapiens
ctttttctgatgttccatgatt

SEQ ID NO: 8770687 - DNA, 22 bp, Homo sapiens
ctttttctgatgttccatgatt

SEQ ID NO: 8770688 - DNA, 16 bp, Homo sapiens
ctttttctcccctctt

SEQ ID NO: 8770689 - DNA, 16 bp, Homo sapiens
ctttttctcccctctt

SEQ ID NO: 8770690 - DNA, 22 bp, Homo sapiens
ctttttctgatgttccatgatt

SEQ ID NO: 8770691 - DNA, 22 bp, Homo sapiens
ctttttcctcgtagagcctaat

SEQ ID NO: 8770692 - DNA, 22 bp, Homo sapiens
ctttttgtctctgtcctgatga

SEQ ID NO: 8770693 - DNA, 22 bp, Homo sapiens
ctttttgtctctgtcctgatga

SEQ ID NO: 8770694 - DNA, 22 bp, Homo sapiens
ctttttcttctaggtgtgcctg

SEQ ID NO: 8770695 - DNA, 22 bp, Homo sapiens
ctttttcttctaggtgtgcctg

SEQ ID NO: 8770696 - DNA, 22 bp, Homo sapiens
ctttttcccaggtggagagagg

SEQ ID NO: 8770697 - DNA, 22 bp, Homo sapiens
cttttgttctacagctggggaa

SEQ ID NO: 8770698 - DNA, 22 bp, Homo sapiens
ctttttcccaggtggagagagg

SEQ ID NO: 8770699 - DNA, 22 bp, Homo sapiens
ctttttcccaggtggagagagg

SEQ ID NO: 8770700 - DNA, 22 bp, Homo sapiens
cttttgttaggagaaaacatca

SEQ ID NO: 8770701 - DNA, 22 bp, Homo sapiens
cttttgttaggagaaaacatca

SEQ ID NO: 8770702 - DNA, 22 bp, Homo sapiens
cttttgttaggagaaaacatca

SEQ ID NO: 8770703 - DNA, 22 bp, Homo sapiens
cttttggcctcaaaggaaagaa

SEQ ID NO: 8770704 - DNA, 23 bp, Homo sapiens
ctttggcactttacaataaactc

SEQ ID NO: 8770705 - DNA, 23 bp, Homo sapiens
ctttggcactttacaataaactc

SEQ ID NO: 8770706 - DNA, 22 bp, Homo sapiens
ctttggaagtgatagatatgat

SEQ ID NO: 8770707 - DNA, 22 bp, Homo sapiens
ctttggaagtgatagatatgat

SEQ ID NO: 8770708 - DNA, 22 bp, Homo sapiens
ctttggaataatttcctggagt

SEQ ID NO: 8770709 - DNA, 22 bp, Homo sapiens
ctttggaataatttcctggagt

SEQ ID NO: 8770710 - DNA, 22 bp, Homo sapiens
ctttggaataatcaagctctga

SEQ ID NO: 8770711 - DNA, 22 bp, Homo sapiens
ctttggaataatcaagctctga

SEQ ID NO: 8770712 - DNA, 22 bp, Homo sapiens
ctttggaataatcaagctctga

SEQ ID NO: 8770713 - DNA, 22 bp, Homo sapiens
ctttggaaggtcgtccgtgtgg

SEQ ID NO: 8770714 - DNA, 22 bp, Homo sapiens
ctttggaaggcagagctctgtg

SEQ ID NO: 8770715 - DNA, 22 bp, Homo sapiens
ctttggaaggcagagctctgtg

SEQ ID NO: 8770716 - DNA, 22 bp, Homo sapiens
ctttggaaggaagacctttcag

SEQ ID NO: 8770717 - DNA, 22 bp, Homo sapiens
ctttggaaggaagacctttcag

SEQ ID NO: 8770718 - DNA, 22 bp, Homo sapiens
ctttggaacatactgctgagct

SEQ ID NO: 8770719 - DNA, 22 bp, Homo sapiens
ctttggaacacccagctctgtg

SEQ ID NO: 8770720 - DNA, 22 bp, Homo sapiens
ctttggaacacccagctctgtg

SEQ ID NO: 8770721 - DNA, 22 bp, Homo sapiens
ctttggatggctgtgtgtttat

SEQ ID NO: 8770722 - DNA, 22 bp, Homo sapiens
ctttggatggctgtgtgtttat

SEQ ID NO: 8770723 - DNA, 22 bp, Homo sapiens
ctttggagttccctaatttccc

SEQ ID NO: 8770724 - DNA, 19 bp, Homo sapiens
ctttggagtcttttactct

SEQ ID NO: 8770725 - DNA, 22 bp, Homo sapiens
ctttggaggtcatagccaagag

SEQ ID NO: 8770726 - DNA, 22 bp, Homo sapiens
ctttggcaatgaaacacaagaa

SEQ ID NO: 8770727 - DNA, 21 bp, Homo sapiens
ctttggcaagggagaagtcac

SEQ ID NO: 8770728 - DNA, 22 bp, Homo sapiens
ctttggaggacctatgtgcaat

SEQ ID NO: 8770729 - DNA, 22 bp, Homo sapiens
gaaactttcatgaatataagat

SEQ ID NO: 8770730 - DNA, 22 bp, Homo sapiens
gaaactttggctaaaagccaga

SEQ ID NO: 8770731 - DNA, 22 bp, Homo sapiens
gaaactttcatgaatataagat

SEQ ID NO: 8770732 - DNA, 22 bp, Homo sapiens
gaaactttcatgaatataagat

SEQ ID NO: 8770733 - DNA, 22 bp, Homo sapiens
gaaacttacttactcacatttc

SEQ ID NO: 8770734 - DNA, 22 bp, Homo sapiens
gaaagaatgagcatcatgactt

SEQ ID NO: 8770735 - DNA, 22 bp, Homo sapiens
gaaagaatcaactatgtctctg

SEQ ID NO: 8770736 - DNA, 22 bp, Homo sapiens
gaaagaatcaactatgtctctg

SEQ ID NO: 8770737 - DNA, 22 bp, Homo sapiens
gaaagaatgctatagtgacttc

SEQ ID NO: 8770738 - DNA, 22 bp, Homo sapiens
gaaagaatgctatagtgacttc

SEQ ID NO: 8770739 - DNA, 22 bp, Homo sapiens
gaaagaatgctatagtgacttc

SEQ ID NO: 8770740 - DNA, 22 bp, Homo sapiens
gaaagaatgctgggagccatct

SEQ ID NO: 8770741 - DNA, 22 bp, Homo sapiens
gaaagaatgctgggagccatct

SEQ ID NO: 8770742 - DNA, 22 bp, Homo sapiens
gaaagaagctttagatggctat

SEQ ID NO: 8770743 - DNA, 22 bp, Homo sapiens
gaaagaagctttagatggctat

SEQ ID NO: 8770744 - DNA, 22 bp, Homo sapiens
gaaagaagctttagatggctat

SEQ ID NO: 8770745 - DNA, 22 bp, Homo sapiens
gaaacccaaactaagacagtag

SEQ ID NO: 8770746 - DNA, 22 bp, Homo sapiens
gaaacccaaactaagacagtag

SEQ ID NO: 8770747 - DNA, 22 bp, Homo sapiens
gaaacccttcctagagggcaag

SEQ ID NO: 8770748 - DNA, 22 bp, Homo sapiens
gaaaccatgcaagctgctagag

SEQ ID NO: 8770749 - DNA, 22 bp, Homo sapiens
gaaaccagtttgtaccaagatc

SEQ ID NO: 8770750 - DNA, 22 bp, Homo sapiens
gaaaccagctagaggcagaggg

SEQ ID NO: 8770751 - DNA, 21 bp, Homo sapiens
gaaaccaggttatcaatcaca

SEQ ID NO: 8770752 - DNA, 22 bp, Homo sapiens
gaaactgagtaggctagagcac

SEQ ID NO: 8770753 - DNA, 22 bp, Homo sapiens
gaaactgatattaactcagtgt

SEQ ID NO: 8770754 - DNA, 22 bp, Homo sapiens
gaaactgaatataagaaaggta

SEQ ID NO: 8770755 - DNA, 22 bp, Homo sapiens
gaaactctcgcatcctgggaac

SEQ ID NO: 8770756 - DNA, 22 bp, Homo sapiens
gaaactctcgcatcctgggaac

SEQ ID NO: 8770757 - DNA, 22 bp, Homo sapiens
gaaacgttggcataagtttatg

SEQ ID NO: 8770758 - DNA, 22 bp, Homo sapiens
gaaactctcgcatcctgggaac

SEQ ID NO: 8770759 - DNA, 22 bp, Homo sapiens
gaaactctcgcatcctgggaac

SEQ ID NO: 8770760 - DNA, 22 bp, Homo sapiens
ctttttgttgtataagcccttt

SEQ ID NO: 8770761 - DNA, 22 bp, Homo sapiens
ctttttgttgtataagcccttt

SEQ ID NO: 8770762 - DNA, 22 bp, Homo sapiens
ctttttgttgtataagcccttt

SEQ ID NO: 8770763 - DNA, 22 bp, Homo sapiens
ctttttgtgtatgctacagttg

SEQ ID NO: 8770764 - DNA, 22 bp, Homo sapiens
ctttttgtgtatgctacagttg

SEQ ID NO: 8770765 - DNA, 22 bp, Homo sapiens
ctttttgtctctgtcctgatga

SEQ ID NO: 8770766 - DNA, 22 bp, Homo sapiens
cttttttaaggtagctcctcct

SEQ ID NO: 8770767 - DNA, 22 bp, Homo sapiens
cttttttaaggtagctcctcct

SEQ ID NO: 8770768 - DNA, 22 bp, Homo sapiens
ctttttgttgtccacactagga

SEQ ID NO: 8770769 - DNA, 22 bp, Homo sapiens
ctttttgttgtccacactagga

SEQ ID NO: 8770770 - DNA, 22 bp, Homo sapiens
ctttttgttgtccacactagga

SEQ ID NO: 8770771 - DNA, 22 bp, Homo sapiens
ctttttgttgtccacactagga

SEQ ID NO: 8770772 - DNA, 22 bp, Homo sapiens
ctttttgttgtccacactagga

SEQ ID NO: 8770773 - DNA, 22 bp, Homo sapiens
cttttttaaggtagctcctcct

SEQ ID NO: 8770774 - DNA, 22 bp, Homo sapiens
gaaaaaggataaatacagtgtt

SEQ ID NO: 8770775 - DNA, 22 bp, Homo sapiens
cttttttcctaaggcaacatga

SEQ ID NO: 8770776 - DNA, 22 bp, Homo sapiens
cttttttcctaaggcaacatga

SEQ ID NO: 8770777 - DNA, 22 bp, Homo sapiens
gaaaaagtgaccttggtagcta

SEQ ID NO: 8770778 - DNA, 22 bp, Homo sapiens
gaaaaagtgaccttggtagcta

SEQ ID NO: 8770779 - DNA, 22 bp, Homo sapiens
gaaaaaggataaatacagtgtt

SEQ ID NO: 8770780 - DNA, 22 bp, Homo sapiens
gaaaaagtgaccttggtagcta

SEQ ID NO: 8770781 - DNA, 22 bp, Homo sapiens
gaaaaagtgaccttggtagcta

SEQ ID NO: 8770782 - DNA, 22 bp, Homo sapiens
gaaaaatgctccaaatctgtgg

SEQ ID NO: 8770783 - DNA, 22 bp, Homo sapiens
gaaaaatgctccaaatctgtgg

SEQ ID NO: 8770784 - DNA, 22 bp, Homo sapiens
gaaaaatgctccaaatctgtgg

SEQ ID NO: 8770785 - DNA, 22 bp, Homo sapiens
gaaaaatgctccaaatctgtgg

SEQ ID NO: 8770786 - DNA, 22 bp, Homo sapiens
gaaaaatgctccaaatctgtgg

SEQ ID NO: 8770787 - DNA, 22 bp, Homo sapiens
gaaaaatgctccaaatctgtgg

SEQ ID NO: 8770788 - DNA, 22 bp, Homo sapiens
gaaaaatgagctgatgtcaggg

SEQ ID NO: 8770789 - DNA, 22 bp, Homo sapiens
gaaaaatgagctgatgtcaggg

SEQ ID NO: 8770790 - DNA, 22 bp, Homo sapiens
gaaaaatgagctgatgtcaggg

SEQ ID NO: 8770791 - DNA, 22 bp, Homo sapiens
gaaaccagataagggaggctga

SEQ ID NO: 8770792 - DNA, 22 bp, Homo sapiens
gaaaccagcatttaaaccagga

SEQ ID NO: 8770793 - DNA, 22 bp, Homo sapiens
gaaacagcacgtttggagagat

SEQ ID NO: 8770794 - DNA, 22 bp, Homo sapiens
gaaacagcacgtttggagagat

SEQ ID NO: 8770795 - DNA, 22 bp, Homo sapiens
gaaaaatgctccaaatctgtgg

SEQ ID NO: 8770796 - DNA, 22 bp, Homo sapiens
gaaatattgggactcagagctt

SEQ ID NO: 8770797 - DNA, 22 bp, Homo sapiens
gaaatattgggactcagagctt

SEQ ID NO: 8770798 - DNA, 22 bp, Homo sapiens
gaaatattgggactcagagctt

SEQ ID NO: 8770799 - DNA, 22 bp, Homo sapiens
gaaatattgggactcagagctt

SEQ ID NO: 8770800 - DNA, 22 bp, Homo sapiens
gaaatattgtactggagatgtt

SEQ ID NO: 8770801 - DNA, 22 bp, Homo sapiens
gaaatattgtactggagatgtt

SEQ ID NO: 8770802 - DNA, 22 bp, Homo sapiens
gaaatgtagaattgcttaactg

SEQ ID NO: 8770803 - DNA, 22 bp, Homo sapiens
gaaatattgtactggagatgtt

SEQ ID NO: 8770804 - DNA, 22 bp, Homo sapiens
gaaatattgtactggagatgtt

SEQ ID NO: 8770805 - DNA, 22 bp, Homo sapiens
gaaatgtcaagatatgtttgga

SEQ ID NO: 8770806 - DNA, 22 bp, Homo sapiens
gaaatgtcaagatatgtttgga

SEQ ID NO: 8770807 - DNA, 22 bp, Homo sapiens
gaaatgtcatagtcttcaagcc

SEQ ID NO: 8770808 - DNA, 22 bp, Homo sapiens
gaaatgtaggcataattatttt

SEQ ID NO: 8770809 - DNA, 22 bp, Homo sapiens
gaaatgtaggcataattatttt

SEQ ID NO: 8770810 - DNA, 20 bp, Homo sapiens
gaaatgtatctcttgattct

SEQ ID NO: 8770811 - DNA, 20 bp, Homo sapiens
gaaatgtatctcttgattct

SEQ ID NO: 8770812 - DNA, 22 bp, Homo sapiens
gaaatgtataagctggtctttt

SEQ ID NO: 8770813 - DNA, 22 bp, Homo sapiens
gaaatgtgggtcatgacccatt

SEQ ID NO: 8770814 - DNA, 22 bp, Homo sapiens
gaaatgtgcagaatgtgttaga

SEQ ID NO: 8770815 - DNA, 18 bp, Homo sapiens
gaaatgtgattctagggc

SEQ ID NO: 8770816 - DNA, 22 bp, Homo sapiens
gaaatgtgtgacaagtttcaat

SEQ ID NO: 8770817 - DNA, 20 bp, Homo sapiens
gaaatgtgacctcttctgtg

SEQ ID NO: 8770818 - DNA, 22 bp, Homo sapiens
gaaatgtgacctacttccttgt

SEQ ID NO: 8770819 - DNA, 22 bp, Homo sapiens
gaaatgtctttgacaagagagg

SEQ ID NO: 8770820 - DNA, 22 bp, Homo sapiens
gaaatgtctttgacaagagagg

SEQ ID NO: 8770821 - DNA, 22 bp, Homo sapiens
gaaatgtctctggatttgcttt

SEQ ID NO: 8770822 - DNA, 22 bp, Homo sapiens
gaaatgtctcttgatttttgga

SEQ ID NO: 8770823 - DNA, 22 bp, Homo sapiens
gaaatgtcatagtcttcaagcc

SEQ ID NO: 8770824 - DNA, 20 bp, Homo sapiens
gaaatgtctatgataatgat

SEQ ID NO: 8770825 - DNA, 22 bp, Homo sapiens
gaaatattacagtggaggggat

SEQ ID NO: 8770826 - DNA, 22 bp, Homo sapiens
gaaatattacagtggaggggat

SEQ ID NO: 8770827 - DNA, 22 bp, Homo sapiens
gaaatatacattgcaggaagag

SEQ ID NO: 8770828 - DNA, 22 bp, Homo sapiens
gaaatatacattgcaggaagag

SEQ ID NO: 8770829 - DNA, 22 bp, Homo sapiens
gaaatattacagtggaggggat

SEQ ID NO: 8770830 - DNA, 22 bp, Homo sapiens
gaaatattcttgtcttgttttc

SEQ ID NO: 8770831 - DNA, 22 bp, Homo sapiens
gaaatattcttgtcttgttttc

SEQ ID NO: 8770832 - DNA, 22 bp, Homo sapiens
gaaatattcttgtcttgttttc

SEQ ID NO: 8770833 - DNA, 22 bp, Homo sapiens
gaaatacagaaagggctgaatg

SEQ ID NO: 8770834 - DNA, 22 bp, Homo sapiens
gaaatatacattgcaggaagag

SEQ ID NO: 8770835 - DNA, 22 bp, Homo sapiens
gaaatacaggaatgccacacag

SEQ ID NO: 8770836 - DNA, 22 bp, Homo sapiens
gaaagactcttgatgtctttgg

SEQ ID NO: 8770837 - DNA, 22 bp, Homo sapiens
gaaagacttcctttgagagtac

SEQ ID NO: 8770838 - DNA, 22 bp, Homo sapiens
gaaagacttcctttgagagtac

SEQ ID NO: 8770839 - DNA, 22 bp, Homo sapiens
gaaagagaacctgggcctagat

SEQ ID NO: 8770840 - DNA, 22 bp, Homo sapiens
gaaagacatagttgcaagatgg

SEQ ID NO: 8770841 - DNA, 22 bp, Homo sapiens
gaaagacatagttgcaagatgg

SEQ ID NO: 8770842 - DNA, 22 bp, Homo sapiens
gaaatgttatgagatatgtact

SEQ ID NO: 8770843 - DNA, 22 bp, Homo sapiens
gaaatgtgttgttcatttctaa

SEQ ID NO: 8770844 - DNA, 22 bp, Homo sapiens
gaaatgttatgagatatgtact

SEQ ID NO: 8770845 - DNA, 22 bp, Homo sapiens
gaaatgttatgagatatgtact

SEQ ID NO: 8770846 - DNA, 22 bp, Homo sapiens
gaaatgttgtcctgtctcttga

SEQ ID NO: 8770847 - DNA, 22 bp, Homo sapiens
gaaatgtttccttttgtatgct

SEQ ID NO: 8770848 - DNA, 22 bp, Homo sapiens
gaaatgtttccttttgtatgct

SEQ ID NO: 8770849 - DNA, 22 bp, Homo sapiens
gaaattaagcaggggtctgtgg

SEQ ID NO: 8770850 - DNA, 22 bp, Homo sapiens
gaaattaagcaggggtctgtgg

SEQ ID NO: 8770851 - DNA, 22 bp, Homo sapiens
gaaattaagcaggggtctgtgg

SEQ ID NO: 8770852 - DNA, 22 bp, Homo sapiens
gaaattaaccacctttggcttt

SEQ ID NO: 8770853 - DNA, 22 bp, Homo sapiens
gaaattaaccacctttggcttt

SEQ ID NO: 8770854 - DNA, 22 bp, Homo sapiens
gaaattaaccacctttggcttt

SEQ ID NO: 8770855 - DNA, 22 bp, Homo sapiens
gaaattcaaaatgtcagtatag

SEQ ID NO: 8770856 - DNA, 22 bp, Homo sapiens
gaaattcaaaatgtcagtatag

SEQ ID NO: 8770857 - DNA, 22 bp, Homo sapiens
gaaattcaaaatgtcagtatag

SEQ ID NO: 8770858 - DNA, 22 bp, Homo sapiens
gaaattcaaataagatatgtag

SEQ ID NO: 8770859 - DNA, 22 bp, Homo sapiens
gaaattcaccttttacgtggcc

SEQ ID NO: 8770860 - DNA, 22 bp, Homo sapiens
gaaattaagcaggggtctgtgg

SEQ ID NO: 8770861 - DNA, 22 bp, Homo sapiens
gaaattgtcagcttctttcagt

SEQ ID NO: 8770862 - DNA, 22 bp, Homo sapiens
gaaattgtcagcttctttcagt

SEQ ID NO: 8770863 - DNA, 22 bp, Homo sapiens
gaaattgtaaaggattgcgcca

SEQ ID NO: 8770864 - DNA, 22 bp, Homo sapiens
gaaattgaataccctgcatgaa

SEQ ID NO: 8770865 - DNA, 22 bp, Homo sapiens
gaaattgaaagaccaactgcat

SEQ ID NO: 8770866 - DNA, 22 bp, Homo sapiens
gaaattgaaagaccaactgcat

SEQ ID NO: 8770867 - DNA, 22 bp, Homo sapiens
gaaattgaataccctgcatgaa

SEQ ID NO: 8770868 - DNA, 22 bp, Homo sapiens
gaaattgaaaccgatctgtgtt

SEQ ID NO: 8770869 - DNA, 22 bp, Homo sapiens
gaaattctgtgtcccagagtgc

SEQ ID NO: 8770870 - DNA, 20 bp, Homo sapiens
gaaattctcgtattagttta

SEQ ID NO: 8770871 - DNA, 22 bp, Homo sapiens
gaaattcaccttttacgtggcc

SEQ ID NO: 8770872 - DNA, 22 bp, Homo sapiens
gaaattcaggacaaagactctt

SEQ ID NO: 8770873 - DNA, 22 bp, Homo sapiens
gaaattcactgtatttcttggg

SEQ ID NO: 8770874 - DNA, 22 bp, Homo sapiens
gaagaacacttcatgattcatt

SEQ ID NO: 8770875 - DNA, 22 bp, Homo sapiens
gaagaactgaaagttgatgcac

SEQ ID NO: 8770876 - DNA, 22 bp, Homo sapiens
gaagaaattgaattcatgagct

SEQ ID NO: 8770877 - DNA, 22 bp, Homo sapiens
gaagaacaagcagtgctttcct

SEQ ID NO: 8770878 - DNA, 22 bp, Homo sapiens
gaagaacacctgctgcccagtg

SEQ ID NO: 8770879 - DNA, 22 bp, Homo sapiens
gaagaaatgtgttcaaggtagg

SEQ ID NO: 8770880 - DNA, 22 bp, Homo sapiens
gaactttaaaacaaagtacagt

SEQ ID NO: 8770881 - DNA, 22 bp, Homo sapiens
gaactttaaaacaaagtacagt

SEQ ID NO: 8770882 - DNA, 22 bp, Homo sapiens
gaacttgttgtaagaaaatatg

SEQ ID NO: 8770883 - DNA, 22 bp, Homo sapiens
gaaattgtctgtgcccaagtct

SEQ ID NO: 8770884 - DNA, 22 bp, Homo sapiens
gaaattgtcagcttctttcagt

SEQ ID NO: 8770885 - DNA, 22 bp, Homo sapiens
gaaattgtcagtgatatgatac

SEQ ID NO: 8770886 - DNA, 22 bp, Homo sapiens
gaacttcttcaacataatggac

SEQ ID NO: 8770887 - DNA, 22 bp, Homo sapiens
gaacttcacgatagccaaagct

SEQ ID NO: 8770888 - DNA, 22 bp, Homo sapiens
gaacttcagaatcagcatatct

SEQ ID NO: 8770889 - DNA, 22 bp, Homo sapiens
gaacttcttctttaagagactc

SEQ ID NO: 8770890 - DNA, 22 bp, Homo sapiens
gaacttcttctttaagagactc

SEQ ID NO: 8770891 - DNA, 22 bp, Homo sapiens
gaacttcttcaacataatggac

SEQ ID NO: 8770892 - DNA, 22 bp, Homo sapiens
gaacttgagcaacactgagtga

SEQ ID NO: 8770893 - DNA, 22 bp, Homo sapiens
gaagaagggagtgacaaatgca

SEQ ID NO: 8770894 - DNA, 22 bp, Homo sapiens
gaagaagggagtgacaaatgca

SEQ ID NO: 8770895 - DNA, 22 bp, Homo sapiens
gaagaagggagtgacaaatgca

SEQ ID NO: 8770896 - DNA, 22 bp, Homo sapiens
gaagaagggagtgacaaatgca

SEQ ID NO: 8770897 - DNA, 22 bp, Homo sapiens
gaagaagcaggagtgtgtagca

SEQ ID NO: 8770898 - DNA, 22 bp, Homo sapiens
gaagaagcctctgtggatctga

SEQ ID NO: 8770899 - DNA, 19 bp, Homo sapiens
gaagaagcttgagaagtag

SEQ ID NO: 8770900 - DNA, 22 bp, Homo sapiens
gaagaactgtgacagaagcagt

SEQ ID NO: 8770901 - DNA, 22 bp, Homo sapiens
gaagaactgtgacagaagcagt

SEQ ID NO: 8770902 - DNA, 22 bp, Homo sapiens
gaagaactgacaaactagatca

SEQ ID NO: 8770903 - DNA, 22 bp, Homo sapiens
gaagaactttagggcagaattt

SEQ ID NO: 8770904 - DNA, 22 bp, Homo sapiens
gaagaacttaacataataagga

SEQ ID NO: 8770905 - DNA, 22 bp, Homo sapiens
gaagaagacatggaacaatagt

SEQ ID NO: 8770906 - DNA, 22 bp, Homo sapiens
ctgggagtccctggaatagctc

SEQ ID NO: 8770907 - DNA, 22 bp, Homo sapiens
ctgggagtgaaaggagggctgc

SEQ ID NO: 8770908 - DNA, 22 bp, Homo sapiens
ctgggaggcggaggttgcagtg

SEQ ID NO: 8770909 - DNA, 22 bp, Homo sapiens
ctgggagtactgggggatgtca

SEQ ID NO: 8770910 - DNA, 22 bp, Homo sapiens
ctggagctaataatccatctga

SEQ ID NO: 8770911 - DNA, 22 bp, Homo sapiens
ctggagccttcaccaggggaaa

SEQ ID NO: 8770912 - DNA, 22 bp, Homo sapiens
ctgggaggcggagcttgcagtg

SEQ ID NO: 8770913 - DNA, 22 bp, Homo sapiens
ctgggaggcggaggttgcagtg

SEQ ID NO: 8770914 - DNA, 22 bp, Homo sapiens
ctggagctccagggtctcctct

SEQ ID NO: 8770915 - DNA, 22 bp, Homo sapiens
ctggagctccagggtctcctct

SEQ ID NO: 8770916 - DNA, 22 bp, Homo sapiens
ctggagctcagcccaggttcca

SEQ ID NO: 8770917 - DNA, 19 bp, Homo sapiens
ctgggagttcactgctgcc

SEQ ID NO: 8770918 - DNA, 22 bp, Homo sapiens
ctgggatgctccggcctggatg

SEQ ID NO: 8770919 - DNA, 22 bp, Homo sapiens
ctgggatgatagtgctagtatt

SEQ ID NO: 8770920 - DNA, 22 bp, Homo sapiens
ctgggatccacgggctcccaag

SEQ ID NO: 8770921 - DNA, 22 bp, Homo sapiens
ctgggagtttgttagtaatgca

SEQ ID NO: 8770922 - DNA, 22 bp, Homo sapiens
ctgggatgggaactgagaatca

SEQ ID NO: 8770923 - DNA, 22 bp, Homo sapiens
ctgggatggctccgctgctgct

SEQ ID NO: 8770924 - DNA, 22 bp, Homo sapiens
ctgggatgtgaggagcgcctct

SEQ ID NO: 8770925 - DNA, 22 bp, Homo sapiens
ctgggccagatccagcctcaca

SEQ ID NO: 8770926 - DNA, 22 bp, Homo sapiens
ctgggccagcaactgcaatgga

SEQ ID NO: 8770927 - DNA, 22 bp, Homo sapiens
ctgggccaggaccagggttgaa

SEQ ID NO: 8770928 - DNA, 22 bp, Homo sapiens
ctgggccagcaactgcaatgga

SEQ ID NO: 8770929 - DNA, 22 bp, Homo sapiens
ctgggccaggaccagggttgaa

SEQ ID NO: 8770930 - DNA, 22 bp, Homo sapiens
ctgggccaggaccagggttgaa

SEQ ID NO: 8770931 - DNA, 22 bp, Homo sapiens
ctgggccaggaccagggttgaa

SEQ ID NO: 8770932 - DNA, 22 bp, Homo sapiens
ctgggcccacgagggctctggg

SEQ ID NO: 8770933 - DNA, 22 bp, Homo sapiens
ctgggcccacgagggctctggg

SEQ ID NO: 8770934 - DNA, 22 bp, Homo sapiens
ctgggcccaggcggctctcgga

SEQ ID NO: 8770935 - DNA, 22 bp, Homo sapiens
ctgggcccacgagggctctggg

SEQ ID NO: 8770936 - DNA, 22 bp, Homo sapiens
ctgggcccacgagggctctggg

SEQ ID NO: 8770937 - DNA, 22 bp, Homo sapiens
ctgggcctccacgggccatcac

SEQ ID NO: 8770938 - DNA, 22 bp, Homo sapiens
ctgggcctccacgggccatcac

SEQ ID NO: 8770939 - DNA, 22 bp, Homo sapiens
ctgggctcaaatcctggccctg

SEQ ID NO: 8770940 - DNA, 22 bp, Homo sapiens
ctgggcctccagctctgccagc

SEQ ID NO: 8770941 - DNA, 22 bp, Homo sapiens
ctgggcctccacgggccatcac

SEQ ID NO: 8770942 - DNA, 22 bp, Homo sapiens
ctgggcctccacgggccatcac

SEQ ID NO: 8770943 - DNA, 22 bp, Homo sapiens
ctgggcctccacgggccatcac

SEQ ID NO: 8770944 - DNA, 22 bp, Homo sapiens
ctgggcctcatgcacagagatg

SEQ ID NO: 8770945 - DNA, 22 bp, Homo sapiens
ctgggcctcatgcacagagatg

SEQ ID NO: 8770946 - DNA, 22 bp, Homo sapiens
ctgggctcaaatcctggccctg

SEQ ID NO: 8770947 - DNA, 22 bp, Homo sapiens
ctgggctcagcaggccaaggcc

SEQ ID NO: 8770948 - DNA, 22 bp, Homo sapiens
ctgggctcaagaagtcttccct

SEQ ID NO: 8770949 - DNA, 22 bp, Homo sapiens
ctgggctcagcaggccaaggcc

SEQ ID NO: 8770950 - DNA, 22 bp, Homo sapiens
ctgggctcagtggctcatggct

SEQ ID NO: 8770951 - DNA, 22 bp, Homo sapiens
ctgggctcagtggctcatggct

SEQ ID NO: 8770952 - DNA, 22 bp, Homo sapiens
ctgggctcagtggctcatggct

SEQ ID NO: 8770953 - DNA, 22 bp, Homo sapiens
ctgggctcagtggctcatggct

SEQ ID NO: 8770954 - DNA, 22 bp, Homo sapiens
ctgggctcagcccatgctgtcc

SEQ ID NO: 8770955 - DNA, 22 bp, Homo sapiens
ctgggctccactcccacagtgt

SEQ ID NO: 8770956 - DNA, 22 bp, Homo sapiens
ctgggctccactcccacagtgt

SEQ ID NO: 8770957 - DNA, 22 bp, Homo sapiens
ctgggctccactacttgctaac

SEQ ID NO: 8770958 - DNA, 22 bp, Homo sapiens
ctgggctccactacttgctaac

SEQ ID NO: 8770959 - DNA, 22 bp, Homo sapiens
ctgggctccactacttgctaac

SEQ ID NO: 8770960 - DNA, 22 bp, Homo sapiens
ctgggctccactacttgctaac

SEQ ID NO: 8770961 - DNA, 21 bp, Homo sapiens
ctgggctcatggtgttacaga

SEQ ID NO: 8770962 - DNA, 22 bp, Homo sapiens
ctgggctcagtgtctcactcct

SEQ ID NO: 8770963 - DNA, 22 bp, Homo sapiens
ctgggctcagtgtctcactcct

SEQ ID NO: 8770964 - DNA, 22 bp, Homo sapiens
ctgggcctagcaacagaggagt

SEQ ID NO: 8770965 - DNA, 22 bp, Homo sapiens
ctgggcctagaggaagctgaca

SEQ ID NO: 8770966 - DNA, 22 bp, Homo sapiens
ctgggcctaggatggaagggcc

SEQ ID NO: 8770967 - DNA, 22 bp, Homo sapiens
ctgggcctaggatggaagggcc

SEQ ID NO: 8770968 - DNA, 22 bp, Homo sapiens
ctgggcctagcaacagaggagt

SEQ ID NO: 8770969 - DNA, 22 bp, Homo sapiens
ctgggcctagcaacagaggagt

SEQ ID NO: 8770970 - DNA, 22 bp, Homo sapiens
ctgggcccaggcggctctcgga

SEQ ID NO: 8770971 - DNA, 22 bp, Homo sapiens
ctgggccctgaagacagtcagg

SEQ ID NO: 8770972 - DNA, 22 bp, Homo sapiens
ctgggccctatggaagaaaggg

SEQ ID NO: 8770973 - DNA, 22 bp, Homo sapiens
ctgggccctatggaagaaaggg

SEQ ID NO: 8770974 - DNA, 22 bp, Homo sapiens
ctgggcctaacccacagcgttt

SEQ ID NO: 8770975 - DNA, 22 bp, Homo sapiens
ctgggccctgaagacagtcagg

SEQ ID NO: 8770976 - DNA, 22 bp, Homo sapiens
ctgggcctcatccccagagttt

SEQ ID NO: 8770977 - DNA, 22 bp, Homo sapiens
ctgggcctcatccccagagttt

SEQ ID NO: 8770978 - DNA, 22 bp, Homo sapiens
ctgggcctcatccagccacaac

SEQ ID NO: 8770979 - DNA, 22 bp, Homo sapiens
ctgggcctcatgcacagagatg

SEQ ID NO: 8770980 - DNA, 22 bp, Homo sapiens
ctgggcctcatcctcagagttt

SEQ ID NO: 8770981 - DNA, 22 bp, Homo sapiens
ctgggcctcatcctcagagttt

SEQ ID NO: 8770982 - DNA, 22 bp, Homo sapiens
ctgggcctcatccccagagttt

SEQ ID NO: 8770983 - DNA, 22 bp, Homo sapiens
ctgggcctcaagctcagatttc

SEQ ID NO: 8770984 - DNA, 22 bp, Homo sapiens
ctgggcctcaatctcagagttt

SEQ ID NO: 8770985 - DNA, 22 bp, Homo sapiens
ctgggcctcaatctcagagttt

SEQ ID NO: 8770986 - DNA, 23 bp, Homo sapiens
ctgggcctatggtctgaatccaa

SEQ ID NO: 8770987 - DNA, 22 bp, Homo sapiens
ctgggcctcaagctcagatttc

SEQ ID NO: 8770988 - DNA, 22 bp, Homo sapiens
ctgggcctcaccctagaccaat

SEQ ID NO: 8770989 - DNA, 22 bp, Homo sapiens
ctgggcctcacacccaccaaat

SEQ ID NO: 8770990 - DNA, 22 bp, Homo sapiens
ctgggcctcacacccaccaaat

SEQ ID NO: 8770991 - DNA, 22 bp, Homo sapiens
ctggggtggagattggcaatct

SEQ ID NO: 8770992 - DNA, 22 bp, Homo sapiens
ctggggtggagattggcaatct

SEQ ID NO: 8770993 - DNA, 22 bp, Homo sapiens
ctggggtggagattggcaatct

SEQ ID NO: 8770994 - DNA, 22 bp, Homo sapiens
ctggggtggatgggtccaagtt

SEQ ID NO: 8770995 - DNA, 22 bp, Homo sapiens
ctggggtggatgggtccaagtt

SEQ ID NO: 8770996 - DNA, 22 bp, Homo sapiens
ctggggtggtgcaggcctcatg

SEQ ID NO: 8770997 - DNA, 22 bp, Homo sapiens
ctggggtggatgggtccaagtt

SEQ ID NO: 8770998 - DNA, 22 bp, Homo sapiens
ctggggtggtgcaggcctcatg

SEQ ID NO: 8770999 - DNA, 22 bp, Homo sapiens
ctggggtggtgcaggcctcatg

SEQ ID NO: 8771000 - DNA, 22 bp, Homo sapiens
ctggggtggtgcaggcctcatg

SEQ ID NO: 8771001 - DNA, 22 bp, Homo sapiens
ctgggtggaaagtgctgagaat

SEQ ID NO: 8771002 - DNA, 22 bp, Homo sapiens
ctggggggctactgacagagga

SEQ ID NO: 8771003 - DNA, 22 bp, Homo sapiens
ctggggggctactgacagagga

SEQ ID NO: 8771004 - DNA, 22 bp, Homo sapiens
ctgggggtcttgaaagggagag

SEQ ID NO: 8771005 - DNA, 22 bp, Homo sapiens
ctgggggtgagcagcagcgacg

SEQ ID NO: 8771006 - DNA, 22 bp, Homo sapiens
ctgggggtcgcgcctctgggca

SEQ ID NO: 8771007 - DNA, 22 bp, Homo sapiens
ctggggtgagcagaaacagggg

SEQ ID NO: 8771008 - DNA, 22 bp, Homo sapiens
ctggggtctcaattctagcggg

SEQ ID NO: 8771009 - DNA, 22 bp, Homo sapiens
ctgggggtgagcagcagcgacg

SEQ ID NO: 8771010 - DNA, 22 bp, Homo sapiens
ctgggggtgagcagcagcgacg

SEQ ID NO: 8771011 - DNA, 19 bp, Homo sapiens
ctgggggtgctcacgctct

SEQ ID NO: 8771012 - DNA, 22 bp, Homo sapiens
ctgggctctagaaaggaaagaa

SEQ ID NO: 8771013 - DNA, 22 bp, Homo sapiens
ctgggctctagaaaggaaagaa

SEQ ID NO: 8771014 - DNA, 22 bp, Homo sapiens
ctgggctctagaaaggaaagaa

SEQ ID NO: 8771015 - DNA, 22 bp, Homo sapiens
ctgggctctagaaaggaaagaa

SEQ ID NO: 8771016 - DNA, 22 bp, Homo sapiens
ctggggctggtgaggcaggctc

SEQ ID NO: 8771017 - DNA, 22 bp, Homo sapiens
ctggggctgtaggaggacttat

SEQ ID NO: 8771018 - DNA, 22 bp, Homo sapiens
ctggggctggtgaggcaggctc

SEQ ID NO: 8771019 - DNA, 22 bp, Homo sapiens
ctggggctggtgaggcaggctc

SEQ ID NO: 8771020 - DNA, 22 bp, Homo sapiens
ctgggggcaatggtcagagtgt

SEQ ID NO: 8771021 - DNA, 22 bp, Homo sapiens
ctgggggcagcaagaagccatg

SEQ ID NO: 8771022 - DNA, 22 bp, Homo sapiens
ctgggggcagcaagaagccatg

SEQ ID NO: 8771023 - DNA, 22 bp, Homo sapiens
ctgggggcagcaagaagccatg

SEQ ID NO: 8771024 - DNA, 22 bp, Homo sapiens
ctgggggccttacggaactcca

SEQ ID NO: 8771025 - DNA, 22 bp, Homo sapiens
ctggggggagctgcgtccagca

SEQ ID NO: 8771026 - DNA, 22 bp, Homo sapiens
ctgggggccttacggaactcca

SEQ ID NO: 8771027 - DNA, 22 bp, Homo sapiens
ctgggggccttacggaactcca

SEQ ID NO: 8771028 - DNA, 22 bp, Homo sapiens
ctgggggccttacggaactcca

SEQ ID NO: 8771029 - DNA, 22 bp, Homo sapiens
ctgggggccttacggaactcca

SEQ ID NO: 8771030 - DNA, 20 bp, Homo sapiens
ctgggctcggtggccctggc

SEQ ID NO: 8771031 - DNA, 20 bp, Homo sapiens
ctgggctcggtggccctggc

SEQ ID NO: 8771032 - DNA, 22 bp, Homo sapiens
ctgggctctaagggagcaccgt

SEQ ID NO: 8771033 - DNA, 22 bp, Homo sapiens
ctgggctctaagggagcaccgt

SEQ ID NO: 8771034 - DNA, 22 bp, Homo sapiens
ctgggctctaagggagcaccgt

SEQ ID NO: 8771035 - DNA, 20 bp, Homo sapiens
ctgggctcggtggccctggc

SEQ ID NO: 8771036 - DNA, 18 bp, Homo sapiens
ctgggctcgagagatcct

SEQ ID NO: 8771037 - DNA, 18 bp, Homo sapiens
ctgggctcgagagatcct

SEQ ID NO: 8771038 - DNA, 22 bp, Homo sapiens
ctgggctcctaaccatccaggt

SEQ ID NO: 8771039 - DNA, 22 bp, Homo sapiens
ctgggctcctaaccatccaggt

SEQ ID NO: 8771040 - DNA, 22 bp, Homo sapiens
ctgggctccctcatgtgtctgc

SEQ ID NO: 8771041 - DNA, 22 bp, Homo sapiens
ctgggctcctaaccatccaggt

SEQ ID NO: 8771042 - DNA, 22 bp, Homo sapiens
ctgggctccctcatgtgtctgc

SEQ ID NO: 8771043 - DNA, 22 bp, Homo sapiens
ctgggctccctcatgtgtctgc

SEQ ID NO: 8771044 - DNA, 22 bp, Homo sapiens
ctgggtggaaagtgctgagaat

SEQ ID NO: 8771045 - DNA, 22 bp, Homo sapiens
ctgggtggctgtccagccagcc

SEQ ID NO: 8771046 - DNA, 22 bp, Homo sapiens
ctgggtggttttgatgtgaatt

SEQ ID NO: 8771047 - DNA, 22 bp, Homo sapiens
ctgggtgtcaggagacatgatg

SEQ ID NO: 8771048 - DNA, 22 bp, Homo sapiens
ctgggtgttcacccgaggcgct

SEQ ID NO: 8771049 - DNA, 22 bp, Homo sapiens
ctgggtgttcaggagctgggct

SEQ ID NO: 8771050 - DNA, 22 bp, Homo sapiens
ctgggtgttcaggagctgggct

SEQ ID NO: 8771051 - DNA, 22 bp, Homo sapiens
ctgggtgttgggtactgaccgt

SEQ ID NO: 8771052 - DNA, 22 bp, Homo sapiens
ctgggtgttcaggagctgggct

SEQ ID NO: 8771053 - DNA, 22 bp, Homo sapiens
ctgggttccatgtagccaagag

SEQ ID NO: 8771054 - DNA, 22 bp, Homo sapiens
ctgggttgccctgggcctgtga

SEQ ID NO: 8771055 - DNA, 22 bp, Homo sapiens
ctgggtttagggtctccccttg

SEQ ID NO: 8771056 - DNA, 22 bp, Homo sapiens
ctgggtttagggtctccccttg

SEQ ID NO: 8771057 - DNA, 22 bp, Homo sapiens
ctgggttgcaaagcgctggctg

SEQ ID NO: 8771058 - DNA, 22 bp, Homo sapiens
ctgggttccatgtagccaagag

SEQ ID NO: 8771059 - DNA, 22 bp, Homo sapiens
ctgggttctatttttggcttca

SEQ ID NO: 8771060 - DNA, 22 bp, Homo sapiens
ctgggttctatttttggcttca

SEQ ID NO: 8771061 - DNA, 22 bp, Homo sapiens
ctgggttctctgcttagggcct

SEQ ID NO: 8771062 - DNA, 22 bp, Homo sapiens
ctgggttttattacagtgagct

SEQ ID NO: 8771063 - DNA, 22 bp, Homo sapiens
ctgggttttattacagtgagct

SEQ ID NO: 8771064 - DNA, 22 bp, Homo sapiens
ctggtacagtgttacaaaatgg

SEQ ID NO: 8771065 - DNA, 22 bp, Homo sapiens
ctggtacagtgttacaaaatgg

SEQ ID NO: 8771066 - DNA, 22 bp, Homo sapiens
ctggtacatagtaagaacacaa

SEQ ID NO: 8771067 - DNA, 22 bp, Homo sapiens
ctggtacatttgatgataatag

SEQ ID NO: 8771068 - DNA, 22 bp, Homo sapiens
ctggtacatagtaagaacacaa

SEQ ID NO: 8771069 - DNA, 22 bp, Homo sapiens
ctggtacatttgatgataatag

SEQ ID NO: 8771070 - DNA, 22 bp, Homo sapiens
ctggtacaaaatgctgatatca

SEQ ID NO: 8771071 - DNA, 22 bp, Homo sapiens
ctggtacagggaaataaaggaa

SEQ ID NO: 8771072 - DNA, 22 bp, Homo sapiens
ctggtacagggaaataaaggaa

SEQ ID NO: 8771073 - DNA, 22 bp, Homo sapiens
ctggtacagggaaataaaggaa

SEQ ID NO: 8771074 - DNA, 22 bp, Homo sapiens
ctggtgtggactccgcgcggag

SEQ ID NO: 8771075 - DNA, 22 bp, Homo sapiens
ctggtgtggcggcgccctgtag

SEQ ID NO: 8771076 - DNA, 22 bp, Homo sapiens
ctggtgtttattacaggtgctc

SEQ ID NO: 8771077 - DNA, 22 bp, Homo sapiens
ctggtgtccagcatgtgtggaa

SEQ ID NO: 8771078 - DNA, 22 bp, Homo sapiens
ctggtgggtagagggcatcagg

SEQ ID NO: 8771079 - DNA, 22 bp, Homo sapiens
ctggtgggtagagggcatcagg

SEQ ID NO: 8771080 - DNA, 22 bp, Homo sapiens
ctggtgtgattgagcccaggtg

SEQ ID NO: 8771081 - DNA, 22 bp, Homo sapiens
ctggtgtggactccgcgcggag

SEQ ID NO: 8771082 - DNA, 22 bp, Homo sapiens
ctggtgcctcctccctgtgctt

SEQ ID NO: 8771083 - DNA, 22 bp, Homo sapiens
ctggtcacctccttcccagcta

SEQ ID NO: 8771084 - DNA, 22 bp, Homo sapiens
ctggtcacctccttcccagcta

SEQ ID NO: 8771085 - DNA, 22 bp, Homo sapiens
ctggtcacctccttcccagcta

SEQ ID NO: 8771086 - DNA, 22 bp, Homo sapiens
ctggtcaccaggtagcattgta

SEQ ID NO: 8771087 - DNA, 22 bp, Homo sapiens
ctggtacagtgttacaaaatgg

SEQ ID NO: 8771088 - DNA, 22 bp, Homo sapiens
ctggtaggggtgactgttatcg

SEQ ID NO: 8771089 - DNA, 20 bp, Homo sapiens
ctgtgaccagagacccagga

SEQ ID NO: 8771090 - DNA, 22 bp, Homo sapiens
ctgtgacaaaagcagcctgcct

SEQ ID NO: 8771091 - DNA, 22 bp, Homo sapiens
ctgtgaatttaaagcacacatc

SEQ ID NO: 8771092 - DNA, 22 bp, Homo sapiens
ctgtgacaaaagcagcctgcct

SEQ ID NO: 8771093 - DNA, 22 bp, Homo sapiens
ctgtgaatgctagtaagagtgc

SEQ ID NO: 8771094 - DNA, 22 bp, Homo sapiens
ctgtgaacaatagcagcatctt

SEQ ID NO: 8771095 - DNA, 22 bp, Homo sapiens
ctgtgaattgcaacaattgcaa

SEQ ID NO: 8771096 - DNA, 22 bp, Homo sapiens
ctgtgaattgaatatgactatg

SEQ ID NO: 8771097 - DNA, 22 bp, Homo sapiens
ctgtgaattgaatatgactatg

SEQ ID NO: 8771098 - DNA, 22 bp, Homo sapiens
ctgtgaatgttatatctcaatg

SEQ ID NO: 8771099 - DNA, 22 bp, Homo sapiens
ctgtccctctcacacctcacca

SEQ ID NO: 8771100 - DNA, 19 bp, Homo sapiens
ctgtccctcccaggtatga

SEQ ID NO: 8771101 - DNA, 22 bp, Homo sapiens
ctgtccctcatcacctctgggt

SEQ ID NO: 8771102 - DNA, 22 bp, Homo sapiens
ctgtccctctcacacctcacca

SEQ ID NO: 8771103 - DNA, 22 bp, Homo sapiens
ctgtccctcagttctgggcaaa

SEQ ID NO: 8771104 - DNA, 22 bp, Homo sapiens
ctgtccctcatcacctctgggt

SEQ ID NO: 8771105 - DNA, 22 bp, Homo sapiens
ctgtccctcatcacctctgggt

SEQ ID NO: 8771106 - DNA, 19 bp, Homo sapiens
ctgtccctcccaggtatga

SEQ ID NO: 8771107 - DNA, 22 bp, Homo sapiens
ctgtccctcatcacctctgggt

SEQ ID NO: 8771108 - DNA, 22 bp, Homo sapiens
ctgtctgttcagattcattact

SEQ ID NO: 8771109 - DNA, 22 bp, Homo sapiens
ctgtgaaactggacagcacttg

SEQ ID NO: 8771110 - DNA, 22 bp, Homo sapiens
ctgtctgttgaccatagtttgc

SEQ ID NO: 8771111 - DNA, 22 bp, Homo sapiens
ctgtctgttatctcaccagtcc

SEQ ID NO: 8771112 - DNA, 22 bp, Homo sapiens
ctgtctgtggtctcagtaggcc

SEQ ID NO: 8771113 - DNA, 22 bp, Homo sapiens
ctgtctgtgtggacacggctgc

SEQ ID NO: 8771114 - DNA, 22 bp, Homo sapiens
ctgtctgttatctcaccagtcc

SEQ ID NO: 8771115 - DNA, 22 bp, Homo sapiens
ctgtggaatcgggaaaagacag

SEQ ID NO: 8771116 - DNA, 22 bp, Homo sapiens
ctgtggaatcgggaaaagacag

SEQ ID NO: 8771117 - DNA, 22 bp, Homo sapiens
ctgtggaattgatgcttagtgt

SEQ ID NO: 8771118 - DNA, 22 bp, Homo sapiens
ctgtggaaggtttagataggta

SEQ ID NO: 8771119 - DNA, 22 bp, Homo sapiens
ctgtggaatcatcaggtcttac

SEQ ID NO: 8771120 - DNA, 22 bp, Homo sapiens
ctgtggaaggtttagataggta

SEQ ID NO: 8771121 - DNA, 22 bp, Homo sapiens
ctgtgagggcagggaccagagg

SEQ ID NO: 8771122 - DNA, 20 bp, Homo sapiens
ctgtggaattttaccatgcg

SEQ ID NO: 8771123 - DNA, 20 bp, Homo sapiens
ctgtggaattttaccatgcg

SEQ ID NO: 8771124 - DNA, 22 bp, Homo sapiens
ctgtggaattgatgcttagtgt

SEQ ID NO: 8771125 - DNA, 20 bp, Homo sapiens
ctgtggaattttaccatgcg

SEQ ID NO: 8771126 - DNA, 22 bp, Homo sapiens
ctgtggacaggggcgcagaggt

SEQ ID NO: 8771127 - DNA, 22 bp, Homo sapiens
ctgtgaggcggaaaggactctc

SEQ ID NO: 8771128 - DNA, 22 bp, Homo sapiens
ctgtgaggcgggtggagtggag

SEQ ID NO: 8771129 - DNA, 22 bp, Homo sapiens
ctgtgaggcctttggccagata

SEQ ID NO: 8771130 - DNA, 22 bp, Homo sapiens
ctgtgaggccctgggtgctgga

SEQ ID NO: 8771131 - DNA, 22 bp, Homo sapiens
ctgtgagctgggtggccaggac

SEQ ID NO: 8771132 - DNA, 22 bp, Homo sapiens
ctgtgactgtgttggatgcaca

SEQ ID NO: 8771133 - DNA, 22 bp, Homo sapiens
ctgtgactggaatctggctctt

SEQ ID NO: 8771134 - DNA, 22 bp, Homo sapiens
ctgtgactgggtgacagtcctc

SEQ ID NO: 8771135 - DNA, 22 bp, Homo sapiens
ctgtgactgggtgacagtcctc

SEQ ID NO: 8771136 - DNA, 18 bp, Homo sapiens
ctgtgactcctagatctc

SEQ ID NO: 8771137 - DNA, 22 bp, Homo sapiens
ctgtgacccagttcctggcacc

SEQ ID NO: 8771138 - DNA, 19 bp, Homo sapiens
ctgtcccagactctgctct

SEQ ID NO: 8771139 - DNA, 22 bp, Homo sapiens
ctgtcccagatgttctcagcac

SEQ ID NO: 8771140 - DNA, 22 bp, Homo sapiens
ctgtcccacaagcagtgtgcac

SEQ ID NO: 8771141 - DNA, 22 bp, Homo sapiens
ctgtccatgttaagccccttgc

SEQ ID NO: 8771142 - DNA, 22 bp, Homo sapiens
ctgtccattttcgtgcctcctt

SEQ ID NO: 8771143 - DNA, 22 bp, Homo sapiens
ctgtccccgcgagtccagagct

SEQ ID NO: 8771144 - DNA, 22 bp, Homo sapiens
ctgtcccctgtgctttcacttg

SEQ ID NO: 8771145 - DNA, 22 bp, Homo sapiens
ctgtccccgcgagtccagagct

SEQ ID NO: 8771146 - DNA, 22 bp, Homo sapiens
ctgtccccgcgagtccagagct

SEQ ID NO: 8771147 - DNA, 20 bp, Homo sapiens
ctgtccccgaggtcaccagg

SEQ ID NO: 8771148 - DNA, 20 bp, Homo sapiens
ctgtccccgaggtcaccagg

SEQ ID NO: 8771149 - DNA, 22 bp, Homo sapiens
ctgtcccatactatctgggtga

SEQ ID NO: 8771150 - DNA, 22 bp, Homo sapiens
ctgtcccaggatcctgactcca

SEQ ID NO: 8771151 - DNA, 21 bp, Homo sapiens
ctgtccccagtgagcaccccc

SEQ ID NO: 8771152 - DNA, 21 bp, Homo sapiens
ctgtccccagtgagcaccccc

SEQ ID NO: 8771153 - DNA, 21 bp, Homo sapiens
ctgtccccagtgagcaccccc

SEQ ID NO: 8771154 - DNA, 21 bp, Homo sapiens
ctgtccccagtgagcaccccc

SEQ ID NO: 8771155 - DNA, 22 bp, Homo sapiens
ctggttttgtcagaagctttat

SEQ ID NO: 8771156 - DNA, 22 bp, Homo sapiens
ctgtcattgagcctgtcagggc

SEQ ID NO: 8771157 - DNA, 22 bp, Homo sapiens
ctgtcattcttacataatgtga

SEQ ID NO: 8771158 - DNA, 22 bp, Homo sapiens
ctgtccagtgcagagaacagag

SEQ ID NO: 8771159 - DNA, 22 bp, Homo sapiens
ctgtccagtgcagagaacagag

SEQ ID NO: 8771160 - DNA, 22 bp, Homo sapiens
ctgtccagtgcagagaacagag

SEQ ID NO: 8771161 - DNA, 22 bp, Homo sapiens
ctggtttattcgtcacaccgga

SEQ ID NO: 8771162 - DNA, 22 bp, Homo sapiens
ctggtttgcccacaccagccac

SEQ ID NO: 8771163 - DNA, 22 bp, Homo sapiens
ctggttttaatgttatgtttat

SEQ ID NO: 8771164 - DNA, 22 bp, Homo sapiens
ctggttttaatgttatgtttat

SEQ ID NO: 8771165 - DNA, 22 bp, Homo sapiens
ctggttttatgttatagatgga

SEQ ID NO: 8771166 - DNA, 22 bp, Homo sapiens
ctggtttatgagggaagggatg

SEQ ID NO: 8771167 - DNA, 22 bp, Homo sapiens
ctggtttataaatctgtggcca

SEQ ID NO: 8771168 - DNA, 22 bp, Homo sapiens
ctggtttagtgaaataggccag

SEQ ID NO: 8771169 - DNA, 17 bp, Homo sapiens
ctggtttatgggcagtg

SEQ ID NO: 8771170 - DNA, 22 bp, Homo sapiens
ctggtttatgtatcatctagaa

SEQ ID NO: 8771171 - DNA, 19 bp, Homo sapiens
ctggtttaggtagtgagtc

SEQ ID NO: 8771172 - DNA, 22 bp, Homo sapiens
ctggtttagtaggggactgaag

SEQ ID NO: 8771173 - DNA, 22 bp, Homo sapiens
ctggtttagtcataatggagaa

SEQ ID NO: 8771174 - DNA, 22 bp, Homo sapiens
ctggtttaaaattactggttaa

SEQ ID NO: 8771175 - DNA, 22 bp, Homo sapiens
ctggtttaaccatgtatcctgg

SEQ ID NO: 8771176 - DNA, 22 bp, Homo sapiens
ctggttggtgccacatggtggc

SEQ ID NO: 8771177 - DNA, 22 bp, Homo sapiens
ctggttggaagtgcagactctc

SEQ ID NO: 8771178 - DNA, 22 bp, Homo sapiens
ctggtttagctgtaaggttccc

SEQ ID NO: 8771179 - DNA, 22 bp, Homo sapiens
ctggtttactctgcactgctca

SEQ ID NO: 8771180 - DNA, 22 bp, Homo sapiens
ctggtttacccaagatttgctg

SEQ ID NO: 8771181 - DNA, 22 bp, Homo sapiens
ctggtttaagcttatatagttg

SEQ ID NO: 8771182 - DNA, 22 bp, Homo sapiens
ctggtttacccaagatttgctg

SEQ ID NO: 8771183 - DNA, 22 bp, Homo sapiens
ctggttctgattttgctgcatt

SEQ ID NO: 8771184 - DNA, 22 bp, Homo sapiens
ctggttcccagcaggagtgtag

SEQ ID NO: 8771185 - DNA, 19 bp, Homo sapiens
ctgtgggtgtgcaagggtg

SEQ ID NO: 8771186 - DNA, 22 bp, Homo sapiens
ctgtgggctgaaagtgctcccg

SEQ ID NO: 8771187 - DNA, 22 bp, Homo sapiens
ctgtgggctgaaagtgctcccg

SEQ ID NO: 8771188 - DNA, 22 bp, Homo sapiens
ctgtgggctcctgcagctcagg

SEQ ID NO: 8771189 - DNA, 22 bp, Homo sapiens
ctgtgggctcctgcagctcagg

SEQ ID NO: 8771190 - DNA, 22 bp, Homo sapiens
ctgtgggctgaaagtgctcccg

SEQ ID NO: 8771191 - DNA, 22 bp, Homo sapiens
ctgtggggaaagggtcctgctc

SEQ ID NO: 8771192 - DNA, 18 bp, Homo sapiens
ctgtgggctggtgcatga

SEQ ID NO: 8771193 - DNA, 22 bp, Homo sapiens
ctgtgggcttgaggttagacag

SEQ ID NO: 8771194 - DNA, 22 bp, Homo sapiens
ctgtgggcttgaggttagacag

SEQ ID NO: 8771195 - DNA, 18 bp, Homo sapiens
ctgtgggctggtgcatga

SEQ ID NO: 8771196 - DNA, 22 bp, Homo sapiens
ctgtggtgagcaactgactgaa

SEQ ID NO: 8771197 - DNA, 23 bp, Homo sapiens
ctgtggtgaggccctagaatctg

SEQ ID NO: 8771198 - DNA, 20 bp, Homo sapiens
ctgtggtgagcaggagagta

SEQ ID NO: 8771199 - DNA, 22 bp, Homo sapiens
ctgtggtgagcaactgactgaa

SEQ ID NO: 8771200 - DNA, 22 bp, Homo sapiens
ctgtggtgagcaactgactgaa

SEQ ID NO: 8771201 - DNA, 22 bp, Homo sapiens
ctgtggtgagcaactgactgaa

SEQ ID NO: 8771202 - DNA, 22 bp, Homo sapiens
ctgtggtcatgagtccttccat

SEQ ID NO: 8771203 - DNA, 22 bp, Homo sapiens
ctgtgtgaatagtgaggtctat

SEQ ID NO: 8771204 - DNA, 22 bp, Homo sapiens
ctgtgtctttcctactttgtgg

SEQ ID NO: 8771205 - DNA, 22 bp, Homo sapiens
ctgtgtgtgaacacagcccagc

SEQ ID NO: 8771206 - DNA, 22 bp, Homo sapiens
ctgtgtgatgggaagaatgttt

SEQ ID NO: 8771207 - DNA, 22 bp, Homo sapiens
ctgtgtgagtgactgcatctca

SEQ ID NO: 8771208 - DNA, 22 bp, Homo sapiens
ctgtgtctttcctactttgtgg

SEQ ID NO: 8771209 - DNA, 22 bp, Homo sapiens
ctgtggtggcacagcgggctgg

SEQ ID NO: 8771210 - DNA, 22 bp, Homo sapiens
ctgtgtcttctgttttgaagtt

SEQ ID NO: 8771211 - DNA, 22 bp, Homo sapiens
ctgtgtgtgtctgcagcatact

SEQ ID NO: 8771212 - DNA, 22 bp, Homo sapiens
ctgtgtgtgtctgcagcatact

SEQ ID NO: 8771213 - DNA, 22 bp, Homo sapiens
ctgtgtgtgtctgcagcatact

SEQ ID NO: 8771214 - DNA, 22 bp, Homo sapiens
ctgtgtgtgctacaggcttcca

SEQ ID NO: 8771215 - DNA, 23 bp, Homo sapiens
ctgtgtgtgccgagggtggccac

SEQ ID NO: 8771216 - DNA, 22 bp, Homo sapiens
ctgtgtgtgctacaggcttcca

SEQ ID NO: 8771217 - DNA, 22 bp, Homo sapiens
ctgtgtgtgctacaggcttcca

SEQ ID NO: 8771218 - DNA, 22 bp, Homo sapiens
ctgtgtgtgaacacagcccagc

SEQ ID NO: 8771219 - DNA, 22 bp, Homo sapiens
ctgtgtgtgagaagcaggttga

SEQ ID NO: 8771220 - DNA, 22 bp, Homo sapiens
ctgtgtgtgagaagcaggttga

SEQ ID NO: 8771221 - DNA, 23 bp, Homo sapiens
ctgtgtgtgccgagggtggccac

SEQ ID NO: 8771222 - DNA, 22 bp, Homo sapiens
ctgtgttggcttttctcttgta

SEQ ID NO: 8771223 - DNA, 22 bp, Homo sapiens
ctgtgtttctaagtaaaggagc

SEQ ID NO: 8771224 - DNA, 22 bp, Homo sapiens
ctgtgtgtttatatcatttcct

SEQ ID NO: 8771225 - DNA, 22 bp, Homo sapiens
ctgtgtgtttatatcatttcct

SEQ ID NO: 8771226 - DNA, 22 bp, Homo sapiens
ctgtgttcagtgctactgagtt

SEQ ID NO: 8771227 - DNA, 22 bp, Homo sapiens
ctgtgtttttggtctgatctat

SEQ ID NO: 8771228 - DNA, 22 bp, Homo sapiens
ctgtgtttttggtctgatctat

SEQ ID NO: 8771229 - DNA, 22 bp, Homo sapiens
ctgtgtttgacaggcggtctcc

SEQ ID NO: 8771230 - DNA, 22 bp, Homo sapiens
ctgtgtttgacaggcggtctcc

SEQ ID NO: 8771231 - DNA, 22 bp, Homo sapiens
ctgtgggcagctcctcctgtca

SEQ ID NO: 8771232 - DNA, 22 bp, Homo sapiens
ctgtgggcagctcctcctgtca

SEQ ID NO: 8771233 - DNA, 22 bp, Homo sapiens
ctgtgggcagctcctcctgtca

SEQ ID NO: 8771234 - DNA, 22 bp, Homo sapiens
ctgtgggatgggacctcagctg

SEQ ID NO: 8771235 - DNA, 22 bp, Homo sapiens
ctgtgggcatttgagtgtgggt

SEQ ID NO: 8771236 - DNA, 22 bp, Homo sapiens
ctgtgggcatttgagtgtgggt

SEQ ID NO: 8771237 - DNA, 22 bp, Homo sapiens
ctgtgggcctagtctggcctag

SEQ ID NO: 8771238 - DNA, 22 bp, Homo sapiens
ctgtgggcctagtctggcctag

SEQ ID NO: 8771239 - DNA, 22 bp, Homo sapiens
ctgtgggcctagtctggcctag

SEQ ID NO: 8771240 - DNA, 19 bp, Homo sapiens
ctgtgggcggaggaggggc

SEQ ID NO: 8771241 - DNA, 19 bp, Homo sapiens
ctgtgggcggaggaggggc

SEQ ID NO: 8771242 - DNA, 22 bp, Homo sapiens
ctgtgggctcccagcttctctc

SEQ ID NO: 8771243 - DNA, 22 bp, Homo sapiens
ctgtgggctcccagcttctctc

SEQ ID NO: 8771244 - DNA, 22 bp, Homo sapiens
ctgtgggctcctgcagctcagg

SEQ ID NO: 8771245 - DNA, 20 bp, Homo sapiens
ctgtgggcctcacttggggt

SEQ ID NO: 8771246 - DNA, 20 bp, Homo sapiens
ctgtgggcctcacttggggt

SEQ ID NO: 8771247 - DNA, 22 bp, Homo sapiens
ctgtgggcctgatgttcttctc

SEQ ID NO: 8771248 - DNA, 22 bp, Homo sapiens
ctgtgggcgcctgtcagcctca

SEQ ID NO: 8771249 - DNA, 22 bp, Homo sapiens
ctgtgggcgcctgtcagcctca

SEQ ID NO: 8771250 - DNA, 22 bp, Homo sapiens
ctgtgggcgcctgtcagcctca

SEQ ID NO: 8771251 - DNA, 22 bp, Homo sapiens
ctgtggctttgcagggcttgtt

SEQ ID NO: 8771252 - DNA, 22 bp, Homo sapiens
ctgtggctttctctgcctcctt

SEQ ID NO: 8771253 - DNA, 22 bp, Homo sapiens
ctgtggcttctgggtcagttca

SEQ ID NO: 8771254 - DNA, 22 bp, Homo sapiens
ctgtggctttctctgcctcctt

SEQ ID NO: 8771255 - DNA, 22 bp, Homo sapiens
ctgtggctttgcagggcttgtt

SEQ ID NO: 8771256 - DNA, 22 bp, Homo sapiens
ctgtggctttctctgcctcctt

SEQ ID NO: 8771257 - DNA, 22 bp, Homo sapiens
ctgtgggagggtgagagaacca

SEQ ID NO: 8771258 - DNA, 22 bp, Homo sapiens
ctgtggcttctgggtcagttca

SEQ ID NO: 8771259 - DNA, 22 bp, Homo sapiens
ctgtggcttctgcttgggcctc

SEQ ID NO: 8771260 - DNA, 22 bp, Homo sapiens
ctgtggcttctgggtcagttca

SEQ ID NO: 8771261 - DNA, 22 bp, Homo sapiens
ctgtggcttctgggtcagttca

SEQ ID NO: 8771262 - DNA, 22 bp, Homo sapiens
ctgtggctttctctgcctcctt

SEQ ID NO: 8771263 - DNA, 22 bp, Homo sapiens
ctgtggcttctgcttgggcctc

SEQ ID NO: 8771264 - DNA, 22 bp, Homo sapiens
ctgtggcttctgggtcagttca

SEQ ID NO: 8771265 - DNA, 22 bp, Homo sapiens
ctgtggcttctgcttgggcctc

SEQ ID NO: 8771266 - DNA, 22 bp, Homo sapiens
ctgtggcttctaggtccccgat

SEQ ID NO: 8771267 - DNA, 22 bp, Homo sapiens
ctgtggcttctaggtccccgat

SEQ ID NO: 8771268 - DNA, 22 bp, Homo sapiens
ctgtggcttctaggtccccgat

SEQ ID NO: 8771269 - DNA, 22 bp, Homo sapiens
ctgtggcttctaggtccccgat

SEQ ID NO: 8771270 - DNA, 22 bp, Homo sapiens
ctgtggcttctaggtccccgat

SEQ ID NO: 8771271 - DNA, 23 bp, Homo sapiens
ctgtggccacccctagctggagg

SEQ ID NO: 8771272 - DNA, 22 bp, Homo sapiens
ctgtggcattgtgaggactgca

SEQ ID NO: 8771273 - DNA, 22 bp, Homo sapiens
ctgtggcaggtgtctggggcag

SEQ ID NO: 8771274 - DNA, 22 bp, Homo sapiens
ctgtggcagggaagaggccatg

SEQ ID NO: 8771275 - DNA, 22 bp, Homo sapiens
ctgtggcaggaagggactagca

SEQ ID NO: 8771276 - DNA, 22 bp, Homo sapiens
ctgtggcattgccgaggctggc

SEQ ID NO: 8771277 - DNA, 20 bp, Homo sapiens
ctgtggcatctgtcatggtg

SEQ ID NO: 8771278 - DNA, 22 bp, Homo sapiens
ctgtggcattaataaaagtgca

SEQ ID NO: 8771279 - DNA, 22 bp, Homo sapiens
ctgtggcattgccgaggctggc

SEQ ID NO: 8771280 - DNA, 22 bp, Homo sapiens
ctgtggagtttgtggcgctgac

SEQ ID NO: 8771281 - DNA, 22 bp, Homo sapiens
ctgtggagtttgtggcgctgac

SEQ ID NO: 8771282 - DNA, 22 bp, Homo sapiens
ctgtggcaagtctgcctgtcac

SEQ ID NO: 8771283 - DNA, 22 bp, Homo sapiens
ctgtggcacatgtggcaaggcc

SEQ ID NO: 8771284 - DNA, 22 bp, Homo sapiens
ctgtggcagaggtgacacctct

SEQ ID NO: 8771285 - DNA, 22 bp, Homo sapiens
tttcttgattagctgtggctca

SEQ ID NO: 8771286 - DNA, 22 bp, Homo sapiens
ctctgaagccccaaatagtccg

SEQ ID NO: 8771287 - DNA, 22 bp, Homo sapiens
ctctgaagatggtaccagcttt

SEQ ID NO: 8771288 - DNA, 22 bp, Homo sapiens
tttgaaaaaggcctttggtatg

SEQ ID NO: 8771289 - DNA, 22 bp, Homo sapiens
tttgaaaacttaatttggtcgt

SEQ ID NO: 8771290 - DNA, 22 bp, Homo sapiens
tttgaaaacttaatttggtcgt

SEQ ID NO: 8771291 - DNA, 22 bp, Homo sapiens
tttgaaaagaaccatcgcctta

SEQ ID NO: 8771292 - DNA, 22 bp, Homo sapiens
tttgaaaaaggcctttggtatg

SEQ ID NO: 8771293 - DNA, 22 bp, Homo sapiens
tttcttgtaaaagctgtgggaa

SEQ ID NO: 8771294 - DNA, 22 bp, Homo sapiens
tttcttgtaaaagctgtgggaa

SEQ ID NO: 8771295 - DNA, 22 bp, Homo sapiens
tttcttggatgtgaaactaggg

SEQ ID NO: 8771296 - DNA, 22 bp, Homo sapiens
tttcttgggttccagttcccag

SEQ ID NO: 8771297 - DNA, 22 bp, Homo sapiens
tttcttggagctcttagggtcg

SEQ ID NO: 8771298 - DNA, 22 bp, Homo sapiens
tttgaaaattagacacaggcta

SEQ ID NO: 8771299 - DNA, 22 bp, Homo sapiens
tttgaaaagaaccatcgcctta

SEQ ID NO: 8771300 - DNA, 22 bp, Homo sapiens
tttgaaaagaaccatcgcctta

SEQ ID NO: 8771301 - DNA, 22 bp, Homo sapiens
tttgaaaatttaagtgctacac

SEQ ID NO: 8771302 - DNA, 22 bp, Homo sapiens
tttgaaaatttaagtgctacac

SEQ ID NO: 8771303 - DNA, 22 bp, Homo sapiens
tttgaaacaggtgattcagcta

SEQ ID NO: 8771304 - DNA, 22 bp, Homo sapiens
tttgaaacccgtcactttgagt

SEQ ID NO: 8771305 - DNA, 22 bp, Homo sapiens
tttgaaacctagttatatgact

SEQ ID NO: 8771306 - DNA, 22 bp, Homo sapiens
tttgaaacctagttatatgact

SEQ ID NO: 8771307 - DNA, 22 bp, Homo sapiens
tttgaaacctagttatatgact

SEQ ID NO: 8771308 - DNA, 22 bp, Homo sapiens
tttgaaagaaaccagtgagtga

SEQ ID NO: 8771309 - DNA, 22 bp, Homo sapiens
tttgaaactctgaacatgtttc

SEQ ID NO: 8771310 - DNA, 22 bp, Homo sapiens
tttgaaactcatgatcatcact

SEQ ID NO: 8771311 - DNA, 22 bp, Homo sapiens
tttgaaactcatgatcatcact

SEQ ID NO: 8771312 - DNA, 22 bp, Homo sapiens
tttgaaagaatttatgtacttt

SEQ ID NO: 8771313 - DNA, 22 bp, Homo sapiens
tttgaaagaatttatgtacttt

SEQ ID NO: 8771314 - DNA, 22 bp, Homo sapiens
tttgaaagaatttatgtacttt

SEQ ID NO: 8771315 - DNA, 22 bp, Homo sapiens
tttgaaagacagaatatttttg

SEQ ID NO: 8771316 - DNA, 21 bp, Homo sapiens
tttgaatagaaatagtgctta

SEQ ID NO: 8771317 - DNA, 22 bp, Homo sapiens
ctctgcactgtccggctttctt

SEQ ID NO: 8771318 - DNA, 22 bp, Homo sapiens
ctctgcactgtccggctttctt

SEQ ID NO: 8771319 - DNA, 22 bp, Homo sapiens
ctctgcactgtccggctttctt

SEQ ID NO: 8771320 - DNA, 22 bp, Homo sapiens
ctctgcacctacacaacaggaa

SEQ ID NO: 8771321 - DNA, 22 bp, Homo sapiens
ctctgcaccttgtaggaggcaa

SEQ ID NO: 8771322 - DNA, 22 bp, Homo sapiens
ctctgcaccttgtaggaggcaa

SEQ ID NO: 8771323 - DNA, 22 bp, Homo sapiens
ctctgcagagcctccagcccag

SEQ ID NO: 8771324 - DNA, 22 bp, Homo sapiens
ctctgagtttcatttccctcct

SEQ ID NO: 8771325 - DNA, 22 bp, Homo sapiens
ctctgagtagatagggaacctg

SEQ ID NO: 8771326 - DNA, 22 bp, Homo sapiens
ctctgagttgaggcaggagagt

SEQ ID NO: 8771327 - DNA, 22 bp, Homo sapiens
ctctgaggtttcctcacaagct

SEQ ID NO: 8771328 - DNA, 22 bp, Homo sapiens
ctctgaggttcctttgccctcg

SEQ ID NO: 8771329 - DNA, 22 bp, Homo sapiens
ctctgaggtttcctcacaagct

SEQ ID NO: 8771330 - DNA, 23 bp, Homo sapiens
ctctgcaccaggtggttttcagc

SEQ ID NO: 8771331 - DNA, 22 bp, Homo sapiens
ctctgcacccccggctcctcgt

SEQ ID NO: 8771332 - DNA, 22 bp, Homo sapiens
ctctgcacctacacaacaggaa

SEQ ID NO: 8771333 - DNA, 22 bp, Homo sapiens
ctctgcaacttctagcagtgtc

SEQ ID NO: 8771334 - DNA, 22 bp, Homo sapiens
ctctgcacacaagtaatttcat

SEQ ID NO: 8771335 - DNA, 22 bp, Homo sapiens
tttgaaagagctgatacatgaa

SEQ ID NO: 8771336 - DNA, 22 bp, Homo sapiens
tttgaaagagctgatacatgaa

SEQ ID NO: 8771337 - DNA, 22 bp, Homo sapiens
ctctgaggtctaggaccatggc

SEQ ID NO: 8771338 - DNA, 22 bp, Homo sapiens
ctctgaggtctaggaccatggc

SEQ ID NO: 8771339 - DNA, 22 bp, Homo sapiens
ctctgaggtctaggaccatggc

SEQ ID NO: 8771340 - DNA, 22 bp, Homo sapiens
ctctgaggttccctgggtccca

SEQ ID NO: 8771341 - DNA, 22 bp, Homo sapiens
tttgcaaagaaattattgctgt

SEQ ID NO: 8771342 - DNA, 22 bp, Homo sapiens
tttgcaaagaaattattgctgt

SEQ ID NO: 8771343 - DNA, 22 bp, Homo sapiens
tttgcaaagaaattattgctgt

SEQ ID NO: 8771344 - DNA, 22 bp, Homo sapiens
tttgcaaactttcctctggacc

SEQ ID NO: 8771345 - DNA, 22 bp, Homo sapiens
tttgcaaactttcctctggacc

SEQ ID NO: 8771346 - DNA, 22 bp, Homo sapiens
tttgcaaactttcctctggacc

SEQ ID NO: 8771347 - DNA, 22 bp, Homo sapiens
tttgcaaactttcctctggacc

SEQ ID NO: 8771348 - DNA, 22 bp, Homo sapiens
tttgcaaagaaattattgctgt

SEQ ID NO: 8771349 - DNA, 22 bp, Homo sapiens
tttgcaaagtccattgaagtta

SEQ ID NO: 8771350 - DNA, 22 bp, Homo sapiens
tttgcaaagtccattgaagtta

SEQ ID NO: 8771351 - DNA, 22 bp, Homo sapiens
tttgcaaagtccattgaagtta

SEQ ID NO: 8771352 - DNA, 22 bp, Homo sapiens
tttgcaaagtccctgggatgga

SEQ ID NO: 8771353 - DNA, 22 bp, Homo sapiens
tttgcaaagtccattgaagtta

SEQ ID NO: 8771354 - DNA, 22 bp, Homo sapiens
tttgcaaagtccctgggatgga

SEQ ID NO: 8771355 - DNA, 22 bp, Homo sapiens
tttgcaaagtccctgggatgga

SEQ ID NO: 8771356 - DNA, 18 bp, Homo sapiens
tttgcaaaggaagtatgg

SEQ ID NO: 8771357 - DNA, 18 bp, Homo sapiens
tttgcaaaggaagtatgg

SEQ ID NO: 8771358 - DNA, 18 bp, Homo sapiens
tttgcaaaggaagtatgg

SEQ ID NO: 8771359 - DNA, 18 bp, Homo sapiens
tttgcaaaggaagtatgg

SEQ ID NO: 8771360 - DNA, 22 bp, Homo sapiens
tttgcaaagtgactattatatg

SEQ ID NO: 8771361 - DNA, 22 bp, Homo sapiens
tttgcaaagtgactattatatg

SEQ ID NO: 8771362 - DNA, 22 bp, Homo sapiens
tttgcaaagtgactattatatg

SEQ ID NO: 8771363 - DNA, 22 bp, Homo sapiens
tttgcaaagtgcttgcagagta

SEQ ID NO: 8771364 - DNA, 22 bp, Homo sapiens
tttgcaaagtgcttgcagagta

SEQ ID NO: 8771365 - DNA, 22 bp, Homo sapiens
tttgcaaagtgcttgcagagta

SEQ ID NO: 8771366 - DNA, 22 bp, Homo sapiens
tttgcaaagtgactattatatg

SEQ ID NO: 8771367 - DNA, 22 bp, Homo sapiens
tttgcaaagtgcttgcagagta

SEQ ID NO: 8771368 - DNA, 22 bp, Homo sapiens
ctctggagtgggtggccgggag

SEQ ID NO: 8771369 - DNA, 22 bp, Homo sapiens
ctctggcacactccttccaggt

SEQ ID NO: 8771370 - DNA, 20 bp, Homo sapiens
ctctggcaaaggatgcctat

SEQ ID NO: 8771371 - DNA, 22 bp, Homo sapiens
ctctggagtgggtggccgggag

SEQ ID NO: 8771372 - DNA, 20 bp, Homo sapiens
ctctggcaaaggatgcctat

SEQ ID NO: 8771373 - DNA, 22 bp, Homo sapiens
tttgcaaagtgcttgcagagta

SEQ ID NO: 8771374 - DNA, 22 bp, Homo sapiens
ctctggagtgggtggccgggag

SEQ ID NO: 8771375 - DNA, 22 bp, Homo sapiens
ctctggccccagtggccccttg

SEQ ID NO: 8771376 - DNA, 22 bp, Homo sapiens
ctctggccgcagctcagctctg

SEQ ID NO: 8771377 - DNA, 22 bp, Homo sapiens
ctctggccgagcatgggggtta

SEQ ID NO: 8771378 - DNA, 19 bp, Homo sapiens
ctctggcctctggatgctg

SEQ ID NO: 8771379 - DNA, 22 bp, Homo sapiens
ctctggccgcagctcagctctg

SEQ ID NO: 8771380 - DNA, 22 bp, Homo sapiens
ctctggcctgcttcctcaggta

SEQ ID NO: 8771381 - DNA, 19 bp, Homo sapiens
ctctggcctctggatgctg

SEQ ID NO: 8771382 - DNA, 22 bp, Homo sapiens
ctctggcctgcagatccatgct

SEQ ID NO: 8771383 - DNA, 22 bp, Homo sapiens
ctctggcctgcttcctcaggta

SEQ ID NO: 8771384 - DNA, 22 bp, Homo sapiens
ctctggcctgcttcctcaggta

SEQ ID NO: 8771385 - DNA, 22 bp, Homo sapiens
ctctggcctgcttcctcaggta

SEQ ID NO: 8771386 - DNA, 22 bp, Homo sapiens
tttgcaaaccggagctctgcaa

SEQ ID NO: 8771387 - DNA, 22 bp, Homo sapiens
tttgcaaaccggagctctgcaa

SEQ ID NO: 8771388 - DNA, 22 bp, Homo sapiens
tttgcaaacattcagggctcca

SEQ ID NO: 8771389 - DNA, 22 bp, Homo sapiens
tttgcaaacattcagggctcca

SEQ ID NO: 8771390 - DNA, 22 bp, Homo sapiens
tttgcaaacacttaagaagaga

SEQ ID NO: 8771391 - DNA, 22 bp, Homo sapiens
tttgcaaactttcctctggacc

SEQ ID NO: 8771392 - DNA, 22 bp, Homo sapiens
tttgcaaactttcctctggacc

SEQ ID NO: 8771393 - DNA, 22 bp, Homo sapiens
tttgcaaactttcctctggacc

SEQ ID NO: 8771394 - DNA, 22 bp, Homo sapiens
tttgcaaacggccctgagtccc

SEQ ID NO: 8771395 - DNA, 22 bp, Homo sapiens
tttgcaaacggccctgagtccc

SEQ ID NO: 8771396 - DNA, 22 bp, Homo sapiens
tttgcaaacggccctgagtccc

SEQ ID NO: 8771397 - DNA, 22 bp, Homo sapiens
tttgcaaacattcagggctcca

SEQ ID NO: 8771398 - DNA, 22 bp, Homo sapiens
tttgcaaaccggagctctgcaa

SEQ ID NO: 8771399 - DNA, 22 bp, Homo sapiens
tttgcaaacacttaagaagaga

SEQ ID NO: 8771400 - DNA, 22 bp, Homo sapiens
tttgcaaacacttaagaagaga

SEQ ID NO: 8771401 - DNA, 22 bp, Homo sapiens
tttgcaaacacttaagaagaga

SEQ ID NO: 8771402 - DNA, 22 bp, Homo sapiens
tttgcaaacacttaagaagaga

SEQ ID NO: 8771403 - DNA, 22 bp, Homo sapiens
tttgcaaaattattcccagcat

SEQ ID NO: 8771404 - DNA, 22 bp, Homo sapiens
tttgagaagataggggaatact

SEQ ID NO: 8771405 - DNA, 22 bp, Homo sapiens
tttgagaagagtttgaggtatt

SEQ ID NO: 8771406 - DNA, 22 bp, Homo sapiens
tttgagaagagtttgaggtatt

SEQ ID NO: 8771407 - DNA, 22 bp, Homo sapiens
tttgcaaaatgaggtgaagagt

SEQ ID NO: 8771408 - DNA, 22 bp, Homo sapiens
tttgcaaaatgaggtgaagagt

SEQ ID NO: 8771409 - DNA, 22 bp, Homo sapiens
tttgcaaaattattcccagcat

SEQ ID NO: 8771410 - DNA, 22 bp, Homo sapiens
tttgcaaaattattcccagcat

SEQ ID NO: 8771411 - DNA, 22 bp, Homo sapiens
tttgcaaaatgtcttgtgttag

SEQ ID NO: 8771412 - DNA, 22 bp, Homo sapiens
tttgcaaaatgtcttgtgttag

SEQ ID NO: 8771413 - DNA, 22 bp, Homo sapiens
tttgcaaaatgaggtgaagagt

SEQ ID NO: 8771414 - DNA, 22 bp, Homo sapiens
tttgacttctgggcattttggt

SEQ ID NO: 8771415 - DNA, 22 bp, Homo sapiens
tttgactttgggctctaactca

SEQ ID NO: 8771416 - DNA, 22 bp, Homo sapiens
tttgacttctgggcattttggt

SEQ ID NO: 8771417 - DNA, 22 bp, Homo sapiens
tttgacttctgggcattttggt

SEQ ID NO: 8771418 - DNA, 22 bp, Homo sapiens
tttgactgttttatgaggtggt

SEQ ID NO: 8771419 - DNA, 22 bp, Homo sapiens
tttgactttgggctctaactca

SEQ ID NO: 8771420 - DNA, 22 bp, Homo sapiens
tttgagaaaaagtgatgatgat

SEQ ID NO: 8771421 - DNA, 22 bp, Homo sapiens
tttgagaaacagacgaaagaca

SEQ ID NO: 8771422 - DNA, 22 bp, Homo sapiens
tttgagaaacagacgaaagaca

SEQ ID NO: 8771423 - DNA, 22 bp, Homo sapiens
tttgagaaccctgtattttaag

SEQ ID NO: 8771424 - DNA, 22 bp, Homo sapiens
ctctggctcccgcagcccccat

SEQ ID NO: 8771425 - DNA, 22 bp, Homo sapiens
ctctggctccatttccctatgt

SEQ ID NO: 8771426 - DNA, 22 bp, Homo sapiens
tttggaatgacagatatcaata

SEQ ID NO: 8771427 - DNA, 22 bp, Homo sapiens
tttggaatgaaacagcagagcc

SEQ ID NO: 8771428 - DNA, 22 bp, Homo sapiens
tttggaatgaaacagcagagcc

SEQ ID NO: 8771429 - DNA, 22 bp, Homo sapiens
tttggaatggaatagagattgc

SEQ ID NO: 8771430 - DNA, 22 bp, Homo sapiens
tttggaatgcccatggactggt

SEQ ID NO: 8771431 - DNA, 22 bp, Homo sapiens
tttggaatgacagatatcaata

SEQ ID NO: 8771432 - DNA, 22 bp, Homo sapiens
tttggaatagcatagaagctca

SEQ ID NO: 8771433 - DNA, 22 bp, Homo sapiens
tttggaataatcagatcctagt

SEQ ID NO: 8771434 - DNA, 22 bp, Homo sapiens
tttggaatcctcagtatgatca

SEQ ID NO: 8771435 - DNA, 22 bp, Homo sapiens
tttggaatggtaccttcagttg

SEQ ID NO: 8771436 - DNA, 22 bp, Homo sapiens
tttggaatggtaccttcagttg

SEQ ID NO: 8771437 - DNA, 22 bp, Homo sapiens
tttggaatgtagtttaatcatc

SEQ ID NO: 8771438 - DNA, 22 bp, Homo sapiens
tttggaatggtaccttcagttg

SEQ ID NO: 8771439 - DNA, 22 bp, Homo sapiens
tttggaatggaatagagattgc

SEQ ID NO: 8771440 - DNA, 22 bp, Homo sapiens
tttggaattatgcttaaagttt

SEQ ID NO: 8771441 - DNA, 22 bp, Homo sapiens
tttggaattacttactcaagcc

SEQ ID NO: 8771442 - DNA, 22 bp, Homo sapiens
tttggaattatgcttaaagttt

SEQ ID NO: 8771443 - DNA, 22 bp, Homo sapiens
tttggaattctgcagctcatgt

SEQ ID NO: 8771444 - DNA, 22 bp, Homo sapiens
tttggaattccatttctgcatt

SEQ ID NO: 8771445 - DNA, 22 bp, Homo sapiens
tttggaattcagatggcttagg

SEQ ID NO: 8771446 - DNA, 22 bp, Homo sapiens
tttggaattccatttctgcatt

SEQ ID NO: 8771447 - DNA, 22 bp, Homo sapiens
ctctgggtcccacgtcattgct

SEQ ID NO: 8771448 - DNA, 19 bp, Homo sapiens
ctctgggctgcatcttggt

SEQ ID NO: 8771449 - DNA, 20 bp, Homo sapiens
ctctgggctgcaccctcgcc

SEQ ID NO: 8771450 - DNA, 20 bp, Homo sapiens
ctctgggctgcaccctcgcc

SEQ ID NO: 8771451 - DNA, 21 bp, Homo sapiens
tttgttcaggcaagttacagt

SEQ ID NO: 8771452 - DNA, 21 bp, Homo sapiens
tttgttcaggcaagttacagt

SEQ ID NO: 8771453 - DNA, 22 bp, Homo sapiens
ctctgggtgttaatgtcagtgt

SEQ ID NO: 8771454 - DNA, 22 bp, Homo sapiens
ctctgggtgtgacagcacctgg

SEQ ID NO: 8771455 - DNA, 22 bp, Homo sapiens
ctctgggtgtgacagcacctgg

SEQ ID NO: 8771456 - DNA, 21 bp, Homo sapiens
tttgttcaggggcaaagttaa

SEQ ID NO: 8771457 - DNA, 21 bp, Homo sapiens
tttgttcatagctcactcttt

SEQ ID NO: 8771458 - DNA, 21 bp, Homo sapiens
tttgttcatagctcactcttt

SEQ ID NO: 8771459 - DNA, 21 bp, Homo sapiens
tttgttcatagctcactcttt

SEQ ID NO: 8771460 - DNA, 23 bp, Homo sapiens
tttgttcatcattagagtctagc

SEQ ID NO: 8771461 - DNA, 22 bp, Homo sapiens
tttgttcatgcctatattctca

SEQ ID NO: 8771462 - DNA, 22 bp, Homo sapiens
tttgttcatgcctatattctca

SEQ ID NO: 8771463 - DNA, 22 bp, Homo sapiens
ctctgggtgtcttaggagctca

SEQ ID NO: 8771464 - DNA, 22 bp, Homo sapiens
ctctgggtgtcttaggagctca

SEQ ID NO: 8771465 - DNA, 22 bp, Homo sapiens
ctctgggtgtgacagcacctgg

SEQ ID NO: 8771466 - DNA, 22 bp, Homo sapiens
ctctgggtgtcttaggagctca

SEQ ID NO: 8771467 - DNA, 22 bp, Homo sapiens
ctctgggtggtctcactgagtg

SEQ ID NO: 8771468 - DNA, 22 bp, Homo sapiens
ctctgggtgtcatggcctcagc

SEQ ID NO: 8771469 - DNA, 22 bp, Homo sapiens
ctctgggtgggcagcagatgga

SEQ ID NO: 8771470 - DNA, 22 bp, Homo sapiens
ctctgggtggtctcactgagtg

SEQ ID NO: 8771471 - DNA, 22 bp, Homo sapiens
ctctgggtggtctcactgagtg

SEQ ID NO: 8771472 - DNA, 22 bp, Homo sapiens
ctctgggtgagacagacctggt

SEQ ID NO: 8771473 - DNA, 17 bp, Homo sapiens
ctctgggtgcctgtgtg

SEQ ID NO: 8771474 - DNA, 22 bp, Homo sapiens
ctctgggtgggcagcagatgga

SEQ ID NO: 8771475 - DNA, 22 bp, Homo sapiens
ctctgggtctacctgtggccag

SEQ ID NO: 8771476 - DNA, 22 bp, Homo sapiens
ctctgggtctacctgtggccag

SEQ ID NO: 8771477 - DNA, 22 bp, Homo sapiens
ctctgggtcctggggctacaag

SEQ ID NO: 8771478 - DNA, 22 bp, Homo sapiens
ctctgggtcctggggctacaag

SEQ ID NO: 8771479 - DNA, 20 bp, Homo sapiens
ctctgggtcgagacagactt

SEQ ID NO: 8771480 - DNA, 17 bp, Homo sapiens
ctctgggtctcctgctt

SEQ ID NO: 8771481 - DNA, 22 bp, Homo sapiens
ctctgggtctccctgaggctaa

SEQ ID NO: 8771482 - DNA, 22 bp, Homo sapiens
ctctgggtgagacagacctggt

SEQ ID NO: 8771483 - DNA, 22 bp, Homo sapiens
ctctgggtctccctgaggctaa

SEQ ID NO: 8771484 - DNA, 22 bp, Homo sapiens
ctctgggtctataatgcagctg

SEQ ID NO: 8771485 - DNA, 17 bp, Homo sapiens
tttgttcattgaagaga

SEQ ID NO: 8771486 - DNA, 22 bp, Homo sapiens
tttgttctagatcgtgtttgtg

SEQ ID NO: 8771487 - DNA, 22 bp, Homo sapiens
ctctgtgcgggccatggtcagg

SEQ ID NO: 8771488 - DNA, 22 bp, Homo sapiens
ctctgtgcgggccatggtcagg

SEQ ID NO: 8771489 - DNA, 22 bp, Homo sapiens
ctctgtgctcccatgctagtaa

SEQ ID NO: 8771490 - DNA, 22 bp, Homo sapiens
ctctgtgctcccatgctagtaa

SEQ ID NO: 8771491 - DNA, 22 bp, Homo sapiens
ctctgtgccctactgctcagct

SEQ ID NO: 8771492 - DNA, 22 bp, Homo sapiens
ctctgtgcctcagttttcttct

SEQ ID NO: 8771493 - DNA, 22 bp, Homo sapiens
ctctgtgccctactgctcagct

SEQ ID NO: 8771494 - DNA, 22 bp, Homo sapiens
ctctgtgggggagaggcagctg

SEQ ID NO: 8771495 - DNA, 22 bp, Homo sapiens
ctctgtggaagaagaaagaagg

SEQ ID NO: 8771496 - DNA, 22 bp, Homo sapiens
ctctgtgggaagctgggtgtga

SEQ ID NO: 8771497 - DNA, 22 bp, Homo sapiens
ctctgtgttaaattgggttttt

SEQ ID NO: 8771498 - DNA, 22 bp, Homo sapiens
ctctgtgtggtcctctgtattg

SEQ ID NO: 8771499 - DNA, 22 bp, Homo sapiens
ctctgtgttaaattgggttttt

SEQ ID NO: 8771500 - DNA, 22 bp, Homo sapiens
ctctgtgttcagcctagcagaa

SEQ ID NO: 8771501 - DNA, 22 bp, Homo sapiens
ctctgtgttccgggttgctgct

SEQ ID NO: 8771502 - DNA, 22 bp, Homo sapiens
ctctgtgttcagcctagcagaa

SEQ ID NO: 8771503 - DNA, 22 bp, Homo sapiens
ctctgtgttccgggttgctgct

SEQ ID NO: 8771504 - DNA, 22 bp, Homo sapiens
ctctgtgtggtatgattgtcat

SEQ ID NO: 8771505 - DNA, 22 bp, Homo sapiens
ctctgtgtggtagattccatta

SEQ ID NO: 8771506 - DNA, 22 bp, Homo sapiens
ctctgtgtggtatgattgtcat

SEQ ID NO: 8771507 - DNA, 22 bp, Homo sapiens
ctctgtgtggtcctctgtattg

SEQ ID NO: 8771508 - DNA, 22 bp, Homo sapiens
ctctgtgtggtcctctgtattg

SEQ ID NO: 8771509 - DNA, 22 bp, Homo sapiens
ctctgtgtatccaagttcaggt

SEQ ID NO: 8771510 - DNA, 22 bp, Homo sapiens
ctctgtggttagactatggctg

SEQ ID NO: 8771511 - DNA, 22 bp, Homo sapiens
ctctgtggtggagtgggtcacc

SEQ ID NO: 8771512 - DNA, 22 bp, Homo sapiens
ctctgtgtctgagttatggtct

SEQ ID NO: 8771513 - DNA, 22 bp, Homo sapiens
ctctgtgtctgagttatggtct

SEQ ID NO: 8771514 - DNA, 22 bp, Homo sapiens
ctctgtgtctgaagccctattt

SEQ ID NO: 8771515 - DNA, 22 bp, Homo sapiens
ctctgtgtcagctgggtgtgca

SEQ ID NO: 8771516 - DNA, 22 bp, Homo sapiens
ctctgtgtcagctgggtgtgca

SEQ ID NO: 8771517 - DNA, 22 bp, Homo sapiens
ctctgtgtgctggtggggtcct

SEQ ID NO: 8771518 - DNA, 22 bp, Homo sapiens
ctctgtgtctgaagccctattt

SEQ ID NO: 8771519 - DNA, 22 bp, Homo sapiens
ctctgtgtgctggtggggtcct

SEQ ID NO: 8771520 - DNA, 22 bp, Homo sapiens
ctctgtgtggtagattccatta

SEQ ID NO: 8771521 - DNA, 22 bp, Homo sapiens
ttttgcctgagagtgaaaataa

SEQ ID NO: 8771522 - DNA, 22 bp, Homo sapiens
ttttgcctaagaatctctctga

SEQ ID NO: 8771523 - DNA, 22 bp, Homo sapiens
ttttgcctagggttgacccgtt

SEQ ID NO: 8771524 - DNA, 22 bp, Homo sapiens
ttttctcttccctctggacctg

SEQ ID NO: 8771525 - DNA, 17 bp, Homo sapiens
ttttctctcttggattc

SEQ ID NO: 8771526 - DNA, 17 bp, Homo sapiens
ttttctctcttggattc

SEQ ID NO: 8771527 - DNA, 17 bp, Homo sapiens
ttttctctcttggattc

SEQ ID NO: 8771528 - DNA, 21 bp, Homo sapiens
ctctgtgttgagggtgttgag

SEQ ID NO: 8771529 - DNA, 22 bp, Homo sapiens
ctctgtgttccgggttgctgct

SEQ ID NO: 8771530 - DNA, 21 bp, Homo sapiens
ctctgtgttgagggtgttgag

SEQ ID NO: 8771531 - DNA, 22 bp, Homo sapiens
ttttgctggggtggctagctta

SEQ ID NO: 8771532 - DNA, 22 bp, Homo sapiens
ttttgctgttatatgctattat

SEQ ID NO: 8771533 - DNA, 22 bp, Homo sapiens
ttttgctgtgtccttgagccgg

SEQ ID NO: 8771534 - DNA, 22 bp, Homo sapiens
ttttgctggtttatctctatta

SEQ ID NO: 8771535 - DNA, 21 bp, Homo sapiens
ttttgctgttttagaatgaga

SEQ ID NO: 8771536 - DNA, 21 bp, Homo sapiens
ttttgctgttttagaatgaga

SEQ ID NO: 8771537 - DNA, 22 bp, Homo sapiens
ttttgcctgcactgtatatata

SEQ ID NO: 8771538 - DNA, 22 bp, Homo sapiens
ttttgcctgtgaatactatctt

SEQ ID NO: 8771539 - DNA, 22 bp, Homo sapiens
ttttgcctgagatccgagtctg

SEQ ID NO: 8771540 - DNA, 22 bp, Homo sapiens
ttttgcctgagatccgagtctg

SEQ ID NO: 8771541 - DNA, 22 bp, Homo sapiens
ttttgctgcattgaagtcagat

SEQ ID NO: 8771542 - DNA, 21 bp, Homo sapiens
ttttgctgaatggacacgtgc

SEQ ID NO: 8771543 - DNA, 22 bp, Homo sapiens
ttttgcctgcactgtatatata

SEQ ID NO: 8771544 - DNA, 23 bp, Homo sapiens
tttcagaagtggtcctaggaagc

SEQ ID NO: 8771545 - DNA, 23 bp, Homo sapiens
tttcagaagtggtcctaggaagc

SEQ ID NO: 8771546 - DNA, 22 bp, Homo sapiens
ctccttcagctgaatccctgct

SEQ ID NO: 8771547 - DNA, 22 bp, Homo sapiens
ctccttcacgcaggctgccatg

SEQ ID NO: 8771548 - DNA, 22 bp, Homo sapiens
ctccttcaaagtggaattaaga

SEQ ID NO: 8771549 - DNA, 22 bp, Homo sapiens
ctccttcacgcaggctgccatg

SEQ ID NO: 8771550 - DNA, 22 bp, Homo sapiens
ctccttcagtctgcgtggctgt

SEQ ID NO: 8771551 - DNA, 22 bp, Homo sapiens
ctccttcagctgaatccctgct

SEQ ID NO: 8771552 - DNA, 22 bp, Homo sapiens
ctccttcatgtcatgtgtccgg

SEQ ID NO: 8771553 - DNA, 22 bp, Homo sapiens
ctccttcagtctgcgtggctgt

SEQ ID NO: 8771554 - DNA, 22 bp, Homo sapiens
ctccttcatgtcatgtgtccgg

SEQ ID NO: 8771555 - DNA, 22 bp, Homo sapiens
ctccttcctgccccagtgataa

SEQ ID NO: 8771556 - DNA, 22 bp, Homo sapiens
ctccttcctgccccagtgataa

SEQ ID NO: 8771557 - DNA, 22 bp, Homo sapiens
ctccttcctgcagatctgagat

SEQ ID NO: 8771558 - DNA, 22 bp, Homo sapiens
ctccttcctgcagatctgagat

SEQ ID NO: 8771559 - DNA, 22 bp, Homo sapiens
ctccttcctgcagatctgagat

SEQ ID NO: 8771560 - DNA, 22 bp, Homo sapiens
ctccttcctgcagatctgagat

SEQ ID NO: 8771561 - DNA, 22 bp, Homo sapiens
ctccttcctggttagcacctta

SEQ ID NO: 8771562 - DNA, 22 bp, Homo sapiens
tttcagtttatgtcttgaatta

SEQ ID NO: 8771563 - DNA, 22 bp, Homo sapiens
tttcagtttcatggcacagcta

SEQ ID NO: 8771564 - DNA, 22 bp, Homo sapiens
ctccttccaacaagagaaagag

SEQ ID NO: 8771565 - DNA, 22 bp, Homo sapiens
ctccttccaacaagagaaagag

SEQ ID NO: 8771566 - DNA, 22 bp, Homo sapiens
ctccttcccatgagtgtgggca

SEQ ID NO: 8771567 - DNA, 22 bp, Homo sapiens
ctccttccctaccatcaatgtt

SEQ ID NO: 8771568 - DNA, 22 bp, Homo sapiens
ctccttcccctactcagcatcc

SEQ ID NO: 8771569 - DNA, 22 bp, Homo sapiens
ctccttccctaccatcaatgtt

SEQ ID NO: 8771570 - DNA, 22 bp, Homo sapiens
ctccttcccttcaagtgttcct

SEQ ID NO: 8771571 - DNA, 22 bp, Homo sapiens
ctccttcccttcaagtgttcct

SEQ ID NO: 8771572 - DNA, 19 bp, Homo sapiens
ctccttccctggtttctgt

SEQ ID NO: 8771573 - DNA, 19 bp, Homo sapiens
ctccttccctggtttctgt

SEQ ID NO: 8771574 - DNA, 22 bp, Homo sapiens
tttcagaaccaagagagacatc

SEQ ID NO: 8771575 - DNA, 22 bp, Homo sapiens
tttcagaaattgttattattct

SEQ ID NO: 8771576 - DNA, 22 bp, Homo sapiens
tttcagaaattgttattattct

SEQ ID NO: 8771577 - DNA, 22 bp, Homo sapiens
tttcagaaattatattagatgc

SEQ ID NO: 8771578 - DNA, 22 bp, Homo sapiens
tttcagaaattatattagatgc

SEQ ID NO: 8771579 - DNA, 22 bp, Homo sapiens
tttcagaaggggagaaaggtca

SEQ ID NO: 8771580 - DNA, 22 bp, Homo sapiens
tttcagaagtcaactaggtaaa

SEQ ID NO: 8771581 - DNA, 22 bp, Homo sapiens
tttcagaaccaagagagacatc

SEQ ID NO: 8771582 - DNA, 22 bp, Homo sapiens
tttcagaaccgctaaaataaat

SEQ ID NO: 8771583 - DNA, 22 bp, Homo sapiens
tttcagaaccgctaaaataaat

SEQ ID NO: 8771584 - DNA, 22 bp, Homo sapiens
tttcagaaccgctaaaataaat

SEQ ID NO: 8771585 - DNA, 22 bp, Homo sapiens
tttattcatcatctgttcatat

SEQ ID NO: 8771586 - DNA, 20 bp, Homo sapiens
tttattcagcctaccctctt

SEQ ID NO: 8771587 - DNA, 22 bp, Homo sapiens
tttattcatcatctgttcatat

SEQ ID NO: 8771588 - DNA, 22 bp, Homo sapiens
tttattcatcatctgttcatat

SEQ ID NO: 8771589 - DNA, 22 bp, Homo sapiens
tttattcatcatctgttcatat

SEQ ID NO: 8771590 - DNA, 22 bp, Homo sapiens
tttattcatcatctgttcatat

SEQ ID NO: 8771591 - DNA, 20 bp, Homo sapiens
tttattcagcctaccctctt

SEQ ID NO: 8771592 - DNA, 20 bp, Homo sapiens
tttattcagcctaccctctt

SEQ ID NO: 8771593 - DNA, 22 bp, Homo sapiens
tttattcagcagcagcagtggt

SEQ ID NO: 8771594 - DNA, 22 bp, Homo sapiens
tttattcagcagcagcagtggt

SEQ ID NO: 8771595 - DNA, 22 bp, Homo sapiens
tttattcagcagcagcagtggt

SEQ ID NO: 8771596 - DNA, 22 bp, Homo sapiens
tttattcatcatctgttcatat

SEQ ID NO: 8771597 - DNA, 22 bp, Homo sapiens
tttattcattgtttcgtcgcag

SEQ ID NO: 8771598 - DNA, 22 bp, Homo sapiens
tttattcattgtttcgtcgcag

SEQ ID NO: 8771599 - DNA, 22 bp, Homo sapiens
tttattcattgtttcgtcgcag

SEQ ID NO: 8771600 - DNA, 22 bp, Homo sapiens
tttcacatataggggaagctac

SEQ ID NO: 8771601 - DNA, 22 bp, Homo sapiens
tttcacatataggggaagctac

SEQ ID NO: 8771602 - DNA, 22 bp, Homo sapiens
tttattcactggggtctgcccg

SEQ ID NO: 8771603 - DNA, 22 bp, Homo sapiens
tttattcacttcagtgccaaag

SEQ ID NO: 8771604 - DNA, 22 bp, Homo sapiens
tttattcactggggtctgcccg

SEQ ID NO: 8771605 - DNA, 22 bp, Homo sapiens
tttattcactggggtctgcccg

SEQ ID NO: 8771606 - DNA, 22 bp, Homo sapiens
tttattcacttcagtgccaaag

SEQ ID NO: 8771607 - DNA, 22 bp, Homo sapiens
tttattcagcagcagcagtggt

SEQ ID NO: 8771608 - DNA, 22 bp, Homo sapiens
tttattcacttcagtgccaaag

SEQ ID NO: 8771609 - DNA, 19 bp, Homo sapiens
tttattcacctttaccttg

SEQ ID NO: 8771610 - DNA, 22 bp, Homo sapiens
tttattcactcattcagccagt

SEQ ID NO: 8771611 - DNA, 22 bp, Homo sapiens
tttattcactcattcagccagt

SEQ ID NO: 8771612 - DNA, 22 bp, Homo sapiens
tttattcactcattcagccagt

SEQ ID NO: 8771613 - DNA, 19 bp, Homo sapiens
tttattcacctttaccttg

SEQ ID NO: 8771614 - DNA, 19 bp, Homo sapiens
tttattcacctttaccttg

SEQ ID NO: 8771615 - DNA, 21 bp, Homo sapiens
tttatgcatgcctctctgtca

SEQ ID NO: 8771616 - DNA, 22 bp, Homo sapiens
tttatgcagcgtttcaccaccc

SEQ ID NO: 8771617 - DNA, 22 bp, Homo sapiens
tttatgcatctctaggaagggc

SEQ ID NO: 8771618 - DNA, 22 bp, Homo sapiens
tttatgctactcaatagtcagt

SEQ ID NO: 8771619 - DNA, 22 bp, Homo sapiens
tttatgattattttaaagcagc

SEQ ID NO: 8771620 - DNA, 22 bp, Homo sapiens
tttatgattattttaaagcagc

SEQ ID NO: 8771621 - DNA, 21 bp, Homo sapiens
tttatgcagataatgctattt

SEQ ID NO: 8771622 - DNA, 22 bp, Homo sapiens
tttatgcacaattagtcttata

SEQ ID NO: 8771623 - DNA, 22 bp, Homo sapiens
tttatgcagatttgtacagtga

SEQ ID NO: 8771624 - DNA, 22 bp, Homo sapiens
tttatgcagatttgtacagtga

SEQ ID NO: 8771625 - DNA, 22 bp, Homo sapiens
tttatgcagcactttacatttg

SEQ ID NO: 8771626 - DNA, 22 bp, Homo sapiens
ctccaggatacctgttcctata

SEQ ID NO: 8771627 - DNA, 19 bp, Homo sapiens
ctccaggatggctgggcga

SEQ ID NO: 8771628 - DNA, 22 bp, Homo sapiens
ctccaggatgttagacgtccag

SEQ ID NO: 8771629 - DNA, 19 bp, Homo sapiens
ctccaggatggctgggcga

SEQ ID NO: 8771630 - DNA, 22 bp, Homo sapiens
ctccaggactgaggacagagct

SEQ ID NO: 8771631 - DNA, 22 bp, Homo sapiens
ctccaggagctgtgtctttctt

SEQ ID NO: 8771632 - DNA, 22 bp, Homo sapiens
ctccaggactgaggacagagct

SEQ ID NO: 8771633 - DNA, 22 bp, Homo sapiens
ctccaggagtggcctggacacc

SEQ ID NO: 8771634 - DNA, 22 bp, Homo sapiens
ctccaggaggttgctgcttcct

SEQ ID NO: 8771635 - DNA, 22 bp, Homo sapiens
ctccaggaggttgctgcttcct

SEQ ID NO: 8771636 - DNA, 23 bp, Homo sapiens
tttatattcctaatgtcttgagc

SEQ ID NO: 8771637 - DNA, 23 bp, Homo sapiens
tttatattcctaatgtcttgagc

SEQ ID NO: 8771638 - DNA, 22 bp, Homo sapiens
ctccaggcccacgtcgaggagg

SEQ ID NO: 8771639 - DNA, 22 bp, Homo sapiens
ctccaggccatggctgcggagg

SEQ ID NO: 8771640 - DNA, 22 bp, Homo sapiens
ctccaggccatggctgcggagg

SEQ ID NO: 8771641 - DNA, 22 bp, Homo sapiens
ctccaggccatggctgcggagg

SEQ ID NO: 8771642 - DNA, 22 bp, Homo sapiens
ctccaggccatggctgcggagg

SEQ ID NO: 8771643 - DNA, 22 bp, Homo sapiens
ctccaggcccacgtcgaggagg

SEQ ID NO: 8771644 - DNA, 22 bp, Homo sapiens
ctccaggcccacggccgcggcc

SEQ ID NO: 8771645 - DNA, 22 bp, Homo sapiens
ctccaggcccacggccgcggcc

SEQ ID NO: 8771646 - DNA, 22 bp, Homo sapiens
ctccaggccagggaagtggaca

SEQ ID NO: 8771647 - DNA, 22 bp, Homo sapiens
ctccaggccaagattaagtaat

SEQ ID NO: 8771648 - DNA, 22 bp, Homo sapiens
ctccaggccatggctgcggagg

SEQ ID NO: 8771649 - DNA, 19 bp, Homo sapiens
ctctctggcggtgtctgcg

SEQ ID NO: 8771650 - DNA, 18 bp, Homo sapiens
ctctctggtctggatccc

SEQ ID NO: 8771651 - DNA, 19 bp, Homo sapiens
ctctctggcggtgtctgcg

SEQ ID NO: 8771652 - DNA, 19 bp, Homo sapiens
ctctctggcggtgtctgcg

SEQ ID NO: 8771653 - DNA, 18 bp, Homo sapiens
tttctcaaggctgacatt

SEQ ID NO: 8771654 - DNA, 22 bp, Homo sapiens
tttctcaactgtattatgcaga

SEQ ID NO: 8771655 - DNA, 22 bp, Homo sapiens
tttctcaagtactgcacatgaa

SEQ ID NO: 8771656 - DNA, 22 bp, Homo sapiens
tttctacagctggtgcaacttt

SEQ ID NO: 8771657 - DNA, 22 bp, Homo sapiens
tttctacatgtcaatccaaacc

SEQ ID NO: 8771658 - DNA, 22 bp, Homo sapiens
tttctattttaaaggcatatgg

SEQ ID NO: 8771659 - DNA, 22 bp, Homo sapiens
tttctcaacctcaacactattt

SEQ ID NO: 8771660 - DNA, 22 bp, Homo sapiens
ctctctgttatgctttcatgaa

SEQ ID NO: 8771661 - DNA, 22 bp, Homo sapiens
ctctctttcattggtcgccttg

SEQ ID NO: 8771662 - DNA, 22 bp, Homo sapiens
ctctcttcccgtgagtgttgca

SEQ ID NO: 8771663 - DNA, 18 bp, Homo sapiens
ctctctttccactctttg

SEQ ID NO: 8771664 - DNA, 22 bp, Homo sapiens
ctctctggtttcagcgaagggg

SEQ ID NO: 8771665 - DNA, 22 bp, Homo sapiens
ctctctggtttcagcgaagggg

SEQ ID NO: 8771666 - DNA, 22 bp, Homo sapiens
ctctctggtttcagcgaagggg

SEQ ID NO: 8771667 - DNA, 22 bp, Homo sapiens
ctctctgtatgtgtatatttat

SEQ ID NO: 8771668 - DNA, 18 bp, Homo sapiens
ctctctggtctggatccc

SEQ ID NO: 8771669 - DNA, 22 bp, Homo sapiens
ctctgaaagcaaaactagagaa

SEQ ID NO: 8771670 - DNA, 22 bp, Homo sapiens
ctctgaaagcaaaactagagaa

SEQ ID NO: 8771671 - DNA, 22 bp, Homo sapiens
ctctgaaagcaaaactagagaa

SEQ ID NO: 8771672 - DNA, 22 bp, Homo sapiens
ctctgaaagcaaaactagagaa

SEQ ID NO: 8771673 - DNA, 22 bp, Homo sapiens
ctctgaaagttagagaaaatag

SEQ ID NO: 8771674 - DNA, 22 bp, Homo sapiens
ctctgaaattggccctcagcag

SEQ ID NO: 8771675 - DNA, 22 bp, Homo sapiens
ctctgaaagttagagaaaatag

SEQ ID NO: 8771676 - DNA, 22 bp, Homo sapiens
ctctgaaagttagagaaaatag

SEQ ID NO: 8771677 - DNA, 22 bp, Homo sapiens
ctctgaaagagtttagtattat

SEQ ID NO: 8771678 - DNA, 22 bp, Homo sapiens
ctctgaaagacaagctctcatt

SEQ ID NO: 8771679 - DNA, 18 bp, Homo sapiens
ctctgaaagacacaccag

SEQ ID NO: 8771680 - DNA, 18 bp, Homo sapiens
ctctctttccactctttg

SEQ ID NO: 8771681 - DNA, 18 bp, Homo sapiens
ctctctttccactctttg

SEQ ID NO: 8771682 - DNA, 18 bp, Homo sapiens
ctctctttccactctttg

SEQ ID NO: 8771683 - DNA, 22 bp, Homo sapiens
ctctctttctgaatgaggacta

SEQ ID NO: 8771684 - DNA, 22 bp, Homo sapiens
ctctgaaaatgtggtggggaaa

SEQ ID NO: 8771685 - DNA, 22 bp, Homo sapiens
ctctgaaactccagccccaggt

SEQ ID NO: 8771686 - DNA, 22 bp, Homo sapiens
ctctgaaactcctgcaccttct

SEQ ID NO: 8771687 - DNA, 22 bp, Homo sapiens
ctctctttgatgtataaataat

SEQ ID NO: 8771688 - DNA, 22 bp, Homo sapiens
ctctctttgatgtataaataat

SEQ ID NO: 8771689 - DNA, 22 bp, Homo sapiens
ctctctttttcgtgtgccgaag

SEQ ID NO: 8771690 - DNA, 22 bp, Homo sapiens
tttctacagaagatacactgct

SEQ ID NO: 8771691 - DNA, 22 bp, Homo sapiens
tttctacacttcgtggtgtttt

SEQ ID NO: 8771692 - DNA, 22 bp, Homo sapiens
tttctacaacacttctgaatct

SEQ ID NO: 8771693 - DNA, 22 bp, Homo sapiens
tttctacaacacttctgaatct

SEQ ID NO: 8771694 - DNA, 22 bp, Homo sapiens
tttcctttctagaagcctaaat

SEQ ID NO: 8771695 - DNA, 22 bp, Homo sapiens
tttcctttctcaagagccggca

SEQ ID NO: 8771696 - DNA, 22 bp, Homo sapiens
tttctacagctggtgcaacttt

SEQ ID NO: 8771697 - DNA, 22 bp, Homo sapiens
tttctacagaagatacactgct

SEQ ID NO: 8771698 - DNA, 22 bp, Homo sapiens
tttctacagtactgatttcata

SEQ ID NO: 8771699 - DNA, 22 bp, Homo sapiens
tttccactctggccaccatctt

SEQ ID NO: 8771700 - DNA, 22 bp, Homo sapiens
tttcctttctagaagcctaaat

SEQ ID NO: 8771701 - DNA, 22 bp, Homo sapiens
tttccacactgcagccagcaaa

SEQ ID NO: 8771702 - DNA, 22 bp, Homo sapiens
tttccacagctgtataaaataa

SEQ ID NO: 8771703 - DNA, 22 bp, Homo sapiens
tttccacactgcagccagcaaa

SEQ ID NO: 8771704 - DNA, 22 bp, Homo sapiens
tttccacactgcagccagcaaa

SEQ ID NO: 8771705 - DNA, 22 bp, Homo sapiens
tttccactcctattgcatctca

SEQ ID NO: 8771706 - DNA, 22 bp, Homo sapiens
tttccacccagagcatttgttt

SEQ ID NO: 8771707 - DNA, 22 bp, Homo sapiens
tttccacagctgtataaaataa

SEQ ID NO: 8771708 - DNA, 22 bp, Homo sapiens
tttccaatttttaagtggatga

SEQ ID NO: 8771709 - DNA, 22 bp, Homo sapiens
tttccaatttggtagtcatcgg

SEQ ID NO: 8771710 - DNA, 22 bp, Homo sapiens
tttccaattcaagcttttacgt

SEQ ID NO: 8771711 - DNA, 22 bp, Homo sapiens
tttccaattcaagcttttacgt

SEQ ID NO: 8771712 - DNA, 22 bp, Homo sapiens
tttccaattcaagcttttacgt

SEQ ID NO: 8771713 - DNA, 22 bp, Homo sapiens
tttccacaatttgagcagcaga

SEQ ID NO: 8771714 - DNA, 22 bp, Homo sapiens
tttccacaatttgagcagcaga

SEQ ID NO: 8771715 - DNA, 22 bp, Homo sapiens
tttccacaatttgagcagcaga

SEQ ID NO: 8771716 - DNA, 22 bp, Homo sapiens
tttccacaatgtttttgcagga

SEQ ID NO: 8771717 - DNA, 22 bp, Homo sapiens
tttccacacaggctctactact

SEQ ID NO: 8771718 - DNA, 18 bp, Homo sapiens
tttcattataaagcaggc

SEQ ID NO: 8771719 - DNA, 22 bp, Homo sapiens
tttccaagataatacacagaaa

SEQ ID NO: 8771720 - DNA, 22 bp, Homo sapiens
tttccaactgtaccccagtgtt

SEQ ID NO: 8771721 - DNA, 18 bp, Homo sapiens
tttccaagaagagagctc

SEQ ID NO: 8771722 - DNA, 22 bp, Homo sapiens
tttccaataaggtcaccttcct

SEQ ID NO: 8771723 - DNA, 22 bp, Homo sapiens
tttccaagtactgagctgtcaa

SEQ ID NO: 8771724 - DNA, 22 bp, Homo sapiens
tttcattaaagtcaaatctggt

SEQ ID NO: 8771725 - DNA, 22 bp, Homo sapiens
tttcatgtttatggaaaatgag

SEQ ID NO: 8771726 - DNA, 22 bp, Homo sapiens
tttcatgttacatttaaaatgt

SEQ ID NO: 8771727 - DNA, 22 bp, Homo sapiens
tttcatgttacatttaaaatgt

SEQ ID NO: 8771728 - DNA, 22 bp, Homo sapiens
tttcatgttattaatagtgctg

SEQ ID NO: 8771729 - DNA, 22 bp, Homo sapiens
tttcatgttattaatagtgctg

SEQ ID NO: 8771730 - DNA, 22 bp, Homo sapiens
tttcatgttggatactgtttca

SEQ ID NO: 8771731 - DNA, 22 bp, Homo sapiens
tttcagtttccagctttgtcat

SEQ ID NO: 8771732 - DNA, 23 bp, Homo sapiens
tttcatgttggcatgactgactt

SEQ ID NO: 8771733 - DNA, 23 bp, Homo sapiens
tttcatgttggcatgactgactt

SEQ ID NO: 8771734 - DNA, 22 bp, Homo sapiens
tttcatgtttatggaaaatgag

SEQ ID NO: 8771735 - DNA, 22 bp, Homo sapiens
ctggagataagtaaagaggcaa

SEQ ID NO: 8771736 - DNA, 22 bp, Homo sapiens
ctggagataagcagtcccaggc

SEQ ID NO: 8771737 - DNA, 19 bp, Homo sapiens
ctggagatagggcctttaa

SEQ ID NO: 8771738 - DNA, 22 bp, Homo sapiens
ctggagatgtccgggtgctgtt

SEQ ID NO: 8771739 - DNA, 22 bp, Homo sapiens
ctggagatgtccgggtgctgtt

SEQ ID NO: 8771740 - DNA, 22 bp, Homo sapiens
ctggagattaagttctcagcca

SEQ ID NO: 8771741 - DNA, 22 bp, Homo sapiens
ctggagatgtccgggtgctgtt

SEQ ID NO: 8771742 - DNA, 22 bp, Homo sapiens
ctggagagttggaagatggact

SEQ ID NO: 8771743 - DNA, 22 bp, Homo sapiens
ctggagagttggaagatggact

SEQ ID NO: 8771744 - DNA, 22 bp, Homo sapiens
ctggagagttggaagatggact

SEQ ID NO: 8771745 - DNA, 22 bp, Homo sapiens
ctggagagttggaagatggact

SEQ ID NO: 8771746 - DNA, 22 bp, Homo sapiens
ctggagagggagctgttggaag

SEQ ID NO: 8771747 - DNA, 22 bp, Homo sapiens
ctggagagggagctgttggaag

SEQ ID NO: 8771748 - DNA, 22 bp, Homo sapiens
ctggagagggagccctggcagt

SEQ ID NO: 8771749 - DNA, 22 bp, Homo sapiens
ctggagaggctgggaacaggtt

SEQ ID NO: 8771750 - DNA, 22 bp, Homo sapiens
ctggagaggctgggaacaggtt

SEQ ID NO: 8771751 - DNA, 22 bp, Homo sapiens
ctggagaggctgggaacaggtt

SEQ ID NO: 8771752 - DNA, 22 bp, Homo sapiens
ctggagaggccccaagatattt

SEQ ID NO: 8771753 - DNA, 22 bp, Homo sapiens
ctggagaggccccaagatattt

SEQ ID NO: 8771754 - DNA, 22 bp, Homo sapiens
ctggagcctgcagttttcactt

SEQ ID NO: 8771755 - DNA, 22 bp, Homo sapiens
ctggagccggcgagccccagcc

SEQ ID NO: 8771756 - DNA, 22 bp, Homo sapiens
ctggagccggcgagccccagcc

SEQ ID NO: 8771757 - DNA, 22 bp, Homo sapiens
ctggagccggcgagccccagcc

SEQ ID NO: 8771758 - DNA, 22 bp, Homo sapiens
ctggagccggaccagggacggt

SEQ ID NO: 8771759 - DNA, 22 bp, Homo sapiens
ctggagcagcaggtggccaggg

SEQ ID NO: 8771760 - DNA, 22 bp, Homo sapiens
ctggagcagcaggtggccaggg

SEQ ID NO: 8771761 - DNA, 22 bp, Homo sapiens
ctggagcaggcttgtcccagct

SEQ ID NO: 8771762 - DNA, 22 bp, Homo sapiens
ctggagcaggcttgtcccagct

SEQ ID NO: 8771763 - DNA, 22 bp, Homo sapiens
ctggagcaggcttgtcccagct

SEQ ID NO: 8771764 - DNA, 22 bp, Homo sapiens
ctggagcatccatgcccagggt

SEQ ID NO: 8771765 - DNA, 22 bp, Homo sapiens
ctggaaggtaacaaggccatta

SEQ ID NO: 8771766 - DNA, 22 bp, Homo sapiens
ctggaaggtctgtccccactgc

SEQ ID NO: 8771767 - DNA, 22 bp, Homo sapiens
ctggaaggtggatggcgaggcc

SEQ ID NO: 8771768 - DNA, 22 bp, Homo sapiens
ctggaaggtgactgtcttgaat

SEQ ID NO: 8771769 - DNA, 22 bp, Homo sapiens
ctggaagggtcagagtgatgag

SEQ ID NO: 8771770 - DNA, 22 bp, Homo sapiens
ctggaagggtcagagtgatgag

SEQ ID NO: 8771771 - DNA, 22 bp, Homo sapiens
ctggaagggtcagagtgatgag

SEQ ID NO: 8771772 - DNA, 22 bp, Homo sapiens
ctggaagggtctacttagcaga

SEQ ID NO: 8771773 - DNA, 22 bp, Homo sapiens
ctggaagggtctacttagcaga

SEQ ID NO: 8771774 - DNA, 22 bp, Homo sapiens
ctggaaggtaacaaggccatta

SEQ ID NO: 8771775 - DNA, 22 bp, Homo sapiens
ctggaaggttcctcccagctcc

SEQ ID NO: 8771776 - DNA, 22 bp, Homo sapiens
ctggagaactagttaaacacgt

SEQ ID NO: 8771777 - DNA, 22 bp, Homo sapiens
ctggagagaccgaaagaggctg

SEQ ID NO: 8771778 - DNA, 22 bp, Homo sapiens
ctggagagaccgaaagaggctg

SEQ ID NO: 8771779 - DNA, 22 bp, Homo sapiens
ctggagaactagttaaacacgt

SEQ ID NO: 8771780 - DNA, 22 bp, Homo sapiens
ctggagaaacatcaggcatagg

SEQ ID NO: 8771781 - DNA, 22 bp, Homo sapiens
ctggaagggaaatctcttggca

SEQ ID NO: 8771782 - DNA, 22 bp, Homo sapiens
ctggaagggagcactgtagaga

SEQ ID NO: 8771783 - DNA, 22 bp, Homo sapiens
ctggaaggctctgctgcctgtc

SEQ ID NO: 8771784 - DNA, 22 bp, Homo sapiens
ctggaagggaaatctcttggca

SEQ ID NO: 8771785 - DNA, 22 bp, Homo sapiens
ctggaagggtacataggaaact

SEQ ID NO: 8771786 - DNA, 22 bp, Homo sapiens
ctggaaggggcagtctttgggc

SEQ ID NO: 8771787 - DNA, 22 bp, Homo sapiens
ctggaagggggacagccacaca

SEQ ID NO: 8771788 - DNA, 22 bp, Homo sapiens
ctggaaggagaaggaggctgtg

SEQ ID NO: 8771789 - DNA, 22 bp, Homo sapiens
ctggaaggagaaggaggctgtg

SEQ ID NO: 8771790 - DNA, 22 bp, Homo sapiens
ctggaaggagcccgggcggatc

SEQ ID NO: 8771791 - DNA, 19 bp, Homo sapiens
ctggaaggagggactgttc

SEQ ID NO: 8771792 - DNA, 19 bp, Homo sapiens
ctggaaggagggactgttc

SEQ ID NO: 8771793 - DNA, 19 bp, Homo sapiens
ctggaaggagggactgttc

SEQ ID NO: 8771794 - DNA, 22 bp, Homo sapiens
ctggaaggcggaggttgtagtg

SEQ ID NO: 8771795 - DNA, 22 bp, Homo sapiens
ctggaaggcagaggttgcagtg

SEQ ID NO: 8771796 - DNA, 22 bp, Homo sapiens
ctggaaggcagaggttgcagtg

SEQ ID NO: 8771797 - DNA, 22 bp, Homo sapiens
ctggaaggagaaggaggctgtg

SEQ ID NO: 8771798 - DNA, 22 bp, Homo sapiens
ctggaaggagaaggaggctgtg

SEQ ID NO: 8771799 - DNA, 22 bp, Homo sapiens
ctggaaagtgtctccatcctgg

SEQ ID NO: 8771800 - DNA, 22 bp, Homo sapiens
ctggaagaggaagccagctgga

SEQ ID NO: 8771801 - DNA, 22 bp, Homo sapiens
ctggaagaggggaaatgccatg

SEQ ID NO: 8771802 - DNA, 22 bp, Homo sapiens
ctggaagaggacacacgaatca

SEQ ID NO: 8771803 - DNA, 22 bp, Homo sapiens
ctggaagagtcctaaacagata

SEQ ID NO: 8771804 - DNA, 22 bp, Homo sapiens
ctgctgtctttatttcactgct

SEQ ID NO: 8771805 - DNA, 22 bp, Homo sapiens
ctgctgtgagtggttcttgcct

SEQ ID NO: 8771806 - DNA, 22 bp, Homo sapiens
ctgctgtgagcactccagcctg

SEQ ID NO: 8771807 - DNA, 22 bp, Homo sapiens
ctgctgtgacagctgccgtgtt

SEQ ID NO: 8771808 - DNA, 23 bp, Homo sapiens
ctgctgtgaaacatggttttggt

SEQ ID NO: 8771809 - DNA, 22 bp, Homo sapiens
ctgctgtgacagctgccgtgtt

SEQ ID NO: 8771810 - DNA, 22 bp, Homo sapiens
ctggaaagtcaggtcagaaact

SEQ ID NO: 8771811 - DNA, 22 bp, Homo sapiens
ctgctgtgagtttggaggtcta

SEQ ID NO: 8771812 - DNA, 22 bp, Homo sapiens
ctggaaagtgcttttctgagag

SEQ ID NO: 8771813 - DNA, 22 bp, Homo sapiens
ctggaaagtgctgagacaattg

SEQ ID NO: 8771814 - DNA, 22 bp, Homo sapiens
ctgcctgtggtctgtgatctaa

SEQ ID NO: 8771815 - DNA, 22 bp, Homo sapiens
ctgcctgtggtctgtgatctaa

SEQ ID NO: 8771816 - DNA, 19 bp, Homo sapiens
ctgcctgttatggagagaa

SEQ ID NO: 8771817 - DNA, 22 bp, Homo sapiens
ctgcctgtgtgtgcctgcagaa

SEQ ID NO: 8771818 - DNA, 22 bp, Homo sapiens
ctgcctgtgtgtgcctgcagaa

SEQ ID NO: 8771819 - DNA, 22 bp, Homo sapiens
ctgcctggggaatgtgaggatt

SEQ ID NO: 8771820 - DNA, 22 bp, Homo sapiens
ctgcccctgccaggcagctgtc

SEQ ID NO: 8771821 - DNA, 22 bp, Homo sapiens
ctgcctgtggacaccctggagg

SEQ ID NO: 8771822 - DNA, 22 bp, Homo sapiens
ctgcctggggaatgtgaggatt

SEQ ID NO: 8771823 - DNA, 22 bp, Homo sapiens
ctgccttctttcaagggtaagc

SEQ ID NO: 8771824 - DNA, 22 bp, Homo sapiens
ctgccttgcaccggctctctgg

SEQ ID NO: 8771825 - DNA, 21 bp, Homo sapiens
ctgccttgaatggtactggga

SEQ ID NO: 8771826 - DNA, 22 bp, Homo sapiens
ctgccttccaaccccagactcc

SEQ ID NO: 8771827 - DNA, 22 bp, Homo sapiens
ctgccttccaaccccagactcc

SEQ ID NO: 8771828 - DNA, 22 bp, Homo sapiens
ctgccttccaaccccagactcc

SEQ ID NO: 8771829 - DNA, 22 bp, Homo sapiens
ctgccttcatctctgagctggg

SEQ ID NO: 8771830 - DNA, 22 bp, Homo sapiens
ctgccttcatctctgagctggg

SEQ ID NO: 8771831 - DNA, 22 bp, Homo sapiens
ctgccttaaaagtacttttact

SEQ ID NO: 8771832 - DNA, 22 bp, Homo sapiens
ctgcctgttttctgatagattt

SEQ ID NO: 8771833 - DNA, 22 bp, Homo sapiens
ctgcctgtttcctcttgctccc

SEQ ID NO: 8771834 - DNA, 22 bp, Homo sapiens
ctgctctgagaggctcttccta

SEQ ID NO: 8771835 - DNA, 22 bp, Homo sapiens
ctgctctgttaattaaactttg

SEQ ID NO: 8771836 - DNA, 22 bp, Homo sapiens
ctgctctgtggtccatgagaca

SEQ ID NO: 8771837 - DNA, 22 bp, Homo sapiens
ctgctctgaccctttcaccttc

SEQ ID NO: 8771838 - DNA, 22 bp, Homo sapiens
ctgctctgaccctttcaccttc

SEQ ID NO: 8771839 - DNA, 21 bp, Homo sapiens
ctgctctgacagtgaggccag

SEQ ID NO: 8771840 - DNA, 22 bp, Homo sapiens
ctgctctgtttcttagctgggt

SEQ ID NO: 8771841 - DNA, 22 bp, Homo sapiens
ctgctctgtttcttagctgggt

SEQ ID NO: 8771842 - DNA, 22 bp, Homo sapiens
ctgctctgtttcttagctgggt

SEQ ID NO: 8771843 - DNA, 22 bp, Homo sapiens
ctgctcttcacactacacccgt

SEQ ID NO: 8771844 - DNA, 22 bp, Homo sapiens
ctgctctgttaattaaactttg

SEQ ID NO: 8771845 - DNA, 21 bp, Homo sapiens
ctgctctgacagtgaggccag

SEQ ID NO: 8771846 - DNA, 21 bp, Homo sapiens
ctgctctgacagtgaggccag

SEQ ID NO: 8771847 - DNA, 22 bp, Homo sapiens
ctgcgcaggggtggcgccagaa

SEQ ID NO: 8771848 - DNA, 22 bp, Homo sapiens
ctgcgcaggggtggcgccagaa

SEQ ID NO: 8771849 - DNA, 22 bp, Homo sapiens
ctgcgatggctgtatgtgctca

SEQ ID NO: 8771850 - DNA, 22 bp, Homo sapiens
ctgcctttggggagttagaggg

SEQ ID NO: 8771851 - DNA, 22 bp, Homo sapiens
ctgccttttaaagccagtgtta

SEQ ID NO: 8771852 - DNA, 22 bp, Homo sapiens
ctgcctttggaagtccagagct

SEQ ID NO: 8771853 - DNA, 22 bp, Homo sapiens
ctgccttttcatctgagctgga

SEQ ID NO: 8771854 - DNA, 22 bp, Homo sapiens
ctgcctttgtgatcagttcttt

SEQ ID NO: 8771855 - DNA, 22 bp, Homo sapiens
ctgcctttgtgatcagttcttt

SEQ ID NO: 8771856 - DNA, 22 bp, Homo sapiens
ctgcctttgcccttgacactgt

SEQ ID NO: 8771857 - DNA, 22 bp, Homo sapiens
ctgcctttgcccttgacactgt

SEQ ID NO: 8771858 - DNA, 22 bp, Homo sapiens
ctgcctttgcccttgacactgt

SEQ ID NO: 8771859 - DNA, 22 bp, Homo sapiens
ctgccttggccctagttcatgg

SEQ ID NO: 8771860 - DNA, 22 bp, Homo sapiens
ctgccttggtttctagcagggc

SEQ ID NO: 8771861 - DNA, 22 bp, Homo sapiens
ctgccttggttcccagccagca

SEQ ID NO: 8771862 - DNA, 22 bp, Homo sapiens
ctgccttgcaccggctctctgg

SEQ ID NO: 8771863 - DNA, 22 bp, Homo sapiens
ctgctgtcccagcctcctcaca

SEQ ID NO: 8771864 - DNA, 22 bp, Homo sapiens
ctgctgtcaaaaatcactccat

SEQ ID NO: 8771865 - DNA, 22 bp, Homo sapiens
ctgctggtgcagagtggggctg

SEQ ID NO: 8771866 - DNA, 22 bp, Homo sapiens
ctgctggtgatgtctgggcatg

SEQ ID NO: 8771867 - DNA, 22 bp, Homo sapiens
ctgctggtgatgtctgggcatg

SEQ ID NO: 8771868 - DNA, 22 bp, Homo sapiens
ctgctggtgatgtctgggcatg

SEQ ID NO: 8771869 - DNA, 22 bp, Homo sapiens
ctgctggtgggaatttacaaga

SEQ ID NO: 8771870 - DNA, 22 bp, Homo sapiens
ctgctggttagtcttagtggga

SEQ ID NO: 8771871 - DNA, 22 bp, Homo sapiens
ctgctgtcaaaaatcactccat

SEQ ID NO: 8771872 - DNA, 22 bp, Homo sapiens
ctgctgtaataggagcgttttg

SEQ ID NO: 8771873 - DNA, 22 bp, Homo sapiens
ctgctgggtctatgcaagtgga

SEQ ID NO: 8771874 - DNA, 22 bp, Homo sapiens
ctgctgggtctatgcaagtgga

SEQ ID NO: 8771875 - DNA, 22 bp, Homo sapiens
ctgctgggtctatgcaagtgga

SEQ ID NO: 8771876 - DNA, 22 bp, Homo sapiens
ctgctgggtccccctgctgatt

SEQ ID NO: 8771877 - DNA, 22 bp, Homo sapiens
ctgctgggcagaggctgcatga

SEQ ID NO: 8771878 - DNA, 22 bp, Homo sapiens
ctgctgggtccccctgctgatt

SEQ ID NO: 8771879 - DNA, 22 bp, Homo sapiens
ctgctgggtccccctgctgatt

SEQ ID NO: 8771880 - DNA, 22 bp, Homo sapiens
ctgctgggtccccctgctgatt

SEQ ID NO: 8771881 - DNA, 19 bp, Homo sapiens
ctgctgggtgctgagggag

SEQ ID NO: 8771882 - DNA, 19 bp, Homo sapiens
ctgctgggtgctgagggag

SEQ ID NO: 8771883 - DNA, 22 bp, Homo sapiens
ctgctggtaccagtggccgtca

SEQ ID NO: 8771884 - DNA, 22 bp, Homo sapiens
ctgctggtaccagtggccgtca

SEQ ID NO: 8771885 - DNA, 22 bp, Homo sapiens
ctgctgggtttgcctttcacca

SEQ ID NO: 8771886 - DNA, 22 bp, Homo sapiens
ctgctgacaaaataaaatgctc

SEQ ID NO: 8771887 - DNA, 22 bp, Homo sapiens
ctgctgaaaacaataatgatga

SEQ ID NO: 8771888 - DNA, 22 bp, Homo sapiens
ctgctcttcccactcactccca

SEQ ID NO: 8771889 - DNA, 22 bp, Homo sapiens
ctgctcttgagggactgcggtc

SEQ ID NO: 8771890 - DNA, 22 bp, Homo sapiens
ctgctgagagatgccaatctca

SEQ ID NO: 8771891 - DNA, 22 bp, Homo sapiens
ctgctgagagatgccaatctca

SEQ ID NO: 8771892 - DNA, 22 bp, Homo sapiens
ctgctgactcttcctggagtga

SEQ ID NO: 8771893 - DNA, 22 bp, Homo sapiens
ctgctgagaaaagactgaggga

SEQ ID NO: 8771894 - DNA, 22 bp, Homo sapiens
ctgctgagaaatgcatccagtt

SEQ ID NO: 8771895 - DNA, 22 bp, Homo sapiens
ctgctgacttacactgtttatt

SEQ ID NO: 8771896 - DNA, 22 bp, Homo sapiens
ctgctgagatgccaggagctct

SEQ ID NO: 8771897 - DNA, 20 bp, Homo sapiens
ctgctgagagcctggcttgc

SEQ ID NO: 8771898 - DNA, 22 bp, Homo sapiens
ctgctgagagccccagctgaga

SEQ ID NO: 8771899 - DNA, 22 bp, Homo sapiens
ctgctgagagccccagctgaga

SEQ ID NO: 8771900 - DNA, 22 bp, Homo sapiens
ctgctgagagccccagctgaga

SEQ ID NO: 8771901 - DNA, 22 bp, Homo sapiens
ctgctgggatagaagtatctca

SEQ ID NO: 8771902 - DNA, 22 bp, Homo sapiens
ctgctgggaaggtctgctcagt

SEQ ID NO: 8771903 - DNA, 22 bp, Homo sapiens
ctgctgggaaggtctgctcagt

SEQ ID NO: 8771904 - DNA, 22 bp, Homo sapiens
ctgctgggcagaggctgcatga

SEQ ID NO: 8771905 - DNA, 22 bp, Homo sapiens
ctgctgggaaggtctgctcagt

SEQ ID NO: 8771906 - DNA, 22 bp, Homo sapiens
ctgctgagatgccaggagctct

SEQ ID NO: 8771907 - DNA, 22 bp, Homo sapiens
ctgaggctcagcgtgaggaaag

SEQ ID NO: 8771908 - DNA, 22 bp, Homo sapiens
ctgaggctcaagggcaggtggg

SEQ ID NO: 8771909 - DNA, 22 bp, Homo sapiens
ctgaggctcaagggcaggtggg

SEQ ID NO: 8771910 - DNA, 22 bp, Homo sapiens
ctgaggctcaagggcaggtggg

SEQ ID NO: 8771911 - DNA, 22 bp, Homo sapiens
ctgaggctcaagggcaggtggg

SEQ ID NO: 8771912 - DNA, 22 bp, Homo sapiens
ctgaggctagtataaagagcat

SEQ ID NO: 8771913 - DNA, 22 bp, Homo sapiens
ctgaggctaacctcgagagaca

SEQ ID NO: 8771914 - DNA, 22 bp, Homo sapiens
ctgaggctaacctcgagagaca

SEQ ID NO: 8771915 - DNA, 22 bp, Homo sapiens
ctgaggcctgtgttggggcagt

SEQ ID NO: 8771916 - DNA, 22 bp, Homo sapiens
ctgaggcctgtgttggggcagt

SEQ ID NO: 8771917 - DNA, 22 bp, Homo sapiens
ctgaggcctggtgaggtggtga

SEQ ID NO: 8771918 - DNA, 22 bp, Homo sapiens
ctgaggcctgggggcgtggacg

SEQ ID NO: 8771919 - DNA, 22 bp, Homo sapiens
ctgaggcctgggggcgtggacg

SEQ ID NO: 8771920 - DNA, 22 bp, Homo sapiens
ctgaggcctgggggcgtggacg

SEQ ID NO: 8771921 - DNA, 22 bp, Homo sapiens
ctgaggcctggccccaccacag

SEQ ID NO: 8771922 - DNA, 22 bp, Homo sapiens
ctgagccaaaaagcagagcttg

SEQ ID NO: 8771923 - DNA, 22 bp, Homo sapiens
ctgagccaaaaagcagagcttg

SEQ ID NO: 8771924 - DNA, 22 bp, Homo sapiens
ctgagccaaaaagcagagcttg

SEQ ID NO: 8771925 - DNA, 22 bp, Homo sapiens
ctgaggccgttggtgggcctta

SEQ ID NO: 8771926 - DNA, 22 bp, Homo sapiens
ctgaggccgttggtgggcctta

SEQ ID NO: 8771927 - DNA, 22 bp, Homo sapiens
ctgaggccgttggtgggcctta

SEQ ID NO: 8771928 - DNA, 22 bp, Homo sapiens
ctgagccaaaaagcagagcttg

SEQ ID NO: 8771929 - DNA, 22 bp, Homo sapiens
ctgagcatttgtgcagcttctc

SEQ ID NO: 8771930 - DNA, 22 bp, Homo sapiens
ctgagcagtttcttagggctca

SEQ ID NO: 8771931 - DNA, 22 bp, Homo sapiens
ctgagcatgctcctcttttcca

SEQ ID NO: 8771932 - DNA, 22 bp, Homo sapiens
ctgaggctgagacaggtgaaat

SEQ ID NO: 8771933 - DNA, 22 bp, Homo sapiens
ctgaggctgcccagggccaggt

SEQ ID NO: 8771934 - DNA, 22 bp, Homo sapiens
ctgaggctgcccagggccaggt

SEQ ID NO: 8771935 - DNA, 22 bp, Homo sapiens
ctgaggctgcccagggccaggt

SEQ ID NO: 8771936 - DNA, 22 bp, Homo sapiens
ctgaggctggagtgcagtggtg

SEQ ID NO: 8771937 - DNA, 22 bp, Homo sapiens
ctgaggctggagtgcagtggtg

SEQ ID NO: 8771938 - DNA, 22 bp, Homo sapiens
ctgaggctccctcgggtctgct

SEQ ID NO: 8771939 - DNA, 22 bp, Homo sapiens
ctgaggctctgagaaagccaaa

SEQ ID NO: 8771940 - DNA, 22 bp, Homo sapiens
ctgaggctctgggtgtcactgt

SEQ ID NO: 8771941 - DNA, 22 bp, Homo sapiens
ctgaggctgaagagggcctacg

SEQ ID NO: 8771942 - DNA, 22 bp, Homo sapiens
ctgaggctgaagagggcctacg

SEQ ID NO: 8771943 - DNA, 22 bp, Homo sapiens
ctgaggctctgggtgtcactgt

SEQ ID NO: 8771944 - DNA, 17 bp, Homo sapiens
ctgaggggagtgctgtg

SEQ ID NO: 8771945 - DNA, 17 bp, Homo sapiens
ctgaggggagtgctgtg

SEQ ID NO: 8771946 - DNA, 22 bp, Homo sapiens
ctgaggtctagacaccccaggg

SEQ ID NO: 8771947 - DNA, 22 bp, Homo sapiens
ctgaggctggagtgcagtggtg

SEQ ID NO: 8771948 - DNA, 18 bp, Homo sapiens
ctgaggctggcaggagcc

SEQ ID NO: 8771949 - DNA, 22 bp, Homo sapiens
ctgaggctggagtgcagtggtg

SEQ ID NO: 8771950 - DNA, 22 bp, Homo sapiens
ctgaggggaaaagtcaggatga

SEQ ID NO: 8771951 - DNA, 17 bp, Homo sapiens
ctgaggggagtgctgtg

SEQ ID NO: 8771952 - DNA, 22 bp, Homo sapiens
ctcttctgtacctcggcctcca

SEQ ID NO: 8771953 - DNA, 22 bp, Homo sapiens
ctcttctgtacctcggcctcca

SEQ ID NO: 8771954 - DNA, 22 bp, Homo sapiens
ctcttctctgcagcctttgaag

SEQ ID NO: 8771955 - DNA, 22 bp, Homo sapiens
ctcttctctgcagcctttgaag

SEQ ID NO: 8771956 - DNA, 22 bp, Homo sapiens
ctcttcttgaaagaggaattca

SEQ ID NO: 8771957 - DNA, 22 bp, Homo sapiens
ctcttcttatggccgtggctga

SEQ ID NO: 8771958 - DNA, 22 bp, Homo sapiens
ctcttcctacagtctgctatgc

SEQ ID NO: 8771959 - DNA, 22 bp, Homo sapiens
ctcttcctctcatgcggtcata

SEQ ID NO: 8771960 - DNA, 22 bp, Homo sapiens
ctcttctctgcagcctttgaag

SEQ ID NO: 8771961 - DNA, 22 bp, Homo sapiens
ctcttcctttcccttgagggtg

SEQ ID NO: 8771962 - DNA, 22 bp, Homo sapiens
ctcttccttaagactataaaga

SEQ ID NO: 8771963 - DNA, 22 bp, Homo sapiens
ctcttccttaagactataaaga

SEQ ID NO: 8771964 - DNA, 22 bp, Homo sapiens
ctcttccttaagactataaaga

SEQ ID NO: 8771965 - DNA, 22 bp, Homo sapiens
ttttgcttttgtaacacagtgt

SEQ ID NO: 8771966 - DNA, 22 bp, Homo sapiens
ttttgcttttgtaacacagtgt

SEQ ID NO: 8771967 - DNA, 22 bp, Homo sapiens
ttttgcttttgtaacacagtgt

SEQ ID NO: 8771968 - DNA, 22 bp, Homo sapiens
ctcttcctacagtctgctatgc

SEQ ID NO: 8771969 - DNA, 22 bp, Homo sapiens
ctcttcctacagtctgctatgc

SEQ ID NO: 8771970 - DNA, 22 bp, Homo sapiens
ttttggaagccgcggctgggca

SEQ ID NO: 8771971 - DNA, 22 bp, Homo sapiens
ttttggaatcatttacagagca

SEQ ID NO: 8771972 - DNA, 19 bp, Homo sapiens
ctgagcagcggcagcactt

SEQ ID NO: 8771973 - DNA, 19 bp, Homo sapiens
ctgagcagcggcagcactt

SEQ ID NO: 8771974 - DNA, 19 bp, Homo sapiens
ctgagcagcggcagcactt

SEQ ID NO: 8771975 - DNA, 22 bp, Homo sapiens
ctgagcagaagggtgcacgtgc

SEQ ID NO: 8771976 - DNA, 22 bp, Homo sapiens
ctgagcagcgtggggagctggc

SEQ ID NO: 8771977 - DNA, 22 bp, Homo sapiens
ctgagcagcgtggggagctggc

SEQ ID NO: 8771978 - DNA, 22 bp, Homo sapiens
ctgagcagtggttcttgagcgc

SEQ ID NO: 8771979 - DNA, 22 bp, Homo sapiens
ctgagcagtggttcttgagcgc

SEQ ID NO: 8771980 - DNA, 22 bp, Homo sapiens
ctgagcagtgctttgcagtggg

SEQ ID NO: 8771981 - DNA, 22 bp, Homo sapiens
ctgagcagtggttcttgagcgc

SEQ ID NO: 8771982 - DNA, 22 bp, Homo sapiens
ctgagcagtctgactcaagcta

SEQ ID NO: 8771983 - DNA, 22 bp, Homo sapiens
ctgagcagtctagccaggtgtt

SEQ ID NO: 8771984 - DNA, 22 bp, Homo sapiens
ctgagcagtagagggtctcttt

SEQ ID NO: 8771985 - DNA, 22 bp, Homo sapiens
ctgagcaggatattcacagcag

SEQ ID NO: 8771986 - DNA, 22 bp, Homo sapiens
ctgagcagggaccaaaagcatt

SEQ ID NO: 8771987 - DNA, 22 bp, Homo sapiens
ctgaggtctctttccatagtga

SEQ ID NO: 8771988 - DNA, 19 bp, Homo sapiens
ctgaggtgaggggcatcat

SEQ ID NO: 8771989 - DNA, 19 bp, Homo sapiens
ctgaggtgaggggcatcat

SEQ ID NO: 8771990 - DNA, 19 bp, Homo sapiens
ctgaggtgaggggcatcat

SEQ ID NO: 8771991 - DNA, 22 bp, Homo sapiens
ctgaggtgctatggaggatacg

SEQ ID NO: 8771992 - DNA, 22 bp, Homo sapiens
ctgaggtggaacagaggtgaag

SEQ ID NO: 8771993 - DNA, 22 bp, Homo sapiens
ctgaggtgctagggtccctgct

SEQ ID NO: 8771994 - DNA, 19 bp, Homo sapiens
ctgaggtgcagtaagaggc

SEQ ID NO: 8771995 - DNA, 22 bp, Homo sapiens
ctgaggtgatgtcaaatgggtt

SEQ ID NO: 8771996 - DNA, 22 bp, Homo sapiens
ctgaggtgatgtcaaatgggtt

SEQ ID NO: 8771997 - DNA, 22 bp, Homo sapiens
ctgaggtggcgcctctctttaa

SEQ ID NO: 8771998 - DNA, 22 bp, Homo sapiens
ctgaggtgtgaaatggtggcaa

SEQ ID NO: 8771999 - DNA, 22 bp, Homo sapiens
ctgaggtggcatcctagctcta

SEQ ID NO: 8772000 - DNA, 22 bp, Homo sapiens
ctgaggtggcatcctagctcta

SEQ ID NO: 8772001 - DNA, 23 bp, Homo sapiens
ctgaggtggagagtgaggtaagt

SEQ ID NO: 8772002 - DNA, 23 bp, Homo sapiens
ctgaggtggagagtgaggtaagt

SEQ ID NO: 8772003 - DNA, 22 bp, Homo sapiens
ctgaggtggaacagaggtgaag

SEQ ID NO: 8772004 - DNA, 22 bp, Homo sapiens
ctgaggtgctatggaggatacg

SEQ ID NO: 8772005 - DNA, 22 bp, Homo sapiens
ctgaggtggaacagaggtgaag

SEQ ID NO: 8772006 - DNA, 22 bp, Homo sapiens
ctgaggtgtgagccacttcccc

SEQ ID NO: 8772007 - DNA, 22 bp, Homo sapiens
ctgcaggacagggaggagcaag

SEQ ID NO: 8772008 - DNA, 22 bp, Homo sapiens
ctgcaggacagggaggagcaag

SEQ ID NO: 8772009 - DNA, 22 bp, Homo sapiens
ctgcaggacagggccggaggcc

SEQ ID NO: 8772010 - DNA, 22 bp, Homo sapiens
ctgcaggaattcaaagtgagct

SEQ ID NO: 8772011 - DNA, 22 bp, Homo sapiens
ctgcaggactgaaagatgaggt

SEQ ID NO: 8772012 - DNA, 22 bp, Homo sapiens
ctgcaggacgaccgcctcatct

SEQ ID NO: 8772013 - DNA, 22 bp, Homo sapiens
ctgcaggacgaccgcctcatct

SEQ ID NO: 8772014 - DNA, 22 bp, Homo sapiens
ctgcaggaatctgtgctaggtg

SEQ ID NO: 8772015 - DNA, 22 bp, Homo sapiens
ctgcagctttttgtgcttgtaa

SEQ ID NO: 8772016 - DNA, 22 bp, Homo sapiens
ctgcagctttggaaacctgttt

SEQ ID NO: 8772017 - DNA, 22 bp, Homo sapiens
ctgcagcttatttgctgtgtga

SEQ ID NO: 8772018 - DNA, 22 bp, Homo sapiens
ctgcagcttatttgctgtgtga

SEQ ID NO: 8772019 - DNA, 22 bp, Homo sapiens
ctgcagctttcgctccatcagc

SEQ ID NO: 8772020 - DNA, 22 bp, Homo sapiens
ctgcagctttcgctccatcagc

SEQ ID NO: 8772021 - DNA, 22 bp, Homo sapiens
ctgcagctgtctctactgggca

SEQ ID NO: 8772022 - DNA, 22 bp, Homo sapiens
ctgcagctgtagaggacagtgg

SEQ ID NO: 8772023 - DNA, 22 bp, Homo sapiens
ctgcagcttaaaggagttcaat

SEQ ID NO: 8772024 - DNA, 22 bp, Homo sapiens
ctgcagcttaaaggagttcaat

SEQ ID NO: 8772025 - DNA, 22 bp, Homo sapiens
ctgcagcctcaacctcctgagc

SEQ ID NO: 8772026 - DNA, 22 bp, Homo sapiens
ctgcagcctaggtgcagctggg

SEQ ID NO: 8772027 - DNA, 22 bp, Homo sapiens
ctgcagcctaggtgcagctggg

SEQ ID NO: 8772028 - DNA, 22 bp, Homo sapiens
ctgcagctgggccagggccacc

SEQ ID NO: 8772029 - DNA, 22 bp, Homo sapiens
ctgcagctgggccagggccacc

SEQ ID NO: 8772030 - DNA, 22 bp, Homo sapiens
ctgcagcctcaacctcctgagc

SEQ ID NO: 8772031 - DNA, 22 bp, Homo sapiens
ctgcaggagtgaaagcaggcct

SEQ ID NO: 8772032 - DNA, 22 bp, Homo sapiens
ctgcaggcatctaactgtgggc

SEQ ID NO: 8772033 - DNA, 22 bp, Homo sapiens
ctgcaggatttcatgggctgac

SEQ ID NO: 8772034 - DNA, 18 bp, Homo sapiens
ctgccatgtcctactgtc

SEQ ID NO: 8772035 - DNA, 21 bp, Homo sapiens
ctgcaggatgctgaagccagg

SEQ ID NO: 8772036 - DNA, 22 bp, Homo sapiens
ctgcaggaggatcctgagagtg

SEQ ID NO: 8772037 - DNA, 22 bp, Homo sapiens
ctgcaggagggctggggaagcc

SEQ ID NO: 8772038 - DNA, 22 bp, Homo sapiens
ctgcaggagcaagcctgggaga

SEQ ID NO: 8772039 - DNA, 22 bp, Homo sapiens
ctgcaggagcaaagcctctgct

SEQ ID NO: 8772040 - DNA, 22 bp, Homo sapiens
ctgcaggagcaaagcctctgct

SEQ ID NO: 8772041 - DNA, 22 bp, Homo sapiens
ctgccatgtgtgaaaggggagg

SEQ ID NO: 8772042 - DNA, 22 bp, Homo sapiens
ctgccatgtgtgaaaggggagg

SEQ ID NO: 8772043 - DNA, 22 bp, Homo sapiens
ctgcaggatttcatgggctgac

SEQ ID NO: 8772044 - DNA, 22 bp, Homo sapiens
ctgcccaagtggagtctccgca

SEQ ID NO: 8772045 - DNA, 22 bp, Homo sapiens
ctgcccacacctgagctgggcc

SEQ ID NO: 8772046 - DNA, 22 bp, Homo sapiens
ctgcccagattttaccacctgc

SEQ ID NO: 8772047 - DNA, 22 bp, Homo sapiens
ctgcccagattttaccacctgc

SEQ ID NO: 8772048 - DNA, 20 bp, Homo sapiens
ctgcccagccactgagggat

SEQ ID NO: 8772049 - DNA, 20 bp, Homo sapiens
ctgcccagccactgagggat

SEQ ID NO: 8772050 - DNA, 20 bp, Homo sapiens
ctgcccagccactgagggat

SEQ ID NO: 8772051 - DNA, 22 bp, Homo sapiens
ctgcccagattttaccacctgc

SEQ ID NO: 8772052 - DNA, 20 bp, Homo sapiens
ctgcccagccactgagggat

SEQ ID NO: 8772053 - DNA, 20 bp, Homo sapiens
ctgcccagccactgagggat

SEQ ID NO: 8772054 - DNA, 20 bp, Homo sapiens
ctgcccagccactgagggat

SEQ ID NO: 8772055 - DNA, 22 bp, Homo sapiens
ctgcccaggctgaaggaacatc

SEQ ID NO: 8772056 - DNA, 22 bp, Homo sapiens
ctgcccaggctgaaggaacatc

SEQ ID NO: 8772057 - DNA, 22 bp, Homo sapiens
ctgcccaggggagtgctgtcgg

SEQ ID NO: 8772058 - DNA, 22 bp, Homo sapiens
ctgcccaggggagtgctgtcgg

SEQ ID NO: 8772059 - DNA, 22 bp, Homo sapiens
ctgcccaggggagtgctgtcgg

SEQ ID NO: 8772060 - DNA, 22 bp, Homo sapiens
ctgcccaggaaggagaggatgg

SEQ ID NO: 8772061 - DNA, 22 bp, Homo sapiens
ctgcccaggaaggagaggatgg

SEQ ID NO: 8772062 - DNA, 22 bp, Homo sapiens
ctgcccaggctgaaggaacatc

SEQ ID NO: 8772063 - DNA, 22 bp, Homo sapiens
ctgcccagtttgggagcctttc

SEQ ID NO: 8772064 - DNA, 22 bp, Homo sapiens
ctgcccaggggagtgctgtcgg

SEQ ID NO: 8772065 - DNA, 22 bp, Homo sapiens
ctgcccatcgtcatttaataaa

SEQ ID NO: 8772066 - DNA, 22 bp, Homo sapiens
ctgcccagtttgggagcctttc

SEQ ID NO: 8772067 - DNA, 21 bp, Homo sapiens
ctgcccatttgtgatgtcccc

SEQ ID NO: 8772068 - DNA, 22 bp, Homo sapiens
ctgccccaggcctccttttctt

SEQ ID NO: 8772069 - DNA, 22 bp, Homo sapiens
ctgccccaggcctcgggaggag

SEQ ID NO: 8772070 - DNA, 22 bp, Homo sapiens
ctgccccagtgccaggcaggtg

SEQ ID NO: 8772071 - DNA, 22 bp, Homo sapiens
ctgcccccaggctgcatggctg

SEQ ID NO: 8772072 - DNA, 22 bp, Homo sapiens
ctgcccctgccaggcagctgtc

SEQ ID NO: 8772073 - DNA, 22 bp, Homo sapiens
ctgcccccaggctgcatggctg

SEQ ID NO: 8772074 - DNA, 22 bp, Homo sapiens
ctgcccccagcctgggcttcga

SEQ ID NO: 8772075 - DNA, 22 bp, Homo sapiens
ctgccccctgctttgtccttga

SEQ ID NO: 8772076 - DNA, 22 bp, Homo sapiens
ctgcccctcgaccaagcgcgtc

SEQ ID NO: 8772077 - DNA, 22 bp, Homo sapiens
ctgccccctgctttgtccttga

SEQ ID NO: 8772078 - DNA, 22 bp, Homo sapiens
ctgcccccaggctgcatggctg

SEQ ID NO: 8772079 - DNA, 22 bp, Homo sapiens
ctgcccccaggctgcatggctg

SEQ ID NO: 8772080 - DNA, 22 bp, Homo sapiens
ttggatccatctcaggcatagg

SEQ ID NO: 8772081 - DNA, 22 bp, Homo sapiens
ttggatccatctcaggcatagg

SEQ ID NO: 8772082 - DNA, 22 bp, Homo sapiens
ttggatccatctcaggcatagg

SEQ ID NO: 8772083 - DNA, 22 bp, Homo sapiens
ttggagtcattggcctgggtga

SEQ ID NO: 8772084 - DNA, 22 bp, Homo sapiens
ttggagtgacagatgaggaaac

SEQ ID NO: 8772085 - DNA, 22 bp, Homo sapiens
ttggagtaggtttcgtgccgct

SEQ ID NO: 8772086 - DNA, 20 bp, Homo sapiens
ttggagtctaaagactgggg

SEQ ID NO: 8772087 - DNA, 22 bp, Homo sapiens
ttggagtcagatgactgtagga

SEQ ID NO: 8772088 - DNA, 22 bp, Homo sapiens
ttggagtagctggctttgtgct

SEQ ID NO: 8772089 - DNA, 22 bp, Homo sapiens
ttggagtagatggttatggatt

SEQ ID NO: 8772090 - DNA, 21 bp, Homo sapiens
ttggagtagcactatgtaaac

SEQ ID NO: 8772091 - DNA, 22 bp, Homo sapiens
ttggaggtttgaaaatatgtgt

SEQ ID NO: 8772092 - DNA, 22 bp, Homo sapiens
ttggagtagaaaaaatcatgct

SEQ ID NO: 8772093 - DNA, 22 bp, Homo sapiens
ttggaaggccctgcctagcagg

SEQ ID NO: 8772094 - DNA, 22 bp, Homo sapiens
ttggaaggctgaatggcctctc

SEQ ID NO: 8772095 - DNA, 22 bp, Homo sapiens
ttggaagggaacaccatttgac

SEQ ID NO: 8772096 - DNA, 23 bp, Homo sapiens
ttggaagggaagagcatttgaga

SEQ ID NO: 8772097 - DNA, 22 bp, Homo sapiens
ttggaagggaaccgagtttgct

SEQ ID NO: 8772098 - DNA, 20 bp, Homo sapiens
ttggaaggtggagaagagga

SEQ ID NO: 8772099 - DNA, 20 bp, Homo sapiens
ttggaaggtggagaagagga

SEQ ID NO: 8772100 - DNA, 20 bp, Homo sapiens
ttggaaggtggagaagagga

SEQ ID NO: 8772101 - DNA, 20 bp, Homo sapiens
ttggaaggtggagaagagga

SEQ ID NO: 8772102 - DNA, 22 bp, Homo sapiens
ttggaaggggcagagtggctgc

SEQ ID NO: 8772103 - DNA, 22 bp, Homo sapiens
ttggaagggtttcagttagtct

SEQ ID NO: 8772104 - DNA, 22 bp, Homo sapiens
ttggaaggtgagtccctgggtt

SEQ ID NO: 8772105 - DNA, 22 bp, Homo sapiens
ttggaaggggcagagtggctgc

SEQ ID NO: 8772106 - DNA, 22 bp, Homo sapiens
ttggaagggatattggcatatg

SEQ ID NO: 8772107 - DNA, 22 bp, Homo sapiens
ttggaaggttctggtcatggtt

SEQ ID NO: 8772108 - DNA, 22 bp, Homo sapiens
ttggaaggttctggtcatggtt

SEQ ID NO: 8772109 - DNA, 22 bp, Homo sapiens
ctcagtctgtcttgtctgtgtt

SEQ ID NO: 8772110 - DNA, 22 bp, Homo sapiens
ctcagtcttctcctccaatgga

SEQ ID NO: 8772111 - DNA, 22 bp, Homo sapiens
ttggaaaagtgaaactagatgc

SEQ ID NO: 8772112 - DNA, 22 bp, Homo sapiens
ttggaaaagtgaaactagatgc

SEQ ID NO: 8772113 - DNA, 22 bp, Homo sapiens
ttggaaaagtgaaactagatgc

SEQ ID NO: 8772114 - DNA, 22 bp, Homo sapiens
ctcagtccgtcccgctaggtgc

SEQ ID NO: 8772115 - DNA, 22 bp, Homo sapiens
ctcagtccttatttgcctctac

SEQ ID NO: 8772116 - DNA, 22 bp, Homo sapiens
ctcagtccttatttgcctctac

SEQ ID NO: 8772117 - DNA, 22 bp, Homo sapiens
ctcagtctcttgggctgtgaag

SEQ ID NO: 8772118 - DNA, 22 bp, Homo sapiens
ctcagtctcttgggctgtgaag

SEQ ID NO: 8772119 - DNA, 22 bp, Homo sapiens
ctcagtcagttattatgccagt

SEQ ID NO: 8772120 - DNA, 22 bp, Homo sapiens
ctcagtctgtcttgtctgtgtt

SEQ ID NO: 8772121 - DNA, 22 bp, Homo sapiens
ctcagtctcttgggctgtgaag

SEQ ID NO: 8772122 - DNA, 19 bp, Homo sapiens
ctcagtctggctctgcctg

SEQ ID NO: 8772123 - DNA, 19 bp, Homo sapiens
ctcagtctggctctgcctg

SEQ ID NO: 8772124 - DNA, 19 bp, Homo sapiens
ctcagtctggctctgcctg

SEQ ID NO: 8772125 - DNA, 22 bp, Homo sapiens
ttggaaggatttagagatgtct

SEQ ID NO: 8772126 - DNA, 22 bp, Homo sapiens
ttggaaggatttagagatgtct

SEQ ID NO: 8772127 - DNA, 22 bp, Homo sapiens
ttggaaggagtctttggggatg

SEQ ID NO: 8772128 - DNA, 22 bp, Homo sapiens
ttggaaggagtctttggggatg

SEQ ID NO: 8772129 - DNA, 22 bp, Homo sapiens
ttggaaggccagcaccttgagt

SEQ ID NO: 8772130 - DNA, 22 bp, Homo sapiens
ttggaaggccctgcctagcagg

SEQ ID NO: 8772131 - DNA, 22 bp, Homo sapiens
ttggaaggatttagagatgtct

SEQ ID NO: 8772132 - DNA, 22 bp, Homo sapiens
ttggaaggcagcatttgtccat

SEQ ID NO: 8772133 - DNA, 19 bp, Homo sapiens
ttggaaggagccagagtgg

SEQ ID NO: 8772134 - DNA, 19 bp, Homo sapiens
ttggaaggagccagagtgg

SEQ ID NO: 8772135 - DNA, 22 bp, Homo sapiens
ttggaaggagtcaaccagctga

SEQ ID NO: 8772136 - DNA, 22 bp, Homo sapiens
ttggaaggagcctaaaagagac

SEQ ID NO: 8772137 - DNA, 22 bp, Homo sapiens
ttggaaggaattaaggtcatga

SEQ ID NO: 8772138 - DNA, 22 bp, Homo sapiens
ttggaaggaccaggccttgatt

SEQ ID NO: 8772139 - DNA, 22 bp, Homo sapiens
ttggaaggaagaaccgcggtag

SEQ ID NO: 8772140 - DNA, 22 bp, Homo sapiens
ttggaagcgagcacatggagga

SEQ ID NO: 8772141 - DNA, 22 bp, Homo sapiens
ttggaagcgagcacatggagga

SEQ ID NO: 8772142 - DNA, 22 bp, Homo sapiens
ttggaagccagaggaccaggga

SEQ ID NO: 8772143 - DNA, 22 bp, Homo sapiens
ttggaaaatgaggcacagagag

SEQ ID NO: 8772144 - DNA, 22 bp, Homo sapiens
ttggctgctaatggctgacagc

SEQ ID NO: 8772145 - DNA, 22 bp, Homo sapiens
ctccaggacactaacccaggct

SEQ ID NO: 8772146 - DNA, 22 bp, Homo sapiens
ctccaggacactaacccaggct

SEQ ID NO: 8772147 - DNA, 22 bp, Homo sapiens
ctccaggaccagggctcctgga

SEQ ID NO: 8772148 - DNA, 22 bp, Homo sapiens
ctccaggaccagggctcctgga

SEQ ID NO: 8772149 - DNA, 22 bp, Homo sapiens
ctccaggacatgactttcttgc

SEQ ID NO: 8772150 - DNA, 22 bp, Homo sapiens
ctccaggactcaggcccctggg

SEQ ID NO: 8772151 - DNA, 22 bp, Homo sapiens
ctccaggactcaggcccctggg

SEQ ID NO: 8772152 - DNA, 22 bp, Homo sapiens
ctccaggactgaggacagagct

SEQ ID NO: 8772153 - DNA, 22 bp, Homo sapiens
ctccaggacccagtggctccag

SEQ ID NO: 8772154 - DNA, 22 bp, Homo sapiens
ctccaggactcaggcccctggg

SEQ ID NO: 8772155 - DNA, 22 bp, Homo sapiens
ctccaggaccagggctcctgga

SEQ ID NO: 8772156 - DNA, 22 bp, Homo sapiens
ctccaggacccagtggctccag

SEQ ID NO: 8772157 - DNA, 22 bp, Homo sapiens
ttggctgaactgagctccatcg

SEQ ID NO: 8772158 - DNA, 22 bp, Homo sapiens
ttggctgaagactagatgttta

SEQ ID NO: 8772159 - DNA, 22 bp, Homo sapiens
ttggctgaagactagatgttta

SEQ ID NO: 8772160 - DNA, 22 bp, Homo sapiens
ttggctgaaagccatgagaccg

SEQ ID NO: 8772161 - DNA, 22 bp, Homo sapiens
ttggctgaaagccatgagaccg

SEQ ID NO: 8772162 - DNA, 22 bp, Homo sapiens
ttggctgaaggaataaatggat

SEQ ID NO: 8772163 - DNA, 22 bp, Homo sapiens
ttggctgaatgaggtcaccttt

SEQ ID NO: 8772164 - DNA, 22 bp, Homo sapiens
ttggctgaactgagctccatcg

SEQ ID NO: 8772165 - DNA, 22 bp, Homo sapiens
ttggctgaaggttaagtgctgg

SEQ ID NO: 8772166 - DNA, 22 bp, Homo sapiens
ttggctgaaggttaagtgctgg

SEQ ID NO: 8772167 - DNA, 22 bp, Homo sapiens
ttggctgaccagaacctgcccc

SEQ ID NO: 8772168 - DNA, 22 bp, Homo sapiens
ttggctgacaaatggaatctct

SEQ ID NO: 8772169 - DNA, 22 bp, Homo sapiens
ttggctgagagaggaaaagggc

SEQ ID NO: 8772170 - DNA, 22 bp, Homo sapiens
ttggctgaatgaggtcaccttt

SEQ ID NO: 8772171 - DNA, 22 bp, Homo sapiens
ttggctgaccagaacctgcccc

SEQ ID NO: 8772172 - DNA, 22 bp, Homo sapiens
ttggctgagagctgctctgcag

SEQ ID NO: 8772173 - DNA, 22 bp, Homo sapiens
ttggctgatgcaagagcttcct

SEQ ID NO: 8772174 - DNA, 22 bp, Homo sapiens
ttggctgatgcaagagcttcct

SEQ ID NO: 8772175 - DNA, 22 bp, Homo sapiens
ttggctgagccatgtgaaacca

SEQ ID NO: 8772176 - DNA, 22 bp, Homo sapiens
ttggctgagagctgctctgcag

SEQ ID NO: 8772177 - DNA, 22 bp, Homo sapiens
ttggctgcaatcacagggactc

SEQ ID NO: 8772178 - DNA, 22 bp, Homo sapiens
ttggctgcattttgggttcgtt

SEQ ID NO: 8772179 - DNA, 22 bp, Homo sapiens
ttggctgccgagcgcatcccgg

SEQ ID NO: 8772180 - DNA, 21 bp, Homo sapiens
ttggctgcctgagattagaat

SEQ ID NO: 8772181 - DNA, 22 bp, Homo sapiens
ttggctgccttcacccctggcc

SEQ ID NO: 8772182 - DNA, 22 bp, Homo sapiens
ttggctgccttcacccctggcc

SEQ ID NO: 8772183 - DNA, 22 bp, Homo sapiens
ttggctgcctgtggatcgcatt

SEQ ID NO: 8772184 - DNA, 22 bp, Homo sapiens
ttggctgccttcacccctggcc

SEQ ID NO: 8772185 - DNA, 22 bp, Homo sapiens
ctccagcctcatctcctggctg

SEQ ID NO: 8772186 - DNA, 22 bp, Homo sapiens
ttggctctgatggggatcagga

SEQ ID NO: 8772187 - DNA, 22 bp, Homo sapiens
ttggctctggaactatttctga

SEQ ID NO: 8772188 - DNA, 17 bp, Homo sapiens
ttggctctattgcctct

SEQ ID NO: 8772189 - DNA, 22 bp, Homo sapiens
ttggctctgaaacccaagctct

SEQ ID NO: 8772190 - DNA, 21 bp, Homo sapiens
ttggctctgaaacttgcacct

SEQ ID NO: 8772191 - DNA, 22 bp, Homo sapiens
ctccagaggttctcatctggga

SEQ ID NO: 8772192 - DNA, 22 bp, Homo sapiens
ctccagagtcacactgcctggg

SEQ ID NO: 8772193 - DNA, 22 bp, Homo sapiens
ctccagagtcacactgcctggg

SEQ ID NO: 8772194 - DNA, 22 bp, Homo sapiens
ctccagagtcacactgcctggg

SEQ ID NO: 8772195 - DNA, 22 bp, Homo sapiens
ctccagagtcacactgcctggg

SEQ ID NO: 8772196 - DNA, 22 bp, Homo sapiens
ctccagagtcacactgcctggg

SEQ ID NO: 8772197 - DNA, 22 bp, Homo sapiens
ctccagagtcatcgagcattcc

SEQ ID NO: 8772198 - DNA, 22 bp, Homo sapiens
ctccagagtcatcgagcattcc

SEQ ID NO: 8772199 - DNA, 22 bp, Homo sapiens
ctccagagggtcagactctgag

SEQ ID NO: 8772200 - DNA, 22 bp, Homo sapiens
ctccagagggtcagactctgag

SEQ ID NO: 8772201 - DNA, 22 bp, Homo sapiens
ctccagaggatgcaggtgaggg

SEQ ID NO: 8772202 - DNA, 22 bp, Homo sapiens
ctccagaggttctcatctggga

SEQ ID NO: 8772203 - DNA, 22 bp, Homo sapiens
ctccagaggtccccgcggcact

SEQ ID NO: 8772204 - DNA, 22 bp, Homo sapiens
ctccagaggtccccgcggcact

SEQ ID NO: 8772205 - DNA, 22 bp, Homo sapiens
ctccagaggtccccgcggcact

SEQ ID NO: 8772206 - DNA, 22 bp, Homo sapiens
ctccagaggatgcaggtgaggg

SEQ ID NO: 8772207 - DNA, 22 bp, Homo sapiens
ctccagaggatgcaggtgaggg

SEQ ID NO: 8772208 - DNA, 22 bp, Homo sapiens
ctccagaggatgcaggtgaggg

SEQ ID NO: 8772209 - DNA, 18 bp, Homo sapiens
ctccagagctgtgagaca

SEQ ID NO: 8772210 - DNA, 18 bp, Homo sapiens
ctccagagctgtgagaca

SEQ ID NO: 8772211 - DNA, 18 bp, Homo sapiens
ctccagagctgtgagaca

SEQ ID NO: 8772212 - DNA, 22 bp, Homo sapiens
ctccagaggaaagcacatagtg

SEQ ID NO: 8772213 - DNA, 22 bp, Homo sapiens
ctcaggttttggctttgtgtac

SEQ ID NO: 8772214 - DNA, 22 bp, Homo sapiens
ctcaggtcttagttctgtcatc

SEQ ID NO: 8772215 - DNA, 22 bp, Homo sapiens
ctcagtagaaaatacatggact

SEQ ID NO: 8772216 - DNA, 20 bp, Homo sapiens
ctcagtaaaagcacagggtc

SEQ ID NO: 8772217 - DNA, 22 bp, Homo sapiens
ctcagggtgcagcacagttcct

SEQ ID NO: 8772218 - DNA, 22 bp, Homo sapiens
ctcagggggaatcaggtcacag

SEQ ID NO: 8772219 - DNA, 22 bp, Homo sapiens
ctcagggggaatcaggtcacag

SEQ ID NO: 8772220 - DNA, 21 bp, Homo sapiens
ctcaggggattttgagattag

SEQ ID NO: 8772221 - DNA, 22 bp, Homo sapiens
ctcagggggaatcaggtcacag

SEQ ID NO: 8772222 - DNA, 22 bp, Homo sapiens
ctcagggcttgagtgtccagga

SEQ ID NO: 8772223 - DNA, 21 bp, Homo sapiens
ctcagggcttggtgtcctcat

SEQ ID NO: 8772224 - DNA, 22 bp, Homo sapiens
ctcaggggacctggctccgagt

SEQ ID NO: 8772225 - DNA, 22 bp, Homo sapiens
ctcaggggacctggctccgagt

SEQ ID NO: 8772226 - DNA, 22 bp, Homo sapiens
ctcaggggacctggctccgagt

SEQ ID NO: 8772227 - DNA, 22 bp, Homo sapiens
ctcagggatggtgaagcaccca

SEQ ID NO: 8772228 - DNA, 22 bp, Homo sapiens
ctcagggcagtatggctgagag

SEQ ID NO: 8772229 - DNA, 22 bp, Homo sapiens
ctcagggatgggcagatgttaa

SEQ ID NO: 8772230 - DNA, 23 bp, Homo sapiens
ctcagggatagaaaggaagacag

SEQ ID NO: 8772231 - DNA, 23 bp, Homo sapiens
ctcagggatagaaaggaagacag

SEQ ID NO: 8772232 - DNA, 22 bp, Homo sapiens
ctcagggagtagcacatgtgga

SEQ ID NO: 8772233 - DNA, 22 bp, Homo sapiens
ctcagggaattgaatctccttg

SEQ ID NO: 8772234 - DNA, 22 bp, Homo sapiens
ctcagggaattatttctgtcct

SEQ ID NO: 8772235 - DNA, 22 bp, Homo sapiens
ctcagggctctgcatgcacacg

SEQ ID NO: 8772236 - DNA, 22 bp, Homo sapiens
ctcagggcggcgggcagcccag

SEQ ID NO: 8772237 - DNA, 22 bp, Homo sapiens
ctcagggcggcgggcagcccag

SEQ ID NO: 8772238 - DNA, 22 bp, Homo sapiens
ctcagggccaaggatgctgttg

SEQ ID NO: 8772239 - DNA, 22 bp, Homo sapiens
ttgccctgaagaacgtcccaga

SEQ ID NO: 8772240 - DNA, 22 bp, Homo sapiens
ttgccctgaagaacgtcccaga

SEQ ID NO: 8772241 - DNA, 17 bp, Homo sapiens
ttgccctgatttttaac

SEQ ID NO: 8772242 - DNA, 16 bp, Homo sapiens
ttgccctgaggggagg

SEQ ID NO: 8772243 - DNA, 22 bp, Homo sapiens
ttgccctgcagcggtgagtggt

SEQ ID NO: 8772244 - DNA, 22 bp, Homo sapiens
ttgccctgcctccctgaggtga

SEQ ID NO: 8772245 - DNA, 22 bp, Homo sapiens
ttgccctgcctccctgaggtga

SEQ ID NO: 8772246 - DNA, 22 bp, Homo sapiens
ttgccccttggccgttaaaaca

SEQ ID NO: 8772247 - DNA, 22 bp, Homo sapiens
ttgcccatctcagtgcctcgct

SEQ ID NO: 8772248 - DNA, 22 bp, Homo sapiens
ttgccctgcgggtcctgcgcaa

SEQ ID NO: 8772249 - DNA, 22 bp, Homo sapiens
ttgccctgcgggtcctgcgcaa

SEQ ID NO: 8772250 - DNA, 22 bp, Homo sapiens
ttgccctgcgttaccatctctt

SEQ ID NO: 8772251 - DNA, 22 bp, Homo sapiens
ttgccctgcgttaccatctctt

SEQ ID NO: 8772252 - DNA, 22 bp, Homo sapiens
ttgccctggggctggcctggca

SEQ ID NO: 8772253 - DNA, 22 bp, Homo sapiens
ttgccctgtcagtagaagtgca

SEQ ID NO: 8772254 - DNA, 22 bp, Homo sapiens
ttgccctgtctcactatgttaa

SEQ ID NO: 8772255 - DNA, 22 bp, Homo sapiens
ttgccctgtctcactatgttaa

SEQ ID NO: 8772256 - DNA, 22 bp, Homo sapiens
ttgccctgtcagtagaagtgca

SEQ ID NO: 8772257 - DNA, 22 bp, Homo sapiens
ttgccctgtcttaagctggcaa

SEQ ID NO: 8772258 - DNA, 22 bp, Homo sapiens
ttgcatagtgctgaggttcggg

SEQ ID NO: 8772259 - DNA, 22 bp, Homo sapiens
ttgcatagtgctgaggttcggg

SEQ ID NO: 8772260 - DNA, 22 bp, Homo sapiens
ttgcatcaggtagacaactata

SEQ ID NO: 8772261 - DNA, 22 bp, Homo sapiens
ttgcatcagaaaatatgggaag

SEQ ID NO: 8772262 - DNA, 23 bp, Homo sapiens
ttgcatggagcctgggattcctc

SEQ ID NO: 8772263 - DNA, 22 bp, Homo sapiens
ttgcatgcacctaacaaattat

SEQ ID NO: 8772264 - DNA, 22 bp, Homo sapiens
ctcaggaaccgcggcagcagcc

SEQ ID NO: 8772265 - DNA, 22 bp, Homo sapiens
ctcaggaaccgcggcagcagcc

SEQ ID NO: 8772266 - DNA, 22 bp, Homo sapiens
ctcaggacagattccagagaaa

SEQ ID NO: 8772267 - DNA, 22 bp, Homo sapiens
ctcaggacccggtccaggtggg

SEQ ID NO: 8772268 - DNA, 22 bp, Homo sapiens
ctcaggactcagagacactctc

SEQ ID NO: 8772269 - DNA, 22 bp, Homo sapiens
ctcaggactcagagacactctc

SEQ ID NO: 8772270 - DNA, 22 bp, Homo sapiens
ctcaggacggccgggggagcct

SEQ ID NO: 8772271 - DNA, 22 bp, Homo sapiens
ctcaggagatgacagaaggtat

SEQ ID NO: 8772272 - DNA, 22 bp, Homo sapiens
ctcaggagagtcttatatctcc

SEQ ID NO: 8772273 - DNA, 22 bp, Homo sapiens
ctcaggagacagtgtccacatg

SEQ ID NO: 8772274 - DNA, 22 bp, Homo sapiens
ctcaggacccggtccaggtggg

SEQ ID NO: 8772275 - DNA, 22 bp, Homo sapiens
ctcaggagacagtgtccacatg

SEQ ID NO: 8772276 - DNA, 22 bp, Homo sapiens
ctcaggagacagtgtccacatg

SEQ ID NO: 8772277 - DNA, 22 bp, Homo sapiens
ctcaggagacagtgtccacatg

SEQ ID NO: 8772278 - DNA, 22 bp, Homo sapiens
ctcagcttctacctcctgagtg

SEQ ID NO: 8772279 - DNA, 22 bp, Homo sapiens
ctcaggaaaggccatgcaaggg

SEQ ID NO: 8772280 - DNA, 22 bp, Homo sapiens
ctcaggaaaatattgaagaagt

SEQ ID NO: 8772281 - DNA, 22 bp, Homo sapiens
ctcaggaaaatattgaagaagt

SEQ ID NO: 8772282 - DNA, 22 bp, Homo sapiens
ctcagccccaatttgccctctt

SEQ ID NO: 8772283 - DNA, 22 bp, Homo sapiens
ctcagaggcaagcaaggagctg

SEQ ID NO: 8772284 - DNA, 22 bp, Homo sapiens
ctcagccccaatttgccctctt

SEQ ID NO: 8772285 - DNA, 22 bp, Homo sapiens
ctcaggaggatgactgccttgg

SEQ ID NO: 8772286 - DNA, 22 bp, Homo sapiens
ctcaggaggatgactgccttgg

SEQ ID NO: 8772287 - DNA, 22 bp, Homo sapiens
ctcaggaggatgactgccttgg

SEQ ID NO: 8772288 - DNA, 22 bp, Homo sapiens
ctcaggaggatgactgccttgg

SEQ ID NO: 8772289 - DNA, 22 bp, Homo sapiens
ctcaggaggccattctcaaggt

SEQ ID NO: 8772290 - DNA, 22 bp, Homo sapiens
ctcaggaggccattctcaaggt

SEQ ID NO: 8772291 - DNA, 22 bp, Homo sapiens
ctcaggagcttcctcagcccat

SEQ ID NO: 8772292 - DNA, 22 bp, Homo sapiens
ctcaggagatgacagaaggtat

SEQ ID NO: 8772293 - DNA, 22 bp, Homo sapiens
ctcaggagcttcctcagcccat

SEQ ID NO: 8772294 - DNA, 22 bp, Homo sapiens
ctcaggagcttcctcagcccat

SEQ ID NO: 8772295 - DNA, 22 bp, Homo sapiens
ctcaggaggaggaagttcattg

SEQ ID NO: 8772296 - DNA, 22 bp, Homo sapiens
ctcaggaggtttcctgtctagg

SEQ ID NO: 8772297 - DNA, 22 bp, Homo sapiens
ctcaggaggtttcctgtctagg

SEQ ID NO: 8772298 - DNA, 22 bp, Homo sapiens
ctcaggagtagttcagcagctg

SEQ ID NO: 8772299 - DNA, 22 bp, Homo sapiens
ctcaggaggtttcctgtctagg

SEQ ID NO: 8772300 - DNA, 22 bp, Homo sapiens
ctcaggaggtggtagaggccct

SEQ ID NO: 8772301 - DNA, 22 bp, Homo sapiens
ctcaggaggtggtagaggccct

SEQ ID NO: 8772302 - DNA, 22 bp, Homo sapiens
ctcaggaggtggtagaggccct

SEQ ID NO: 8772303 - DNA, 22 bp, Homo sapiens
ttgcactttgaaataacagtgg

SEQ ID NO: 8772304 - DNA, 22 bp, Homo sapiens
ctcaggagtagttcagcagctg

SEQ ID NO: 8772305 - DNA, 22 bp, Homo sapiens
ttgcagtttatgttcctgcagt

SEQ ID NO: 8772306 - DNA, 22 bp, Homo sapiens
ttgcagttttctgcctcatttc

SEQ ID NO: 8772307 - DNA, 22 bp, Homo sapiens
ttgcataaatgcttaaaatttg

SEQ ID NO: 8772308 - DNA, 22 bp, Homo sapiens
ttgcataaagattttattgcat

SEQ ID NO: 8772309 - DNA, 22 bp, Homo sapiens
ttgcataaatgcttaaaatttg

SEQ ID NO: 8772310 - DNA, 22 bp, Homo sapiens
ttgcatagaatatcatattttc

SEQ ID NO: 8772311 - DNA, 22 bp, Homo sapiens
ttgcatagtgctgaggttcggg

SEQ ID NO: 8772312 - DNA, 22 bp, Homo sapiens
ctcactgcaagctcagcctccc

SEQ ID NO: 8772313 - DNA, 22 bp, Homo sapiens
ctcactcagacatccagtgcag

SEQ ID NO: 8772314 - DNA, 22 bp, Homo sapiens
ctcactcagtttttagttcatc

SEQ ID NO: 8772315 - DNA, 22 bp, Homo sapiens
ctcactgaaacctccgcctccc

SEQ ID NO: 8772316 - DNA, 22 bp, Homo sapiens
ctcactgcaacctccgtctccc

SEQ ID NO: 8772317 - DNA, 22 bp, Homo sapiens
ctcactgcaacctccgcctcct

SEQ ID NO: 8772318 - DNA, 22 bp, Homo sapiens
ctcactgacgaggaagctgaga

SEQ ID NO: 8772319 - DNA, 22 bp, Homo sapiens
ctcactgacagagattgaaaat

SEQ ID NO: 8772320 - DNA, 19 bp, Homo sapiens
ctcacctctgtgcgccccc

SEQ ID NO: 8772321 - DNA, 19 bp, Homo sapiens
ctcacctggaggtgctgat

SEQ ID NO: 8772322 - DNA, 19 bp, Homo sapiens
ctcacctctgtgcgccccc

SEQ ID NO: 8772323 - DNA, 22 bp, Homo sapiens
ctcacctgcaatcccttccagg

SEQ ID NO: 8772324 - DNA, 22 bp, Homo sapiens
ctcaccccactaccccttggtg

SEQ ID NO: 8772325 - DNA, 22 bp, Homo sapiens
ctatagaaaattgtatcacacg

SEQ ID NO: 8772326 - DNA, 22 bp, Homo sapiens
ctatagaaaattgtatcacacg

SEQ ID NO: 8772327 - DNA, 22 bp, Homo sapiens
ctatacagcagcttactagtta

SEQ ID NO: 8772328 - DNA, 19 bp, Homo sapiens
ctatacagcctctgaggaa

SEQ ID NO: 8772329 - DNA, 19 bp, Homo sapiens
ctatacagcctctgaggaa

SEQ ID NO: 8772330 - DNA, 22 bp, Homo sapiens
ctcacaggttctgcagctcaca

SEQ ID NO: 8772331 - DNA, 22 bp, Homo sapiens
ctataagacagatactgacttt

SEQ ID NO: 8772332 - DNA, 22 bp, Homo sapiens
ctataagacagatactgacttt

SEQ ID NO: 8772333 - DNA, 22 bp, Homo sapiens
ctatacactttttgaaaataga

SEQ ID NO: 8772334 - DNA, 22 bp, Homo sapiens
ctatacactttttgaaaataga

SEQ ID NO: 8772335 - DNA, 22 bp, Homo sapiens
ctatacagagcatccttaactt

SEQ ID NO: 8772336 - DNA, 22 bp, Homo sapiens
ctataactgggtattagactac

SEQ ID NO: 8772337 - DNA, 22 bp, Homo sapiens
ctataaatctacccagcattgg

SEQ ID NO: 8772338 - DNA, 22 bp, Homo sapiens
ctataaatctacccagcattgg

SEQ ID NO: 8772339 - DNA, 22 bp, Homo sapiens
ttctggcttatcctaactctaa

SEQ ID NO: 8772340 - DNA, 22 bp, Homo sapiens
ttctggcttgacccctacttcc

SEQ ID NO: 8772341 - DNA, 22 bp, Homo sapiens
ttctggcttcatctgacaagcc

SEQ ID NO: 8772342 - DNA, 22 bp, Homo sapiens
ttctggctccagatgcttctgt

SEQ ID NO: 8772343 - DNA, 22 bp, Homo sapiens
ttctggctcgattctctgaccg

SEQ ID NO: 8772344 - DNA, 22 bp, Homo sapiens
ttctggctccgcggggcggccc

SEQ ID NO: 8772345 - DNA, 22 bp, Homo sapiens
ttctggctctcccctgctgggt

SEQ ID NO: 8772346 - DNA, 22 bp, Homo sapiens
ttctggctctcccctgctgggt

SEQ ID NO: 8772347 - DNA, 22 bp, Homo sapiens
ttctggctgcagtccctgtaat

SEQ ID NO: 8772348 - DNA, 22 bp, Homo sapiens
ttctggctgtatgatatttaat

SEQ ID NO: 8772349 - DNA, 22 bp, Homo sapiens
ttctggctgcagtccctgtaat

SEQ ID NO: 8772350 - DNA, 22 bp, Homo sapiens
ttctggctgaaagtttatttga

SEQ ID NO: 8772351 - DNA, 20 bp, Homo sapiens
ttctggcaaacagagttctt

SEQ ID NO: 8772352 - DNA, 20 bp, Homo sapiens
ttctggcaaacagagttctt

SEQ ID NO: 8772353 - DNA, 22 bp, Homo sapiens
ttctggcatctgggggaggcct

SEQ ID NO: 8772354 - DNA, 22 bp, Homo sapiens
ttctggcatgagagatgggggt

SEQ ID NO: 8772355 - DNA, 18 bp, Homo sapiens
ttctggctcactcatgct

SEQ ID NO: 8772356 - DNA, 18 bp, Homo sapiens
ttctggctcactcatgct

SEQ ID NO: 8772357 - DNA, 22 bp, Homo sapiens
ttctggctaccctcctaatgtt

SEQ ID NO: 8772358 - DNA, 22 bp, Homo sapiens
ctcagagaacctaagcggagga

SEQ ID NO: 8772359 - DNA, 22 bp, Homo sapiens
ctcagagaacctaagcggagga

SEQ ID NO: 8772360 - DNA, 22 bp, Homo sapiens
ctcagagaagatggatgaggta

SEQ ID NO: 8772361 - DNA, 22 bp, Homo sapiens
ctcagaaagggttgctgagggc

SEQ ID NO: 8772362 - DNA, 22 bp, Homo sapiens
ttctttctgtccataatgagac

SEQ ID NO: 8772363 - DNA, 22 bp, Homo sapiens
ctcagaaaggtgccatttatgt

SEQ ID NO: 8772364 - DNA, 22 bp, Homo sapiens
ctcagagaaaaggagcaagggt

SEQ ID NO: 8772365 - DNA, 22 bp, Homo sapiens
ttctttctgtcatggtgtactg

SEQ ID NO: 8772366 - DNA, 22 bp, Homo sapiens
ttctttctggggtccttcggct

SEQ ID NO: 8772367 - DNA, 22 bp, Homo sapiens
ttctttctctgtaaaaggaaaa

SEQ ID NO: 8772368 - DNA, 22 bp, Homo sapiens
ttctttctctgtaaaaggaaaa

SEQ ID NO: 8772369 - DNA, 22 bp, Homo sapiens
ttctttctgaatacagttgagt

SEQ ID NO: 8772370 - DNA, 22 bp, Homo sapiens
ctcactgcaagctcagcctccc

SEQ ID NO: 8772371 - DNA, 22 bp, Homo sapiens
ttctttctctactagcagagct

SEQ ID NO: 8772372 - DNA, 22 bp, Homo sapiens
ttctttctgggaagagttcaga

SEQ ID NO: 8772373 - DNA, 22 bp, Homo sapiens
ttctttctgggaagagttcaga

SEQ ID NO: 8772374 - DNA, 21 bp, Homo sapiens
ttctttctgaatctgaagtat

SEQ ID NO: 8772375 - DNA, 22 bp, Homo sapiens
ttctttctgaatacagttgagt

SEQ ID NO: 8772376 - DNA, 22 bp, Homo sapiens
ttctttctgaatacagttgagt

SEQ ID NO: 8772377 - DNA, 22 bp, Homo sapiens
ttctttctgaatacagttgagt

SEQ ID NO: 8772378 - DNA, 21 bp, Homo sapiens
ttctttctgaatctgaagtat

SEQ ID NO: 8772379 - DNA, 21 bp, Homo sapiens
ttctttctgaatctgaagtat

SEQ ID NO: 8772380 - DNA, 22 bp, Homo sapiens
ctcagagcccagggtacacccg

SEQ ID NO: 8772381 - DNA, 22 bp, Homo sapiens
ctcagagctgaggccagggaca

SEQ ID NO: 8772382 - DNA, 17 bp, Homo sapiens
ctcagagcaggacagaa

SEQ ID NO: 8772383 - DNA, 21 bp, Homo sapiens
ctcagagcagttcagagggat

SEQ ID NO: 8772384 - DNA, 21 bp, Homo sapiens
ctcagagcagttcagagggat

SEQ ID NO: 8772385 - DNA, 22 bp, Homo sapiens
ctcagagccagttagcaggtgc

SEQ ID NO: 8772386 - DNA, 22 bp, Homo sapiens
ctcagagccagttagcaggtgc

SEQ ID NO: 8772387 - DNA, 19 bp, Homo sapiens
ctcagagaggggcagtgcc

SEQ ID NO: 8772388 - DNA, 19 bp, Homo sapiens
ctcagagaggggcagtgcc

SEQ ID NO: 8772389 - DNA, 22 bp, Homo sapiens
ctcagagaggttgaacaacttg

SEQ ID NO: 8772390 - DNA, 21 bp, Homo sapiens
ctcagagacaaatgccatccc

SEQ ID NO: 8772391 - DNA, 22 bp, Homo sapiens
ctcagagcacttttgaaagctc

SEQ ID NO: 8772392 - DNA, 22 bp, Homo sapiens
ctcagagcaatgaacatgcaaa

SEQ ID NO: 8772393 - DNA, 22 bp, Homo sapiens
ctcagagagtgaattcctgcct

SEQ ID NO: 8772394 - DNA, 18 bp, Homo sapiens
ctcagagatgcccttatt

SEQ ID NO: 8772395 - DNA, 22 bp, Homo sapiens
ttctattgtaccttttctctca

SEQ ID NO: 8772396 - DNA, 22 bp, Homo sapiens
ttctattgtaccttttctctca

SEQ ID NO: 8772397 - DNA, 22 bp, Homo sapiens
ttctatttccagtccttcagag

SEQ ID NO: 8772398 - DNA, 22 bp, Homo sapiens
ttctattgggcagcattgcttc

SEQ ID NO: 8772399 - DNA, 22 bp, Homo sapiens
ttctattgggcagcattgcttc

SEQ ID NO: 8772400 - DNA, 22 bp, Homo sapiens
ttctattaatatgttaattctg

SEQ ID NO: 8772401 - DNA, 22 bp, Homo sapiens
ttctattgacattcactgtaac

SEQ ID NO: 8772402 - DNA, 22 bp, Homo sapiens
ttctattgaatgataatctata

SEQ ID NO: 8772403 - DNA, 22 bp, Homo sapiens
ttctattaatatgttaattctg

SEQ ID NO: 8772404 - DNA, 22 bp, Homo sapiens
ttctattgcacacaaataatta

SEQ ID NO: 8772405 - DNA, 22 bp, Homo sapiens
ttctattgacattcactgtaac

SEQ ID NO: 8772406 - DNA, 22 bp, Homo sapiens
ttctattgacattcactgtaac

SEQ ID NO: 8772407 - DNA, 22 bp, Homo sapiens
ttctattgcacacaaataatta

SEQ ID NO: 8772408 - DNA, 22 bp, Homo sapiens
ttctattgcacacaaataatta

SEQ ID NO: 8772409 - DNA, 22 bp, Homo sapiens
ttctatgtgctggagaatattt

SEQ ID NO: 8772410 - DNA, 22 bp, Homo sapiens
ttctatgtggatatagaactgc

SEQ ID NO: 8772411 - DNA, 22 bp, Homo sapiens
ttctatgttagtatgggtctcc

SEQ ID NO: 8772412 - DNA, 22 bp, Homo sapiens
ttctatgtgttgacaagcctga

SEQ ID NO: 8772413 - DNA, 22 bp, Homo sapiens
ttctatgtacctagcgttgtat

SEQ ID NO: 8772414 - DNA, 22 bp, Homo sapiens
ttctatgtacctagcgttgtat

SEQ ID NO: 8772415 - DNA, 22 bp, Homo sapiens
ttctatgtagataaggctgctc

SEQ ID NO: 8772416 - DNA, 20 bp, Homo sapiens
ttctatggaccagtatattt

SEQ ID NO: 8772417 - DNA, 22 bp, Homo sapiens
ttctatgtcagtgtgctctgtg

SEQ ID NO: 8772418 - DNA, 22 bp, Homo sapiens
ttctatgtgaacgttatagttt

SEQ ID NO: 8772419 - DNA, 22 bp, Homo sapiens
ttctatttccagtccttcagag

SEQ ID NO: 8772420 - DNA, 22 bp, Homo sapiens
ttctatttcttaatcttggctg

SEQ ID NO: 8772421 - DNA, 22 bp, Homo sapiens
ttctatttccagtccttcagag

SEQ ID NO: 8772422 - DNA, 22 bp, Homo sapiens
ttctatttcttaatcttggctg

SEQ ID NO: 8772423 - DNA, 22 bp, Homo sapiens
ttctgaagctcccttttgtagt

SEQ ID NO: 8772424 - DNA, 22 bp, Homo sapiens
ttctgcatacactgaatgtagt

SEQ ID NO: 8772425 - DNA, 22 bp, Homo sapiens
ttctgcataggctatatttgtt

SEQ ID NO: 8772426 - DNA, 23 bp, Homo sapiens
ttctggaagatttacttgagaca

SEQ ID NO: 8772427 - DNA, 23 bp, Homo sapiens
ttctggaagatttacttgagaca

SEQ ID NO: 8772428 - DNA, 23 bp, Homo sapiens
ttctggatgttctagtctgagag

SEQ ID NO: 8772429 - DNA, 22 bp, Homo sapiens
ttctggaaggatgtttctatct

SEQ ID NO: 8772430 - DNA, 22 bp, Homo sapiens
ttctggaactatactgttggtg

SEQ ID NO: 8772431 - DNA, 22 bp, Homo sapiens
ttctggaagagtaaaataagcc

SEQ ID NO: 8772432 - DNA, 22 bp, Homo sapiens
ttctgcatggagaaactgagtc

SEQ ID NO: 8772433 - DNA, 22 bp, Homo sapiens
ttctgcatgccctctgtgtggc

SEQ ID NO: 8772434 - DNA, 22 bp, Homo sapiens
ttctgcatgatattaaatgtaa

SEQ ID NO: 8772435 - DNA, 22 bp, Homo sapiens
ttctgcatgatattaaatgtaa

SEQ ID NO: 8772436 - DNA, 22 bp, Homo sapiens
cgtgtggtcccggcaaggcaag

SEQ ID NO: 8772437 - DNA, 22 bp, Homo sapiens
cgtgtggtcccggcaaggcaag

SEQ ID NO: 8772438 - DNA, 20 bp, Homo sapiens
cgtgtgtggctattttgggt

SEQ ID NO: 8772439 - DNA, 20 bp, Homo sapiens
cgtgtgtggctattttgggt

SEQ ID NO: 8772440 - DNA, 22 bp, Homo sapiens
cgtgtgtgtacctgcgcattta

SEQ ID NO: 8772441 - DNA, 22 bp, Homo sapiens
cgtgtacacgcacacgtgtcct

SEQ ID NO: 8772442 - DNA, 22 bp, Homo sapiens
cgtgggtcgggactccgcctcg

SEQ ID NO: 8772443 - DNA, 22 bp, Homo sapiens
cgtgtatgtgcctgcattcaca

SEQ ID NO: 8772444 - DNA, 22 bp, Homo sapiens
cgtgtatgataaatgttaataa

SEQ ID NO: 8772445 - DNA, 22 bp, Homo sapiens
cgtgtacagtctatcttttttc

SEQ ID NO: 8772446 - DNA, 22 bp, Homo sapiens
cgtgtagcatgcgccaccacca

SEQ ID NO: 8772447 - DNA, 22 bp, Homo sapiens
cgtgtgtgtacctgcgcattta

SEQ ID NO: 8772448 - DNA, 22 bp, Homo sapiens
cgttcacatcgtattattggga

SEQ ID NO: 8772449 - DNA, 22 bp, Homo sapiens
cgttctctcatgatcttcccga

SEQ ID NO: 8772450 - DNA, 22 bp, Homo sapiens
cgttgtttgagattttcagaat

SEQ ID NO: 8772451 - DNA, 22 bp, Homo sapiens
cgttttcttcactttgcaagtt

SEQ ID NO: 8772452 - DNA, 23 bp, Homo sapiens
cgttttttcctcagatgttctgg

SEQ ID NO: 8772453 - DNA, 23 bp, Homo sapiens
cgttttttcctcagatgttctgg

SEQ ID NO: 8772454 - DNA, 22 bp, Homo sapiens
cgtttattttgaagattccact

SEQ ID NO: 8772455 - DNA, 22 bp, Homo sapiens
cgtttccaactgtgatgaggtc

SEQ ID NO: 8772456 - DNA, 22 bp, Homo sapiens
cgttttcatgggtagaggttct

SEQ ID NO: 8772457 - DNA, 22 bp, Homo sapiens
cgttttcttcactttgcaagtt

SEQ ID NO: 8772458 - DNA, 22 bp, Homo sapiens
ctagagaaaccccatgagcttt

SEQ ID NO: 8772459 - DNA, 22 bp, Homo sapiens
ctagagaacaacattcatatgg

SEQ ID NO: 8772460 - DNA, 22 bp, Homo sapiens
ctagagaagaggttaagcatga

SEQ ID NO: 8772461 - DNA, 22 bp, Homo sapiens
ctagagaatcttttaagaagtg

SEQ ID NO: 8772462 - DNA, 22 bp, Homo sapiens
ctagagaagaggttaagcatga

SEQ ID NO: 8772463 - DNA, 18 bp, Homo sapiens
ctagagaaggttactatg

SEQ ID NO: 8772464 - DNA, 22 bp, Homo sapiens
ctagagaatcttttaagaagtg

SEQ ID NO: 8772465 - DNA, 22 bp, Homo sapiens
ctagagaatggcaaagattaga

SEQ ID NO: 8772466 - DNA, 22 bp, Homo sapiens
ctagagaattgtcttgagagtt

SEQ ID NO: 8772467 - DNA, 22 bp, Homo sapiens
ctagagaaaatgttaatacagt

SEQ ID NO: 8772468 - DNA, 22 bp, Homo sapiens
ctagagaaacagtgctctgaac

SEQ ID NO: 8772469 - DNA, 22 bp, Homo sapiens
ctagagaaaatgatagcaggaa

SEQ ID NO: 8772470 - DNA, 22 bp, Homo sapiens
ctagaaatattttacagtcaag

SEQ ID NO: 8772471 - DNA, 22 bp, Homo sapiens
ctagaaagatacttaaatcaag

SEQ ID NO: 8772472 - DNA, 22 bp, Homo sapiens
ctagaaagatacttaaatcaag

SEQ ID NO: 8772473 - DNA, 22 bp, Homo sapiens
ctaaaaatccacactaggtgaa

SEQ ID NO: 8772474 - DNA, 17 bp, Homo sapiens
ctagagagaaagagcta

SEQ ID NO: 8772475 - DNA, 22 bp, Homo sapiens
ctagagaattgtcttgagagtt

SEQ ID NO: 8772476 - DNA, 22 bp, Homo sapiens
ctagagggatgttaggatagca

SEQ ID NO: 8772477 - DNA, 22 bp, Homo sapiens
ctagagggatgttaggatagca

SEQ ID NO: 8772478 - DNA, 22 bp, Homo sapiens
ctagagctttctgctggtgttg

SEQ ID NO: 8772479 - DNA, 22 bp, Homo sapiens
ctagagctgttctgtgcactca

SEQ ID NO: 8772480 - DNA, 22 bp, Homo sapiens
ctagagctgttctgtgcactca

SEQ ID NO: 8772481 - DNA, 22 bp, Homo sapiens
ctagagcagattgcagagtagg

SEQ ID NO: 8772482 - DNA, 22 bp, Homo sapiens
ctagaggtagaggcagtgggaa

SEQ ID NO: 8772483 - DNA, 22 bp, Homo sapiens
ctagatctgcccactgaagttc

SEQ ID NO: 8772484 - DNA, 22 bp, Homo sapiens
ccttacaatgcagtttacttag

SEQ ID NO: 8772485 - DNA, 22 bp, Homo sapiens
ccttaaaagaactatctcttct

SEQ ID NO: 8772486 - DNA, 22 bp, Homo sapiens
ccttaaactctgatatgatatt

SEQ ID NO: 8772487 - DNA, 22 bp, Homo sapiens
ccttaaactttatcttgtgaga

SEQ ID NO: 8772488 - DNA, 22 bp, Homo sapiens
ttaagcaacacacattaattat

SEQ ID NO: 8772489 - DNA, 22 bp, Homo sapiens
ttaagcaacacacattaattat

SEQ ID NO: 8772490 - DNA, 22 bp, Homo sapiens
ttaagcatggaagtgaaataat

SEQ ID NO: 8772491 - DNA, 22 bp, Homo sapiens
ttaagcataattaaagtgaaat

SEQ ID NO: 8772492 - DNA, 21 bp, Homo sapiens
cctgtgtgtgtccctttaaga

SEQ ID NO: 8772493 - DNA, 22 bp, Homo sapiens
cctgtgtgtctgtcactgcaca

SEQ ID NO: 8772494 - DNA, 22 bp, Homo sapiens
cctgtgtgtctgtcactgcaca

SEQ ID NO: 8772495 - DNA, 22 bp, Homo sapiens
cctgtgtgtctgtcactgcaca

SEQ ID NO: 8772496 - DNA, 21 bp, Homo sapiens
cctgtgtgtgtccctttaaga

SEQ ID NO: 8772497 - DNA, 22 bp, Homo sapiens
ccttagaaggctgaataattct

SEQ ID NO: 8772498 - DNA, 22 bp, Homo sapiens
ccttagaagaaagttacttttt

SEQ ID NO: 8772499 - DNA, 22 bp, Homo sapiens
ccttacctgattgctggcatcc

SEQ ID NO: 8772500 - DNA, 22 bp, Homo sapiens
ccttagaaaatcatggaatatt

SEQ ID NO: 8772501 - DNA, 22 bp, Homo sapiens
ccttagaaatgtaccaaaggaa

SEQ ID NO: 8772502 - DNA, 22 bp, Homo sapiens
ccttacctgattgctggcatcc

SEQ ID NO: 8772503 - DNA, 22 bp, Homo sapiens
ccttacctgattgctggcatcc

SEQ ID NO: 8772504 - DNA, 22 bp, Homo sapiens
ccttaatctgatatggctggtg

SEQ ID NO: 8772505 - DNA, 22 bp, Homo sapiens
ccttagatcaggctgtctaggg

SEQ ID NO: 8772506 - DNA, 22 bp, Homo sapiens
ccttagaggcaggaagaattgc

SEQ ID NO: 8772507 - DNA, 22 bp, Homo sapiens
ttacaaagagtgccagagtgtg

SEQ ID NO: 8772508 - DNA, 22 bp, Homo sapiens
ccttatggccaacctttgcctt

SEQ ID NO: 8772509 - DNA, 22 bp, Homo sapiens
ccttagtgtgcctgaggcagat

SEQ ID NO: 8772510 - DNA, 22 bp, Homo sapiens
ccttagtgaaacagaggcaatt

SEQ ID NO: 8772511 - DNA, 22 bp, Homo sapiens
ccttagggactaatagactgtc

SEQ ID NO: 8772512 - DNA, 17 bp, Homo sapiens
ccttagggcagtgtggt

SEQ ID NO: 8772513 - DNA, 22 bp, Homo sapiens
ccttagctggagtggtggaatg

SEQ ID NO: 8772514 - DNA, 22 bp, Homo sapiens
ttacaaagagtgttcttttcca

SEQ ID NO: 8772515 - DNA, 22 bp, Homo sapiens
ttacaaagattatattcagtta

SEQ ID NO: 8772516 - DNA, 21 bp, Homo sapiens
ttacaaagcaagtgctgtgtc

SEQ ID NO: 8772517 - DNA, 22 bp, Homo sapiens
ttacaaagattatattcagtta

SEQ ID NO: 8772518 - DNA, 22 bp, Homo sapiens
ttacaaagattatattcagtta

SEQ ID NO: 8772519 - DNA, 22 bp, Homo sapiens
ttacaaagcaggtcagctgaaa

SEQ ID NO: 8772520 - DNA, 22 bp, Homo sapiens
ttacaaagcgttgagacaagta

SEQ ID NO: 8772521 - DNA, 22 bp, Homo sapiens
ttacagaagtgaaggcctttaa

SEQ ID NO: 8772522 - DNA, 22 bp, Homo sapiens
ttacaaagcgttgagacaagta

SEQ ID NO: 8772523 - DNA, 22 bp, Homo sapiens
ttacaaagcgttgagacaagta

SEQ ID NO: 8772524 - DNA, 22 bp, Homo sapiens
ttacagttactggtactgttaa

SEQ ID NO: 8772525 - DNA, 22 bp, Homo sapiens
ttacagttagaatctgatgaaa

SEQ ID NO: 8772526 - DNA, 22 bp, Homo sapiens
ttacagttagaatctgatgaaa

SEQ ID NO: 8772527 - DNA, 22 bp, Homo sapiens
ttacagttaggtgtgtagtggt

SEQ ID NO: 8772528 - DNA, 22 bp, Homo sapiens
ttacagttgctacaaaggataa

SEQ ID NO: 8772529 - DNA, 22 bp, Homo sapiens
ttacagaagtttcagcgtttta

SEQ ID NO: 8772530 - DNA, 22 bp, Homo sapiens
ttacagtgttacttgatgtcca

SEQ ID NO: 8772531 - DNA, 22 bp, Homo sapiens
ttacagttgttctatcagcatg

SEQ ID NO: 8772532 - DNA, 22 bp, Homo sapiens
ttacagtttacataagaattgt

SEQ ID NO: 8772533 - DNA, 22 bp, Homo sapiens
ttacagtttacataagaattgt

SEQ ID NO: 8772534 - DNA, 22 bp, Homo sapiens
ttacagttgttctatcagcatg

SEQ ID NO: 8772535 - DNA, 22 bp, Homo sapiens
ttacagtttaagaggaaacaaa

SEQ ID NO: 8772536 - DNA, 22 bp, Homo sapiens
ttacagtttaccaagaatattg

SEQ ID NO: 8772537 - DNA, 22 bp, Homo sapiens
ttacagtttaagaggaaacaaa

SEQ ID NO: 8772538 - DNA, 22 bp, Homo sapiens
ttacagtttacataagaattgt

SEQ ID NO: 8772539 - DNA, 22 bp, Homo sapiens
ttacagtttagtccaagccaga

SEQ ID NO: 8772540 - DNA, 22 bp, Homo sapiens
ttacagtttaccaagaatattg

SEQ ID NO: 8772541 - DNA, 22 bp, Homo sapiens
ttacagtttatccaggaagagc

SEQ ID NO: 8772542 - DNA, 22 bp, Homo sapiens
ttaaattagtcaagcttctctg

SEQ ID NO: 8772543 - DNA, 22 bp, Homo sapiens
ttaaattattgagggattgtca

SEQ ID NO: 8772544 - DNA, 22 bp, Homo sapiens
ttaaattattgagggattgtca

SEQ ID NO: 8772545 - DNA, 22 bp, Homo sapiens
ttaaatagctcttgtagaagaa

SEQ ID NO: 8772546 - DNA, 22 bp, Homo sapiens
ttaaatagtaggtctattttgg

SEQ ID NO: 8772547 - DNA, 22 bp, Homo sapiens
tgtcagctcccagtcagagaga

SEQ ID NO: 8772548 - DNA, 22 bp, Homo sapiens
ttaaatagtaggtctattttgg

SEQ ID NO: 8772549 - DNA, 22 bp, Homo sapiens
tgtcagcatgaaccctgaatta

SEQ ID NO: 8772550 - DNA, 22 bp, Homo sapiens
tgtcagcagtttttagtggagg

SEQ ID NO: 8772551 - DNA, 21 bp, Homo sapiens
tgtcagagcttgtaggacatt

SEQ ID NO: 8772552 - DNA, 22 bp, Homo sapiens
tgtcagaactctattgatgtcc

SEQ ID NO: 8772553 - DNA, 22 bp, Homo sapiens
tgtcagaactctattgatgtcc

SEQ ID NO: 8772554 - DNA, 21 bp, Homo sapiens
tgtcagcacgcatgaggccag

SEQ ID NO: 8772555 - DNA, 22 bp, Homo sapiens
tgtcagatgcgataaactagtg

SEQ ID NO: 8772556 - DNA, 22 bp, Homo sapiens
tgtcagcaagacatcagagtga

SEQ ID NO: 8772557 - DNA, 22 bp, Homo sapiens
tgtcagatgtgtctccaagtgc

SEQ ID NO: 8772558 - DNA, 22 bp, Homo sapiens
ttaaattttagaaacagactct

SEQ ID NO: 8772559 - DNA, 22 bp, Homo sapiens
ttaaattttagaaacagactct

SEQ ID NO: 8772560 - DNA, 22 bp, Homo sapiens
ttaaatttctacgtgatccagg

SEQ ID NO: 8772561 - DNA, 22 bp, Homo sapiens
ttaaatttctacgtgatccagg

SEQ ID NO: 8772562 - DNA, 22 bp, Homo sapiens
ttaaattccagcctcataatag

SEQ ID NO: 8772563 - DNA, 22 bp, Homo sapiens
ttaaattccagcctcataatag

SEQ ID NO: 8772564 - DNA, 22 bp, Homo sapiens
ttaaattcattccaacttttga

SEQ ID NO: 8772565 - DNA, 22 bp, Homo sapiens
ttaaattccagcctcataatag

SEQ ID NO: 8772566 - DNA, 22 bp, Homo sapiens
ttaaattccagcctcataatag

SEQ ID NO: 8772567 - DNA, 22 bp, Homo sapiens
ttaaattatttctagtgaggtg

SEQ ID NO: 8772568 - DNA, 22 bp, Homo sapiens
ttaaattatttctagtgaggtg

SEQ ID NO: 8772569 - DNA, 22 bp, Homo sapiens
ttaagagtaatggaaggccact

SEQ ID NO: 8772570 - DNA, 22 bp, Homo sapiens
ttaagagtaatggaaggccact

SEQ ID NO: 8772571 - DNA, 22 bp, Homo sapiens
ttaagagttatttgcacataat

SEQ ID NO: 8772572 - DNA, 22 bp, Homo sapiens
ttaagagttatttgcacataat

SEQ ID NO: 8772573 - DNA, 22 bp, Homo sapiens
ttaagagtttagtgccacctgg

SEQ ID NO: 8772574 - DNA, 19 bp, Homo sapiens
ttaagagtaggcattgtgc

SEQ ID NO: 8772575 - DNA, 19 bp, Homo sapiens
ttaagagtaggcattgtgc

SEQ ID NO: 8772576 - DNA, 22 bp, Homo sapiens
ttaagatcaagataagcaataa

SEQ ID NO: 8772577 - DNA, 22 bp, Homo sapiens
ttaaattttagaaacagactct

SEQ ID NO: 8772578 - DNA, 22 bp, Homo sapiens
ttatcagttgtgtgtatacacg

SEQ ID NO: 8772579 - DNA, 22 bp, Homo sapiens
ttatcacttatgagctttttgc

SEQ ID NO: 8772580 - DNA, 22 bp, Homo sapiens
ttatcagagtccccaaaagaaa

SEQ ID NO: 8772581 - DNA, 23 bp, Homo sapiens
ttatcaggacatgctgtctcagg

SEQ ID NO: 8772582 - DNA, 22 bp, Homo sapiens
ttatcatgacaggatgatagaa

SEQ ID NO: 8772583 - DNA, 22 bp, Homo sapiens
ttatcattgtcgcagtctaatt

SEQ ID NO: 8772584 - DNA, 22 bp, Homo sapiens
ttatcacttatgagctttttgc

SEQ ID NO: 8772585 - DNA, 22 bp, Homo sapiens
ttatatttctggtagccttcag

SEQ ID NO: 8772586 - DNA, 22 bp, Homo sapiens
ttatatttctggtagccttcag

SEQ ID NO: 8772587 - DNA, 22 bp, Homo sapiens
ttatatttctggtagccttcag

SEQ ID NO: 8772588 - DNA, 23 bp, Homo sapiens
ttataaatattttcaggtgtgtt

SEQ ID NO: 8772589 - DNA, 22 bp, Homo sapiens
ttataaagtgagaagtgctatg

SEQ ID NO: 8772590 - DNA, 22 bp, Homo sapiens
ttataaagtgagaagtgctatg

SEQ ID NO: 8772591 - DNA, 22 bp, Homo sapiens
ttataaagtgagaagtgctatg

SEQ ID NO: 8772592 - DNA, 22 bp, Homo sapiens
ttataaagtgagaagtgctatg

SEQ ID NO: 8772593 - DNA, 22 bp, Homo sapiens
ttataaaggtttgtgcatattt

SEQ ID NO: 8772594 - DNA, 22 bp, Homo sapiens
ttataaaggtttgtgcatattt

SEQ ID NO: 8772595 - DNA, 22 bp, Homo sapiens
ttataaaggtttgtgcatattt

SEQ ID NO: 8772596 - DNA, 22 bp, Homo sapiens
ttataacattataaagtggaga

SEQ ID NO: 8772597 - DNA, 22 bp, Homo sapiens
ttataacatcaatcagagttaa

SEQ ID NO: 8772598 - DNA, 22 bp, Homo sapiens
ttataacaacagtttactttaa

SEQ ID NO: 8772599 - DNA, 22 bp, Homo sapiens
ttataacactgccttgtcacca

SEQ ID NO: 8772600 - DNA, 22 bp, Homo sapiens
ccttgagaggaagtttgtagaa

SEQ ID NO: 8772601 - DNA, 22 bp, Homo sapiens
ccttgagacacagccaaagatg

SEQ ID NO: 8772602 - DNA, 22 bp, Homo sapiens
ccttgagagaagtctgtgcctt

SEQ ID NO: 8772603 - DNA, 22 bp, Homo sapiens
ccttgagacacagccaaagatg

SEQ ID NO: 8772604 - DNA, 22 bp, Homo sapiens
ccttgactgtaatggagtaggg

SEQ ID NO: 8772605 - DNA, 22 bp, Homo sapiens
ccttgaaatgttctcactgggg

SEQ ID NO: 8772606 - DNA, 22 bp, Homo sapiens
ccttgaaatgttctcactgggg

SEQ ID NO: 8772607 - DNA, 22 bp, Homo sapiens
ccttgagatgagctaatttttt

SEQ ID NO: 8772608 - DNA, 21 bp, Homo sapiens
ccttgaggcccaggccaggcc

SEQ ID NO: 8772609 - DNA, 22 bp, Homo sapiens
ccttgagttgaattaatggtgg

SEQ ID NO: 8772610 - DNA, 22 bp, Homo sapiens
ccttgatggtgagagctgcaga

SEQ ID NO: 8772611 - DNA, 22 bp, Homo sapiens
ccttgcaggggaacaggcagtg

SEQ ID NO: 8772612 - DNA, 22 bp, Homo sapiens
ccttgcagacatcagtagtggc

SEQ ID NO: 8772613 - DNA, 22 bp, Homo sapiens
ccttgcatgtgctaacgacaag

SEQ ID NO: 8772614 - DNA, 22 bp, Homo sapiens
ccttgcagttgttactgtagcc

SEQ ID NO: 8772615 - DNA, 22 bp, Homo sapiens
ccttgcatttaaaggcgtaggg

SEQ ID NO: 8772616 - DNA, 22 bp, Homo sapiens
ccttgcatctcatttcattctt

SEQ ID NO: 8772617 - DNA, 22 bp, Homo sapiens
ccttgcatctcatttcattctt

SEQ ID NO: 8772618 - DNA, 22 bp, Homo sapiens
ccttgcatatattatatctttg

SEQ ID NO: 8772619 - DNA, 22 bp, Homo sapiens
ccttgcatatattatatctttg

SEQ ID NO: 8772620 - DNA, 22 bp, Homo sapiens
ccttgcctcattgtgcttctcc

SEQ ID NO: 8772621 - DNA, 22 bp, Homo sapiens
ccttgccctgagcaggggtcag

SEQ ID NO: 8772622 - DNA, 22 bp, Homo sapiens
ccttgcccgctgcctctgagtt

SEQ ID NO: 8772623 - DNA, 22 bp, Homo sapiens
ttagttttcccatctttatggt

SEQ ID NO: 8772624 - DNA, 22 bp, Homo sapiens
ttataaagattgttatgtatct

SEQ ID NO: 8772625 - DNA, 22 bp, Homo sapiens
ttataaagattgttatgtatct

SEQ ID NO: 8772626 - DNA, 22 bp, Homo sapiens
ttataaagattgttatgtatct

SEQ ID NO: 8772627 - DNA, 22 bp, Homo sapiens
ttagttttctcatctatctcac

SEQ ID NO: 8772628 - DNA, 22 bp, Homo sapiens
ttataaagatccttccagagtt

SEQ ID NO: 8772629 - DNA, 22 bp, Homo sapiens
ttataaagattgttatgtatct

SEQ ID NO: 8772630 - DNA, 22 bp, Homo sapiens
ttagttttcccatctttatggt

SEQ ID NO: 8772631 - DNA, 22 bp, Homo sapiens
ttagttttcccatctttatggt

SEQ ID NO: 8772632 - DNA, 22 bp, Homo sapiens
ttagttttcccatctttatggt

SEQ ID NO: 8772633 - DNA, 22 bp, Homo sapiens
ttagttttctcatctatctcac

SEQ ID NO: 8772634 - DNA, 22 bp, Homo sapiens
ttagttttcccatctttatggt

SEQ ID NO: 8772635 - DNA, 22 bp, Homo sapiens
ttagcaaactctgttagattct

SEQ ID NO: 8772636 - DNA, 22 bp, Homo sapiens
ttagacaggatgtatgaaagct

SEQ ID NO: 8772637 - DNA, 22 bp, Homo sapiens
ttagacagagctccttgagggc

SEQ ID NO: 8772638 - DNA, 22 bp, Homo sapiens
ttagacaggatgtatgaaagct

SEQ ID NO: 8772639 - DNA, 18 bp, Homo sapiens
ccttcagctctgccagta

SEQ ID NO: 8772640 - DNA, 22 bp, Homo sapiens
ttagacagagctccttgagggc

SEQ ID NO: 8772641 - DNA, 22 bp, Homo sapiens
ttagcaaatatcttgaaacagg

SEQ ID NO: 8772642 - DNA, 22 bp, Homo sapiens
ttagcaaatatcttgaaacagg

SEQ ID NO: 8772643 - DNA, 22 bp, Homo sapiens
ttagcaaagtttgccatctagt

SEQ ID NO: 8772644 - DNA, 21 bp, Homo sapiens
ttagcaaagcaaacacatgct

SEQ ID NO: 8772645 - DNA, 22 bp, Homo sapiens
ttagcaaactctgttagattct

SEQ ID NO: 8772646 - DNA, 22 bp, Homo sapiens
ttagcaaagaagatgtgagttt

SEQ ID NO: 8772647 - DNA, 22 bp, Homo sapiens
ttagcaacacccatttgtgtgc

SEQ ID NO: 8772648 - DNA, 22 bp, Homo sapiens
ttagcaaatatcttgaaacagg

SEQ ID NO: 8772649 - DNA, 22 bp, Homo sapiens
ttagcaaatatcttgaaacagg

SEQ ID NO: 8772650 - DNA, 22 bp, Homo sapiens
ttagcaaatatcttgaaacagg

SEQ ID NO: 8772651 - DNA, 22 bp, Homo sapiens
ttagcaatatgaatgcatttgc

SEQ ID NO: 8772652 - DNA, 22 bp, Homo sapiens
ttagcaatgtatgattaaaata

SEQ ID NO: 8772653 - DNA, 22 bp, Homo sapiens
ttagcaatgtatgattaaaata

SEQ ID NO: 8772654 - DNA, 22 bp, Homo sapiens
ttagcaattgattctcataagc

SEQ ID NO: 8772655 - DNA, 22 bp, Homo sapiens
ttagcactggattaatcaaagt

SEQ ID NO: 8772656 - DNA, 22 bp, Homo sapiens
ccttgaaaccacatcttagaaa

SEQ ID NO: 8772657 - DNA, 22 bp, Homo sapiens
ccttgaaaccctgacactctgt

SEQ ID NO: 8772658 - DNA, 22 bp, Homo sapiens
ccttgaaaccctgacactctgt

SEQ ID NO: 8772659 - DNA, 22 bp, Homo sapiens
ccttgaaagccaggcagaggaa

SEQ ID NO: 8772660 - DNA, 22 bp, Homo sapiens
ccttgaaagtatatgctcaatt

SEQ ID NO: 8772661 - DNA, 22 bp, Homo sapiens
ccttgaaagccaggcagaggaa

SEQ ID NO: 8772662 - DNA, 22 bp, Homo sapiens
ccttgaaatgagaaaaagttgg

SEQ ID NO: 8772663 - DNA, 22 bp, Homo sapiens
ccttgaaagtatatgctcaatt

SEQ ID NO: 8772664 - DNA, 23 bp, Homo sapiens
ttagcacatgcccagagggatga

SEQ ID NO: 8772665 - DNA, 22 bp, Homo sapiens
ttagcacaggcaactccacata

SEQ ID NO: 8772666 - DNA, 22 bp, Homo sapiens
ccttcaagttcctggtccctgg

SEQ ID NO: 8772667 - DNA, 22 bp, Homo sapiens
ccttcaaggcaaggagggctgg

SEQ ID NO: 8772668 - DNA, 22 bp, Homo sapiens
ccttcaaattctcttagctgaa

SEQ ID NO: 8772669 - DNA, 22 bp, Homo sapiens
ccttcaaggcaaggagggctgg

SEQ ID NO: 8772670 - DNA, 22 bp, Homo sapiens
ccttcacaccatctttaccagg

SEQ ID NO: 8772671 - DNA, 22 bp, Homo sapiens
ccttcacaccatctttaccagg

SEQ ID NO: 8772672 - DNA, 22 bp, Homo sapiens
ccttcacacaggtagaagcaga

SEQ ID NO: 8772673 - DNA, 22 bp, Homo sapiens
ccttcacacaggtagaagcaga

SEQ ID NO: 8772674 - DNA, 22 bp, Homo sapiens
ccttcacactttcacttggata

SEQ ID NO: 8772675 - DNA, 20 bp, Homo sapiens
ccttcagaacttacatagta

SEQ ID NO: 8772676 - DNA, 20 bp, Homo sapiens
ccttcagaacttacatagta

SEQ ID NO: 8772677 - DNA, 22 bp, Homo sapiens
ccttcagcctagaacttgagag

SEQ ID NO: 8772678 - DNA, 22 bp, Homo sapiens
ccttcagccagttttctttgtt

SEQ ID NO: 8772679 - DNA, 22 bp, Homo sapiens
ccttcagaggtgtagattgcgt

SEQ ID NO: 8772680 - DNA, 22 bp, Homo sapiens
ccttcacactttcacttggata

SEQ ID NO: 8772681 - DNA, 22 bp, Homo sapiens
ccttcagaatgaaattctaatg

SEQ ID NO: 8772682 - DNA, 22 bp, Homo sapiens
ccttcagaatgaaattctaatg

SEQ ID NO: 8772683 - DNA, 23 bp, Homo sapiens
ccttcagaagaagtaacaggggc

SEQ ID NO: 8772684 - DNA, 22 bp, Homo sapiens
ttacagtttatccaggaagagc

SEQ ID NO: 8772685 - DNA, 22 bp, Homo sapiens
ttacagtttctagtaatacttg

SEQ ID NO: 8772686 - DNA, 22 bp, Homo sapiens
ttacagtttctagtaatacttg

SEQ ID NO: 8772687 - DNA, 22 bp, Homo sapiens
ttacataaaagttcacgtaggc

SEQ ID NO: 8772688 - DNA, 22 bp, Homo sapiens
ttacataacggtatgaaaaatg

SEQ ID NO: 8772689 - DNA, 22 bp, Homo sapiens
ttacataacggtatgaaaaatg

SEQ ID NO: 8772690 - DNA, 22 bp, Homo sapiens
ttacataacggtatgaaaaatg

SEQ ID NO: 8772691 - DNA, 22 bp, Homo sapiens
ttacataactttaaaatgccgt

SEQ ID NO: 8772692 - DNA, 22 bp, Homo sapiens
ttacataacggtatgaaaaatg

SEQ ID NO: 8772693 - DNA, 22 bp, Homo sapiens
ttacataactttaaaatgccgt

SEQ ID NO: 8772694 - DNA, 22 bp, Homo sapiens
ttacatagattcatttagttaa

SEQ ID NO: 8772695 - DNA, 22 bp, Homo sapiens
ttacataggtatgtttgctttg

SEQ ID NO: 8772696 - DNA, 22 bp, Homo sapiens
ccttcaaactttcattaaccag

SEQ ID NO: 8772697 - DNA, 22 bp, Homo sapiens
ccttcaaagtacacatctttat

SEQ ID NO: 8772698 - DNA, 22 bp, Homo sapiens
ccttcaaagagtatttcctgag

SEQ ID NO: 8772699 - DNA, 22 bp, Homo sapiens
ttacatagttaaatagtacagc

SEQ ID NO: 8772700 - DNA, 22 bp, Homo sapiens
ccttcaaaacactagtttttga

SEQ ID NO: 8772701 - DNA, 22 bp, Homo sapiens
ttcaaatacattctttgccact

SEQ ID NO: 8772702 - DNA, 21 bp, Homo sapiens
ttcaaagtttgcctaaagatt

SEQ ID NO: 8772703 - DNA, 22 bp, Homo sapiens
ttcaaagtttcaatctgtatca

SEQ ID NO: 8772704 - DNA, 21 bp, Homo sapiens
ttcaaagtttgcctaaagatt

SEQ ID NO: 8772705 - DNA, 21 bp, Homo sapiens
ttcaaagtttgcctaaagatt

SEQ ID NO: 8772706 - DNA, 22 bp, Homo sapiens
ttcaaatcactttggagcttaa

SEQ ID NO: 8772707 - DNA, 22 bp, Homo sapiens
ttcaaatcagaccgaaggcaac

SEQ ID NO: 8772708 - DNA, 22 bp, Homo sapiens
ttcaaatcctagccctgtggcc

SEQ ID NO: 8772709 - DNA, 22 bp, Homo sapiens
ttcaaatccctgctccactatt

SEQ ID NO: 8772710 - DNA, 22 bp, Homo sapiens
ttcaaatgatggcagtcctggc

SEQ ID NO: 8772711 - DNA, 22 bp, Homo sapiens
ttcaaatcctgcttatgctacc

SEQ ID NO: 8772712 - DNA, 22 bp, Homo sapiens
ttcaaagtcctgtcaggtagcc

SEQ ID NO: 8772713 - DNA, 22 bp, Homo sapiens
ttcaaagtgcatgttcctcaga

SEQ ID NO: 8772714 - DNA, 22 bp, Homo sapiens
ttcaaagtgctgttcaaagtag

SEQ ID NO: 8772715 - DNA, 20 bp, Homo sapiens
ttcaaagtgtatgatatgca

SEQ ID NO: 8772716 - DNA, 20 bp, Homo sapiens
ttcaaagtgtatgatatgca

SEQ ID NO: 8772717 - DNA, 22 bp, Homo sapiens
ttcaaagtgtgacctgacaagc

SEQ ID NO: 8772718 - DNA, 22 bp, Homo sapiens
cggagaggacctgcaactcgct

SEQ ID NO: 8772719 - DNA, 22 bp, Homo sapiens
cggagaggtgggggcagcatct

SEQ ID NO: 8772720 - DNA, 22 bp, Homo sapiens
cggagaggtgggggcagcatct

SEQ ID NO: 8772721 - DNA, 22 bp, Homo sapiens
cggaggttgaggctgcagtgag

SEQ ID NO: 8772722 - DNA, 22 bp, Homo sapiens
cggacccactcggatcccagcc

SEQ ID NO: 8772723 - DNA, 22 bp, Homo sapiens
cggacccactcggatcccagcc

SEQ ID NO: 8772724 - DNA, 22 bp, Homo sapiens
cggagaggacctgcaactcgct

SEQ ID NO: 8772725 - DNA, 22 bp, Homo sapiens
cggagaggacctgcaactcgct

SEQ ID NO: 8772726 - DNA, 22 bp, Homo sapiens
ttcaaatggttagactgttagc

SEQ ID NO: 8772727 - DNA, 22 bp, Homo sapiens
ttcaaatgcaagttactacttt

SEQ ID NO: 8772728 - DNA, 22 bp, Homo sapiens
ttcaaatgcaagttactacttt

SEQ ID NO: 8772729 - DNA, 22 bp, Homo sapiens
ttcaaatggttagactgttagc

SEQ ID NO: 8772730 - DNA, 22 bp, Homo sapiens
cggagtcttgctatgttgccca

SEQ ID NO: 8772731 - DNA, 22 bp, Homo sapiens
cggagtcttgctatgttgccca

SEQ ID NO: 8772732 - DNA, 22 bp, Homo sapiens
cggagtcttgctatgttgccca

SEQ ID NO: 8772733 - DNA, 22 bp, Homo sapiens
cggagtcttgctatgttgccca

SEQ ID NO: 8772734 - DNA, 22 bp, Homo sapiens
cggaggttgaggctgcagtgag

SEQ ID NO: 8772735 - DNA, 22 bp, Homo sapiens
cggaggttgaggctgcagtgag

SEQ ID NO: 8772736 - DNA, 22 bp, Homo sapiens
cggaggttgaggctgcagtgag

SEQ ID NO: 8772737 - DNA, 22 bp, Homo sapiens
cggcagagccctgagtcagcct

SEQ ID NO: 8772738 - DNA, 22 bp, Homo sapiens
cggcagagccctgagtcagcct

SEQ ID NO: 8772739 - DNA, 22 bp, Homo sapiens
cggcagagccctgagtcagcct

SEQ ID NO: 8772740 - DNA, 22 bp, Homo sapiens
cggcagagacggcgctttgaac

SEQ ID NO: 8772741 - DNA, 22 bp, Homo sapiens
cggcagagcggcgagcccctcc

SEQ ID NO: 8772742 - DNA, 22 bp, Homo sapiens
cggcagagcggcgagcccctcc

SEQ ID NO: 8772743 - DNA, 22 bp, Homo sapiens
cggcagagcttcctgctcagcg

SEQ ID NO: 8772744 - DNA, 22 bp, Homo sapiens
cggcagagcttcctgctcagcg

SEQ ID NO: 8772745 - DNA, 22 bp, Homo sapiens
cggagttgtaagggatgtggct

SEQ ID NO: 8772746 - DNA, 22 bp, Homo sapiens
cggatcctcagtcgtgcgggag

SEQ ID NO: 8772747 - DNA, 22 bp, Homo sapiens
cggcacagtggctcacgcctgt

SEQ ID NO: 8772748 - DNA, 22 bp, Homo sapiens
cggcagagacggcgctttgaac

SEQ ID NO: 8772749 - DNA, 22 bp, Homo sapiens
cggcacagggtaaacgttaccc

SEQ ID NO: 8772750 - DNA, 22 bp, Homo sapiens
cggcacagccgggcaaggctgg

SEQ ID NO: 8772751 - DNA, 22 bp, Homo sapiens
cggcacagccgggcaaggctgg

SEQ ID NO: 8772752 - DNA, 22 bp, Homo sapiens
cggcagagtgtgtgcgtgcatg

SEQ ID NO: 8772753 - DNA, 22 bp, Homo sapiens
cggcagagtgtgtgcgtgcatg

SEQ ID NO: 8772754 - DNA, 18 bp, Homo sapiens
cggcagagtgcttctagc

SEQ ID NO: 8772755 - DNA, 18 bp, Homo sapiens
cggcagagtgcttctagc

SEQ ID NO: 8772756 - DNA, 22 bp, Homo sapiens
cggcaggacctcatttccttct

SEQ ID NO: 8772757 - DNA, 22 bp, Homo sapiens
cggcagctgattgcagagcacc

SEQ ID NO: 8772758 - DNA, 22 bp, Homo sapiens
cggcagctcgagggccacccgt

SEQ ID NO: 8772759 - DNA, 22 bp, Homo sapiens
cggcagctgattgcagagcacc

SEQ ID NO: 8772760 - DNA, 22 bp, Homo sapiens
cggcagcaaaggaagccaggtc

SEQ ID NO: 8772761 - DNA, 22 bp, Homo sapiens
cggcagggctccatgcatttct

SEQ ID NO: 8772762 - DNA, 22 bp, Homo sapiens
cggcagggctccatgcatttct

SEQ ID NO: 8772763 - DNA, 22 bp, Homo sapiens
cggcagggttggttttctctga

SEQ ID NO: 8772764 - DNA, 22 bp, Homo sapiens
cgtgggtcgggactccgcctcg

SEQ ID NO: 8772765 - DNA, 22 bp, Homo sapiens
cgtgggctgcgcccagttcttc

SEQ ID NO: 8772766 - DNA, 22 bp, Homo sapiens
cgtggctggtggacctgagggc

SEQ ID NO: 8772767 - DNA, 22 bp, Homo sapiens
cgtgggaggaaaaatgggcttc

SEQ ID NO: 8772768 - DNA, 22 bp, Homo sapiens
cgtgggaggaaaaatgggcttc

SEQ ID NO: 8772769 - DNA, 22 bp, Homo sapiens
cgtgggagtggtgggtgctcag

SEQ ID NO: 8772770 - DNA, 22 bp, Homo sapiens
cgtggctggtggacctgagggc

SEQ ID NO: 8772771 - DNA, 22 bp, Homo sapiens
cgtggctggtggacctgagggc

SEQ ID NO: 8772772 - DNA, 22 bp, Homo sapiens
cgtgagcaaaatggacactccc

SEQ ID NO: 8772773 - DNA, 22 bp, Homo sapiens
cgtggctggggcgactccacgg

SEQ ID NO: 8772774 - DNA, 22 bp, Homo sapiens
cgtgagcaaaatggacactccc

SEQ ID NO: 8772775 - DNA, 22 bp, Homo sapiens
cggggccctggggctgaaggtc

SEQ ID NO: 8772776 - DNA, 22 bp, Homo sapiens
cggggcctagctgcacaccctc

SEQ ID NO: 8772777 - DNA, 22 bp, Homo sapiens
cggggcctagtctacctcggca

SEQ ID NO: 8772778 - DNA, 22 bp, Homo sapiens
cggggctgacagcaggtgtgct

SEQ ID NO: 8772779 - DNA, 22 bp, Homo sapiens
cggggctgacagcaggtgtgct

SEQ ID NO: 8772780 - DNA, 22 bp, Homo sapiens
cggggctgacagcaggtgtgct

SEQ ID NO: 8772781 - DNA, 22 bp, Homo sapiens
cggggctgacagcaggtgtgct

SEQ ID NO: 8772782 - DNA, 22 bp, Homo sapiens
cggggctgaggcaacgcggaga

SEQ ID NO: 8772783 - DNA, 22 bp, Homo sapiens
cgggctggctgcagctgctgga

SEQ ID NO: 8772784 - DNA, 22 bp, Homo sapiens
cggcagggttggttttctctga

SEQ ID NO: 8772785 - DNA, 22 bp, Homo sapiens
cgggcaaggcgagactaggccc

SEQ ID NO: 8772786 - DNA, 22 bp, Homo sapiens
cgggcaaggcgagactaggccc

SEQ ID NO: 8772787 - DNA, 22 bp, Homo sapiens
cggggaggcttcggattaaagc

SEQ ID NO: 8772788 - DNA, 22 bp, Homo sapiens
cggggaggcttcggattaaagc

SEQ ID NO: 8772789 - DNA, 22 bp, Homo sapiens
cggggagggcagaggctccctc

SEQ ID NO: 8772790 - DNA, 22 bp, Homo sapiens
cggggagggcagaggctccctc

SEQ ID NO: 8772791 - DNA, 22 bp, Homo sapiens
cggggaggcttcggattaaagc

SEQ ID NO: 8772792 - DNA, 22 bp, Homo sapiens
cggggacacactggcagctcct

SEQ ID NO: 8772793 - DNA, 22 bp, Homo sapiens
cggggaatcatggctgggcagt

SEQ ID NO: 8772794 - DNA, 22 bp, Homo sapiens
cggggaagcggttctggcggta

SEQ ID NO: 8772795 - DNA, 22 bp, Homo sapiens
cggggaaaatgaagcaggtgga

SEQ ID NO: 8772796 - DNA, 22 bp, Homo sapiens
cggggagaacactgtgtccttc

SEQ ID NO: 8772797 - DNA, 22 bp, Homo sapiens
cggggagggcagaggctccctc

SEQ ID NO: 8772798 - DNA, 22 bp, Homo sapiens
cggggcaggagtccctgtagag

SEQ ID NO: 8772799 - DNA, 22 bp, Homo sapiens
cggggaggcttcggattaaagc

SEQ ID NO: 8772800 - DNA, 23 bp, Homo sapiens
cggggccagggtcaggaccggtc

SEQ ID NO: 8772801 - DNA, 22 bp, Homo sapiens
cggggccctggggctgaaggtc

SEQ ID NO: 8772802 - DNA, 22 bp, Homo sapiens
cggggccctggggctgaaggtc

SEQ ID NO: 8772803 - DNA, 22 bp, Homo sapiens
cggggccctggggctgaaggtc

SEQ ID NO: 8772804 - DNA, 22 bp, Homo sapiens
cggggccctggggctgaaggtc

SEQ ID NO: 8772805 - DNA, 22 bp, Homo sapiens
cggggccctggggctgaaggtc

SEQ ID NO: 8772806 - DNA, 20 bp, Homo sapiens
ttatttcagttgctagattg

SEQ ID NO: 8772807 - DNA, 20 bp, Homo sapiens
ttatttcagttgctagattg

SEQ ID NO: 8772808 - DNA, 20 bp, Homo sapiens
ttatttcagttgctagattg

SEQ ID NO: 8772809 - DNA, 20 bp, Homo sapiens
ttatttcagttgctagattg

SEQ ID NO: 8772810 - DNA, 20 bp, Homo sapiens
ttatttcagttgctagattg

SEQ ID NO: 8772811 - DNA, 21 bp, Homo sapiens
ttatttcacatggacttccag

SEQ ID NO: 8772812 - DNA, 22 bp, Homo sapiens
ttatttcaaaagagcttggggt

SEQ ID NO: 8772813 - DNA, 22 bp, Homo sapiens
ttatttattgtgtacctactgt

SEQ ID NO: 8772814 - DNA, 22 bp, Homo sapiens
ttattgcatagattatgccata

SEQ ID NO: 8772815 - DNA, 22 bp, Homo sapiens
ttatttatgttaacagtcgaga

SEQ ID NO: 8772816 - DNA, 22 bp, Homo sapiens
ttatttattcattctgtctgtc

SEQ ID NO: 8772817 - DNA, 22 bp, Homo sapiens
ttatttattcattctgtctgtc

SEQ ID NO: 8772818 - DNA, 22 bp, Homo sapiens
ttattgcactattgattttcta

SEQ ID NO: 8772819 - DNA, 22 bp, Homo sapiens
ttattgcactattgattttcta

SEQ ID NO: 8772820 - DNA, 22 bp, Homo sapiens
ttattgcaccttcctcactaac

SEQ ID NO: 8772821 - DNA, 22 bp, Homo sapiens
ttattgcaccatgcctcagttt

SEQ ID NO: 8772822 - DNA, 22 bp, Homo sapiens
ttattgcaccatgcctcagttt

SEQ ID NO: 8772823 - DNA, 23 bp, Homo sapiens
ttattgcaaggtaaaattgctga

SEQ ID NO: 8772824 - DNA, 22 bp, Homo sapiens
ttattgcaactttagggataga

SEQ ID NO: 8772825 - DNA, 22 bp, Homo sapiens
ttattgcaactttagggataga

SEQ ID NO: 8772826 - DNA, 22 bp, Homo sapiens
ttattgcaactcctaaatagag

SEQ ID NO: 8772827 - DNA, 22 bp, Homo sapiens
ttattgcaactcctaaatagag

SEQ ID NO: 8772828 - DNA, 17 bp, Homo sapiens
ttattgctataagctga

SEQ ID NO: 8772829 - DNA, 17 bp, Homo sapiens
ttattgctataagctga

SEQ ID NO: 8772830 - DNA, 22 bp, Homo sapiens
ttattgctagtgtcatttcaca

SEQ ID NO: 8772831 - DNA, 23 bp, Homo sapiens
ttattgcatccaaatgcattcct

SEQ ID NO: 8772832 - DNA, 22 bp, Homo sapiens
ttattgcatagattatgccata

SEQ ID NO: 8772833 - DNA, 22 bp, Homo sapiens
ttattgcagatggtgtgagaga

SEQ ID NO: 8772834 - DNA, 22 bp, Homo sapiens
ttattgcagatggtgtgagaga

SEQ ID NO: 8772835 - DNA, 22 bp, Homo sapiens
ttattgcactattgattttcta

SEQ ID NO: 8772836 - DNA, 22 bp, Homo sapiens
ttattgcagatggtgtgagaga

SEQ ID NO: 8772837 - DNA, 17 bp, Homo sapiens
ttattgcagtgctgaag

SEQ ID NO: 8772838 - DNA, 22 bp, Homo sapiens
ttattgcagccgcagggcgctg

SEQ ID NO: 8772839 - DNA, 22 bp, Homo sapiens
cgctgcctccaggtgcagcagg

SEQ ID NO: 8772840 - DNA, 22 bp, Homo sapiens
cgctgcagtttatgtgttcctg

SEQ ID NO: 8772841 - DNA, 22 bp, Homo sapiens
cgctgcagatgggagctggttg

SEQ ID NO: 8772842 - DNA, 22 bp, Homo sapiens
cgctgcagctggctgcagggaa

SEQ ID NO: 8772843 - DNA, 22 bp, Homo sapiens
cgctgcacgtgtcacactaacc

SEQ ID NO: 8772844 - DNA, 22 bp, Homo sapiens
cgctgcagaagcgtgttcagga

SEQ ID NO: 8772845 - DNA, 22 bp, Homo sapiens
cgctgcagacgcgctggcgaaa

SEQ ID NO: 8772846 - DNA, 22 bp, Homo sapiens
cgctggccatagcctcctgtgt

SEQ ID NO: 8772847 - DNA, 22 bp, Homo sapiens
cgctggccatagcctcctgtgt

SEQ ID NO: 8772848 - DNA, 22 bp, Homo sapiens
cgctggccatagcctcctgtgt

SEQ ID NO: 8772849 - DNA, 22 bp, Homo sapiens
ttcaaagtaccgtacttaatgg

SEQ ID NO: 8772850 - DNA, 22 bp, Homo sapiens
cgctggcttcctcctggggcca

SEQ ID NO: 8772851 - DNA, 22 bp, Homo sapiens
ttcaaagtaccgtacttaatgg

SEQ ID NO: 8772852 - DNA, 22 bp, Homo sapiens
cgctggccatagcctcctgtgt

SEQ ID NO: 8772853 - DNA, 22 bp, Homo sapiens
ttcaaagtaccgtacttaatgg

SEQ ID NO: 8772854 - DNA, 22 bp, Homo sapiens
cgctgccttcatcccacgccta

SEQ ID NO: 8772855 - DNA, 22 bp, Homo sapiens
cgctgcttatgagactggcacg

SEQ ID NO: 8772856 - DNA, 22 bp, Homo sapiens
cgctgctctgcagactcccgga

SEQ ID NO: 8772857 - DNA, 22 bp, Homo sapiens
ttatttcatgtaaaatttatgt

SEQ ID NO: 8772858 - DNA, 22 bp, Homo sapiens
ttatttcatataatgttatcaa

SEQ ID NO: 8772859 - DNA, 22 bp, Homo sapiens
ttatttcatataatgttatcaa

SEQ ID NO: 8772860 - DNA, 22 bp, Homo sapiens
ttatttcatataatgttatcaa

SEQ ID NO: 8772861 - DNA, 16 bp, Homo sapiens
cgcctccctccctcgc

SEQ ID NO: 8772862 - DNA, 16 bp, Homo sapiens
cgcctccctccctcgc

SEQ ID NO: 8772863 - DNA, 22 bp, Homo sapiens
ttatttcatgtaaaatttatgt

SEQ ID NO: 8772864 - DNA, 22 bp, Homo sapiens
cgcctctctttttctcccagac

SEQ ID NO: 8772865 - DNA, 22 bp, Homo sapiens
cgcctctctttttctcccagac

SEQ ID NO: 8772866 - DNA, 20 bp, Homo sapiens
cgctcctgttcccggtccca

SEQ ID NO: 8772867 - DNA, 22 bp, Homo sapiens
cgctccttgagcgtgtcggcct

SEQ ID NO: 8772868 - DNA, 22 bp, Homo sapiens
cgctccttgagcgtgtcggcct

SEQ ID NO: 8772869 - DNA, 22 bp, Homo sapiens
ttatccaagcagaagctgcaca

SEQ ID NO: 8772870 - DNA, 22 bp, Homo sapiens
cctttggtaacattccaacctt

SEQ ID NO: 8772871 - DNA, 22 bp, Homo sapiens
ccttttctatccttctaggttc

SEQ ID NO: 8772872 - DNA, 22 bp, Homo sapiens
ccttttctaggatgctttatag

SEQ ID NO: 8772873 - DNA, 22 bp, Homo sapiens
cctttttccctggagggacagc

SEQ ID NO: 8772874 - DNA, 22 bp, Homo sapiens
cctttttccctggagggacagc

SEQ ID NO: 8772875 - DNA, 16 bp, Homo sapiens
cctttttctcttgctg

SEQ ID NO: 8772876 - DNA, 22 bp, Homo sapiens
cctttttcaatatagaattgca

SEQ ID NO: 8772877 - DNA, 16 bp, Homo sapiens
cctttttctcttgctg

SEQ ID NO: 8772878 - DNA, 22 bp, Homo sapiens
cctttttcagcttctagaggct

SEQ ID NO: 8772879 - DNA, 22 bp, Homo sapiens
cctttttcaatatagaattgca

SEQ ID NO: 8772880 - DNA, 22 bp, Homo sapiens
ccttttgctctcccatccagaa

SEQ ID NO: 8772881 - DNA, 22 bp, Homo sapiens
ccttttgctctcccatccagaa

SEQ ID NO: 8772882 - DNA, 22 bp, Homo sapiens
ccttttggccaggtcagtgcag

SEQ ID NO: 8772883 - DNA, 22 bp, Homo sapiens
ccttttggaaatatttatgacc

SEQ ID NO: 8772884 - DNA, 22 bp, Homo sapiens
ccttttggataattctacccca

SEQ ID NO: 8772885 - DNA, 22 bp, Homo sapiens
ccttttgctctcccatccagaa

SEQ ID NO: 8772886 - DNA, 22 bp, Homo sapiens
ccttttgaaggtgttgttaagt

SEQ ID NO: 8772887 - DNA, 22 bp, Homo sapiens
ccttttgagacttccactgtgt

SEQ ID NO: 8772888 - DNA, 22 bp, Homo sapiens
ccttttgaggcttgggctcaga

SEQ ID NO: 8772889 - DNA, 22 bp, Homo sapiens
ccttttctgtgtgggtaattta

SEQ ID NO: 8772890 - DNA, 22 bp, Homo sapiens
cgacgggctcggtccgcttcct

SEQ ID NO: 8772891 - DNA, 21 bp, Homo sapiens
cgacagtgtatagattagagc

SEQ ID NO: 8772892 - DNA, 22 bp, Homo sapiens
cgagagagacatggtgacctgc

SEQ ID NO: 8772893 - DNA, 22 bp, Homo sapiens
cgagagatgggttggcaggggc

SEQ ID NO: 8772894 - DNA, 22 bp, Homo sapiens
cgagagatgggttggcaggggc

SEQ ID NO: 8772895 - DNA, 22 bp, Homo sapiens
cgagagagacatggtgacctgc

SEQ ID NO: 8772896 - DNA, 22 bp, Homo sapiens
cgacgggctcggtccgcttcct

SEQ ID NO: 8772897 - DNA, 22 bp, Homo sapiens
cgactgtcatacacaagacatg

SEQ ID NO: 8772898 - DNA, 21 bp, Homo sapiens
cctttttgcttatggacagac

SEQ ID NO: 8772899 - DNA, 22 bp, Homo sapiens
cctttttctgagttgtagcttc

SEQ ID NO: 8772900 - DNA, 22 bp, Homo sapiens
cctttttctgagttgtagcttc

SEQ ID NO: 8772901 - DNA, 19 bp, Homo sapiens
ccttttttaacttcagcaa

SEQ ID NO: 8772902 - DNA, 22 bp, Homo sapiens
ccttttttctatgccaactctg

SEQ ID NO: 8772903 - DNA, 22 bp, Homo sapiens
cgaaaatagatctgtttcccag

SEQ ID NO: 8772904 - DNA, 22 bp, Homo sapiens
cgaaaatagatctgtttcccag

SEQ ID NO: 8772905 - DNA, 22 bp, Homo sapiens
cgaaaatagatctgtttcccag

SEQ ID NO: 8772906 - DNA, 22 bp, Homo sapiens
cgaaatcagcatcttgaggcaa

SEQ ID NO: 8772907 - DNA, 22 bp, Homo sapiens
cgagagtggacagggcgcagct

SEQ ID NO: 8772908 - DNA, 22 bp, Homo sapiens
cgagagttagctaggagtcaca

SEQ ID NO: 8772909 - DNA, 22 bp, Homo sapiens
ttattcagcatttagaggaagg

SEQ ID NO: 8772910 - DNA, 22 bp, Homo sapiens
ttattcagctctctagaggcac

SEQ ID NO: 8772911 - DNA, 22 bp, Homo sapiens
ttattgcaaaggaagagcttga

SEQ ID NO: 8772912 - DNA, 22 bp, Homo sapiens
ttattgcaaaggaagagcttga

SEQ ID NO: 8772913 - DNA, 22 bp, Homo sapiens
ttattgcaaaggaagagcttga

SEQ ID NO: 8772914 - DNA, 22 bp, Homo sapiens
ttattgcaaccttttctggtgt

SEQ ID NO: 8772915 - DNA, 22 bp, Homo sapiens
ccagtgttcataattttacact

SEQ ID NO: 8772916 - DNA, 22 bp, Homo sapiens
ccagtgtgtttttctctgactc

SEQ ID NO: 8772917 - DNA, 22 bp, Homo sapiens
ccagtgtgtttaatgcattcca

SEQ ID NO: 8772918 - DNA, 22 bp, Homo sapiens
ccagtgtggccaggtgctggta

SEQ ID NO: 8772919 - DNA, 22 bp, Homo sapiens
ccagtgtgttccctgcctcact

SEQ ID NO: 8772920 - DNA, 22 bp, Homo sapiens
ccagtgtgggctggtggaggac

SEQ ID NO: 8772921 - DNA, 22 bp, Homo sapiens
ccagtgtgggcccggcctcctc

SEQ ID NO: 8772922 - DNA, 23 bp, Homo sapiens
ccagtgtggtaggtccacaggtg

SEQ ID NO: 8772923 - DNA, 22 bp, Homo sapiens
ccagtgtggtaggtccacaggt

SEQ ID NO: 8772924 - DNA, 22 bp, Homo sapiens
ccagtgtgttagtggatttccc

SEQ ID NO: 8772925 - DNA, 22 bp, Homo sapiens
ccagtgtgttccctgcctcact

SEQ ID NO: 8772926 - DNA, 23 bp, Homo sapiens
ccagtgtggtaggtccacaggtg

SEQ ID NO: 8772927 - DNA, 21 bp, Homo sapiens
tgaggcaggggtgcttttgtc

SEQ ID NO: 8772928 - DNA, 21 bp, Homo sapiens
tgaggcaggggtgcttttgtc

SEQ ID NO: 8772929 - DNA, 22 bp, Homo sapiens
tgaggcaggtaagcaagttttg

SEQ ID NO: 8772930 - DNA, 22 bp, Homo sapiens
tgaggcaggtaagcaagttttg

SEQ ID NO: 8772931 - DNA, 22 bp, Homo sapiens
tgaggcagtattctccattcca

SEQ ID NO: 8772932 - DNA, 22 bp, Homo sapiens
tgaggcaggtggattacaaggt

SEQ ID NO: 8772933 - DNA, 22 bp, Homo sapiens
tgaggcaggtggattacaaggt

SEQ ID NO: 8772934 - DNA, 22 bp, Homo sapiens
tgaggcagtattctccattcca

SEQ ID NO: 8772935 - DNA, 22 bp, Homo sapiens
tgaggcagtattctccattcca

SEQ ID NO: 8772936 - DNA, 22 bp, Homo sapiens
tgaggcaggtggattacaaggt

SEQ ID NO: 8772937 - DNA, 22 bp, Homo sapiens
tgaggcagtattttagtgactt

SEQ ID NO: 8772938 - DNA, 22 bp, Homo sapiens
tgaggcagtattttagtgactt

SEQ ID NO: 8772939 - DNA, 22 bp, Homo sapiens
tgaggcagtattttagtgactt

SEQ ID NO: 8772940 - DNA, 22 bp, Homo sapiens
tgaggcagtattttagtgactt

SEQ ID NO: 8772941 - DNA, 22 bp, Homo sapiens
tgaggcagtattttagtgactt

SEQ ID NO: 8772942 - DNA, 18 bp, Homo sapiens
tgaggcagtcagtgatgg

SEQ ID NO: 8772943 - DNA, 22 bp, Homo sapiens
tgaggcagtcaccccctcctgc

SEQ ID NO: 8772944 - DNA, 22 bp, Homo sapiens
tgaggcagtcaccccctcctgc

SEQ ID NO: 8772945 - DNA, 22 bp, Homo sapiens
tgaggcagtcaccccctcctgc

SEQ ID NO: 8772946 - DNA, 22 bp, Homo sapiens
tgaggcagtcaccccctcctgc

SEQ ID NO: 8772947 - DNA, 22 bp, Homo sapiens
tgatgaggggctcagaggtcag

SEQ ID NO: 8772948 - DNA, 22 bp, Homo sapiens
tgatgagggcagttcttgttgc

SEQ ID NO: 8772949 - DNA, 22 bp, Homo sapiens
tgatgagggggaacagagattt

SEQ ID NO: 8772950 - DNA, 21 bp, Homo sapiens
tgatgaggtcatagcaccctc

SEQ ID NO: 8772951 - DNA, 22 bp, Homo sapiens
tgatgagggggaacagagattt

SEQ ID NO: 8772952 - DNA, 22 bp, Homo sapiens
tgatgagggcagttcttgttgc

SEQ ID NO: 8772953 - DNA, 22 bp, Homo sapiens
tgatgagggagatttgagccca

SEQ ID NO: 8772954 - DNA, 22 bp, Homo sapiens
tgatgaggggctcagaggtcag

SEQ ID NO: 8772955 - DNA, 22 bp, Homo sapiens
ccatggagcacctcacagaggc

SEQ ID NO: 8772956 - DNA, 19 bp, Homo sapiens
ccatggagagagatgcatt

SEQ ID NO: 8772957 - DNA, 22 bp, Homo sapiens
tgatgaggacctggtctctgct

SEQ ID NO: 8772958 - DNA, 22 bp, Homo sapiens
tgatgaggagactgtggcttgg

SEQ ID NO: 8772959 - DNA, 22 bp, Homo sapiens
tgatgaggcttcttggtgaaca

SEQ ID NO: 8772960 - DNA, 22 bp, Homo sapiens
tgatgaggcatatgctacacat

SEQ ID NO: 8772961 - DNA, 22 bp, Homo sapiens
tgatgagggaactggttcatac

SEQ ID NO: 8772962 - DNA, 22 bp, Homo sapiens
tgatgaggacccatcacctggt

SEQ ID NO: 8772963 - DNA, 22 bp, Homo sapiens
tgatgaggacctggtctctgct

SEQ ID NO: 8772964 - DNA, 18 bp, Homo sapiens
tgaggcagtcagtgatgg

SEQ ID NO: 8772965 - DNA, 18 bp, Homo sapiens
tgaggcagtcagtgatgg

SEQ ID NO: 8772966 - DNA, 22 bp, Homo sapiens
tgaggcagtgatgtttaagcac

SEQ ID NO: 8772967 - DNA, 22 bp, Homo sapiens
tgaggcagtgatgtttaagcac

SEQ ID NO: 8772968 - DNA, 18 bp, Homo sapiens
tgaggcagtcagtgatgg

SEQ ID NO: 8772969 - DNA, 18 bp, Homo sapiens
tgaggcagtcagtgatgg

SEQ ID NO: 8772970 - DNA, 18 bp, Homo sapiens
tgaggcagtcagtgatgg

SEQ ID NO: 8772971 - DNA, 18 bp, Homo sapiens
tgaggcagtcagtgatgg

SEQ ID NO: 8772972 - DNA, 22 bp, Homo sapiens
tgaggcagtgatgtttaagcac

SEQ ID NO: 8772973 - DNA, 22 bp, Homo sapiens
tgaggcagtgctgggaagcctg

SEQ ID NO: 8772974 - DNA, 22 bp, Homo sapiens
tgatgacaatgttgctgcaata

SEQ ID NO: 8772975 - DNA, 22 bp, Homo sapiens
tgatgacaaactttcctgatgc

SEQ ID NO: 8772976 - DNA, 22 bp, Homo sapiens
tgatgaattagtaacaaatgag

SEQ ID NO: 8772977 - DNA, 22 bp, Homo sapiens
tgattacattggtaatgtttat

SEQ ID NO: 8772978 - DNA, 22 bp, Homo sapiens
tgattagacaaaggaatcatgc

SEQ ID NO: 8772979 - DNA, 22 bp, Homo sapiens
tgattacagtctgacagatgtt

SEQ ID NO: 8772980 - DNA, 22 bp, Homo sapiens
tgattacagtctgacagatgtt

SEQ ID NO: 8772981 - DNA, 22 bp, Homo sapiens
tgattacagtatttgagatcca

SEQ ID NO: 8772982 - DNA, 23 bp, Homo sapiens
tgattacaggaagttcaagtgtt

SEQ ID NO: 8772983 - DNA, 22 bp, Homo sapiens
tgattacagtatttgagatcca

SEQ ID NO: 8772984 - DNA, 23 bp, Homo sapiens
tgattacaggaagttcaagtgtt

SEQ ID NO: 8772985 - DNA, 22 bp, Homo sapiens
tgattacacagcagtaatttca

SEQ ID NO: 8772986 - DNA, 22 bp, Homo sapiens
tgattacactatttgggaatag

SEQ ID NO: 8772987 - DNA, 17 bp, Homo sapiens
tgattcaactagaaact

SEQ ID NO: 8772988 - DNA, 22 bp, Homo sapiens
tgattcaactttcataacaaaa

SEQ ID NO: 8772989 - DNA, 22 bp, Homo sapiens
tgattcaactttcataacaaaa

SEQ ID NO: 8772990 - DNA, 22 bp, Homo sapiens
tgattcaactttcataacaaaa

SEQ ID NO: 8772991 - DNA, 17 bp, Homo sapiens
tgattcaactagaaact

SEQ ID NO: 8772992 - DNA, 22 bp, Homo sapiens
tgattcaaatattgtgtatgat

SEQ ID NO: 8772993 - DNA, 22 bp, Homo sapiens
tgattagattgagtcaaccttg

SEQ ID NO: 8772994 - DNA, 22 bp, Homo sapiens
cccaagcagggtgcagaggcat

SEQ ID NO: 8772995 - DNA, 22 bp, Homo sapiens
cccaagcagggtgcagaggcat

SEQ ID NO: 8772996 - DNA, 19 bp, Homo sapiens
cccaacttgactattttct

SEQ ID NO: 8772997 - DNA, 22 bp, Homo sapiens
cccaagagcttctaggacgctg

SEQ ID NO: 8772998 - DNA, 22 bp, Homo sapiens
cccaagaggtggaggttgcagt

SEQ ID NO: 8772999 - DNA, 22 bp, Homo sapiens
cccaaagggtgtcagcagcaag

SEQ ID NO: 8773000 - DNA, 22 bp, Homo sapiens
cccaaagggtgtcagcagcaag

SEQ ID NO: 8773001 - DNA, 22 bp, Homo sapiens
cccaaaggttgaggctgcagtg

SEQ ID NO: 8773002 - DNA, 20 bp, Homo sapiens
cccaaagcttcatatgagcc

SEQ ID NO: 8773003 - DNA, 22 bp, Homo sapiens
cccaaacatccaggtgctggac

SEQ ID NO: 8773004 - DNA, 22 bp, Homo sapiens
cccaaagaaaacagtacctcag

SEQ ID NO: 8773005 - DNA, 22 bp, Homo sapiens
ccatttttcataaactatccaa

SEQ ID NO: 8773006 - DNA, 22 bp, Homo sapiens
ccatttttcacaagactcactt

SEQ ID NO: 8773007 - DNA, 22 bp, Homo sapiens
ccatttttcacaagactcactt

SEQ ID NO: 8773008 - DNA, 22 bp, Homo sapiens
ccatttttaaagagcttaagta

SEQ ID NO: 8773009 - DNA, 22 bp, Homo sapiens
ccatttttcacaagactcactt

SEQ ID NO: 8773010 - DNA, 22 bp, Homo sapiens
ccatttttcacaagactcactt

SEQ ID NO: 8773011 - DNA, 22 bp, Homo sapiens
cccaaacagttcctgtggtact

SEQ ID NO: 8773012 - DNA, 22 bp, Homo sapiens
ccatttttgacagaaggcctaa

SEQ ID NO: 8773013 - DNA, 22 bp, Homo sapiens
ccatttttgacagaaggcctaa

SEQ ID NO: 8773014 - DNA, 22 bp, Homo sapiens
ccatttttgacagaaggcctaa

SEQ ID NO: 8773015 - DNA, 22 bp, Homo sapiens
ccatttttgacagaaggcctaa

SEQ ID NO: 8773016 - DNA, 22 bp, Homo sapiens
ccatttttcataaactatccaa

SEQ ID NO: 8773017 - DNA, 22 bp, Homo sapiens
ccatttttcataaactatccaa

SEQ ID NO: 8773018 - DNA, 22 bp, Homo sapiens
ccatttttcataaactatccaa

SEQ ID NO: 8773019 - DNA, 22 bp, Homo sapiens
ccatttttaaagagcttaagta

SEQ ID NO: 8773020 - DNA, 22 bp, Homo sapiens
ccatttttaaagagcttaagta

SEQ ID NO: 8773021 - DNA, 22 bp, Homo sapiens
ccatttttaaagagcttaagta

SEQ ID NO: 8773022 - DNA, 23 bp, Homo sapiens
ccatggccaatgtcaagctacta

SEQ ID NO: 8773023 - DNA, 22 bp, Homo sapiens
ccatggcagcctggcctggctt

SEQ ID NO: 8773024 - DNA, 22 bp, Homo sapiens
ccatggcagcctggcctggctt

SEQ ID NO: 8773025 - DNA, 20 bp, Homo sapiens
ccatggccacatctgtgctg

SEQ ID NO: 8773026 - DNA, 20 bp, Homo sapiens
ccatggccacatctgtgctg

SEQ ID NO: 8773027 - DNA, 22 bp, Homo sapiens
ccatggccaggaaagccaaggt

SEQ ID NO: 8773028 - DNA, 22 bp, Homo sapiens
ccatggccaggaaagccaaggt

SEQ ID NO: 8773029 - DNA, 22 bp, Homo sapiens
ccatggccaattgcaccttgct

SEQ ID NO: 8773030 - DNA, 22 bp, Homo sapiens
ccatggccaattgcaccttgct

SEQ ID NO: 8773031 - DNA, 22 bp, Homo sapiens
ccatggccaattgcaccttgct

SEQ ID NO: 8773032 - DNA, 22 bp, Homo sapiens
ccatggagcgggtgagtgagtg

SEQ ID NO: 8773033 - DNA, 22 bp, Homo sapiens
ccatggagcgggtgagtgagtg

SEQ ID NO: 8773034 - DNA, 22 bp, Homo sapiens
ccatggcaatggtcagtctatt

SEQ ID NO: 8773035 - DNA, 22 bp, Homo sapiens
ccatggcaactggcgtccaggg

SEQ ID NO: 8773036 - DNA, 23 bp, Homo sapiens
cccagcagagatgaggaggggtc

SEQ ID NO: 8773037 - DNA, 22 bp, Homo sapiens
cccagcagatggctatgtgcta

SEQ ID NO: 8773038 - DNA, 23 bp, Homo sapiens
cccagcagagatgaggaggggtc

SEQ ID NO: 8773039 - DNA, 22 bp, Homo sapiens
cccagcagaccgctgtgatggc

SEQ ID NO: 8773040 - DNA, 22 bp, Homo sapiens
cccagcagaccgctgtgatggc

SEQ ID NO: 8773041 - DNA, 18 bp, Homo sapiens
cccagcactttgggagcc

SEQ ID NO: 8773042 - DNA, 18 bp, Homo sapiens
cccagcactttgggagcc

SEQ ID NO: 8773043 - DNA, 22 bp, Homo sapiens
cccagcagaatctgatgagggc

SEQ ID NO: 8773044 - DNA, 22 bp, Homo sapiens
cccagcagaatctgatgagggc

SEQ ID NO: 8773045 - DNA, 22 bp, Homo sapiens
cccagcagccagaatgaggagc

SEQ ID NO: 8773046 - DNA, 22 bp, Homo sapiens
cccagcagccagaatgaggagc

SEQ ID NO: 8773047 - DNA, 23 bp, Homo sapiens
cccagcagattgtaaagtgtcca

SEQ ID NO: 8773048 - DNA, 22 bp, Homo sapiens
tgcagcagtgttccttggcttg

SEQ ID NO: 8773049 - DNA, 22 bp, Homo sapiens
tgcagcagtgttccttggcttg

SEQ ID NO: 8773050 - DNA, 22 bp, Homo sapiens
tgcagcagtcagtcaggcctgg

SEQ ID NO: 8773051 - DNA, 22 bp, Homo sapiens
tgcagcagtcagtcaggcctgg

SEQ ID NO: 8773052 - DNA, 22 bp, Homo sapiens
tgcagcagtcagtcaggcctgg

SEQ ID NO: 8773053 - DNA, 22 bp, Homo sapiens
cccagagaattccacatagagg

SEQ ID NO: 8773054 - DNA, 22 bp, Homo sapiens
cccagagaattccacatagagg

SEQ ID NO: 8773055 - DNA, 22 bp, Homo sapiens
cccagagactttgtccgacgac

SEQ ID NO: 8773056 - DNA, 22 bp, Homo sapiens
cccagagagcacaggtggtggg

SEQ ID NO: 8773057 - DNA, 22 bp, Homo sapiens
cccagagagcatttggacaaag

SEQ ID NO: 8773058 - DNA, 22 bp, Homo sapiens
cccagagagcatttggacaaag

SEQ ID NO: 8773059 - DNA, 22 bp, Homo sapiens
cccagagagcacaggtggtggg

SEQ ID NO: 8773060 - DNA, 22 bp, Homo sapiens
cccagagagcacaggtggtggg

SEQ ID NO: 8773061 - DNA, 22 bp, Homo sapiens
cccagagaggtaaaacagcctt

SEQ ID NO: 8773062 - DNA, 22 bp, Homo sapiens
cccagagaggtaaaacagcctt

SEQ ID NO: 8773063 - DNA, 22 bp, Homo sapiens
cccagagagcatttggacaaag

SEQ ID NO: 8773064 - DNA, 22 bp, Homo sapiens
cccagagatctactgagcccag

SEQ ID NO: 8773065 - DNA, 22 bp, Homo sapiens
cccagagatctactgagcccag

SEQ ID NO: 8773066 - DNA, 22 bp, Homo sapiens
cccagagggtggaggttgcagt

SEQ ID NO: 8773067 - DNA, 22 bp, Homo sapiens
cccagaggtgaaggaggtggga

SEQ ID NO: 8773068 - DNA, 22 bp, Homo sapiens
cccagaggtgaaggaggtggga

SEQ ID NO: 8773069 - DNA, 22 bp, Homo sapiens
cccagaggtgaaggaggtggga

SEQ ID NO: 8773070 - DNA, 22 bp, Homo sapiens
cccagactcctctggctggtgg

SEQ ID NO: 8773071 - DNA, 22 bp, Homo sapiens
cccagactgcagagcgggcaga

SEQ ID NO: 8773072 - DNA, 22 bp, Homo sapiens
cccagactgcagagcgggcaga

SEQ ID NO: 8773073 - DNA, 22 bp, Homo sapiens
cccagagaattccacatagagg

SEQ ID NO: 8773074 - DNA, 22 bp, Homo sapiens
cccagagaattccacatagagg

SEQ ID NO: 8773075 - DNA, 22 bp, Homo sapiens
cccagagaagtgaagtgacttg

SEQ ID NO: 8773076 - DNA, 22 bp, Homo sapiens
cccagagaagtgaagtgacttg

SEQ ID NO: 8773077 - DNA, 22 bp, Homo sapiens
tgcagaggtttgtggtgttgct

SEQ ID NO: 8773078 - DNA, 22 bp, Homo sapiens
tgcagaggtttgtggtgttgct

SEQ ID NO: 8773079 - DNA, 22 bp, Homo sapiens
cccacaggtggaagcctcggaa

SEQ ID NO: 8773080 - DNA, 22 bp, Homo sapiens
cccacagtgatcgcattcgtac

SEQ ID NO: 8773081 - DNA, 23 bp, Homo sapiens
cccacatgtctgagtcagtgcca

SEQ ID NO: 8773082 - DNA, 22 bp, Homo sapiens
cccacagttaaccaaaggaatt

SEQ ID NO: 8773083 - DNA, 22 bp, Homo sapiens
cccacaggtggaagcctcggaa

SEQ ID NO: 8773084 - DNA, 22 bp, Homo sapiens
cccacaggtggaagcctcggaa

SEQ ID NO: 8773085 - DNA, 22 bp, Homo sapiens
cccacaggccctgctgccttga

SEQ ID NO: 8773086 - DNA, 22 bp, Homo sapiens
tgattcaactttcttgaatgca

SEQ ID NO: 8773087 - DNA, 22 bp, Homo sapiens
tgattcaactttcttgaatgca

SEQ ID NO: 8773088 - DNA, 22 bp, Homo sapiens
cccaagggtgcccagcagagga

SEQ ID NO: 8773089 - DNA, 22 bp, Homo sapiens
tgattcaactttcttgaatgca

SEQ ID NO: 8773090 - DNA, 22 bp, Homo sapiens
tgattcaactttcttgaatgca

SEQ ID NO: 8773091 - DNA, 22 bp, Homo sapiens
cccacaggcaggggcagagaca

SEQ ID NO: 8773092 - DNA, 22 bp, Homo sapiens
cccacagaatgccaatgagacc

SEQ ID NO: 8773093 - DNA, 22 bp, Homo sapiens
cccacaggcaggtgcatgggct

SEQ ID NO: 8773094 - DNA, 22 bp, Homo sapiens
cccacaggcaggtgcatgggct

SEQ ID NO: 8773095 - DNA, 22 bp, Homo sapiens
cccacaggcaggtgcatgggct

SEQ ID NO: 8773096 - DNA, 22 bp, Homo sapiens
cccacccagcctggctgagggg

SEQ ID NO: 8773097 - DNA, 22 bp, Homo sapiens
cccaccagccatctgagagtgt

SEQ ID NO: 8773098 - DNA, 22 bp, Homo sapiens
cccacatttttgagtcttcatc

SEQ ID NO: 8773099 - DNA, 22 bp, Homo sapiens
cccacccagctgagccgctcac

SEQ ID NO: 8773100 - DNA, 22 bp, Homo sapiens
tgcagaggtttccaggcaagtt

SEQ ID NO: 8773101 - DNA, 22 bp, Homo sapiens
tgcagaggtgaaagactagcaa

SEQ ID NO: 8773102 - DNA, 22 bp, Homo sapiens
tgcatattctcctttattttgt

SEQ ID NO: 8773103 - DNA, 22 bp, Homo sapiens
tgcatattataaagagaattag

SEQ ID NO: 8773104 - DNA, 22 bp, Homo sapiens
tgcatatatcttatttttctgt

SEQ ID NO: 8773105 - DNA, 19 bp, Homo sapiens
tgcatatatctatgaaaga

SEQ ID NO: 8773106 - DNA, 22 bp, Homo sapiens
tgcatatatcttatttttctgt

SEQ ID NO: 8773107 - DNA, 22 bp, Homo sapiens
cccaggagacagaaacagaggt

SEQ ID NO: 8773108 - DNA, 22 bp, Homo sapiens
cccaggagacagaaacagaggt

SEQ ID NO: 8773109 - DNA, 22 bp, Homo sapiens
cccaggagacatatagaaggac

SEQ ID NO: 8773110 - DNA, 22 bp, Homo sapiens
cccaggagacagaaacagaggt

SEQ ID NO: 8773111 - DNA, 22 bp, Homo sapiens
cccaggagaatatttttgggtc

SEQ ID NO: 8773112 - DNA, 22 bp, Homo sapiens
cccaggagacagaaacagaggt

SEQ ID NO: 8773113 - DNA, 22 bp, Homo sapiens
cccaggagacagaaacagaggt

SEQ ID NO: 8773114 - DNA, 22 bp, Homo sapiens
cccaggagataacgttcccaag

SEQ ID NO: 8773115 - DNA, 22 bp, Homo sapiens
cccaggagataacgttcccaag

SEQ ID NO: 8773116 - DNA, 22 bp, Homo sapiens
tgcatattttctgattcagaag

SEQ ID NO: 8773117 - DNA, 21 bp, Homo sapiens
cccaggaggagctccggctcc

SEQ ID NO: 8773118 - DNA, 21 bp, Homo sapiens
cccaggaggagctccggctcc

SEQ ID NO: 8773119 - DNA, 22 bp, Homo sapiens
cccaggaggacattccataccc

SEQ ID NO: 8773120 - DNA, 22 bp, Homo sapiens
cccaggaggacattccataccc

SEQ ID NO: 8773121 - DNA, 22 bp, Homo sapiens
cccaggagataacgttcccaag

SEQ ID NO: 8773122 - DNA, 22 bp, Homo sapiens
cccaggagatctggatctcgtc

SEQ ID NO: 8773123 - DNA, 22 bp, Homo sapiens
cccaggagcttctctctgcctc

SEQ ID NO: 8773124 - DNA, 22 bp, Homo sapiens
tgcatattttataaagatggaa

SEQ ID NO: 8773125 - DNA, 22 bp, Homo sapiens
tgcatattgtccttgatattat

SEQ ID NO: 8773126 - DNA, 22 bp, Homo sapiens
tgcatattgtgaaaatgtagat

SEQ ID NO: 8773127 - DNA, 22 bp, Homo sapiens
cccaggaggcagaagttgcagt

SEQ ID NO: 8773128 - DNA, 22 bp, Homo sapiens
cccaggaggcagaagttgcagt

SEQ ID NO: 8773129 - DNA, 22 bp, Homo sapiens
cccaggaggaggaaaaagctcg

SEQ ID NO: 8773130 - DNA, 22 bp, Homo sapiens
cccaggaggaggaaaaagctcg

SEQ ID NO: 8773131 - DNA, 22 bp, Homo sapiens
cccaggaggcagagcttgcagt

SEQ ID NO: 8773132 - DNA, 22 bp, Homo sapiens
cccaggaggcagagcttgcagt

SEQ ID NO: 8773133 - DNA, 22 bp, Homo sapiens
cccaggaggcagagatagcagt

SEQ ID NO: 8773134 - DNA, 22 bp, Homo sapiens
cccaggaggcagagatagcagt

SEQ ID NO: 8773135 - DNA, 22 bp, Homo sapiens
cccaggaggcagatgttgcagt

SEQ ID NO: 8773136 - DNA, 22 bp, Homo sapiens
cccaggaggcagatgttgcagt

SEQ ID NO: 8773137 - DNA, 22 bp, Homo sapiens
cccaggaggcagatgttgcagt

SEQ ID NO: 8773138 - DNA, 22 bp, Homo sapiens
cccaggaggcagaggttgcagt

SEQ ID NO: 8773139 - DNA, 22 bp, Homo sapiens
cccaggaggcagaggttgcagt

SEQ ID NO: 8773140 - DNA, 22 bp, Homo sapiens
cccaggaggcagaggttggagc

SEQ ID NO: 8773141 - DNA, 22 bp, Homo sapiens
cccaggaggcagaggttggagc

SEQ ID NO: 8773142 - DNA, 22 bp, Homo sapiens
cccaggaggccaaggttgcagt

SEQ ID NO: 8773143 - DNA, 22 bp, Homo sapiens
cccaggaggccaaggttgcagt

SEQ ID NO: 8773144 - DNA, 22 bp, Homo sapiens
cccaggaggcctgcctggccgg

SEQ ID NO: 8773145 - DNA, 22 bp, Homo sapiens
cccaggaggcctgcctggccgg

SEQ ID NO: 8773146 - DNA, 22 bp, Homo sapiens
cccaggaggcctgcctggccgg

SEQ ID NO: 8773147 - DNA, 22 bp, Homo sapiens
cccaggaggcctgcctggccgg

SEQ ID NO: 8773148 - DNA, 22 bp, Homo sapiens
cccaggaggcctgcctggccgg

SEQ ID NO: 8773149 - DNA, 19 bp, Homo sapiens
cccaggaggcggaggttgc

SEQ ID NO: 8773150 - DNA, 22 bp, Homo sapiens
cccaggaggcgcaggttgcggt

SEQ ID NO: 8773151 - DNA, 20 bp, Homo sapiens
cccaggagtgagcagcttta

SEQ ID NO: 8773152 - DNA, 22 bp, Homo sapiens
cccaggagttagaggttgtggt

SEQ ID NO: 8773153 - DNA, 22 bp, Homo sapiens
tgccctggttacactggagtcc

SEQ ID NO: 8773154 - DNA, 22 bp, Homo sapiens
tgccctggttacactggagtcc

SEQ ID NO: 8773155 - DNA, 20 bp, Homo sapiens
cccaggagtgagcagcttta

SEQ ID NO: 8773156 - DNA, 21 bp, Homo sapiens
cccaggagtcctatttaaatg

SEQ ID NO: 8773157 - DNA, 19 bp, Homo sapiens
cccaggagtctggctggtt

SEQ ID NO: 8773158 - DNA, 22 bp, Homo sapiens
tgcctcagtctaaagtctctca

SEQ ID NO: 8773159 - DNA, 23 bp, Homo sapiens
tgcctcagtggaatgtgagggtg

SEQ ID NO: 8773160 - DNA, 22 bp, Homo sapiens
tgcctcagtttcatctgcagaa

SEQ ID NO: 8773161 - DNA, 21 bp, Homo sapiens
cccaggagtcctatttaaatg

SEQ ID NO: 8773162 - DNA, 19 bp, Homo sapiens
cccaggagtctggctggtt

SEQ ID NO: 8773163 - DNA, 19 bp, Homo sapiens
cccaggagtctggctggtt

SEQ ID NO: 8773164 - DNA, 22 bp, Homo sapiens
cccaggaggttggggctacagt

SEQ ID NO: 8773165 - DNA, 22 bp, Homo sapiens
cccaggagtaagtgacattgtt

SEQ ID NO: 8773166 - DNA, 22 bp, Homo sapiens
cccaggaggttggggctacagt

SEQ ID NO: 8773167 - DNA, 22 bp, Homo sapiens
cccaggaggttggggctacagt

SEQ ID NO: 8773168 - DNA, 22 bp, Homo sapiens
cccaggaggttgaggctgcagt

SEQ ID NO: 8773169 - DNA, 22 bp, Homo sapiens
tgccctgatgatcctcctcgca

SEQ ID NO: 8773170 - DNA, 22 bp, Homo sapiens
tgccctgaagcaccctcaccct

SEQ ID NO: 8773171 - DNA, 22 bp, Homo sapiens
tgccctgaagcaccctcaccct

SEQ ID NO: 8773172 - DNA, 22 bp, Homo sapiens
tgccctgaagcaccctcaccct

SEQ ID NO: 8773173 - DNA, 22 bp, Homo sapiens
tgccctctttctgtacagctcc

SEQ ID NO: 8773174 - DNA, 22 bp, Homo sapiens
cccaggaggttgaggctgcagt

SEQ ID NO: 8773175 - DNA, 23 bp, Homo sapiens
tgccctcccaatgcttcggtcac

SEQ ID NO: 8773176 - DNA, 23 bp, Homo sapiens
tgccctcccaatgcttcggtcac

SEQ ID NO: 8773177 - DNA, 22 bp, Homo sapiens
tgccctccacagtggctccacc

SEQ ID NO: 8773178 - DNA, 22 bp, Homo sapiens
tgccctccacagtggctccacc

SEQ ID NO: 8773179 - DNA, 22 bp, Homo sapiens
tgccctcccacattatggctgt

SEQ ID NO: 8773180 - DNA, 22 bp, Homo sapiens
tgccctcccacattatggctgt

SEQ ID NO: 8773181 - DNA, 22 bp, Homo sapiens
tgccctccctgtactgtcagga

SEQ ID NO: 8773182 - DNA, 22 bp, Homo sapiens
tgccctccacagtggctccacc

SEQ ID NO: 8773183 - DNA, 22 bp, Homo sapiens
tgccctccacagtggctccacc

SEQ ID NO: 8773184 - DNA, 22 bp, Homo sapiens
tgccctcaggagtccctgacca

SEQ ID NO: 8773185 - DNA, 22 bp, Homo sapiens
tgccctcaggagtccctgacca

SEQ ID NO: 8773186 - DNA, 22 bp, Homo sapiens
tgccctcttaggtctgcgcagc

SEQ ID NO: 8773187 - DNA, 22 bp, Homo sapiens
tgccctctgcctcctctgcaga

SEQ ID NO: 8773188 - DNA, 22 bp, Homo sapiens
tgccctctgcctcctctgcaga

SEQ ID NO: 8773189 - DNA, 22 bp, Homo sapiens
tgccctcctcctgagcccatgt

SEQ ID NO: 8773190 - DNA, 22 bp, Homo sapiens
tgccctccctgtactgtcagga

SEQ ID NO: 8773191 - DNA, 22 bp, Homo sapiens
tgccctccctgtactgtcagga

SEQ ID NO: 8773192 - DNA, 22 bp, Homo sapiens
tgccctctcaagttgagtcaga

SEQ ID NO: 8773193 - DNA, 22 bp, Homo sapiens
tgccctctcaagttgagtcaga

SEQ ID NO: 8773194 - DNA, 22 bp, Homo sapiens
tgccctcagccacctccaagtt

SEQ ID NO: 8773195 - DNA, 22 bp, Homo sapiens
tgccctcagccacctccaagtt

SEQ ID NO: 8773196 - DNA, 22 bp, Homo sapiens
tgccctcagccacctccaagtt

SEQ ID NO: 8773197 - DNA, 22 bp, Homo sapiens
tgccctcagcagcagctcctgc

SEQ ID NO: 8773198 - DNA, 22 bp, Homo sapiens
tgccctcagcagcagctcctgc

SEQ ID NO: 8773199 - DNA, 22 bp, Homo sapiens
tgccctcagaattgctccctgc

SEQ ID NO: 8773200 - DNA, 22 bp, Homo sapiens
tgccctcagcagcagctcctgc

SEQ ID NO: 8773201 - DNA, 22 bp, Homo sapiens
tgccctcagcagcagctcctgc

SEQ ID NO: 8773202 - DNA, 22 bp, Homo sapiens
tgcccagcttcttacttttaaa

SEQ ID NO: 8773203 - DNA, 21 bp, Homo sapiens
cccaggaggctgagaagagca

SEQ ID NO: 8773204 - DNA, 21 bp, Homo sapiens
cccaggaggctgagaagagca

SEQ ID NO: 8773205 - DNA, 22 bp, Homo sapiens
cccaggaggcggaggttgtggt

SEQ ID NO: 8773206 - DNA, 19 bp, Homo sapiens
cccaggaggcggaggttgc

SEQ ID NO: 8773207 - DNA, 22 bp, Homo sapiens
cccaggaggcggaggttgcagt

SEQ ID NO: 8773208 - DNA, 22 bp, Homo sapiens
cccaggaggcggaggttgcagt

SEQ ID NO: 8773209 - DNA, 22 bp, Homo sapiens
tgcagtggaaagactcagactt

SEQ ID NO: 8773210 - DNA, 22 bp, Homo sapiens
tgcagtggaaagactcagactt

SEQ ID NO: 8773211 - DNA, 22 bp, Homo sapiens
tgcagtgcctcggcagtgcagc

SEQ ID NO: 8773212 - DNA, 21 bp, Homo sapiens
tgcagtgaggggagctgtcag

SEQ ID NO: 8773213 - DNA, 22 bp, Homo sapiens
tgcagtgagaagcagttatgat

SEQ ID NO: 8773214 - DNA, 22 bp, Homo sapiens
tgcagtgagaagcagttatgat

SEQ ID NO: 8773215 - DNA, 22 bp, Homo sapiens
tgcagtgaaagtatcttaattt

SEQ ID NO: 8773216 - DNA, 22 bp, Homo sapiens
cccagccctgacctattggaaa

SEQ ID NO: 8773217 - DNA, 22 bp, Homo sapiens
tgcaggtgctgtgtcaagagag

SEQ ID NO: 8773218 - DNA, 22 bp, Homo sapiens
tgcagtggaagaggtggagatc

SEQ ID NO: 8773219 - DNA, 22 bp, Homo sapiens
tgcagtggaagaggtggagatc

SEQ ID NO: 8773220 - DNA, 22 bp, Homo sapiens
tgcagtggaatctggagagcag

SEQ ID NO: 8773221 - DNA, 22 bp, Homo sapiens
tgcagtggaatctggagagcag

SEQ ID NO: 8773222 - DNA, 18 bp, Homo sapiens
cccagctccacttccctc

SEQ ID NO: 8773223 - DNA, 22 bp, Homo sapiens
cccagctccaagggacagcgaa

SEQ ID NO: 8773224 - DNA, 22 bp, Homo sapiens
cccagctcaagcagagagctaa

SEQ ID NO: 8773225 - DNA, 22 bp, Homo sapiens
cccagctcaagcagagagctaa

SEQ ID NO: 8773226 - DNA, 22 bp, Homo sapiens
cccagctcaagcagagagctaa

SEQ ID NO: 8773227 - DNA, 22 bp, Homo sapiens
cccaggagaatataatgttctt

SEQ ID NO: 8773228 - DNA, 22 bp, Homo sapiens
cccaggagaatataatgttctt

SEQ ID NO: 8773229 - DNA, 21 bp, Homo sapiens
cccaggagaagaaaagatgca

SEQ ID NO: 8773230 - DNA, 21 bp, Homo sapiens
cccaggagaagaaaagatgca

SEQ ID NO: 8773231 - DNA, 21 bp, Homo sapiens
cccaggagaagaaaagatgca

SEQ ID NO: 8773232 - DNA, 22 bp, Homo sapiens
cccaggactctgacacccccaa

SEQ ID NO: 8773233 - DNA, 22 bp, Homo sapiens
cccaggactctgacacccccaa

SEQ ID NO: 8773234 - DNA, 22 bp, Homo sapiens
cccaggactcttcactgcagcc

SEQ ID NO: 8773235 - DNA, 22 bp, Homo sapiens
cccaggaccgcgcggctgagcg

SEQ ID NO: 8773236 - DNA, 22 bp, Homo sapiens
cccaggactaatgagctctacg

SEQ ID NO: 8773237 - DNA, 22 bp, Homo sapiens
cccaggactcggcactctcctt

SEQ ID NO: 8773238 - DNA, 22 bp, Homo sapiens
cccaggactaatgagctctacg

SEQ ID NO: 8773239 - DNA, 22 bp, Homo sapiens
cccaggaccatccttctgtgcc

SEQ ID NO: 8773240 - DNA, 22 bp, Homo sapiens
cccaggacccttcaatggctcc

SEQ ID NO: 8773241 - DNA, 22 bp, Homo sapiens
cccaggacccttcaatggctcc

SEQ ID NO: 8773242 - DNA, 18 bp, Homo sapiens
cccagctccacttccctc

SEQ ID NO: 8773243 - DNA, 22 bp, Homo sapiens
cccagctcccaagttgctatgg

SEQ ID NO: 8773244 - DNA, 22 bp, Homo sapiens
cccagctcccatgttctccaat

SEQ ID NO: 8773245 - DNA, 22 bp, Homo sapiens
cccaggaaatagccaggaggtg

SEQ ID NO: 8773246 - DNA, 22 bp, Homo sapiens
cccaggaaatagccaggaggtg

SEQ ID NO: 8773247 - DNA, 22 bp, Homo sapiens
tgcagcatttgctgaagcagga

SEQ ID NO: 8773248 - DNA, 22 bp, Homo sapiens
tgcagcattttataccatcatt

SEQ ID NO: 8773249 - DNA, 22 bp, Homo sapiens
tgcagcattgcaaagcagtctt

SEQ ID NO: 8773250 - DNA, 22 bp, Homo sapiens
tgcagcatgcaggagaggctct

SEQ ID NO: 8773251 - DNA, 22 bp, Homo sapiens
tgcagcatgccaaacgaggagg

SEQ ID NO: 8773252 - DNA, 22 bp, Homo sapiens
tgcagcagtttaatgcagggtt

SEQ ID NO: 8773253 - DNA, 22 bp, Homo sapiens
cccagccaagtgatctgaccgc

SEQ ID NO: 8773254 - DNA, 22 bp, Homo sapiens
cccagcatttctgggctgcact

SEQ ID NO: 8773255 - DNA, 22 bp, Homo sapiens
cccagccaaggtgctggtgttg

SEQ ID NO: 8773256 - DNA, 22 bp, Homo sapiens
cccagcagtaaccagtggaaat

SEQ ID NO: 8773257 - DNA, 22 bp, Homo sapiens
cccagcaggtgccatcactctg

SEQ ID NO: 8773258 - DNA, 22 bp, Homo sapiens
cccagcatggagtgaggactca

SEQ ID NO: 8773259 - DNA, 22 bp, Homo sapiens
cccagcccccgagtgtctggaa

SEQ ID NO: 8773260 - DNA, 22 bp, Homo sapiens
cccagcccccgagtgtctggaa

SEQ ID NO: 8773261 - DNA, 22 bp, Homo sapiens
cccagcccccgagtgtctggaa

SEQ ID NO: 8773262 - DNA, 22 bp, Homo sapiens
cccagcccccgagtgtctggaa

SEQ ID NO: 8773263 - DNA, 22 bp, Homo sapiens
cccagcccatctcaaaggtcta

SEQ ID NO: 8773264 - DNA, 22 bp, Homo sapiens
cccagcccatctcaaaggtcta

SEQ ID NO: 8773265 - DNA, 22 bp, Homo sapiens
cccagcccatctcaaaggtcta

SEQ ID NO: 8773266 - DNA, 20 bp, Homo sapiens
cccagcccgggccgcgctcg

SEQ ID NO: 8773267 - DNA, 20 bp, Homo sapiens
cccagcccgggccgcgctcg

SEQ ID NO: 8773268 - DNA, 20 bp, Homo sapiens
cccagcccgggccgcgctcg

SEQ ID NO: 8773269 - DNA, 22 bp, Homo sapiens
cccagcccccgagtgtctggaa

SEQ ID NO: 8773270 - DNA, 20 bp, Homo sapiens
cccagcccgggccgcgctcg

SEQ ID NO: 8773271 - DNA, 20 bp, Homo sapiens
cccagcccctacctgttgcc

SEQ ID NO: 8773272 - DNA, 20 bp, Homo sapiens
cccagcccctacctgttgcc

SEQ ID NO: 8773273 - DNA, 20 bp, Homo sapiens
cccagcccctacctgttgcc

SEQ ID NO: 8773274 - DNA, 20 bp, Homo sapiens
cccagcccctacctgttgcc

SEQ ID NO: 8773275 - DNA, 20 bp, Homo sapiens
cccagcccctacctgttgcc

SEQ ID NO: 8773276 - DNA, 20 bp, Homo sapiens
cccagcccctacctgttgcc

SEQ ID NO: 8773277 - DNA, 18 bp, Homo sapiens
cccagcccaccatttctc

SEQ ID NO: 8773278 - DNA, 18 bp, Homo sapiens
cccagcccaccatttctc

SEQ ID NO: 8773279 - DNA, 19 bp, Homo sapiens
cccagccaggtcttgcatc

SEQ ID NO: 8773280 - DNA, 22 bp, Homo sapiens
cccagcccagcgttcgaggggt

SEQ ID NO: 8773281 - DNA, 22 bp, Homo sapiens
cccagcccagcgttcgaggggt

SEQ ID NO: 8773282 - DNA, 22 bp, Homo sapiens
cccagcccacggtcctgggtgg

SEQ ID NO: 8773283 - DNA, 22 bp, Homo sapiens
cccagcccacggtcctgggtgg

SEQ ID NO: 8773284 - DNA, 22 bp, Homo sapiens
cccagcccacggtcctgggtgg

SEQ ID NO: 8773285 - DNA, 22 bp, Homo sapiens
cccagcccacggtcctgggtgg

SEQ ID NO: 8773286 - DNA, 22 bp, Homo sapiens
cccagcccacggtcctgggtgg

SEQ ID NO: 8773287 - DNA, 22 bp, Homo sapiens
cccagcccacggtcctgggtgg

SEQ ID NO: 8773288 - DNA, 22 bp, Homo sapiens
cccagcccacggtcctgggtgg

SEQ ID NO: 8773289 - DNA, 22 bp, Homo sapiens
cccagcccacggtcctgggtgg

SEQ ID NO: 8773290 - DNA, 22 bp, Homo sapiens
ccaggtaggagagagggatcct

SEQ ID NO: 8773291 - DNA, 22 bp, Homo sapiens
ccaggtaggagagagggatcct

SEQ ID NO: 8773292 - DNA, 22 bp, Homo sapiens
ccaggtaaattacctactgaat

SEQ ID NO: 8773293 - DNA, 22 bp, Homo sapiens
ccagggtttagcaagcctacaa

SEQ ID NO: 8773294 - DNA, 22 bp, Homo sapiens
ccaggtaacttgagaacatgag

SEQ ID NO: 8773295 - DNA, 22 bp, Homo sapiens
ccagggtttaaattctgactat

SEQ ID NO: 8773296 - DNA, 22 bp, Homo sapiens
ccagggttgctgtatggcactt

SEQ ID NO: 8773297 - DNA, 22 bp, Homo sapiens
ccagggttggatgagtcactta

SEQ ID NO: 8773298 - DNA, 22 bp, Homo sapiens
ccagggttggtattcacctgga

SEQ ID NO: 8773299 - DNA, 22 bp, Homo sapiens
ccagggttggcaagcaaggctt

SEQ ID NO: 8773300 - DNA, 22 bp, Homo sapiens
ccagggtgtgggcgtcggcacg

SEQ ID NO: 8773301 - DNA, 22 bp, Homo sapiens
ccagggttgcagggagccagca

SEQ ID NO: 8773302 - DNA, 22 bp, Homo sapiens
ccagggtgtagggattccagat

SEQ ID NO: 8773303 - DNA, 22 bp, Homo sapiens
ccagggtgtgagaaggaagtag

SEQ ID NO: 8773304 - DNA, 22 bp, Homo sapiens
ccagggtggcgtagatgctggg

SEQ ID NO: 8773305 - DNA, 22 bp, Homo sapiens
ccagggtgggaggctgaaggcg

SEQ ID NO: 8773306 - DNA, 22 bp, Homo sapiens
ccagggtgggaggctgaaggcg

SEQ ID NO: 8773307 - DNA, 21 bp, Homo sapiens
tgagataaatttccttactac

SEQ ID NO: 8773308 - DNA, 22 bp, Homo sapiens
tgagataacaaaattatcttca

SEQ ID NO: 8773309 - DNA, 22 bp, Homo sapiens
tgagataaggaagtaattagga

SEQ ID NO: 8773310 - DNA, 22 bp, Homo sapiens
tgagataacatggaagagtagc

SEQ ID NO: 8773311 - DNA, 22 bp, Homo sapiens
tgagataactctgatttatgtt

SEQ ID NO: 8773312 - DNA, 22 bp, Homo sapiens
tgagcaccatctgtttgtgtgc

SEQ ID NO: 8773313 - DNA, 22 bp, Homo sapiens
tgagataataaatagctttctt

SEQ ID NO: 8773314 - DNA, 22 bp, Homo sapiens
tgagataaggatgttatactcg

SEQ ID NO: 8773315 - DNA, 22 bp, Homo sapiens
tgagcaccgccgcatttccaag

SEQ ID NO: 8773316 - DNA, 22 bp, Homo sapiens
tgagcacctaccttgtccagtg

SEQ ID NO: 8773317 - DNA, 22 bp, Homo sapiens
tgagcacctccctgacagtggg

SEQ ID NO: 8773318 - DNA, 22 bp, Homo sapiens
tgagcacctccctgacagtggg

SEQ ID NO: 8773319 - DNA, 22 bp, Homo sapiens
tgagcacctactgtattccagg

SEQ ID NO: 8773320 - DNA, 19 bp, Homo sapiens
tgagcaccttctcacgtaa

SEQ ID NO: 8773321 - DNA, 22 bp, Homo sapiens
tgagcacctggaccagattctg

SEQ ID NO: 8773322 - DNA, 22 bp, Homo sapiens
tgagagtggttcagctcagaag

SEQ ID NO: 8773323 - DNA, 22 bp, Homo sapiens
tgagagtattttggcattatca

SEQ ID NO: 8773324 - DNA, 22 bp, Homo sapiens
ccaggtctatcaagttgggctc

SEQ ID NO: 8773325 - DNA, 22 bp, Homo sapiens
tgagacgaagtcttgctctgtt

SEQ ID NO: 8773326 - DNA, 22 bp, Homo sapiens
ccaggtcctgttttcaccacag

SEQ ID NO: 8773327 - DNA, 22 bp, Homo sapiens
ccagggttgctttagattctga

SEQ ID NO: 8773328 - DNA, 22 bp, Homo sapiens
tgagaggtcattaggccatgag

SEQ ID NO: 8773329 - DNA, 22 bp, Homo sapiens
tgagagtagagtcttcatctgt

SEQ ID NO: 8773330 - DNA, 19 bp, Homo sapiens
tgagactgggtgcagtact

SEQ ID NO: 8773331 - DNA, 22 bp, Homo sapiens
tgagcagacttgatgaggcagc

SEQ ID NO: 8773332 - DNA, 22 bp, Homo sapiens
tgagcactttaaaatattccca

SEQ ID NO: 8773333 - DNA, 22 bp, Homo sapiens
tgagcagaaaagaatgctgagc

SEQ ID NO: 8773334 - DNA, 22 bp, Homo sapiens
tgagctggcacttttcctggga

SEQ ID NO: 8773335 - DNA, 22 bp, Homo sapiens
tgagctggcaggggctcaggga

SEQ ID NO: 8773336 - DNA, 22 bp, Homo sapiens
tgagctggcaggggctcaggga

SEQ ID NO: 8773337 - DNA, 22 bp, Homo sapiens
tgagctggcaggggctcaggga

SEQ ID NO: 8773338 - DNA, 19 bp, Homo sapiens
tgagctggctgagcctctc

SEQ ID NO: 8773339 - DNA, 22 bp, Homo sapiens
tgagctgggaagagcagccaga

SEQ ID NO: 8773340 - DNA, 22 bp, Homo sapiens
tgagctggcttgtcaaccaggg

SEQ ID NO: 8773341 - DNA, 19 bp, Homo sapiens
tgagctggctgagcctctc

SEQ ID NO: 8773342 - DNA, 22 bp, Homo sapiens
tgagctgggaagagcagccaga

SEQ ID NO: 8773343 - DNA, 22 bp, Homo sapiens
tgagctgggaagagcagccaga

SEQ ID NO: 8773344 - DNA, 22 bp, Homo sapiens
tgagctgggaagagcagccaga

SEQ ID NO: 8773345 - DNA, 22 bp, Homo sapiens
tgaggaagttgtttctcttcta

SEQ ID NO: 8773346 - DNA, 23 bp, Homo sapiens
tgagctggtattgtccatctcca

SEQ ID NO: 8773347 - DNA, 23 bp, Homo sapiens
tgagctggtattgtccatctcca

SEQ ID NO: 8773348 - DNA, 22 bp, Homo sapiens
tgagctgggctgggctgagctg

SEQ ID NO: 8773349 - DNA, 22 bp, Homo sapiens
tgagctgggctgggctgagctg

SEQ ID NO: 8773350 - DNA, 22 bp, Homo sapiens
tgagctgggctgggctgagctg

SEQ ID NO: 8773351 - DNA, 22 bp, Homo sapiens
tgaggacattggtcaggacatg

SEQ ID NO: 8773352 - DNA, 22 bp, Homo sapiens
tgaggacattggtcaggacatg

SEQ ID NO: 8773353 - DNA, 22 bp, Homo sapiens
tgaggacatttatcttggcgca

SEQ ID NO: 8773354 - DNA, 22 bp, Homo sapiens
ccagtgggaacactggcattgc

SEQ ID NO: 8773355 - DNA, 23 bp, Homo sapiens
ccagtggcgtaaactagaggata

SEQ ID NO: 8773356 - DNA, 22 bp, Homo sapiens
ccagtggctacaggggggttga

SEQ ID NO: 8773357 - DNA, 22 bp, Homo sapiens
ccagtgtggccaggtcttctgg

SEQ ID NO: 8773358 - DNA, 22 bp, Homo sapiens
ccagtgtggccaggtgctggta

SEQ ID NO: 8773359 - DNA, 22 bp, Homo sapiens
ccagtgtgccaatttacagctg

SEQ ID NO: 8773360 - DNA, 22 bp, Homo sapiens
tgaggacatgagtgggacagag

SEQ ID NO: 8773361 - DNA, 22 bp, Homo sapiens
tgaggacattgagactggagac

SEQ ID NO: 8773362 - DNA, 22 bp, Homo sapiens
tgaggacatgagtgggacagag

SEQ ID NO: 8773363 - DNA, 22 bp, Homo sapiens
tgaggacatgagtgggacagag

SEQ ID NO: 8773364 - DNA, 22 bp, Homo sapiens
tgaggacatgagtgggacagag

SEQ ID NO: 8773365 - DNA, 22 bp, Homo sapiens
tgacagagacagattgaagctt

SEQ ID NO: 8773366 - DNA, 22 bp, Homo sapiens
tgacagagacagattgaagctt

SEQ ID NO: 8773367 - DNA, 22 bp, Homo sapiens
tgacagagacttcagagccaaa

SEQ ID NO: 8773368 - DNA, 22 bp, Homo sapiens
tgacagagacttcagagccaaa

SEQ ID NO: 8773369 - DNA, 22 bp, Homo sapiens
tgacagagagatgggaaagggc

SEQ ID NO: 8773370 - DNA, 22 bp, Homo sapiens
tgacagagacttcagagccaaa

SEQ ID NO: 8773371 - DNA, 22 bp, Homo sapiens
tgacaattcattatatctacag

SEQ ID NO: 8773372 - DNA, 22 bp, Homo sapiens
tgacaatgggtggacaagatag

SEQ ID NO: 8773373 - DNA, 22 bp, Homo sapiens
tgacaatggggcacatggaaag

SEQ ID NO: 8773374 - DNA, 22 bp, Homo sapiens
tgacaatgggtggacaagatag

SEQ ID NO: 8773375 - DNA, 21 bp, Homo sapiens
ccagggaagaaatgagggcag

SEQ ID NO: 8773376 - DNA, 21 bp, Homo sapiens
ccagggaagaaatgagggcag

SEQ ID NO: 8773377 - DNA, 21 bp, Homo sapiens
ccagggaagaaatgagggcag

SEQ ID NO: 8773378 - DNA, 22 bp, Homo sapiens
ccagggaagaaagatgaagtgc

SEQ ID NO: 8773379 - DNA, 22 bp, Homo sapiens
ccagggaagaataggtgtggtt

SEQ ID NO: 8773380 - DNA, 22 bp, Homo sapiens
ccagggaagaccacttcctgga

SEQ ID NO: 8773381 - DNA, 22 bp, Homo sapiens
ccagggaaactttggagtggag

SEQ ID NO: 8773382 - DNA, 22 bp, Homo sapiens
ccagggaaattaatgagttaat

SEQ ID NO: 8773383 - DNA, 22 bp, Homo sapiens
ccagggaaattaatgagttaat

SEQ ID NO: 8773384 - DNA, 22 bp, Homo sapiens
ccagggaaaggaggttgacttg

SEQ ID NO: 8773385 - DNA, 22 bp, Homo sapiens
ccagggaaaatcaacttctact

SEQ ID NO: 8773386 - DNA, 22 bp, Homo sapiens
ccagggaaacagcccagtgtga

SEQ ID NO: 8773387 - DNA, 22 bp, Homo sapiens
ccagggaaacagcccagtgtga

SEQ ID NO: 8773388 - DNA, 22 bp, Homo sapiens
ccaggcttttagctgcatggca

SEQ ID NO: 8773389 - DNA, 22 bp, Homo sapiens
ccaggctttgtaccaggctttc

SEQ ID NO: 8773390 - DNA, 22 bp, Homo sapiens
ccaggcttggtgtgtggtcagg

SEQ ID NO: 8773391 - DNA, 19 bp, Homo sapiens
ccaggctttatgcaaatac

SEQ ID NO: 8773392 - DNA, 22 bp, Homo sapiens
ccaggctttaagaggtggaaac

SEQ ID NO: 8773393 - DNA, 21 bp, Homo sapiens
tgaaggagaggaccgagtgct

SEQ ID NO: 8773394 - DNA, 22 bp, Homo sapiens
tgaaggagaattaataggcatt

SEQ ID NO: 8773395 - DNA, 22 bp, Homo sapiens
tgaaggagaattaataggcatt

SEQ ID NO: 8773396 - DNA, 22 bp, Homo sapiens
tgacagagcaagatcttatctc

SEQ ID NO: 8773397 - DNA, 23 bp, Homo sapiens
tgacagagcacagtgggggagat

SEQ ID NO: 8773398 - DNA, 23 bp, Homo sapiens
tgacagagcacagtgggggagat

SEQ ID NO: 8773399 - DNA, 22 bp, Homo sapiens
tgacagagatggaatgaatctt

SEQ ID NO: 8773400 - DNA, 23 bp, Homo sapiens
tgacagagcaagacttggtctca

SEQ ID NO: 8773401 - DNA, 23 bp, Homo sapiens
tgacagagcaagacttggtctca

SEQ ID NO: 8773402 - DNA, 23 bp, Homo sapiens
tgacagagcaagacttggtctca

SEQ ID NO: 8773403 - DNA, 19 bp, Homo sapiens
tgacagagagcagggtggt

SEQ ID NO: 8773404 - DNA, 19 bp, Homo sapiens
tgacagagagcagggtggt

SEQ ID NO: 8773405 - DNA, 22 bp, Homo sapiens
tgacagagagcttttgactgtc

SEQ ID NO: 8773406 - DNA, 22 bp, Homo sapiens
tgacagagagcttttgactgtc

SEQ ID NO: 8773407 - DNA, 22 bp, Homo sapiens
tgacagagaggtaagttatgaa

SEQ ID NO: 8773408 - DNA, 22 bp, Homo sapiens
tgacagagaggtaagttatgaa

SEQ ID NO: 8773409 - DNA, 22 bp, Homo sapiens
tgacagagaggtaagttatgaa

SEQ ID NO: 8773410 - DNA, 22 bp, Homo sapiens
tgacagagccaagatcagtact

SEQ ID NO: 8773411 - DNA, 22 bp, Homo sapiens
tgacagagccaagatcagtact

SEQ ID NO: 8773412 - DNA, 22 bp, Homo sapiens
tgacagagcatgtagtgacagc

SEQ ID NO: 8773413 - DNA, 22 bp, Homo sapiens
tgacagagctggagaataattt

SEQ ID NO: 8773414 - DNA, 22 bp, Homo sapiens
tgacagagctgggatttgaagc

SEQ ID NO: 8773415 - DNA, 22 bp, Homo sapiens
tgacagagctgggatttgaagc

SEQ ID NO: 8773416 - DNA, 22 bp, Homo sapiens
tgacagaggagctggaatgatt

SEQ ID NO: 8773417 - DNA, 22 bp, Homo sapiens
tgacagaggagctggaatgatt

SEQ ID NO: 8773418 - DNA, 22 bp, Homo sapiens
tgacagagcaagatctagataa

SEQ ID NO: 8773419 - DNA, 22 bp, Homo sapiens
tgacagagcatgtagtgacagc

SEQ ID NO: 8773420 - DNA, 22 bp, Homo sapiens
tgacagagcatgtagtgacagc

SEQ ID NO: 8773421 - DNA, 22 bp, Homo sapiens
tgacagagcatgtagtgacagc

SEQ ID NO: 8773422 - DNA, 22 bp, Homo sapiens
tgacagagtccagaagtagtgt

SEQ ID NO: 8773423 - DNA, 22 bp, Homo sapiens
tgacagagtccagaagtagtgt

SEQ ID NO: 8773424 - DNA, 22 bp, Homo sapiens
tgacagagtccagaagtagtgt

SEQ ID NO: 8773425 - DNA, 22 bp, Homo sapiens
tgacagagtcggggcaagctgt

SEQ ID NO: 8773426 - DNA, 22 bp, Homo sapiens
tgacagagtgacactcttgtct

SEQ ID NO: 8773427 - DNA, 22 bp, Homo sapiens
tgacagagtcggggcaagctgt

SEQ ID NO: 8773428 - DNA, 22 bp, Homo sapiens
tgacagaggctgagttagtctg

SEQ ID NO: 8773429 - DNA, 22 bp, Homo sapiens
tgacagaggctgagttagtctg

SEQ ID NO: 8773430 - DNA, 22 bp, Homo sapiens
tgacagaggctgagttagtctg

SEQ ID NO: 8773431 - DNA, 22 bp, Homo sapiens
tgacagaggcacccacaactat

SEQ ID NO: 8773432 - DNA, 22 bp, Homo sapiens
ccagggcatgggaagaactgaa

SEQ ID NO: 8773433 - DNA, 22 bp, Homo sapiens
tgacagagtgacactcttgtct

SEQ ID NO: 8773434 - DNA, 22 bp, Homo sapiens
tgacagagtgacactcttgtct

SEQ ID NO: 8773435 - DNA, 22 bp, Homo sapiens
ccagggcatgggaagaactgaa

SEQ ID NO: 8773436 - DNA, 22 bp, Homo sapiens
ccagggccaagagacctcgagg

SEQ ID NO: 8773437 - DNA, 22 bp, Homo sapiens
ccagggcatgtaactaatggtg

SEQ ID NO: 8773438 - DNA, 22 bp, Homo sapiens
tgaccaaggacagtcacgctgt

SEQ ID NO: 8773439 - DNA, 22 bp, Homo sapiens
tgaccaaagagttgcttgtatt

SEQ ID NO: 8773440 - DNA, 22 bp, Homo sapiens
tgaccaaaaaattccctgtgag

SEQ ID NO: 8773441 - DNA, 22 bp, Homo sapiens
tgacatttttgtacaaagtcag

SEQ ID NO: 8773442 - DNA, 22 bp, Homo sapiens
tgaccaggatactgcagggatg

SEQ ID NO: 8773443 - DNA, 21 bp, Homo sapiens
tgaccagtgccccatcctgtc

SEQ ID NO: 8773444 - DNA, 22 bp, Homo sapiens
tgaccagttaagtcatcctgtc

SEQ ID NO: 8773445 - DNA, 22 bp, Homo sapiens
tgaccagtgatctactgggatt

SEQ ID NO: 8773446 - DNA, 22 bp, Homo sapiens
tgacccattggtccctagatcc

SEQ ID NO: 8773447 - DNA, 22 bp, Homo sapiens
tgacccattaaccactttccct

SEQ ID NO: 8773448 - DNA, 22 bp, Homo sapiens
tgaccatggcacatgtttgcct

SEQ ID NO: 8773449 - DNA, 22 bp, Homo sapiens
tgaccatggtgtgccctgtgcg

SEQ ID NO: 8773450 - DNA, 22 bp, Homo sapiens
tgacccaagggcttagcagttt

SEQ ID NO: 8773451 - DNA, 22 bp, Homo sapiens
ccagggccagtaagattggcat

SEQ ID NO: 8773452 - DNA, 22 bp, Homo sapiens
ccagggcccacggccagaatag

SEQ ID NO: 8773453 - DNA, 22 bp, Homo sapiens
ccagggcccacggccagaatag

SEQ ID NO: 8773454 - DNA, 22 bp, Homo sapiens
ccagggccagtaagattggcat

SEQ ID NO: 8773455 - DNA, 22 bp, Homo sapiens
ccagggccaagagacctcgagg

SEQ ID NO: 8773456 - DNA, 22 bp, Homo sapiens
ccagggccagtaagattggcat

SEQ ID NO: 8773457 - DNA, 22 bp, Homo sapiens
tgacatttttataagagtcaaa

SEQ ID NO: 8773458 - DNA, 22 bp, Homo sapiens
tgacatctttgatctcatttag

SEQ ID NO: 8773459 - DNA, 22 bp, Homo sapiens
tgacatgctaagattatgttat

SEQ ID NO: 8773460 - DNA, 23 bp, Homo sapiens
ccagggcccctacaccactgtcc

SEQ ID NO: 8773461 - DNA, 23 bp, Homo sapiens
ccagggcccctacaccactgtcc

SEQ ID NO: 8773462 - DNA, 23 bp, Homo sapiens
ccagggcccctacaccactgtcc

SEQ ID NO: 8773463 - DNA, 22 bp, Homo sapiens
tgacatctgggccctcagctaa

SEQ ID NO: 8773464 - DNA, 22 bp, Homo sapiens
tgacatctgaccacacgtattc

SEQ ID NO: 8773465 - DNA, 22 bp, Homo sapiens
tgaccctcttccccatgcgctc

SEQ ID NO: 8773466 - DNA, 22 bp, Homo sapiens
tgactttaagctatctgattct

SEQ ID NO: 8773467 - DNA, 22 bp, Homo sapiens
tgaccctgagagctgaatggct

SEQ ID NO: 8773468 - DNA, 22 bp, Homo sapiens
tgactttaaagctcactctttt

SEQ ID NO: 8773469 - DNA, 22 bp, Homo sapiens
tgaccctgagagctgaatggct

SEQ ID NO: 8773470 - DNA, 22 bp, Homo sapiens
tgaccctgaaatgtagtggttt

SEQ ID NO: 8773471 - DNA, 22 bp, Homo sapiens
tgacccctatatcctgtttctt

SEQ ID NO: 8773472 - DNA, 22 bp, Homo sapiens
tgaccccactgtgctcagaggt

SEQ ID NO: 8773473 - DNA, 19 bp, Homo sapiens
tgaccccacgctccagagc

SEQ ID NO: 8773474 - DNA, 22 bp, Homo sapiens
tgactttacagatatgtttcct

SEQ ID NO: 8773475 - DNA, 22 bp, Homo sapiens
tgactttagaattttatccaga

SEQ ID NO: 8773476 - DNA, 22 bp, Homo sapiens
tgactttcttaactagctgttc

SEQ ID NO: 8773477 - DNA, 22 bp, Homo sapiens
tgactttccattctcacacagt

SEQ ID NO: 8773478 - DNA, 17 bp, Homo sapiens
tgactttatttgcttgg

SEQ ID NO: 8773479 - DNA, 21 bp, Homo sapiens
tgactttatttgacagcccag

SEQ ID NO: 8773480 - DNA, 18 bp, Homo sapiens
tgactttctttttcaacc

SEQ ID NO: 8773481 - DNA, 22 bp, Homo sapiens
tgactttgtccctttcaaatcc

SEQ ID NO: 8773482 - DNA, 22 bp, Homo sapiens
tgacttttggacctcactgtcc

SEQ ID NO: 8773483 - DNA, 22 bp, Homo sapiens
tgagaaaacagtttgtaataat

SEQ ID NO: 8773484 - DNA, 22 bp, Homo sapiens
tgagaaaacagtttgtaataat

SEQ ID NO: 8773485 - DNA, 22 bp, Homo sapiens
tgacttttggacctcactgtcc

SEQ ID NO: 8773486 - DNA, 22 bp, Homo sapiens
tgagaaaacagtttgtaataat

SEQ ID NO: 8773487 - DNA, 22 bp, Homo sapiens
tgagaaaactcaaagacagatc

SEQ ID NO: 8773488 - DNA, 22 bp, Homo sapiens
tgagaaaactcaaagacagatc

SEQ ID NO: 8773489 - DNA, 22 bp, Homo sapiens
tgagaaaactcaaagacagatc

SEQ ID NO: 8773490 - DNA, 22 bp, Homo sapiens
tgagaaaactcaaagacagatc

SEQ ID NO: 8773491 - DNA, 22 bp, Homo sapiens
tgagaaaactcaaagacagatc

SEQ ID NO: 8773492 - DNA, 22 bp, Homo sapiens
tgagaaaactcaaagacagatc

SEQ ID NO: 8773493 - DNA, 22 bp, Homo sapiens
tgagaaaaggttgagatgataa

SEQ ID NO: 8773494 - DNA, 22 bp, Homo sapiens
ccagggtctctgctgcctgaga

SEQ ID NO: 8773495 - DNA, 22 bp, Homo sapiens
ccaggctccgcatagaccccac

SEQ ID NO: 8773496 - DNA, 22 bp, Homo sapiens
ccaggctcctcatgatcttgtt

SEQ ID NO: 8773497 - DNA, 22 bp, Homo sapiens
ccaggctcctcatgatcttgtt

SEQ ID NO: 8773498 - DNA, 22 bp, Homo sapiens
ccaggctccccaggaggccctt

SEQ ID NO: 8773499 - DNA, 22 bp, Homo sapiens
ccaggctccccaggaggccctt

SEQ ID NO: 8773500 - DNA, 22 bp, Homo sapiens
ccaggctccccaggaggccctt

SEQ ID NO: 8773501 - DNA, 22 bp, Homo sapiens
ccaggctccccaggaggccctt

SEQ ID NO: 8773502 - DNA, 22 bp, Homo sapiens
ccaggctccgcatagaccccac

SEQ ID NO: 8773503 - DNA, 21 bp, Homo sapiens
tgaaacagatggaagtatttg

SEQ ID NO: 8773504 - DNA, 22 bp, Homo sapiens
tgaaagcactgattctcaactc

SEQ ID NO: 8773505 - DNA, 22 bp, Homo sapiens
tgaaagcagatagctctgttgt

SEQ ID NO: 8773506 - DNA, 22 bp, Homo sapiens
tgaaagcagatagctctgttgt

SEQ ID NO: 8773507 - DNA, 22 bp, Homo sapiens
tgaaagcagcaccaataccatt

SEQ ID NO: 8773508 - DNA, 22 bp, Homo sapiens
tgaaagcagcaccaataccatt

SEQ ID NO: 8773509 - DNA, 22 bp, Homo sapiens
tgaaagcagcaccaataccatt

SEQ ID NO: 8773510 - DNA, 22 bp, Homo sapiens
tgaaagcatgcttgccaagctt

SEQ ID NO: 8773511 - DNA, 20 bp, Homo sapiens
tgaaagcatgtggtatttgg

SEQ ID NO: 8773512 - DNA, 22 bp, Homo sapiens
tgaaagctgcccagtggaatta

SEQ ID NO: 8773513 - DNA, 22 bp, Homo sapiens
tgaaagcattagtctaaggtag

SEQ ID NO: 8773514 - DNA, 22 bp, Homo sapiens
tgaaagctttgggacagtgtga

SEQ ID NO: 8773515 - DNA, 22 bp, Homo sapiens
tgaaagctgtccactaggctgt

SEQ ID NO: 8773516 - DNA, 22 bp, Homo sapiens
tgaaagcttgttggaaatgtag

SEQ ID NO: 8773517 - DNA, 22 bp, Homo sapiens
tgaaagctgggcacaagattct

SEQ ID NO: 8773518 - DNA, 22 bp, Homo sapiens
tgaaagcatatgctaaagacca

SEQ ID NO: 8773519 - DNA, 22 bp, Homo sapiens
tgaaagcagtgccatgattatg

SEQ ID NO: 8773520 - DNA, 22 bp, Homo sapiens
tgaaagcatgcttgccaagctt

SEQ ID NO: 8773521 - DNA, 22 bp, Homo sapiens
tgaaagcatatgctaaagacca

SEQ ID NO: 8773522 - DNA, 22 bp, Homo sapiens
tgaaagcatgcttgccaagctt

SEQ ID NO: 8773523 - DNA, 22 bp, Homo sapiens
tgaaagcagtgccatgattatg

SEQ ID NO: 8773524 - DNA, 22 bp, Homo sapiens
tgaaagcagtgatttctccttc

SEQ ID NO: 8773525 - DNA, 22 bp, Homo sapiens
tgaaagcaggcgggctacttta

SEQ ID NO: 8773526 - DNA, 22 bp, Homo sapiens
tgaaagcagtgatttctccttc

SEQ ID NO: 8773527 - DNA, 22 bp, Homo sapiens
tgaaagcaggcgggctacttta

SEQ ID NO: 8773528 - DNA, 22 bp, Homo sapiens
ccaggctgagcatgattggagc

SEQ ID NO: 8773529 - DNA, 22 bp, Homo sapiens
ccaggctgagcatgattggagc

SEQ ID NO: 8773530 - DNA, 22 bp, Homo sapiens
tgaaagggaacctgctggactg

SEQ ID NO: 8773531 - DNA, 22 bp, Homo sapiens
tgaaagggaacctgctggactg

SEQ ID NO: 8773532 - DNA, 22 bp, Homo sapiens
tgaaaggaagagggctactcct

SEQ ID NO: 8773533 - DNA, 22 bp, Homo sapiens
tgaaaggcagttagaggtgttt

SEQ ID NO: 8773534 - DNA, 22 bp, Homo sapiens
tgaaaggcagttagaggtgttt

SEQ ID NO: 8773535 - DNA, 22 bp, Homo sapiens
tgaaaggaaagtacagtgatgc

SEQ ID NO: 8773536 - DNA, 22 bp, Homo sapiens
ccaggctgagcatgattggagc

SEQ ID NO: 8773537 - DNA, 22 bp, Homo sapiens
tgaaaggggttgagttacagct

SEQ ID NO: 8773538 - DNA, 22 bp, Homo sapiens
ccaggctgccgaggaaagaaag

SEQ ID NO: 8773539 - DNA, 22 bp, Homo sapiens
ccaggctgcagtcaaggggcat

SEQ ID NO: 8773540 - DNA, 22 bp, Homo sapiens
ccaggctgcagtcaaggggcat

SEQ ID NO: 8773541 - DNA, 22 bp, Homo sapiens
ccaggctgcagtcaaggggcat

SEQ ID NO: 8773542 - DNA, 22 bp, Homo sapiens
ccaggctgctcacaagctgccc

SEQ ID NO: 8773543 - DNA, 22 bp, Homo sapiens
ccaggctgctcacaagctgccc

SEQ ID NO: 8773544 - DNA, 22 bp, Homo sapiens
ccaggctgctcacaagctgccc

SEQ ID NO: 8773545 - DNA, 22 bp, Homo sapiens
tgaacacagttctgatgagctt

SEQ ID NO: 8773546 - DNA, 22 bp, Homo sapiens
tgaacacataaaagcaaagggt

SEQ ID NO: 8773547 - DNA, 22 bp, Homo sapiens
tgaacacatattaggtgctcat

SEQ ID NO: 8773548 - DNA, 22 bp, Homo sapiens
tgaacacataaggctttcctgt

SEQ ID NO: 8773549 - DNA, 22 bp, Homo sapiens
tgaacacataaggctttcctgt

SEQ ID NO: 8773550 - DNA, 22 bp, Homo sapiens
tgaacacataaggctttcctgt

SEQ ID NO: 8773551 - DNA, 22 bp, Homo sapiens
tgaacacagggccaaacttgag

SEQ ID NO: 8773552 - DNA, 18 bp, Homo sapiens
tgaacacagtacaattcc

SEQ ID NO: 8773553 - DNA, 22 bp, Homo sapiens
tgaagatgtcagcaggggtggt

SEQ ID NO: 8773554 - DNA, 22 bp, Homo sapiens
tgaagatgtcagcaggggtggt

SEQ ID NO: 8773555 - DNA, 22 bp, Homo sapiens
tgaagattgagaaattatccaa

SEQ ID NO: 8773556 - DNA, 17 bp, Homo sapiens
tgaagatgcatggcagc

SEQ ID NO: 8773557 - DNA, 22 bp, Homo sapiens
tgaagataaattgtactgaaga

SEQ ID NO: 8773558 - DNA, 22 bp, Homo sapiens
tgaagataacagtaaggtattg

SEQ ID NO: 8773559 - DNA, 22 bp, Homo sapiens
tgaagatttaagcatctcaatt

SEQ ID NO: 8773560 - DNA, 22 bp, Homo sapiens
tgaagatttaagcatctcaatt

SEQ ID NO: 8773561 - DNA, 22 bp, Homo sapiens
tgaagatttccaccaaatcaca

SEQ ID NO: 8773562 - DNA, 22 bp, Homo sapiens
tgaagctttaggatgggttcat

SEQ ID NO: 8773563 - DNA, 22 bp, Homo sapiens
tgaagctttcctgtggtcagga

SEQ ID NO: 8773564 - DNA, 22 bp, Homo sapiens
tgaaggaaagagggaacatccc

SEQ ID NO: 8773565 - DNA, 17 bp, Homo sapiens
tgaaggaaggatgatgt

SEQ ID NO: 8773566 - DNA, 22 bp, Homo sapiens
tgaaggaatgagggagtgggtc

SEQ ID NO: 8773567 - DNA, 22 bp, Homo sapiens
tgaaggaagaataggcagtgtt

SEQ ID NO: 8773568 - DNA, 22 bp, Homo sapiens
tgaaggaaatgacggcagaaga

SEQ ID NO: 8773569 - DNA, 22 bp, Homo sapiens
tgaaggaaatgacggcagaaga

SEQ ID NO: 8773570 - DNA, 22 bp, Homo sapiens
tgaaggaaatgacggcagaaga

SEQ ID NO: 8773571 - DNA, 22 bp, Homo sapiens
tgaaggagaaatggaaagtggg

SEQ ID NO: 8773572 - DNA, 22 bp, Homo sapiens
tgaaggagaaatggaaagtggg

SEQ ID NO: 8773573 - DNA, 22 bp, Homo sapiens
tgaaggacagcagtggctccaa

SEQ ID NO: 8773574 - DNA, 22 bp, Homo sapiens
tgaaggaatgagtatactgttt

SEQ ID NO: 8773575 - DNA, 22 bp, Homo sapiens
tgaacagatggcccagcagagg

SEQ ID NO: 8773576 - DNA, 22 bp, Homo sapiens
tgaacagatggcccagcagagg

SEQ ID NO: 8773577 - DNA, 22 bp, Homo sapiens
tgaacagatggcccagcagagg

SEQ ID NO: 8773578 - DNA, 22 bp, Homo sapiens
tgaacagatggcccagcagagg

SEQ ID NO: 8773579 - DNA, 22 bp, Homo sapiens
tgaacagatggcccagcagagg

SEQ ID NO: 8773580 - DNA, 22 bp, Homo sapiens
tgaacagatgtggaggtacctt

SEQ ID NO: 8773581 - DNA, 22 bp, Homo sapiens
tgaacagatgtggaggtacctt

SEQ ID NO: 8773582 - DNA, 18 bp, Homo sapiens
tgaacagctgagactatc

SEQ ID NO: 8773583 - DNA, 22 bp, Homo sapiens
tgaacaggcattatcagggatc

SEQ ID NO: 8773584 - DNA, 22 bp, Homo sapiens
tgaacagatcaatagaactgac

SEQ ID NO: 8773585 - DNA, 22 bp, Homo sapiens
tgaacagagctgattcagctca

SEQ ID NO: 8773586 - DNA, 22 bp, Homo sapiens
tgaacagagctgattcagctca

SEQ ID NO: 8773587 - DNA, 22 bp, Homo sapiens
tgaacagatcaatagaactgac

SEQ ID NO: 8773588 - DNA, 22 bp, Homo sapiens
tgaacagagctgattcagctca

SEQ ID NO: 8773589 - DNA, 18 bp, Homo sapiens
tgaacagatgagttgaag

SEQ ID NO: 8773590 - DNA, 22 bp, Homo sapiens
tgaacagatgccttctcccatg

SEQ ID NO: 8773591 - DNA, 22 bp, Homo sapiens
tgaacagactgacctctgacct

SEQ ID NO: 8773592 - DNA, 22 bp, Homo sapiens
tgaacagactgacctctgacct

SEQ ID NO: 8773593 - DNA, 22 bp, Homo sapiens
tgaacagactgacctctgacct

SEQ ID NO: 8773594 - DNA, 19 bp, Homo sapiens
tgaacagagaggactctgg

SEQ ID NO: 8773595 - DNA, 19 bp, Homo sapiens
tgaacagagaggactctgg

SEQ ID NO: 8773596 - DNA, 19 bp, Homo sapiens
tgaacagagaggactctgg

SEQ ID NO: 8773597 - DNA, 22 bp, Homo sapiens
tgaacactgccatatttaagaa

SEQ ID NO: 8773598 - DNA, 22 bp, Homo sapiens
tgaacacattttcttcagtaga

SEQ ID NO: 8773599 - DNA, 22 bp, Homo sapiens
tgaacacgcttcatacagaggg

SEQ ID NO: 8773600 - DNA, 22 bp, Homo sapiens
tgaacacatttgggaaaatctt

SEQ ID NO: 8773601 - DNA, 22 bp, Homo sapiens
tgaacacatttctggccaattt

SEQ ID NO: 8773602 - DNA, 22 bp, Homo sapiens
tgaacacatttctggccaattt

SEQ ID NO: 8773603 - DNA, 22 bp, Homo sapiens
tgaacacatctgcgtgtgtctc

SEQ ID NO: 8773604 - DNA, 22 bp, Homo sapiens
tgaagaggccaaactatcattg

SEQ ID NO: 8773605 - DNA, 19 bp, Homo sapiens
tgaagagctgtcaaaagtg

SEQ ID NO: 8773606 - DNA, 22 bp, Homo sapiens
tgaagagatagaagtacatgct

SEQ ID NO: 8773607 - DNA, 22 bp, Homo sapiens
tgaagagatagaagtacatgct

SEQ ID NO: 8773608 - DNA, 22 bp, Homo sapiens
tgaagagatagaagtacatgct

SEQ ID NO: 8773609 - DNA, 22 bp, Homo sapiens
tgaagagatagaagtacatgct

SEQ ID NO: 8773610 - DNA, 22 bp, Homo sapiens
tgaagagattaagttggttttg

SEQ ID NO: 8773611 - DNA, 22 bp, Homo sapiens
tgaagagatagaagtacatgct

SEQ ID NO: 8773612 - DNA, 22 bp, Homo sapiens
tgaacaggtatttattgaacat

SEQ ID NO: 8773613 - DNA, 22 bp, Homo sapiens
tgaacaggctgtactcatgagg

SEQ ID NO: 8773614 - DNA, 22 bp, Homo sapiens
tgaacaggtgccttcagggagt

SEQ ID NO: 8773615 - DNA, 23 bp, Homo sapiens
tgaacagtatgtgggacattgag

SEQ ID NO: 8773616 - DNA, 22 bp, Homo sapiens
tgaagagaagaaaattatcttt

SEQ ID NO: 8773617 - DNA, 22 bp, Homo sapiens
tgaagagaagaaaattatcttt

SEQ ID NO: 8773618 - DNA, 22 bp, Homo sapiens
tgaagagaagaaaattatcttt

SEQ ID NO: 8773619 - DNA, 22 bp, Homo sapiens
ccaggctcactgactaccacat

SEQ ID NO: 8773620 - DNA, 22 bp, Homo sapiens
ccaggctcagcgcgcacgtctg

SEQ ID NO: 8773621 - DNA, 22 bp, Homo sapiens
ccaggctcagctattaagaaac

SEQ ID NO: 8773622 - DNA, 22 bp, Homo sapiens
ccaggctcagcgcgcacgtctg

SEQ ID NO: 8773623 - DNA, 22 bp, Homo sapiens
ccaggctcaggcctgctcgttg

SEQ ID NO: 8773624 - DNA, 22 bp, Homo sapiens
ccaggctcaggcctgctcgttg

SEQ ID NO: 8773625 - DNA, 22 bp, Homo sapiens
ccaggctcaggcctgctcgttg

SEQ ID NO: 8773626 - DNA, 22 bp, Homo sapiens
ccaggctcaggcctgctcgttg

SEQ ID NO: 8773627 - DNA, 22 bp, Homo sapiens
ccaggctcaggcctgctcgttg

SEQ ID NO: 8773628 - DNA, 17 bp, Homo sapiens
ccaggctccatcactgt

SEQ ID NO: 8773629 - DNA, 17 bp, Homo sapiens
ccaggctccatcactgt

SEQ ID NO: 8773630 - DNA, 17 bp, Homo sapiens
ccaggctccatcactgt

SEQ ID NO: 8773631 - DNA, 22 bp, Homo sapiens
ccaggctcagggcagactttca

SEQ ID NO: 8773632 - DNA, 22 bp, Homo sapiens
ccaggctcaggtgcgagagaca

SEQ ID NO: 8773633 - DNA, 22 bp, Homo sapiens
ccaggctcaggtgcgagagaca

SEQ ID NO: 8773634 - DNA, 22 bp, Homo sapiens
ccaggctcacagcatcccagga

SEQ ID NO: 8773635 - DNA, 22 bp, Homo sapiens
ccaggctcacagcatcccagga

SEQ ID NO: 8773636 - DNA, 22 bp, Homo sapiens
ccaggctagagtgcaatggcgc

SEQ ID NO: 8773637 - DNA, 22 bp, Homo sapiens
ccaggctagagtgcagtggcgt

SEQ ID NO: 8773638 - DNA, 22 bp, Homo sapiens
ccaggctagagtgcagtggcgt

SEQ ID NO: 8773639 - DNA, 22 bp, Homo sapiens
ccaggctagagtgcagtggcat

SEQ ID NO: 8773640 - DNA, 22 bp, Homo sapiens
ccaggctagagtgcagtggcat

SEQ ID NO: 8773641 - DNA, 22 bp, Homo sapiens
ccaggctagagtgcaatggcat

SEQ ID NO: 8773642 - DNA, 22 bp, Homo sapiens
ccaggctagagagcagtggcat

SEQ ID NO: 8773643 - DNA, 22 bp, Homo sapiens
ccaggctagagagcagtggcat

SEQ ID NO: 8773644 - DNA, 22 bp, Homo sapiens
ccaggctagagagcagtggcac

SEQ ID NO: 8773645 - DNA, 22 bp, Homo sapiens
ccaggctagagagcagtggcac

SEQ ID NO: 8773646 - DNA, 22 bp, Homo sapiens
ccaggctcactgactaccacat

SEQ ID NO: 8773647 - DNA, 22 bp, Homo sapiens
ccaggctcagcgcgcacgtctg

SEQ ID NO: 8773648 - DNA, 22 bp, Homo sapiens
ccaggctcacctggagcccctg

SEQ ID NO: 8773649 - DNA, 22 bp, Homo sapiens
ccaggctcactgactaccacat

SEQ ID NO: 8773650 - DNA, 22 bp, Homo sapiens
ccaggctcacagcatcccagga

SEQ ID NO: 8773651 - DNA, 22 bp, Homo sapiens
ccaggctcacagcatcccagga

SEQ ID NO: 8773652 - DNA, 19 bp, Homo sapiens
ccaggcctggcgtctccgc

SEQ ID NO: 8773653 - DNA, 22 bp, Homo sapiens
tctttcaaagctgtagtagatt

SEQ ID NO: 8773654 - DNA, 22 bp, Homo sapiens
tctttcaaagtaacaaccacga

SEQ ID NO: 8773655 - DNA, 19 bp, Homo sapiens
ccaggcctggcgtctccgc

SEQ ID NO: 8773656 - DNA, 19 bp, Homo sapiens
ccaggcctggcgtctccgc

SEQ ID NO: 8773657 - DNA, 19 bp, Homo sapiens
ccaggcctggcgtctccgc

SEQ ID NO: 8773658 - DNA, 22 bp, Homo sapiens
ccaggcgtggcttcagcagccc

SEQ ID NO: 8773659 - DNA, 22 bp, Homo sapiens
tctttattttatgcttgtgcaa

SEQ ID NO: 8773660 - DNA, 22 bp, Homo sapiens
tctttcaaagcaaaatgaggct

SEQ ID NO: 8773661 - DNA, 22 bp, Homo sapiens
tctttcaaagcaaaatgaggct

SEQ ID NO: 8773662 - DNA, 22 bp, Homo sapiens
tctttattttatgcttgtgcaa

SEQ ID NO: 8773663 - DNA, 22 bp, Homo sapiens
tctttattttatgcttgtgcaa

SEQ ID NO: 8773664 - DNA, 22 bp, Homo sapiens
tctttatttaagtctgttgtaa

SEQ ID NO: 8773665 - DNA, 22 bp, Homo sapiens
tctttatttaagtctgttgtaa

SEQ ID NO: 8773666 - DNA, 22 bp, Homo sapiens
tctttatttctgaatcccccat

SEQ ID NO: 8773667 - DNA, 22 bp, Homo sapiens
tctttaatatctgccccagagc

SEQ ID NO: 8773668 - DNA, 22 bp, Homo sapiens
tctttatttaagtctgttgtaa

SEQ ID NO: 8773669 - DNA, 22 bp, Homo sapiens
tctttaagccaagatatattta

SEQ ID NO: 8773670 - DNA, 22 bp, Homo sapiens
tctttaagagttcatttgcatg

SEQ ID NO: 8773671 - DNA, 22 bp, Homo sapiens
tctttaagagtaattattttgg

SEQ ID NO: 8773672 - DNA, 22 bp, Homo sapiens
tctttaagggatgttctgcttt

SEQ ID NO: 8773673 - DNA, 22 bp, Homo sapiens
tctttaagggatgttctgcttt

SEQ ID NO: 8773674 - DNA, 22 bp, Homo sapiens
tctttaaggtgatttctgctac

SEQ ID NO: 8773675 - DNA, 22 bp, Homo sapiens
tctttaaggtgatttctgctac

SEQ ID NO: 8773676 - DNA, 22 bp, Homo sapiens
tctttaatataaaggaatgaat

SEQ ID NO: 8773677 - DNA, 22 bp, Homo sapiens
tcttgtttctgtatataatgac

SEQ ID NO: 8773678 - DNA, 22 bp, Homo sapiens
tcttgtttctgtatataatgac

SEQ ID NO: 8773679 - DNA, 22 bp, Homo sapiens
tcttgtttggattttgggcagt

SEQ ID NO: 8773680 - DNA, 22 bp, Homo sapiens
tcttgttttgaactcatcagga

SEQ ID NO: 8773681 - DNA, 22 bp, Homo sapiens
tctttaagagtaattattttgg

SEQ ID NO: 8773682 - DNA, 22 bp, Homo sapiens
tctttaacaggaattattacag

SEQ ID NO: 8773683 - DNA, 22 bp, Homo sapiens
tctttaaagttggagcttgcaa

SEQ ID NO: 8773684 - DNA, 22 bp, Homo sapiens
tctttaaagttggagcttgcaa

SEQ ID NO: 8773685 - DNA, 22 bp, Homo sapiens
tctttaaagttggagcttgcaa

SEQ ID NO: 8773686 - DNA, 22 bp, Homo sapiens
tcttgtcatgcccttggtaact

SEQ ID NO: 8773687 - DNA, 22 bp, Homo sapiens
tcttgtcctaagagctggattc

SEQ ID NO: 8773688 - DNA, 21 bp, Homo sapiens
tcttgtgtgctgccctgctac

SEQ ID NO: 8773689 - DNA, 22 bp, Homo sapiens
tcttgttacagtttattacatg

SEQ ID NO: 8773690 - DNA, 22 bp, Homo sapiens
tcttgtgtggaactgcttttct

SEQ ID NO: 8773691 - DNA, 22 bp, Homo sapiens
tcttgttatcaggaaaacagta

SEQ ID NO: 8773692 - DNA, 22 bp, Homo sapiens
tcttgttatcaggaaaacagta

SEQ ID NO: 8773693 - DNA, 23 bp, Homo sapiens
tcttgtttcctttgcgctatcca

SEQ ID NO: 8773694 - DNA, 21 bp, Homo sapiens
tcttggggaggagggctgcac

SEQ ID NO: 8773695 - DNA, 22 bp, Homo sapiens
tcttgtaattaactagaaagat

SEQ ID NO: 8773696 - DNA, 22 bp, Homo sapiens
tcttggtttttccagggctgat

SEQ ID NO: 8773697 - DNA, 21 bp, Homo sapiens
tcttggttccgtgtgtttgat

SEQ ID NO: 8773698 - DNA, 22 bp, Homo sapiens
tcttggttaggggaaataggca

SEQ ID NO: 8773699 - DNA, 22 bp, Homo sapiens
tcttggttaggggaaataggca

SEQ ID NO: 8773700 - DNA, 22 bp, Homo sapiens
tcttgtatgtcttcatctggtt

SEQ ID NO: 8773701 - DNA, 22 bp, Homo sapiens
tcttgtcactactgttatgcat

SEQ ID NO: 8773702 - DNA, 22 bp, Homo sapiens
ccagcctcactggcatcaccta

SEQ ID NO: 8773703 - DNA, 22 bp, Homo sapiens
ccagcctcactggcatcaccta

SEQ ID NO: 8773704 - DNA, 18 bp, Homo sapiens
tcttgcctgcaccctctc

SEQ ID NO: 8773705 - DNA, 22 bp, Homo sapiens
tcttgccgcgcaggcgcagttc

SEQ ID NO: 8773706 - DNA, 21 bp, Homo sapiens
ccagcctcagatcagggagct

SEQ ID NO: 8773707 - DNA, 22 bp, Homo sapiens
tctgcagaattcgaggaagaaa

SEQ ID NO: 8773708 - DNA, 22 bp, Homo sapiens
tctgcagacaggaagctgaggc

SEQ ID NO: 8773709 - DNA, 23 bp, Homo sapiens
tctgcagacgctgttctattgtc

SEQ ID NO: 8773710 - DNA, 23 bp, Homo sapiens
tctgcagacgctgttctattgtc

SEQ ID NO: 8773711 - DNA, 22 bp, Homo sapiens
tctgcagagattctgggctgag

SEQ ID NO: 8773712 - DNA, 17 bp, Homo sapiens
tctgcagaggcaaacct

SEQ ID NO: 8773713 - DNA, 22 bp, Homo sapiens
ccagccctttgtggttcactga

SEQ ID NO: 8773714 - DNA, 22 bp, Homo sapiens
ccagcccttgctgaagggtggc

SEQ ID NO: 8773715 - DNA, 22 bp, Homo sapiens
ccagcctcactggcatcaccta

SEQ ID NO: 8773716 - DNA, 22 bp, Homo sapiens
ccagccctttgtggttcactga

SEQ ID NO: 8773717 - DNA, 22 bp, Homo sapiens
ccagccctttgtggttcactga

SEQ ID NO: 8773718 - DNA, 22 bp, Homo sapiens
ccagccgcggtgagggtggctg

SEQ ID NO: 8773719 - DNA, 22 bp, Homo sapiens
ccagccgcggtgagggtggctg

SEQ ID NO: 8773720 - DNA, 22 bp, Homo sapiens
ccagcccttgagatggaaggga

SEQ ID NO: 8773721 - DNA, 22 bp, Homo sapiens
ccagcccttgaggtctgtccat

SEQ ID NO: 8773722 - DNA, 22 bp, Homo sapiens
ccagcccttgaggtctgtccat

SEQ ID NO: 8773723 - DNA, 22 bp, Homo sapiens
ccagcccttgaggtctgtccat

SEQ ID NO: 8773724 - DNA, 22 bp, Homo sapiens
ccagcccttgagatggaaggga

SEQ ID NO: 8773725 - DNA, 22 bp, Homo sapiens
ccagcccttgagatggaaggga

SEQ ID NO: 8773726 - DNA, 22 bp, Homo sapiens
tgtaatattgtagtgacagtac

SEQ ID NO: 8773727 - DNA, 22 bp, Homo sapiens
tgtaatatatataactgtgtgc

SEQ ID NO: 8773728 - DNA, 22 bp, Homo sapiens
tgtaatataagcattaatagtt

SEQ ID NO: 8773729 - DNA, 22 bp, Homo sapiens
tgtaatatatataactgtgtgc

SEQ ID NO: 8773730 - DNA, 22 bp, Homo sapiens
tgtaatgagaaagagagtgaat

SEQ ID NO: 8773731 - DNA, 18 bp, Homo sapiens
tgtaatgcagcgggtggc

SEQ ID NO: 8773732 - DNA, 21 bp, Homo sapiens
tgtaagtttcatctgaattgg

SEQ ID NO: 8773733 - DNA, 21 bp, Homo sapiens
tgtaagtttcatctgaattgg

SEQ ID NO: 8773734 - DNA, 22 bp, Homo sapiens
tgtaatataagcattaatagtt

SEQ ID NO: 8773735 - DNA, 22 bp, Homo sapiens
tgtaagtagtaatggaaggaca

SEQ ID NO: 8773736 - DNA, 22 bp, Homo sapiens
tgtaagtagtaatggaaggaca

SEQ ID NO: 8773737 - DNA, 21 bp, Homo sapiens
tgtaagtttcatctgaattgg

SEQ ID NO: 8773738 - DNA, 22 bp, Homo sapiens
cctggaaaacatgggaatcaca

SEQ ID NO: 8773739 - DNA, 22 bp, Homo sapiens
cctggaaaacatgggaatcaca

SEQ ID NO: 8773740 - DNA, 22 bp, Homo sapiens
cctgcttcagggatgatggcac

SEQ ID NO: 8773741 - DNA, 22 bp, Homo sapiens
cctgctttgctggtaccatcag

SEQ ID NO: 8773742 - DNA, 22 bp, Homo sapiens
cctgctgtgtccctggctttct

SEQ ID NO: 8773743 - DNA, 22 bp, Homo sapiens
cctgctgtgtgacgggatgtta

SEQ ID NO: 8773744 - DNA, 22 bp, Homo sapiens
tgtacagtggaaaatggattcg

SEQ ID NO: 8773745 - DNA, 22 bp, Homo sapiens
tgtacagtgtaaataagtggat

SEQ ID NO: 8773746 - DNA, 22 bp, Homo sapiens
tgtacagttttaactctgaggg

SEQ ID NO: 8773747 - DNA, 22 bp, Homo sapiens
tgtacatacatagatatacaca

SEQ ID NO: 8773748 - DNA, 22 bp, Homo sapiens
tgtacatacatagatatacaca

SEQ ID NO: 8773749 - DNA, 22 bp, Homo sapiens
tgtaattatttctgtgcagtca

SEQ ID NO: 8773750 - DNA, 22 bp, Homo sapiens
tgtaattaaactgaagacagaa

SEQ ID NO: 8773751 - DNA, 22 bp, Homo sapiens
tgtacatacatagatatacaca

SEQ ID NO: 8773752 - DNA, 22 bp, Homo sapiens
tgtacatacatagatatacaca

SEQ ID NO: 8773753 - DNA, 22 bp, Homo sapiens
tgtacatacatagatatacaca

SEQ ID NO: 8773754 - DNA, 22 bp, Homo sapiens
tgtacatacatagatatacaca

SEQ ID NO: 8773755 - DNA, 22 bp, Homo sapiens
tgtacatatatgtatgtacgca

SEQ ID NO: 8773756 - DNA, 22 bp, Homo sapiens
tgtacatagatcttgaaaatta

SEQ ID NO: 8773757 - DNA, 22 bp, Homo sapiens
cctggagcactctccctggctg

SEQ ID NO: 8773758 - DNA, 22 bp, Homo sapiens
tgtcaagatgacagatagatga

SEQ ID NO: 8773759 - DNA, 22 bp, Homo sapiens
tgtcaagagtagtttgaatagt

SEQ ID NO: 8773760 - DNA, 22 bp, Homo sapiens
tgtcaactgtgatgtcaacact

SEQ ID NO: 8773761 - DNA, 22 bp, Homo sapiens
tgtcaagagctgttgaggctga

SEQ ID NO: 8773762 - DNA, 22 bp, Homo sapiens
tgtcaagtctctgaatgaaatg

SEQ ID NO: 8773763 - DNA, 22 bp, Homo sapiens
tgtcaagtctctgaatgaaatg

SEQ ID NO: 8773764 - DNA, 22 bp, Homo sapiens
tgtcaagttgtggcatgtctaa

SEQ ID NO: 8773765 - DNA, 22 bp, Homo sapiens
tgtcaacacacctatctcaatt

SEQ ID NO: 8773766 - DNA, 22 bp, Homo sapiens
tgtcaacacacctatctcaatt

SEQ ID NO: 8773767 - DNA, 22 bp, Homo sapiens
tgtcaacacacctatctcaatt

SEQ ID NO: 8773768 - DNA, 22 bp, Homo sapiens
tgtcaacaccaaagcctcccag

SEQ ID NO: 8773769 - DNA, 22 bp, Homo sapiens
tgtcaacaggctttctaaggca

SEQ ID NO: 8773770 - DNA, 22 bp, Homo sapiens
tgtcaacagatctcaaagctgg

SEQ ID NO: 8773771 - DNA, 22 bp, Homo sapiens
tgtcaacatttatcaagttatt

SEQ ID NO: 8773772 - DNA, 22 bp, Homo sapiens
tgtcaacatttatcaagttatt

SEQ ID NO: 8773773 - DNA, 22 bp, Homo sapiens
tgtcaacatctgagccttcccc

SEQ ID NO: 8773774 - DNA, 22 bp, Homo sapiens
tgtcaactgcctctgaaggagt

SEQ ID NO: 8773775 - DNA, 22 bp, Homo sapiens
tgtcaacaacagcattttctat

SEQ ID NO: 8773776 - DNA, 22 bp, Homo sapiens
tgtcaacaaaacggttcaaatg

SEQ ID NO: 8773777 - DNA, 22 bp, Homo sapiens
tgtcaacaaaacggttcaaatg

SEQ ID NO: 8773778 - DNA, 22 bp, Homo sapiens
tgtcaacaaaacggttcaaatg

SEQ ID NO: 8773779 - DNA, 22 bp, Homo sapiens
tgtattccaaaatgctgaggat

SEQ ID NO: 8773780 - DNA, 22 bp, Homo sapiens
tgtattctctcaatatttcata

SEQ ID NO: 8773781 - DNA, 22 bp, Homo sapiens
tgtattccaaaatgctgaggat

SEQ ID NO: 8773782 - DNA, 18 bp, Homo sapiens
cctggaggtcttcggggt

SEQ ID NO: 8773783 - DNA, 18 bp, Homo sapiens
cctggaggtcttcggggt

SEQ ID NO: 8773784 - DNA, 16 bp, Homo sapiens
cctggaggtcacttca

SEQ ID NO: 8773785 - DNA, 16 bp, Homo sapiens
cctggaggtcacttca

SEQ ID NO: 8773786 - DNA, 22 bp, Homo sapiens
cctggaggggaccaggaccagg

SEQ ID NO: 8773787 - DNA, 22 bp, Homo sapiens
cctggaggggaccaggaccagg

SEQ ID NO: 8773788 - DNA, 22 bp, Homo sapiens
cctggagggcgccgcacagtcc

SEQ ID NO: 8773789 - DNA, 22 bp, Homo sapiens
cctggaggcagaaataggactt

SEQ ID NO: 8773790 - DNA, 22 bp, Homo sapiens
cctggaggcagaaataggactt

SEQ ID NO: 8773791 - DNA, 22 bp, Homo sapiens
cctggaggctctgggagggcag

SEQ ID NO: 8773792 - DNA, 22 bp, Homo sapiens
cctggaggctctgggagggcag

SEQ ID NO: 8773793 - DNA, 22 bp, Homo sapiens
cctggaggctctgggagggcag

SEQ ID NO: 8773794 - DNA, 22 bp, Homo sapiens
cctggaggctctgggagggcag

SEQ ID NO: 8773795 - DNA, 22 bp, Homo sapiens
cctggaggcggaggttgcagtg

SEQ ID NO: 8773796 - DNA, 22 bp, Homo sapiens
cctggaggctctgggagggcag

SEQ ID NO: 8773797 - DNA, 22 bp, Homo sapiens
cctggagggaccctggccctgt

SEQ ID NO: 8773798 - DNA, 22 bp, Homo sapiens
cctggagggcagcccattctgg

SEQ ID NO: 8773799 - DNA, 22 bp, Homo sapiens
cctggagggcgccgcacagtcc

SEQ ID NO: 8773800 - DNA, 22 bp, Homo sapiens
cctggagggcgccgcacagtcc

SEQ ID NO: 8773801 - DNA, 22 bp, Homo sapiens
cctggagggaccctggccctgt

SEQ ID NO: 8773802 - DNA, 22 bp, Homo sapiens
cctggagggaccctggccctgt

SEQ ID NO: 8773803 - DNA, 18 bp, Homo sapiens
cctggagctccacagcaa

SEQ ID NO: 8773804 - DNA, 18 bp, Homo sapiens
cctggagctccacagcaa

SEQ ID NO: 8773805 - DNA, 22 bp, Homo sapiens
cctggagcttttccagttgaca

SEQ ID NO: 8773806 - DNA, 22 bp, Homo sapiens
cctggagcttggtcacgctgcg

SEQ ID NO: 8773807 - DNA, 22 bp, Homo sapiens
cctggagcttggtcacgctgcg

SEQ ID NO: 8773808 - DNA, 22 bp, Homo sapiens
cctggagcttttccatcctgga

SEQ ID NO: 8773809 - DNA, 22 bp, Homo sapiens
cctggagcttttccatcctgga

SEQ ID NO: 8773810 - DNA, 22 bp, Homo sapiens
cctggaggagcgctgaccagct

SEQ ID NO: 8773811 - DNA, 22 bp, Homo sapiens
cctggaggagcgctgaccagct

SEQ ID NO: 8773812 - DNA, 22 bp, Homo sapiens
cctggaggagcgctgaccagct

SEQ ID NO: 8773813 - DNA, 22 bp, Homo sapiens
tggtctggggaccgagggttac

SEQ ID NO: 8773814 - DNA, 22 bp, Homo sapiens
tggtctgggcaaatccttctga

SEQ ID NO: 8773815 - DNA, 22 bp, Homo sapiens
tggtctgctgaacagccgtatc

SEQ ID NO: 8773816 - DNA, 20 bp, Homo sapiens
tggtctggagccagtgagga

SEQ ID NO: 8773817 - DNA, 22 bp, Homo sapiens
tggtctgcctggatcacagccc

SEQ ID NO: 8773818 - DNA, 22 bp, Homo sapiens
tggtctgctgaacagccgtatc

SEQ ID NO: 8773819 - DNA, 17 bp, Homo sapiens
tggtctggaagaactga

SEQ ID NO: 8773820 - DNA, 17 bp, Homo sapiens
tggtctggaagaactga

SEQ ID NO: 8773821 - DNA, 22 bp, Homo sapiens
cctgctgctatgaaggtgacag

SEQ ID NO: 8773822 - DNA, 22 bp, Homo sapiens
cctgctgctatgaaggtgacag

SEQ ID NO: 8773823 - DNA, 22 bp, Homo sapiens
cctgctctaaatctcatggaac

SEQ ID NO: 8773824 - DNA, 22 bp, Homo sapiens
tggtcttagctggaaggaggga

SEQ ID NO: 8773825 - DNA, 22 bp, Homo sapiens
cctgctcggggtgcagtgggct

SEQ ID NO: 8773826 - DNA, 22 bp, Homo sapiens
tggtctgttcaaggtggctgat

SEQ ID NO: 8773827 - DNA, 22 bp, Homo sapiens
cctgctggacctcaacacattt

SEQ ID NO: 8773828 - DNA, 22 bp, Homo sapiens
tggtctgcatttattcaagact

SEQ ID NO: 8773829 - DNA, 22 bp, Homo sapiens
tggtctgcagacatgtgggtgt

SEQ ID NO: 8773830 - DNA, 22 bp, Homo sapiens
tggtctgcagacatgtgggtgt

SEQ ID NO: 8773831 - DNA, 22 bp, Homo sapiens
tggtctgcctggatcacagccc

SEQ ID NO: 8773832 - DNA, 22 bp, Homo sapiens
tggtctgatggtcccaccaccg

SEQ ID NO: 8773833 - DNA, 22 bp, Homo sapiens
tggtctgaggaacaccagcact

SEQ ID NO: 8773834 - DNA, 22 bp, Homo sapiens
cctgccttcccagcttggcttt

SEQ ID NO: 8773835 - DNA, 22 bp, Homo sapiens
cctgccttccagccttgggctc

SEQ ID NO: 8773836 - DNA, 22 bp, Homo sapiens
cctgccttccagccttgggctc

SEQ ID NO: 8773837 - DNA, 22 bp, Homo sapiens
cctgccttcagccctgaagtct

SEQ ID NO: 8773838 - DNA, 22 bp, Homo sapiens
tggtctcttcttccaagatggc

SEQ ID NO: 8773839 - DNA, 22 bp, Homo sapiens
cctgctgtcccctgagcctgga

SEQ ID NO: 8773840 - DNA, 22 bp, Homo sapiens
cctgctgtccctctgggctcca

SEQ ID NO: 8773841 - DNA, 22 bp, Homo sapiens
cctgctgtagggcccctggggc

SEQ ID NO: 8773842 - DNA, 22 bp, Homo sapiens
cctgctgggcctgagcaatgag

SEQ ID NO: 8773843 - DNA, 22 bp, Homo sapiens
cctgctggtttttacaaagatg

SEQ ID NO: 8773844 - DNA, 22 bp, Homo sapiens
cctgctgtgaagccaggcctgt

SEQ ID NO: 8773845 - DNA, 22 bp, Homo sapiens
cctgctgtgaccggggagcagg

SEQ ID NO: 8773846 - DNA, 22 bp, Homo sapiens
cctgctgggacgtgtggttgcc

SEQ ID NO: 8773847 - DNA, 20 bp, Homo sapiens
cctgctgggaaccctctgaa

SEQ ID NO: 8773848 - DNA, 20 bp, Homo sapiens
cctgctgggaaccctctgaa

SEQ ID NO: 8773849 - DNA, 20 bp, Homo sapiens
cctgctgggaaccctctgaa

SEQ ID NO: 8773850 - DNA, 22 bp, Homo sapiens
cctgctggcgtggctggcgccc

SEQ ID NO: 8773851 - DNA, 22 bp, Homo sapiens
cctgctggctggtagagttccg

SEQ ID NO: 8773852 - DNA, 22 bp, Homo sapiens
cctgctggcggggacccagtga

SEQ ID NO: 8773853 - DNA, 22 bp, Homo sapiens
cctgctggccagtggagggctg

SEQ ID NO: 8773854 - DNA, 22 bp, Homo sapiens
cctgctggacgtggaggagggg

SEQ ID NO: 8773855 - DNA, 22 bp, Homo sapiens
cctgctggcggggacccagtga

SEQ ID NO: 8773856 - DNA, 22 bp, Homo sapiens
cctgctggccactgctccacct

SEQ ID NO: 8773857 - DNA, 22 bp, Homo sapiens
cctgctggccactgctccacct

SEQ ID NO: 8773858 - DNA, 22 bp, Homo sapiens
cctgctggacgtggaggagggg

SEQ ID NO: 8773859 - DNA, 22 bp, Homo sapiens
tgggtcagagctgtgctgccca

SEQ ID NO: 8773860 - DNA, 22 bp, Homo sapiens
tgggtcagaggacctcgtggcc

SEQ ID NO: 8773861 - DNA, 23 bp, Homo sapiens
tgggtcactgtttcaccattgct

SEQ ID NO: 8773862 - DNA, 22 bp, Homo sapiens
tgggtcactctatcctgcttag

SEQ ID NO: 8773863 - DNA, 22 bp, Homo sapiens
tgggtcacaaaggccagatgat

SEQ ID NO: 8773864 - DNA, 18 bp, Homo sapiens
cctgccagtctggagcag

SEQ ID NO: 8773865 - DNA, 22 bp, Homo sapiens
tgggtaggggacgtggaagaaa

SEQ ID NO: 8773866 - DNA, 22 bp, Homo sapiens
cctgccaggcgagtctaggcca

SEQ ID NO: 8773867 - DNA, 22 bp, Homo sapiens
cctgccaggcgagtctaggcca

SEQ ID NO: 8773868 - DNA, 22 bp, Homo sapiens
cctgccaggctttcaggtttgg

SEQ ID NO: 8773869 - DNA, 22 bp, Homo sapiens
cctgccagggccagaggccagc

SEQ ID NO: 8773870 - DNA, 22 bp, Homo sapiens
cctgccagtcactatgtcacct

SEQ ID NO: 8773871 - DNA, 18 bp, Homo sapiens
cctgccagtctggagcag

SEQ ID NO: 8773872 - DNA, 22 bp, Homo sapiens
cctgccagtcactatgtcacct

SEQ ID NO: 8773873 - DNA, 22 bp, Homo sapiens
cctgccagtcactatgtcacct

SEQ ID NO: 8773874 - DNA, 22 bp, Homo sapiens
cctgccagggccttggaagaaa

SEQ ID NO: 8773875 - DNA, 22 bp, Homo sapiens
cctgccagggccagaggccagc

SEQ ID NO: 8773876 - DNA, 22 bp, Homo sapiens
cctgccagggccagaggccagc

SEQ ID NO: 8773877 - DNA, 22 bp, Homo sapiens
cctgccagggccagaggccagc

SEQ ID NO: 8773878 - DNA, 22 bp, Homo sapiens
cctgccagggccagaggccagc

SEQ ID NO: 8773879 - DNA, 22 bp, Homo sapiens
cctgcctggtgtaagtctaagg

SEQ ID NO: 8773880 - DNA, 22 bp, Homo sapiens
cctgcctgggttcaaatcccag

SEQ ID NO: 8773881 - DNA, 22 bp, Homo sapiens
cctgcctggggacaaaggaggg

SEQ ID NO: 8773882 - DNA, 22 bp, Homo sapiens
cctgcctgggctcacttgccag

SEQ ID NO: 8773883 - DNA, 22 bp, Homo sapiens
cctgcctgggctcacttgccag

SEQ ID NO: 8773884 - DNA, 20 bp, Homo sapiens
cctgcctgcctcggctcatt

SEQ ID NO: 8773885 - DNA, 20 bp, Homo sapiens
cctgcctgcctcggctcatt

SEQ ID NO: 8773886 - DNA, 22 bp, Homo sapiens
cctgcctgcctgctggccggga

SEQ ID NO: 8773887 - DNA, 22 bp, Homo sapiens
cctgcctggcttccagaagaga

SEQ ID NO: 8773888 - DNA, 22 bp, Homo sapiens
cctgcctgcctgctggccggga

SEQ ID NO: 8773889 - DNA, 22 bp, Homo sapiens
cctgcctgggctcacttgccag

SEQ ID NO: 8773890 - DNA, 20 bp, Homo sapiens
cctgcctgcctcggctcatt

SEQ ID NO: 8773891 - DNA, 22 bp, Homo sapiens
tgggtcagattgagcccctggt

SEQ ID NO: 8773892 - DNA, 23 bp, Homo sapiens
tgggtcagctgcctccaggacaa

SEQ ID NO: 8773893 - DNA, 22 bp, Homo sapiens
cctgcctgtaagatgggtacaa

SEQ ID NO: 8773894 - DNA, 22 bp, Homo sapiens
cctgcctggtgtaagtctaagg

SEQ ID NO: 8773895 - DNA, 22 bp, Homo sapiens
cctgcctgtaagatgggtacaa

SEQ ID NO: 8773896 - DNA, 22 bp, Homo sapiens
cctgcctgtactagagacccag

SEQ ID NO: 8773897 - DNA, 22 bp, Homo sapiens
cctgcctgtcatcgcctgcgcc

SEQ ID NO: 8773898 - DNA, 22 bp, Homo sapiens
cctgcctgtcatcgcctgcgcc

SEQ ID NO: 8773899 - DNA, 22 bp, Homo sapiens
cctgcctgtccctcagtccaca

SEQ ID NO: 8773900 - DNA, 22 bp, Homo sapiens
cctgcctgtcatcgcctgcgcc

SEQ ID NO: 8773901 - DNA, 22 bp, Homo sapiens
cctgcctgtactagagacccag

SEQ ID NO: 8773902 - DNA, 22 bp, Homo sapiens
cctgcctgtactagagacccag

SEQ ID NO: 8773903 - DNA, 22 bp, Homo sapiens
cctgcctgtcatcgcctgcgcc

SEQ ID NO: 8773904 - DNA, 20 bp, Homo sapiens
cctgcctgtgtttgtgatga

SEQ ID NO: 8773905 - DNA, 20 bp, Homo sapiens
cctgcctgtgtttgtgatga

SEQ ID NO: 8773906 - DNA, 20 bp, Homo sapiens
cctgcctgtgtttgtgatga

SEQ ID NO: 8773907 - DNA, 22 bp, Homo sapiens
cctgcctgtctttatcccctgt

SEQ ID NO: 8773908 - DNA, 23 bp, Homo sapiens
cctgcctgttctaactccatttc

SEQ ID NO: 8773909 - DNA, 23 bp, Homo sapiens
cctgcctgttctaactccatttc

SEQ ID NO: 8773910 - DNA, 23 bp, Homo sapiens
cctgcctgttctaactccatttc

SEQ ID NO: 8773911 - DNA, 22 bp, Homo sapiens
cctgcctgtctttatcccctgt

SEQ ID NO: 8773912 - DNA, 22 bp, Homo sapiens
cctgcctgtctttatcccctgt

SEQ ID NO: 8773913 - DNA, 22 bp, Homo sapiens
cctgcctgtccctcagtccaca

SEQ ID NO: 8773914 - DNA, 22 bp, Homo sapiens
cctgcctgtccctcagtccaca

SEQ ID NO: 8773915 - DNA, 22 bp, Homo sapiens
cctgcctgtctttatcccctgt

SEQ ID NO: 8773916 - DNA, 21 bp, Homo sapiens
tgggagagcgttgctgtcctc

SEQ ID NO: 8773917 - DNA, 21 bp, Homo sapiens
tgggagagcgttgctgtcctc

SEQ ID NO: 8773918 - DNA, 22 bp, Homo sapiens
tggctctgaccaggtagaggag

SEQ ID NO: 8773919 - DNA, 22 bp, Homo sapiens
tgggagcaggaagcaggaagta

SEQ ID NO: 8773920 - DNA, 22 bp, Homo sapiens
tgggagcaggctgatgataggt

SEQ ID NO: 8773921 - DNA, 21 bp, Homo sapiens
tggctctgaaagagtgctgca

SEQ ID NO: 8773922 - DNA, 21 bp, Homo sapiens
tggctctgaaagagtgctgca

SEQ ID NO: 8773923 - DNA, 21 bp, Homo sapiens
tggctctgaaagagtgctgca

SEQ ID NO: 8773924 - DNA, 21 bp, Homo sapiens
tggctctgaaagagtgctgca

SEQ ID NO: 8773925 - DNA, 21 bp, Homo sapiens
tggctctgaaagagtgctgca

SEQ ID NO: 8773926 - DNA, 21 bp, Homo sapiens
tggctctgaaagagtgctgca

SEQ ID NO: 8773927 - DNA, 22 bp, Homo sapiens
tggctctcttgtaaggtagtag

SEQ ID NO: 8773928 - DNA, 20 bp, Homo sapiens
tggctctctctagtaagtgg

SEQ ID NO: 8773929 - DNA, 22 bp, Homo sapiens
cctccctgccggctggactagt

SEQ ID NO: 8773930 - DNA, 22 bp, Homo sapiens
cctccctctttcagtcccacag

SEQ ID NO: 8773931 - DNA, 22 bp, Homo sapiens
cctccctgcgctcctgcggcgg

SEQ ID NO: 8773932 - DNA, 22 bp, Homo sapiens
cctccctgcgctcctgcggcgg

SEQ ID NO: 8773933 - DNA, 22 bp, Homo sapiens
tggctctcagctcccagcagcc

SEQ ID NO: 8773934 - DNA, 22 bp, Homo sapiens
tggctctccagctctaaggcct

SEQ ID NO: 8773935 - DNA, 23 bp, Homo sapiens
tggctctctcagtgctgcagagg

SEQ ID NO: 8773936 - DNA, 23 bp, Homo sapiens
tggctctctcagtgctgcagagg

SEQ ID NO: 8773937 - DNA, 22 bp, Homo sapiens
cctctggcatagcaagtggcct

SEQ ID NO: 8773938 - DNA, 22 bp, Homo sapiens
cctctggcatagcaagtggcct

SEQ ID NO: 8773939 - DNA, 22 bp, Homo sapiens
cctctggcatagcaagtggcct

SEQ ID NO: 8773940 - DNA, 22 bp, Homo sapiens
cctctggcagccagccagttgt

SEQ ID NO: 8773941 - DNA, 16 bp, Homo sapiens
cctctggcaattagat

SEQ ID NO: 8773942 - DNA, 22 bp, Homo sapiens
cctctggcaacttcacagccca

SEQ ID NO: 8773943 - DNA, 22 bp, Homo sapiens
cctctggcaagtgatttatcat

SEQ ID NO: 8773944 - DNA, 23 bp, Homo sapiens
tgggagctcaagggaggctgccc

SEQ ID NO: 8773945 - DNA, 23 bp, Homo sapiens
tgggagctcaagggaggctgccc

SEQ ID NO: 8773946 - DNA, 22 bp, Homo sapiens
cctctggatctttctccacact

SEQ ID NO: 8773947 - DNA, 22 bp, Homo sapiens
cctctggcaacttcacagccca

SEQ ID NO: 8773948 - DNA, 22 bp, Homo sapiens
tgggagcagttgtgaagctcag

SEQ ID NO: 8773949 - DNA, 22 bp, Homo sapiens
tgggagcagttgtgaagctcag

SEQ ID NO: 8773950 - DNA, 22 bp, Homo sapiens
tgggagcaggtgtgctagggaa

SEQ ID NO: 8773951 - DNA, 22 bp, Homo sapiens
tgggagcaggtgtgctagggaa

SEQ ID NO: 8773952 - DNA, 22 bp, Homo sapiens
tgggagcaggtgtgctagggaa

SEQ ID NO: 8773953 - DNA, 22 bp, Homo sapiens
tgggagcagttcaggtgtggct

SEQ ID NO: 8773954 - DNA, 22 bp, Homo sapiens
tgggagcagttcaggtgtggct

SEQ ID NO: 8773955 - DNA, 22 bp, Homo sapiens
tgggagcctggcaggccagagg

SEQ ID NO: 8773956 - DNA, 22 bp, Homo sapiens
tgggagcccaagggagctgccg

SEQ ID NO: 8773957 - DNA, 23 bp, Homo sapiens
tgggagctcaagggaggctgccc

SEQ ID NO: 8773958 - DNA, 22 bp, Homo sapiens
cctcttctgagtgagactccct

SEQ ID NO: 8773959 - DNA, 22 bp, Homo sapiens
cctcttctgagtgagactccct

SEQ ID NO: 8773960 - DNA, 22 bp, Homo sapiens
tgggccagcaattgctgctcag

SEQ ID NO: 8773961 - DNA, 22 bp, Homo sapiens
cctcttctgcttcaggagcact

SEQ ID NO: 8773962 - DNA, 22 bp, Homo sapiens
cctcttgaacctaggcaagact

SEQ ID NO: 8773963 - DNA, 20 bp, Homo sapiens
cctcttgcaaaagagatgac

SEQ ID NO: 8773964 - DNA, 22 bp, Homo sapiens
cctctttgacaagtacctgccc

SEQ ID NO: 8773965 - DNA, 22 bp, Homo sapiens
cctctttgactatagtagttaa

SEQ ID NO: 8773966 - DNA, 22 bp, Homo sapiens
cctcttgccaatcagctacaga

SEQ ID NO: 8773967 - DNA, 22 bp, Homo sapiens
cctctttgagattcagttttcc

SEQ ID NO: 8773968 - DNA, 22 bp, Homo sapiens
cctctttgactctcaggtcttt

SEQ ID NO: 8773969 - DNA, 22 bp, Homo sapiens
cctgaaaatatcctctcctttg

SEQ ID NO: 8773970 - DNA, 22 bp, Homo sapiens
cctctttgttcaggctgctggc

SEQ ID NO: 8773971 - DNA, 22 bp, Homo sapiens
cctctttgtgcctgcaggctgc

SEQ ID NO: 8773972 - DNA, 22 bp, Homo sapiens
cctctttgtgcctgcaggctgc

SEQ ID NO: 8773973 - DNA, 22 bp, Homo sapiens
cctgaaaatatcctctcctttg

SEQ ID NO: 8773974 - DNA, 22 bp, Homo sapiens
cctgaagcaagggtaggcaggt

SEQ ID NO: 8773975 - DNA, 22 bp, Homo sapiens
cctgaagcacaaaagcacagct

SEQ ID NO: 8773976 - DNA, 22 bp, Homo sapiens
cctgaagcacccggagctggca

SEQ ID NO: 8773977 - DNA, 18 bp, Homo sapiens
cctgaagcctgtgtcttt

SEQ ID NO: 8773978 - DNA, 22 bp, Homo sapiens
cctgaagcacccggagctggca

SEQ ID NO: 8773979 - DNA, 18 bp, Homo sapiens
cctgaagcctgtgtcttt

SEQ ID NO: 8773980 - DNA, 22 bp, Homo sapiens
cctgaagctcttaagaccttta

SEQ ID NO: 8773981 - DNA, 22 bp, Homo sapiens
cctgaaggaaactggaaataca

SEQ ID NO: 8773982 - DNA, 22 bp, Homo sapiens
cctgaagggactccagagagca

SEQ ID NO: 8773983 - DNA, 22 bp, Homo sapiens
tgggccagaggcatggagctat

SEQ ID NO: 8773984 - DNA, 22 bp, Homo sapiens
tgggccagaggcatggagctat

SEQ ID NO: 8773985 - DNA, 22 bp, Homo sapiens
tgggccactaccttctctggat

SEQ ID NO: 8773986 - DNA, 22 bp, Homo sapiens
tgggccagatccatggcaataa

SEQ ID NO: 8773987 - DNA, 22 bp, Homo sapiens
tgggccagaggcatggagctat

SEQ ID NO: 8773988 - DNA, 21 bp, Homo sapiens
tgggccagatctgagtttcta

SEQ ID NO: 8773989 - DNA, 21 bp, Homo sapiens
tgggccagatctgagtttcta

SEQ ID NO: 8773990 - DNA, 22 bp, Homo sapiens
cctctggccattctttgatgga

SEQ ID NO: 8773991 - DNA, 22 bp, Homo sapiens
cctctggccattctttgatgga

SEQ ID NO: 8773992 - DNA, 22 bp, Homo sapiens
cctctggcctaggccgggagag

SEQ ID NO: 8773993 - DNA, 22 bp, Homo sapiens
cctctggcctaggccgggagag

SEQ ID NO: 8773994 - DNA, 22 bp, Homo sapiens
cctctggccacatgggacatag

SEQ ID NO: 8773995 - DNA, 22 bp, Homo sapiens
cctctggccacatgggacatag

SEQ ID NO: 8773996 - DNA, 22 bp, Homo sapiens
cctctggccatcccccattaag

SEQ ID NO: 8773997 - DNA, 22 bp, Homo sapiens
cctctggccagagaaaggccag

SEQ ID NO: 8773998 - DNA, 22 bp, Homo sapiens
tgggcagggagctggaaccaca

SEQ ID NO: 8773999 - DNA, 22 bp, Homo sapiens
cctctggcctaggccgggagag

SEQ ID NO: 8774000 - DNA, 22 bp, Homo sapiens
tgggccactaccttctctggat

SEQ ID NO: 8774001 - DNA, 22 bp, Homo sapiens
tgggccactgctccaagtagct

SEQ ID NO: 8774002 - DNA, 22 bp, Homo sapiens
tgggccactgctgcggaaggcg

SEQ ID NO: 8774003 - DNA, 22 bp, Homo sapiens
tgggccactgctgcggaaggcg

SEQ ID NO: 8774004 - DNA, 22 bp, Homo sapiens
tgggccactcttccctgggtct

SEQ ID NO: 8774005 - DNA, 23 bp, Homo sapiens
tgggccactatagaaatctctca

SEQ ID NO: 8774006 - DNA, 23 bp, Homo sapiens
tgggccactatagaaatctctca

SEQ ID NO: 8774007 - DNA, 22 bp, Homo sapiens
cctgattgtctcttgcagcact

SEQ ID NO: 8774008 - DNA, 23 bp, Homo sapiens
cctgcaaagaaacaagccacctg

SEQ ID NO: 8774009 - DNA, 22 bp, Homo sapiens
cctgcaagactatttagttcca

SEQ ID NO: 8774010 - DNA, 22 bp, Homo sapiens
cctgcaagacctgagacacacc

SEQ ID NO: 8774011 - DNA, 22 bp, Homo sapiens
cctgcacagaccaaagaggaca

SEQ ID NO: 8774012 - DNA, 22 bp, Homo sapiens
cctgcaagactatttagttcca

SEQ ID NO: 8774013 - DNA, 22 bp, Homo sapiens
cctgcaagacctgagacacacc

SEQ ID NO: 8774014 - DNA, 22 bp, Homo sapiens
cctgcacatgtgtgcgcctgta

SEQ ID NO: 8774015 - DNA, 22 bp, Homo sapiens
cctgatgtccataatcctgtaa

SEQ ID NO: 8774016 - DNA, 22 bp, Homo sapiens
cctgattattgtaaatatattt

SEQ ID NO: 8774017 - DNA, 22 bp, Homo sapiens
cctgattagggtctttcaaatg

SEQ ID NO: 8774018 - DNA, 22 bp, Homo sapiens
tggggtcctctcacttggaggg

SEQ ID NO: 8774019 - DNA, 22 bp, Homo sapiens
tggggtcctctcacttggaggg

SEQ ID NO: 8774020 - DNA, 17 bp, Homo sapiens
tggggtccccgatggtg

SEQ ID NO: 8774021 - DNA, 20 bp, Homo sapiens
tggggtcctggaggggatcc

SEQ ID NO: 8774022 - DNA, 22 bp, Homo sapiens
cctgccaggagctggtgctgca

SEQ ID NO: 8774023 - DNA, 22 bp, Homo sapiens
cctgccaggagctggtgctgca

SEQ ID NO: 8774024 - DNA, 22 bp, Homo sapiens
cctgccaggagctggtgctgca

SEQ ID NO: 8774025 - DNA, 22 bp, Homo sapiens
cctgccagacgcaccagggggc

SEQ ID NO: 8774026 - DNA, 22 bp, Homo sapiens
cctgcagaagagtccagctcat

SEQ ID NO: 8774027 - DNA, 22 bp, Homo sapiens
cctgcacttctcacagctgctg

SEQ ID NO: 8774028 - DNA, 22 bp, Homo sapiens
cctgcacctgccatgtgagata

SEQ ID NO: 8774029 - DNA, 22 bp, Homo sapiens
tgggggtgtcctggtgcacaca

SEQ ID NO: 8774030 - DNA, 22 bp, Homo sapiens
tgggggtgtcctggtgcacaca

SEQ ID NO: 8774031 - DNA, 22 bp, Homo sapiens
cctgagggctcagcccccagcc

SEQ ID NO: 8774032 - DNA, 22 bp, Homo sapiens
cctgaggtcagccattcttgcc

SEQ ID NO: 8774033 - DNA, 21 bp, Homo sapiens
cctgagggtggttgtgaagat

SEQ ID NO: 8774034 - DNA, 22 bp, Homo sapiens
cctgagggtcaaggagccctag

SEQ ID NO: 8774035 - DNA, 22 bp, Homo sapiens
tgggggtgtgccagggacctcc

SEQ ID NO: 8774036 - DNA, 22 bp, Homo sapiens
tgggggtgtcctggtgcacaca

SEQ ID NO: 8774037 - DNA, 19 bp, Homo sapiens
tggggtcaagagaggcttc

SEQ ID NO: 8774038 - DNA, 22 bp, Homo sapiens
tggggtccagtgccaccccaag

SEQ ID NO: 8774039 - DNA, 19 bp, Homo sapiens
tggggtcaagagaggcttc

SEQ ID NO: 8774040 - DNA, 17 bp, Homo sapiens
tggggtccccgatggtg

SEQ ID NO: 8774041 - DNA, 22 bp, Homo sapiens
tggggtccagtgcctggcaagg

SEQ ID NO: 8774042 - DNA, 22 bp, Homo sapiens
cctgacaggcggaggctgcagt

SEQ ID NO: 8774043 - DNA, 22 bp, Homo sapiens
cctgacaggcggaggctgcagt

SEQ ID NO: 8774044 - DNA, 22 bp, Homo sapiens
cctgacaaggctaacaaaaggc

SEQ ID NO: 8774045 - DNA, 23 bp, Homo sapiens
cctgacacaaaaggattcttgct

SEQ ID NO: 8774046 - DNA, 22 bp, Homo sapiens
cctgacactgccgccaccccgc

SEQ ID NO: 8774047 - DNA, 23 bp, Homo sapiens
cctgacacaaaaggattcttgct

SEQ ID NO: 8774048 - DNA, 19 bp, Homo sapiens
cctgaccacacaggccttg

SEQ ID NO: 8774049 - DNA, 23 bp, Homo sapiens
cctgaccctgtctccctcacatg

SEQ ID NO: 8774050 - DNA, 22 bp, Homo sapiens
cctgaccctccttagagtccag

SEQ ID NO: 8774051 - DNA, 23 bp, Homo sapiens
cctgaccctgtctccctcacatg

SEQ ID NO: 8774052 - DNA, 22 bp, Homo sapiens
cctgagaaatagcatcattttt

SEQ ID NO: 8774053 - DNA, 22 bp, Homo sapiens
cctgagaataattctccatagc

SEQ ID NO: 8774054 - DNA, 22 bp, Homo sapiens
cctgagaagagcttatgagtga

SEQ ID NO: 8774055 - DNA, 22 bp, Homo sapiens
cctgagaagagcttatgagtga

SEQ ID NO: 8774056 - DNA, 22 bp, Homo sapiens
cctgagaatgtttaacagagaa

SEQ ID NO: 8774057 - DNA, 22 bp, Homo sapiens
cctgagaatgtttaacagagaa

SEQ ID NO: 8774058 - DNA, 22 bp, Homo sapiens
cctgacttaagtctcctgttgg

SEQ ID NO: 8774059 - DNA, 22 bp, Homo sapiens
cctgacctatttttctcagctg

SEQ ID NO: 8774060 - DNA, 22 bp, Homo sapiens
cctgacgaaaggcgtgctggag

SEQ ID NO: 8774061 - DNA, 22 bp, Homo sapiens
cctgaggcttgggagttccgcc

SEQ ID NO: 8774062 - DNA, 22 bp, Homo sapiens
cctgaggcttaatctgtcccaa

SEQ ID NO: 8774063 - DNA, 22 bp, Homo sapiens
cctgagggaacatgcacccaat

SEQ ID NO: 8774064 - DNA, 22 bp, Homo sapiens
cctgagggagggtataggctgt

SEQ ID NO: 8774065 - DNA, 22 bp, Homo sapiens
cctgagggagggtataggctgt

SEQ ID NO: 8774066 - DNA, 22 bp, Homo sapiens
cctgagggctcagcccccagcc

SEQ ID NO: 8774067 - DNA, 22 bp, Homo sapiens
cctgagggcgccgagctcccag

SEQ ID NO: 8774068 - DNA, 22 bp, Homo sapiens
cctgagggcgtaattaacagtg

SEQ ID NO: 8774069 - DNA, 22 bp, Homo sapiens
cctgaggggctgcaggccagct

SEQ ID NO: 8774070 - DNA, 22 bp, Homo sapiens
cctgagggctcagcccccagcc

SEQ ID NO: 8774071 - DNA, 22 bp, Homo sapiens
cctgaggggctgcaggccagct

SEQ ID NO: 8774072 - DNA, 22 bp, Homo sapiens
cctgaggggctgcaggccagct

SEQ ID NO: 8774073 - DNA, 22 bp, Homo sapiens
cctgaggggctgcaggccagct

SEQ ID NO: 8774074 - DNA, 22 bp, Homo sapiens
cctgaggggctgcaggccagct

SEQ ID NO: 8774075 - DNA, 22 bp, Homo sapiens
cctgagctggcagtgacctgga

SEQ ID NO: 8774076 - DNA, 22 bp, Homo sapiens
cctgagctggcagtgacctgga

SEQ ID NO: 8774077 - DNA, 22 bp, Homo sapiens
cctgaggccctggctgtgctga

SEQ ID NO: 8774078 - DNA, 22 bp, Homo sapiens
cctgaggctccacctccagaga

SEQ ID NO: 8774079 - DNA, 22 bp, Homo sapiens
cctgaggccctggctgtgctga

SEQ ID NO: 8774080 - DNA, 22 bp, Homo sapiens
cctgaggccctggctgtgctga

SEQ ID NO: 8774081 - DNA, 22 bp, Homo sapiens
cctgaggctggcccttccatcc

SEQ ID NO: 8774082 - DNA, 22 bp, Homo sapiens
cctgaggctctcctgaataatg

SEQ ID NO: 8774083 - DNA, 22 bp, Homo sapiens
cctgaggctggcccttccatcc

SEQ ID NO: 8774084 - DNA, 22 bp, Homo sapiens
cctgaggctcgcgcgcccctgg

SEQ ID NO: 8774085 - DNA, 22 bp, Homo sapiens
cctgaggctccacctccagaga

SEQ ID NO: 8774086 - DNA, 22 bp, Homo sapiens
cctgaggctccacctccagaga

SEQ ID NO: 8774087 - DNA, 22 bp, Homo sapiens
tggctcagcgcggcctggtctt

SEQ ID NO: 8774088 - DNA, 23 bp, Homo sapiens
tggctcagctagttttccatttc

SEQ ID NO: 8774089 - DNA, 23 bp, Homo sapiens
tggctcagctagttttccatttc

SEQ ID NO: 8774090 - DNA, 22 bp, Homo sapiens
cctccccatgacccggtgctgg

SEQ ID NO: 8774091 - DNA, 22 bp, Homo sapiens
cctccccatgacccggtgctgg

SEQ ID NO: 8774092 - DNA, 22 bp, Homo sapiens
cctccccatgacccggtgctgg

SEQ ID NO: 8774093 - DNA, 22 bp, Homo sapiens
cctcccctcagacagagactgg

SEQ ID NO: 8774094 - DNA, 22 bp, Homo sapiens
cctcccacttcttgctgaggtc

SEQ ID NO: 8774095 - DNA, 22 bp, Homo sapiens
cctcccaggcattgccattttc

SEQ ID NO: 8774096 - DNA, 22 bp, Homo sapiens
cctcccagatgtgcccaatgga

SEQ ID NO: 8774097 - DNA, 18 bp, Homo sapiens
cctccctcattttcccag

SEQ ID NO: 8774098 - DNA, 22 bp, Homo sapiens
cctccctcagaatgaagaaagg

SEQ ID NO: 8774099 - DNA, 22 bp, Homo sapiens
cctccctccattgccatcgtct

SEQ ID NO: 8774100 - DNA, 22 bp, Homo sapiens
cctccctcagaatgaagaaagg

SEQ ID NO: 8774101 - DNA, 18 bp, Homo sapiens
cctccctcattttcccag

SEQ ID NO: 8774102 - DNA, 22 bp, Homo sapiens
cctcccctgctcagaactctgg

SEQ ID NO: 8774103 - DNA, 23 bp, Homo sapiens
cctccccttcccacagctgggtg

SEQ ID NO: 8774104 - DNA, 23 bp, Homo sapiens
cctccccttcccacagctgggtg

SEQ ID NO: 8774105 - DNA, 19 bp, Homo sapiens
cctccccttggaccagcaa

SEQ ID NO: 8774106 - DNA, 19 bp, Homo sapiens
cctccccttggaccagcaa

SEQ ID NO: 8774107 - DNA, 23 bp, Homo sapiens
cctccccttcccacagctgggtg

SEQ ID NO: 8774108 - DNA, 22 bp, Homo sapiens
cctccctctgttagagctgtct

SEQ ID NO: 8774109 - DNA, 22 bp, Homo sapiens
cctccctctgttagagctgtct

SEQ ID NO: 8774110 - DNA, 22 bp, Homo sapiens
cctccctctttcagtcccacag

SEQ ID NO: 8774111 - DNA, 22 bp, Homo sapiens
cctccctctgttagagctgtct

SEQ ID NO: 8774112 - DNA, 22 bp, Homo sapiens
cctccctccctgcagaagccac

SEQ ID NO: 8774113 - DNA, 22 bp, Homo sapiens
cctccctccctgcagaagccac

SEQ ID NO: 8774114 - DNA, 22 bp, Homo sapiens
cctccctccctgcagaagccac

SEQ ID NO: 8774115 - DNA, 22 bp, Homo sapiens
cctccctccattgccatcgtct

SEQ ID NO: 8774116 - DNA, 22 bp, Homo sapiens
cctccctccctcttatggttta

SEQ ID NO: 8774117 - DNA, 22 bp, Homo sapiens
tggctagatttattgctgagca

SEQ ID NO: 8774118 - DNA, 22 bp, Homo sapiens
tggctagataactagaatttca

SEQ ID NO: 8774119 - DNA, 20 bp, Homo sapiens
tggctagcattaaaatgact

SEQ ID NO: 8774120 - DNA, 22 bp, Homo sapiens
tggctaggtagctttctgctgt

SEQ ID NO: 8774121 - DNA, 22 bp, Homo sapiens
tggctaggaatccatgactctc

SEQ ID NO: 8774122 - DNA, 22 bp, Homo sapiens
tggctaggactcatcctgtttc

SEQ ID NO: 8774123 - DNA, 22 bp, Homo sapiens
tggctcagcctggccctttcat

SEQ ID NO: 8774124 - DNA, 22 bp, Homo sapiens
tggctcagcctggccctttcat

SEQ ID NO: 8774125 - DNA, 22 bp, Homo sapiens
tggctcagcgcggcctggtctt

SEQ ID NO: 8774126 - DNA, 22 bp, Homo sapiens
tggctcagccagccctaggaac

SEQ ID NO: 8774127 - DNA, 22 bp, Homo sapiens
tggctacatcacagagaattcc

SEQ ID NO: 8774128 - DNA, 22 bp, Homo sapiens
tggctacagtggcatatcaaat

SEQ ID NO: 8774129 - DNA, 22 bp, Homo sapiens
tggctacagcttggccacagag

SEQ ID NO: 8774130 - DNA, 22 bp, Homo sapiens
tggctacagcaagaggaaagaa

SEQ ID NO: 8774131 - DNA, 22 bp, Homo sapiens
tggctacagacattcctaggga

SEQ ID NO: 8774132 - DNA, 22 bp, Homo sapiens
tggctagaccgcggagccaaga

SEQ ID NO: 8774133 - DNA, 22 bp, Homo sapiens
tggctagaattgggttcacagg

SEQ ID NO: 8774134 - DNA, 23 bp, Homo sapiens
tggctagacaaatcatccaaggg

SEQ ID NO: 8774135 - DNA, 22 bp, Homo sapiens
tggctacctgatttcttttcag

SEQ ID NO: 8774136 - DNA, 22 bp, Homo sapiens
tggctacatttgttgatcactt

SEQ ID NO: 8774137 - DNA, 22 bp, Homo sapiens
tggctacatttatactctcatt

SEQ ID NO: 8774138 - DNA, 22 bp, Homo sapiens
tggctacatttatactctcatt

SEQ ID NO: 8774139 - DNA, 22 bp, Homo sapiens
tggctaatcttaaggcttttgc

SEQ ID NO: 8774140 - DNA, 22 bp, Homo sapiens
tggctacaaggtggctattcta

SEQ ID NO: 8774141 - DNA, 22 bp, Homo sapiens
tggctacagaattggccctgtt

SEQ ID NO: 8774142 - DNA, 22 bp, Homo sapiens
tggcctggggacctgtgagacc

SEQ ID NO: 8774143 - DNA, 22 bp, Homo sapiens
tggctaacaaggtgaaaccccg

SEQ ID NO: 8774144 - DNA, 22 bp, Homo sapiens
tggctaagaattggcagctgct

SEQ ID NO: 8774145 - DNA, 22 bp, Homo sapiens
tggctaagatttaaatgtttgc

SEQ ID NO: 8774146 - DNA, 22 bp, Homo sapiens
tggctaagcatgctccagctgc

SEQ ID NO: 8774147 - DNA, 22 bp, Homo sapiens
tggctaagaattggcagctgct

SEQ ID NO: 8774148 - DNA, 22 bp, Homo sapiens
tggctaagaattggcagctgct

SEQ ID NO: 8774149 - DNA, 22 bp, Homo sapiens
tggctaagctggggaggcctgg

SEQ ID NO: 8774150 - DNA, 19 bp, Homo sapiens
tggctaaggccagcggaaa

SEQ ID NO: 8774151 - DNA, 22 bp, Homo sapiens
tggctaacaaggtgaaaccccg

SEQ ID NO: 8774152 - DNA, 22 bp, Homo sapiens
tggctaacaaggtgaaaccccg

SEQ ID NO: 8774153 - DNA, 22 bp, Homo sapiens
tggctaacaaggtgaaaccccg

SEQ ID NO: 8774154 - DNA, 22 bp, Homo sapiens
tggctaacaaggtgaaaccccg

SEQ ID NO: 8774155 - DNA, 22 bp, Homo sapiens
cctcagctgcttccctggagcc

SEQ ID NO: 8774156 - DNA, 22 bp, Homo sapiens
cctcagctgcttccctggagcc

SEQ ID NO: 8774157 - DNA, 22 bp, Homo sapiens
tggcctgggtcacaccagggtc

SEQ ID NO: 8774158 - DNA, 22 bp, Homo sapiens
cctcagctgtcttttccgaggt

SEQ ID NO: 8774159 - DNA, 22 bp, Homo sapiens
tggcctggggacctgtgagacc

SEQ ID NO: 8774160 - DNA, 22 bp, Homo sapiens
cctcagctcccatgagatctgc

SEQ ID NO: 8774161 - DNA, 22 bp, Homo sapiens
cctcagccttggccccaggcag

SEQ ID NO: 8774162 - DNA, 22 bp, Homo sapiens
cctcagctgcttccctggagcc

SEQ ID NO: 8774163 - DNA, 22 bp, Homo sapiens
cctcagcccctgaatggagaga

SEQ ID NO: 8774164 - DNA, 23 bp, Homo sapiens
cctcagcatggcaggagcccagc

SEQ ID NO: 8774165 - DNA, 22 bp, Homo sapiens
cctcagccttggccccaggcag

SEQ ID NO: 8774166 - DNA, 22 bp, Homo sapiens
cctcagcatcctggtgaagtag

SEQ ID NO: 8774167 - DNA, 22 bp, Homo sapiens
tggcctcggcatccagcaagag

SEQ ID NO: 8774168 - DNA, 22 bp, Homo sapiens
tggcctcctcgggctgaccctg

SEQ ID NO: 8774169 - DNA, 22 bp, Homo sapiens
tggcctcccctaacagcctctt

SEQ ID NO: 8774170 - DNA, 22 bp, Homo sapiens
tggcctcccctaacagcctctt

SEQ ID NO: 8774171 - DNA, 22 bp, Homo sapiens
tggcctcccctaacagcctctt

SEQ ID NO: 8774172 - DNA, 22 bp, Homo sapiens
tggcctcccctaacagcctctt

SEQ ID NO: 8774173 - DNA, 22 bp, Homo sapiens
tggcctcagattattgcacagt

SEQ ID NO: 8774174 - DNA, 22 bp, Homo sapiens
tggcctcaatctgtcctccagc

SEQ ID NO: 8774175 - DNA, 22 bp, Homo sapiens
tggcctcaccactagctgggtg

SEQ ID NO: 8774176 - DNA, 22 bp, Homo sapiens
tggcctcaaccgtcctaagcac

SEQ ID NO: 8774177 - DNA, 22 bp, Homo sapiens
tggccctgcttatgtctctctt

SEQ ID NO: 8774178 - DNA, 22 bp, Homo sapiens
tggcctcaaccgtcctaagcac

SEQ ID NO: 8774179 - DNA, 22 bp, Homo sapiens
cctcagaagaagtggaattgat

SEQ ID NO: 8774180 - DNA, 22 bp, Homo sapiens
cctcactctgcaccctgcagca

SEQ ID NO: 8774181 - DNA, 22 bp, Homo sapiens
cctcactctgcaccctgcagca

SEQ ID NO: 8774182 - DNA, 22 bp, Homo sapiens
cctcactcttgtcctggcaggt

SEQ ID NO: 8774183 - DNA, 22 bp, Homo sapiens
cctcactcttgtcctggcaggt

SEQ ID NO: 8774184 - DNA, 22 bp, Homo sapiens
cctcactcttgtcctggcaggt

SEQ ID NO: 8774185 - DNA, 22 bp, Homo sapiens
ccgggggcgggacgagcttgac

SEQ ID NO: 8774186 - DNA, 22 bp, Homo sapiens
ccgggctggagtgcaatggctc

SEQ ID NO: 8774187 - DNA, 18 bp, Homo sapiens
ccgggctttggtgacaca

SEQ ID NO: 8774188 - DNA, 22 bp, Homo sapiens
ccggtcccaggtgccccggtga

SEQ ID NO: 8774189 - DNA, 22 bp, Homo sapiens
ccggtcccaggtgccccggtga

SEQ ID NO: 8774190 - DNA, 22 bp, Homo sapiens
ccggtcccaggtgccccggtga

SEQ ID NO: 8774191 - DNA, 22 bp, Homo sapiens
ccgtggtcacctgagctccttg

SEQ ID NO: 8774192 - DNA, 22 bp, Homo sapiens
ccgtggtcacctgagctccttg

SEQ ID NO: 8774193 - DNA, 22 bp, Homo sapiens
ccgtggccttgatggctccggt

SEQ ID NO: 8774194 - DNA, 22 bp, Homo sapiens
ccgtctgcagcctccaggagtt

SEQ ID NO: 8774195 - DNA, 21 bp, Homo sapiens
ccgtgctcggctatggaccac

SEQ ID NO: 8774196 - DNA, 22 bp, Homo sapiens
ccgtgctcgggaaaggccagtg

SEQ ID NO: 8774197 - DNA, 22 bp, Homo sapiens
ccgtcccctctgaccttgctga

SEQ ID NO: 8774198 - DNA, 22 bp, Homo sapiens
ccgtcccctctgaccttgctga

SEQ ID NO: 8774199 - DNA, 22 bp, Homo sapiens
ccgtccccagccacctgctgat

SEQ ID NO: 8774200 - DNA, 22 bp, Homo sapiens
ccgtccccagccacctgctgat

SEQ ID NO: 8774201 - DNA, 22 bp, Homo sapiens
ccggctactcgggaggctgacg

SEQ ID NO: 8774202 - DNA, 22 bp, Homo sapiens
ccggctactcgggaggctgacg

SEQ ID NO: 8774203 - DNA, 22 bp, Homo sapiens
ccggctactcgggaggctgacg

SEQ ID NO: 8774204 - DNA, 22 bp, Homo sapiens
ccggctactcgggaggctgacg

SEQ ID NO: 8774205 - DNA, 22 bp, Homo sapiens
ccggctcggcgaccaggctgaa

SEQ ID NO: 8774206 - DNA, 22 bp, Homo sapiens
ccggctcggcgaccaggctgaa

SEQ ID NO: 8774207 - DNA, 22 bp, Homo sapiens
ccggctactcgggaggctgacg

SEQ ID NO: 8774208 - DNA, 22 bp, Homo sapiens
ccggctcggcgaccaggctgaa

SEQ ID NO: 8774209 - DNA, 22 bp, Homo sapiens
ccggctactcgggaggctgacg

SEQ ID NO: 8774210 - DNA, 22 bp, Homo sapiens
ccgggcctcgggacaccgggta

SEQ ID NO: 8774211 - DNA, 22 bp, Homo sapiens
ccgggccccacggtgacctcag

SEQ ID NO: 8774212 - DNA, 22 bp, Homo sapiens
ccgggagcaggcgccaccgcca

SEQ ID NO: 8774213 - DNA, 22 bp, Homo sapiens
ccgggagcaggcgccaccgcca

SEQ ID NO: 8774214 - DNA, 22 bp, Homo sapiens
ccgggcgggggctctcgtcacc

SEQ ID NO: 8774215 - DNA, 22 bp, Homo sapiens
ccgggctggagtgcaatggctc

SEQ ID NO: 8774216 - DNA, 22 bp, Homo sapiens
ccgggcctcgggacaccgggta

SEQ ID NO: 8774217 - DNA, 22 bp, Homo sapiens
ccgggcctcgggacaccgggta

SEQ ID NO: 8774218 - DNA, 22 bp, Homo sapiens
ccgggcctcgggacaccgggta

SEQ ID NO: 8774219 - DNA, 22 bp, Homo sapiens
ccgggcctcgggacaccgggta

SEQ ID NO: 8774220 - DNA, 22 bp, Homo sapiens
cctaaatagagtcagatgtaat

SEQ ID NO: 8774221 - DNA, 22 bp, Homo sapiens
ccgtgtgtatggtggaactgct

SEQ ID NO: 8774222 - DNA, 23 bp, Homo sapiens
ccgtgtgtatactctgtaataga

SEQ ID NO: 8774223 - DNA, 22 bp, Homo sapiens
cctaaagaattttcatagagct

SEQ ID NO: 8774224 - DNA, 19 bp, Homo sapiens
cctaaagtttgaaccctgg

SEQ ID NO: 8774225 - DNA, 22 bp, Homo sapiens
ccgtgtgtatggtggaactgct

SEQ ID NO: 8774226 - DNA, 22 bp, Homo sapiens
cctcaccctgaccactactttt

SEQ ID NO: 8774227 - DNA, 22 bp, Homo sapiens
cctcacccactacactcaaggg

SEQ ID NO: 8774228 - DNA, 22 bp, Homo sapiens
cctcacagtgttcgtgtcagat

SEQ ID NO: 8774229 - DNA, 20 bp, Homo sapiens
cctcacagggcagagagggg

SEQ ID NO: 8774230 - DNA, 17 bp, Homo sapiens
cctcacagggaccagac

SEQ ID NO: 8774231 - DNA, 17 bp, Homo sapiens
cctcacagggaccagac

SEQ ID NO: 8774232 - DNA, 22 bp, Homo sapiens
cctcacagggccaggcccctca

SEQ ID NO: 8774233 - DNA, 22 bp, Homo sapiens
cctcacagcttttcaaagtgga

SEQ ID NO: 8774234 - DNA, 22 bp, Homo sapiens
ccctgtcctgctaggccctggt

SEQ ID NO: 8774235 - DNA, 22 bp, Homo sapiens
ccctgtcctgctaggccctggt

SEQ ID NO: 8774236 - DNA, 23 bp, Homo sapiens
ccctgtagcccaggacaggcttt

SEQ ID NO: 8774237 - DNA, 22 bp, Homo sapiens
ccctggtgtccactggaggaag

SEQ ID NO: 8774238 - DNA, 22 bp, Homo sapiens
ccctggtggtacggcactggca

SEQ ID NO: 8774239 - DNA, 22 bp, Homo sapiens
ccctggtgtggatgtgattggc

SEQ ID NO: 8774240 - DNA, 22 bp, Homo sapiens
ccctggtgtccactggaggaag

SEQ ID NO: 8774241 - DNA, 22 bp, Homo sapiens
ccctggtcagggaaggcgcctg

SEQ ID NO: 8774242 - DNA, 22 bp, Homo sapiens
ccctgggttctggctgggctgc

SEQ ID NO: 8774243 - DNA, 22 bp, Homo sapiens
ccctgggataccagacaccaga

SEQ ID NO: 8774244 - DNA, 22 bp, Homo sapiens
ccctgggataccagacaccaga

SEQ ID NO: 8774245 - DNA, 22 bp, Homo sapiens
ccctggtggggccagacttgct

SEQ ID NO: 8774246 - DNA, 22 bp, Homo sapiens
ccctggtgccctgggtcagcct

SEQ ID NO: 8774247 - DNA, 22 bp, Homo sapiens
ccctggtcagggaaggcgcctg

SEQ ID NO: 8774248 - DNA, 22 bp, Homo sapiens
ccctggtgccctgggtcagcct

SEQ ID NO: 8774249 - DNA, 22 bp, Homo sapiens
ccctggaggaaaatctgaggct

SEQ ID NO: 8774250 - DNA, 22 bp, Homo sapiens
ccctggaggaaaatctgaggct

SEQ ID NO: 8774251 - DNA, 22 bp, Homo sapiens
ccctggagctgcttgcatgttg

SEQ ID NO: 8774252 - DNA, 22 bp, Homo sapiens
ccctggagctgcttgcatgttg

SEQ ID NO: 8774253 - DNA, 22 bp, Homo sapiens
ccctgggagtccactgatgtca

SEQ ID NO: 8774254 - DNA, 22 bp, Homo sapiens
ccggaaactcctttgagagcct

SEQ ID NO: 8774255 - DNA, 22 bp, Homo sapiens
ccggagtgtctggcctgctggg

SEQ ID NO: 8774256 - DNA, 22 bp, Homo sapiens
ccggcgggcagcggcagtgagc

SEQ ID NO: 8774257 - DNA, 22 bp, Homo sapiens
ccggcgtctcttccacttccta

SEQ ID NO: 8774258 - DNA, 22 bp, Homo sapiens
ccggcgggcgcggtgacgtcag

SEQ ID NO: 8774259 - DNA, 22 bp, Homo sapiens
ccggcgtctcttccacttccta

SEQ ID NO: 8774260 - DNA, 22 bp, Homo sapiens
ccggctactcgggaggctgacg

SEQ ID NO: 8774261 - DNA, 22 bp, Homo sapiens
ccggctactcgggaggctgacg

SEQ ID NO: 8774262 - DNA, 22 bp, Homo sapiens
ccggagagtcagagcgcggccc

SEQ ID NO: 8774263 - DNA, 22 bp, Homo sapiens
ccggaaggcggaacgtgcagtg

SEQ ID NO: 8774264 - DNA, 22 bp, Homo sapiens
ccgcggggcgtgggctcttacc

SEQ ID NO: 8774265 - DNA, 22 bp, Homo sapiens
ccgcggggcgtgggctcttacc

SEQ ID NO: 8774266 - DNA, 22 bp, Homo sapiens
ccgctgtcctggagctgctgct

SEQ ID NO: 8774267 - DNA, 22 bp, Homo sapiens
ccgctaggcctccggtcgcgca

SEQ ID NO: 8774268 - DNA, 22 bp, Homo sapiens
ccgctcctgaagagcctccccg

SEQ ID NO: 8774269 - DNA, 22 bp, Homo sapiens
ccgctcctgaagagcctccccg

SEQ ID NO: 8774270 - DNA, 22 bp, Homo sapiens
ccgcgcgcgtgggcgtccaggg

SEQ ID NO: 8774271 - DNA, 22 bp, Homo sapiens
ccgcgaggtggaggttgcagtg

SEQ ID NO: 8774272 - DNA, 22 bp, Homo sapiens
ccctgtggcaggaggaggagca

SEQ ID NO: 8774273 - DNA, 22 bp, Homo sapiens
ccctgtggcaggaggaggagca

SEQ ID NO: 8774274 - DNA, 22 bp, Homo sapiens
ccctgtggatttcagtttgtgt

SEQ ID NO: 8774275 - DNA, 22 bp, Homo sapiens
ccctgtggaggcagcatcctgc

SEQ ID NO: 8774276 - DNA, 22 bp, Homo sapiens
ccctgtggaggaggagagcagt

SEQ ID NO: 8774277 - DNA, 22 bp, Homo sapiens
ccctgtggaggaggagagcagt

SEQ ID NO: 8774278 - DNA, 22 bp, Homo sapiens
ccctgtgctgtcatgctgggcg

SEQ ID NO: 8774279 - DNA, 22 bp, Homo sapiens
ccctgtgctgtcatgctgggcg

SEQ ID NO: 8774280 - DNA, 22 bp, Homo sapiens
ccctgtgcctagttggcctaaa

SEQ ID NO: 8774281 - DNA, 22 bp, Homo sapiens
ccctgtgcctagttggcctaaa

SEQ ID NO: 8774282 - DNA, 22 bp, Homo sapiens
ccctgtgcacacacttcactct

SEQ ID NO: 8774283 - DNA, 22 bp, Homo sapiens
ccctgtgcagatggcagctggg

SEQ ID NO: 8774284 - DNA, 22 bp, Homo sapiens
ccctgtgcacacacttcactct

SEQ ID NO: 8774285 - DNA, 20 bp, Homo sapiens
ccctgtgattggcaagtgtc

SEQ ID NO: 8774286 - DNA, 22 bp, Homo sapiens
ccctgtctgtaccgtgatgagc

SEQ ID NO: 8774287 - DNA, 22 bp, Homo sapiens
tggaggtacataatgagagggt

SEQ ID NO: 8774288 - DNA, 19 bp, Homo sapiens
tggaggggtttgaatgtgg

SEQ ID NO: 8774289 - DNA, 19 bp, Homo sapiens
tggaggggtttgaatgtgg

SEQ ID NO: 8774290 - DNA, 19 bp, Homo sapiens
tggaggggtttgaatgtgg

SEQ ID NO: 8774291 - DNA, 19 bp, Homo sapiens
tggaggggtttgaatgtgg

SEQ ID NO: 8774292 - DNA, 19 bp, Homo sapiens
tggaggggtttgaatgtgg

SEQ ID NO: 8774293 - DNA, 19 bp, Homo sapiens
tggaggggtttgaatgtgg

SEQ ID NO: 8774294 - DNA, 22 bp, Homo sapiens
tggaggggcaatggagcgcgga

SEQ ID NO: 8774295 - DNA, 22 bp, Homo sapiens
tggaggtctctgtctgggcagg

SEQ ID NO: 8774296 - DNA, 22 bp, Homo sapiens
tggaggtctcctggtattgacc

SEQ ID NO: 8774297 - DNA, 22 bp, Homo sapiens
tggaggtctctgtctgggcagg

SEQ ID NO: 8774298 - DNA, 22 bp, Homo sapiens
tggaggtctgcaaggcgctgga

SEQ ID NO: 8774299 - DNA, 22 bp, Homo sapiens
tggaggtcgcgcgggtgctgca

SEQ ID NO: 8774300 - DNA, 22 bp, Homo sapiens
tggaggtcctggctgggtttta

SEQ ID NO: 8774301 - DNA, 22 bp, Homo sapiens
tggaggtcctgcaggatggcac

SEQ ID NO: 8774302 - DNA, 19 bp, Homo sapiens
tggaggtccaggagtaggg

SEQ ID NO: 8774303 - DNA, 23 bp, Homo sapiens
ccctggagctagtctgagcagag

SEQ ID NO: 8774304 - DNA, 22 bp, Homo sapiens
ccctggagctagtctgagcaga

SEQ ID NO: 8774305 - DNA, 23 bp, Homo sapiens
ccctggagctagtctgagcagag

SEQ ID NO: 8774306 - DNA, 23 bp, Homo sapiens
ccctggagctagtctgagcagag

SEQ ID NO: 8774307 - DNA, 23 bp, Homo sapiens
ccctggagctagtctgagcgggg

SEQ ID NO: 8774308 - DNA, 23 bp, Homo sapiens
ccctggagctagtctgagcgggg

SEQ ID NO: 8774309 - DNA, 23 bp, Homo sapiens
ccctggagctagtctgagcagag

SEQ ID NO: 8774310 - DNA, 22 bp, Homo sapiens
tggaggtggagttggaaactga

SEQ ID NO: 8774311 - DNA, 22 bp, Homo sapiens
tggaggtgacggggcctcgttg

SEQ ID NO: 8774312 - DNA, 22 bp, Homo sapiens
tggaggtgacggggcctcgttg

SEQ ID NO: 8774313 - DNA, 22 bp, Homo sapiens
tggaggtgagtgtggtacagca

SEQ ID NO: 8774314 - DNA, 22 bp, Homo sapiens
ccctgctgaatcccatggagtc

SEQ ID NO: 8774315 - DNA, 22 bp, Homo sapiens
tggaggccaggaaggcagcgag

SEQ ID NO: 8774316 - DNA, 19 bp, Homo sapiens
tggaggccaggacacaggt

SEQ ID NO: 8774317 - DNA, 22 bp, Homo sapiens
tggaggggcaatggagcgcgga

SEQ ID NO: 8774318 - DNA, 22 bp, Homo sapiens
tggaggggcaatggagcgcgga

SEQ ID NO: 8774319 - DNA, 22 bp, Homo sapiens
ccctgctcttctgactcaagct

SEQ ID NO: 8774320 - DNA, 22 bp, Homo sapiens
ccctgctcttagtgcctgtgtg

SEQ ID NO: 8774321 - DNA, 22 bp, Homo sapiens
ccctgctagtccttccttggct

SEQ ID NO: 8774322 - DNA, 22 bp, Homo sapiens
ccctgctagttgtctcagtgat

SEQ ID NO: 8774323 - DNA, 22 bp, Homo sapiens
ccctgctagttgtctcagtgat

SEQ ID NO: 8774324 - DNA, 23 bp, Homo sapiens
ccctgctcaggggtctgattctc

SEQ ID NO: 8774325 - DNA, 23 bp, Homo sapiens
ccctgctcaggggtctgattctc

SEQ ID NO: 8774326 - DNA, 22 bp, Homo sapiens
ccctgctcttagtgcctgtgtg

SEQ ID NO: 8774327 - DNA, 22 bp, Homo sapiens
ccctgctcttagtgcctgtgtg

SEQ ID NO: 8774328 - DNA, 22 bp, Homo sapiens
ccctgccttgtctgggctaggt

SEQ ID NO: 8774329 - DNA, 22 bp, Homo sapiens
ccctgccttggggtccacaccg

SEQ ID NO: 8774330 - DNA, 22 bp, Homo sapiens
ccctgccttggggtccacaccg

SEQ ID NO: 8774331 - DNA, 22 bp, Homo sapiens
ccctgccttggggtccacaccg

SEQ ID NO: 8774332 - DNA, 22 bp, Homo sapiens
ccctgccttggggtccacaccg

SEQ ID NO: 8774333 - DNA, 22 bp, Homo sapiens
ccctgccttgttggagcctatg

SEQ ID NO: 8774334 - DNA, 22 bp, Homo sapiens
ccctgccttgtctgggctaggt

SEQ ID NO: 8774335 - DNA, 22 bp, Homo sapiens
ccctgccttgtctgggctaggt

SEQ ID NO: 8774336 - DNA, 22 bp, Homo sapiens
ccctgccttgttggagcctatg

SEQ ID NO: 8774337 - DNA, 22 bp, Homo sapiens
ccctgccttgttggagcctatg

SEQ ID NO: 8774338 - DNA, 22 bp, Homo sapiens
ccctgctagaacctccaacatg

SEQ ID NO: 8774339 - DNA, 22 bp, Homo sapiens
ccctgccttgttggagcctatg

SEQ ID NO: 8774340 - DNA, 22 bp, Homo sapiens
tggacaggttgagtaggaggag

SEQ ID NO: 8774341 - DNA, 22 bp, Homo sapiens
tggacaggttgagtaggaggag

SEQ ID NO: 8774342 - DNA, 22 bp, Homo sapiens
tggacaggtttgggtgcctgtt

SEQ ID NO: 8774343 - DNA, 22 bp, Homo sapiens
tggacaggtttgggtgcctgtt

SEQ ID NO: 8774344 - DNA, 22 bp, Homo sapiens
tggacagtaagagaagatgtag

SEQ ID NO: 8774345 - DNA, 23 bp, Homo sapiens
ccctgcagtcagggtgagatggt

SEQ ID NO: 8774346 - DNA, 22 bp, Homo sapiens
tggacagttgtcttgtagctaa

SEQ ID NO: 8774347 - DNA, 23 bp, Homo sapiens
tggacagtagggtagacagtgcc

SEQ ID NO: 8774348 - DNA, 22 bp, Homo sapiens
tggacagtaggaagagtgtggg

SEQ ID NO: 8774349 - DNA, 23 bp, Homo sapiens
tggacagtagggtagacagtgcc

SEQ ID NO: 8774350 - DNA, 22 bp, Homo sapiens
ccctgccttcttggcctttaaa

SEQ ID NO: 8774351 - DNA, 22 bp, Homo sapiens
ccctgcctgtgggcatcaacat

SEQ ID NO: 8774352 - DNA, 22 bp, Homo sapiens
ccctgcctctgaagctgctcag

SEQ ID NO: 8774353 - DNA, 22 bp, Homo sapiens
ccctgcctctgaagctgctcag

SEQ ID NO: 8774354 - DNA, 22 bp, Homo sapiens
ccctgcctctgaagctgctcag

SEQ ID NO: 8774355 - DNA, 22 bp, Homo sapiens
ccctgcctctgaagctgctcag

SEQ ID NO: 8774356 - DNA, 19 bp, Homo sapiens
ccctgccctggtgactggg

SEQ ID NO: 8774357 - DNA, 22 bp, Homo sapiens
ccctgcagtgtgacctcaccta

SEQ ID NO: 8774358 - DNA, 19 bp, Homo sapiens
ccctgccctggtgactggg

SEQ ID NO: 8774359 - DNA, 19 bp, Homo sapiens
ccctgccctggtgactggg

SEQ ID NO: 8774360 - DNA, 19 bp, Homo sapiens
ccctgccctggtgactggg

SEQ ID NO: 8774361 - DNA, 22 bp, Homo sapiens
ccctgcctctgaagctgctcag

SEQ ID NO: 8774362 - DNA, 22 bp, Homo sapiens
ccctgcctctgaagctgctcag

SEQ ID NO: 8774363 - DNA, 19 bp, Homo sapiens
ccctgccctggtgactggg

SEQ ID NO: 8774364 - DNA, 22 bp, Homo sapiens
tggacaggttgagtaggaggag

SEQ ID NO: 8774365 - DNA, 22 bp, Homo sapiens
tggacaggtgcacacagcagcc

SEQ ID NO: 8774366 - DNA, 22 bp, Homo sapiens
tggacaggtgcacacagcagcc

SEQ ID NO: 8774367 - DNA, 22 bp, Homo sapiens
ccctgcagccggccagctcatt

SEQ ID NO: 8774368 - DNA, 22 bp, Homo sapiens
ccctgcagagccagccctgacc

SEQ ID NO: 8774369 - DNA, 22 bp, Homo sapiens
ccctgcagagccagccctgacc

SEQ ID NO: 8774370 - DNA, 22 bp, Homo sapiens
ccctgcagcattctctaactgg

SEQ ID NO: 8774371 - DNA, 22 bp, Homo sapiens
ccctgcagatctagggtccttc

SEQ ID NO: 8774372 - DNA, 22 bp, Homo sapiens
ccctgcagaaccacagacaaac

SEQ ID NO: 8774373 - DNA, 23 bp, Homo sapiens
ccctgcactaagaggagaaggtg

SEQ ID NO: 8774374 - DNA, 22 bp, Homo sapiens
ccctgaggaccaggaaggaggg

SEQ ID NO: 8774375 - DNA, 22 bp, Homo sapiens
ccctgaggagagcgcttcccga

SEQ ID NO: 8774376 - DNA, 22 bp, Homo sapiens
ccctgcacagcctggctctctt

SEQ ID NO: 8774377 - DNA, 22 bp, Homo sapiens
ccctgcacagcctggctctctt

SEQ ID NO: 8774378 - DNA, 22 bp, Homo sapiens
tggaagggaacaggtgggtgtt

SEQ ID NO: 8774379 - DNA, 22 bp, Homo sapiens
tggaagggaaagtttggggtcc

SEQ ID NO: 8774380 - DNA, 22 bp, Homo sapiens
tggaagggaacaggtgggtgtt

SEQ ID NO: 8774381 - DNA, 22 bp, Homo sapiens
tggaagggaacaggtgggtgtt

SEQ ID NO: 8774382 - DNA, 22 bp, Homo sapiens
tggaaggctttgctgtccttgc

SEQ ID NO: 8774383 - DNA, 22 bp, Homo sapiens
tggaaggcttggaatacttcca

SEQ ID NO: 8774384 - DNA, 22 bp, Homo sapiens
tggaaggcttggaatacttcca

SEQ ID NO: 8774385 - DNA, 17 bp, Homo sapiens
tggaaggcttcaatatt

SEQ ID NO: 8774386 - DNA, 22 bp, Homo sapiens
tggaaggctgtgattactgtgc

SEQ ID NO: 8774387 - DNA, 21 bp, Homo sapiens
tggaaggctgctctgccaggg

SEQ ID NO: 8774388 - DNA, 21 bp, Homo sapiens
tggaaggctgctctgccaggg

SEQ ID NO: 8774389 - DNA, 22 bp, Homo sapiens
tggaaggcgtctcgaaggccta

SEQ ID NO: 8774390 - DNA, 22 bp, Homo sapiens
tggaaggcctgttgtgtcctag

SEQ ID NO: 8774391 - DNA, 22 bp, Homo sapiens
tggaaggctaggtgctaggccc

SEQ ID NO: 8774392 - DNA, 22 bp, Homo sapiens
tggaaggctaggtgctaggccc

SEQ ID NO: 8774393 - DNA, 22 bp, Homo sapiens
tggaagaatgtttgccttataa

SEQ ID NO: 8774394 - DNA, 22 bp, Homo sapiens
tggaagaatttggggataaatt

SEQ ID NO: 8774395 - DNA, 22 bp, Homo sapiens
tggaaggcagtgatattgttga

SEQ ID NO: 8774396 - DNA, 22 bp, Homo sapiens
tggaaggcaggacctgccttgg

SEQ ID NO: 8774397 - DNA, 20 bp, Homo sapiens
tggaaggcatctgcattatt

SEQ ID NO: 8774398 - DNA, 20 bp, Homo sapiens
tggaaggcatctgcattatt

SEQ ID NO: 8774399 - DNA, 22 bp, Homo sapiens
tggaagacagttgatgggagtt

SEQ ID NO: 8774400 - DNA, 22 bp, Homo sapiens
tggaagacaggcatggaagtgg

SEQ ID NO: 8774401 - DNA, 22 bp, Homo sapiens
tggaagacaggagatgtgtgta

SEQ ID NO: 8774402 - DNA, 22 bp, Homo sapiens
ccctacaggtgattctggtgct

SEQ ID NO: 8774403 - DNA, 22 bp, Homo sapiens
ccctacaggtgattctggtgct

SEQ ID NO: 8774404 - DNA, 22 bp, Homo sapiens
ccctaaggcagcccagtctgtg

SEQ ID NO: 8774405 - DNA, 22 bp, Homo sapiens
ccctaagaccctcaagatctcc

SEQ ID NO: 8774406 - DNA, 22 bp, Homo sapiens
cccgtttgcctctttatttact

SEQ ID NO: 8774407 - DNA, 22 bp, Homo sapiens
ccctaagaatctcccttgtagc

SEQ ID NO: 8774408 - DNA, 22 bp, Homo sapiens
ccctaagaagcaaagtgatacc

SEQ ID NO: 8774409 - DNA, 22 bp, Homo sapiens
ccctaaaagtctcattttccag

SEQ ID NO: 8774410 - DNA, 17 bp, Homo sapiens
cccgttctcttcgctgg

SEQ ID NO: 8774411 - DNA, 22 bp, Homo sapiens
cccgttcctataatagcataga

SEQ ID NO: 8774412 - DNA, 22 bp, Homo sapiens
cccgtcccttttgcccgctggt

SEQ ID NO: 8774413 - DNA, 22 bp, Homo sapiens
cccgtccctgtgcgtcgcgagc

SEQ ID NO: 8774414 - DNA, 22 bp, Homo sapiens
cccgggttgtccgcgcgtccgg

SEQ ID NO: 8774415 - DNA, 22 bp, Homo sapiens
cccgtccctgtgcgtcgcgagc

SEQ ID NO: 8774416 - DNA, 21 bp, Homo sapiens
cccgtcagcagggcccctcct

SEQ ID NO: 8774417 - DNA, 22 bp, Homo sapiens
cccgggaggaggaagttgcagt

SEQ ID NO: 8774418 - DNA, 22 bp, Homo sapiens
cccgggaggtggagactgcagt

SEQ ID NO: 8774419 - DNA, 18 bp, Homo sapiens
cccggctaatttttggta

SEQ ID NO: 8774420 - DNA, 22 bp, Homo sapiens
tgctttcattgcctgcggtttt

SEQ ID NO: 8774421 - DNA, 21 bp, Homo sapiens
tgctttctaaaaatactattg

SEQ ID NO: 8774422 - DNA, 21 bp, Homo sapiens
tgctttctaaaaatactattg

SEQ ID NO: 8774423 - DNA, 22 bp, Homo sapiens
tggaaagacattcagccgctgg

SEQ ID NO: 8774424 - DNA, 22 bp, Homo sapiens
tggaaagacatgtccttcatta

SEQ ID NO: 8774425 - DNA, 19 bp, Homo sapiens
ccctagagtaagactgcat

SEQ ID NO: 8774426 - DNA, 22 bp, Homo sapiens
ccctagagagatcagatgggga

SEQ ID NO: 8774427 - DNA, 22 bp, Homo sapiens
ccctagaaatgaaagcatacgt

SEQ ID NO: 8774428 - DNA, 22 bp, Homo sapiens
ccctagaacacgcagacactga

SEQ ID NO: 8774429 - DNA, 22 bp, Homo sapiens
tggaagaataggatagaagaac

SEQ ID NO: 8774430 - DNA, 22 bp, Homo sapiens
tggaagaataggatagaagaac

SEQ ID NO: 8774431 - DNA, 22 bp, Homo sapiens
tggaagaataggatagaagaac

SEQ ID NO: 8774432 - DNA, 22 bp, Homo sapiens
tggaagaagctacaagcggtga

SEQ ID NO: 8774433 - DNA, 22 bp, Homo sapiens
tggaagaatagaagatggttga

SEQ ID NO: 8774434 - DNA, 22 bp, Homo sapiens
tggaagaaggcagagaggcatt

SEQ ID NO: 8774435 - DNA, 22 bp, Homo sapiens
tggaagaaggcagagaggcatt

SEQ ID NO: 8774436 - DNA, 22 bp, Homo sapiens
tgcctgccctttccacacagcc

SEQ ID NO: 8774437 - DNA, 22 bp, Homo sapiens
tgcctgccctttccacacagcc

SEQ ID NO: 8774438 - DNA, 22 bp, Homo sapiens
tgcctgccctgaaaactgccca

SEQ ID NO: 8774439 - DNA, 22 bp, Homo sapiens
tgcctgccctgaaaactgccca

SEQ ID NO: 8774440 - DNA, 20 bp, Homo sapiens
tgcctgcccctgctttttcc

SEQ ID NO: 8774441 - DNA, 22 bp, Homo sapiens
tgcctgccctgaaaactgccca

SEQ ID NO: 8774442 - DNA, 18 bp, Homo sapiens
tgcctgccccgtaagggt

SEQ ID NO: 8774443 - DNA, 20 bp, Homo sapiens
tgcctgcccctgctttttcc

SEQ ID NO: 8774444 - DNA, 22 bp, Homo sapiens
tgcctgcctaggaagctgtgaa

SEQ ID NO: 8774445 - DNA, 22 bp, Homo sapiens
tgcctgcctaggaagctgtgaa

SEQ ID NO: 8774446 - DNA, 22 bp, Homo sapiens
tgcctgccgctgtctagtactg

SEQ ID NO: 8774447 - DNA, 22 bp, Homo sapiens
tgcctgcctaggaagctgtgaa

SEQ ID NO: 8774448 - DNA, 22 bp, Homo sapiens
tgcctgcctcaggccgagtgct

SEQ ID NO: 8774449 - DNA, 22 bp, Homo sapiens
tgcctgcctcaggccgagtgct

SEQ ID NO: 8774450 - DNA, 22 bp, Homo sapiens
tgcctgcctaggaagctgtgaa

SEQ ID NO: 8774451 - DNA, 22 bp, Homo sapiens
tgcctgcctcaggccgagtgct

SEQ ID NO: 8774452 - DNA, 22 bp, Homo sapiens
tgcctgcctctggcagccctgc

SEQ ID NO: 8774453 - DNA, 22 bp, Homo sapiens
tgcctgcctctggcagccctgc

SEQ ID NO: 8774454 - DNA, 22 bp, Homo sapiens
tgcctgcctctggcagccctgc

SEQ ID NO: 8774455 - DNA, 22 bp, Homo sapiens
tgcctgcctctggcagccctgc

SEQ ID NO: 8774456 - DNA, 22 bp, Homo sapiens
tgcctgcctctggcagccctgc

SEQ ID NO: 8774457 - DNA, 22 bp, Homo sapiens
tgcctgcctctggagcccatcc

SEQ ID NO: 8774458 - DNA, 22 bp, Homo sapiens
tgcctgcctctggagcccatcc

SEQ ID NO: 8774459 - DNA, 21 bp, Homo sapiens
tgcctgcctcctttggctagg

SEQ ID NO: 8774460 - DNA, 22 bp, Homo sapiens
tgcctgcctctggagcccatcc

SEQ ID NO: 8774461 - DNA, 22 bp, Homo sapiens
tgcctgcctgcatagtcccacg

SEQ ID NO: 8774462 - DNA, 22 bp, Homo sapiens
tgcctgccttgctgctggacag

SEQ ID NO: 8774463 - DNA, 22 bp, Homo sapiens
tgcctgccttgctgctggacag

SEQ ID NO: 8774464 - DNA, 22 bp, Homo sapiens
tgcctgcgaggcatgggtgaga

SEQ ID NO: 8774465 - DNA, 22 bp, Homo sapiens
tgcctgccttgctgctggacag

SEQ ID NO: 8774466 - DNA, 22 bp, Homo sapiens
tgcctcagtttctccatatgaa

SEQ ID NO: 8774467 - DNA, 22 bp, Homo sapiens
tgcctcatttttaagtgttata

SEQ ID NO: 8774468 - DNA, 22 bp, Homo sapiens
tgcctccaccattgctcacttt

SEQ ID NO: 8774469 - DNA, 22 bp, Homo sapiens
tgcctccatgtttcagcatcta

SEQ ID NO: 8774470 - DNA, 22 bp, Homo sapiens
tgcctccatgtttcagcatcta

SEQ ID NO: 8774471 - DNA, 22 bp, Homo sapiens
tgcttgtctctctgtgcccact

SEQ ID NO: 8774472 - DNA, 19 bp, Homo sapiens
tgcctgctcctggcttcca

SEQ ID NO: 8774473 - DNA, 22 bp, Homo sapiens
tgcctgctagatatccaggtga

SEQ ID NO: 8774474 - DNA, 22 bp, Homo sapiens
tgcctgctaggccctgctgggt

SEQ ID NO: 8774475 - DNA, 22 bp, Homo sapiens
tgctttcattcacaaaatagca

SEQ ID NO: 8774476 - DNA, 22 bp, Homo sapiens
tgctttcattcacaaaatagca

SEQ ID NO: 8774477 - DNA, 22 bp, Homo sapiens
tgctttcagtttacatcagaac

SEQ ID NO: 8774478 - DNA, 22 bp, Homo sapiens
tgctttcagatatctgtttcaa

SEQ ID NO: 8774479 - DNA, 22 bp, Homo sapiens
tgctttcagctggtaaagaaac

SEQ ID NO: 8774480 - DNA, 22 bp, Homo sapiens
tgctttcactgatgtatcattt

SEQ ID NO: 8774481 - DNA, 22 bp, Homo sapiens
tgctttcacttctctgcagcca

SEQ ID NO: 8774482 - DNA, 22 bp, Homo sapiens
tgctttcacaccatgcctataa

SEQ ID NO: 8774483 - DNA, 22 bp, Homo sapiens
tgctttcacaccatgcctataa

SEQ ID NO: 8774484 - DNA, 22 bp, Homo sapiens
tgctttcaatgaattgtatact

SEQ ID NO: 8774485 - DNA, 22 bp, Homo sapiens
cagtttatagctctagcagctt

SEQ ID NO: 8774486 - DNA, 22 bp, Homo sapiens
cagtttatagctctagcagctt

SEQ ID NO: 8774487 - DNA, 22 bp, Homo sapiens
cagtttagtgttgcatttggag

SEQ ID NO: 8774488 - DNA, 22 bp, Homo sapiens
cagtttatagttgttatgtgtg

SEQ ID NO: 8774489 - DNA, 22 bp, Homo sapiens
cagtttatatataagcacattg

SEQ ID NO: 8774490 - DNA, 22 bp, Homo sapiens
cagtttacctatatgtaaattt

SEQ ID NO: 8774491 - DNA, 22 bp, Homo sapiens
cagtttagtaggtgatatcaat

SEQ ID NO: 8774492 - DNA, 22 bp, Homo sapiens
cagtttaggtcatccttgcttt

SEQ ID NO: 8774493 - DNA, 22 bp, Homo sapiens
cagtttaagtagaactgagaat

SEQ ID NO: 8774494 - DNA, 22 bp, Homo sapiens
cagtttaaggcaggacatggga

SEQ ID NO: 8774495 - DNA, 22 bp, Homo sapiens
cagtttaagtagaactgagaat

SEQ ID NO: 8774496 - DNA, 22 bp, Homo sapiens
cagtttaagtagaactgagaat

SEQ ID NO: 8774497 - DNA, 21 bp, Homo sapiens
cagtttaataacaaagaagga

SEQ ID NO: 8774498 - DNA, 22 bp, Homo sapiens
cagtttaagtgtgttgaaggta

SEQ ID NO: 8774499 - DNA, 22 bp, Homo sapiens
tcagcttttaaaaacaagaagt

SEQ ID NO: 8774500 - DNA, 22 bp, Homo sapiens
tcagctttgggggtctcaggag

SEQ ID NO: 8774501 - DNA, 22 bp, Homo sapiens
tcagctttgccaccagctgtaa

SEQ ID NO: 8774502 - DNA, 21 bp, Homo sapiens
tcagctttgcaactgcacatc

SEQ ID NO: 8774503 - DNA, 22 bp, Homo sapiens
cagtttatagctctagcagctt

SEQ ID NO: 8774504 - DNA, 22 bp, Homo sapiens
tcagctttctcttctatcgata

SEQ ID NO: 8774505 - DNA, 22 bp, Homo sapiens
tcagctttttggattgcccaag

SEQ ID NO: 8774506 - DNA, 22 bp, Homo sapiens
tcaggaaaatactgcttatcca

SEQ ID NO: 8774507 - DNA, 21 bp, Homo sapiens
tcaggaaacacctcttaagga

SEQ ID NO: 8774508 - DNA, 21 bp, Homo sapiens
tcaggaaacacctcttaagga

SEQ ID NO: 8774509 - DNA, 21 bp, Homo sapiens
tcaggaaacacctcttaagga

SEQ ID NO: 8774510 - DNA, 22 bp, Homo sapiens
cataaaatggcttgttctttaa

SEQ ID NO: 8774511 - DNA, 22 bp, Homo sapiens
cataaaatggcttgttctttaa

SEQ ID NO: 8774512 - DNA, 22 bp, Homo sapiens
cataaactctctgtaccaatat

SEQ ID NO: 8774513 - DNA, 22 bp, Homo sapiens
cataaactctctgtaccaatat

SEQ ID NO: 8774514 - DNA, 22 bp, Homo sapiens
cataaactctctgtaccaatat

SEQ ID NO: 8774515 - DNA, 22 bp, Homo sapiens
tcaggaaagaagatgctcagtg

SEQ ID NO: 8774516 - DNA, 22 bp, Homo sapiens
tcaggaaagaagatgctcagtg

SEQ ID NO: 8774517 - DNA, 22 bp, Homo sapiens
tcaggaaactgtcaagtgggat

SEQ ID NO: 8774518 - DNA, 22 bp, Homo sapiens
tcaggaaactgtcaagtgggat

SEQ ID NO: 8774519 - DNA, 19 bp, Homo sapiens
cataaatgtacaagataca

SEQ ID NO: 8774520 - DNA, 22 bp, Homo sapiens
cataaattcagttctgcctctt

SEQ ID NO: 8774521 - DNA, 22 bp, Homo sapiens
cataaagtgtataagtgaagaa

SEQ ID NO: 8774522 - DNA, 19 bp, Homo sapiens
cataaatgtacaagataca

SEQ ID NO: 8774523 - DNA, 22 bp, Homo sapiens
cataaactcttgagattcttgt

SEQ ID NO: 8774524 - DNA, 22 bp, Homo sapiens
cagttaaatgatgtgccctaga

SEQ ID NO: 8774525 - DNA, 22 bp, Homo sapiens
cagttaaatttggctgttttct

SEQ ID NO: 8774526 - DNA, 20 bp, Homo sapiens
cagttaatgactaggcatca

SEQ ID NO: 8774527 - DNA, 22 bp, Homo sapiens
cagttaaatgatgtgccctaga

SEQ ID NO: 8774528 - DNA, 22 bp, Homo sapiens
cagttaaattctccagttacca

SEQ ID NO: 8774529 - DNA, 22 bp, Homo sapiens
cagttaaagtgcttatcacaga

SEQ ID NO: 8774530 - DNA, 22 bp, Homo sapiens
cagttaaagtgcttatcacaga

SEQ ID NO: 8774531 - DNA, 22 bp, Homo sapiens
cagttaaaggcccaatatctgg

SEQ ID NO: 8774532 - DNA, 22 bp, Homo sapiens
cagttaaaggcccaatatctgg

SEQ ID NO: 8774533 - DNA, 22 bp, Homo sapiens
cagttaaagtgcttatcacaga

SEQ ID NO: 8774534 - DNA, 22 bp, Homo sapiens
cagttaaagctgcatgtgtcag

SEQ ID NO: 8774535 - DNA, 22 bp, Homo sapiens
cagttaaaggcccaatatctgg

SEQ ID NO: 8774536 - DNA, 22 bp, Homo sapiens
cagttaaagctgcatgtgtcag

SEQ ID NO: 8774537 - DNA, 22 bp, Homo sapiens
cagttaaacgggccatgtgagt

SEQ ID NO: 8774538 - DNA, 22 bp, Homo sapiens
cagttaaacgggccatgtgagt

SEQ ID NO: 8774539 - DNA, 22 bp, Homo sapiens
cagttaaacagattgagtgtta

SEQ ID NO: 8774540 - DNA, 22 bp, Homo sapiens
tcagatgccctttgttttagac

SEQ ID NO: 8774541 - DNA, 22 bp, Homo sapiens
tcagatgcgatgcattcaggct

SEQ ID NO: 8774542 - DNA, 22 bp, Homo sapiens
tcagatgctaaagatggaatta

SEQ ID NO: 8774543 - DNA, 22 bp, Homo sapiens
tcagatgcctgtggggtctagg

SEQ ID NO: 8774544 - DNA, 22 bp, Homo sapiens
tcagcagaatcttcctacacct

SEQ ID NO: 8774545 - DNA, 22 bp, Homo sapiens
tcagatgccaactgaacaacag

SEQ ID NO: 8774546 - DNA, 22 bp, Homo sapiens
cagttactcaataattcttgcg

SEQ ID NO: 8774547 - DNA, 22 bp, Homo sapiens
cagttaccatcttcagtgatga

SEQ ID NO: 8774548 - DNA, 22 bp, Homo sapiens
cagttactcaataattcttgcg

SEQ ID NO: 8774549 - DNA, 22 bp, Homo sapiens
cagttacataaatgataaaatg

SEQ ID NO: 8774550 - DNA, 22 bp, Homo sapiens
cagttacagagccagttagaga

SEQ ID NO: 8774551 - DNA, 22 bp, Homo sapiens
cagttgttcccagcaatgaaag

SEQ ID NO: 8774552 - DNA, 22 bp, Homo sapiens
tcagcagccgcagctgactcag

SEQ ID NO: 8774553 - DNA, 22 bp, Homo sapiens
cagtttaaatgagtgactgcag

SEQ ID NO: 8774554 - DNA, 22 bp, Homo sapiens
cagtttaaatgagtgactgcag

SEQ ID NO: 8774555 - DNA, 22 bp, Homo sapiens
cagtttaaagaaggatgggagt

SEQ ID NO: 8774556 - DNA, 22 bp, Homo sapiens
tcagcagccgcagctgactcag

SEQ ID NO: 8774557 - DNA, 19 bp, Homo sapiens
cagtttaactaattttatc

SEQ ID NO: 8774558 - DNA, 22 bp, Homo sapiens
cagtttaacctatccattatgt

SEQ ID NO: 8774559 - DNA, 22 bp, Homo sapiens
cagtttaacctatccattatgt

SEQ ID NO: 8774560 - DNA, 20 bp, Homo sapiens
cagtttaactttgagcagtt

SEQ ID NO: 8774561 - DNA, 19 bp, Homo sapiens
cagtttaactaattttatc

SEQ ID NO: 8774562 - DNA, 22 bp, Homo sapiens
cagtttaagacaagggggtgta

SEQ ID NO: 8774563 - DNA, 20 bp, Homo sapiens
cagtttaactttgagcagtt

SEQ ID NO: 8774564 - DNA, 23 bp, Homo sapiens
tcagcagcagaagtgctgggatg

SEQ ID NO: 8774565 - DNA, 21 bp, Homo sapiens
tcagcagcatctgcctagagt

SEQ ID NO: 8774566 - DNA, 22 bp, Homo sapiens
tcagcagcagctcagcatgttt

SEQ ID NO: 8774567 - DNA, 22 bp, Homo sapiens
tcagcagaggggaaggcatctg

SEQ ID NO: 8774568 - DNA, 22 bp, Homo sapiens
tcagcagagtttcatcttggga

SEQ ID NO: 8774569 - DNA, 22 bp, Homo sapiens
tcagcagacattattttctggc

SEQ ID NO: 8774570 - DNA, 22 bp, Homo sapiens
tcagcagacctgttatttggat

SEQ ID NO: 8774571 - DNA, 22 bp, Homo sapiens
tcagcagacagttagctatatt

SEQ ID NO: 8774572 - DNA, 22 bp, Homo sapiens
tcagcagaatgtggcatgtcac

SEQ ID NO: 8774573 - DNA, 22 bp, Homo sapiens
tcagcagagctcaggctccagc

SEQ ID NO: 8774574 - DNA, 22 bp, Homo sapiens
cagttaaaaggtatgctaccaa

SEQ ID NO: 8774575 - DNA, 22 bp, Homo sapiens
cagttaaaagaagtctatctta

SEQ ID NO: 8774576 - DNA, 22 bp, Homo sapiens
cagttaaacgatgatggggtca

SEQ ID NO: 8774577 - DNA, 22 bp, Homo sapiens
cagttaaacgggccatgtgagt

SEQ ID NO: 8774578 - DNA, 22 bp, Homo sapiens
cagttaaacgatgatggggtca

SEQ ID NO: 8774579 - DNA, 22 bp, Homo sapiens
cagttaaacagattgagtgtta

SEQ ID NO: 8774580 - DNA, 22 bp, Homo sapiens
cagttaaacagattgagtgtta

SEQ ID NO: 8774581 - DNA, 22 bp, Homo sapiens
cagttaaaatgtgctataagaa

SEQ ID NO: 8774582 - DNA, 22 bp, Homo sapiens
cagttaaaatgtgctataagaa

SEQ ID NO: 8774583 - DNA, 22 bp, Homo sapiens
cagtgtttgtatagaatatgca

SEQ ID NO: 8774584 - DNA, 22 bp, Homo sapiens
cagtgtttgtatagaatatgca

SEQ ID NO: 8774585 - DNA, 22 bp, Homo sapiens
cagtgtttgtatagaatatgca

SEQ ID NO: 8774586 - DNA, 22 bp, Homo sapiens
cagtgtttgcttaagttatatg

SEQ ID NO: 8774587 - DNA, 22 bp, Homo sapiens
cagtgtttgtatagaatatgca

SEQ ID NO: 8774588 - DNA, 22 bp, Homo sapiens
cagtgtttgcttaagttatatg

SEQ ID NO: 8774589 - DNA, 22 bp, Homo sapiens
cagtgtttgcttaagttatatg

SEQ ID NO: 8774590 - DNA, 22 bp, Homo sapiens
cagtgtttctgtgcccagtggg

SEQ ID NO: 8774591 - DNA, 22 bp, Homo sapiens
cagtgtttccgtcagtatgtga

SEQ ID NO: 8774592 - DNA, 22 bp, Homo sapiens
cagtgtttctgagttccagctc

SEQ ID NO: 8774593 - DNA, 22 bp, Homo sapiens
cagtgtttgtggaattcaggtg

SEQ ID NO: 8774594 - DNA, 22 bp, Homo sapiens
cagtgtttgttgagaaaggcaa

SEQ ID NO: 8774595 - DNA, 22 bp, Homo sapiens
cagtgtttgtggaattcaggtg

SEQ ID NO: 8774596 - DNA, 22 bp, Homo sapiens
cagtgttttgagaagggcacgt

SEQ ID NO: 8774597 - DNA, 22 bp, Homo sapiens
cagtgttttgagaagggcacgt

SEQ ID NO: 8774598 - DNA, 22 bp, Homo sapiens
cagtgtttgttgagaaaggcaa

SEQ ID NO: 8774599 - DNA, 22 bp, Homo sapiens
cagtgttttgttacttgggcac

SEQ ID NO: 8774600 - DNA, 22 bp, Homo sapiens
cagtgtttccgtcagtatgtga

SEQ ID NO: 8774601 - DNA, 22 bp, Homo sapiens
cagtgtttagcacagtgcttgg

SEQ ID NO: 8774602 - DNA, 22 bp, Homo sapiens
cagtgtttagcacagtgcttgg

SEQ ID NO: 8774603 - DNA, 22 bp, Homo sapiens
cagtgtgcctgaatcaagtgtt

SEQ ID NO: 8774604 - DNA, 23 bp, Homo sapiens
cagtgtgacgaggtgaggcaggc

SEQ ID NO: 8774605 - DNA, 22 bp, Homo sapiens
cagtgtgacttctgagctgcca

SEQ ID NO: 8774606 - DNA, 22 bp, Homo sapiens
cagtgtctgggacagaaagtca

SEQ ID NO: 8774607 - DNA, 22 bp, Homo sapiens
cagtgtctggttggctctacgt

SEQ ID NO: 8774608 - DNA, 22 bp, Homo sapiens
cagtgtctttcagactcagaaa

SEQ ID NO: 8774609 - DNA, 23 bp, Homo sapiens
tcagaagtgggatacaaagctga

SEQ ID NO: 8774610 - DNA, 19 bp, Homo sapiens
tcagactgaaagtttagat

SEQ ID NO: 8774611 - DNA, 19 bp, Homo sapiens
tcagactgaaagtttagat

SEQ ID NO: 8774612 - DNA, 22 bp, Homo sapiens
tcagactgaaagatacacctct

SEQ ID NO: 8774613 - DNA, 22 bp, Homo sapiens
tcagactggcatctaagggctg

SEQ ID NO: 8774614 - DNA, 22 bp, Homo sapiens
tcagactgcttagctcccagta

SEQ ID NO: 8774615 - DNA, 22 bp, Homo sapiens
tcagactgctgtccctgcctgg

SEQ ID NO: 8774616 - DNA, 22 bp, Homo sapiens
tcagactgatcatctatcagat

SEQ ID NO: 8774617 - DNA, 22 bp, Homo sapiens
tcagactgactagtcaatgaaa

SEQ ID NO: 8774618 - DNA, 22 bp, Homo sapiens
tcagactgacggccgaggcaag

SEQ ID NO: 8774619 - DNA, 22 bp, Homo sapiens
tcagactgaccgaagcatctgg

SEQ ID NO: 8774620 - DNA, 22 bp, Homo sapiens
tcagacttctactttgcagagc

SEQ ID NO: 8774621 - DNA, 22 bp, Homo sapiens
tcagactgtttgcaccataggc

SEQ ID NO: 8774622 - DNA, 22 bp, Homo sapiens
tcagactgtgtcataagtaggt

SEQ ID NO: 8774623 - DNA, 22 bp, Homo sapiens
tcagactgtcttagctttatac

SEQ ID NO: 8774624 - DNA, 22 bp, Homo sapiens
tcagactggattttcacgtttt

SEQ ID NO: 8774625 - DNA, 22 bp, Homo sapiens
tcagactggggctccctgagga

SEQ ID NO: 8774626 - DNA, 22 bp, Homo sapiens
tcagactgggtttgcagccacc

SEQ ID NO: 8774627 - DNA, 22 bp, Homo sapiens
tcagacttttaaagactgaatg

SEQ ID NO: 8774628 - DNA, 22 bp, Homo sapiens
tcagagaaaatggaaactttta

SEQ ID NO: 8774629 - DNA, 22 bp, Homo sapiens
tcagagaaaatggaaactttta

SEQ ID NO: 8774630 - DNA, 22 bp, Homo sapiens
tcagagaaataattgctgagtt

SEQ ID NO: 8774631 - DNA, 22 bp, Homo sapiens
tcagagaaaggccaaaatatca

SEQ ID NO: 8774632 - DNA, 22 bp, Homo sapiens
tcagagaaatgacaatatatag

SEQ ID NO: 8774633 - DNA, 22 bp, Homo sapiens
tcagagaaatgaagtagggatt

SEQ ID NO: 8774634 - DNA, 22 bp, Homo sapiens
tcagagaaatgctgagctcatg

SEQ ID NO: 8774635 - DNA, 22 bp, Homo sapiens
tcagagaacacagaggtgatgt

SEQ ID NO: 8774636 - DNA, 22 bp, Homo sapiens
tcagagaacacagaggtgatgt

SEQ ID NO: 8774637 - DNA, 22 bp, Homo sapiens
cagtgtctccagatgctccaat

SEQ ID NO: 8774638 - DNA, 22 bp, Homo sapiens
cagtgtctccagatgctccaat

SEQ ID NO: 8774639 - DNA, 22 bp, Homo sapiens
cagtgccacttaatgaggctgc

SEQ ID NO: 8774640 - DNA, 22 bp, Homo sapiens
cagtgccaaggatggcctggga

SEQ ID NO: 8774641 - DNA, 22 bp, Homo sapiens
cagtgccaaggagaaggacagc

SEQ ID NO: 8774642 - DNA, 21 bp, Homo sapiens
cagtgccagccacaggacgcc

SEQ ID NO: 8774643 - DNA, 22 bp, Homo sapiens
cagtgccagaggtactagtgga

SEQ ID NO: 8774644 - DNA, 22 bp, Homo sapiens
cagtgccatgtctgagccccta

SEQ ID NO: 8774645 - DNA, 22 bp, Homo sapiens
cagtgcccaaaggaacagaaag

SEQ ID NO: 8774646 - DNA, 22 bp, Homo sapiens
cagtgcccaaaggaacagaaag

SEQ ID NO: 8774647 - DNA, 22 bp, Homo sapiens
cagtgccatgatgcagagcaat

SEQ ID NO: 8774648 - DNA, 22 bp, Homo sapiens
cagtgccatattgaaagacatt

SEQ ID NO: 8774649 - DNA, 22 bp, Homo sapiens
cagtgccatattgaaagacatt

SEQ ID NO: 8774650 - DNA, 22 bp, Homo sapiens
cagtgccagtggatgaactgtt

SEQ ID NO: 8774651 - DNA, 22 bp, Homo sapiens
cagtggctgtgaccagggacct

SEQ ID NO: 8774652 - DNA, 22 bp, Homo sapiens
cagtggctggttagggacagga

SEQ ID NO: 8774653 - DNA, 22 bp, Homo sapiens
cagtggctgagagtggacactg

SEQ ID NO: 8774654 - DNA, 22 bp, Homo sapiens
cagtggcaggggaagcaggtgt

SEQ ID NO: 8774655 - DNA, 22 bp, Homo sapiens
cagtggcttctcatgtcattca

SEQ ID NO: 8774656 - DNA, 22 bp, Homo sapiens
cagtggggaggccaggatagaa

SEQ ID NO: 8774657 - DNA, 23 bp, Homo sapiens
cagtgggcttctaactgctcctg

SEQ ID NO: 8774658 - DNA, 22 bp, Homo sapiens
cagtggggaggccaggatagaa

SEQ ID NO: 8774659 - DNA, 22 bp, Homo sapiens
cagtgggggtgaggccgaggta

SEQ ID NO: 8774660 - DNA, 22 bp, Homo sapiens
cagtgggggggccatgctgcag

SEQ ID NO: 8774661 - DNA, 22 bp, Homo sapiens
cagtggggggactgaggcctga

SEQ ID NO: 8774662 - DNA, 22 bp, Homo sapiens
cagtgggtagtggggattagca

SEQ ID NO: 8774663 - DNA, 22 bp, Homo sapiens
cagtggggtttctgtgggtgct

SEQ ID NO: 8774664 - DNA, 22 bp, Homo sapiens
cagtggggtttctgtgggtgct

SEQ ID NO: 8774665 - DNA, 22 bp, Homo sapiens
cagtgggtaaataagtgggtaa

SEQ ID NO: 8774666 - DNA, 22 bp, Homo sapiens
cagtggggtttctgtgggtgct

SEQ ID NO: 8774667 - DNA, 21 bp, Homo sapiens
cagtgggctgctgcgctccag

SEQ ID NO: 8774668 - DNA, 22 bp, Homo sapiens
cagtgggatatgggggcagcat

SEQ ID NO: 8774669 - DNA, 22 bp, Homo sapiens
cagtgggattgggattggaacc

SEQ ID NO: 8774670 - DNA, 22 bp, Homo sapiens
cagtgggacatgggcactgggc

SEQ ID NO: 8774671 - DNA, 22 bp, Homo sapiens
cagtgggacatgggcactgggc

SEQ ID NO: 8774672 - DNA, 22 bp, Homo sapiens
cagtgggatatgggggcagcat

SEQ ID NO: 8774673 - DNA, 22 bp, Homo sapiens
cagtgggatatgggggcagcat

SEQ ID NO: 8774674 - DNA, 23 bp, Homo sapiens
cagtgggaggactgagataaaac

SEQ ID NO: 8774675 - DNA, 22 bp, Homo sapiens
cagtgggatatgggggcagcat

SEQ ID NO: 8774676 - DNA, 22 bp, Homo sapiens
cagtgggaaagtgaagagcatt

SEQ ID NO: 8774677 - DNA, 22 bp, Homo sapiens
cagtgggaagaatgcagcctcc

SEQ ID NO: 8774678 - DNA, 22 bp, Homo sapiens
cagtgggaagaatgcagcctcc

SEQ ID NO: 8774679 - DNA, 22 bp, Homo sapiens
cagtgggaagggcagaggcttt

SEQ ID NO: 8774680 - DNA, 22 bp, Homo sapiens
cagtgggaagggcagaggcttt

SEQ ID NO: 8774681 - DNA, 22 bp, Homo sapiens
cagtgggaatgaagtggaggcc

SEQ ID NO: 8774682 - DNA, 22 bp, Homo sapiens
cagtgggacatgggcactgggc

SEQ ID NO: 8774683 - DNA, 22 bp, Homo sapiens
cagtgggaatgaagtggaggcc

SEQ ID NO: 8774684 - DNA, 22 bp, Homo sapiens
cagtgggaatgaagtggaggcc

SEQ ID NO: 8774685 - DNA, 22 bp, Homo sapiens
tatttgaaagtgtacaaaaact

SEQ ID NO: 8774686 - DNA, 22 bp, Homo sapiens
tcacaaatattttaacagtagg

SEQ ID NO: 8774687 - DNA, 22 bp, Homo sapiens
tcacaaatattttaacagtagg

SEQ ID NO: 8774688 - DNA, 22 bp, Homo sapiens
tcacaaatattttaacagtagg

SEQ ID NO: 8774689 - DNA, 22 bp, Homo sapiens
tcacaaatattttaacagtagg

SEQ ID NO: 8774690 - DNA, 22 bp, Homo sapiens
tcacaaatatagtgagaaccag

SEQ ID NO: 8774691 - DNA, 22 bp, Homo sapiens
tcacaaatatagtgagaaccag

SEQ ID NO: 8774692 - DNA, 22 bp, Homo sapiens
tcacaaatatagtgagaaccag

SEQ ID NO: 8774693 - DNA, 22 bp, Homo sapiens
tcacaagacagaaaacatttag

SEQ ID NO: 8774694 - DNA, 22 bp, Homo sapiens
tcacaagaatttgtagatgaaa

SEQ ID NO: 8774695 - DNA, 22 bp, Homo sapiens
tcacaagacaagacaaattgca

SEQ ID NO: 8774696 - DNA, 22 bp, Homo sapiens
tcacaagaatttgtagatgaaa

SEQ ID NO: 8774697 - DNA, 22 bp, Homo sapiens
tcacaacttgaagctgatttaa

SEQ ID NO: 8774698 - DNA, 22 bp, Homo sapiens
tcacaaatttcagctccctgaa

SEQ ID NO: 8774699 - DNA, 22 bp, Homo sapiens
tcacaactcacagccaccggtg

SEQ ID NO: 8774700 - DNA, 20 bp, Homo sapiens
tcacaactccatcatttccc

SEQ ID NO: 8774701 - DNA, 22 bp, Homo sapiens
tcacaactcacagccaccggtg

SEQ ID NO: 8774702 - DNA, 22 bp, Homo sapiens
tcacaaatcgaagccttataat

SEQ ID NO: 8774703 - DNA, 22 bp, Homo sapiens
tcacaaatcgaagccttataat

SEQ ID NO: 8774704 - DNA, 22 bp, Homo sapiens
tcacaaatcattttatctgtgt

SEQ ID NO: 8774705 - DNA, 22 bp, Homo sapiens
tcacaaatgaccatggttacta

SEQ ID NO: 8774706 - DNA, 22 bp, Homo sapiens
tcacaaatcattttatctgtgt

SEQ ID NO: 8774707 - DNA, 22 bp, Homo sapiens
tcacaaatcattttatctgtgt

SEQ ID NO: 8774708 - DNA, 22 bp, Homo sapiens
tcacaaatgtttgcatgtgtct

SEQ ID NO: 8774709 - DNA, 22 bp, Homo sapiens
tcacaaatgtttgcatgtgtct

SEQ ID NO: 8774710 - DNA, 22 bp, Homo sapiens
tcacaaatgaggaaatcgagca

SEQ ID NO: 8774711 - DNA, 22 bp, Homo sapiens
tcacaaatgtctcctgtcctgt

SEQ ID NO: 8774712 - DNA, 22 bp, Homo sapiens
cagtgagaaaactaagacatta

SEQ ID NO: 8774713 - DNA, 22 bp, Homo sapiens
cagtgagaaaactaagacatta

SEQ ID NO: 8774714 - DNA, 22 bp, Homo sapiens
cagtgagaattcagtaggtact

SEQ ID NO: 8774715 - DNA, 22 bp, Homo sapiens
cagtgacgtaaactgcatgtgc

SEQ ID NO: 8774716 - DNA, 22 bp, Homo sapiens
cagtgagagagaacgcattcat

SEQ ID NO: 8774717 - DNA, 22 bp, Homo sapiens
cagtgagaattcagtaggtact

SEQ ID NO: 8774718 - DNA, 22 bp, Homo sapiens
cagtgacagcaagcagtgctgg

SEQ ID NO: 8774719 - DNA, 22 bp, Homo sapiens
cagtgacagcaagcagtgctgg

SEQ ID NO: 8774720 - DNA, 22 bp, Homo sapiens
cagtgacgtaaactgcatgtgc

SEQ ID NO: 8774721 - DNA, 22 bp, Homo sapiens
cagtgaagtgtggacgtcacca

SEQ ID NO: 8774722 - DNA, 17 bp, Homo sapiens
cagtgaagagacattaa

SEQ ID NO: 8774723 - DNA, 22 bp, Homo sapiens
cagtgaagttctactgaatggt

SEQ ID NO: 8774724 - DNA, 22 bp, Homo sapiens
tcacaagactgagcttgcttga

SEQ ID NO: 8774725 - DNA, 22 bp, Homo sapiens
cagtgagataccacagagcaaa

SEQ ID NO: 8774726 - DNA, 22 bp, Homo sapiens
cagtgagagtatttgtgctaag

SEQ ID NO: 8774727 - DNA, 22 bp, Homo sapiens
tcacactttccatggctgttaa

SEQ ID NO: 8774728 - DNA, 22 bp, Homo sapiens
tcacactttatttatttcatgc

SEQ ID NO: 8774729 - DNA, 18 bp, Homo sapiens
tcacacttcctttgggtc

SEQ ID NO: 8774730 - DNA, 21 bp, Homo sapiens
tcacacttgattggcttagac

SEQ ID NO: 8774731 - DNA, 22 bp, Homo sapiens
tcacacttcaaagggttagatc

SEQ ID NO: 8774732 - DNA, 22 bp, Homo sapiens
tcacactttatttatttcatgc

SEQ ID NO: 8774733 - DNA, 22 bp, Homo sapiens
tcacacttatcccactcagtca

SEQ ID NO: 8774734 - DNA, 22 bp, Homo sapiens
tcacagactcaagggcatagga

SEQ ID NO: 8774735 - DNA, 20 bp, Homo sapiens
tcacaggagggaaggcaggt

SEQ ID NO: 8774736 - DNA, 20 bp, Homo sapiens
tcacaggagggaaggcaggt

SEQ ID NO: 8774737 - DNA, 20 bp, Homo sapiens
tcacaggagggaaggcaggt

SEQ ID NO: 8774738 - DNA, 22 bp, Homo sapiens
tcacaggaggactgaaagatat

SEQ ID NO: 8774739 - DNA, 20 bp, Homo sapiens
tcacaggagggaaggcaggt

SEQ ID NO: 8774740 - DNA, 22 bp, Homo sapiens
tcacaggagggagagacaccca

SEQ ID NO: 8774741 - DNA, 22 bp, Homo sapiens
tcacaggagggagagacaccca

SEQ ID NO: 8774742 - DNA, 22 bp, Homo sapiens
tcacagtgtggcaactcacaga

SEQ ID NO: 8774743 - DNA, 22 bp, Homo sapiens
tcacaggagtcaaggaatagta

SEQ ID NO: 8774744 - DNA, 22 bp, Homo sapiens
tcacagtgtggcaactcacaga

SEQ ID NO: 8774745 - DNA, 22 bp, Homo sapiens
tcacagtgtggcaactcacaga

SEQ ID NO: 8774746 - DNA, 22 bp, Homo sapiens
tcacagtgtggcaactcacaga

SEQ ID NO: 8774747 - DNA, 22 bp, Homo sapiens
tcacagttactccttcagatga

SEQ ID NO: 8774748 - DNA, 22 bp, Homo sapiens
tcacagtgttggaatcagagct

SEQ ID NO: 8774749 - DNA, 22 bp, Homo sapiens
tcacagttcatctgataaacta

SEQ ID NO: 8774750 - DNA, 22 bp, Homo sapiens
tcacagttcatctgataaacta

SEQ ID NO: 8774751 - DNA, 22 bp, Homo sapiens
tcacagttcatctgataaacta

SEQ ID NO: 8774752 - DNA, 21 bp, Homo sapiens
tcacagttcaagatgaacccc

SEQ ID NO: 8774753 - DNA, 22 bp, Homo sapiens
tcacagttatagtctgtagaat

SEQ ID NO: 8774754 - DNA, 22 bp, Homo sapiens
cagtgcatgcacacacatggta

SEQ ID NO: 8774755 - DNA, 22 bp, Homo sapiens
cagtgcatgtctgtgtggggat

SEQ ID NO: 8774756 - DNA, 22 bp, Homo sapiens
cagtgccaaggagaaggacagc

SEQ ID NO: 8774757 - DNA, 22 bp, Homo sapiens
cagtgcatatgattctgcagtt

SEQ ID NO: 8774758 - DNA, 22 bp, Homo sapiens
tcacaggagagctgatgctggt

SEQ ID NO: 8774759 - DNA, 22 bp, Homo sapiens
tcacaggagaatgtacttacca

SEQ ID NO: 8774760 - DNA, 22 bp, Homo sapiens
tcacaggaccctgagggtggcg

SEQ ID NO: 8774761 - DNA, 22 bp, Homo sapiens
tcacaggagcccaggggagctg

SEQ ID NO: 8774762 - DNA, 22 bp, Homo sapiens
tcacaggagattatgtgtgcta

SEQ ID NO: 8774763 - DNA, 22 bp, Homo sapiens
tcacaggaaccatcagagaaat

SEQ ID NO: 8774764 - DNA, 22 bp, Homo sapiens
tcacaggaaccatcagagaaat

SEQ ID NO: 8774765 - DNA, 22 bp, Homo sapiens
tcacagctttgagcagagacca

SEQ ID NO: 8774766 - DNA, 22 bp, Homo sapiens
tcacaggaagggtaaatattta

SEQ ID NO: 8774767 - DNA, 20 bp, Homo sapiens
tcacagctggctatgacagg

SEQ ID NO: 8774768 - DNA, 22 bp, Homo sapiens
tcacagctggggttttggcagc

SEQ ID NO: 8774769 - DNA, 22 bp, Homo sapiens
tcacagctgttttgtccattaa

SEQ ID NO: 8774770 - DNA, 22 bp, Homo sapiens
tcacagctgttttgtccattaa

SEQ ID NO: 8774771 - DNA, 22 bp, Homo sapiens
tcacagagaaaagctatcacaa

SEQ ID NO: 8774772 - DNA, 22 bp, Homo sapiens
tcacagagaaatgtggcacaaa

SEQ ID NO: 8774773 - DNA, 22 bp, Homo sapiens
tcacagagaaatgtggcacaaa

SEQ ID NO: 8774774 - DNA, 22 bp, Homo sapiens
tcacagagaaatgtggcacaaa

SEQ ID NO: 8774775 - DNA, 22 bp, Homo sapiens
tcacagacttgtctccagggat

SEQ ID NO: 8774776 - DNA, 22 bp, Homo sapiens
tcacagacttgtctccagggat

SEQ ID NO: 8774777 - DNA, 22 bp, Homo sapiens
tcacagagaaaagctatcacaa

SEQ ID NO: 8774778 - DNA, 18 bp, Homo sapiens
tcacagacttactgggcc

SEQ ID NO: 8774779 - DNA, 18 bp, Homo sapiens
tcacagacttactgggcc

SEQ ID NO: 8774780 - DNA, 22 bp, Homo sapiens
tcacagactgtgttgctactca

SEQ ID NO: 8774781 - DNA, 21 bp, Homo sapiens
tcacagactggtcagtgaggc

SEQ ID NO: 8774782 - DNA, 21 bp, Homo sapiens
tcacagactggtcagtgaggc

SEQ ID NO: 8774783 - DNA, 21 bp, Homo sapiens
tcacagactggtcagtgaggc

SEQ ID NO: 8774784 - DNA, 22 bp, Homo sapiens
tcacagactcttgattgtctaa

SEQ ID NO: 8774785 - DNA, 22 bp, Homo sapiens
caggttcagcaggaggcatccc

SEQ ID NO: 8774786 - DNA, 22 bp, Homo sapiens
caggttagcaacatggttagag

SEQ ID NO: 8774787 - DNA, 22 bp, Homo sapiens
caggttagtaaggtctacataa

SEQ ID NO: 8774788 - DNA, 22 bp, Homo sapiens
caggttagtatttttagttcat

SEQ ID NO: 8774789 - DNA, 15 bp, Homo sapiens
caggttagtttccag

SEQ ID NO: 8774790 - DNA, 22 bp, Homo sapiens
caggttcccttgcagctaagtg

SEQ ID NO: 8774791 - DNA, 22 bp, Homo sapiens
caggttccctagcagcaaagcc

SEQ ID NO: 8774792 - DNA, 22 bp, Homo sapiens
caggttcattctttcttgtatt

SEQ ID NO: 8774793 - DNA, 22 bp, Homo sapiens
caggttagttaatctttgtttc

SEQ ID NO: 8774794 - DNA, 22 bp, Homo sapiens
caggtgtttcaaatgtgaaact

SEQ ID NO: 8774795 - DNA, 22 bp, Homo sapiens
caggtgttgatgtttattgagt

SEQ ID NO: 8774796 - DNA, 22 bp, Homo sapiens
caggtgttgtctaaagcttcag

SEQ ID NO: 8774797 - DNA, 22 bp, Homo sapiens
caggtgttatacatgaaattta

SEQ ID NO: 8774798 - DNA, 22 bp, Homo sapiens
caggtgttgatactaatcgtgg

SEQ ID NO: 8774799 - DNA, 22 bp, Homo sapiens
caggtggtcaggcagatgggct

SEQ ID NO: 8774800 - DNA, 22 bp, Homo sapiens
caggtggtcaggcagatgggct

SEQ ID NO: 8774801 - DNA, 22 bp, Homo sapiens
cagggtgggcacccagcctcca

SEQ ID NO: 8774802 - DNA, 22 bp, Homo sapiens
cagggtgggcacccagcctcca

SEQ ID NO: 8774803 - DNA, 22 bp, Homo sapiens
cagggtggccctgtggtctcat

SEQ ID NO: 8774804 - DNA, 22 bp, Homo sapiens
cagggtggccctgtggtctcat

SEQ ID NO: 8774805 - DNA, 22 bp, Homo sapiens
tatttcattctttatcaggagc

SEQ ID NO: 8774806 - DNA, 22 bp, Homo sapiens
tatttcattctttatcaggagc

SEQ ID NO: 8774807 - DNA, 22 bp, Homo sapiens
tatttccaaaaaggccatattc

SEQ ID NO: 8774808 - DNA, 22 bp, Homo sapiens
tatttccaaaaaggccatattc

SEQ ID NO: 8774809 - DNA, 22 bp, Homo sapiens
tatttcatgtgcaccataattc

SEQ ID NO: 8774810 - DNA, 22 bp, Homo sapiens
tatttcagtcacttcttctctg

SEQ ID NO: 8774811 - DNA, 22 bp, Homo sapiens
tatttataacagtgagaacggg

SEQ ID NO: 8774812 - DNA, 22 bp, Homo sapiens
tatttataacagtgagaacggg

SEQ ID NO: 8774813 - DNA, 22 bp, Homo sapiens
tatttcaggtatggtgtgaaat

SEQ ID NO: 8774814 - DNA, 22 bp, Homo sapiens
tatttataacagtgagaacggg

SEQ ID NO: 8774815 - DNA, 22 bp, Homo sapiens
tatttataacagtgagaacggg

SEQ ID NO: 8774816 - DNA, 22 bp, Homo sapiens
cagtaaaaatgttgtcaaggca

SEQ ID NO: 8774817 - DNA, 22 bp, Homo sapiens
caggtttctagttctaagaata

SEQ ID NO: 8774818 - DNA, 21 bp, Homo sapiens
caggtttgctatggagcagcc

SEQ ID NO: 8774819 - DNA, 22 bp, Homo sapiens
caggttggtcggcaagtacaca

SEQ ID NO: 8774820 - DNA, 22 bp, Homo sapiens
caggttggtcggcaagtacaca

SEQ ID NO: 8774821 - DNA, 22 bp, Homo sapiens
caggttggggacttaggatgac

SEQ ID NO: 8774822 - DNA, 22 bp, Homo sapiens
caggttggtattcatctccaca

SEQ ID NO: 8774823 - DNA, 22 bp, Homo sapiens
caggttggtattcatctccaca

SEQ ID NO: 8774824 - DNA, 22 bp, Homo sapiens
caggttcttgtttcaaacagac

SEQ ID NO: 8774825 - DNA, 22 bp, Homo sapiens
caggttgggatcggttgcaatg

SEQ ID NO: 8774826 - DNA, 22 bp, Homo sapiens
caggttcttaagtaacagcaca

SEQ ID NO: 8774827 - DNA, 22 bp, Homo sapiens
caggttcttaacttgttcttcc

SEQ ID NO: 8774828 - DNA, 22 bp, Homo sapiens
caggttctgggtcctgggtcct

SEQ ID NO: 8774829 - DNA, 22 bp, Homo sapiens
caggttctggggctccactgtg

SEQ ID NO: 8774830 - DNA, 22 bp, Homo sapiens
caggttctatactgaataattt

SEQ ID NO: 8774831 - DNA, 22 bp, Homo sapiens
caggttctcagaaggcagtcac

SEQ ID NO: 8774832 - DNA, 22 bp, Homo sapiens
caggttctcagaaggcagtcac

SEQ ID NO: 8774833 - DNA, 22 bp, Homo sapiens
caggttctgaggatggtgcctg

SEQ ID NO: 8774834 - DNA, 22 bp, Homo sapiens
caggttctggagatgcagagat

SEQ ID NO: 8774835 - DNA, 22 bp, Homo sapiens
caggttctatactgaataattt

SEQ ID NO: 8774836 - DNA, 22 bp, Homo sapiens
tatttctttcaggtatgtgttg

SEQ ID NO: 8774837 - DNA, 22 bp, Homo sapiens
tatttctttcaggtatgtgttg

SEQ ID NO: 8774838 - DNA, 21 bp, Homo sapiens
tatttctttgactctctccct

SEQ ID NO: 8774839 - DNA, 21 bp, Homo sapiens
tatttctttgactctctccct

SEQ ID NO: 8774840 - DNA, 21 bp, Homo sapiens
tatttctttgactctctccct

SEQ ID NO: 8774841 - DNA, 22 bp, Homo sapiens
cagtcccagacatagtaaggga

SEQ ID NO: 8774842 - DNA, 22 bp, Homo sapiens
cagtcccagaagagcctgggag

SEQ ID NO: 8774843 - DNA, 22 bp, Homo sapiens
tatttcttgttccctccaagtt

SEQ ID NO: 8774844 - DNA, 22 bp, Homo sapiens
tatttcttgttccctccaagtt

SEQ ID NO: 8774845 - DNA, 22 bp, Homo sapiens
tatttcttgttccctccaagtt

SEQ ID NO: 8774846 - DNA, 22 bp, Homo sapiens
cagtcccagacccagaaggtgg

SEQ ID NO: 8774847 - DNA, 20 bp, Homo sapiens
cagtccactggagttcctac

SEQ ID NO: 8774848 - DNA, 20 bp, Homo sapiens
cagtccactggagttcctac

SEQ ID NO: 8774849 - DNA, 22 bp, Homo sapiens
cagtcccaaggaggaagcagtc

SEQ ID NO: 8774850 - DNA, 19 bp, Homo sapiens
cagtcccaaattcttgtca

SEQ ID NO: 8774851 - DNA, 19 bp, Homo sapiens
cagtcccaaattcttgtca

SEQ ID NO: 8774852 - DNA, 20 bp, Homo sapiens
cagtcccaatccagggccag

SEQ ID NO: 8774853 - DNA, 22 bp, Homo sapiens
cagtcccaaggaggaagcagtc

SEQ ID NO: 8774854 - DNA, 22 bp, Homo sapiens
cagtcccactagtgccaatacc

SEQ ID NO: 8774855 - DNA, 22 bp, Homo sapiens
cagtcccaccaggatcgctctt

SEQ ID NO: 8774856 - DNA, 22 bp, Homo sapiens
cagtcccacaagatctccacaa

SEQ ID NO: 8774857 - DNA, 22 bp, Homo sapiens
cagtagctaaattattttcatg

SEQ ID NO: 8774858 - DNA, 22 bp, Homo sapiens
cagtagctaaattattttcatg

SEQ ID NO: 8774859 - DNA, 22 bp, Homo sapiens
cagtagctgtctagccttatgg

SEQ ID NO: 8774860 - DNA, 22 bp, Homo sapiens
cagtagcttacttttcttgatc

SEQ ID NO: 8774861 - DNA, 22 bp, Homo sapiens
cagtaggtgctcaacaagtaca

SEQ ID NO: 8774862 - DNA, 22 bp, Homo sapiens
cagtagtagttaaactgtgtat

SEQ ID NO: 8774863 - DNA, 22 bp, Homo sapiens
cagtataatgccccctgtgggg

SEQ ID NO: 8774864 - DNA, 23 bp, Homo sapiens
cagtataatgtatggatggggca

SEQ ID NO: 8774865 - DNA, 22 bp, Homo sapiens
cagtataatgccccctgtgggg

SEQ ID NO: 8774866 - DNA, 22 bp, Homo sapiens
cagtatagaaagttttaaattg

SEQ ID NO: 8774867 - DNA, 18 bp, Homo sapiens
cagtataaccagcaactc

SEQ ID NO: 8774868 - DNA, 22 bp, Homo sapiens
cagtagtggaagggagagaaaa

SEQ ID NO: 8774869 - DNA, 22 bp, Homo sapiens
cagtagtggtctatcactggag

SEQ ID NO: 8774870 - DNA, 22 bp, Homo sapiens
cagtagcatgtaataaagacag

SEQ ID NO: 8774871 - DNA, 22 bp, Homo sapiens
tatttccagaggagtatagaag

SEQ ID NO: 8774872 - DNA, 22 bp, Homo sapiens
tatttccaaaagcctattatga

SEQ ID NO: 8774873 - DNA, 22 bp, Homo sapiens
tagcattccttgtggcttctga

SEQ ID NO: 8774874 - DNA, 22 bp, Homo sapiens
tagcattccatcttggacttgt

SEQ ID NO: 8774875 - DNA, 22 bp, Homo sapiens
tagcgatcaggattaaagtcca

SEQ ID NO: 8774876 - DNA, 22 bp, Homo sapiens
tagcattcagaactgagagcaa

SEQ ID NO: 8774877 - DNA, 22 bp, Homo sapiens
tagcattatttcctctttttgt

SEQ ID NO: 8774878 - DNA, 22 bp, Homo sapiens
tagctaatggtgaagattcaga

SEQ ID NO: 8774879 - DNA, 22 bp, Homo sapiens
tagcaatagaaacatataaagt

SEQ ID NO: 8774880 - DNA, 20 bp, Homo sapiens
tagcaatgagtgttccattt

SEQ ID NO: 8774881 - DNA, 22 bp, Homo sapiens
tagcaatccgttgatcccttgc

SEQ ID NO: 8774882 - DNA, 22 bp, Homo sapiens
tagcaatgctctatgatgaaaa

SEQ ID NO: 8774883 - DNA, 22 bp, Homo sapiens
tagcaatgtgtgtgtataaatt

SEQ ID NO: 8774884 - DNA, 22 bp, Homo sapiens
tagcaatgtaagatgttaacac

SEQ ID NO: 8774885 - DNA, 22 bp, Homo sapiens
tagcaatgcttcattatttaaa

SEQ ID NO: 8774886 - DNA, 22 bp, Homo sapiens
tagcaatgtgtgtgtataaatt

SEQ ID NO: 8774887 - DNA, 22 bp, Homo sapiens
cagggcagaaggcactctactc

SEQ ID NO: 8774888 - DNA, 22 bp, Homo sapiens
tagcaagatccttccctggcgt

SEQ ID NO: 8774889 - DNA, 22 bp, Homo sapiens
tagcaagatgtcactccaagtt

SEQ ID NO: 8774890 - DNA, 22 bp, Homo sapiens
tagcaagatgtcactccaagtt

SEQ ID NO: 8774891 - DNA, 22 bp, Homo sapiens
tagcaagatgatgaattattca

SEQ ID NO: 8774892 - DNA, 22 bp, Homo sapiens
tagcaaggacgtccaaagaact

SEQ ID NO: 8774893 - DNA, 22 bp, Homo sapiens
tagcaaggacaacatatgagag

SEQ ID NO: 8774894 - DNA, 22 bp, Homo sapiens
tagcaaggcgtggcactcaaat

SEQ ID NO: 8774895 - DNA, 22 bp, Homo sapiens
tagcaaggcttccaatgaacag

SEQ ID NO: 8774896 - DNA, 22 bp, Homo sapiens
tagcaagtgttggtgaagatgt

SEQ ID NO: 8774897 - DNA, 22 bp, Homo sapiens
tagcaaggtgaagtatgggtga

SEQ ID NO: 8774898 - DNA, 22 bp, Homo sapiens
tagcaagtatgatactccatga

SEQ ID NO: 8774899 - DNA, 20 bp, Homo sapiens
cagggcacactgcagcctcg

SEQ ID NO: 8774900 - DNA, 20 bp, Homo sapiens
cagggcacactgcagcctcg

SEQ ID NO: 8774901 - DNA, 22 bp, Homo sapiens
cagggcaagtttgagattattt

SEQ ID NO: 8774902 - DNA, 22 bp, Homo sapiens
cagggcacggagaagtcacccc

SEQ ID NO: 8774903 - DNA, 22 bp, Homo sapiens
cagggcacagatcggggcgcac

SEQ ID NO: 8774904 - DNA, 22 bp, Homo sapiens
cagggcacagatcggggcgcac

SEQ ID NO: 8774905 - DNA, 22 bp, Homo sapiens
cagggcacagatcggggcgcac

SEQ ID NO: 8774906 - DNA, 22 bp, Homo sapiens
cagggcagaaggcactctactc

SEQ ID NO: 8774907 - DNA, 22 bp, Homo sapiens
cagggcagaaggcactctactc

SEQ ID NO: 8774908 - DNA, 22 bp, Homo sapiens
cagggcagaacatatagatagt

SEQ ID NO: 8774909 - DNA, 22 bp, Homo sapiens
cagggcacttaaattgcctcgt

SEQ ID NO: 8774910 - DNA, 22 bp, Homo sapiens
cagggcacttaaattgcctcgt

SEQ ID NO: 8774911 - DNA, 22 bp, Homo sapiens
cagggcagaacatatagatagt

SEQ ID NO: 8774912 - DNA, 22 bp, Homo sapiens
cagggatggcgctggctgcccg

SEQ ID NO: 8774913 - DNA, 22 bp, Homo sapiens
tagatacacacacagtcatgtg

SEQ ID NO: 8774914 - DNA, 22 bp, Homo sapiens
tagatacacacacagtcatgtg

SEQ ID NO: 8774915 - DNA, 22 bp, Homo sapiens
tagatacacacacagtcatgtg

SEQ ID NO: 8774916 - DNA, 22 bp, Homo sapiens
cagggatggcgctggctgcccg

SEQ ID NO: 8774917 - DNA, 22 bp, Homo sapiens
cagggcaaagagagcacatgct

SEQ ID NO: 8774918 - DNA, 22 bp, Homo sapiens
cagggcaaagagagcacatgct

SEQ ID NO: 8774919 - DNA, 22 bp, Homo sapiens
cagggcaaagtcttctagaacc

SEQ ID NO: 8774920 - DNA, 21 bp, Homo sapiens
cagggcaaccaagtccagaga

SEQ ID NO: 8774921 - DNA, 22 bp, Homo sapiens
tagataaattagaaagtttact

SEQ ID NO: 8774922 - DNA, 18 bp, Homo sapiens
tagagttactacatgatt

SEQ ID NO: 8774923 - DNA, 18 bp, Homo sapiens
tagagttactacatgatt

SEQ ID NO: 8774924 - DNA, 22 bp, Homo sapiens
tagagttatccttcacaggtat

SEQ ID NO: 8774925 - DNA, 22 bp, Homo sapiens
tagagtgttgtaattgaaaagg

SEQ ID NO: 8774926 - DNA, 22 bp, Homo sapiens
tagataaattagaaagtttact

SEQ ID NO: 8774927 - DNA, 22 bp, Homo sapiens
tagataaaagggcaaagggcat

SEQ ID NO: 8774928 - DNA, 22 bp, Homo sapiens
tagaggagaacacaaattatag

SEQ ID NO: 8774929 - DNA, 19 bp, Homo sapiens
tagaggagaagggaagtgg

SEQ ID NO: 8774930 - DNA, 19 bp, Homo sapiens
tagaggagaagggaagtgg

SEQ ID NO: 8774931 - DNA, 19 bp, Homo sapiens
tagaggagaagggaagtgg

SEQ ID NO: 8774932 - DNA, 22 bp, Homo sapiens
tagagctgggcagtgctctgag

SEQ ID NO: 8774933 - DNA, 17 bp, Homo sapiens
tagagctggttcaggag

SEQ ID NO: 8774934 - DNA, 22 bp, Homo sapiens
tagagcttagagaatgagtttg

SEQ ID NO: 8774935 - DNA, 22 bp, Homo sapiens
tagagctgtatcaaagagcctt

SEQ ID NO: 8774936 - DNA, 22 bp, Homo sapiens
tagagctgtatcaaagagcctt

SEQ ID NO: 8774937 - DNA, 22 bp, Homo sapiens
tagagcttgattggattcaggg

SEQ ID NO: 8774938 - DNA, 22 bp, Homo sapiens
tagagcttggactgcattttcg

SEQ ID NO: 8774939 - DNA, 21 bp, Homo sapiens
tagagcttggcacagagtaga

SEQ ID NO: 8774940 - DNA, 19 bp, Homo sapiens
tagagcttgttttaggaag

SEQ ID NO: 8774941 - DNA, 22 bp, Homo sapiens
tagagctggaatttgcagcaag

SEQ ID NO: 8774942 - DNA, 22 bp, Homo sapiens
tagagctggaatttgcagcaag

SEQ ID NO: 8774943 - DNA, 22 bp, Homo sapiens
tagagctggccgggacagctgg

SEQ ID NO: 8774944 - DNA, 22 bp, Homo sapiens
tagagctgggcagtgctctgag

SEQ ID NO: 8774945 - DNA, 22 bp, Homo sapiens
tagagctggaaaactgcaggta

SEQ ID NO: 8774946 - DNA, 22 bp, Homo sapiens
tagagctggaaaactgcaggta

SEQ ID NO: 8774947 - DNA, 19 bp, Homo sapiens
tagagctgcttcctggcag

SEQ ID NO: 8774948 - DNA, 19 bp, Homo sapiens
tagagctgcttcctggcag

SEQ ID NO: 8774949 - DNA, 21 bp, Homo sapiens
tagaatcactaataagatgta

SEQ ID NO: 8774950 - DNA, 22 bp, Homo sapiens
tagaatcaagcagtagagcaga

SEQ ID NO: 8774951 - DNA, 21 bp, Homo sapiens
tagaatcactaataagatgta

SEQ ID NO: 8774952 - DNA, 22 bp, Homo sapiens
caggctgggcagcctccccggc

SEQ ID NO: 8774953 - DNA, 22 bp, Homo sapiens
caggctgggcagcctccccggc

SEQ ID NO: 8774954 - DNA, 22 bp, Homo sapiens
tagaatcaagcagtagagcaga

SEQ ID NO: 8774955 - DNA, 22 bp, Homo sapiens
tagaatcaagcagtagagcaga

SEQ ID NO: 8774956 - DNA, 22 bp, Homo sapiens
tagaatatgtggtgtatacttt

SEQ ID NO: 8774957 - DNA, 18 bp, Homo sapiens
tagaatcaaatattttac

SEQ ID NO: 8774958 - DNA, 22 bp, Homo sapiens
tagaatatgattaattttctta

SEQ ID NO: 8774959 - DNA, 22 bp, Homo sapiens
tagaatatgattaattttctta

SEQ ID NO: 8774960 - DNA, 22 bp, Homo sapiens
tagaatatgtggtaggatctgg

SEQ ID NO: 8774961 - DNA, 22 bp, Homo sapiens
caggctgggctggtgttagagt

SEQ ID NO: 8774962 - DNA, 22 bp, Homo sapiens
caggctgggctggtgttagagt

SEQ ID NO: 8774963 - DNA, 22 bp, Homo sapiens
caggctgggctggtgttagagt

SEQ ID NO: 8774964 - DNA, 22 bp, Homo sapiens
caggctgggctggtgttagagt

SEQ ID NO: 8774965 - DNA, 22 bp, Homo sapiens
caggctgggctccggagataaa

SEQ ID NO: 8774966 - DNA, 22 bp, Homo sapiens
caggctgggctccggagataaa

SEQ ID NO: 8774967 - DNA, 22 bp, Homo sapiens
caggctgggctccggagataaa

SEQ ID NO: 8774968 - DNA, 22 bp, Homo sapiens
caggctggtcccagagcattgc

SEQ ID NO: 8774969 - DNA, 22 bp, Homo sapiens
tagacattttaagacatatacc

SEQ ID NO: 8774970 - DNA, 22 bp, Homo sapiens
caggctggtcccagagcattgc

SEQ ID NO: 8774971 - DNA, 22 bp, Homo sapiens
tagacattttaagacatatacc

SEQ ID NO: 8774972 - DNA, 22 bp, Homo sapiens
tagacattttctcaacatctct

SEQ ID NO: 8774973 - DNA, 22 bp, Homo sapiens
tagaccaagacagagctgcttt

SEQ ID NO: 8774974 - DNA, 22 bp, Homo sapiens
tagaatactagtgaagtcatcg

SEQ ID NO: 8774975 - DNA, 22 bp, Homo sapiens
tagaatatacactacagcttaa

SEQ ID NO: 8774976 - DNA, 22 bp, Homo sapiens
tagaatatacactacagcttaa

SEQ ID NO: 8774977 - DNA, 22 bp, Homo sapiens
tagaatacagtttaagaactac

SEQ ID NO: 8774978 - DNA, 21 bp, Homo sapiens
tagaatacaggtattttggat

SEQ ID NO: 8774979 - DNA, 22 bp, Homo sapiens
tagaacatcaggttgaatttgg

SEQ ID NO: 8774980 - DNA, 22 bp, Homo sapiens
tagaacatcaggttgaatttgg

SEQ ID NO: 8774981 - DNA, 22 bp, Homo sapiens
tagaataagttgatgatatatg

SEQ ID NO: 8774982 - DNA, 22 bp, Homo sapiens
tagaacataagtcattcatttg

SEQ ID NO: 8774983 - DNA, 22 bp, Homo sapiens
tagaacataagtcattcatttg

SEQ ID NO: 8774984 - DNA, 22 bp, Homo sapiens
caggctggagtgcagtggcgcc

SEQ ID NO: 8774985 - DNA, 22 bp, Homo sapiens
caggctggagtgcagtggcgcc

SEQ ID NO: 8774986 - DNA, 22 bp, Homo sapiens
caggctggagtgcagtggcgcc

SEQ ID NO: 8774987 - DNA, 22 bp, Homo sapiens
caggctggagtgcagtggcgcc

SEQ ID NO: 8774988 - DNA, 22 bp, Homo sapiens
caggctggagtgcagtggcgct

SEQ ID NO: 8774989 - DNA, 22 bp, Homo sapiens
caggctggagtgcagtggcgct

SEQ ID NO: 8774990 - DNA, 22 bp, Homo sapiens
caggctggagtgcagtggcgct

SEQ ID NO: 8774991 - DNA, 22 bp, Homo sapiens
caggctggagtgcagtggcgct

SEQ ID NO: 8774992 - DNA, 22 bp, Homo sapiens
caggctggagtgcagtggggcg

SEQ ID NO: 8774993 - DNA, 22 bp, Homo sapiens
caggctggagtgcagtggggcg

SEQ ID NO: 8774994 - DNA, 22 bp, Homo sapiens
caggctggagtgcagtggggcg

SEQ ID NO: 8774995 - DNA, 22 bp, Homo sapiens
caggctggagtgcaatggcaca

SEQ ID NO: 8774996 - DNA, 22 bp, Homo sapiens
caggctggagtgcaatggtgct

SEQ ID NO: 8774997 - DNA, 22 bp, Homo sapiens
caggctggagtgcaatggtgct

SEQ ID NO: 8774998 - DNA, 22 bp, Homo sapiens
caggctggagtgcaatgacgcc

SEQ ID NO: 8774999 - DNA, 22 bp, Homo sapiens
caggctggagtgagtgtagtgg

SEQ ID NO: 8775000 - DNA, 22 bp, Homo sapiens
caggctggagtgagtgtagtgg

SEQ ID NO: 8775001 - DNA, 22 bp, Homo sapiens
caggctggagtgcaatgacgcc

SEQ ID NO: 8775002 - DNA, 22 bp, Homo sapiens
caggctggagtgcaatgacgcc

SEQ ID NO: 8775003 - DNA, 22 bp, Homo sapiens
caggctggagtgcaatggcaca

SEQ ID NO: 8775004 - DNA, 22 bp, Homo sapiens
caggctggagtgcaatggcaca

SEQ ID NO: 8775005 - DNA, 22 bp, Homo sapiens
caggctggagtgcaatggcaca

SEQ ID NO: 8775006 - DNA, 22 bp, Homo sapiens
caggctggagtgcaatggcaca

SEQ ID NO: 8775007 - DNA, 22 bp, Homo sapiens
caggctggagtgcaatggcaca

SEQ ID NO: 8775008 - DNA, 22 bp, Homo sapiens
caggctggagtacaattgtgtg

SEQ ID NO: 8775009 - DNA, 22 bp, Homo sapiens
caggctggagtacaattgtgtg

SEQ ID NO: 8775010 - DNA, 22 bp, Homo sapiens
caggctgcctggaagaggactg

SEQ ID NO: 8775011 - DNA, 22 bp, Homo sapiens
caggctgcctggaagaggactg

SEQ ID NO: 8775012 - DNA, 22 bp, Homo sapiens
caggctgcctggaagaggactg

SEQ ID NO: 8775013 - DNA, 22 bp, Homo sapiens
caggctgcctggaagaggactg

SEQ ID NO: 8775014 - DNA, 22 bp, Homo sapiens
caggctggagtgagtgtagtgg

SEQ ID NO: 8775015 - DNA, 22 bp, Homo sapiens
tactgtgaatacaaaataaatt

SEQ ID NO: 8775016 - DNA, 22 bp, Homo sapiens
caggctgccgtggggtccaggc

SEQ ID NO: 8775017 - DNA, 22 bp, Homo sapiens
tactgtgcagctgtgctttggg

SEQ ID NO: 8775018 - DNA, 22 bp, Homo sapiens
tactgtctgcttcttatagctt

SEQ ID NO: 8775019 - DNA, 22 bp, Homo sapiens
gtgaggggtctggacgcacagt

SEQ ID NO: 8775020 - DNA, 22 bp, Homo sapiens
gtgaggggtctggacgcacagt

SEQ ID NO: 8775021 - DNA, 22 bp, Homo sapiens
gtgaggggtggctgagcagttt

SEQ ID NO: 8775022 - DNA, 22 bp, Homo sapiens
gtgaggggtggctgagcagttt

SEQ ID NO: 8775023 - DNA, 22 bp, Homo sapiens
gtgaggggtggctgagcagttt

SEQ ID NO: 8775024 - DNA, 22 bp, Homo sapiens
gtgaggggtggctgagcagttt

SEQ ID NO: 8775025 - DNA, 22 bp, Homo sapiens
gtgaggggtggctgagcagttt

SEQ ID NO: 8775026 - DNA, 22 bp, Homo sapiens
tactatttggaattttaaattg

SEQ ID NO: 8775027 - DNA, 22 bp, Homo sapiens
tactatttatggagtggttatt

SEQ ID NO: 8775028 - DNA, 22 bp, Homo sapiens
tacctgaagtaacaatgaatat

SEQ ID NO: 8775029 - DNA, 20 bp, Homo sapiens
cagccctgtgacctggccct

SEQ ID NO: 8775030 - DNA, 20 bp, Homo sapiens
cagccctgtgacctggccct

SEQ ID NO: 8775031 - DNA, 22 bp, Homo sapiens
cagccctgtctatgactgatga

SEQ ID NO: 8775032 - DNA, 20 bp, Homo sapiens
cagccctgtgacctggccct

SEQ ID NO: 8775033 - DNA, 22 bp, Homo sapiens
gtgagggataatatgcggggtt

SEQ ID NO: 8775034 - DNA, 20 bp, Homo sapiens
cagccctgtgacctggccct

SEQ ID NO: 8775035 - DNA, 22 bp, Homo sapiens
gtgagggcagcttggtcagtgt

SEQ ID NO: 8775036 - DNA, 22 bp, Homo sapiens
gtgaggggagtaaagccatgtt

SEQ ID NO: 8775037 - DNA, 22 bp, Homo sapiens
gtgaggggagtaaagccatgtt

SEQ ID NO: 8775038 - DNA, 22 bp, Homo sapiens
gtgaggggagtaaagccatgtt

SEQ ID NO: 8775039 - DNA, 22 bp, Homo sapiens
gtgaggggccaagagtagggca

SEQ ID NO: 8775040 - DNA, 22 bp, Homo sapiens
gtgaggggccaagagtagggca

SEQ ID NO: 8775041 - DNA, 22 bp, Homo sapiens
gtgaggggccaagagtagggca

SEQ ID NO: 8775042 - DNA, 22 bp, Homo sapiens
gtgaggggagtaaagccatgtt

SEQ ID NO: 8775043 - DNA, 22 bp, Homo sapiens
gtgaggggagtaaagccatgtt

SEQ ID NO: 8775044 - DNA, 22 bp, Homo sapiens
tactgtctatacacttgattac

SEQ ID NO: 8775045 - DNA, 22 bp, Homo sapiens
tactgtatttagaaagaactcc

SEQ ID NO: 8775046 - DNA, 22 bp, Homo sapiens
tactgtcattagcattaacttt

SEQ ID NO: 8775047 - DNA, 22 bp, Homo sapiens
tactgtatgaattatgttattt

SEQ ID NO: 8775048 - DNA, 23 bp, Homo sapiens
tactgtatattactgtgttatac

SEQ ID NO: 8775049 - DNA, 22 bp, Homo sapiens
tactgtatgatttcatgtatat

SEQ ID NO: 8775050 - DNA, 22 bp, Homo sapiens
tactgtatactactgctgttct

SEQ ID NO: 8775051 - DNA, 21 bp, Homo sapiens
tactgtatagatgtgttcttg

SEQ ID NO: 8775052 - DNA, 22 bp, Homo sapiens
tactgtatatgcttgtatctga

SEQ ID NO: 8775053 - DNA, 22 bp, Homo sapiens
tactcaaaaagttatgaatcat

SEQ ID NO: 8775054 - DNA, 22 bp, Homo sapiens
tactcaaaaagttatgaatcat

SEQ ID NO: 8775055 - DNA, 22 bp, Homo sapiens
tactcaaaaagttatgaatcat

SEQ ID NO: 8775056 - DNA, 22 bp, Homo sapiens
tactcaaactcactaagacaga

SEQ ID NO: 8775057 - DNA, 22 bp, Homo sapiens
tactcaaactcactaagacaga

SEQ ID NO: 8775058 - DNA, 22 bp, Homo sapiens
tactatttttgcaacgtataca

SEQ ID NO: 8775059 - DNA, 22 bp, Homo sapiens
tactcacattctgtttcttgct

SEQ ID NO: 8775060 - DNA, 22 bp, Homo sapiens
tactcagtttatgatttcaagt

SEQ ID NO: 8775061 - DNA, 22 bp, Homo sapiens
tactcatgactgatgaatacct

SEQ ID NO: 8775062 - DNA, 20 bp, Homo sapiens
tactcacaaatggtttagca

SEQ ID NO: 8775063 - DNA, 22 bp, Homo sapiens
tagggtggttagaaggagtatg

SEQ ID NO: 8775064 - DNA, 22 bp, Homo sapiens
taggtagggaccaccttgggga

SEQ ID NO: 8775065 - DNA, 22 bp, Homo sapiens
taggtagctttggcgtttcttg

SEQ ID NO: 8775066 - DNA, 22 bp, Homo sapiens
taggtagatttaaagattttct

SEQ ID NO: 8775067 - DNA, 22 bp, Homo sapiens
taggtagctttggcgtttcttg

SEQ ID NO: 8775068 - DNA, 22 bp, Homo sapiens
taggtagatatgttgatttgtt

SEQ ID NO: 8775069 - DNA, 22 bp, Homo sapiens
taggtagacaaagaaatgtgtt

SEQ ID NO: 8775070 - DNA, 22 bp, Homo sapiens
taggtacttaagatctcagcta

SEQ ID NO: 8775071 - DNA, 22 bp, Homo sapiens
taggtacattattagatgcatg

SEQ ID NO: 8775072 - DNA, 22 bp, Homo sapiens
taggtactggacataatataag

SEQ ID NO: 8775073 - DNA, 22 bp, Homo sapiens
taggtacttttcaagtaataat

SEQ ID NO: 8775074 - DNA, 22 bp, Homo sapiens
taggtagaatgcattttggatg

SEQ ID NO: 8775075 - DNA, 23 bp, Homo sapiens
taggtagaagttattttcttctc

SEQ ID NO: 8775076 - DNA, 22 bp, Homo sapiens
caggggaagatgccaagggaga

SEQ ID NO: 8775077 - DNA, 22 bp, Homo sapiens
caggggaagatgccaagggaga

SEQ ID NO: 8775078 - DNA, 22 bp, Homo sapiens
caggggacactcctgcttgggc

SEQ ID NO: 8775079 - DNA, 22 bp, Homo sapiens
caggggacagtatggtggatga

SEQ ID NO: 8775080 - DNA, 22 bp, Homo sapiens
caggggacagtatggtggatga

SEQ ID NO: 8775081 - DNA, 22 bp, Homo sapiens
caggggacattaaagctccata

SEQ ID NO: 8775082 - DNA, 22 bp, Homo sapiens
caggggacattaaagctccata

SEQ ID NO: 8775083 - DNA, 22 bp, Homo sapiens
caggggacagtatggtggatga

SEQ ID NO: 8775084 - DNA, 22 bp, Homo sapiens
cagggctttcctgagaagtgat

SEQ ID NO: 8775085 - DNA, 22 bp, Homo sapiens
cagggctttcctgagaagtgat

SEQ ID NO: 8775086 - DNA, 22 bp, Homo sapiens
cagggcttggttggaaccaccc

SEQ ID NO: 8775087 - DNA, 22 bp, Homo sapiens
cagggcttggatctgtggtcag

SEQ ID NO: 8775088 - DNA, 22 bp, Homo sapiens
cagggcttggttggaaccaccc

SEQ ID NO: 8775089 - DNA, 22 bp, Homo sapiens
cagggcttggatctgtggtcag

SEQ ID NO: 8775090 - DNA, 22 bp, Homo sapiens
cagggctttttattagctgcct

SEQ ID NO: 8775091 - DNA, 22 bp, Homo sapiens
cagggctttttattagctgcct

SEQ ID NO: 8775092 - DNA, 22 bp, Homo sapiens
cagggctttgtgtgcctgggga

SEQ ID NO: 8775093 - DNA, 22 bp, Homo sapiens
cagggctttgtgtgcctgggga

SEQ ID NO: 8775094 - DNA, 22 bp, Homo sapiens
cagggctttgaacaggcatcaa

SEQ ID NO: 8775095 - DNA, 22 bp, Homo sapiens
cagggctttcctgagaagtgat

SEQ ID NO: 8775096 - DNA, 22 bp, Homo sapiens
cagggctttcctgagaagtgat

SEQ ID NO: 8775097 - DNA, 22 bp, Homo sapiens
tagggtagtaccatgctgccag

SEQ ID NO: 8775098 - DNA, 22 bp, Homo sapiens
tagggtccaagccttataatta

SEQ ID NO: 8775099 - DNA, 22 bp, Homo sapiens
taggggttacctttagcatctc

SEQ ID NO: 8775100 - DNA, 22 bp, Homo sapiens
tagggtccatatggatgaatgg

SEQ ID NO: 8775101 - DNA, 22 bp, Homo sapiens
tagggtcccagataggagccag

SEQ ID NO: 8775102 - DNA, 22 bp, Homo sapiens
tagggtcctgcctacagagaca

SEQ ID NO: 8775103 - DNA, 22 bp, Homo sapiens
tagggtcctcatctgtaaatga

SEQ ID NO: 8775104 - DNA, 22 bp, Homo sapiens
tagggctccactcccagagatt

SEQ ID NO: 8775105 - DNA, 22 bp, Homo sapiens
tagggctcgggcacaggacagg

SEQ ID NO: 8775106 - DNA, 22 bp, Homo sapiens
tagggctccactcccagagatt

SEQ ID NO: 8775107 - DNA, 22 bp, Homo sapiens
tagggccagataggcttcttga

SEQ ID NO: 8775108 - DNA, 22 bp, Homo sapiens
tagggcctgacattcagtaggt

SEQ ID NO: 8775109 - DNA, 22 bp, Homo sapiens
tagggcagttataacattagtg

SEQ ID NO: 8775110 - DNA, 22 bp, Homo sapiens
tagggcagtttcatgttatctt

SEQ ID NO: 8775111 - DNA, 21 bp, Homo sapiens
tagggcaggcattggaagaga

SEQ ID NO: 8775112 - DNA, 22 bp, Homo sapiens
tagggcaggggaggaatctgaa

SEQ ID NO: 8775113 - DNA, 22 bp, Homo sapiens
tagggcaggtgaagaaaagcta

SEQ ID NO: 8775114 - DNA, 22 bp, Homo sapiens
tagggaaggagaccaagccaca

SEQ ID NO: 8775115 - DNA, 22 bp, Homo sapiens
tagggacaaagagctgaggcct

SEQ ID NO: 8775116 - DNA, 22 bp, Homo sapiens
tagggaagtgtataggggtcat

SEQ ID NO: 8775117 - DNA, 22 bp, Homo sapiens
cagggctccatgcagggactcc

SEQ ID NO: 8775118 - DNA, 22 bp, Homo sapiens
cagggctcatctgtgtgaccag

SEQ ID NO: 8775119 - DNA, 22 bp, Homo sapiens
caggggagtgagtccctctctg

SEQ ID NO: 8775120 - DNA, 22 bp, Homo sapiens
caggggagtgagtccctctctg

SEQ ID NO: 8775121 - DNA, 22 bp, Homo sapiens
caggggagttttatgcaacaga

SEQ ID NO: 8775122 - DNA, 22 bp, Homo sapiens
caggggagttttatgcaacaga

SEQ ID NO: 8775123 - DNA, 22 bp, Homo sapiens
caggggagttttatgcaacaga

SEQ ID NO: 8775124 - DNA, 22 bp, Homo sapiens
caggggacattaaagctccata

SEQ ID NO: 8775125 - DNA, 22 bp, Homo sapiens
caggggagttttatgcaacaga

SEQ ID NO: 8775126 - DNA, 22 bp, Homo sapiens
caggggagttttatgcaacaga

SEQ ID NO: 8775127 - DNA, 22 bp, Homo sapiens
caggggcaagaatgctgtcagc

SEQ ID NO: 8775128 - DNA, 22 bp, Homo sapiens
tagtctggacttcttagtgtca

SEQ ID NO: 8775129 - DNA, 22 bp, Homo sapiens
tagtcttcctggaagaagtgtt

SEQ ID NO: 8775130 - DNA, 22 bp, Homo sapiens
tagtctcttatcaggcacacac

SEQ ID NO: 8775131 - DNA, 22 bp, Homo sapiens
tagtctttcatttggagcattt

SEQ ID NO: 8775132 - DNA, 19 bp, Homo sapiens
tagtctttattcttaattt

SEQ ID NO: 8775133 - DNA, 22 bp, Homo sapiens
tagtgaaacctgacagatcatg

SEQ ID NO: 8775134 - DNA, 22 bp, Homo sapiens
tagtctttttaataaataatgc

SEQ ID NO: 8775135 - DNA, 22 bp, Homo sapiens
tagtgaaatttatgcacagcta

SEQ ID NO: 8775136 - DNA, 22 bp, Homo sapiens
tagtgaaatttatgcacagcta

SEQ ID NO: 8775137 - DNA, 22 bp, Homo sapiens
tagtgaatgttggctattaata

SEQ ID NO: 8775138 - DNA, 22 bp, Homo sapiens
tagtgaaatgataacagagcag

SEQ ID NO: 8775139 - DNA, 22 bp, Homo sapiens
tagtgaaatgagaatgtatgac

SEQ ID NO: 8775140 - DNA, 22 bp, Homo sapiens
tagtgaaagtcaaagacagcta

SEQ ID NO: 8775141 - DNA, 22 bp, Homo sapiens
tagtgaaacctgacagatcatg

SEQ ID NO: 8775142 - DNA, 22 bp, Homo sapiens
tagtgaaagtattaaacagctg

SEQ ID NO: 8775143 - DNA, 22 bp, Homo sapiens
tagtgacctagtgcctggcctt

SEQ ID NO: 8775144 - DNA, 19 bp, Homo sapiens
tagtgagtagtgaattaga

SEQ ID NO: 8775145 - DNA, 22 bp, Homo sapiens
tagtgattccaatgtgaagtgg

SEQ ID NO: 8775146 - DNA, 22 bp, Homo sapiens
tatcagtttaaaatctgtgaat

SEQ ID NO: 8775147 - DNA, 22 bp, Homo sapiens
tatcagtgtgcatctctgaatg

SEQ ID NO: 8775148 - DNA, 20 bp, Homo sapiens
tatcagtaggatattctgcc

SEQ ID NO: 8775149 - DNA, 22 bp, Homo sapiens
tatcataggtgtcataatagca

SEQ ID NO: 8775150 - DNA, 22 bp, Homo sapiens
tatcataggttctgaatgtttc

SEQ ID NO: 8775151 - DNA, 22 bp, Homo sapiens
tatcatcactgtaatccgttga

SEQ ID NO: 8775152 - DNA, 22 bp, Homo sapiens
tatcatgatcagcaactaatca

SEQ ID NO: 8775153 - DNA, 22 bp, Homo sapiens
tatcatcttgttgtcatgcagc

SEQ ID NO: 8775154 - DNA, 22 bp, Homo sapiens
tatcatctgcaaagcacatcta

SEQ ID NO: 8775155 - DNA, 22 bp, Homo sapiens
tatcatttaacagaatcattgc

SEQ ID NO: 8775156 - DNA, 22 bp, Homo sapiens
tatcatttaacagaatcattgc

SEQ ID NO: 8775157 - DNA, 22 bp, Homo sapiens
tatcatttaacagaatcattgc

SEQ ID NO: 8775158 - DNA, 22 bp, Homo sapiens
tatcatttaacagaatcattgc

SEQ ID NO: 8775159 - DNA, 22 bp, Homo sapiens
tatcattatacagacgtataca

SEQ ID NO: 8775160 - DNA, 22 bp, Homo sapiens
tatcattctaattctcctcgta

SEQ ID NO: 8775161 - DNA, 22 bp, Homo sapiens
tatcattctaattctcctcgta

SEQ ID NO: 8775162 - DNA, 22 bp, Homo sapiens
tatcattcttctcacctttgaa

SEQ ID NO: 8775163 - DNA, 22 bp, Homo sapiens
cagggtggcactcagcgcatct

SEQ ID NO: 8775164 - DNA, 22 bp, Homo sapiens
cagggtggcaggcaccatggcc

SEQ ID NO: 8775165 - DNA, 22 bp, Homo sapiens
cagggtggccaggtagataata

SEQ ID NO: 8775166 - DNA, 22 bp, Homo sapiens
cagggctcaggctctgggattc

SEQ ID NO: 8775167 - DNA, 22 bp, Homo sapiens
cagggctcaggctctgggattc

SEQ ID NO: 8775168 - DNA, 22 bp, Homo sapiens
cagggctcagggactgcagaaa

SEQ ID NO: 8775169 - DNA, 22 bp, Homo sapiens
cagggctcagggactgcagaaa

SEQ ID NO: 8775170 - DNA, 22 bp, Homo sapiens
cagggctcagggactgcagaaa

SEQ ID NO: 8775171 - DNA, 22 bp, Homo sapiens
cagggctcactcggctggcgtc

SEQ ID NO: 8775172 - DNA, 22 bp, Homo sapiens
cagggctcactcggctggcgtc

SEQ ID NO: 8775173 - DNA, 22 bp, Homo sapiens
cagggctcactcggctggcgtc

SEQ ID NO: 8775174 - DNA, 22 bp, Homo sapiens
cagggctcaccactgggatcct

SEQ ID NO: 8775175 - DNA, 22 bp, Homo sapiens
cagggctcaccactgggatcct

SEQ ID NO: 8775176 - DNA, 22 bp, Homo sapiens
cagggctagggagccctcctgg

SEQ ID NO: 8775177 - DNA, 22 bp, Homo sapiens
cagggcctgcctggttcctgga

SEQ ID NO: 8775178 - DNA, 22 bp, Homo sapiens
cagggcctgtcacgacgctcat

SEQ ID NO: 8775179 - DNA, 22 bp, Homo sapiens
cagggcctgtacaagtcccacc

SEQ ID NO: 8775180 - DNA, 22 bp, Homo sapiens
cagggcctgtacaagtcccacc

SEQ ID NO: 8775181 - DNA, 22 bp, Homo sapiens
cagggcctgtacaagtcccacc

SEQ ID NO: 8775182 - DNA, 22 bp, Homo sapiens
cagggccttcgtaagtgtccgg

SEQ ID NO: 8775183 - DNA, 22 bp, Homo sapiens
cagggccttgttcaggagtgaa

SEQ ID NO: 8775184 - DNA, 22 bp, Homo sapiens
cagggccttgttcaggagtgaa

SEQ ID NO: 8775185 - DNA, 22 bp, Homo sapiens
cagggccttttagcatcttctc

SEQ ID NO: 8775186 - DNA, 21 bp, Homo sapiens
cagggctagagagaatgacaa

SEQ ID NO: 8775187 - DNA, 22 bp, Homo sapiens
cagggcggggtctgccggccct

SEQ ID NO: 8775188 - DNA, 22 bp, Homo sapiens
cagggcgaacttggcggtgggc

SEQ ID NO: 8775189 - DNA, 22 bp, Homo sapiens
cagggcgaacttggcggtgggc

SEQ ID NO: 8775190 - DNA, 22 bp, Homo sapiens
cagggcctgcttccttcttgtt

SEQ ID NO: 8775191 - DNA, 22 bp, Homo sapiens
cagggcctggagctgggcctgc

SEQ ID NO: 8775192 - DNA, 22 bp, Homo sapiens
cagggcctggagctgggcctgc

SEQ ID NO: 8775193 - DNA, 22 bp, Homo sapiens
cagggcctgcttccttcttgtt

SEQ ID NO: 8775194 - DNA, 22 bp, Homo sapiens
cagggcctcattgtcagtcctg

SEQ ID NO: 8775195 - DNA, 22 bp, Homo sapiens
taggagcctgctctgcagggac

SEQ ID NO: 8775196 - DNA, 22 bp, Homo sapiens
taggagcctgctctgcagggac

SEQ ID NO: 8775197 - DNA, 22 bp, Homo sapiens
taggaggaactttttgtttgga

SEQ ID NO: 8775198 - DNA, 22 bp, Homo sapiens
taggacttggtgactctcaatg

SEQ ID NO: 8775199 - DNA, 22 bp, Homo sapiens
taggacttggtttgaagatttt

SEQ ID NO: 8775200 - DNA, 22 bp, Homo sapiens
taggacttggtgactctcaatg

SEQ ID NO: 8775201 - DNA, 21 bp, Homo sapiens
taggactttacaatttaggaa

SEQ ID NO: 8775202 - DNA, 22 bp, Homo sapiens
taggactttgagaattgttatt

SEQ ID NO: 8775203 - DNA, 22 bp, Homo sapiens
taggactttgagaattgttatt

SEQ ID NO: 8775204 - DNA, 22 bp, Homo sapiens
taggactgataaggggccagag

SEQ ID NO: 8775205 - DNA, 22 bp, Homo sapiens
taggacttagtctaatttttct

SEQ ID NO: 8775206 - DNA, 22 bp, Homo sapiens
taggacttggaaggagctccca

SEQ ID NO: 8775207 - DNA, 22 bp, Homo sapiens
taggacttagaactggaagaca

SEQ ID NO: 8775208 - DNA, 22 bp, Homo sapiens
taggacccctgtggtagatggg

SEQ ID NO: 8775209 - DNA, 19 bp, Homo sapiens
taggaccctggtggccccc

SEQ ID NO: 8775210 - DNA, 19 bp, Homo sapiens
taggaccctggtggccccc

SEQ ID NO: 8775211 - DNA, 22 bp, Homo sapiens
taggaccaggggctgccaggaa

SEQ ID NO: 8775212 - DNA, 22 bp, Homo sapiens
taggaccaagtggagtgcaggt

SEQ ID NO: 8775213 - DNA, 22 bp, Homo sapiens
taggaccagcagggtcagggtc

SEQ ID NO: 8775214 - DNA, 22 bp, Homo sapiens
taggaccaagtggagtgcaggt

SEQ ID NO: 8775215 - DNA, 22 bp, Homo sapiens
taggaccagatcaagactcttg

SEQ ID NO: 8775216 - DNA, 22 bp, Homo sapiens
taggaccaggcttggagatagg

SEQ ID NO: 8775217 - DNA, 18 bp, Homo sapiens
taggagagaatttattta

SEQ ID NO: 8775218 - DNA, 18 bp, Homo sapiens
taggagagaatttattta

SEQ ID NO: 8775219 - DNA, 17 bp, Homo sapiens
taggagactggctgtcc

SEQ ID NO: 8775220 - DNA, 22 bp, Homo sapiens
taggactttggcgtcagaactg

SEQ ID NO: 8775221 - DNA, 22 bp, Homo sapiens
taggactttggcgtcagaactg

SEQ ID NO: 8775222 - DNA, 19 bp, Homo sapiens
taggaccctggtggccccc

SEQ ID NO: 8775223 - DNA, 22 bp, Homo sapiens
taggactttggcgtcagaactg

SEQ ID NO: 8775224 - DNA, 22 bp, Homo sapiens
taggagaagagtcagggcctaa

SEQ ID NO: 8775225 - DNA, 22 bp, Homo sapiens
taggagaagagtcagggcctaa

SEQ ID NO: 8775226 - DNA, 22 bp, Homo sapiens
taggagagctgaactattgtct

SEQ ID NO: 8775227 - DNA, 20 bp, Homo sapiens
taggagcaatgagagtagaa

SEQ ID NO: 8775228 - DNA, 22 bp, Homo sapiens
taggagaggtgaatggcacact

SEQ ID NO: 8775229 - DNA, 22 bp, Homo sapiens
taggagaggtgaatggcacact

SEQ ID NO: 8775230 - DNA, 22 bp, Homo sapiens
tagctatttgagcatattccag

SEQ ID NO: 8775231 - DNA, 22 bp, Homo sapiens
tagctagctgcacaggccctgg

SEQ ID NO: 8775232 - DNA, 22 bp, Homo sapiens
tagctaccattattgagcacct

SEQ ID NO: 8775233 - DNA, 22 bp, Homo sapiens
tagctcctggctgcagggcctc

SEQ ID NO: 8775234 - DNA, 22 bp, Homo sapiens
tagctcagcaggtgggacaggt

SEQ ID NO: 8775235 - DNA, 22 bp, Homo sapiens
tagctcatctaggctaccacag

SEQ ID NO: 8775236 - DNA, 22 bp, Homo sapiens
tagctcatgtaatccgaacata

SEQ ID NO: 8775237 - DNA, 22 bp, Homo sapiens
cagggcagagggaaactccttt

SEQ ID NO: 8775238 - DNA, 22 bp, Homo sapiens
cagggcagagccaggatttcaa

SEQ ID NO: 8775239 - DNA, 22 bp, Homo sapiens
cagggcaggaatttgacattgc

SEQ ID NO: 8775240 - DNA, 22 bp, Homo sapiens
cagggcagcttcctttgttagg

SEQ ID NO: 8775241 - DNA, 22 bp, Homo sapiens
cagggcagagggaaactccttt

SEQ ID NO: 8775242 - DNA, 22 bp, Homo sapiens
cagggcagccaggccccgtggg

SEQ ID NO: 8775243 - DNA, 22 bp, Homo sapiens
cagggcagccaggccccgtggg

SEQ ID NO: 8775244 - DNA, 22 bp, Homo sapiens
taggacataagtattctaactt

SEQ ID NO: 8775245 - DNA, 18 bp, Homo sapiens
taggaacattgattggag

SEQ ID NO: 8775246 - DNA, 22 bp, Homo sapiens
taggaacatatgcagtgctttt

SEQ ID NO: 8775247 - DNA, 22 bp, Homo sapiens
taggaacatatgcagtgctttt

SEQ ID NO: 8775248 - DNA, 22 bp, Homo sapiens
taggaacatgcccttaccttcc

SEQ ID NO: 8775249 - DNA, 22 bp, Homo sapiens
taggaacagtttcaggatgttt

SEQ ID NO: 8775250 - DNA, 22 bp, Homo sapiens
taggaacagtcctagaaatctg

SEQ ID NO: 8775251 - DNA, 22 bp, Homo sapiens
taggaacacatcctcctctagc

SEQ ID NO: 8775252 - DNA, 22 bp, Homo sapiens
taggaacacacatgtgtagctg

SEQ ID NO: 8775253 - DNA, 22 bp, Homo sapiens
taggaacacagggacttgatga

SEQ ID NO: 8775254 - DNA, 22 bp, Homo sapiens
taggaacaagtttccttgctgt

SEQ ID NO: 8775255 - DNA, 22 bp, Homo sapiens
taggaacaagtttccttgctgt

SEQ ID NO: 8775256 - DNA, 22 bp, Homo sapiens
taggaacaactgcaggtacaag

SEQ ID NO: 8775257 - DNA, 22 bp, Homo sapiens
taggaaattggaaactcttcac

SEQ ID NO: 8775258 - DNA, 22 bp, Homo sapiens
taggaaattgccaatatatgac

SEQ ID NO: 8775259 - DNA, 22 bp, Homo sapiens
taggaaattttactggtctggg

SEQ ID NO: 8775260 - DNA, 22 bp, Homo sapiens
taggaacaaaaggttttcctga

SEQ ID NO: 8775261 - DNA, 22 bp, Homo sapiens
taggaacaaagagcctcacatt

SEQ ID NO: 8775262 - DNA, 22 bp, Homo sapiens
taggaaattgccaatatatgac

SEQ ID NO: 8775263 - DNA, 22 bp, Homo sapiens
taggaaattgacacctgcttga

SEQ ID NO: 8775264 - DNA, 22 bp, Homo sapiens
taggaaattagaacttggaaac

SEQ ID NO: 8775265 - DNA, 22 bp, Homo sapiens
taggaaattctcttgctaagtt

SEQ ID NO: 8775266 - DNA, 22 bp, Homo sapiens
cagggcagcttcctttgttagg

SEQ ID NO: 8775267 - DNA, 22 bp, Homo sapiens
cagggcaggaatttgacattgc

SEQ ID NO: 8775268 - DNA, 22 bp, Homo sapiens
tctctgcagctaagaaattaat

SEQ ID NO: 8775269 - DNA, 23 bp, Homo sapiens
tctctgcatgtcctgagcacatc

SEQ ID NO: 8775270 - DNA, 22 bp, Homo sapiens
tctctgcatgacccaaggctga

SEQ ID NO: 8775271 - DNA, 22 bp, Homo sapiens
tctctgcatccccagggctctc

SEQ ID NO: 8775272 - DNA, 22 bp, Homo sapiens
tctctgcatccccagggctctc

SEQ ID NO: 8775273 - DNA, 22 bp, Homo sapiens
tctctgatgattggaagcttag

SEQ ID NO: 8775274 - DNA, 22 bp, Homo sapiens
tctctgatctttaattcagata

SEQ ID NO: 8775275 - DNA, 22 bp, Homo sapiens
tctctgcaactacatcttaggg

SEQ ID NO: 8775276 - DNA, 22 bp, Homo sapiens
tctctgcaagatgagaaatatt

SEQ ID NO: 8775277 - DNA, 22 bp, Homo sapiens
tctctgagttttaaggatgatg

SEQ ID NO: 8775278 - DNA, 22 bp, Homo sapiens
tctctgagttttaaggatgatg

SEQ ID NO: 8775279 - DNA, 22 bp, Homo sapiens
tctctcttgtcaccccatctgc

SEQ ID NO: 8775280 - DNA, 22 bp, Homo sapiens
tctctcttgtcaccccatctgc

SEQ ID NO: 8775281 - DNA, 23 bp, Homo sapiens
tctcctggctgcactgtggccac

SEQ ID NO: 8775282 - DNA, 17 bp, Homo sapiens
tctcctggctctatcag

SEQ ID NO: 8775283 - DNA, 23 bp, Homo sapiens
tctcctggctgcactgtggccac

SEQ ID NO: 8775284 - DNA, 22 bp, Homo sapiens
tctcctggctcaccaggctgga

SEQ ID NO: 8775285 - DNA, 22 bp, Homo sapiens
tctcctggctcaccaggctgga

SEQ ID NO: 8775286 - DNA, 22 bp, Homo sapiens
tctcctggctcaccaggctgga

SEQ ID NO: 8775287 - DNA, 22 bp, Homo sapiens
tctcctggcctttaggttaagg

SEQ ID NO: 8775288 - DNA, 22 bp, Homo sapiens
tctctgcccatcctcagtccac

SEQ ID NO: 8775289 - DNA, 22 bp, Homo sapiens
tctctgggaaatggagaatttt

SEQ ID NO: 8775290 - DNA, 22 bp, Homo sapiens
tctctgggaaatggagaatttt

SEQ ID NO: 8775291 - DNA, 22 bp, Homo sapiens
tctctgggaatgggcctgggta

SEQ ID NO: 8775292 - DNA, 22 bp, Homo sapiens
tctctgggaattcacaagccct

SEQ ID NO: 8775293 - DNA, 22 bp, Homo sapiens
tctctgggaatgggcctgggta

SEQ ID NO: 8775294 - DNA, 22 bp, Homo sapiens
tctctgggaattcacaagccct

SEQ ID NO: 8775295 - DNA, 22 bp, Homo sapiens
tctctgcccaagtttctcaagt

SEQ ID NO: 8775296 - DNA, 22 bp, Homo sapiens
tctctgcccatcctcagtccac

SEQ ID NO: 8775297 - DNA, 22 bp, Homo sapiens
tctctgcccaagtttctcaagt

SEQ ID NO: 8775298 - DNA, 22 bp, Homo sapiens
tctctgccacagcttctgcctt

SEQ ID NO: 8775299 - DNA, 22 bp, Homo sapiens
tctctgccaccatgagatgggc

SEQ ID NO: 8775300 - DNA, 22 bp, Homo sapiens
tctctgggagccaggatgacac

SEQ ID NO: 8775301 - DNA, 22 bp, Homo sapiens
tctctgggacactgggtcagtt

SEQ ID NO: 8775302 - DNA, 22 bp, Homo sapiens
tctctgggagcaattgtttgct

SEQ ID NO: 8775303 - DNA, 22 bp, Homo sapiens
tctctgggagcaattgtttgct

SEQ ID NO: 8775304 - DNA, 22 bp, Homo sapiens
tctctgggagcaattgtttgct

SEQ ID NO: 8775305 - DNA, 22 bp, Homo sapiens
tctctgggacactgggtcagtt

SEQ ID NO: 8775306 - DNA, 22 bp, Homo sapiens
tctctgggacactgggtcagtt

SEQ ID NO: 8775307 - DNA, 22 bp, Homo sapiens
tctctgggacactgggtcagtt

SEQ ID NO: 8775308 - DNA, 22 bp, Homo sapiens
tctctgggaattttttggacat

SEQ ID NO: 8775309 - DNA, 22 bp, Homo sapiens
tctctgggaattttttggacat

SEQ ID NO: 8775310 - DNA, 22 bp, Homo sapiens
tctctgggagttgagcagcagc

SEQ ID NO: 8775311 - DNA, 21 bp, Homo sapiens
tctctgggaggacttgtgaga

SEQ ID NO: 8775312 - DNA, 22 bp, Homo sapiens
tctctgggagttgagcagcagc

SEQ ID NO: 8775313 - DNA, 22 bp, Homo sapiens
tctctgggagttgagcagcagc

SEQ ID NO: 8775314 - DNA, 21 bp, Homo sapiens
tctctgggaggacttgtgaga

SEQ ID NO: 8775315 - DNA, 22 bp, Homo sapiens
tctctgggagccaggatgacac

SEQ ID NO: 8775316 - DNA, 22 bp, Homo sapiens
tctctgggagccaggatgacac

SEQ ID NO: 8775317 - DNA, 22 bp, Homo sapiens
tctctgggagccaggatgacac

SEQ ID NO: 8775318 - DNA, 22 bp, Homo sapiens
tctctgggagccaggatgacac

SEQ ID NO: 8775319 - DNA, 21 bp, Homo sapiens
tctctgggaggacttgtgaga

SEQ ID NO: 8775320 - DNA, 22 bp, Homo sapiens
ccagcagcccctcaatgatctg

SEQ ID NO: 8775321 - DNA, 22 bp, Homo sapiens
ccagcagcccacaggcgtccct

SEQ ID NO: 8775322 - DNA, 22 bp, Homo sapiens
ccagcagcccacaggcgtccct

SEQ ID NO: 8775323 - DNA, 22 bp, Homo sapiens
ccagcagcccacaggcgtccct

SEQ ID NO: 8775324 - DNA, 22 bp, Homo sapiens
ccagcagcgatagggtgagtgc

SEQ ID NO: 8775325 - DNA, 22 bp, Homo sapiens
ccagcagccctcttccaagact

SEQ ID NO: 8775326 - DNA, 22 bp, Homo sapiens
ccagcagccctcttccaagact

SEQ ID NO: 8775327 - DNA, 22 bp, Homo sapiens
ccagcagccctcttccaagact

SEQ ID NO: 8775328 - DNA, 22 bp, Homo sapiens
ccagcagccctcttccaagact

SEQ ID NO: 8775329 - DNA, 22 bp, Homo sapiens
ccagcagcatcctgcagcactt

SEQ ID NO: 8775330 - DNA, 22 bp, Homo sapiens
ccagcagcatcctgcagcactt

SEQ ID NO: 8775331 - DNA, 22 bp, Homo sapiens
ccagcagcatcctgcagcactt

SEQ ID NO: 8775332 - DNA, 22 bp, Homo sapiens
ccagcagcaggccaggccctcc

SEQ ID NO: 8775333 - DNA, 22 bp, Homo sapiens
ccagcagccagagaaggacctc

SEQ ID NO: 8775334 - DNA, 22 bp, Homo sapiens
ccagcagccagagaaggacctc

SEQ ID NO: 8775335 - DNA, 22 bp, Homo sapiens
ccagcagccaccttctcgaaat

SEQ ID NO: 8775336 - DNA, 22 bp, Homo sapiens
ccagcagccaccttctcgaaat

SEQ ID NO: 8775337 - DNA, 22 bp, Homo sapiens
ccagcagcagcgtccaaggaga

SEQ ID NO: 8775338 - DNA, 22 bp, Homo sapiens
ccagcagcagcgtccaaggaga

SEQ ID NO: 8775339 - DNA, 22 bp, Homo sapiens
ccagcagcagcgtccaaggaga

SEQ ID NO: 8775340 - DNA, 22 bp, Homo sapiens
ccagcagagttggtttctggta

SEQ ID NO: 8775341 - DNA, 22 bp, Homo sapiens
ccagcagagtctaggaaggagg

SEQ ID NO: 8775342 - DNA, 22 bp, Homo sapiens
ccagcagagtggggtttagagt

SEQ ID NO: 8775343 - DNA, 22 bp, Homo sapiens
ccagcagagttggtttctggta

SEQ ID NO: 8775344 - DNA, 22 bp, Homo sapiens
ccagcagagtctaggaaggagg

SEQ ID NO: 8775345 - DNA, 22 bp, Homo sapiens
ccagcagagtctaggaaggagg

SEQ ID NO: 8775346 - DNA, 22 bp, Homo sapiens
ccagcagagggtcttggccatt

SEQ ID NO: 8775347 - DNA, 22 bp, Homo sapiens
ccagcagagggtcttggccatt

SEQ ID NO: 8775348 - DNA, 22 bp, Homo sapiens
ccagcagaggggcggagtgcag

SEQ ID NO: 8775349 - DNA, 22 bp, Homo sapiens
ccagcagaggggcggagtgcag

SEQ ID NO: 8775350 - DNA, 22 bp, Homo sapiens
ccagcactgctctcagactgag

SEQ ID NO: 8775351 - DNA, 22 bp, Homo sapiens
ccagcactgctctcagactgag

SEQ ID NO: 8775352 - DNA, 21 bp, Homo sapiens
ccagcagctcaaggatctctt

SEQ ID NO: 8775353 - DNA, 21 bp, Homo sapiens
ccagcagctcaaggatctctt

SEQ ID NO: 8775354 - DNA, 22 bp, Homo sapiens
ccagcagctcagctactggtca

SEQ ID NO: 8775355 - DNA, 22 bp, Homo sapiens
ccagcagctccctcagggtccg

SEQ ID NO: 8775356 - DNA, 22 bp, Homo sapiens
ccagcagctccctcagggtccg

SEQ ID NO: 8775357 - DNA, 22 bp, Homo sapiens
ccagcagctccctcagggtccg

SEQ ID NO: 8775358 - DNA, 22 bp, Homo sapiens
ccagcagctccctcagggtccg

SEQ ID NO: 8775359 - DNA, 22 bp, Homo sapiens
ccagcagctgacaccagtccca

SEQ ID NO: 8775360 - DNA, 22 bp, Homo sapiens
ccagcagctgacaccagtccca

SEQ ID NO: 8775361 - DNA, 22 bp, Homo sapiens
ccagcagctgacaccagtccca

SEQ ID NO: 8775362 - DNA, 22 bp, Homo sapiens
ccagcagctgctatgtggtttt

SEQ ID NO: 8775363 - DNA, 22 bp, Homo sapiens
ccagcagctgcaaagcctgggt

SEQ ID NO: 8775364 - DNA, 22 bp, Homo sapiens
ccagcagctgcaaagcctgggt

SEQ ID NO: 8775365 - DNA, 22 bp, Homo sapiens
ccagcagctgcaaagcctgggt

SEQ ID NO: 8775366 - DNA, 22 bp, Homo sapiens
ccagcagctgtggctttgcctc

SEQ ID NO: 8775367 - DNA, 22 bp, Homo sapiens
ccagcagctttattggctctcc

SEQ ID NO: 8775368 - DNA, 22 bp, Homo sapiens
ccagcagctttattggctctcc

SEQ ID NO: 8775369 - DNA, 22 bp, Homo sapiens
ccagcagggcagtgccctggac

SEQ ID NO: 8775370 - DNA, 22 bp, Homo sapiens
ccagcagggcagtgccctggac

SEQ ID NO: 8775371 - DNA, 23 bp, Homo sapiens
tctgaattatctcattttcagag

SEQ ID NO: 8775372 - DNA, 22 bp, Homo sapiens
tctgaattaatcatgcctcttt

SEQ ID NO: 8775373 - DNA, 22 bp, Homo sapiens
tctgaattaggggttttcaggt

SEQ ID NO: 8775374 - DNA, 22 bp, Homo sapiens
tctgaatatgtttatcatctct

SEQ ID NO: 8775375 - DNA, 22 bp, Homo sapiens
tctgaatcacagtcattcagct

SEQ ID NO: 8775376 - DNA, 22 bp, Homo sapiens
tctgaattaactggggttgcca

SEQ ID NO: 8775377 - DNA, 22 bp, Homo sapiens
tctgaattaaaccctttgtgcc

SEQ ID NO: 8775378 - DNA, 19 bp, Homo sapiens
tctgaagtccagggcatac

SEQ ID NO: 8775379 - DNA, 22 bp, Homo sapiens
tctgaataatgtccttgtatca

SEQ ID NO: 8775380 - DNA, 22 bp, Homo sapiens
tctgaagttcttaaattagttt

SEQ ID NO: 8775381 - DNA, 22 bp, Homo sapiens
tctgaatatgtttatcatctct

SEQ ID NO: 8775382 - DNA, 17 bp, Homo sapiens
tctgaatttatactttg

SEQ ID NO: 8775383 - DNA, 22 bp, Homo sapiens
tctgaatttagtgattagcttt

SEQ ID NO: 8775384 - DNA, 20 bp, Homo sapiens
tctgaattgagtgaatgtct

SEQ ID NO: 8775385 - DNA, 22 bp, Homo sapiens
ccagcatccctggggttggcca

SEQ ID NO: 8775386 - DNA, 22 bp, Homo sapiens
tctgaatttcccaaggctatct

SEQ ID NO: 8775387 - DNA, 22 bp, Homo sapiens
ccagcatccatgctccctcggg

SEQ ID NO: 8775388 - DNA, 18 bp, Homo sapiens
ccagcatgccagaggctg

SEQ ID NO: 8775389 - DNA, 18 bp, Homo sapiens
ccagcatgccagaggctg

SEQ ID NO: 8775390 - DNA, 18 bp, Homo sapiens
ccagcatgccagaggctg

SEQ ID NO: 8775391 - DNA, 22 bp, Homo sapiens
ccagcatgagacgatgatgaag

SEQ ID NO: 8775392 - DNA, 22 bp, Homo sapiens
ccagcatgagacgatgatgaag

SEQ ID NO: 8775393 - DNA, 22 bp, Homo sapiens
ccagcatctatgtgctgttgat

SEQ ID NO: 8775394 - DNA, 22 bp, Homo sapiens
ccagcatctatgtgctgttgat

SEQ ID NO: 8775395 - DNA, 22 bp, Homo sapiens
ccagcatcctcagctcacttct

SEQ ID NO: 8775396 - DNA, 22 bp, Homo sapiens
ccagcatctaacgctcctggga

SEQ ID NO: 8775397 - DNA, 22 bp, Homo sapiens
tctctgttcatggcactatgtc

SEQ ID NO: 8775398 - DNA, 22 bp, Homo sapiens
tctcttaaaagagtaatagaga

SEQ ID NO: 8775399 - DNA, 22 bp, Homo sapiens
tctcttaaaagattttaatgac

SEQ ID NO: 8775400 - DNA, 22 bp, Homo sapiens
tctctgttcatggcactatgtc

SEQ ID NO: 8775401 - DNA, 22 bp, Homo sapiens
tctctgtgttgcaggaaaatct

SEQ ID NO: 8775402 - DNA, 22 bp, Homo sapiens
tctcttaaaggtcttcagctga

SEQ ID NO: 8775403 - DNA, 22 bp, Homo sapiens
tctcttaactccaccagtgcag

SEQ ID NO: 8775404 - DNA, 22 bp, Homo sapiens
tctcttaaatacttcacatctc

SEQ ID NO: 8775405 - DNA, 22 bp, Homo sapiens
tctcttaaaggtcttcagctga

SEQ ID NO: 8775406 - DNA, 22 bp, Homo sapiens
tctcttaaaggtcttcagctga

SEQ ID NO: 8775407 - DNA, 22 bp, Homo sapiens
tctctgtgtgtgtgacagcatt

SEQ ID NO: 8775408 - DNA, 22 bp, Homo sapiens
tctctgtgtgtgtgacagcatt

SEQ ID NO: 8775409 - DNA, 22 bp, Homo sapiens
tctctgtgtgttggctgtatat

SEQ ID NO: 8775410 - DNA, 22 bp, Homo sapiens
tctctgtgtgttggctgtatat

SEQ ID NO: 8775411 - DNA, 22 bp, Homo sapiens
ccagcaggtgtagggctcatgg

SEQ ID NO: 8775412 - DNA, 22 bp, Homo sapiens
ccagcagggttggtttcttctg

SEQ ID NO: 8775413 - DNA, 22 bp, Homo sapiens
tctctgtgtgccttcatctgcc

SEQ ID NO: 8775414 - DNA, 23 bp, Homo sapiens
tctctgtgtgcctcagtttcttc

SEQ ID NO: 8775415 - DNA, 19 bp, Homo sapiens
ccagcaggttcatttcagg

SEQ ID NO: 8775416 - DNA, 22 bp, Homo sapiens
ccagcatcagcacccaaggagc

SEQ ID NO: 8775417 - DNA, 22 bp, Homo sapiens
tctgagaggtgaattcagcaaa

SEQ ID NO: 8775418 - DNA, 22 bp, Homo sapiens
tctgagagctctggggcccctt

SEQ ID NO: 8775419 - DNA, 22 bp, Homo sapiens
tctgagagctgtagaagcctat

SEQ ID NO: 8775420 - DNA, 22 bp, Homo sapiens
tctgagagctgtagaagcctat

SEQ ID NO: 8775421 - DNA, 22 bp, Homo sapiens
tctgagagcaaggcattagcag

SEQ ID NO: 8775422 - DNA, 21 bp, Homo sapiens
tctgagagcaactgcccttta

SEQ ID NO: 8775423 - DNA, 22 bp, Homo sapiens
tctgagagcaggaggagctgct

SEQ ID NO: 8775424 - DNA, 22 bp, Homo sapiens
tctgagagcaggaggagctgct

SEQ ID NO: 8775425 - DNA, 22 bp, Homo sapiens
tctgagagccactgaacagcaa

SEQ ID NO: 8775426 - DNA, 22 bp, Homo sapiens
tctgagagcatcactggggtac

SEQ ID NO: 8775427 - DNA, 22 bp, Homo sapiens
tctgcagaagccatggccttgc

SEQ ID NO: 8775428 - DNA, 22 bp, Homo sapiens
tctgcagaaggaatcagctgag

SEQ ID NO: 8775429 - DNA, 19 bp, Homo sapiens
tctgcagaaggcatacatg

SEQ ID NO: 8775430 - DNA, 22 bp, Homo sapiens
tctgagagtctctgaggcagat

SEQ ID NO: 8775431 - DNA, 22 bp, Homo sapiens
tctgatataaaagtgacattca

SEQ ID NO: 8775432 - DNA, 22 bp, Homo sapiens
tctgatataaaagtgacattca

SEQ ID NO: 8775433 - DNA, 22 bp, Homo sapiens
tctgatatcgcactaaactctg

SEQ ID NO: 8775434 - DNA, 22 bp, Homo sapiens
tctgagagtctctgaggcagat

SEQ ID NO: 8775435 - DNA, 22 bp, Homo sapiens
tctgagagtctctgaggcagat

SEQ ID NO: 8775436 - DNA, 22 bp, Homo sapiens
tctgagagtccatctccaagcc

SEQ ID NO: 8775437 - DNA, 22 bp, Homo sapiens
tctgagagtacgggctgcgcgc

SEQ ID NO: 8775438 - DNA, 22 bp, Homo sapiens
ccagccctcactgaggcctctc

SEQ ID NO: 8775439 - DNA, 22 bp, Homo sapiens
ccagccctcactgaggcctctc

SEQ ID NO: 8775440 - DNA, 22 bp, Homo sapiens
ccagccctcactgaggcctctc

SEQ ID NO: 8775441 - DNA, 22 bp, Homo sapiens
ccagccctgcctctcagggccc

SEQ ID NO: 8775442 - DNA, 22 bp, Homo sapiens
ccagccctgcctctcagggccc

SEQ ID NO: 8775443 - DNA, 20 bp, Homo sapiens
ccagcatgtacacatgtgga

SEQ ID NO: 8775444 - DNA, 20 bp, Homo sapiens
ccagcatgtacacatgtgga

SEQ ID NO: 8775445 - DNA, 22 bp, Homo sapiens
ccagcatgctcagtctaaattg

SEQ ID NO: 8775446 - DNA, 22 bp, Homo sapiens
ccagcatggcacctgagatgag

SEQ ID NO: 8775447 - DNA, 22 bp, Homo sapiens
ccagcatgctcagtctaaattg

SEQ ID NO: 8775448 - DNA, 22 bp, Homo sapiens
ccagcccttagataaacctggc

SEQ ID NO: 8775449 - DNA, 22 bp, Homo sapiens
ccagccctgtttatgtgtcact

SEQ ID NO: 8775450 - DNA, 19 bp, Homo sapiens
ccagccctgtcacttcttg

SEQ ID NO: 8775451 - DNA, 19 bp, Homo sapiens
ccagccctgtcacttcttg

SEQ ID NO: 8775452 - DNA, 19 bp, Homo sapiens
ccagccctgtcacttcttg

SEQ ID NO: 8775453 - DNA, 22 bp, Homo sapiens
ccagccctgtttatgtgtcact

SEQ ID NO: 8775454 - DNA, 22 bp, Homo sapiens
ccagccctgtttatgtgtcact

SEQ ID NO: 8775455 - DNA, 22 bp, Homo sapiens
ccagccctgtaaggatgaggca

SEQ ID NO: 8775456 - DNA, 22 bp, Homo sapiens
ccagccctgtaaggatgaggca

SEQ ID NO: 8775457 - DNA, 22 bp, Homo sapiens
ccagccctgtcaccaactggag

SEQ ID NO: 8775458 - DNA, 22 bp, Homo sapiens
ccagccctgtcaccaactggag

SEQ ID NO: 8775459 - DNA, 19 bp, Homo sapiens
ccagccctgtcacttcttg

SEQ ID NO: 8775460 - DNA, 22 bp, Homo sapiens
tctatattccagatacagatta

SEQ ID NO: 8775461 - DNA, 22 bp, Homo sapiens
tctcaaattcccttttcctcct

SEQ ID NO: 8775462 - DNA, 22 bp, Homo sapiens
tctcaaatgtaaagcatgattt

SEQ ID NO: 8775463 - DNA, 18 bp, Homo sapiens
tctatatggacatagaga

SEQ ID NO: 8775464 - DNA, 22 bp, Homo sapiens
tctatataacctccacttctac

SEQ ID NO: 8775465 - DNA, 16 bp, Homo sapiens
ccacctgcagctctca

SEQ ID NO: 8775466 - DNA, 22 bp, Homo sapiens
ccacctgagataagagagctca

SEQ ID NO: 8775467 - DNA, 22 bp, Homo sapiens
ccacctcctcggccatgtgacg

SEQ ID NO: 8775468 - DNA, 22 bp, Homo sapiens
ccacctccacctattgccagcc

SEQ ID NO: 8775469 - DNA, 22 bp, Homo sapiens
ccacctccacctattgccagcc

SEQ ID NO: 8775470 - DNA, 22 bp, Homo sapiens
ccacctccacctattgccagcc

SEQ ID NO: 8775471 - DNA, 22 bp, Homo sapiens
tctcaacagtgcaagctgctcc

SEQ ID NO: 8775472 - DNA, 22 bp, Homo sapiens
tctcaaatttgttagataaaat

SEQ ID NO: 8775473 - DNA, 22 bp, Homo sapiens
tctcaaatttgctggaccagta

SEQ ID NO: 8775474 - DNA, 22 bp, Homo sapiens
tctcaaatttatacagagttca

SEQ ID NO: 8775475 - DNA, 22 bp, Homo sapiens
tctcaagctactaccttggatc

SEQ ID NO: 8775476 - DNA, 22 bp, Homo sapiens
tctcaagcttgttggtatgttt

SEQ ID NO: 8775477 - DNA, 21 bp, Homo sapiens
tctcaacttttctctttgggc

SEQ ID NO: 8775478 - DNA, 22 bp, Homo sapiens
tctcaactttgagaaacattgt

SEQ ID NO: 8775479 - DNA, 22 bp, Homo sapiens
ccacttttttctccatctctga

SEQ ID NO: 8775480 - DNA, 22 bp, Homo sapiens
tctccacaagtgttgagagtac

SEQ ID NO: 8775481 - DNA, 20 bp, Homo sapiens
tctcagtttctagagtcagg

SEQ ID NO: 8775482 - DNA, 20 bp, Homo sapiens
tctccaccacagagagcaga

SEQ ID NO: 8775483 - DNA, 22 bp, Homo sapiens
tctccacgtgatggagtccagg

SEQ ID NO: 8775484 - DNA, 22 bp, Homo sapiens
tctccacactttctctcccagg

SEQ ID NO: 8775485 - DNA, 22 bp, Homo sapiens
tctccacaccagaaggagctga

SEQ ID NO: 8775486 - DNA, 22 bp, Homo sapiens
tctccacaccagaaggagctga

SEQ ID NO: 8775487 - DNA, 22 bp, Homo sapiens
ccactttgcaagatattcagag

SEQ ID NO: 8775488 - DNA, 22 bp, Homo sapiens
ccactttgagaagctgatgaaa

SEQ ID NO: 8775489 - DNA, 22 bp, Homo sapiens
ccactttgagaagctgatgaaa

SEQ ID NO: 8775490 - DNA, 18 bp, Homo sapiens
ccactttgcagcctggcc

SEQ ID NO: 8775491 - DNA, 22 bp, Homo sapiens
ccactttctgagggaacagcag

SEQ ID NO: 8775492 - DNA, 22 bp, Homo sapiens
ccactttgaaccactgaggtgg

SEQ ID NO: 8775493 - DNA, 22 bp, Homo sapiens
tctcaagcttgttggtatgttt

SEQ ID NO: 8775494 - DNA, 22 bp, Homo sapiens
ccactttgtaatgtgttatgtt

SEQ ID NO: 8775495 - DNA, 19 bp, Homo sapiens
ccactttgcttctctgggt

SEQ ID NO: 8775496 - DNA, 19 bp, Homo sapiens
ccactttgcttctctgggt

SEQ ID NO: 8775497 - DNA, 22 bp, Homo sapiens
ccacttttgggaacagtgagta

SEQ ID NO: 8775498 - DNA, 22 bp, Homo sapiens
ccactttttcagtgtgcatgca

SEQ ID NO: 8775499 - DNA, 22 bp, Homo sapiens
ccacttttgggaacagtgagta

SEQ ID NO: 8775500 - DNA, 18 bp, Homo sapiens
tctccacttctgtgagaa

SEQ ID NO: 8775501 - DNA, 22 bp, Homo sapiens
tctccagaaatggggctgggga

SEQ ID NO: 8775502 - DNA, 22 bp, Homo sapiens
tctccagagtaaccttggagca

SEQ ID NO: 8775503 - DNA, 19 bp, Homo sapiens
tctccagctttgggctttt

SEQ ID NO: 8775504 - DNA, 19 bp, Homo sapiens
tctccagctttgggctttt

SEQ ID NO: 8775505 - DNA, 22 bp, Homo sapiens
tctccaggaaagacactggact

SEQ ID NO: 8775506 - DNA, 22 bp, Homo sapiens
tctccaggaaagacactggact

SEQ ID NO: 8775507 - DNA, 21 bp, Homo sapiens
ccagagagagggaagtgggtt

SEQ ID NO: 8775508 - DNA, 21 bp, Homo sapiens
ccagagagagggaagtgggtt

SEQ ID NO: 8775509 - DNA, 22 bp, Homo sapiens
ccagagagagaggtcaatggca

SEQ ID NO: 8775510 - DNA, 19 bp, Homo sapiens
ccagagagctaggtacaga

SEQ ID NO: 8775511 - DNA, 19 bp, Homo sapiens
ccagagagctaggtacaga

SEQ ID NO: 8775512 - DNA, 19 bp, Homo sapiens
ccagagagctaggtacaga

SEQ ID NO: 8775513 - DNA, 22 bp, Homo sapiens
ccagagagctacaaggcataaa

SEQ ID NO: 8775514 - DNA, 19 bp, Homo sapiens
ccagagagctaggtacaga

SEQ ID NO: 8775515 - DNA, 22 bp, Homo sapiens
ccagagagctacaaggcataaa

SEQ ID NO: 8775516 - DNA, 22 bp, Homo sapiens
ccagagagattgcttctaaaga

SEQ ID NO: 8775517 - DNA, 22 bp, Homo sapiens
ccagagagctacaaggcataaa

SEQ ID NO: 8775518 - DNA, 22 bp, Homo sapiens
ccagagagagtactgggctctg

SEQ ID NO: 8775519 - DNA, 22 bp, Homo sapiens
ccagagagagtactgggctctg

SEQ ID NO: 8775520 - DNA, 21 bp, Homo sapiens
ccagagagagggaagtgggtt

SEQ ID NO: 8775521 - DNA, 21 bp, Homo sapiens
ccagagagagggaagtgggtt

SEQ ID NO: 8775522 - DNA, 22 bp, Homo sapiens
ccagagagagtactgggctctg

SEQ ID NO: 8775523 - DNA, 22 bp, Homo sapiens
ccagagagagtactgggctctg

SEQ ID NO: 8775524 - DNA, 22 bp, Homo sapiens
ccagagagagtactgggctctg

SEQ ID NO: 8775525 - DNA, 22 bp, Homo sapiens
tctccctctttgtctgctttgg

SEQ ID NO: 8775526 - DNA, 20 bp, Homo sapiens
tctccctgcccatctcagat

SEQ ID NO: 8775527 - DNA, 22 bp, Homo sapiens
tctccctggagccctgaagcat

SEQ ID NO: 8775528 - DNA, 16 bp, Homo sapiens
tctccctgttctccaa

SEQ ID NO: 8775529 - DNA, 22 bp, Homo sapiens
tctccctgtggaggacccctta

SEQ ID NO: 8775530 - DNA, 22 bp, Homo sapiens
tctccctcattcctgcttccat

SEQ ID NO: 8775531 - DNA, 22 bp, Homo sapiens
tctccctctttgtctgctttgg

SEQ ID NO: 8775532 - DNA, 22 bp, Homo sapiens
tctccctctttgtctgctttgg

SEQ ID NO: 8775533 - DNA, 22 bp, Homo sapiens
tctccctctgtaagatcagggg

SEQ ID NO: 8775534 - DNA, 22 bp, Homo sapiens
tctccctctgtaagatcagggg

SEQ ID NO: 8775535 - DNA, 22 bp, Homo sapiens
tctccctctcagatttattcac

SEQ ID NO: 8775536 - DNA, 22 bp, Homo sapiens
tctccctctcagatttattcac

SEQ ID NO: 8775537 - DNA, 22 bp, Homo sapiens
tctcccacagtctcccatggct

SEQ ID NO: 8775538 - DNA, 22 bp, Homo sapiens
ccagagaggccttggcaagaca

SEQ ID NO: 8775539 - DNA, 22 bp, Homo sapiens
ccagagaggccaaggtcgtggt

SEQ ID NO: 8775540 - DNA, 22 bp, Homo sapiens
ccagagaggccaaggtcgtggt

SEQ ID NO: 8775541 - DNA, 22 bp, Homo sapiens
ccagagaggcaaaactccttcc

SEQ ID NO: 8775542 - DNA, 22 bp, Homo sapiens
ccagagaggccaaggtcgtggt

SEQ ID NO: 8775543 - DNA, 22 bp, Homo sapiens
ccaccagctttgccaccctgct

SEQ ID NO: 8775544 - DNA, 22 bp, Homo sapiens
ccaccagctttgccaccctgct

SEQ ID NO: 8775545 - DNA, 22 bp, Homo sapiens
ccaccagctttggcggtgacag

SEQ ID NO: 8775546 - DNA, 22 bp, Homo sapiens
ccaccagctttgccaccctgct

SEQ ID NO: 8775547 - DNA, 22 bp, Homo sapiens
tcgctgaggctgcacggctgcc

SEQ ID NO: 8775548 - DNA, 22 bp, Homo sapiens
tcgctgaggctgcacggctgcc

SEQ ID NO: 8775549 - DNA, 22 bp, Homo sapiens
tcgctgaggctgcacggctgcc

SEQ ID NO: 8775550 - DNA, 22 bp, Homo sapiens
tcgctctagagtgcagcgcttt

SEQ ID NO: 8775551 - DNA, 22 bp, Homo sapiens
tcgctcaggcttgagtgtagtg

SEQ ID NO: 8775552 - DNA, 22 bp, Homo sapiens
tcgcgggttgcacatggccatc

SEQ ID NO: 8775553 - DNA, 22 bp, Homo sapiens
tcgcgcagtgcacggcactggg

SEQ ID NO: 8775554 - DNA, 18 bp, Homo sapiens
tcctttcaccccttctct

SEQ ID NO: 8775555 - DNA, 22 bp, Homo sapiens
tcgcctccaaagagttcctgag

SEQ ID NO: 8775556 - DNA, 22 bp, Homo sapiens
tcgcctgcagtggtttagggac

SEQ ID NO: 8775557 - DNA, 22 bp, Homo sapiens
tcgcctgctgtttaacctagga

SEQ ID NO: 8775558 - DNA, 22 bp, Homo sapiens
ccaccaagtcccactataattt

SEQ ID NO: 8775559 - DNA, 22 bp, Homo sapiens
ccaccaagtcccactataattt

SEQ ID NO: 8775560 - DNA, 22 bp, Homo sapiens
ccacatttttgatactctcact

SEQ ID NO: 8775561 - DNA, 22 bp, Homo sapiens
ccaccacttctggcttctggtg

SEQ ID NO: 8775562 - DNA, 22 bp, Homo sapiens
ccaccacatttgcctagacttt

SEQ ID NO: 8775563 - DNA, 22 bp, Homo sapiens
ccaccacatttgcctagacttt

SEQ ID NO: 8775564 - DNA, 22 bp, Homo sapiens
ccaccagaccaccaagagcaac

SEQ ID NO: 8775565 - DNA, 22 bp, Homo sapiens
ccaccagcagtgtgcaaggatt

SEQ ID NO: 8775566 - DNA, 22 bp, Homo sapiens
ccaccagcttcagcagccgcgg

SEQ ID NO: 8775567 - DNA, 22 bp, Homo sapiens
ccaccagctgcatatgcacgta

SEQ ID NO: 8775568 - DNA, 22 bp, Homo sapiens
ccaccagcttcagcagccgcgg

SEQ ID NO: 8775569 - DNA, 22 bp, Homo sapiens
tcggggtctttgacacgctctg

SEQ ID NO: 8775570 - DNA, 22 bp, Homo sapiens
tcggggtctttgacacgctctg

SEQ ID NO: 8775571 - DNA, 22 bp, Homo sapiens
tcgggctcgctctcctagcgga

SEQ ID NO: 8775572 - DNA, 22 bp, Homo sapiens
tcgggctcgctctcctagcgga

SEQ ID NO: 8775573 - DNA, 22 bp, Homo sapiens
tcgggctcgctctcctagcgga

SEQ ID NO: 8775574 - DNA, 22 bp, Homo sapiens
tcggccacggggtttcctccaa

SEQ ID NO: 8775575 - DNA, 20 bp, Homo sapiens
tcggctggacactgtgcact

SEQ ID NO: 8775576 - DNA, 20 bp, Homo sapiens
tcggctggacactgtgcact

SEQ ID NO: 8775577 - DNA, 22 bp, Homo sapiens
tcggagagttggaagtagcaga

SEQ ID NO: 8775578 - DNA, 22 bp, Homo sapiens
tcggagcgtcactggctggagg

SEQ ID NO: 8775579 - DNA, 22 bp, Homo sapiens
tcggagcgtcactggctggagg

SEQ ID NO: 8775580 - DNA, 22 bp, Homo sapiens
tcggagctgtagatgaaaccct

SEQ ID NO: 8775581 - DNA, 22 bp, Homo sapiens
tcggaggatatcacagagcttt

SEQ ID NO: 8775582 - DNA, 22 bp, Homo sapiens
tcgctttaatggtcttcacagc

SEQ ID NO: 8775583 - DNA, 22 bp, Homo sapiens
tcgcttgaacccaggaagtgga

SEQ ID NO: 8775584 - DNA, 22 bp, Homo sapiens
tcgcttgaacccaggaagtgga

SEQ ID NO: 8775585 - DNA, 22 bp, Homo sapiens
tcggaaggggccgcgctcggac

SEQ ID NO: 8775586 - DNA, 22 bp, Homo sapiens
tcgctgtggtttctgtacatgg

SEQ ID NO: 8775587 - DNA, 22 bp, Homo sapiens
tcgctgtgaaaaccttggacaa

SEQ ID NO: 8775588 - DNA, 22 bp, Homo sapiens
tcgcttcacaccatcagcgagg

SEQ ID NO: 8775589 - DNA, 22 bp, Homo sapiens
tcgcttgaacccaggaagtgga

SEQ ID NO: 8775590 - DNA, 22 bp, Homo sapiens
ccacccttccattcttcctctt

SEQ ID NO: 8775591 - DNA, 22 bp, Homo sapiens
ccaccctgtgtttttgccattg

SEQ ID NO: 8775592 - DNA, 22 bp, Homo sapiens
ccaccctgtgcaggcgtgggta

SEQ ID NO: 8775593 - DNA, 22 bp, Homo sapiens
ccacccttgggttcggaggccg

SEQ ID NO: 8775594 - DNA, 22 bp, Homo sapiens
ccacccttgggttcggaggccg

SEQ ID NO: 8775595 - DNA, 22 bp, Homo sapiens
ccacccttgggttcggaggccg

SEQ ID NO: 8775596 - DNA, 22 bp, Homo sapiens
ccaccgccatggcgttgtacag

SEQ ID NO: 8775597 - DNA, 22 bp, Homo sapiens
ccaccgctgaaggcactggcat

SEQ ID NO: 8775598 - DNA, 22 bp, Homo sapiens
ccaccctgtgcaggcgtgggta

SEQ ID NO: 8775599 - DNA, 22 bp, Homo sapiens
ccaccctgtgcaggcgtgggta

SEQ ID NO: 8775600 - DNA, 22 bp, Homo sapiens
ccaccctggacaggcctctgag

SEQ ID NO: 8775601 - DNA, 22 bp, Homo sapiens
ccaccctggactcgaggcccga

SEQ ID NO: 8775602 - DNA, 19 bp, Homo sapiens
ccaccctgggagctcactc

SEQ ID NO: 8775603 - DNA, 22 bp, Homo sapiens
ccaccctgggttctgatgtgga

SEQ ID NO: 8775604 - DNA, 22 bp, Homo sapiens
ccaccctgggttctgatgtgga

SEQ ID NO: 8775605 - DNA, 22 bp, Homo sapiens
ccaccctggacaggcctctgag

SEQ ID NO: 8775606 - DNA, 22 bp, Homo sapiens
ccaccctgggttctgatgtgga

SEQ ID NO: 8775607 - DNA, 17 bp, Homo sapiens
tcggtttgccaggcttc

SEQ ID NO: 8775608 - DNA, 22 bp, Homo sapiens
ccaccctggacaggcctctgag

SEQ ID NO: 8775609 - DNA, 23 bp, Homo sapiens
tcggtgggcgtggaggccgaggc

SEQ ID NO: 8775610 - DNA, 22 bp, Homo sapiens
tcggtgcgcgaggcgcggtccc

SEQ ID NO: 8775611 - DNA, 22 bp, Homo sapiens
tcggtgcgcgaggcgcggtccc

SEQ ID NO: 8775612 - DNA, 23 bp, Homo sapiens
tcggtgggcgtggaggccgaggc

SEQ ID NO: 8775613 - DNA, 23 bp, Homo sapiens
tcggtgggcgtggaggccgaggc

SEQ ID NO: 8775614 - DNA, 21 bp, Homo sapiens
tcctctgcagtgaggtggcct

SEQ ID NO: 8775615 - DNA, 21 bp, Homo sapiens
tcctctgatcctggatccgca

SEQ ID NO: 8775616 - DNA, 22 bp, Homo sapiens
tcctctgagacatcaggttgag

SEQ ID NO: 8775617 - DNA, 22 bp, Homo sapiens
tcctgaaggcctgagttccacc

SEQ ID NO: 8775618 - DNA, 22 bp, Homo sapiens
tcctgaagtcacaggctctgag

SEQ ID NO: 8775619 - DNA, 22 bp, Homo sapiens
tcctgaagtatgggtatggagt

SEQ ID NO: 8775620 - DNA, 22 bp, Homo sapiens
tcctgaagtattgtttgagtaa

SEQ ID NO: 8775621 - DNA, 21 bp, Homo sapiens
tcctctgcagtgaggtggcct

SEQ ID NO: 8775622 - DNA, 21 bp, Homo sapiens
tcctctgcagtgaggtggcct

SEQ ID NO: 8775623 - DNA, 22 bp, Homo sapiens
tcctctgccaaagggagttgcc

SEQ ID NO: 8775624 - DNA, 22 bp, Homo sapiens
tcctgaagtcacaggctctgag

SEQ ID NO: 8775625 - DNA, 22 bp, Homo sapiens
tcctctccatgtctcacgccac

SEQ ID NO: 8775626 - DNA, 22 bp, Homo sapiens
tcctctccatgtctcacgccac

SEQ ID NO: 8775627 - DNA, 22 bp, Homo sapiens
tcctctccatgtctcacgccac

SEQ ID NO: 8775628 - DNA, 21 bp, Homo sapiens
tcctctccatgatctgtttgt

SEQ ID NO: 8775629 - DNA, 22 bp, Homo sapiens
tcctctctgcactggccctgcc

SEQ ID NO: 8775630 - DNA, 22 bp, Homo sapiens
tcctctctgcactggccctgcc

SEQ ID NO: 8775631 - DNA, 18 bp, Homo sapiens
tcctctctttccccaggg

SEQ ID NO: 8775632 - DNA, 18 bp, Homo sapiens
tcctctctttccccaggg

SEQ ID NO: 8775633 - DNA, 23 bp, Homo sapiens
ccacatggcaagatgatgcattc

SEQ ID NO: 8775634 - DNA, 22 bp, Homo sapiens
ccacatggtcctcatttactct

SEQ ID NO: 8775635 - DNA, 22 bp, Homo sapiens
ccacatggtcctcatttactct

SEQ ID NO: 8775636 - DNA, 22 bp, Homo sapiens
ccacatttcttcacttgtccca

SEQ ID NO: 8775637 - DNA, 22 bp, Homo sapiens
ccacatttcttcacttgtccca

SEQ ID NO: 8775638 - DNA, 22 bp, Homo sapiens
ccacatttactggatgctcagg

SEQ ID NO: 8775639 - DNA, 22 bp, Homo sapiens
tcctgaccactaggaccaggct

SEQ ID NO: 8775640 - DNA, 22 bp, Homo sapiens
tcctgaccattccttgtctcca

SEQ ID NO: 8775641 - DNA, 22 bp, Homo sapiens
tcctgacctcttgctctgacct

SEQ ID NO: 8775642 - DNA, 22 bp, Homo sapiens
tcctgactccaggtcctgtgtg

SEQ ID NO: 8775643 - DNA, 22 bp, Homo sapiens
tcctgactctggtgtcctctac

SEQ ID NO: 8775644 - DNA, 22 bp, Homo sapiens
ccacatgaaattgcttatattt

SEQ ID NO: 8775645 - DNA, 22 bp, Homo sapiens
ccacatgaatcttggaagcagg

SEQ ID NO: 8775646 - DNA, 22 bp, Homo sapiens
ccacatgagctggcaatgccct

SEQ ID NO: 8775647 - DNA, 20 bp, Homo sapiens
ccacatgagctctttctgac

SEQ ID NO: 8775648 - DNA, 22 bp, Homo sapiens
ccacatgatgaggaagctgaac

SEQ ID NO: 8775649 - DNA, 22 bp, Homo sapiens
ccacagtgcctggaattctgca

SEQ ID NO: 8775650 - DNA, 22 bp, Homo sapiens
cattgcaacttcaaactcctgg

SEQ ID NO: 8775651 - DNA, 22 bp, Homo sapiens
cattgcaacttcaaactcctgg

SEQ ID NO: 8775652 - DNA, 22 bp, Homo sapiens
cattgcaacttcaaactcctgg

SEQ ID NO: 8775653 - DNA, 22 bp, Homo sapiens
cattgcaacttcaaactcctgg

SEQ ID NO: 8775654 - DNA, 22 bp, Homo sapiens
tcccagggtcctcttctggaat

SEQ ID NO: 8775655 - DNA, 22 bp, Homo sapiens
tcccagggtcctcttctggaat

SEQ ID NO: 8775656 - DNA, 22 bp, Homo sapiens
tcccagggtcctcttctggaat

SEQ ID NO: 8775657 - DNA, 22 bp, Homo sapiens
cattgagaatctgggctacagc

SEQ ID NO: 8775658 - DNA, 22 bp, Homo sapiens
cattgagagtgacttggacaat

SEQ ID NO: 8775659 - DNA, 22 bp, Homo sapiens
cattgagaggctgcctgcctga

SEQ ID NO: 8775660 - DNA, 22 bp, Homo sapiens
cattgagagtgacttggacaat

SEQ ID NO: 8775661 - DNA, 21 bp, Homo sapiens
cattgagataggagagattgt

SEQ ID NO: 8775662 - DNA, 21 bp, Homo sapiens
cattgagataggagagattgt

SEQ ID NO: 8775663 - DNA, 22 bp, Homo sapiens
cattgagagaatcacatagaag

SEQ ID NO: 8775664 - DNA, 22 bp, Homo sapiens
cattgagagaatcacatagaag

SEQ ID NO: 8775665 - DNA, 22 bp, Homo sapiens
cattgcaacttcaaactcctgg

SEQ ID NO: 8775666 - DNA, 22 bp, Homo sapiens
cattgcaacttcaaactcctgg

SEQ ID NO: 8775667 - DNA, 22 bp, Homo sapiens
cattgcaacttcaaactcctgg

SEQ ID NO: 8775668 - DNA, 20 bp, Homo sapiens
cattgcaaagtagcagactg

SEQ ID NO: 8775669 - DNA, 22 bp, Homo sapiens
cattgattatggaaagcagtgg

SEQ ID NO: 8775670 - DNA, 18 bp, Homo sapiens
cattgacagtatatcttt

SEQ ID NO: 8775671 - DNA, 18 bp, Homo sapiens
cattgacagtatatcttt

SEQ ID NO: 8775672 - DNA, 22 bp, Homo sapiens
tcccaggagcaccttttgagcc

SEQ ID NO: 8775673 - DNA, 16 bp, Homo sapiens
tcccaggaggcggaac

SEQ ID NO: 8775674 - DNA, 22 bp, Homo sapiens
tcccaggaggtgcttcctagga

SEQ ID NO: 8775675 - DNA, 22 bp, Homo sapiens
tcccaggaggtgcttcctagga

SEQ ID NO: 8775676 - DNA, 18 bp, Homo sapiens
cattcttggcagcttttg

SEQ ID NO: 8775677 - DNA, 22 bp, Homo sapiens
tcccggcgctgggaggtgggtc

SEQ ID NO: 8775678 - DNA, 22 bp, Homo sapiens
tcccggcgctgggaggtgggtc

SEQ ID NO: 8775679 - DNA, 22 bp, Homo sapiens
tcccggcgctgggaggtgggtc

SEQ ID NO: 8775680 - DNA, 22 bp, Homo sapiens
tccctaggaccccaccttccgc

SEQ ID NO: 8775681 - DNA, 22 bp, Homo sapiens
tccctagcttccgggggctgcc

SEQ ID NO: 8775682 - DNA, 22 bp, Homo sapiens
tccctaaactctgaactgattc

SEQ ID NO: 8775683 - DNA, 22 bp, Homo sapiens
tccctactgttagggactcagc

SEQ ID NO: 8775684 - DNA, 22 bp, Homo sapiens
tcccggcgctgggaggtgggtc

SEQ ID NO: 8775685 - DNA, 22 bp, Homo sapiens
tccccagctctgtgcttccact

SEQ ID NO: 8775686 - DNA, 22 bp, Homo sapiens
tccccagcttgctacttctgct

SEQ ID NO: 8775687 - DNA, 22 bp, Homo sapiens
tccccagctctgtgcttccact

SEQ ID NO: 8775688 - DNA, 22 bp, Homo sapiens
tccccagcttgctacttctgct

SEQ ID NO: 8775689 - DNA, 22 bp, Homo sapiens
tccccagcattgagggtctctc

SEQ ID NO: 8775690 - DNA, 22 bp, Homo sapiens
tccccagccgtgaaggagagga

SEQ ID NO: 8775691 - DNA, 22 bp, Homo sapiens
tccccagacagcgggaggcctg

SEQ ID NO: 8775692 - DNA, 22 bp, Homo sapiens
tccccagaggaatatgagattg

SEQ ID NO: 8775693 - DNA, 19 bp, Homo sapiens
tccccagcacctctgagtc

SEQ ID NO: 8775694 - DNA, 19 bp, Homo sapiens
tccccagcacctctgagtc

SEQ ID NO: 8775695 - DNA, 19 bp, Homo sapiens
tccccagcacctctgagtc

SEQ ID NO: 8775696 - DNA, 22 bp, Homo sapiens
tccccagatggccagctacatg

SEQ ID NO: 8775697 - DNA, 22 bp, Homo sapiens
tccccagatggccagctacatg

SEQ ID NO: 8775698 - DNA, 22 bp, Homo sapiens
tccccagatggccagctacatg

SEQ ID NO: 8775699 - DNA, 22 bp, Homo sapiens
tccccagatgacatcaaaaggc

SEQ ID NO: 8775700 - DNA, 22 bp, Homo sapiens
catttgtagtatctgtttatat

SEQ ID NO: 8775701 - DNA, 22 bp, Homo sapiens
catttgtagtatctgtttatat

SEQ ID NO: 8775702 - DNA, 22 bp, Homo sapiens
catttgtagttaaaaatgtctc

SEQ ID NO: 8775703 - DNA, 22 bp, Homo sapiens
catttgtagtatctgtttatat

SEQ ID NO: 8775704 - DNA, 22 bp, Homo sapiens
catttgtagttaaaaatgtctc

SEQ ID NO: 8775705 - DNA, 22 bp, Homo sapiens
catttgtagttaaaaatgtctc

SEQ ID NO: 8775706 - DNA, 22 bp, Homo sapiens
catttgtatagtgcttagacca

SEQ ID NO: 8775707 - DNA, 22 bp, Homo sapiens
catttgtatctgggctgctgtg

SEQ ID NO: 8775708 - DNA, 22 bp, Homo sapiens
catttgtatgttcctccttagg

SEQ ID NO: 8775709 - DNA, 22 bp, Homo sapiens
catttgtatcatatgtatctta

SEQ ID NO: 8775710 - DNA, 22 bp, Homo sapiens
tcctcccctcagggcaacggat

SEQ ID NO: 8775711 - DNA, 17 bp, Homo sapiens
tcctccccgcagttgca

SEQ ID NO: 8775712 - DNA, 17 bp, Homo sapiens
tcctccccgcagttgca

SEQ ID NO: 8775713 - DNA, 21 bp, Homo sapiens
tcctctccatgatctgtttgt

SEQ ID NO: 8775714 - DNA, 22 bp, Homo sapiens
tcctctccatattttctgattt

SEQ ID NO: 8775715 - DNA, 22 bp, Homo sapiens
tcctcaggctgcctggaagact

SEQ ID NO: 8775716 - DNA, 22 bp, Homo sapiens
tcctcagggaagatgagcctca

SEQ ID NO: 8775717 - DNA, 22 bp, Homo sapiens
tcctcagggaagatgagcctca

SEQ ID NO: 8775718 - DNA, 22 bp, Homo sapiens
catttggaccaaaatagccaac

SEQ ID NO: 8775719 - DNA, 22 bp, Homo sapiens
catttggaccaaaatagccaac

SEQ ID NO: 8775720 - DNA, 20 bp, Homo sapiens
catttgggatcatgaggttt

SEQ ID NO: 8775721 - DNA, 22 bp, Homo sapiens
catttgtaatactgacttgcag

SEQ ID NO: 8775722 - DNA, 22 bp, Homo sapiens
catttgtaatactgacttgcag

SEQ ID NO: 8775723 - DNA, 22 bp, Homo sapiens
catttgtacagaacagctttat

SEQ ID NO: 8775724 - DNA, 22 bp, Homo sapiens
catttgtaatactgacttgcag

SEQ ID NO: 8775725 - DNA, 22 bp, Homo sapiens
catttggtgttaggcatgttaa

SEQ ID NO: 8775726 - DNA, 22 bp, Homo sapiens
catttggtcattaggtctcctt

SEQ ID NO: 8775727 - DNA, 22 bp, Homo sapiens
catttgtactgttcaatgtcat

SEQ ID NO: 8775728 - DNA, 22 bp, Homo sapiens
catttgtactgttcaatgtcat

SEQ ID NO: 8775729 - DNA, 22 bp, Homo sapiens
catttgtagagtaggaaagagt

SEQ ID NO: 8775730 - DNA, 22 bp, Homo sapiens
catttgtagctatttactgtat

SEQ ID NO: 8775731 - DNA, 22 bp, Homo sapiens
catttgtaggatgcttcttgtt

SEQ ID NO: 8775732 - DNA, 22 bp, Homo sapiens
tcctcagcttttatttcacttg

SEQ ID NO: 8775733 - DNA, 18 bp, Homo sapiens
tcctcagcctcacctagc

SEQ ID NO: 8775734 - DNA, 22 bp, Homo sapiens
tcctcagctttggtttactcat

SEQ ID NO: 8775735 - DNA, 22 bp, Homo sapiens
tcctcaggatctaggagtgctt

SEQ ID NO: 8775736 - DNA, 22 bp, Homo sapiens
tcctcaggagagctcctatgcc

SEQ ID NO: 8775737 - DNA, 22 bp, Homo sapiens
tcctcaggatgtggagtagaat

SEQ ID NO: 8775738 - DNA, 22 bp, Homo sapiens
tcctcaggatgtggagtagaat

SEQ ID NO: 8775739 - DNA, 22 bp, Homo sapiens
tcctcaggatgtggggtagaat

SEQ ID NO: 8775740 - DNA, 22 bp, Homo sapiens
tcctcaggcggtgaggaggggc

SEQ ID NO: 8775741 - DNA, 22 bp, Homo sapiens
tccctagtcgcatctgtggaga

SEQ ID NO: 8775742 - DNA, 22 bp, Homo sapiens
tccctcacctagtctttgactc

SEQ ID NO: 8775743 - DNA, 22 bp, Homo sapiens
tccctcacctagtctttgactc

SEQ ID NO: 8775744 - DNA, 22 bp, Homo sapiens
tccctcaatgtgggtcaagacc

SEQ ID NO: 8775745 - DNA, 22 bp, Homo sapiens
tccctaggagaattgccgcagc

SEQ ID NO: 8775746 - DNA, 22 bp, Homo sapiens
tccctagtcgcatctgtggaga

SEQ ID NO: 8775747 - DNA, 22 bp, Homo sapiens
tccctaggtcctagtcacagta

SEQ ID NO: 8775748 - DNA, 22 bp, Homo sapiens
tccctcactggttctgcatccc

SEQ ID NO: 8775749 - DNA, 22 bp, Homo sapiens
tcctcagcattagcacagacat

SEQ ID NO: 8775750 - DNA, 22 bp, Homo sapiens
tcctagaaggatcattctagtg

SEQ ID NO: 8775751 - DNA, 22 bp, Homo sapiens
cattcattcagcaactgttatt

SEQ ID NO: 8775752 - DNA, 22 bp, Homo sapiens
cattcattcagcaactgttatt

SEQ ID NO: 8775753 - DNA, 22 bp, Homo sapiens
cattcatttactttcaacagct

SEQ ID NO: 8775754 - DNA, 22 bp, Homo sapiens
tcccagagcccaagttggagag

SEQ ID NO: 8775755 - DNA, 22 bp, Homo sapiens
tcccactgagcatatgcagatg

SEQ ID NO: 8775756 - DNA, 22 bp, Homo sapiens
tcccagaggaaatggcagctga

SEQ ID NO: 8775757 - DNA, 22 bp, Homo sapiens
tcccagccacaggtgtagccct

SEQ ID NO: 8775758 - DNA, 22 bp, Homo sapiens
tcccagagctctgacaccagct

SEQ ID NO: 8775759 - DNA, 22 bp, Homo sapiens
tcccagagctctgacaccagct

SEQ ID NO: 8775760 - DNA, 22 bp, Homo sapiens
tcccagagcctctgccactctg

SEQ ID NO: 8775761 - DNA, 22 bp, Homo sapiens
tcccagccaggctctaccactt

SEQ ID NO: 8775762 - DNA, 22 bp, Homo sapiens
tcccagccacagtttccacctg

SEQ ID NO: 8775763 - DNA, 22 bp, Homo sapiens
tcccagccacagtttccacctg

SEQ ID NO: 8775764 - DNA, 22 bp, Homo sapiens
tcccagccacagtttccacctg

SEQ ID NO: 8775765 - DNA, 22 bp, Homo sapiens
tcccagcccagacttctccagt

SEQ ID NO: 8775766 - DNA, 23 bp, Homo sapiens
tcccaggaatctgcatttttaac

SEQ ID NO: 8775767 - DNA, 22 bp, Homo sapiens
tcccaggacaggccacatggaa

SEQ ID NO: 8775768 - DNA, 22 bp, Homo sapiens
tcccaggaattgaagccagtgt

SEQ ID NO: 8775769 - DNA, 22 bp, Homo sapiens
tcccaggacatgggctctgctc

SEQ ID NO: 8775770 - DNA, 22 bp, Homo sapiens
tcccaggacatgggctctgctc

SEQ ID NO: 8775771 - DNA, 22 bp, Homo sapiens
tcccaggacaggccacatggaa

SEQ ID NO: 8775772 - DNA, 22 bp, Homo sapiens
tcccaggacatgggctctgctc

SEQ ID NO: 8775773 - DNA, 22 bp, Homo sapiens
tcccaggacaggccacatggaa

SEQ ID NO: 8775774 - DNA, 22 bp, Homo sapiens
tcccaggacccaggcattcaca

SEQ ID NO: 8775775 - DNA, 22 bp, Homo sapiens
tcccaggacttccagttggagg

SEQ ID NO: 8775776 - DNA, 22 bp, Homo sapiens
catgtttactaccaggagaatg

SEQ ID NO: 8775777 - DNA, 22 bp, Homo sapiens
catgttgtgaaggaaaatgggc

SEQ ID NO: 8775778 - DNA, 22 bp, Homo sapiens
catgttgggcatgcatatgtgt

SEQ ID NO: 8775779 - DNA, 22 bp, Homo sapiens
catgttgggaatcagctgagag

SEQ ID NO: 8775780 - DNA, 22 bp, Homo sapiens
catgttgattagagagcttaga

SEQ ID NO: 8775781 - DNA, 22 bp, Homo sapiens
catgttggcttgtcacaatgaa

SEQ ID NO: 8775782 - DNA, 22 bp, Homo sapiens
catgttgtagtatcataatggt

SEQ ID NO: 8775783 - DNA, 22 bp, Homo sapiens
catgttggtgtgctgcacccgt

SEQ ID NO: 8775784 - DNA, 22 bp, Homo sapiens
catgttggtgtgctgcacccat

SEQ ID NO: 8775785 - DNA, 22 bp, Homo sapiens
catgtttctgatgcagctttta

SEQ ID NO: 8775786 - DNA, 22 bp, Homo sapiens
catgtttactaccaggagaatg

SEQ ID NO: 8775787 - DNA, 22 bp, Homo sapiens
catgtttgtacaaaggtacaca

SEQ ID NO: 8775788 - DNA, 22 bp, Homo sapiens
cattatattttactgcatggga

SEQ ID NO: 8775789 - DNA, 22 bp, Homo sapiens
catgttatttatccattaaaca

SEQ ID NO: 8775790 - DNA, 22 bp, Homo sapiens
catgttatttatccattaaaca

SEQ ID NO: 8775791 - DNA, 19 bp, Homo sapiens
catgttatgctgtagtatc

SEQ ID NO: 8775792 - DNA, 19 bp, Homo sapiens
catgttatgctgtagtatc

SEQ ID NO: 8775793 - DNA, 22 bp, Homo sapiens
catgttaagtgtttgataacca

SEQ ID NO: 8775794 - DNA, 22 bp, Homo sapiens
catgttaatatgcattgagtac

SEQ ID NO: 8775795 - DNA, 22 bp, Homo sapiens
catgttaagtgtttgataacca

SEQ ID NO: 8775796 - DNA, 22 bp, Homo sapiens
catgttaatatgcattgagtac

SEQ ID NO: 8775797 - DNA, 22 bp, Homo sapiens
catgttggctgaggctgtattt

SEQ ID NO: 8775798 - DNA, 22 bp, Homo sapiens
catgttggcttgtcacaatgaa

SEQ ID NO: 8775799 - DNA, 22 bp, Homo sapiens
catgttggcaaggatacagcag

SEQ ID NO: 8775800 - DNA, 22 bp, Homo sapiens
catgttgaatggccttgatttt

SEQ ID NO: 8775801 - DNA, 22 bp, Homo sapiens
catgttggcactgtctctgcct

SEQ ID NO: 8775802 - DNA, 22 bp, Homo sapiens
catgttggcaaggatacagcag

SEQ ID NO: 8775803 - DNA, 22 bp, Homo sapiens
catgttctaacaatgagaaacc

SEQ ID NO: 8775804 - DNA, 22 bp, Homo sapiens
catgttcaaataagtagtttct

SEQ ID NO: 8775805 - DNA, 22 bp, Homo sapiens
cattcaaatgtgccactgtcct

SEQ ID NO: 8775806 - DNA, 22 bp, Homo sapiens
cattcaaatgtgccactgtcct

SEQ ID NO: 8775807 - DNA, 22 bp, Homo sapiens
cattcaaatgtgccactgtcct

SEQ ID NO: 8775808 - DNA, 22 bp, Homo sapiens
cattcaaattaagattttgtta

SEQ ID NO: 8775809 - DNA, 22 bp, Homo sapiens
cattcaaattaagattttgtta

SEQ ID NO: 8775810 - DNA, 22 bp, Homo sapiens
cattcaagagtggacataatgc

SEQ ID NO: 8775811 - DNA, 22 bp, Homo sapiens
cattcacaaaaccacatgccat

SEQ ID NO: 8775812 - DNA, 22 bp, Homo sapiens
cattcacaaaaccacatgccat

SEQ ID NO: 8775813 - DNA, 22 bp, Homo sapiens
cattcacaaaaccacatgccat

SEQ ID NO: 8775814 - DNA, 22 bp, Homo sapiens
cattcacaatagttgaaaggtg

SEQ ID NO: 8775815 - DNA, 22 bp, Homo sapiens
cattcacaatagttgaaaggtg

SEQ ID NO: 8775816 - DNA, 22 bp, Homo sapiens
cattcacaaagctgattgatgg

SEQ ID NO: 8775817 - DNA, 22 bp, Homo sapiens
cattcacaaagctgattgatgg

SEQ ID NO: 8775818 - DNA, 22 bp, Homo sapiens
cattcacaactgagcattgttg

SEQ ID NO: 8775819 - DNA, 22 bp, Homo sapiens
cattcacagagggggaagcatc

SEQ ID NO: 8775820 - DNA, 22 bp, Homo sapiens
cattcacagagggggaagcatc

SEQ ID NO: 8775821 - DNA, 22 bp, Homo sapiens
cattcacagcaggtcagctgaa

SEQ ID NO: 8775822 - DNA, 22 bp, Homo sapiens
cattcacagagggggaagcatc

SEQ ID NO: 8775823 - DNA, 22 bp, Homo sapiens
cattcacaatggattgcttcaa

SEQ ID NO: 8775824 - DNA, 22 bp, Homo sapiens
cattcacaatggattgcttcaa

SEQ ID NO: 8775825 - DNA, 22 bp, Homo sapiens
cattcacaatggattgcttcaa

SEQ ID NO: 8775826 - DNA, 22 bp, Homo sapiens
cattcataggaagaaaatgggc

SEQ ID NO: 8775827 - DNA, 22 bp, Homo sapiens
cattcataagtttttgtgctgg

SEQ ID NO: 8775828 - DNA, 22 bp, Homo sapiens
cattcataagactttgctcttg

SEQ ID NO: 8775829 - DNA, 22 bp, Homo sapiens
cattcatacaagtttgtttcat

SEQ ID NO: 8775830 - DNA, 22 bp, Homo sapiens
cattcataggaggagatgatta

SEQ ID NO: 8775831 - DNA, 22 bp, Homo sapiens
cattcatatttgcagtatacct

SEQ ID NO: 8775832 - DNA, 22 bp, Homo sapiens
cattcataggaggagatgatta

SEQ ID NO: 8775833 - DNA, 22 bp, Homo sapiens
cattcattcacattttgtctat

SEQ ID NO: 8775834 - DNA, 22 bp, Homo sapiens
cattcacattcttcttactgtt

SEQ ID NO: 8775835 - DNA, 22 bp, Homo sapiens
cattcacattcttcttactgtt

SEQ ID NO: 8775836 - DNA, 22 bp, Homo sapiens
cattcacattcttcttactgtt

SEQ ID NO: 8775837 - DNA, 22 bp, Homo sapiens
cattcacatcttgttccatcac

SEQ ID NO: 8775838 - DNA, 22 bp, Homo sapiens
cattcacatcttgttccatcac

SEQ ID NO: 8775839 - DNA, 22 bp, Homo sapiens
cattcacatcttgttccatcac

SEQ ID NO: 8775840 - DNA, 21 bp, Homo sapiens
cattcacagtctggctcttga

SEQ ID NO: 8775841 - DNA, 21 bp, Homo sapiens
cattcacagtctggctcttga

SEQ ID NO: 8775842 - DNA, 22 bp, Homo sapiens
cattcacagcaggtcagctgaa

SEQ ID NO: 8775843 - DNA, 22 bp, Homo sapiens
cattcacagcaggtcagctgaa

SEQ ID NO: 8775844 - DNA, 22 bp, Homo sapiens
tccagactggggccatgtctgc

SEQ ID NO: 8775845 - DNA, 22 bp, Homo sapiens
tccagactgccctgcacatgtg

SEQ ID NO: 8775846 - DNA, 19 bp, Homo sapiens
tccagactgtccaggctat

SEQ ID NO: 8775847 - DNA, 22 bp, Homo sapiens
tccagactctttaagttcattt

SEQ ID NO: 8775848 - DNA, 22 bp, Homo sapiens
tccagactcactcatgtgacta

SEQ ID NO: 8775849 - DNA, 22 bp, Homo sapiens
tccagacccatgaccctgggga

SEQ ID NO: 8775850 - DNA, 22 bp, Homo sapiens
tccagacctagctggtcattaa

SEQ ID NO: 8775851 - DNA, 22 bp, Homo sapiens
tccagagaattctacgcagtgc

SEQ ID NO: 8775852 - DNA, 22 bp, Homo sapiens
tccagagaattctacgcagtgc

SEQ ID NO: 8775853 - DNA, 22 bp, Homo sapiens
tccagagaacgatgaaagctgg

SEQ ID NO: 8775854 - DNA, 22 bp, Homo sapiens
tccagagaaatctagtcttaca

SEQ ID NO: 8775855 - DNA, 22 bp, Homo sapiens
tccagagaacgatgaaagctgg

SEQ ID NO: 8775856 - DNA, 22 bp, Homo sapiens
tccagagaaatctagtcttaca

SEQ ID NO: 8775857 - DNA, 22 bp, Homo sapiens
tccagagaacgatgaaagctgg

SEQ ID NO: 8775858 - DNA, 22 bp, Homo sapiens
tccagagagaaaaacaagcttt

SEQ ID NO: 8775859 - DNA, 22 bp, Homo sapiens
tccagagagaaaaacaagcttt

SEQ ID NO: 8775860 - DNA, 22 bp, Homo sapiens
tccagagagaaaaacaagcttt

SEQ ID NO: 8775861 - DNA, 22 bp, Homo sapiens
tccagagacttgcatgtgcttg

SEQ ID NO: 8775862 - DNA, 22 bp, Homo sapiens
tccagagacttgcatgtgcttg

SEQ ID NO: 8775863 - DNA, 22 bp, Homo sapiens
tccagagaattctacgcagtgc

SEQ ID NO: 8775864 - DNA, 22 bp, Homo sapiens
tccagcccagctgtccccttca

SEQ ID NO: 8775865 - DNA, 22 bp, Homo sapiens
tccagcccagctcctctcagaa

SEQ ID NO: 8775866 - DNA, 22 bp, Homo sapiens
tccagagaggcatatttacaag

SEQ ID NO: 8775867 - DNA, 22 bp, Homo sapiens
tccagagaggcatatttacaag

SEQ ID NO: 8775868 - DNA, 22 bp, Homo sapiens
tccagagaggcatatttacaag

SEQ ID NO: 8775869 - DNA, 22 bp, Homo sapiens
tccagagagccacggacagggg

SEQ ID NO: 8775870 - DNA, 22 bp, Homo sapiens
tccagagagccacggacagggg

SEQ ID NO: 8775871 - DNA, 22 bp, Homo sapiens
tccagagagatagtggctaata

SEQ ID NO: 8775872 - DNA, 22 bp, Homo sapiens
tccagagagaaaaacaagcttt

SEQ ID NO: 8775873 - DNA, 22 bp, Homo sapiens
tccagagagaaaaacaagcttt

SEQ ID NO: 8775874 - DNA, 22 bp, Homo sapiens
tccagagagatagtggctaata

SEQ ID NO: 8775875 - DNA, 22 bp, Homo sapiens
tccagagagccacggacagggg

SEQ ID NO: 8775876 - DNA, 22 bp, Homo sapiens
tccagccctgtggcttccaccc

SEQ ID NO: 8775877 - DNA, 22 bp, Homo sapiens
tccagccctgtggcttccaccc

SEQ ID NO: 8775878 - DNA, 22 bp, Homo sapiens
tccagccctgtgtctgggagag

SEQ ID NO: 8775879 - DNA, 22 bp, Homo sapiens
tccagccctgtgtctgggagag

SEQ ID NO: 8775880 - DNA, 22 bp, Homo sapiens
tccagccctgtgtctgggagag

SEQ ID NO: 8775881 - DNA, 22 bp, Homo sapiens
tccagccgccggccctgcaggt

SEQ ID NO: 8775882 - DNA, 19 bp, Homo sapiens
tccagccctgttccctttt

SEQ ID NO: 8775883 - DNA, 19 bp, Homo sapiens
tccagccctgttccctttt

SEQ ID NO: 8775884 - DNA, 22 bp, Homo sapiens
tccagccctgtgtctgggagag

SEQ ID NO: 8775885 - DNA, 17 bp, Homo sapiens
tccagcctcctctgctg

SEQ ID NO: 8775886 - DNA, 17 bp, Homo sapiens
tccagcctcctctgctg

SEQ ID NO: 8775887 - DNA, 22 bp, Homo sapiens
tccagcctcctatttaccctaa

SEQ ID NO: 8775888 - DNA, 22 bp, Homo sapiens
tccagcctcatttctcctgctt

SEQ ID NO: 8775889 - DNA, 22 bp, Homo sapiens
tccagcctaatgttcttcccac

SEQ ID NO: 8775890 - DNA, 22 bp, Homo sapiens
tccagcctaggggaacagctgc

SEQ ID NO: 8775891 - DNA, 22 bp, Homo sapiens
tccagcctaggggaacagctgc

SEQ ID NO: 8775892 - DNA, 22 bp, Homo sapiens
tccagcctcatttctcctgctt

SEQ ID NO: 8775893 - DNA, 22 bp, Homo sapiens
tccagcctcatttctcctgctt

SEQ ID NO: 8775894 - DNA, 22 bp, Homo sapiens
tccagctgctagctagatgcaa

SEQ ID NO: 8775895 - DNA, 21 bp, Homo sapiens
tccagctgcacaagcatgggg

SEQ ID NO: 8775896 - DNA, 22 bp, Homo sapiens
tccagctgctagctagatgcaa

SEQ ID NO: 8775897 - DNA, 22 bp, Homo sapiens
tccagctcttgttgcccactgc

SEQ ID NO: 8775898 - DNA, 22 bp, Homo sapiens
tccagctgacagttcaaaatga

SEQ ID NO: 8775899 - DNA, 18 bp, Homo sapiens
tccaggctccaggctaac

SEQ ID NO: 8775900 - DNA, 18 bp, Homo sapiens
tccaggctccaggctaac

SEQ ID NO: 8775901 - DNA, 18 bp, Homo sapiens
tccaggctccaggctaac

SEQ ID NO: 8775902 - DNA, 22 bp, Homo sapiens
tccaggctcccctgcgtgctcc

SEQ ID NO: 8775903 - DNA, 19 bp, Homo sapiens
tccaggctccattggcaga

SEQ ID NO: 8775904 - DNA, 22 bp, Homo sapiens
tccaggctccctcaggatgcac

SEQ ID NO: 8775905 - DNA, 22 bp, Homo sapiens
tccaggctccctcaggatgcac

SEQ ID NO: 8775906 - DNA, 22 bp, Homo sapiens
tccaggctcccctgcgtgctcc

SEQ ID NO: 8775907 - DNA, 22 bp, Homo sapiens
tccaggctcccctgcgtgctcc

SEQ ID NO: 8775908 - DNA, 22 bp, Homo sapiens
tccaggctcccctgcgtgctcc

SEQ ID NO: 8775909 - DNA, 22 bp, Homo sapiens
tccaggctcccctgcgtgctcc

SEQ ID NO: 8775910 - DNA, 22 bp, Homo sapiens
tccaggctccctcaggatgcac

SEQ ID NO: 8775911 - DNA, 22 bp, Homo sapiens
catgtgttgtctcatttaatcc

SEQ ID NO: 8775912 - DNA, 22 bp, Homo sapiens
catgtgttaatctttctgcaaa

SEQ ID NO: 8775913 - DNA, 22 bp, Homo sapiens
catgtgtgtggacgagcgtggc

SEQ ID NO: 8775914 - DNA, 22 bp, Homo sapiens
catgtgtgtggacgagcgtggc

SEQ ID NO: 8775915 - DNA, 22 bp, Homo sapiens
catgtgtgtccatgtgactaag

SEQ ID NO: 8775916 - DNA, 22 bp, Homo sapiens
catgtgtgtccatgtgactaag

SEQ ID NO: 8775917 - DNA, 22 bp, Homo sapiens
catgtgtggttacctacttgac

SEQ ID NO: 8775918 - DNA, 22 bp, Homo sapiens
catgtgtggtctgtggctatct

SEQ ID NO: 8775919 - DNA, 22 bp, Homo sapiens
catgtgtggttacctacttgac

SEQ ID NO: 8775920 - DNA, 22 bp, Homo sapiens
catgtgtgtggacgagcgtggc

SEQ ID NO: 8775921 - DNA, 22 bp, Homo sapiens
catgtgtgtgagggaaacatgt

SEQ ID NO: 8775922 - DNA, 22 bp, Homo sapiens
catgtgtgtgagggaaacatgt

SEQ ID NO: 8775923 - DNA, 22 bp, Homo sapiens
catgtgtgtccatgtgactaag

SEQ ID NO: 8775924 - DNA, 22 bp, Homo sapiens
tccaggcagcccttcctgactc

SEQ ID NO: 8775925 - DNA, 22 bp, Homo sapiens
tccaggcagcccttcctgactc

SEQ ID NO: 8775926 - DNA, 22 bp, Homo sapiens
tccaggcagcccttcctgactc

SEQ ID NO: 8775927 - DNA, 20 bp, Homo sapiens
tccaggcagctcagagtgtc

SEQ ID NO: 8775928 - DNA, 22 bp, Homo sapiens
tccaggcccatggagcagagct

SEQ ID NO: 8775929 - DNA, 22 bp, Homo sapiens
tccaggcccatggagcagagct

SEQ ID NO: 8775930 - DNA, 22 bp, Homo sapiens
tccaggcccatggagcagagct

SEQ ID NO: 8775931 - DNA, 22 bp, Homo sapiens
tccaggccccactgaagcccct

SEQ ID NO: 8775932 - DNA, 22 bp, Homo sapiens
tccaggccccactgaagcccct

SEQ ID NO: 8775933 - DNA, 20 bp, Homo sapiens
tccaggcagctcagagtgtc

SEQ ID NO: 8775934 - DNA, 22 bp, Homo sapiens
tccaggcccgagatgggctgga

SEQ ID NO: 8775935 - DNA, 22 bp, Homo sapiens
tccaggcccgagatgggctgga

SEQ ID NO: 8775936 - DNA, 22 bp, Homo sapiens
tccaggcccctgcctgggcctg

SEQ ID NO: 8775937 - DNA, 22 bp, Homo sapiens
tccaggcccctgcctgggcctg

SEQ ID NO: 8775938 - DNA, 22 bp, Homo sapiens
tccaggcccctgcctgggcctg

SEQ ID NO: 8775939 - DNA, 22 bp, Homo sapiens
tccaggccccactgaagcccct

SEQ ID NO: 8775940 - DNA, 22 bp, Homo sapiens
tccaggccccagaccgtactgc

SEQ ID NO: 8775941 - DNA, 22 bp, Homo sapiens
tccaggccccagaccgtactgc

SEQ ID NO: 8775942 - DNA, 22 bp, Homo sapiens
tccaggccccagaccgtactgc

SEQ ID NO: 8775943 - DNA, 22 bp, Homo sapiens
tccaggccccccacgctaatgg

SEQ ID NO: 8775944 - DNA, 22 bp, Homo sapiens
tccaggccccagcaccttggga

SEQ ID NO: 8775945 - DNA, 22 bp, Homo sapiens
tccacaggtatttctccttgct

SEQ ID NO: 8775946 - DNA, 22 bp, Homo sapiens
tccacaggtcagggagataggc

SEQ ID NO: 8775947 - DNA, 20 bp, Homo sapiens
tccaagccctccttccattc

SEQ ID NO: 8775948 - DNA, 21 bp, Homo sapiens
tccaagccttcaacacattca

SEQ ID NO: 8775949 - DNA, 22 bp, Homo sapiens
tccacagggcctttctggtgtg

SEQ ID NO: 8775950 - DNA, 22 bp, Homo sapiens
tccacagggcctttctggtgtg

SEQ ID NO: 8775951 - DNA, 22 bp, Homo sapiens
tcatttatttataccattgcct

SEQ ID NO: 8775952 - DNA, 22 bp, Homo sapiens
tcatttatttgactttggagtg

SEQ ID NO: 8775953 - DNA, 22 bp, Homo sapiens
tcatttatttgactttggagtg

SEQ ID NO: 8775954 - DNA, 22 bp, Homo sapiens
tcatttatttataccattgcct

SEQ ID NO: 8775955 - DNA, 22 bp, Homo sapiens
tccacatagagcttagaagcaa

SEQ ID NO: 8775956 - DNA, 22 bp, Homo sapiens
tccacagttttgccactagctg

SEQ ID NO: 8775957 - DNA, 22 bp, Homo sapiens
tccagaccaaggaaggctgggc

SEQ ID NO: 8775958 - DNA, 22 bp, Homo sapiens
tccacattagaatgttttctca

SEQ ID NO: 8775959 - DNA, 22 bp, Homo sapiens
tccacatgacttctaataactg

SEQ ID NO: 8775960 - DNA, 22 bp, Homo sapiens
tccagaccatggatggctgcaa

SEQ ID NO: 8775961 - DNA, 22 bp, Homo sapiens
tccagaccatggatggctgcaa

SEQ ID NO: 8775962 - DNA, 22 bp, Homo sapiens
tccacatgacttctaataactg

SEQ ID NO: 8775963 - DNA, 22 bp, Homo sapiens
tccacatgaccattgtgctcct

SEQ ID NO: 8775964 - DNA, 22 bp, Homo sapiens
tccacatgacttctaataactg

SEQ ID NO: 8775965 - DNA, 22 bp, Homo sapiens
tccacatggctgggaggcctca

SEQ ID NO: 8775966 - DNA, 22 bp, Homo sapiens
tccacatgacttctaataactg

SEQ ID NO: 8775967 - DNA, 22 bp, Homo sapiens
tccacattatgtttctcctttc

SEQ ID NO: 8775968 - DNA, 22 bp, Homo sapiens
tcatttatgcaggaatggcata

SEQ ID NO: 8775969 - DNA, 22 bp, Homo sapiens
tcatttatgcaggaatggcata

SEQ ID NO: 8775970 - DNA, 22 bp, Homo sapiens
tcatttatgcaggaatggcata

SEQ ID NO: 8775971 - DNA, 22 bp, Homo sapiens
tcatttatcgctgccttttaaa

SEQ ID NO: 8775972 - DNA, 22 bp, Homo sapiens
tcatttatcgctgccttttaaa

SEQ ID NO: 8775973 - DNA, 22 bp, Homo sapiens
tcatttatcatttgtgctgtag

SEQ ID NO: 8775974 - DNA, 21 bp, Homo sapiens
tcatttattgagaaatgactg

SEQ ID NO: 8775975 - DNA, 22 bp, Homo sapiens
tcatttatgtctttgccatcca

SEQ ID NO: 8775976 - DNA, 21 bp, Homo sapiens
tcatttattgagaaatgactg

SEQ ID NO: 8775977 - DNA, 21 bp, Homo sapiens
tcatttattgagaaatgactg

SEQ ID NO: 8775978 - DNA, 21 bp, Homo sapiens
tcatttattgagaaatgactg

SEQ ID NO: 8775979 - DNA, 21 bp, Homo sapiens
tcatttattgagaaatgactg

SEQ ID NO: 8775980 - DNA, 22 bp, Homo sapiens
tcattccatttccagctctgaa

SEQ ID NO: 8775981 - DNA, 22 bp, Homo sapiens
tcattcctccagcgggagtcca

SEQ ID NO: 8775982 - DNA, 22 bp, Homo sapiens
tcattctgcatcactcttgctc

SEQ ID NO: 8775983 - DNA, 22 bp, Homo sapiens
tcattctttaccaagttgtcac

SEQ ID NO: 8775984 - DNA, 22 bp, Homo sapiens
tcattcttgatcactagttagt

SEQ ID NO: 8775985 - DNA, 22 bp, Homo sapiens
tcattcttgcgtatgccatggt

SEQ ID NO: 8775986 - DNA, 22 bp, Homo sapiens
tcattctttaccaagttgtcac

SEQ ID NO: 8775987 - DNA, 22 bp, Homo sapiens
catgaaaaatttactgttaaca

SEQ ID NO: 8775988 - DNA, 22 bp, Homo sapiens
catcttttggcctattctgagg

SEQ ID NO: 8775989 - DNA, 22 bp, Homo sapiens
catgaaaaatttactgttaaca

SEQ ID NO: 8775990 - DNA, 22 bp, Homo sapiens
catgaaaaatttactgttaaca

SEQ ID NO: 8775991 - DNA, 23 bp, Homo sapiens
tcattccacaaatacttatctag

SEQ ID NO: 8775992 - DNA, 20 bp, Homo sapiens
tcattccaaatagttcagca

SEQ ID NO: 8775993 - DNA, 22 bp, Homo sapiens
tcattcattgcaagcacacgca

SEQ ID NO: 8775994 - DNA, 22 bp, Homo sapiens
tcattcattctttctgaatata

SEQ ID NO: 8775995 - DNA, 22 bp, Homo sapiens
tcatgtgacaggcactgttctg

SEQ ID NO: 8775996 - DNA, 22 bp, Homo sapiens
tcatgtggcttatagaatttgt

SEQ ID NO: 8775997 - DNA, 23 bp, Homo sapiens
tcatgtggaaaaggatctggtct

SEQ ID NO: 8775998 - DNA, 22 bp, Homo sapiens
catcttttcagaagccattctg

SEQ ID NO: 8775999 - DNA, 22 bp, Homo sapiens
catcttttcagaagccattctg

SEQ ID NO: 8776000 - DNA, 22 bp, Homo sapiens
catctttgtaacttccacataa

SEQ ID NO: 8776001 - DNA, 22 bp, Homo sapiens
catctttgttctgtaaactttt

SEQ ID NO: 8776002 - DNA, 22 bp, Homo sapiens
catctttgtttcatctgtccag

SEQ ID NO: 8776003 - DNA, 22 bp, Homo sapiens
catctttgtttcatctgtccag

SEQ ID NO: 8776004 - DNA, 22 bp, Homo sapiens
catctttgggctgcatggaagg

SEQ ID NO: 8776005 - DNA, 22 bp, Homo sapiens
tcatgcactacataacgatgtt

SEQ ID NO: 8776006 - DNA, 22 bp, Homo sapiens
catctttggagaaacttccgtt

SEQ ID NO: 8776007 - DNA, 22 bp, Homo sapiens
tcatcagtttagaaaaaatatg

SEQ ID NO: 8776008 - DNA, 22 bp, Homo sapiens
tcatcagtgtccttatcactta

SEQ ID NO: 8776009 - DNA, 22 bp, Homo sapiens
tcatcagtttagaaaaaatatg

SEQ ID NO: 8776010 - DNA, 22 bp, Homo sapiens
tcatcagtgtccttatcactta

SEQ ID NO: 8776011 - DNA, 22 bp, Homo sapiens
cataaattgtacccattccaac

SEQ ID NO: 8776012 - DNA, 22 bp, Homo sapiens
cataacacctgatggcaatgat

SEQ ID NO: 8776013 - DNA, 21 bp, Homo sapiens
tcatgaagcatcacttctgcc

SEQ ID NO: 8776014 - DNA, 21 bp, Homo sapiens
tcatgaacattcactgactgc

SEQ ID NO: 8776015 - DNA, 22 bp, Homo sapiens
tcatgaacatggaatatctttt

SEQ ID NO: 8776016 - DNA, 22 bp, Homo sapiens
tcatgaacaaatgatttactaa

SEQ ID NO: 8776017 - DNA, 22 bp, Homo sapiens
tcatgaacatctcaaataacca

SEQ ID NO: 8776018 - DNA, 22 bp, Homo sapiens
tcatcataatatggaatcttgt

SEQ ID NO: 8776019 - DNA, 22 bp, Homo sapiens
tcatcatcactctggcaagcat

SEQ ID NO: 8776020 - DNA, 22 bp, Homo sapiens
tcatcatccttttttgaagagt

SEQ ID NO: 8776021 - DNA, 22 bp, Homo sapiens
tcatgacatgtgaattgaatat

SEQ ID NO: 8776022 - DNA, 22 bp, Homo sapiens
tcatgcaaatactgttccagaa

SEQ ID NO: 8776023 - DNA, 22 bp, Homo sapiens
tcatgcaaagccaattccagct

SEQ ID NO: 8776024 - DNA, 22 bp, Homo sapiens
tcatgcaaagccaattccagct

SEQ ID NO: 8776025 - DNA, 22 bp, Homo sapiens
tcatgcaaactctagtccttta

SEQ ID NO: 8776026 - DNA, 22 bp, Homo sapiens
tcatgcaaactctagtccttta

SEQ ID NO: 8776027 - DNA, 18 bp, Homo sapiens
tcatgaggtagaggctgg

SEQ ID NO: 8776028 - DNA, 23 bp, Homo sapiens
tcatgagtggctgcggggctgag

SEQ ID NO: 8776029 - DNA, 18 bp, Homo sapiens
tcatgaggaaggagaaga

SEQ ID NO: 8776030 - DNA, 22 bp, Homo sapiens
tcatgatacccaagtacctaga

SEQ ID NO: 8776031 - DNA, 22 bp, Homo sapiens
tttattcaagatgaggttcatg

SEQ ID NO: 8776032 - DNA, 22 bp, Homo sapiens
tttattcaagatgaggttcatg

SEQ ID NO: 8776033 - DNA, 22 bp, Homo sapiens
tttatctgaaaaaactcttgga

SEQ ID NO: 8776034 - DNA, 22 bp, Homo sapiens
tttatctgagctgatagatagt

SEQ ID NO: 8776035 - DNA, 22 bp, Homo sapiens
tttatctgacctcacttcttaa

SEQ ID NO: 8776036 - DNA, 22 bp, Homo sapiens
tttatctcttttgaccaagatt

SEQ ID NO: 8776037 - DNA, 22 bp, Homo sapiens
tttatccattggttagaaaatc

SEQ ID NO: 8776038 - DNA, 22 bp, Homo sapiens
tttatccatcatctgctgaagg

SEQ ID NO: 8776039 - DNA, 22 bp, Homo sapiens
tttatccagtgttggaattttt

SEQ ID NO: 8776040 - DNA, 22 bp, Homo sapiens
tttatccatatcattaaaatct

SEQ ID NO: 8776041 - DNA, 22 bp, Homo sapiens
tttatccagcagctattcaaaa

SEQ ID NO: 8776042 - DNA, 22 bp, Homo sapiens
tttatccatatcattaaaatct

SEQ ID NO: 8776043 - DNA, 22 bp, Homo sapiens
tttatccagcagctattcaaaa

SEQ ID NO: 8776044 - DNA, 22 bp, Homo sapiens
tttatcatcttgtttttaaagc

SEQ ID NO: 8776045 - DNA, 22 bp, Homo sapiens
tttatcatcttgtttttaaagc

SEQ ID NO: 8776046 - DNA, 21 bp, Homo sapiens
tttatcatcacgagcttgagc

SEQ ID NO: 8776047 - DNA, 22 bp, Homo sapiens
tttatccagcagctattcaaaa

SEQ ID NO: 8776048 - DNA, 22 bp, Homo sapiens
tttatccaagcacaatttctaa

SEQ ID NO: 8776049 - DNA, 22 bp, Homo sapiens
tttatccaagggttttaactgt

SEQ ID NO: 8776050 - DNA, 22 bp, Homo sapiens
tttatccacagtatccaaaatc

SEQ ID NO: 8776051 - DNA, 22 bp, Homo sapiens
tttatcaaacaaattatccagc

SEQ ID NO: 8776052 - DNA, 22 bp, Homo sapiens
tttatcaaacaaattatccagc

SEQ ID NO: 8776053 - DNA, 22 bp, Homo sapiens
tttatcaaacaaattatccagc

SEQ ID NO: 8776054 - DNA, 22 bp, Homo sapiens
tttatcagtagcaaagttttaa

SEQ ID NO: 8776055 - DNA, 22 bp, Homo sapiens
tttatcagtagcaaagttttaa

SEQ ID NO: 8776056 - DNA, 22 bp, Homo sapiens
tttatcaaacaaattatccagc

SEQ ID NO: 8776057 - DNA, 21 bp, Homo sapiens
tttatcatcacgagcttgagc

SEQ ID NO: 8776058 - DNA, 22 bp, Homo sapiens
tttatcagagatatgtgtggac

SEQ ID NO: 8776059 - DNA, 22 bp, Homo sapiens
tttatcagaagttagagaaaga

SEQ ID NO: 8776060 - DNA, 22 bp, Homo sapiens
tttatcagaggctatgtttcat

SEQ ID NO: 8776061 - DNA, 22 bp, Homo sapiens
tttatataacagagactgctat

SEQ ID NO: 8776062 - DNA, 22 bp, Homo sapiens
tttatatagagatttgtgcatg

SEQ ID NO: 8776063 - DNA, 22 bp, Homo sapiens
tttagcagagcatatgatatcc

SEQ ID NO: 8776064 - DNA, 22 bp, Homo sapiens
tttagcagatctatgtatgtga

SEQ ID NO: 8776065 - DNA, 22 bp, Homo sapiens
tttagcacggtaacacataaag

SEQ ID NO: 8776066 - DNA, 20 bp, Homo sapiens
tttagcacattgtacaaaac

SEQ ID NO: 8776067 - DNA, 22 bp, Homo sapiens
tttagcaattattaagggttga

SEQ ID NO: 8776068 - DNA, 22 bp, Homo sapiens
tttagcaatttctaaaagtgtt

SEQ ID NO: 8776069 - DNA, 22 bp, Homo sapiens
tttagcaatatcataaggaaga

SEQ ID NO: 8776070 - DNA, 22 bp, Homo sapiens
tttagcaattattaagggttga

SEQ ID NO: 8776071 - DNA, 22 bp, Homo sapiens
tttagcaagttctctgagagaa

SEQ ID NO: 8776072 - DNA, 21 bp, Homo sapiens
tttagcaagagtatagtgcat

SEQ ID NO: 8776073 - DNA, 22 bp, Homo sapiens
tttagcaagtatttactgacta

SEQ ID NO: 8776074 - DNA, 22 bp, Homo sapiens
tttagcaataaagggatattaa

SEQ ID NO: 8776075 - DNA, 22 bp, Homo sapiens
tttatattgggagtcgttttga

SEQ ID NO: 8776076 - DNA, 22 bp, Homo sapiens
tttatattgtaaaaatggttct

SEQ ID NO: 8776077 - DNA, 22 bp, Homo sapiens
tttatattgtaaaaatggttct

SEQ ID NO: 8776078 - DNA, 22 bp, Homo sapiens
tttatatttcccaggattggcc

SEQ ID NO: 8776079 - DNA, 22 bp, Homo sapiens
tttatattgggagtcgttttga

SEQ ID NO: 8776080 - DNA, 22 bp, Homo sapiens
tttatattgggagtcgttttga

SEQ ID NO: 8776081 - DNA, 22 bp, Homo sapiens
tttatattgggagtcgttttga

SEQ ID NO: 8776082 - DNA, 22 bp, Homo sapiens
tttatattgggagtcgttttga

SEQ ID NO: 8776083 - DNA, 22 bp, Homo sapiens
tttatatagagatttgtgcatg

SEQ ID NO: 8776084 - DNA, 22 bp, Homo sapiens
tttatatatggctggtctggat

SEQ ID NO: 8776085 - DNA, 22 bp, Homo sapiens
tttatatagagatttgtgcatg

SEQ ID NO: 8776086 - DNA, 22 bp, Homo sapiens
tttatatagagatttgtgcatg

SEQ ID NO: 8776087 - DNA, 22 bp, Homo sapiens
tttagcatcgaagtaaatttag

SEQ ID NO: 8776088 - DNA, 22 bp, Homo sapiens
tttatatagagatttgtgcatg

SEQ ID NO: 8776089 - DNA, 22 bp, Homo sapiens
tttagagaggctctgtaaaatg

SEQ ID NO: 8776090 - DNA, 22 bp, Homo sapiens
tttagagagaattttcaaagtg

SEQ ID NO: 8776091 - DNA, 22 bp, Homo sapiens
tttagagaccctctgctatttt

SEQ ID NO: 8776092 - DNA, 22 bp, Homo sapiens
tttagagaattagaacagtact

SEQ ID NO: 8776093 - DNA, 22 bp, Homo sapiens
tttagagaccctctgctatttt

SEQ ID NO: 8776094 - DNA, 22 bp, Homo sapiens
tttagagtcattttatattgac

SEQ ID NO: 8776095 - DNA, 22 bp, Homo sapiens
tttagagtaaaaactgtgacct

SEQ ID NO: 8776096 - DNA, 22 bp, Homo sapiens
tttagagagtgtaaaaatatat

SEQ ID NO: 8776097 - DNA, 22 bp, Homo sapiens
tttagattgtgacctcccccca

SEQ ID NO: 8776098 - DNA, 22 bp, Homo sapiens
tttagattgtgacctcccccca

SEQ ID NO: 8776099 - DNA, 22 bp, Homo sapiens
tttagatgctgtatgttatttc

SEQ ID NO: 8776100 - DNA, 22 bp, Homo sapiens
tttagagtccaagttcttcact

SEQ ID NO: 8776101 - DNA, 22 bp, Homo sapiens
tttagagtctaatggtgaagat

SEQ ID NO: 8776102 - DNA, 22 bp, Homo sapiens
tttagagttggtcccctgtgag

SEQ ID NO: 8776103 - DNA, 22 bp, Homo sapiens
tttagagttgagtattcattgg

SEQ ID NO: 8776104 - DNA, 22 bp, Homo sapiens
tttagagttgagtattcattgg

SEQ ID NO: 8776105 - DNA, 22 bp, Homo sapiens
tttagagttgagtattcattgg

SEQ ID NO: 8776106 - DNA, 22 bp, Homo sapiens
tttagcaaggtaggtccatgga

SEQ ID NO: 8776107 - DNA, 22 bp, Homo sapiens
tttagcaaggagaaataatcct

SEQ ID NO: 8776108 - DNA, 22 bp, Homo sapiens
tttagcaaattagcacctctaa

SEQ ID NO: 8776109 - DNA, 22 bp, Homo sapiens
tttagcaacgaagcactcgaca

SEQ ID NO: 8776110 - DNA, 21 bp, Homo sapiens
tttagcaagagtatagtgcat

SEQ ID NO: 8776111 - DNA, 22 bp, Homo sapiens
tttagcaagatgccctggcttt

SEQ ID NO: 8776112 - DNA, 22 bp, Homo sapiens
tttagcaaaggtagggttcaga

SEQ ID NO: 8776113 - DNA, 22 bp, Homo sapiens
tttagcaaatatttctgttgat

SEQ ID NO: 8776114 - DNA, 22 bp, Homo sapiens
tttagcaaattactcacagggt

SEQ ID NO: 8776115 - DNA, 22 bp, Homo sapiens
tttagcaaattagcacctctaa

SEQ ID NO: 8776116 - DNA, 22 bp, Homo sapiens
tttagcaaaacattatgtctgt

SEQ ID NO: 8776117 - DNA, 22 bp, Homo sapiens
tttagcaaaacattatgtctgt

SEQ ID NO: 8776118 - DNA, 20 bp, Homo sapiens
tttagcaaaagggactgctc

SEQ ID NO: 8776119 - DNA, 22 bp, Homo sapiens
tttagcaaaacattatgtctgt

SEQ ID NO: 8776120 - DNA, 22 bp, Homo sapiens
tttacagtctgtctagcaatgt

SEQ ID NO: 8776121 - DNA, 22 bp, Homo sapiens
tttacagtctgtctagcaatgt

SEQ ID NO: 8776122 - DNA, 22 bp, Homo sapiens
tttacagtgagagcttagtgag

SEQ ID NO: 8776123 - DNA, 22 bp, Homo sapiens
tttacagtgagagcttagtgag

SEQ ID NO: 8776124 - DNA, 22 bp, Homo sapiens
tttacagtgagagcttagtgag

SEQ ID NO: 8776125 - DNA, 20 bp, Homo sapiens
tttaccaaaggagttatgat

SEQ ID NO: 8776126 - DNA, 20 bp, Homo sapiens
tttacattttgaaacagtga

SEQ ID NO: 8776127 - DNA, 20 bp, Homo sapiens
tttacattttgaaacagtga

SEQ ID NO: 8776128 - DNA, 20 bp, Homo sapiens
tttacattttgaaacagtga

SEQ ID NO: 8776129 - DNA, 20 bp, Homo sapiens
tttacattttgaaacagtga

SEQ ID NO: 8776130 - DNA, 20 bp, Homo sapiens
tttacattttgaaacagtga

SEQ ID NO: 8776131 - DNA, 20 bp, Homo sapiens
tttacattttgaaacagtga

SEQ ID NO: 8776132 - DNA, 22 bp, Homo sapiens
tttacagtgtcttgttgactgt

SEQ ID NO: 8776133 - DNA, 22 bp, Homo sapiens
tttaccacagaaaaaagtaact

SEQ ID NO: 8776134 - DNA, 22 bp, Homo sapiens
tttaccacaattttaaacaatg

SEQ ID NO: 8776135 - DNA, 22 bp, Homo sapiens
tttaccaagatagcatctggtt

SEQ ID NO: 8776136 - DNA, 22 bp, Homo sapiens
tttaccaagctttaattacata

SEQ ID NO: 8776137 - DNA, 22 bp, Homo sapiens
tttaccaagagttgtcactgtt

SEQ ID NO: 8776138 - DNA, 20 bp, Homo sapiens
tttaccaactcaccagtatc

SEQ ID NO: 8776139 - DNA, 22 bp, Homo sapiens
tttaccaaatgagactattgtt

SEQ ID NO: 8776140 - DNA, 22 bp, Homo sapiens
tttaccaaatgagactattgtt

SEQ ID NO: 8776141 - DNA, 22 bp, Homo sapiens
tttagaagggctggtcagaaat

SEQ ID NO: 8776142 - DNA, 22 bp, Homo sapiens
tttagaagacagatgcacagcc

SEQ ID NO: 8776143 - DNA, 22 bp, Homo sapiens
tttaccacagaaaaaagtaact

SEQ ID NO: 8776144 - DNA, 22 bp, Homo sapiens
tttaccacaattttaaacaatg

SEQ ID NO: 8776145 - DNA, 22 bp, Homo sapiens
tttagaagttcacacatttaaa

SEQ ID NO: 8776146 - DNA, 22 bp, Homo sapiens
tttagaagttcacacatttaaa

SEQ ID NO: 8776147 - DNA, 22 bp, Homo sapiens
tttagaagttcacacatttaaa

SEQ ID NO: 8776148 - DNA, 19 bp, Homo sapiens
tttagaagttgaaactctg

SEQ ID NO: 8776149 - DNA, 19 bp, Homo sapiens
tttagaagttgaaactctg

SEQ ID NO: 8776150 - DNA, 22 bp, Homo sapiens
tttaaagaaattcctcatcttt

SEQ ID NO: 8776151 - DNA, 22 bp, Homo sapiens
tttaaagaaattcctcatcttt

SEQ ID NO: 8776152 - DNA, 22 bp, Homo sapiens
tttaaagaaattcctcatcttt

SEQ ID NO: 8776153 - DNA, 22 bp, Homo sapiens
tttaaagagaatgtgaaggagt

SEQ ID NO: 8776154 - DNA, 22 bp, Homo sapiens
tttaaagagaatgtgaaggagt

SEQ ID NO: 8776155 - DNA, 22 bp, Homo sapiens
tttaaacctatctaagaaatag

SEQ ID NO: 8776156 - DNA, 17 bp, Homo sapiens
tttaaactactacaagg

SEQ ID NO: 8776157 - DNA, 17 bp, Homo sapiens
tttaaactactacaagg

SEQ ID NO: 8776158 - DNA, 22 bp, Homo sapiens
tttaaactgttgattttatgaa

SEQ ID NO: 8776159 - DNA, 22 bp, Homo sapiens
tttaaagaaattcctcatcttt

SEQ ID NO: 8776160 - DNA, 22 bp, Homo sapiens
tttaaactgttgattttatgaa

SEQ ID NO: 8776161 - DNA, 17 bp, Homo sapiens
ttgtgtgtagttctgat

SEQ ID NO: 8776162 - DNA, 17 bp, Homo sapiens
ttgtgtgtagttctgat

SEQ ID NO: 8776163 - DNA, 17 bp, Homo sapiens
ttgtgtgtagttctgat

SEQ ID NO: 8776164 - DNA, 22 bp, Homo sapiens
ttgtgtgtagactcagccattg

SEQ ID NO: 8776165 - DNA, 22 bp, Homo sapiens
ttgtgtgtagactcagccattg

SEQ ID NO: 8776166 - DNA, 22 bp, Homo sapiens
ttgtgtgtagactcagccattg

SEQ ID NO: 8776167 - DNA, 22 bp, Homo sapiens
tttaaacatcttgttgccttaa

SEQ ID NO: 8776168 - DNA, 22 bp, Homo sapiens
tttaaacatcttgttgccttaa

SEQ ID NO: 8776169 - DNA, 22 bp, Homo sapiens
tttaaacatcttgttgccttaa

SEQ ID NO: 8776170 - DNA, 22 bp, Homo sapiens
tttaaacatcttgttgccttaa

SEQ ID NO: 8776171 - DNA, 22 bp, Homo sapiens
ttgtgtgtactggttatgggca

SEQ ID NO: 8776172 - DNA, 22 bp, Homo sapiens
ttgtgtggtagcttcattgaac

SEQ ID NO: 8776173 - DNA, 22 bp, Homo sapiens
ttgtgtgtactggttatgggca

SEQ ID NO: 8776174 - DNA, 22 bp, Homo sapiens
ttgtgtcttaaagattaaatgg

SEQ ID NO: 8776175 - DNA, 22 bp, Homo sapiens
ttgtgtgactcctagagtagag

SEQ ID NO: 8776176 - DNA, 22 bp, Homo sapiens
ttgtgtggtagcttcattgaac

SEQ ID NO: 8776177 - DNA, 22 bp, Homo sapiens
ttgtgtggataatattacttga

SEQ ID NO: 8776178 - DNA, 22 bp, Homo sapiens
ttgtgtggataatattacttga

SEQ ID NO: 8776179 - DNA, 22 bp, Homo sapiens
ttgtgtgataagtctcttgtgc

SEQ ID NO: 8776180 - DNA, 19 bp, Homo sapiens
tttaaagtgactggtattt

SEQ ID NO: 8776181 - DNA, 19 bp, Homo sapiens
tttaaagtgactggtattt

SEQ ID NO: 8776182 - DNA, 22 bp, Homo sapiens
tttaaagtgctgctcctatcct

SEQ ID NO: 8776183 - DNA, 19 bp, Homo sapiens
tttaaagtgactggtattt

SEQ ID NO: 8776184 - DNA, 22 bp, Homo sapiens
tttaaataggactcctgggggt

SEQ ID NO: 8776185 - DNA, 22 bp, Homo sapiens
tttaaataggactcctgggggt

SEQ ID NO: 8776186 - DNA, 22 bp, Homo sapiens
tttaaagtggtccatttcagaa

SEQ ID NO: 8776187 - DNA, 22 bp, Homo sapiens
tttaaatgctttaagcaagggt

SEQ ID NO: 8776188 - DNA, 22 bp, Homo sapiens
tttaaatgctttaagcaagggt

SEQ ID NO: 8776189 - DNA, 22 bp, Homo sapiens
tttaaataggactcctgggggt

SEQ ID NO: 8776190 - DNA, 22 bp, Homo sapiens
tttaagatggtattttataaag

SEQ ID NO: 8776191 - DNA, 22 bp, Homo sapiens
tttaagatggtattttataaag

SEQ ID NO: 8776192 - DNA, 22 bp, Homo sapiens
tttaaatgtttatagagagtac

SEQ ID NO: 8776193 - DNA, 22 bp, Homo sapiens
tttaaatgttcatgatactgaa

SEQ ID NO: 8776194 - DNA, 22 bp, Homo sapiens
tttaaatgttcatgatactgaa

SEQ ID NO: 8776195 - DNA, 22 bp, Homo sapiens
tttaaatgttcatgatactgaa

SEQ ID NO: 8776196 - DNA, 22 bp, Homo sapiens
tttaaatgtgttcttagtagct

SEQ ID NO: 8776197 - DNA, 22 bp, Homo sapiens
tttaaatgtgttcttagtagct

SEQ ID NO: 8776198 - DNA, 22 bp, Homo sapiens
tttaagattcagtaaggcaaac

SEQ ID NO: 8776199 - DNA, 19 bp, Homo sapiens
tttaagcaatagtatcttg

SEQ ID NO: 8776200 - DNA, 22 bp, Homo sapiens
tttaagatttcttctcctgaga

SEQ ID NO: 8776201 - DNA, 22 bp, Homo sapiens
tttaagcagagaaatgatgtat

SEQ ID NO: 8776202 - DNA, 22 bp, Homo sapiens
tttaagctgtggcattaattct

SEQ ID NO: 8776203 - DNA, 22 bp, Homo sapiens
tttaaggattgtccatagtgtt

SEQ ID NO: 8776204 - DNA, 22 bp, Homo sapiens
tttaaggatgtaaaggaagaag

SEQ ID NO: 8776205 - DNA, 22 bp, Homo sapiens
tttaatgaataattcaaatctg

SEQ ID NO: 8776206 - DNA, 22 bp, Homo sapiens
tttaatgaataattcaaatctg

SEQ ID NO: 8776207 - DNA, 22 bp, Homo sapiens
tttaatcttcaaaatagtctta

SEQ ID NO: 8776208 - DNA, 22 bp, Homo sapiens
tttaatctattccctaaacacc

SEQ ID NO: 8776209 - DNA, 22 bp, Homo sapiens
tttaatctcccactctcagcct

SEQ ID NO: 8776210 - DNA, 22 bp, Homo sapiens
tttaagtcatggagaattgtgg

SEQ ID NO: 8776211 - DNA, 22 bp, Homo sapiens
tttacagtaaggtggatggtac

SEQ ID NO: 8776212 - DNA, 22 bp, Homo sapiens
tttacagtaaggtggatggtac

SEQ ID NO: 8776213 - DNA, 22 bp, Homo sapiens
tttacagtaaggtggatggtac

SEQ ID NO: 8776214 - DNA, 22 bp, Homo sapiens
tttacagggttcaagaatgaaa

SEQ ID NO: 8776215 - DNA, 22 bp, Homo sapiens
tttacagggttcaagaatgaaa

SEQ ID NO: 8776216 - DNA, 22 bp, Homo sapiens
tttacagtatagtaggactcat

SEQ ID NO: 8776217 - DNA, 22 bp, Homo sapiens
tttacagtcaccaaactttgct

SEQ ID NO: 8776218 - DNA, 22 bp, Homo sapiens
tttacagtcaccaaactttgct

SEQ ID NO: 8776219 - DNA, 22 bp, Homo sapiens
tttacagtctatgttgaattaa

SEQ ID NO: 8776220 - DNA, 22 bp, Homo sapiens
tttacagtctatgttgaattaa

SEQ ID NO: 8776221 - DNA, 22 bp, Homo sapiens
tttacagtccccaggtgaggat

SEQ ID NO: 8776222 - DNA, 22 bp, Homo sapiens
tttacagtctctatagtcaaaa

SEQ ID NO: 8776223 - DNA, 22 bp, Homo sapiens
tttacagtctctatagtcaaaa

SEQ ID NO: 8776224 - DNA, 22 bp, Homo sapiens
tttaatgtagcgtgaaatgatt

SEQ ID NO: 8776225 - DNA, 22 bp, Homo sapiens
tttaatgtgacatcttttagag

SEQ ID NO: 8776226 - DNA, 22 bp, Homo sapiens
tttaatgtgacatcttttagag

SEQ ID NO: 8776227 - DNA, 22 bp, Homo sapiens
tttaatgtattctttggaacca

SEQ ID NO: 8776228 - DNA, 22 bp, Homo sapiens
tttaatgtgacatcttttagag

SEQ ID NO: 8776229 - DNA, 22 bp, Homo sapiens
tttaatgtgagtccctttcaag

SEQ ID NO: 8776230 - DNA, 22 bp, Homo sapiens
tttacagcttctatactatgtg

SEQ ID NO: 8776231 - DNA, 19 bp, Homo sapiens
tttacagggaatggagacc

SEQ ID NO: 8776232 - DNA, 22 bp, Homo sapiens
tttacagggaatattttggctt

SEQ ID NO: 8776233 - DNA, 19 bp, Homo sapiens
tttacagggaatggagacc

SEQ ID NO: 8776234 - DNA, 22 bp, Homo sapiens
tttacagcttctatactatgtg

SEQ ID NO: 8776235 - DNA, 22 bp, Homo sapiens
tttaatggcaagaaggctgcag

SEQ ID NO: 8776236 - DNA, 22 bp, Homo sapiens
tttaatgcaatttctggtctgc

SEQ ID NO: 8776237 - DNA, 22 bp, Homo sapiens
tttaatgcccaaggctttgatg

SEQ ID NO: 8776238 - DNA, 22 bp, Homo sapiens
tttaatgatagtcttacgaaaa

SEQ ID NO: 8776239 - DNA, 22 bp, Homo sapiens
tttaatgatagtcttacgaaaa

SEQ ID NO: 8776240 - DNA, 23 bp, Homo sapiens
tttaatgaccaatagaaggaaca

SEQ ID NO: 8776241 - DNA, 23 bp, Homo sapiens
tttaatgaccaatagaaggaaca

SEQ ID NO: 8776242 - DNA, 23 bp, Homo sapiens
tttaatgaccaatagaaggaaca

SEQ ID NO: 8776243 - DNA, 22 bp, Homo sapiens
tttaatgatagctgtttcacat

SEQ ID NO: 8776244 - DNA, 22 bp, Homo sapiens
tttaatgaggtctctcgctggc

SEQ ID NO: 8776245 - DNA, 22 bp, Homo sapiens
tttaatgaggtctctcgctggc

SEQ ID NO: 8776246 - DNA, 22 bp, Homo sapiens
tttcatggctaggactagagtg

SEQ ID NO: 8776247 - DNA, 22 bp, Homo sapiens
tttcatgattaacttagtgaat

SEQ ID NO: 8776248 - DNA, 22 bp, Homo sapiens
tttcatgatccatttacaaaat

SEQ ID NO: 8776249 - DNA, 22 bp, Homo sapiens
tttcatgaggtctttcagcaag

SEQ ID NO: 8776250 - DNA, 22 bp, Homo sapiens
tttcatgaggctgcataaggag

SEQ ID NO: 8776251 - DNA, 22 bp, Homo sapiens
tttcagagctctaggctctcag

SEQ ID NO: 8776252 - DNA, 22 bp, Homo sapiens
tttcagagctcagcagctagag

SEQ ID NO: 8776253 - DNA, 22 bp, Homo sapiens
tttcagagatgtctagcctatt

SEQ ID NO: 8776254 - DNA, 22 bp, Homo sapiens
tttcagagcctttatctctcta

SEQ ID NO: 8776255 - DNA, 22 bp, Homo sapiens
tttcagagcctttatctctcta

SEQ ID NO: 8776256 - DNA, 22 bp, Homo sapiens
tttcagagctgagatgccacag

SEQ ID NO: 8776257 - DNA, 22 bp, Homo sapiens
tttcagagctgagatgccacag

SEQ ID NO: 8776258 - DNA, 22 bp, Homo sapiens
tttcagagctctaggctctcag

SEQ ID NO: 8776259 - DNA, 22 bp, Homo sapiens
tttcatcttgattctatatggc

SEQ ID NO: 8776260 - DNA, 22 bp, Homo sapiens
tttcatgtggcgatgtctctgg

SEQ ID NO: 8776261 - DNA, 22 bp, Homo sapiens
tttcatgttacagtgtaaaagt

SEQ ID NO: 8776262 - DNA, 22 bp, Homo sapiens
tttcatgttacagtgtaaaagt

SEQ ID NO: 8776263 - DNA, 22 bp, Homo sapiens
tttcatgtgttgaatgtgtaca

SEQ ID NO: 8776264 - DNA, 22 bp, Homo sapiens
tttcatgtgttgaatgtgtaca

SEQ ID NO: 8776265 - DNA, 22 bp, Homo sapiens
tttcatgtctgaattctttagt

SEQ ID NO: 8776266 - DNA, 22 bp, Homo sapiens
tttcatgtgcaattagcaatat

SEQ ID NO: 8776267 - DNA, 22 bp, Homo sapiens
tttcatgtcattccatttcaga

SEQ ID NO: 8776268 - DNA, 22 bp, Homo sapiens
tttcattgagactatagacatc

SEQ ID NO: 8776269 - DNA, 18 bp, Homo sapiens
tttcattgagtgtgatat

SEQ ID NO: 8776270 - DNA, 18 bp, Homo sapiens
tttcattgagtgtgatat

SEQ ID NO: 8776271 - DNA, 22 bp, Homo sapiens
tttcattgatgggtgatagaaa

SEQ ID NO: 8776272 - DNA, 22 bp, Homo sapiens
tttcattgagactatagacatc

SEQ ID NO: 8776273 - DNA, 22 bp, Homo sapiens
tttcattgagaatataagattt

SEQ ID NO: 8776274 - DNA, 21 bp, Homo sapiens
tttcattgaatgagataaggt

SEQ ID NO: 8776275 - DNA, 21 bp, Homo sapiens
tttcattgaatgagataaggt

SEQ ID NO: 8776276 - DNA, 22 bp, Homo sapiens
tttcattgagaatataagattt

SEQ ID NO: 8776277 - DNA, 22 bp, Homo sapiens
tttcattgagaatataagattt

SEQ ID NO: 8776278 - DNA, 22 bp, Homo sapiens
tttcattgacagttgggggaaa

SEQ ID NO: 8776279 - DNA, 22 bp, Homo sapiens
tttcattgaactaaagaatctg

SEQ ID NO: 8776280 - DNA, 22 bp, Homo sapiens
tttcattgaactaaagaatctg

SEQ ID NO: 8776281 - DNA, 22 bp, Homo sapiens
tttcattcattatacagtagag

SEQ ID NO: 8776282 - DNA, 22 bp, Homo sapiens
tttcattcattatacagtagag

SEQ ID NO: 8776283 - DNA, 22 bp, Homo sapiens
tttcattcatgtgttaaaggtg

SEQ ID NO: 8776284 - DNA, 22 bp, Homo sapiens
tttcattgatgggtgatagaaa

SEQ ID NO: 8776285 - DNA, 22 bp, Homo sapiens
tttcattgatgggtgatagaaa

SEQ ID NO: 8776286 - DNA, 22 bp, Homo sapiens
tttcattgatgggtgatagaaa

SEQ ID NO: 8776287 - DNA, 22 bp, Homo sapiens
tttcccagcctcagctcagcag

SEQ ID NO: 8776288 - DNA, 21 bp, Homo sapiens
tttcccagctgaaaataaatg

SEQ ID NO: 8776289 - DNA, 22 bp, Homo sapiens
tttccccaggtagatagataat

SEQ ID NO: 8776290 - DNA, 22 bp, Homo sapiens
tttccccaggtagatagataat

SEQ ID NO: 8776291 - DNA, 22 bp, Homo sapiens
tttcccattctaattactcatt

SEQ ID NO: 8776292 - DNA, 22 bp, Homo sapiens
tttcccattctaattactcatt

SEQ ID NO: 8776293 - DNA, 22 bp, Homo sapiens
tttcccattctaattactcatt

SEQ ID NO: 8776294 - DNA, 22 bp, Homo sapiens
tttcccatggcagaagccctgt

SEQ ID NO: 8776295 - DNA, 22 bp, Homo sapiens
tttcccatccatagccctgcaa

SEQ ID NO: 8776296 - DNA, 22 bp, Homo sapiens
tttcccatcttagcagattaaa

SEQ ID NO: 8776297 - DNA, 22 bp, Homo sapiens
tttcccatcttagcagattaaa

SEQ ID NO: 8776298 - DNA, 22 bp, Homo sapiens
tttcccatccatagccctgcaa

SEQ ID NO: 8776299 - DNA, 22 bp, Homo sapiens
tttcccagttagtgaagacatg

SEQ ID NO: 8776300 - DNA, 22 bp, Homo sapiens
tttcccagttccctgctctata

SEQ ID NO: 8776301 - DNA, 22 bp, Homo sapiens
tttcccagttagtgaagacatg

SEQ ID NO: 8776302 - DNA, 19 bp, Homo sapiens
tttcccagtcccaggagtg

SEQ ID NO: 8776303 - DNA, 22 bp, Homo sapiens
tttcccaggctggaatgcagtg

SEQ ID NO: 8776304 - DNA, 22 bp, Homo sapiens
tttcagagcctttatctctcta

SEQ ID NO: 8776305 - DNA, 22 bp, Homo sapiens
tttcagagcctgcaatcccaat

SEQ ID NO: 8776306 - DNA, 22 bp, Homo sapiens
tttcagagaggcttcaaatctt

SEQ ID NO: 8776307 - DNA, 22 bp, Homo sapiens
tttcagagatgtctagcctatt

SEQ ID NO: 8776308 - DNA, 22 bp, Homo sapiens
tttcagagatgcagaattcagg

SEQ ID NO: 8776309 - DNA, 22 bp, Homo sapiens
tttcagagatgcagaattcagg

SEQ ID NO: 8776310 - DNA, 22 bp, Homo sapiens
tttcagagaactgagtccttgc

SEQ ID NO: 8776311 - DNA, 22 bp, Homo sapiens
tttcagagaattagaagctgat

SEQ ID NO: 8776312 - DNA, 22 bp, Homo sapiens
tttcagagaattagaagctgat

SEQ ID NO: 8776313 - DNA, 22 bp, Homo sapiens
tttcagagaggcttcaaatctt

SEQ ID NO: 8776314 - DNA, 22 bp, Homo sapiens
tttcagagaggcttcaaatctt

SEQ ID NO: 8776315 - DNA, 22 bp, Homo sapiens
tttcagagagatcaacatagct

SEQ ID NO: 8776316 - DNA, 22 bp, Homo sapiens
tttcagagagatcaacatagct

SEQ ID NO: 8776317 - DNA, 22 bp, Homo sapiens
tttcagactccaaattcataag

SEQ ID NO: 8776318 - DNA, 22 bp, Homo sapiens
tttcagagaactgagtccttgc

SEQ ID NO: 8776319 - DNA, 22 bp, Homo sapiens
tttcagagaactgagtccttgc

SEQ ID NO: 8776320 - DNA, 22 bp, Homo sapiens
tttcagagaaagcccaaagact

SEQ ID NO: 8776321 - DNA, 22 bp, Homo sapiens
tttcagacataccagttattga

SEQ ID NO: 8776322 - DNA, 22 bp, Homo sapiens
tttcagacagtgggtccatcca

SEQ ID NO: 8776323 - DNA, 22 bp, Homo sapiens
tttcagaaaacttatcatcagt

SEQ ID NO: 8776324 - DNA, 22 bp, Homo sapiens
tttcactgttaggagtatgcta

SEQ ID NO: 8776325 - DNA, 22 bp, Homo sapiens
tttcagaaacgattatgaacac

SEQ ID NO: 8776326 - DNA, 22 bp, Homo sapiens
tttcagaaagcatcatcaaagt

SEQ ID NO: 8776327 - DNA, 22 bp, Homo sapiens
tttcagaaagcatcatcaaagt

SEQ ID NO: 8776328 - DNA, 22 bp, Homo sapiens
tttcagaaatcaaaaccagggt

SEQ ID NO: 8776329 - DNA, 22 bp, Homo sapiens
tttcagaaagctgaacatatga

SEQ ID NO: 8776330 - DNA, 22 bp, Homo sapiens
tttcagaaatggcactgaaatc

SEQ ID NO: 8776331 - DNA, 22 bp, Homo sapiens
tttcacagctgggtggcagagt

SEQ ID NO: 8776332 - DNA, 22 bp, Homo sapiens
tttcacagctgtcttccgtctc

SEQ ID NO: 8776333 - DNA, 22 bp, Homo sapiens
tttcacagctgggtggcagagt

SEQ ID NO: 8776334 - DNA, 22 bp, Homo sapiens
tttcacagctagtgagcttcta

SEQ ID NO: 8776335 - DNA, 22 bp, Homo sapiens
tttcacagctagtgagcttcta

SEQ ID NO: 8776336 - DNA, 22 bp, Homo sapiens
tttcacagcgtctttctcttgc

SEQ ID NO: 8776337 - DNA, 22 bp, Homo sapiens
tttcacagcgtctttctcttgc

SEQ ID NO: 8776338 - DNA, 22 bp, Homo sapiens
tttcacagctgggaagagatat

SEQ ID NO: 8776339 - DNA, 22 bp, Homo sapiens
tttcacagctgggaagagatat

SEQ ID NO: 8776340 - DNA, 22 bp, Homo sapiens
tttcacagctgatacctcttcc

SEQ ID NO: 8776341 - DNA, 22 bp, Homo sapiens
tttcacagcagaatttctgagg

SEQ ID NO: 8776342 - DNA, 22 bp, Homo sapiens
tttcacagcagtgtgctgcttt

SEQ ID NO: 8776343 - DNA, 22 bp, Homo sapiens
tttcacagcagtgtgctgcttt

SEQ ID NO: 8776344 - DNA, 22 bp, Homo sapiens
tttcacagcagtgtgctgcttt

SEQ ID NO: 8776345 - DNA, 22 bp, Homo sapiens
tttcacagcaacactgtctgca

SEQ ID NO: 8776346 - DNA, 22 bp, Homo sapiens
tttcacagcaacactgtctgca

SEQ ID NO: 8776347 - DNA, 22 bp, Homo sapiens
tttcacagcaacactgtctgca

SEQ ID NO: 8776348 - DNA, 22 bp, Homo sapiens
tttcacagcagaatttctgagg

SEQ ID NO: 8776349 - DNA, 22 bp, Homo sapiens
tttcacagatgttttggagtct

SEQ ID NO: 8776350 - DNA, 18 bp, Homo sapiens
tttcacagattcatgact

SEQ ID NO: 8776351 - DNA, 22 bp, Homo sapiens
tttcaccaaggtaacctttgat

SEQ ID NO: 8776352 - DNA, 20 bp, Homo sapiens
tttcaccatcttggccaggc

SEQ ID NO: 8776353 - DNA, 22 bp, Homo sapiens
tttcaccatcttggccaggctg

SEQ ID NO: 8776354 - DNA, 22 bp, Homo sapiens
tttcacatttgttttaagaagt

SEQ ID NO: 8776355 - DNA, 22 bp, Homo sapiens
tttcacagcttccacttaagga

SEQ ID NO: 8776356 - DNA, 22 bp, Homo sapiens
tttcacagcttccacttaagga

SEQ ID NO: 8776357 - DNA, 22 bp, Homo sapiens
tttcacagcttccacttaagga

SEQ ID NO: 8776358 - DNA, 22 bp, Homo sapiens
tttcacattttatacttaagcc

SEQ ID NO: 8776359 - DNA, 22 bp, Homo sapiens
tttcactagaacgttcttgttt

SEQ ID NO: 8776360 - DNA, 22 bp, Homo sapiens
tttcactcagctctcattgtct

SEQ ID NO: 8776361 - DNA, 22 bp, Homo sapiens
tttcacctcagtctttttatat

SEQ ID NO: 8776362 - DNA, 22 bp, Homo sapiens
tttcactgggcttgcagaaatc

SEQ ID NO: 8776363 - DNA, 20 bp, Homo sapiens
tttcactggcttgataaggt

SEQ ID NO: 8776364 - DNA, 20 bp, Homo sapiens
tttcactggcttgataaggt

SEQ ID NO: 8776365 - DNA, 20 bp, Homo sapiens
tttcactgtggtgctggaga

SEQ ID NO: 8776366 - DNA, 22 bp, Homo sapiens
tttcactgggcttgcagaaatc

SEQ ID NO: 8776367 - DNA, 22 bp, Homo sapiens
tttcactgttaggagtatgcta

SEQ ID NO: 8776368 - DNA, 22 bp, Homo sapiens
tttcactgttaggagtatgcta

SEQ ID NO: 8776369 - DNA, 22 bp, Homo sapiens
tttcaaagtaaggattttcatc

SEQ ID NO: 8776370 - DNA, 22 bp, Homo sapiens
tttcaaaggttttgtcatgtct

SEQ ID NO: 8776371 - DNA, 22 bp, Homo sapiens
tttcaaaggttttgtcatgtct

SEQ ID NO: 8776372 - DNA, 22 bp, Homo sapiens
tttcaaaggtggaagagtgaat

SEQ ID NO: 8776373 - DNA, 23 bp, Homo sapiens
tttcaacaatgcttagagaaaac

SEQ ID NO: 8776374 - DNA, 23 bp, Homo sapiens
tttcaacaatgcttagagaaaac

SEQ ID NO: 8776375 - DNA, 23 bp, Homo sapiens
tttcaacaatgcttagagaaaac

SEQ ID NO: 8776376 - DNA, 22 bp, Homo sapiens
tttcaacagaatatgatcagag

SEQ ID NO: 8776377 - DNA, 22 bp, Homo sapiens
tttcaacagaatatgatcagag

SEQ ID NO: 8776378 - DNA, 22 bp, Homo sapiens
tttcaacagctctcaaatgatc

SEQ ID NO: 8776379 - DNA, 22 bp, Homo sapiens
tttcaacagctctcaaatgatc

SEQ ID NO: 8776380 - DNA, 22 bp, Homo sapiens
tttcaacagatctgtcttcagg

SEQ ID NO: 8776381 - DNA, 22 bp, Homo sapiens
tttcaacaccagagaccatgcg

SEQ ID NO: 8776382 - DNA, 20 bp, Homo sapiens
tttcaacaatttcccttcca

SEQ ID NO: 8776383 - DNA, 22 bp, Homo sapiens
tttcaacactgcatcctcccta

SEQ ID NO: 8776384 - DNA, 22 bp, Homo sapiens
tttcaacagaatatgatcagag

SEQ ID NO: 8776385 - DNA, 19 bp, Homo sapiens
tttcaaagggcataagcct

SEQ ID NO: 8776386 - DNA, 22 bp, Homo sapiens
tttattgcatacacaaatgtca

SEQ ID NO: 8776387 - DNA, 20 bp, Homo sapiens
tttattgagcacgtactgtg

SEQ ID NO: 8776388 - DNA, 22 bp, Homo sapiens
tttattgacttcagtgagtctt

SEQ ID NO: 8776389 - DNA, 22 bp, Homo sapiens
tttattgacttcagtgagtctt

SEQ ID NO: 8776390 - DNA, 22 bp, Homo sapiens
tttattgacccaaagcgagagt

SEQ ID NO: 8776391 - DNA, 22 bp, Homo sapiens
tttattcaagatgaggttcatg

SEQ ID NO: 8776392 - DNA, 20 bp, Homo sapiens
tttattcacagagaagagtt

SEQ ID NO: 8776393 - DNA, 20 bp, Homo sapiens
tttattcacagagaagagtt

SEQ ID NO: 8776394 - DNA, 20 bp, Homo sapiens
tttattcacagagaagagtt

SEQ ID NO: 8776395 - DNA, 20 bp, Homo sapiens
tttattcacagagaagagtt

SEQ ID NO: 8776396 - DNA, 19 bp, Homo sapiens
tttattcacctttaccttg

SEQ ID NO: 8776397 - DNA, 22 bp, Homo sapiens
tttattctagctcagaatagtt

SEQ ID NO: 8776398 - DNA, 22 bp, Homo sapiens
tttattctagctcagaatagtt

SEQ ID NO: 8776399 - DNA, 21 bp, Homo sapiens
tttattctcagatacagggag

SEQ ID NO: 8776400 - DNA, 22 bp, Homo sapiens
tttattctataggcattaagca

SEQ ID NO: 8776401 - DNA, 22 bp, Homo sapiens
tttattctataggcattaagca

SEQ ID NO: 8776402 - DNA, 22 bp, Homo sapiens
tttattctctagttggtcagat

SEQ ID NO: 8776403 - DNA, 23 bp, Homo sapiens
tttattctcagatacataggtct

SEQ ID NO: 8776404 - DNA, 23 bp, Homo sapiens
tttattctcagatacataggtct

SEQ ID NO: 8776405 - DNA, 22 bp, Homo sapiens
tttattctgtgctacatgaaga

SEQ ID NO: 8776406 - DNA, 22 bp, Homo sapiens
tttattctgtgctacatgaaga

SEQ ID NO: 8776407 - DNA, 22 bp, Homo sapiens
tttattctgtgctacatgaaga

SEQ ID NO: 8776408 - DNA, 22 bp, Homo sapiens
tttattcttgagagtgagaaga

SEQ ID NO: 8776409 - DNA, 22 bp, Homo sapiens
tttattgaacacttgcactggc

SEQ ID NO: 8776410 - DNA, 22 bp, Homo sapiens
tttcaagacgttaagtcagctt

SEQ ID NO: 8776411 - DNA, 22 bp, Homo sapiens
tttcaagactcattgagtattg

SEQ ID NO: 8776412 - DNA, 22 bp, Homo sapiens
tttcaagagcaggaaaaaggtc

SEQ ID NO: 8776413 - DNA, 22 bp, Homo sapiens
tttcaagagaaaactaacctat

SEQ ID NO: 8776414 - DNA, 22 bp, Homo sapiens
tttcaagagaaaactaacctat

SEQ ID NO: 8776415 - DNA, 22 bp, Homo sapiens
tttcaagagcaggaaaaaggtc

SEQ ID NO: 8776416 - DNA, 22 bp, Homo sapiens
tttcaagagcaggaaaaaggtc

SEQ ID NO: 8776417 - DNA, 23 bp, Homo sapiens
tttcaactcctgccattatttct

SEQ ID NO: 8776418 - DNA, 23 bp, Homo sapiens
tttcaactcctgccattatttct

SEQ ID NO: 8776419 - DNA, 22 bp, Homo sapiens
tttcaactcatgctaaaggaag

SEQ ID NO: 8776420 - DNA, 22 bp, Homo sapiens
tttcaagaacagcagcattcca

SEQ ID NO: 8776421 - DNA, 22 bp, Homo sapiens
tttcaagaagcaaattaaagtc

SEQ ID NO: 8776422 - DNA, 22 bp, Homo sapiens
tttcaagaacaacattcattca

SEQ ID NO: 8776423 - DNA, 22 bp, Homo sapiens
tttcaagaacaacattcattca

SEQ ID NO: 8776424 - DNA, 23 bp, Homo sapiens
tttcaacaggcagagaagactta

SEQ ID NO: 8776425 - DNA, 22 bp, Homo sapiens
tttcaacagggcacaggtgcca

SEQ ID NO: 8776426 - DNA, 22 bp, Homo sapiens
tttcaacaggatgataataggc

SEQ ID NO: 8776427 - DNA, 22 bp, Homo sapiens
tttcaacaggatgataataggc

SEQ ID NO: 8776428 - DNA, 22 bp, Homo sapiens
tttcaacaggatgataataggc

SEQ ID NO: 8776429 - DNA, 22 bp, Homo sapiens
tttcaacatcacctagcagttc

SEQ ID NO: 8776430 - DNA, 22 bp, Homo sapiens
tttcaacatcacctagcagttc

SEQ ID NO: 8776431 - DNA, 22 bp, Homo sapiens
tttcaacgtgtaatcttattta

SEQ ID NO: 8776432 - DNA, 17 bp, Homo sapiens
tttcaacatcactcagc

SEQ ID NO: 8776433 - DNA, 22 bp, Homo sapiens
tttcaacatcacctagcagttc

SEQ ID NO: 8776434 - DNA, 22 bp, Homo sapiens
tttcaacatcacctagcagttc

SEQ ID NO: 8776435 - DNA, 22 bp, Homo sapiens
tttcaacatacctcagtgtatg

SEQ ID NO: 8776436 - DNA, 22 bp, Homo sapiens
tttcaacatacctcagtgtatg

SEQ ID NO: 8776437 - DNA, 22 bp, Homo sapiens
tttcaacatataccataatgcc

SEQ ID NO: 8776438 - DNA, 22 bp, Homo sapiens
tttcaacatataccataatgcc

SEQ ID NO: 8776439 - DNA, 22 bp, Homo sapiens
tttcaacatataccataatgcc

SEQ ID NO: 8776440 - DNA, 23 bp, Homo sapiens
tttcacagaaggattgtagggcc

SEQ ID NO: 8776441 - DNA, 22 bp, Homo sapiens
tttcacagaactcactaaggag

SEQ ID NO: 8776442 - DNA, 22 bp, Homo sapiens
tttcacagaaaggataacatta

SEQ ID NO: 8776443 - DNA, 22 bp, Homo sapiens
tttcacagaaaggataacatta

SEQ ID NO: 8776444 - DNA, 22 bp, Homo sapiens
tttcacagaaaggataacatta

SEQ ID NO: 8776445 - DNA, 22 bp, Homo sapiens
tttcacagaaagacaacagata

SEQ ID NO: 8776446 - DNA, 22 bp, Homo sapiens
tttcacagaaagacaacagata

SEQ ID NO: 8776447 - DNA, 22 bp, Homo sapiens
tttcacagaaagaagctagttt

SEQ ID NO: 8776448 - DNA, 22 bp, Homo sapiens
tttcacagaaagaagctagttt

SEQ ID NO: 8776449 - DNA, 22 bp, Homo sapiens
tttcacagatataagatttcac

SEQ ID NO: 8776450 - DNA, 22 bp, Homo sapiens
tttcacagatataagatttcac

SEQ ID NO: 8776451 - DNA, 22 bp, Homo sapiens
tttcacagatcctacagcttgt

SEQ ID NO: 8776452 - DNA, 22 bp, Homo sapiens
tttcacagatcctacagcttgt

SEQ ID NO: 8776453 - DNA, 22 bp, Homo sapiens
tttcacagatgttttggagtct

SEQ ID NO: 8776454 - DNA, 22 bp, Homo sapiens
tttcacagatgttttggagtct

SEQ ID NO: 8776455 - DNA, 22 bp, Homo sapiens
tttcacagagaaatataacagg

SEQ ID NO: 8776456 - DNA, 22 bp, Homo sapiens
tttcacagagaaatataacagg

SEQ ID NO: 8776457 - DNA, 22 bp, Homo sapiens
tttcacagaggaggaagctgag

SEQ ID NO: 8776458 - DNA, 22 bp, Homo sapiens
tttcacagaggaggaagctgag

SEQ ID NO: 8776459 - DNA, 22 bp, Homo sapiens
tttcacagaggaggaagctgag

SEQ ID NO: 8776460 - DNA, 22 bp, Homo sapiens
tttcacagaggaggaagctgag

SEQ ID NO: 8776461 - DNA, 22 bp, Homo sapiens
tttcacagagaatattgccttg

SEQ ID NO: 8776462 - DNA, 22 bp, Homo sapiens
tttcacagagaatattgccttg

SEQ ID NO: 8776463 - DNA, 22 bp, Homo sapiens
tttcacagagaaatataacagg

SEQ ID NO: 8776464 - DNA, 22 bp, Homo sapiens
tttcacactagtcagaatacca

SEQ ID NO: 8776465 - DNA, 22 bp, Homo sapiens
tttcacactgcagcatcagaga

SEQ ID NO: 8776466 - DNA, 22 bp, Homo sapiens
tttcacacaacgtgaatatact

SEQ ID NO: 8776467 - DNA, 22 bp, Homo sapiens
tttcacacccactaggactgtt

SEQ ID NO: 8776468 - DNA, 22 bp, Homo sapiens
tttcacacccactaggactgtt

SEQ ID NO: 8776469 - DNA, 22 bp, Homo sapiens
tttcacaattttaaggagcaaa

SEQ ID NO: 8776470 - DNA, 22 bp, Homo sapiens
tttcacaatgcaatcctacttc

SEQ ID NO: 8776471 - DNA, 23 bp, Homo sapiens
tttcacaatgagcattacagaat

SEQ ID NO: 8776472 - DNA, 23 bp, Homo sapiens
tttcacaatgagcattacagaat

SEQ ID NO: 8776473 - DNA, 20 bp, Homo sapiens
tttcacaatgaacatgtctc

SEQ ID NO: 8776474 - DNA, 20 bp, Homo sapiens
tttcacaatgaacatgtctc

SEQ ID NO: 8776475 - DNA, 22 bp, Homo sapiens
ttggacagcacagacatagaat

SEQ ID NO: 8776476 - DNA, 22 bp, Homo sapiens
ttggacagaattttgtgtgtgt

SEQ ID NO: 8776477 - DNA, 22 bp, Homo sapiens
ttggaatttgcttcagctaata

SEQ ID NO: 8776478 - DNA, 21 bp, Homo sapiens
ttggaatttgggagctatgtg

SEQ ID NO: 8776479 - DNA, 22 bp, Homo sapiens
ttggaatttcatgtaagtgact

SEQ ID NO: 8776480 - DNA, 22 bp, Homo sapiens
ttggaattgtgaactaagtgat

SEQ ID NO: 8776481 - DNA, 22 bp, Homo sapiens
ttggaattgctcataagagaga

SEQ ID NO: 8776482 - DNA, 22 bp, Homo sapiens
ttggaatttagtaaaataatgc

SEQ ID NO: 8776483 - DNA, 22 bp, Homo sapiens
ttggaattcctgttgtttcgtc

SEQ ID NO: 8776484 - DNA, 22 bp, Homo sapiens
ttggaattgaggatttacatag

SEQ ID NO: 8776485 - DNA, 22 bp, Homo sapiens
ttggaaatggctgtagttatga

SEQ ID NO: 8776486 - DNA, 22 bp, Homo sapiens
ttggaaatggctgtagttatga

SEQ ID NO: 8776487 - DNA, 23 bp, Homo sapiens
ttggaaatggggagaacagattc

SEQ ID NO: 8776488 - DNA, 22 bp, Homo sapiens
ttggaaatacagcagttacttt

SEQ ID NO: 8776489 - DNA, 22 bp, Homo sapiens
ttggaaatgcaaatatattgaa

SEQ ID NO: 8776490 - DNA, 22 bp, Homo sapiens
ttggaaatgcaaatatattgaa

SEQ ID NO: 8776491 - DNA, 22 bp, Homo sapiens
ttggaaatgatttctattatta

SEQ ID NO: 8776492 - DNA, 22 bp, Homo sapiens
ttggaaatacagcagttacttt

SEQ ID NO: 8776493 - DNA, 22 bp, Homo sapiens
ttggaaagtttttactgaagac

SEQ ID NO: 8776494 - DNA, 22 bp, Homo sapiens
ttggaaagtttttactgaagac

SEQ ID NO: 8776495 - DNA, 22 bp, Homo sapiens
ttggaaagggaggaatgtagac

SEQ ID NO: 8776496 - DNA, 22 bp, Homo sapiens
ttggaaagggatatctgtactt

SEQ ID NO: 8776497 - DNA, 22 bp, Homo sapiens
ttggaaaggagattctattgtg

SEQ ID NO: 8776498 - DNA, 22 bp, Homo sapiens
ttggaaaggagattctattgtg

SEQ ID NO: 8776499 - DNA, 22 bp, Homo sapiens
ttggaaagggaggaatgtagac

SEQ ID NO: 8776500 - DNA, 22 bp, Homo sapiens
ttggaaagcagccgcagccaat

SEQ ID NO: 8776501 - DNA, 22 bp, Homo sapiens
ttggaaaggagattctattgtg

SEQ ID NO: 8776502 - DNA, 22 bp, Homo sapiens
ttggaaagcccattatttggac

SEQ ID NO: 8776503 - DNA, 22 bp, Homo sapiens
ttggaaagaagggctgagcaag

SEQ ID NO: 8776504 - DNA, 22 bp, Homo sapiens
ttggaaagaccgaattcctgtt

SEQ ID NO: 8776505 - DNA, 22 bp, Homo sapiens
ttggaaagattattattatgaa

SEQ ID NO: 8776506 - DNA, 22 bp, Homo sapiens
ttggaaacttggatggaaaacc

SEQ ID NO: 8776507 - DNA, 22 bp, Homo sapiens
ttggaaacgtcaccttttcctt

SEQ ID NO: 8776508 - DNA, 22 bp, Homo sapiens
ttggaaaatgtatttctagaag

SEQ ID NO: 8776509 - DNA, 22 bp, Homo sapiens
ttggaaaccaggctttgagacg

SEQ ID NO: 8776510 - DNA, 22 bp, Homo sapiens
ttggaaaatgaggcacagagag

SEQ ID NO: 8776511 - DNA, 22 bp, Homo sapiens
ttgctttccgtcatgtgctaat

SEQ ID NO: 8776512 - DNA, 22 bp, Homo sapiens
ttgctttcccaaggcagaacat

SEQ ID NO: 8776513 - DNA, 22 bp, Homo sapiens
ttgcttatttgattaaatgtct

SEQ ID NO: 8776514 - DNA, 22 bp, Homo sapiens
ttgcttcaccccaccttgttgc

SEQ ID NO: 8776515 - DNA, 22 bp, Homo sapiens
ttgcttcactacttctaggctc

SEQ ID NO: 8776516 - DNA, 22 bp, Homo sapiens
ttgcttcactacttctaggctc

SEQ ID NO: 8776517 - DNA, 22 bp, Homo sapiens
ttgcttcagagaggaggaggtg

SEQ ID NO: 8776518 - DNA, 22 bp, Homo sapiens
ttgcttcagagaggaggaggtg

SEQ ID NO: 8776519 - DNA, 22 bp, Homo sapiens
ttgcttcagagacagggctcac

SEQ ID NO: 8776520 - DNA, 22 bp, Homo sapiens
ttgctttatttggcatgccact

SEQ ID NO: 8776521 - DNA, 22 bp, Homo sapiens
ttgcttcagagggagacacttt

SEQ ID NO: 8776522 - DNA, 22 bp, Homo sapiens
ttgcattacatttgctcagtct

SEQ ID NO: 8776523 - DNA, 22 bp, Homo sapiens
ttgcattacatttgctcagtct

SEQ ID NO: 8776524 - DNA, 22 bp, Homo sapiens
ttgcattgatgtctatacgctg

SEQ ID NO: 8776525 - DNA, 22 bp, Homo sapiens
ttgcattgcttggtcttcaaga

SEQ ID NO: 8776526 - DNA, 22 bp, Homo sapiens
ttgcattgttgcaatgaagtat

SEQ ID NO: 8776527 - DNA, 22 bp, Homo sapiens
ttgcatttaagtagatgttaca

SEQ ID NO: 8776528 - DNA, 22 bp, Homo sapiens
ttgcattgtaggatgttagaag

SEQ ID NO: 8776529 - DNA, 22 bp, Homo sapiens
ttgctctgtcagggcctcagtc

SEQ ID NO: 8776530 - DNA, 22 bp, Homo sapiens
ttgctctgtccagccagcaggt

SEQ ID NO: 8776531 - DNA, 22 bp, Homo sapiens
ttgctctgtccagccagcaggt

SEQ ID NO: 8776532 - DNA, 22 bp, Homo sapiens
ttgctctgactggagtgcagtg

SEQ ID NO: 8776533 - DNA, 22 bp, Homo sapiens
ttgctctgcagtccagacagta

SEQ ID NO: 8776534 - DNA, 22 bp, Homo sapiens
ttgctctgattaggtggaaaca

SEQ ID NO: 8776535 - DNA, 22 bp, Homo sapiens
ttgctctgtaataatctggggt

SEQ ID NO: 8776536 - DNA, 22 bp, Homo sapiens
ttgctctgaaccacaccatcac

SEQ ID NO: 8776537 - DNA, 22 bp, Homo sapiens
ttgctctgaacccagggcacca

SEQ ID NO: 8776538 - DNA, 22 bp, Homo sapiens
ttgctctcagaggaggaggccg

SEQ ID NO: 8776539 - DNA, 22 bp, Homo sapiens
ttgctctatgtttgtaaacaga

SEQ ID NO: 8776540 - DNA, 19 bp, Homo sapiens
ttgctcccaccccagtttt

SEQ ID NO: 8776541 - DNA, 21 bp, Homo sapiens
ttgctctacagtgagggcagc

SEQ ID NO: 8776542 - DNA, 22 bp, Homo sapiens
ttgctctaccctgatcagttaa

SEQ ID NO: 8776543 - DNA, 22 bp, Homo sapiens
ttgctctagtggcccctgaatg

SEQ ID NO: 8776544 - DNA, 22 bp, Homo sapiens
ttgctctatcacagtgatggga

SEQ ID NO: 8776545 - DNA, 22 bp, Homo sapiens
ttgctgtgtcatttgtttaatc

SEQ ID NO: 8776546 - DNA, 22 bp, Homo sapiens
ttgctgttgatgatgtgataca

SEQ ID NO: 8776547 - DNA, 22 bp, Homo sapiens
ttgctgacctttgctctccgtt

SEQ ID NO: 8776548 - DNA, 22 bp, Homo sapiens
ttgctgagagcgtgtcaacaag

SEQ ID NO: 8776549 - DNA, 22 bp, Homo sapiens
ttgctgagagcgtgtcaacaag

SEQ ID NO: 8776550 - DNA, 22 bp, Homo sapiens
ttgctgtgtaactcctggcctg

SEQ ID NO: 8776551 - DNA, 22 bp, Homo sapiens
ttgctgtagttcaatatgtggt

SEQ ID NO: 8776552 - DNA, 22 bp, Homo sapiens
ttgcttagagccaatcttgatt

SEQ ID NO: 8776553 - DNA, 23 bp, Homo sapiens
ttgcttagagacctcctcatcag

SEQ ID NO: 8776554 - DNA, 22 bp, Homo sapiens
ttgcttatgcctcttgacaaag

SEQ ID NO: 8776555 - DNA, 22 bp, Homo sapiens
ttgctgtttctctgtgtctggt

SEQ ID NO: 8776556 - DNA, 22 bp, Homo sapiens
ttgctgtttaatgatgtcttat

SEQ ID NO: 8776557 - DNA, 20 bp, Homo sapiens
ttgctgttgccaagattttg

SEQ ID NO: 8776558 - DNA, 21 bp, Homo sapiens
ttgctgttttcccaatgcagt

SEQ ID NO: 8776559 - DNA, 22 bp, Homo sapiens
ttgctgttttacttacaagctc

SEQ ID NO: 8776560 - DNA, 22 bp, Homo sapiens
ttgctgttttacttacaagctc

SEQ ID NO: 8776561 - DNA, 21 bp, Homo sapiens
ttgctgttttcccaatgcagt

SEQ ID NO: 8776562 - DNA, 22 bp, Homo sapiens
ttgctgttttacatctggtggg

SEQ ID NO: 8776563 - DNA, 22 bp, Homo sapiens
ttgctcttgaaaattgatgctg

SEQ ID NO: 8776564 - DNA, 22 bp, Homo sapiens
ttgctgaaagtggcaagaagta

SEQ ID NO: 8776565 - DNA, 22 bp, Homo sapiens
ttgctgaagttgctcagctcca

SEQ ID NO: 8776566 - DNA, 22 bp, Homo sapiens
ttgctgaagttgctcagctcca

SEQ ID NO: 8776567 - DNA, 22 bp, Homo sapiens
ttgctgaaatctatgacatcct

SEQ ID NO: 8776568 - DNA, 19 bp, Homo sapiens
ttgctgaaggaagcctctg

SEQ ID NO: 8776569 - DNA, 22 bp, Homo sapiens
ttgacaagcgaagtaccataat

SEQ ID NO: 8776570 - DNA, 22 bp, Homo sapiens
ttgacaaagtttagtaataatc

SEQ ID NO: 8776571 - DNA, 22 bp, Homo sapiens
ttgacaaagtttagtaataatc

SEQ ID NO: 8776572 - DNA, 22 bp, Homo sapiens
ttgacacaatgtatattttcaa

SEQ ID NO: 8776573 - DNA, 22 bp, Homo sapiens
ttgacacaggaaagttgtaact

SEQ ID NO: 8776574 - DNA, 22 bp, Homo sapiens
ttgacaatgtcctttgaatttc

SEQ ID NO: 8776575 - DNA, 22 bp, Homo sapiens
ttgacaaaacaacacagatttc

SEQ ID NO: 8776576 - DNA, 22 bp, Homo sapiens
ttgacaaaacaacacagatttc

SEQ ID NO: 8776577 - DNA, 22 bp, Homo sapiens
ttgacaaaacaacacagatttc

SEQ ID NO: 8776578 - DNA, 22 bp, Homo sapiens
ttgacaaaaataacacagcata

SEQ ID NO: 8776579 - DNA, 22 bp, Homo sapiens
ttgacaaaaataacacagcata

SEQ ID NO: 8776580 - DNA, 22 bp, Homo sapiens
ttgacaaaaacctcatttcacc

SEQ ID NO: 8776581 - DNA, 22 bp, Homo sapiens
ttgacaaagatatattcatgct

SEQ ID NO: 8776582 - DNA, 22 bp, Homo sapiens
ttgacaaagatatattcatgct

SEQ ID NO: 8776583 - DNA, 22 bp, Homo sapiens
ttgacaaaggaattgaatctct

SEQ ID NO: 8776584 - DNA, 22 bp, Homo sapiens
ttgacaaaggaccttgctattt

SEQ ID NO: 8776585 - DNA, 22 bp, Homo sapiens
ttgcaattgctatggagagcgt

SEQ ID NO: 8776586 - DNA, 22 bp, Homo sapiens
ttgcaattgctatggagagcgt

SEQ ID NO: 8776587 - DNA, 22 bp, Homo sapiens
ttgcaattgctatggagagcgt

SEQ ID NO: 8776588 - DNA, 22 bp, Homo sapiens
ttgcaattgctatggagagcgt

SEQ ID NO: 8776589 - DNA, 22 bp, Homo sapiens
ttgcaattgctatggagagcgt

SEQ ID NO: 8776590 - DNA, 22 bp, Homo sapiens
ttgcaattgctatggagagcgt

SEQ ID NO: 8776591 - DNA, 22 bp, Homo sapiens
ttgcaattgctatggagagcgt

SEQ ID NO: 8776592 - DNA, 21 bp, Homo sapiens
ttgcacagaaaaccatagaga

SEQ ID NO: 8776593 - DNA, 22 bp, Homo sapiens
ttgcaattagttacaaaagtgg

SEQ ID NO: 8776594 - DNA, 22 bp, Homo sapiens
ttgacaggaaatatggtggcag

SEQ ID NO: 8776595 - DNA, 22 bp, Homo sapiens
ttgacagctacctacatggtgg

SEQ ID NO: 8776596 - DNA, 22 bp, Homo sapiens
ttgacagagaaaagtgtgactt

SEQ ID NO: 8776597 - DNA, 22 bp, Homo sapiens
ttgacagaaatgtatttgcatg

SEQ ID NO: 8776598 - DNA, 22 bp, Homo sapiens
ttgacacagtcaacttgatttt

SEQ ID NO: 8776599 - DNA, 22 bp, Homo sapiens
ttgacacagtcaacttgatttt

SEQ ID NO: 8776600 - DNA, 22 bp, Homo sapiens
ttgacacagttttctcattaag

SEQ ID NO: 8776601 - DNA, 22 bp, Homo sapiens
ttgacacagttttctcattaag

SEQ ID NO: 8776602 - DNA, 22 bp, Homo sapiens
ttgacacattagagcttgtaaa

SEQ ID NO: 8776603 - DNA, 21 bp, Homo sapiens
ttgcacagaaaaccatagaga

SEQ ID NO: 8776604 - DNA, 22 bp, Homo sapiens
ttgcagaagggcacagtgatca

SEQ ID NO: 8776605 - DNA, 22 bp, Homo sapiens
ttgcagaatacttattctgtat

SEQ ID NO: 8776606 - DNA, 22 bp, Homo sapiens
ttgcagaggcaaaaatgaactc

SEQ ID NO: 8776607 - DNA, 22 bp, Homo sapiens
ttgcagaggcaaaaatgaactc

SEQ ID NO: 8776608 - DNA, 22 bp, Homo sapiens
ttgcagatatttccgatgctat

SEQ ID NO: 8776609 - DNA, 22 bp, Homo sapiens
ttgcagagcagtaggaatatag

SEQ ID NO: 8776610 - DNA, 22 bp, Homo sapiens
ttgcagagatcagcaggtttga

SEQ ID NO: 8776611 - DNA, 22 bp, Homo sapiens
ttgcagatgaagaaagtggtag

SEQ ID NO: 8776612 - DNA, 22 bp, Homo sapiens
ttgcagctagaagattcactgt

SEQ ID NO: 8776613 - DNA, 22 bp, Homo sapiens
ttgcagctagaagattcactgt

SEQ ID NO: 8776614 - DNA, 22 bp, Homo sapiens
ttgcagctctctgaaggttgca

SEQ ID NO: 8776615 - DNA, 22 bp, Homo sapiens
ttgcagctccattttaatggct

SEQ ID NO: 8776616 - DNA, 22 bp, Homo sapiens
ttgcagctgaggaaattgaagc

SEQ ID NO: 8776617 - DNA, 22 bp, Homo sapiens
ttgcagcttcgagtctatctgt

SEQ ID NO: 8776618 - DNA, 22 bp, Homo sapiens
ttgcagcttcgagtctatctgt

SEQ ID NO: 8776619 - DNA, 22 bp, Homo sapiens
ttgcagcttcaagcaggttgac

SEQ ID NO: 8776620 - DNA, 22 bp, Homo sapiens
ttgcagcttcgagtctatctgt

SEQ ID NO: 8776621 - DNA, 22 bp, Homo sapiens
ttgcagcttagtgatgttatct

SEQ ID NO: 8776622 - DNA, 22 bp, Homo sapiens
ttgcagcttcaagcaggttgac

SEQ ID NO: 8776623 - DNA, 22 bp, Homo sapiens
ttgcagcttagtgatgttatct

SEQ ID NO: 8776624 - DNA, 22 bp, Homo sapiens
ttgcagctgttgcaaagtctct

SEQ ID NO: 8776625 - DNA, 22 bp, Homo sapiens
ttgcagctgttgcaaagtctct

SEQ ID NO: 8776626 - DNA, 22 bp, Homo sapiens
ttgcagcttagtgatgttatct

SEQ ID NO: 8776627 - DNA, 22 bp, Homo sapiens
ttgcagctgcagtaaatgttca

SEQ ID NO: 8776628 - DNA, 22 bp, Homo sapiens
ttgcagctctgatccagggacc

SEQ ID NO: 8776629 - DNA, 22 bp, Homo sapiens
ttgcagctgaggaaattgaagc

SEQ ID NO: 8776630 - DNA, 22 bp, Homo sapiens
ttgcagctgcagtaaatgttca

SEQ ID NO: 8776631 - DNA, 22 bp, Homo sapiens
ttgcagctgctgttcctcatgg

SEQ ID NO: 8776632 - DNA, 22 bp, Homo sapiens
ttgcagctgtgagctttacacg

SEQ ID NO: 8776633 - DNA, 22 bp, Homo sapiens
ttgcagctggtggtggccgtgt

SEQ ID NO: 8776634 - DNA, 22 bp, Homo sapiens
ttgcagctgcagtaaatgttca

SEQ ID NO: 8776635 - DNA, 22 bp, Homo sapiens
ttgcagctgtgagctttacacg

SEQ ID NO: 8776636 - DNA, 22 bp, Homo sapiens
ttgcagctgttactgatagata

SEQ ID NO: 8776637 - DNA, 22 bp, Homo sapiens
ttgcagggacctgcagaaagct

SEQ ID NO: 8776638 - DNA, 22 bp, Homo sapiens
ttgcagggaaatcagtgaggat

SEQ ID NO: 8776639 - DNA, 22 bp, Homo sapiens
ttgcagggaaatagaaataaac

SEQ ID NO: 8776640 - DNA, 22 bp, Homo sapiens
ttgcagggataaaacaagtgaa

SEQ ID NO: 8776641 - DNA, 23 bp, Homo sapiens
ttgcagggatggagttcaaaatg

SEQ ID NO: 8776642 - DNA, 22 bp, Homo sapiens
ttgcagggattaccttattttt

SEQ ID NO: 8776643 - DNA, 22 bp, Homo sapiens
ttgcagggcaaatggtcagata

SEQ ID NO: 8776644 - DNA, 22 bp, Homo sapiens
ttgcagcttctaccactgtttc

SEQ ID NO: 8776645 - DNA, 22 bp, Homo sapiens
ttgcagcttctaacagcttcag

SEQ ID NO: 8776646 - DNA, 22 bp, Homo sapiens
ttgcagcttctaccactgtttc

SEQ ID NO: 8776647 - DNA, 22 bp, Homo sapiens
ttgcagcttctaccactgtttc

SEQ ID NO: 8776648 - DNA, 22 bp, Homo sapiens
ttgcaggaaactgagtgtgagc

SEQ ID NO: 8776649 - DNA, 22 bp, Homo sapiens
ttgcaggaagcacaagtctgag

SEQ ID NO: 8776650 - DNA, 22 bp, Homo sapiens
ttgcagcttcttgcatcagaaa

SEQ ID NO: 8776651 - DNA, 22 bp, Homo sapiens
ttgcagcttcttgcatcagaaa

SEQ ID NO: 8776652 - DNA, 22 bp, Homo sapiens
ttgcagggaaacagtttaggaa

SEQ ID NO: 8776653 - DNA, 22 bp, Homo sapiens
ttgcaggattttagagatgaca

SEQ ID NO: 8776654 - DNA, 22 bp, Homo sapiens
ttgcagggtcctgtggctctcc

SEQ ID NO: 8776655 - DNA, 22 bp, Homo sapiens
ttgcagggtacattcttagaat

SEQ ID NO: 8776656 - DNA, 22 bp, Homo sapiens
ttgcagggtcccagaggcctgg

SEQ ID NO: 8776657 - DNA, 22 bp, Homo sapiens
ttgcagggcttggggattacag

SEQ ID NO: 8776658 - DNA, 22 bp, Homo sapiens
ttgcaggggaaggagcagagct

SEQ ID NO: 8776659 - DNA, 22 bp, Homo sapiens
ttgcaggggaaggagcagagct

SEQ ID NO: 8776660 - DNA, 22 bp, Homo sapiens
ttgcaggggagaggaacaaaca

SEQ ID NO: 8776661 - DNA, 22 bp, Homo sapiens
ttgcagggcaggaccatggaca

SEQ ID NO: 8776662 - DNA, 22 bp, Homo sapiens
ttgcagggcatcgcgtacttct

SEQ ID NO: 8776663 - DNA, 22 bp, Homo sapiens
ttgcagggctggaacatggaat

SEQ ID NO: 8776664 - DNA, 22 bp, Homo sapiens
ttgcagggccttggcttcttcc

SEQ ID NO: 8776665 - DNA, 22 bp, Homo sapiens
ttgcagggcatctatgtctggt

SEQ ID NO: 8776666 - DNA, 22 bp, Homo sapiens
ttgcagggttgaccaataggct

SEQ ID NO: 8776667 - DNA, 22 bp, Homo sapiens
ttgcagggttaaagtaaggtag

SEQ ID NO: 8776668 - DNA, 22 bp, Homo sapiens
ttgcagggttgacactgcctgc

SEQ ID NO: 8776669 - DNA, 22 bp, Homo sapiens
ttgcaggtgagggaaatgactg

SEQ ID NO: 8776670 - DNA, 22 bp, Homo sapiens
ttgcagtcacactctaaagtag

SEQ ID NO: 8776671 - DNA, 22 bp, Homo sapiens
ttgcagttaaaaatcattagtt

SEQ ID NO: 8776672 - DNA, 22 bp, Homo sapiens
ttgcatggatggatggttcgat

SEQ ID NO: 8776673 - DNA, 22 bp, Homo sapiens
ttgcatggatggatggttcgat

SEQ ID NO: 8776674 - DNA, 22 bp, Homo sapiens
ttgcatggaggaacatggccca

SEQ ID NO: 8776675 - DNA, 22 bp, Homo sapiens
ttgcatggaggaacatggccca

SEQ ID NO: 8776676 - DNA, 22 bp, Homo sapiens
ttgcatggctgtgaaaatttgg

SEQ ID NO: 8776677 - DNA, 22 bp, Homo sapiens
ttgcatggggattggagcacag

SEQ ID NO: 8776678 - DNA, 22 bp, Homo sapiens
ttgcatgggcaacaggaggtgg

SEQ ID NO: 8776679 - DNA, 22 bp, Homo sapiens
ttgcatggtaataaaatgtgac

SEQ ID NO: 8776680 - DNA, 22 bp, Homo sapiens
ttgcatggtgtgctctgaatca

SEQ ID NO: 8776681 - DNA, 22 bp, Homo sapiens
ttgcatggggattggagcacag

SEQ ID NO: 8776682 - DNA, 22 bp, Homo sapiens
ttgcatggtgtgctctgaatca

SEQ ID NO: 8776683 - DNA, 23 bp, Homo sapiens
ttgcatgtagcccatgagtaact

SEQ ID NO: 8776684 - DNA, 22 bp, Homo sapiens
ttgcatgtcctacatctgtgtc

SEQ ID NO: 8776685 - DNA, 22 bp, Homo sapiens
ttggccagtgaaccaggcctgg

SEQ ID NO: 8776686 - DNA, 22 bp, Homo sapiens
ttggccagtggaaagaggagga

SEQ ID NO: 8776687 - DNA, 22 bp, Homo sapiens
ttggcataccttagtggtggag

SEQ ID NO: 8776688 - DNA, 22 bp, Homo sapiens
ttgggaagtttaatgacagact

SEQ ID NO: 8776689 - DNA, 22 bp, Homo sapiens
ttgggaagtttaatgacagact

SEQ ID NO: 8776690 - DNA, 22 bp, Homo sapiens
ttgggaagtttaatgacagact

SEQ ID NO: 8776691 - DNA, 22 bp, Homo sapiens
ttgggacagaaaaggagaagat

SEQ ID NO: 8776692 - DNA, 20 bp, Homo sapiens
ttgggacacttgctttgcta

SEQ ID NO: 8776693 - DNA, 22 bp, Homo sapiens
ttgggacaagagatagctctga

SEQ ID NO: 8776694 - DNA, 22 bp, Homo sapiens
ttgggacagcaaccatctgcta

SEQ ID NO: 8776695 - DNA, 22 bp, Homo sapiens
ttgggacagagctggggctgga

SEQ ID NO: 8776696 - DNA, 22 bp, Homo sapiens
ttgggaagtaatatggtggtct

SEQ ID NO: 8776697 - DNA, 22 bp, Homo sapiens
ttgggaaggcgtggaagcagaa

SEQ ID NO: 8776698 - DNA, 22 bp, Homo sapiens
ttggcccacagtaccatgctgt

SEQ ID NO: 8776699 - DNA, 22 bp, Homo sapiens
ttgggaagaatggaggtggtta

SEQ ID NO: 8776700 - DNA, 22 bp, Homo sapiens
ttggccatgacaggacaggaag

SEQ ID NO: 8776701 - DNA, 22 bp, Homo sapiens
ttgggacatctggcatacagtt

SEQ ID NO: 8776702 - DNA, 22 bp, Homo sapiens
ttgggacattatcagtctgcag

SEQ ID NO: 8776703 - DNA, 22 bp, Homo sapiens
ttgggagatggggagataatat

SEQ ID NO: 8776704 - DNA, 22 bp, Homo sapiens
ttgggagcatttagaaaagacg

SEQ ID NO: 8776705 - DNA, 22 bp, Homo sapiens
ttgggagcaaataggaaagagg

SEQ ID NO: 8776706 - DNA, 17 bp, Homo sapiens
ttgggagagaaaggtat

SEQ ID NO: 8776707 - DNA, 22 bp, Homo sapiens
ttgggcaggtgtggctctcctt

SEQ ID NO: 8776708 - DNA, 22 bp, Homo sapiens
ttgggcaggtgaagagagggct

SEQ ID NO: 8776709 - DNA, 22 bp, Homo sapiens
ttgggcagtagcctcttggtgt

SEQ ID NO: 8776710 - DNA, 22 bp, Homo sapiens
ttgggcagggaaaggacaggca

SEQ ID NO: 8776711 - DNA, 22 bp, Homo sapiens
ttgggaggtaatggagccaagt

SEQ ID NO: 8776712 - DNA, 22 bp, Homo sapiens
ttgggagcttggccgagatgta

SEQ ID NO: 8776713 - DNA, 22 bp, Homo sapiens
ttgggaggtaatggagccaagt

SEQ ID NO: 8776714 - DNA, 22 bp, Homo sapiens
ttgggcagtctggctgcagagt

SEQ ID NO: 8776715 - DNA, 22 bp, Homo sapiens
ttgggcagtctggctgcagagt

SEQ ID NO: 8776716 - DNA, 22 bp, Homo sapiens
ttgggcagtctggctgcagagt

SEQ ID NO: 8776717 - DNA, 22 bp, Homo sapiens
ttgggcagtgattagttcatga

SEQ ID NO: 8776718 - DNA, 22 bp, Homo sapiens
ttgggcagtgattagttcatga

SEQ ID NO: 8776719 - DNA, 22 bp, Homo sapiens
ttgggccaaagatgtccttgtt

SEQ ID NO: 8776720 - DNA, 22 bp, Homo sapiens
ttgggccaaggcagatctccaa

SEQ ID NO: 8776721 - DNA, 22 bp, Homo sapiens
ttgggccaaatagctatttact

SEQ ID NO: 8776722 - DNA, 22 bp, Homo sapiens
ttgggccaaggcagatctccaa

SEQ ID NO: 8776723 - DNA, 22 bp, Homo sapiens
ttgggccaaatagctatttact

SEQ ID NO: 8776724 - DNA, 22 bp, Homo sapiens
ttgggccaaagatgtccttgtt

SEQ ID NO: 8776725 - DNA, 20 bp, Homo sapiens
ttgggccacactgattcagc

SEQ ID NO: 8776726 - DNA, 20 bp, Homo sapiens
ttgggccacactgattcagc

SEQ ID NO: 8776727 - DNA, 22 bp, Homo sapiens
ttgggcccatggggctaagcta

SEQ ID NO: 8776728 - DNA, 22 bp, Homo sapiens
ttgggccactttagtttcctta

SEQ ID NO: 8776729 - DNA, 22 bp, Homo sapiens
ttgggccactttagtttcctta

SEQ ID NO: 8776730 - DNA, 20 bp, Homo sapiens
ttggcagcagttccaagtga

SEQ ID NO: 8776731 - DNA, 22 bp, Homo sapiens
ttggcagcagggagttggccgc

SEQ ID NO: 8776732 - DNA, 22 bp, Homo sapiens
ttggcagcattccagccaagca

SEQ ID NO: 8776733 - DNA, 22 bp, Homo sapiens
ttggcagcattccagccaagca

SEQ ID NO: 8776734 - DNA, 22 bp, Homo sapiens
ttggaggactagttaagagacc

SEQ ID NO: 8776735 - DNA, 22 bp, Homo sapiens
ttggcagctcttgatggcaccc

SEQ ID NO: 8776736 - DNA, 22 bp, Homo sapiens
ttggcagcattccagccaagca

SEQ ID NO: 8776737 - DNA, 22 bp, Homo sapiens
ttggcagcccagcttactagca

SEQ ID NO: 8776738 - DNA, 22 bp, Homo sapiens
ttggcaggaatattgcagaggt

SEQ ID NO: 8776739 - DNA, 22 bp, Homo sapiens
ttggcagctgttggaccttgac

SEQ ID NO: 8776740 - DNA, 20 bp, Homo sapiens
ttggcagcttcagggtacta

SEQ ID NO: 8776741 - DNA, 22 bp, Homo sapiens
ttggcagctcttgatggcaccc

SEQ ID NO: 8776742 - DNA, 22 bp, Homo sapiens
ttggcagtctcagtcagatggc

SEQ ID NO: 8776743 - DNA, 22 bp, Homo sapiens
ttggcagtcagtcttggtgctt

SEQ ID NO: 8776744 - DNA, 22 bp, Homo sapiens
ttggcagggcatcagacacgtg

SEQ ID NO: 8776745 - DNA, 22 bp, Homo sapiens
ttggcaggatgatagctttgtg

SEQ ID NO: 8776746 - DNA, 22 bp, Homo sapiens
ttggcaggaggcttcagttcct

SEQ ID NO: 8776747 - DNA, 22 bp, Homo sapiens
ttggcaggaatattgcagaggt

SEQ ID NO: 8776748 - DNA, 22 bp, Homo sapiens
ttggcagggcatcagacacgtg

SEQ ID NO: 8776749 - DNA, 22 bp, Homo sapiens
ttggcagggccaggctctctct

SEQ ID NO: 8776750 - DNA, 22 bp, Homo sapiens
ttggagatatcacaccttcaca

SEQ ID NO: 8776751 - DNA, 22 bp, Homo sapiens
ttggagatatcacaccttcaca

SEQ ID NO: 8776752 - DNA, 22 bp, Homo sapiens
ttggagaggcagtcttgctctg

SEQ ID NO: 8776753 - DNA, 22 bp, Homo sapiens
ttggagagcagtaaaccacact

SEQ ID NO: 8776754 - DNA, 22 bp, Homo sapiens
ttggagagcagtaaaccacact

SEQ ID NO: 8776755 - DNA, 22 bp, Homo sapiens
ttggagagatttaggtctcagt

SEQ ID NO: 8776756 - DNA, 22 bp, Homo sapiens
ttggagagatttaggtctcagt

SEQ ID NO: 8776757 - DNA, 22 bp, Homo sapiens
ttggagagatttaggtctcagt

SEQ ID NO: 8776758 - DNA, 22 bp, Homo sapiens
ttggagagggcttggatcacac

SEQ ID NO: 8776759 - DNA, 22 bp, Homo sapiens
ttggagagggcttggatcacac

SEQ ID NO: 8776760 - DNA, 22 bp, Homo sapiens
ttggagagtgatattcagatgc

SEQ ID NO: 8776761 - DNA, 23 bp, Homo sapiens
ttggagagggtgagtagtgtcag

SEQ ID NO: 8776762 - DNA, 23 bp, Homo sapiens
ttggaccactactgttttctctt

SEQ ID NO: 8776763 - DNA, 22 bp, Homo sapiens
ttggacagtgcagatctacacg

SEQ ID NO: 8776764 - DNA, 22 bp, Homo sapiens
ttggacagttgtagccagcaga

SEQ ID NO: 8776765 - DNA, 18 bp, Homo sapiens
ttggacctgtgtcagggc

SEQ ID NO: 8776766 - DNA, 22 bp, Homo sapiens
ttggacctcagttattctatca

SEQ ID NO: 8776767 - DNA, 21 bp, Homo sapiens
ttggacttttgcgtgattgag

SEQ ID NO: 8776768 - DNA, 22 bp, Homo sapiens
ttggactgagagttccaccatt

SEQ ID NO: 8776769 - DNA, 22 bp, Homo sapiens
ttggactggtttacatttcaag

SEQ ID NO: 8776770 - DNA, 22 bp, Homo sapiens
ttggactgaatctttctcacac

SEQ ID NO: 8776771 - DNA, 21 bp, Homo sapiens
ttggagaagtgctatcagtat

SEQ ID NO: 8776772 - DNA, 22 bp, Homo sapiens
ttggagagattatcagaccagc

SEQ ID NO: 8776773 - DNA, 22 bp, Homo sapiens
ttggagagattatcagaccagc

SEQ ID NO: 8776774 - DNA, 22 bp, Homo sapiens
ttggagagaggctgctcaggct

SEQ ID NO: 8776775 - DNA, 22 bp, Homo sapiens
ttggagagaggctgctcaggct

SEQ ID NO: 8776776 - DNA, 22 bp, Homo sapiens
ttggactgagagttccaccatt

SEQ ID NO: 8776777 - DNA, 22 bp, Homo sapiens
ttgtaagtcacaccagggcagg

SEQ ID NO: 8776778 - DNA, 22 bp, Homo sapiens
ttgtaaggtccttctgctgcag

SEQ ID NO: 8776779 - DNA, 22 bp, Homo sapiens
ttgtacaagttttgagcttaag

SEQ ID NO: 8776780 - DNA, 22 bp, Homo sapiens
ttgtacaagttttgagcttaag

SEQ ID NO: 8776781 - DNA, 22 bp, Homo sapiens
ttgtacaagttttgagcttaag

SEQ ID NO: 8776782 - DNA, 22 bp, Homo sapiens
ttgtacaagttttgagcttaag

SEQ ID NO: 8776783 - DNA, 22 bp, Homo sapiens
ttgtacaagtattatgtgaaca

SEQ ID NO: 8776784 - DNA, 22 bp, Homo sapiens
ttgtacaagtattatgtgaaca

SEQ ID NO: 8776785 - DNA, 22 bp, Homo sapiens
ttgtacactctttttattccgt

SEQ ID NO: 8776786 - DNA, 22 bp, Homo sapiens
ttgtacactgttgatgggaatg

SEQ ID NO: 8776787 - DNA, 22 bp, Homo sapiens
ttgtacagaaaaaattcttggt

SEQ ID NO: 8776788 - DNA, 19 bp, Homo sapiens
ttgtacagcaaccaaccct

SEQ ID NO: 8776789 - DNA, 22 bp, Homo sapiens
ttgtacagaccctgaaaagctc

SEQ ID NO: 8776790 - DNA, 22 bp, Homo sapiens
ttgtacagaaactgcatttgga

SEQ ID NO: 8776791 - DNA, 22 bp, Homo sapiens
ttgtacagaaaaaattcttggt

SEQ ID NO: 8776792 - DNA, 21 bp, Homo sapiens
ttgtacacccacagatcagcc

SEQ ID NO: 8776793 - DNA, 22 bp, Homo sapiens
ttgtacacacaggaacaaacgt

SEQ ID NO: 8776794 - DNA, 22 bp, Homo sapiens
ttgtacacagcttgcggctata

SEQ ID NO: 8776795 - DNA, 22 bp, Homo sapiens
ttgtacacacaacaggaggtaa

SEQ ID NO: 8776796 - DNA, 22 bp, Homo sapiens
ttgtacacacaggaacaaacgt

SEQ ID NO: 8776797 - DNA, 22 bp, Homo sapiens
ttgtacacacaggaacaaacgt

SEQ ID NO: 8776798 - DNA, 22 bp, Homo sapiens
ttgtacacaattcttaacatac

SEQ ID NO: 8776799 - DNA, 22 bp, Homo sapiens
ttgtacaatggatgccagatga

SEQ ID NO: 8776800 - DNA, 22 bp, Homo sapiens
ttgtacacaattcttaacatac

SEQ ID NO: 8776801 - DNA, 23 bp, Homo sapiens
ttgtatttttagtagagacaggg

SEQ ID NO: 8776802 - DNA, 23 bp, Homo sapiens
ttgtatttttagtagagacaggg

SEQ ID NO: 8776803 - DNA, 22 bp, Homo sapiens
ttgtatttcgatgcacgtgtag

SEQ ID NO: 8776804 - DNA, 22 bp, Homo sapiens
ttgtatttctccactttctgtt

SEQ ID NO: 8776805 - DNA, 22 bp, Homo sapiens
ttgtatttcgatgcacgtgtag

SEQ ID NO: 8776806 - DNA, 22 bp, Homo sapiens
ttgtacagggaagtaatacaag

SEQ ID NO: 8776807 - DNA, 22 bp, Homo sapiens
ttgtacagggaagtaatacaag

SEQ ID NO: 8776808 - DNA, 23 bp, Homo sapiens
ttgtacagcccagattcctcttc

SEQ ID NO: 8776809 - DNA, 22 bp, Homo sapiens
ttgtacagggaagtaatacaag

SEQ ID NO: 8776810 - DNA, 22 bp, Homo sapiens
ttgggcctctcaaagtgctggg

SEQ ID NO: 8776811 - DNA, 22 bp, Homo sapiens
ttgggcctctcaaagtgctggg

SEQ ID NO: 8776812 - DNA, 22 bp, Homo sapiens
ttgggcctggggtagtgtcgga

SEQ ID NO: 8776813 - DNA, 22 bp, Homo sapiens
ttgggcctcactctagaaggca

SEQ ID NO: 8776814 - DNA, 22 bp, Homo sapiens
ttgggcctcggccaaggacggg

SEQ ID NO: 8776815 - DNA, 23 bp, Homo sapiens
ttgtaaaacagtgtgacggttcc

SEQ ID NO: 8776816 - DNA, 22 bp, Homo sapiens
ttgtaaactggatagacctatt

SEQ ID NO: 8776817 - DNA, 22 bp, Homo sapiens
ttgtaaagttcttaggaagctc

SEQ ID NO: 8776818 - DNA, 22 bp, Homo sapiens
ttgtaaatagtagtaagatgcc

SEQ ID NO: 8776819 - DNA, 22 bp, Homo sapiens
ttgtaaatgaccttttctaatt

SEQ ID NO: 8776820 - DNA, 22 bp, Homo sapiens
ttgtaaatgaccttttctaatt

SEQ ID NO: 8776821 - DNA, 22 bp, Homo sapiens
ttgtaaatgaccttttctaatt

SEQ ID NO: 8776822 - DNA, 22 bp, Homo sapiens
ttgtaacactcccactcttctt

SEQ ID NO: 8776823 - DNA, 22 bp, Homo sapiens
ttgtaacaatctgtcataaatg

SEQ ID NO: 8776824 - DNA, 21 bp, Homo sapiens
ttgtaaatggctttttccttc

SEQ ID NO: 8776825 - DNA, 22 bp, Homo sapiens
ttgtaacagctgtttatatagt

SEQ ID NO: 8776826 - DNA, 22 bp, Homo sapiens
ttgtaacaggcactctgtgcca

SEQ ID NO: 8776827 - DNA, 22 bp, Homo sapiens
ttgtaacacttttctattaata

SEQ ID NO: 8776828 - DNA, 22 bp, Homo sapiens
ttgtaacagctgcttaatagag

SEQ ID NO: 8776829 - DNA, 22 bp, Homo sapiens
ttgtaactttgcatactcctgt

SEQ ID NO: 8776830 - DNA, 22 bp, Homo sapiens
ttgtaagaatatgaatacaaat

SEQ ID NO: 8776831 - DNA, 22 bp, Homo sapiens
ttgtaactgtgggttgattaga

SEQ ID NO: 8776832 - DNA, 22 bp, Homo sapiens
ttgtaacttaagttttgcatat

SEQ ID NO: 8776833 - DNA, 22 bp, Homo sapiens
ttgtaacttgtgattataatct

SEQ ID NO: 8776834 - DNA, 22 bp, Homo sapiens
ttgtaactctgaatacatccta

SEQ ID NO: 8776835 - DNA, 22 bp, Homo sapiens
ttgtaacatcaccatcaaaatc

SEQ ID NO: 8776836 - DNA, 22 bp, Homo sapiens
ttgtaacatcaccatcaaaatc

SEQ ID NO: 8776837 - DNA, 22 bp, Homo sapiens
ttgtaacagtagctgtcagctc

SEQ ID NO: 8776838 - DNA, 22 bp, Homo sapiens
ttgtaacaggtactaaataact

SEQ ID NO: 8776839 - DNA, 22 bp, Homo sapiens
ttgtaacaggtactaaataact

SEQ ID NO: 8776840 - DNA, 22 bp, Homo sapiens
ttgtaacaggtactaaataact

SEQ ID NO: 8776841 - DNA, 20 bp, Homo sapiens
ttgtcagattttgcttgatg

SEQ ID NO: 8776842 - DNA, 22 bp, Homo sapiens
ttgtcacctatactgagcttaa

SEQ ID NO: 8776843 - DNA, 22 bp, Homo sapiens
ttgtcacccctagaggaattct

SEQ ID NO: 8776844 - DNA, 22 bp, Homo sapiens
ttgtcacattcaagttttatat

SEQ ID NO: 8776845 - DNA, 22 bp, Homo sapiens
ttgtcaccatatttcattttga

SEQ ID NO: 8776846 - DNA, 22 bp, Homo sapiens
ttgtcaaatccttgtcatctgc

SEQ ID NO: 8776847 - DNA, 22 bp, Homo sapiens
ttgtcaagtaaggctgacattt

SEQ ID NO: 8776848 - DNA, 22 bp, Homo sapiens
ttgtcacacccttttttatacc

SEQ ID NO: 8776849 - DNA, 22 bp, Homo sapiens
ttgtattttttcctggcggtgg

SEQ ID NO: 8776850 - DNA, 22 bp, Homo sapiens
ttgtcattggggttatttgtta

SEQ ID NO: 8776851 - DNA, 22 bp, Homo sapiens
ttgtccaaagtaacacatctag

SEQ ID NO: 8776852 - DNA, 19 bp, Homo sapiens
ttgtccagaaaggcattgc

SEQ ID NO: 8776853 - DNA, 22 bp, Homo sapiens
ttgtcattggggttatttgtta

SEQ ID NO: 8776854 - DNA, 22 bp, Homo sapiens
ttgtccaaggtcccacagttag

SEQ ID NO: 8776855 - DNA, 22 bp, Homo sapiens
ttgtcatcatgttttccaaagg

SEQ ID NO: 8776856 - DNA, 22 bp, Homo sapiens
ttgtcatcatcctctttggggt

SEQ ID NO: 8776857 - DNA, 22 bp, Homo sapiens
ttgtcatcaagatgcattggtc

SEQ ID NO: 8776858 - DNA, 22 bp, Homo sapiens
ttgtcatcaagatgcattggtc

SEQ ID NO: 8776859 - DNA, 22 bp, Homo sapiens
ttgtccctgcccctgcttgctt

SEQ ID NO: 8776860 - DNA, 22 bp, Homo sapiens
ttgtccatctgtatttcccatg

SEQ ID NO: 8776861 - DNA, 22 bp, Homo sapiens
ttgtccatctgtatttcccatg

SEQ ID NO: 8776862 - DNA, 22 bp, Homo sapiens
ttgtccagcagctcagtctacg

SEQ ID NO: 8776863 - DNA, 22 bp, Homo sapiens
ttgtccagagccaggctgtcgg

SEQ ID NO: 8776864 - DNA, 22 bp, Homo sapiens
ttgtccatctgtatttcccatg

SEQ ID NO: 8776865 - DNA, 22 bp, Homo sapiens
ttgtcctgtgatttcagggcct

SEQ ID NO: 8776866 - DNA, 22 bp, Homo sapiens
ttgtcctgtcaggctgggggct

SEQ ID NO: 8776867 - DNA, 22 bp, Homo sapiens
ttgtcctggaggttaatagagt

SEQ ID NO: 8776868 - DNA, 23 bp, Homo sapiens
ttgtcctgccgatctctgagaat

SEQ ID NO: 8776869 - DNA, 22 bp, Homo sapiens
ttgtcctgcaacctcacatggc

SEQ ID NO: 8776870 - DNA, 22 bp, Homo sapiens
ttgtgtctggaatgcgtggagc

SEQ ID NO: 8776871 - DNA, 22 bp, Homo sapiens
ttgtgtatttcctgaaggtaag

SEQ ID NO: 8776872 - DNA, 22 bp, Homo sapiens
ttgtgtattttttgatactaac

SEQ ID NO: 8776873 - DNA, 22 bp, Homo sapiens
ttgtgggatggctcttcccaaa

SEQ ID NO: 8776874 - DNA, 22 bp, Homo sapiens
ttgtgggatggctcttcccaaa

SEQ ID NO: 8776875 - DNA, 16 bp, Homo sapiens
ttgtggcttttgcaca

SEQ ID NO: 8776876 - DNA, 22 bp, Homo sapiens
ttgtcctgtgtctgtttggatt

SEQ ID NO: 8776877 - DNA, 22 bp, Homo sapiens
ttgtcctgttacttgtttggat

SEQ ID NO: 8776878 - DNA, 22 bp, Homo sapiens
ttgtggctcatcttcagctccc

SEQ ID NO: 8776879 - DNA, 22 bp, Homo sapiens
ttgtggctcatcttcagctccc

SEQ ID NO: 8776880 - DNA, 22 bp, Homo sapiens
ttgtggcatgtgagaactagaa

SEQ ID NO: 8776881 - DNA, 22 bp, Homo sapiens
ttgtcctgtttagggataagga

SEQ ID NO: 8776882 - DNA, 22 bp, Homo sapiens
ttgtggctcgtgagatgttagg

SEQ ID NO: 8776883 - DNA, 22 bp, Homo sapiens
ttgtggctcttgaggctctcgt

SEQ ID NO: 8776884 - DNA, 22 bp, Homo sapiens
ttgtggctcttgaggctctcgt

SEQ ID NO: 8776885 - DNA, 22 bp, Homo sapiens
ttgtggctgtgcaccgctgcct

SEQ ID NO: 8776886 - DNA, 22 bp, Homo sapiens
ttgtggctgtcgagaattgagg

SEQ ID NO: 8776887 - DNA, 22 bp, Homo sapiens
ttgtggctgtgcaccgctgcct

SEQ ID NO: 8776888 - DNA, 22 bp, Homo sapiens
ttgtggcttctacgcccacagg

SEQ ID NO: 8776889 - DNA, 22 bp, Homo sapiens
ttcaaagataattaccaaacat

SEQ ID NO: 8776890 - DNA, 23 bp, Homo sapiens
ttcaaagatcttctgaaatctgt

SEQ ID NO: 8776891 - DNA, 23 bp, Homo sapiens
ttcaaagatcttctgaaatctgt

SEQ ID NO: 8776892 - DNA, 22 bp, Homo sapiens
ttcaaagatggagggatagatt

SEQ ID NO: 8776893 - DNA, 23 bp, Homo sapiens
ttcaaagatcttctgaaatctgt

SEQ ID NO: 8776894 - DNA, 22 bp, Homo sapiens
ttcaaagatggagggatagatt

SEQ ID NO: 8776895 - DNA, 22 bp, Homo sapiens
ttcaaagcaagacacaattcct

SEQ ID NO: 8776896 - DNA, 22 bp, Homo sapiens
ttcaaagctgcagactcctggg

SEQ ID NO: 8776897 - DNA, 22 bp, Homo sapiens
ttcaaagcaatagaaagagtga

SEQ ID NO: 8776898 - DNA, 22 bp, Homo sapiens
ttcaaagcagagggtcaataca

SEQ ID NO: 8776899 - DNA, 22 bp, Homo sapiens
ttcaaagcaatagaaagagtga

SEQ ID NO: 8776900 - DNA, 22 bp, Homo sapiens
ttcaaagcaagacacaattcct

SEQ ID NO: 8776901 - DNA, 22 bp, Homo sapiens
ttcacagactttccatagattg

SEQ ID NO: 8776902 - DNA, 22 bp, Homo sapiens
ttcacaattaactttatactta

SEQ ID NO: 8776903 - DNA, 22 bp, Homo sapiens
ttcacaattaactttatactta

SEQ ID NO: 8776904 - DNA, 22 bp, Homo sapiens
ttcacaattaactttatactta

SEQ ID NO: 8776905 - DNA, 22 bp, Homo sapiens
ttcacaatgccttgttgatggt

SEQ ID NO: 8776906 - DNA, 22 bp, Homo sapiens
ttcacaatgccagcaaccactt

SEQ ID NO: 8776907 - DNA, 22 bp, Homo sapiens
ttcacaatctggcttagcattg

SEQ ID NO: 8776908 - DNA, 22 bp, Homo sapiens
ttcaaagataatgtagcatttt

SEQ ID NO: 8776909 - DNA, 22 bp, Homo sapiens
ttcaaagataatgtagcatttt

SEQ ID NO: 8776910 - DNA, 22 bp, Homo sapiens
ttcaaagataatgtagcatttt

SEQ ID NO: 8776911 - DNA, 22 bp, Homo sapiens
ttcaaagataatgtagcatttt

SEQ ID NO: 8776912 - DNA, 22 bp, Homo sapiens
ttcaaagataatgtagcatttt

SEQ ID NO: 8776913 - DNA, 22 bp, Homo sapiens
ttcaaagataattaccaaacat

SEQ ID NO: 8776914 - DNA, 22 bp, Homo sapiens
ttcaaagataattaccaaacat

SEQ ID NO: 8776915 - DNA, 20 bp, Homo sapiens
ttcaaagaccctcaggtcca

SEQ ID NO: 8776916 - DNA, 22 bp, Homo sapiens
ttcaaagaccttacttggcaaa

SEQ ID NO: 8776917 - DNA, 20 bp, Homo sapiens
ttcaaagaccctcaggtcca

SEQ ID NO: 8776918 - DNA, 20 bp, Homo sapiens
ttcaaagaccctcaggtcca

SEQ ID NO: 8776919 - DNA, 22 bp, Homo sapiens
ttcaaacttaaggagcagcaga

SEQ ID NO: 8776920 - DNA, 22 bp, Homo sapiens
ttcaaagaattttgagacctga

SEQ ID NO: 8776921 - DNA, 22 bp, Homo sapiens
ttcaaacttaaggagcagcaga

SEQ ID NO: 8776922 - DNA, 22 bp, Homo sapiens
ttcaaactgtgtaatttataaa

SEQ ID NO: 8776923 - DNA, 22 bp, Homo sapiens
ttcaaactgtgtaatttataaa

SEQ ID NO: 8776924 - DNA, 22 bp, Homo sapiens
ttcacagctaagagctaagtaa

SEQ ID NO: 8776925 - DNA, 22 bp, Homo sapiens
ttcacagctccttttactcaac

SEQ ID NO: 8776926 - DNA, 22 bp, Homo sapiens
ttcacagctccttttactcaac

SEQ ID NO: 8776927 - DNA, 23 bp, Homo sapiens
ttcacagattaaatatttcttct

SEQ ID NO: 8776928 - DNA, 22 bp, Homo sapiens
ttcacagatgtattggaactcc

SEQ ID NO: 8776929 - DNA, 22 bp, Homo sapiens
ttcacagatgtattggaactcc

SEQ ID NO: 8776930 - DNA, 22 bp, Homo sapiens
ttcacagattgactggattcct

SEQ ID NO: 8776931 - DNA, 22 bp, Homo sapiens
ttcacagattgactggattcct

SEQ ID NO: 8776932 - DNA, 23 bp, Homo sapiens
ttcacagattaaatatttcttct

SEQ ID NO: 8776933 - DNA, 22 bp, Homo sapiens
ttcacagatttccctgcacatg

SEQ ID NO: 8776934 - DNA, 22 bp, Homo sapiens
ttcacagattgactggattcct

SEQ ID NO: 8776935 - DNA, 22 bp, Homo sapiens
ttcacagcctctgccccaggca

SEQ ID NO: 8776936 - DNA, 22 bp, Homo sapiens
ttcacagatttccctgcacatg

SEQ ID NO: 8776937 - DNA, 20 bp, Homo sapiens
ttcacagaggactcaggtca

SEQ ID NO: 8776938 - DNA, 20 bp, Homo sapiens
ttcacagaggactcaggtca

SEQ ID NO: 8776939 - DNA, 22 bp, Homo sapiens
ttcacagagcttgttcatggcc

SEQ ID NO: 8776940 - DNA, 20 bp, Homo sapiens
ttcacagaggactcaggtca

SEQ ID NO: 8776941 - DNA, 22 bp, Homo sapiens
ttcacagagttatttttatgct

SEQ ID NO: 8776942 - DNA, 20 bp, Homo sapiens
ttcacagaggactcaggtca

SEQ ID NO: 8776943 - DNA, 22 bp, Homo sapiens
ttcacagagcttgttcatggcc

SEQ ID NO: 8776944 - DNA, 22 bp, Homo sapiens
ttcacagagcttgttcatggcc

SEQ ID NO: 8776945 - DNA, 22 bp, Homo sapiens
ttcacagagcgggatgctggga

SEQ ID NO: 8776946 - DNA, 22 bp, Homo sapiens
ttcacagagagtatgcagagaa

SEQ ID NO: 8776947 - DNA, 22 bp, Homo sapiens
ttcacagagagaactcaaacca

SEQ ID NO: 8776948 - DNA, 22 bp, Homo sapiens
ttcacagagcgggatgctggga

SEQ ID NO: 8776949 - DNA, 22 bp, Homo sapiens
ttcacagagcgggatgctggga

SEQ ID NO: 8776950 - DNA, 22 bp, Homo sapiens
ttcacagagcactgccaagtac

SEQ ID NO: 8776951 - DNA, 22 bp, Homo sapiens
ttcacagagagtatgcagagaa

SEQ ID NO: 8776952 - DNA, 22 bp, Homo sapiens
ttcacagagcactgccaagtac

SEQ ID NO: 8776953 - DNA, 22 bp, Homo sapiens
ttcacagatgagaaaattgagg

SEQ ID NO: 8776954 - DNA, 22 bp, Homo sapiens
ttcacagatgcctgatgtgtgg

SEQ ID NO: 8776955 - DNA, 22 bp, Homo sapiens
ttcacagatgagaaaattgagg

SEQ ID NO: 8776956 - DNA, 21 bp, Homo sapiens
ttcacagatgggaaaactgag

SEQ ID NO: 8776957 - DNA, 21 bp, Homo sapiens
ttcacagatgggaaaactgag

SEQ ID NO: 8776958 - DNA, 21 bp, Homo sapiens
ttcacagatgggaaaactgag

SEQ ID NO: 8776959 - DNA, 18 bp, Homo sapiens
ttcacagatccacaggaa

SEQ ID NO: 8776960 - DNA, 22 bp, Homo sapiens
ttcacagataacacaggcaaat

SEQ ID NO: 8776961 - DNA, 22 bp, Homo sapiens
ttcacagagttatttttatgct

SEQ ID NO: 8776962 - DNA, 18 bp, Homo sapiens
ttcacagatccacaggaa

SEQ ID NO: 8776963 - DNA, 22 bp, Homo sapiens
ttcacagataacacaggcaaat

SEQ ID NO: 8776964 - DNA, 20 bp, Homo sapiens
ttcacagaggactcaggtca

SEQ ID NO: 8776965 - DNA, 22 bp, Homo sapiens
ttcagcactgttatggatttgc

SEQ ID NO: 8776966 - DNA, 22 bp, Homo sapiens
ttcagcaattttttaagctaat

SEQ ID NO: 8776967 - DNA, 22 bp, Homo sapiens
ttcagtgtccctagtagaagtt

SEQ ID NO: 8776968 - DNA, 22 bp, Homo sapiens
ttcagtgtgaagcttctgaaag

SEQ ID NO: 8776969 - DNA, 22 bp, Homo sapiens
ttcagtgtgcctaagtcagttg

SEQ ID NO: 8776970 - DNA, 22 bp, Homo sapiens
ttcagtgtccctagtagaagtt

SEQ ID NO: 8776971 - DNA, 18 bp, Homo sapiens
ttcagcagcagacacact

SEQ ID NO: 8776972 - DNA, 22 bp, Homo sapiens
ttcagtgtcacaagagcaagcc

SEQ ID NO: 8776973 - DNA, 22 bp, Homo sapiens
ttcagcaactgagtgtctttta

SEQ ID NO: 8776974 - DNA, 22 bp, Homo sapiens
ttcagcaactgagtgtctttta

SEQ ID NO: 8776975 - DNA, 22 bp, Homo sapiens
ttcagcaaggcatgtgcaggag

SEQ ID NO: 8776976 - DNA, 22 bp, Homo sapiens
ttcagcaagtgtctctactgtc

SEQ ID NO: 8776977 - DNA, 22 bp, Homo sapiens
ttcagagccagcaacactaggc

SEQ ID NO: 8776978 - DNA, 22 bp, Homo sapiens
ttcagagccacttcaagtctaa

SEQ ID NO: 8776979 - DNA, 22 bp, Homo sapiens
ttcagagcatctctaaagccag

SEQ ID NO: 8776980 - DNA, 22 bp, Homo sapiens
ttcagagctcagaaaagtgtct

SEQ ID NO: 8776981 - DNA, 22 bp, Homo sapiens
ttcagagctcagaaaagtgtct

SEQ ID NO: 8776982 - DNA, 22 bp, Homo sapiens
ttcagagcttagaatggactac

SEQ ID NO: 8776983 - DNA, 22 bp, Homo sapiens
ttcagagcttagaatggactac

SEQ ID NO: 8776984 - DNA, 22 bp, Homo sapiens
ttcagagaacttcatggaagag

SEQ ID NO: 8776985 - DNA, 22 bp, Homo sapiens
ttcagagaacttcatggaagag

SEQ ID NO: 8776986 - DNA, 22 bp, Homo sapiens
ttcagagaaaggaaagccggat

SEQ ID NO: 8776987 - DNA, 22 bp, Homo sapiens
ttcagagaagcaaaggcagatt

SEQ ID NO: 8776988 - DNA, 22 bp, Homo sapiens
ttcagagaagcaaaggcagatt

SEQ ID NO: 8776989 - DNA, 22 bp, Homo sapiens
ttcagactagacacatttcaag

SEQ ID NO: 8776990 - DNA, 23 bp, Homo sapiens
ttcagactgccttcagcattgtc

SEQ ID NO: 8776991 - DNA, 22 bp, Homo sapiens
ttcagagaaactgaggtttaga

SEQ ID NO: 8776992 - DNA, 22 bp, Homo sapiens
ttcagactggctacattttcat

SEQ ID NO: 8776993 - DNA, 22 bp, Homo sapiens
ttcacagggcagcagctgagcc

SEQ ID NO: 8776994 - DNA, 22 bp, Homo sapiens
ttcacagggcagcagctgagcc

SEQ ID NO: 8776995 - DNA, 22 bp, Homo sapiens
ttcacaggcttggaggtggggg

SEQ ID NO: 8776996 - DNA, 22 bp, Homo sapiens
ttcacaggagggtggatgcatg

SEQ ID NO: 8776997 - DNA, 22 bp, Homo sapiens
ttcagagagtttgtgagtcctt

SEQ ID NO: 8776998 - DNA, 22 bp, Homo sapiens
ttcagagatggaaggcagaatg

SEQ ID NO: 8776999 - DNA, 22 bp, Homo sapiens
ttcagagagaaaccagtgggaa

SEQ ID NO: 8777000 - DNA, 22 bp, Homo sapiens
ttcagagagtccagtatgcagt

SEQ ID NO: 8777001 - DNA, 22 bp, Homo sapiens
ttcagagacagcaaccaggaca

SEQ ID NO: 8777002 - DNA, 22 bp, Homo sapiens
ttcagagaagcaaaggcagatt

SEQ ID NO: 8777003 - DNA, 22 bp, Homo sapiens
ttcagagaattggataattcgt

SEQ ID NO: 8777004 - DNA, 22 bp, Homo sapiens
ttcagagaagtgcacaaaatca

SEQ ID NO: 8777005 - DNA, 19 bp, Homo sapiens
ttcatttgtatctgctcac

SEQ ID NO: 8777006 - DNA, 22 bp, Homo sapiens
ttcatttgtaactctgttaggg

SEQ ID NO: 8777007 - DNA, 22 bp, Homo sapiens
ttcatttgggatgagtcagaag

SEQ ID NO: 8777008 - DNA, 22 bp, Homo sapiens
ttcatttgggatgagtcagaag

SEQ ID NO: 8777009 - DNA, 22 bp, Homo sapiens
ttcatttgccatcagtgtaatg

SEQ ID NO: 8777010 - DNA, 22 bp, Homo sapiens
ttcatttgtggtgaatgaagtg

SEQ ID NO: 8777011 - DNA, 22 bp, Homo sapiens
ttcatttgtggtgaatgaagtg

SEQ ID NO: 8777012 - DNA, 22 bp, Homo sapiens
ttcatttgtggttatttacaat

SEQ ID NO: 8777013 - DNA, 23 bp, Homo sapiens
ttcatttgtctacttcacttgtt

SEQ ID NO: 8777014 - DNA, 22 bp, Homo sapiens
ttcatttgtccaaatactatgt

SEQ ID NO: 8777015 - DNA, 22 bp, Homo sapiens
ttcatttgtccaaatactatgt

SEQ ID NO: 8777016 - DNA, 22 bp, Homo sapiens
ttcatttgtccaaatactatgt

SEQ ID NO: 8777017 - DNA, 22 bp, Homo sapiens
ttcatttgtctgctatagatcc

SEQ ID NO: 8777018 - DNA, 22 bp, Homo sapiens
ttcatttgtctgctatagatcc

SEQ ID NO: 8777019 - DNA, 22 bp, Homo sapiens
ttcattttataaaccctgctga

SEQ ID NO: 8777020 - DNA, 20 bp, Homo sapiens
ttcatttgttgagcaccttc

SEQ ID NO: 8777021 - DNA, 22 bp, Homo sapiens
ttcatttttaccgcgtgtcaaa

SEQ ID NO: 8777022 - DNA, 22 bp, Homo sapiens
ttcatttgttgacagagacatg

SEQ ID NO: 8777023 - DNA, 22 bp, Homo sapiens
ttcatttgtgtgcctgatgcaa

SEQ ID NO: 8777024 - DNA, 22 bp, Homo sapiens
ttcatttgtgtgcctgatgcaa

SEQ ID NO: 8777025 - DNA, 22 bp, Homo sapiens
ttcatttgttgacagagacatg

SEQ ID NO: 8777026 - DNA, 22 bp, Homo sapiens
ttcattttataaaccctgctga

SEQ ID NO: 8777027 - DNA, 22 bp, Homo sapiens
ttccaggaagcagttagcagcc

SEQ ID NO: 8777028 - DNA, 22 bp, Homo sapiens
ttccaggaagtgactatgtcat

SEQ ID NO: 8777029 - DNA, 22 bp, Homo sapiens
ttccaggaagctctcggcctct

SEQ ID NO: 8777030 - DNA, 22 bp, Homo sapiens
ttccaggaagtgactatgtcat

SEQ ID NO: 8777031 - DNA, 22 bp, Homo sapiens
ttccaggcacatcccaactcca

SEQ ID NO: 8777032 - DNA, 22 bp, Homo sapiens
ttccaggcacatcccaactcca

SEQ ID NO: 8777033 - DNA, 23 bp, Homo sapiens
ttccaggcagagcagggattaga

SEQ ID NO: 8777034 - DNA, 22 bp, Homo sapiens
ttccaggaagattcaacaaaag

SEQ ID NO: 8777035 - DNA, 22 bp, Homo sapiens
ttccaggaagacatctcaggaa

SEQ ID NO: 8777036 - DNA, 22 bp, Homo sapiens
ttccaggaacactctgtgtccc

SEQ ID NO: 8777037 - DNA, 22 bp, Homo sapiens
ttccaggaacactctgtgtccc

SEQ ID NO: 8777038 - DNA, 19 bp, Homo sapiens
ttccaggtgctgtggggag

SEQ ID NO: 8777039 - DNA, 22 bp, Homo sapiens
ttccaggcttctctggggcgtc

SEQ ID NO: 8777040 - DNA, 22 bp, Homo sapiens
ttccaggcttctctggggcgtc

SEQ ID NO: 8777041 - DNA, 22 bp, Homo sapiens
ttccaggctgcacagttgggac

SEQ ID NO: 8777042 - DNA, 22 bp, Homo sapiens
ttccaggctgatgggccacagg

SEQ ID NO: 8777043 - DNA, 22 bp, Homo sapiens
ttccaggctcccttggaggtgt

SEQ ID NO: 8777044 - DNA, 22 bp, Homo sapiens
ttccaggctcccttggaggtgt

SEQ ID NO: 8777045 - DNA, 22 bp, Homo sapiens
ttccaggctcccttggaggtgt

SEQ ID NO: 8777046 - DNA, 22 bp, Homo sapiens
ttccaggctcctgcagtttcta

SEQ ID NO: 8777047 - DNA, 22 bp, Homo sapiens
ttccaggctcctgcagtttcta

SEQ ID NO: 8777048 - DNA, 22 bp, Homo sapiens
ttccaggctcccttggaggtgt

SEQ ID NO: 8777049 - DNA, 22 bp, Homo sapiens
ttccaggctgatgggccacagg

SEQ ID NO: 8777050 - DNA, 22 bp, Homo sapiens
ttccaggctgatgggccacagg

SEQ ID NO: 8777051 - DNA, 22 bp, Homo sapiens
ttccaggctgatgggccacagg

SEQ ID NO: 8777052 - DNA, 22 bp, Homo sapiens
ttccaggctgatgggccacagg

SEQ ID NO: 8777053 - DNA, 22 bp, Homo sapiens
ttccaggctcttccaggctgtc

SEQ ID NO: 8777054 - DNA, 22 bp, Homo sapiens
ttccaggctcttccaggctgtc

SEQ ID NO: 8777055 - DNA, 22 bp, Homo sapiens
ttccaggctcttccaggctgtc

SEQ ID NO: 8777056 - DNA, 22 bp, Homo sapiens
ttccaggctattccctttggag

SEQ ID NO: 8777057 - DNA, 22 bp, Homo sapiens
ttccaggctatccggtgaaggg

SEQ ID NO: 8777058 - DNA, 22 bp, Homo sapiens
ttccaggcgcacgtcggcctta

SEQ ID NO: 8777059 - DNA, 22 bp, Homo sapiens
ttccaggctatccggtgaaggg

SEQ ID NO: 8777060 - DNA, 22 bp, Homo sapiens
ttccaggcattacagggtttgc

SEQ ID NO: 8777061 - DNA, 22 bp, Homo sapiens
ttccaggccagaatggtcacat

SEQ ID NO: 8777062 - DNA, 22 bp, Homo sapiens
ttccaggcattaaagtttctcc

SEQ ID NO: 8777063 - DNA, 22 bp, Homo sapiens
ttccaggcatgtcagacatagg

SEQ ID NO: 8777064 - DNA, 22 bp, Homo sapiens
ttccaggcatgtcagacatagg

SEQ ID NO: 8777065 - DNA, 22 bp, Homo sapiens
ttccaggcatgtcagacatagg

SEQ ID NO: 8777066 - DNA, 22 bp, Homo sapiens
ttccagtcagggcaaactgcca

SEQ ID NO: 8777067 - DNA, 22 bp, Homo sapiens
ttccagtcagggcaaactgcca

SEQ ID NO: 8777068 - DNA, 18 bp, Homo sapiens
ttccagtagctgtatcac

SEQ ID NO: 8777069 - DNA, 22 bp, Homo sapiens
ttccagtaatgtgactttgagc

SEQ ID NO: 8777070 - DNA, 22 bp, Homo sapiens
ttccagtaatgtgactttgagc

SEQ ID NO: 8777071 - DNA, 22 bp, Homo sapiens
ttccagtaatgtgactttgagc

SEQ ID NO: 8777072 - DNA, 22 bp, Homo sapiens
ttccagtctagtacctggatgc

SEQ ID NO: 8777073 - DNA, 22 bp, Homo sapiens
ttccagtgaaacatgaggtgtg

SEQ ID NO: 8777074 - DNA, 22 bp, Homo sapiens
ttccagtgaaacatgaggtgtg

SEQ ID NO: 8777075 - DNA, 19 bp, Homo sapiens
ttccagttctaatctcttc

SEQ ID NO: 8777076 - DNA, 22 bp, Homo sapiens
ttccagtgggaaagcatagcca

SEQ ID NO: 8777077 - DNA, 22 bp, Homo sapiens
ttccagtgggaaagcatagcca

SEQ ID NO: 8777078 - DNA, 22 bp, Homo sapiens
ttccagtgatgggcaatttggt

SEQ ID NO: 8777079 - DNA, 22 bp, Homo sapiens
ttccagtgatgggcaatttggt

SEQ ID NO: 8777080 - DNA, 22 bp, Homo sapiens
ttccagtgactaagcttctgct

SEQ ID NO: 8777081 - DNA, 22 bp, Homo sapiens
ttcattgtactttaagagatgc

SEQ ID NO: 8777082 - DNA, 22 bp, Homo sapiens
ttcattgtagcttgactaatta

SEQ ID NO: 8777083 - DNA, 22 bp, Homo sapiens
ttcattgtctctgtttgccttc

SEQ ID NO: 8777084 - DNA, 22 bp, Homo sapiens
ttcattgtactttaagagatgc

SEQ ID NO: 8777085 - DNA, 22 bp, Homo sapiens
ttcattgtactttaagagatgc

SEQ ID NO: 8777086 - DNA, 22 bp, Homo sapiens
ttcattgttggctagctacctc

SEQ ID NO: 8777087 - DNA, 22 bp, Homo sapiens
ttcattgtgaacacattctgcc

SEQ ID NO: 8777088 - DNA, 22 bp, Homo sapiens
ttcataatcaccaaaaactgga

SEQ ID NO: 8777089 - DNA, 22 bp, Homo sapiens
ttcataagggtggccatataaa

SEQ ID NO: 8777090 - DNA, 19 bp, Homo sapiens
ttcataagtttagtgaggg

SEQ ID NO: 8777091 - DNA, 22 bp, Homo sapiens
ttcataagtttgtcactgatgt

SEQ ID NO: 8777092 - DNA, 22 bp, Homo sapiens
ttcataatcaccaaaaactgga

SEQ ID NO: 8777093 - DNA, 22 bp, Homo sapiens
ttcatacaatgggatattatga

SEQ ID NO: 8777094 - DNA, 22 bp, Homo sapiens
ttcatacaatgggatattatga

SEQ ID NO: 8777095 - DNA, 22 bp, Homo sapiens
ttcattgcattccagcctgggt

SEQ ID NO: 8777096 - DNA, 22 bp, Homo sapiens
ttcattgatttccttggaataa

SEQ ID NO: 8777097 - DNA, 22 bp, Homo sapiens
ttcattgcagttcttcaggtta

SEQ ID NO: 8777098 - DNA, 22 bp, Homo sapiens
ttcatacaatgggatattatga

SEQ ID NO: 8777099 - DNA, 22 bp, Homo sapiens
ttcataagttggtgttgacttt

SEQ ID NO: 8777100 - DNA, 22 bp, Homo sapiens
ttcatttagcatgctaaacctg

SEQ ID NO: 8777101 - DNA, 23 bp, Homo sapiens
ttcatttaggagttcataagagc

SEQ ID NO: 8777102 - DNA, 22 bp, Homo sapiens
ttcatttaatttgtgtattaac

SEQ ID NO: 8777103 - DNA, 22 bp, Homo sapiens
ttcatttaatcagaatctctaa

SEQ ID NO: 8777104 - DNA, 22 bp, Homo sapiens
ttcatttaatcagaatctctaa

SEQ ID NO: 8777105 - DNA, 22 bp, Homo sapiens
ttcatttgagtttatagttgct

SEQ ID NO: 8777106 - DNA, 22 bp, Homo sapiens
ttcagtgttaaattcaaagagt

SEQ ID NO: 8777107 - DNA, 22 bp, Homo sapiens
ttcagtgttaatcttgggagaa

SEQ ID NO: 8777108 - DNA, 22 bp, Homo sapiens
ttcagtgttcttttctgttagc

SEQ ID NO: 8777109 - DNA, 22 bp, Homo sapiens
ttcagtgtttgtagagataact

SEQ ID NO: 8777110 - DNA, 22 bp, Homo sapiens
ttcagttcacatgtatcatggc

SEQ ID NO: 8777111 - DNA, 22 bp, Homo sapiens
ttcagtgtttgtagagataact

SEQ ID NO: 8777112 - DNA, 22 bp, Homo sapiens
ttcagttccttgtgcgaattcc

SEQ ID NO: 8777113 - DNA, 22 bp, Homo sapiens
ttcagttccatttcaggtgggt

SEQ ID NO: 8777114 - DNA, 22 bp, Homo sapiens
ttcagtgtgcttcaggacgtta

SEQ ID NO: 8777115 - DNA, 22 bp, Homo sapiens
ttcagtgtggtgcacagttttg

SEQ ID NO: 8777116 - DNA, 22 bp, Homo sapiens
ttcagtgtggcccatgaagagg

SEQ ID NO: 8777117 - DNA, 22 bp, Homo sapiens
ttcagtgtggcccatgaagagg

SEQ ID NO: 8777118 - DNA, 22 bp, Homo sapiens
ttcagtgtggtgcacagttttg

SEQ ID NO: 8777119 - DNA, 22 bp, Homo sapiens
ttcagttttccctcctgcaggt

SEQ ID NO: 8777120 - DNA, 22 bp, Homo sapiens
ttcagttccttatcatagggtt

SEQ ID NO: 8777121 - DNA, 21 bp, Homo sapiens
ttcataaaccattctcatgca

SEQ ID NO: 8777122 - DNA, 21 bp, Homo sapiens
ttcataaaccattctcatgca

SEQ ID NO: 8777123 - DNA, 21 bp, Homo sapiens
ttcataaaccattctcatgca

SEQ ID NO: 8777124 - DNA, 22 bp, Homo sapiens
ttcagttttctttagaatgtag

SEQ ID NO: 8777125 - DNA, 22 bp, Homo sapiens
ttcataaacaaattaaggcctg

SEQ ID NO: 8777126 - DNA, 22 bp, Homo sapiens
ttcataaacaactgatggtaat

SEQ ID NO: 8777127 - DNA, 22 bp, Homo sapiens
ttcaaacagtgtagaatatatg

SEQ ID NO: 8777128 - DNA, 22 bp, Homo sapiens
ttcaaacagtgtagaatatatg

SEQ ID NO: 8777129 - DNA, 22 bp, Homo sapiens
ttcaaacagtgtagaatatatg

SEQ ID NO: 8777130 - DNA, 22 bp, Homo sapiens
ttcaaacagttgcacaacttat

SEQ ID NO: 8777131 - DNA, 22 bp, Homo sapiens
ttcaaacagttgcacaacttat

SEQ ID NO: 8777132 - DNA, 22 bp, Homo sapiens
ttcaaacagttgcacaacttat

SEQ ID NO: 8777133 - DNA, 22 bp, Homo sapiens
ttcaaactctgagtagttctgc

SEQ ID NO: 8777134 - DNA, 22 bp, Homo sapiens
ttcaaactgaggagaggatggc

SEQ ID NO: 8777135 - DNA, 22 bp, Homo sapiens
ttcaaactgaggagaggatggc

SEQ ID NO: 8777136 - DNA, 22 bp, Homo sapiens
ttcaaactcttgctctgctagt

SEQ ID NO: 8777137 - DNA, 22 bp, Homo sapiens
ttcaaactctgagtagttctgc

SEQ ID NO: 8777138 - DNA, 22 bp, Homo sapiens
ttcaaactatgacttcagctac

SEQ ID NO: 8777139 - DNA, 22 bp, Homo sapiens
ttcaaactcacactagggagac

SEQ ID NO: 8777140 - DNA, 22 bp, Homo sapiens
ttcaaactcacactagggagac

SEQ ID NO: 8777141 - DNA, 22 bp, Homo sapiens
ttcaaacattcaaataaaccgg

SEQ ID NO: 8777142 - DNA, 22 bp, Homo sapiens
ttcaaactagttaaaagtcaga

SEQ ID NO: 8777143 - DNA, 22 bp, Homo sapiens
ttcaaaccttcacttgcagagt

SEQ ID NO: 8777144 - DNA, 22 bp, Homo sapiens
ttcaaacctatctaagaaatag

SEQ ID NO: 8777145 - DNA, 22 bp, Homo sapiens
ttcaaacacagacagcagcatg

SEQ ID NO: 8777146 - DNA, 22 bp, Homo sapiens
ttcaaacacagacagcagcatg

SEQ ID NO: 8777147 - DNA, 22 bp, Homo sapiens
ttattgtgtcttggtttatctt

SEQ ID NO: 8777148 - DNA, 22 bp, Homo sapiens
ttattgtcttaaatttggtctt

SEQ ID NO: 8777149 - DNA, 22 bp, Homo sapiens
ttattgtggactactgttctgg

SEQ ID NO: 8777150 - DNA, 22 bp, Homo sapiens
ttcaaacaggggtcagggagat

SEQ ID NO: 8777151 - DNA, 22 bp, Homo sapiens
ttcaaacagatgactctgctct

SEQ ID NO: 8777152 - DNA, 22 bp, Homo sapiens
ttcaaacagatgactctgctct

SEQ ID NO: 8777153 - DNA, 22 bp, Homo sapiens
ttcaaacagatgactctgctct

SEQ ID NO: 8777154 - DNA, 22 bp, Homo sapiens
ttcaaacactgctttgagaggg

SEQ ID NO: 8777155 - DNA, 22 bp, Homo sapiens
ttcaaacactgttggcactggg

SEQ ID NO: 8777156 - DNA, 22 bp, Homo sapiens
ttcaaacactgttggcactggg

SEQ ID NO: 8777157 - DNA, 22 bp, Homo sapiens
ttcaaacactggcttagccaat

SEQ ID NO: 8777158 - DNA, 22 bp, Homo sapiens
ttattgtagcactttggcagtg

SEQ ID NO: 8777159 - DNA, 22 bp, Homo sapiens
ttattgtagcactttggcagtg

SEQ ID NO: 8777160 - DNA, 22 bp, Homo sapiens
ttattgtaggcctattgtagaa

SEQ ID NO: 8777161 - DNA, 22 bp, Homo sapiens
ttattgtcctacttattgtctt

SEQ ID NO: 8777162 - DNA, 22 bp, Homo sapiens
ttattggaaaagggctgtaatt

SEQ ID NO: 8777163 - DNA, 22 bp, Homo sapiens
ttattgctggcaccttcaattc

SEQ ID NO: 8777164 - DNA, 22 bp, Homo sapiens
ttattgcttatgattaggtgtt

SEQ ID NO: 8777165 - DNA, 22 bp, Homo sapiens
ttattgctttggaaaacactca

SEQ ID NO: 8777166 - DNA, 22 bp, Homo sapiens
ttattgctgatagtgtttataa

SEQ ID NO: 8777167 - DNA, 22 bp, Homo sapiens
ttattgctgctaacattttatg

SEQ ID NO: 8777168 - DNA, 22 bp, Homo sapiens
ttattgagcacctactatgtgt

SEQ ID NO: 8777169 - DNA, 22 bp, Homo sapiens
ttattgaaggaactgaaataaa

SEQ ID NO: 8777170 - DNA, 22 bp, Homo sapiens
ttattgaaatggaagctataac

SEQ ID NO: 8777171 - DNA, 22 bp, Homo sapiens
ttattgaaatggaagctataac

SEQ ID NO: 8777172 - DNA, 22 bp, Homo sapiens
ttattgaaatggaagctataac

SEQ ID NO: 8777173 - DNA, 22 bp, Homo sapiens
ttatatctttttacatctctcc

SEQ ID NO: 8777174 - DNA, 22 bp, Homo sapiens
ttatatgaactggactttagga

SEQ ID NO: 8777175 - DNA, 22 bp, Homo sapiens
ttatatgagtatcatatcactt

SEQ ID NO: 8777176 - DNA, 22 bp, Homo sapiens
ttatatgagtatcatatcactt

SEQ ID NO: 8777177 - DNA, 22 bp, Homo sapiens
ttatatgattgaagtgcataag

SEQ ID NO: 8777178 - DNA, 22 bp, Homo sapiens
ttatatgattgaagtgcataag

SEQ ID NO: 8777179 - DNA, 22 bp, Homo sapiens
ttattaaaatgcggatttggct

SEQ ID NO: 8777180 - DNA, 22 bp, Homo sapiens
ttatatcagaaggtgagattga

SEQ ID NO: 8777181 - DNA, 22 bp, Homo sapiens
ttatatcagaaggtgagattga

SEQ ID NO: 8777182 - DNA, 22 bp, Homo sapiens
ttatatatcttgatttgttcca

SEQ ID NO: 8777183 - DNA, 22 bp, Homo sapiens
ttatatatcttgatttgttcca

SEQ ID NO: 8777184 - DNA, 22 bp, Homo sapiens
ttatatatcttgatttgttcca

SEQ ID NO: 8777185 - DNA, 22 bp, Homo sapiens
ttatatatcttgatttgttcca

SEQ ID NO: 8777186 - DNA, 22 bp, Homo sapiens
ttatatatatgtagaggtcacg

SEQ ID NO: 8777187 - DNA, 22 bp, Homo sapiens
ttatatatcttgatttgttcca

SEQ ID NO: 8777188 - DNA, 22 bp, Homo sapiens
ttatataaagataacttttctt

SEQ ID NO: 8777189 - DNA, 19 bp, Homo sapiens
ttatatacttggtttctct

SEQ ID NO: 8777190 - DNA, 19 bp, Homo sapiens
ttatatacttggtttctct

SEQ ID NO: 8777191 - DNA, 22 bp, Homo sapiens
ttatatatatgtagaggtcacg

SEQ ID NO: 8777192 - DNA, 22 bp, Homo sapiens
ttatatatatgtagaggtcacg

SEQ ID NO: 8777193 - DNA, 22 bp, Homo sapiens
ttatatatatgtagaggtcacg

SEQ ID NO: 8777194 - DNA, 22 bp, Homo sapiens
ttattaagtgcgtactgtatgc

SEQ ID NO: 8777195 - DNA, 22 bp, Homo sapiens
ttattaagtgcctacaataaag

SEQ ID NO: 8777196 - DNA, 22 bp, Homo sapiens
ttattaagtgcctacaataaag

SEQ ID NO: 8777197 - DNA, 22 bp, Homo sapiens
ttattaataaagtggcatagcc

SEQ ID NO: 8777198 - DNA, 22 bp, Homo sapiens
ttattaatacatgcacctgcat

SEQ ID NO: 8777199 - DNA, 22 bp, Homo sapiens
ttattaatgagtacaagttatt

SEQ ID NO: 8777200 - DNA, 22 bp, Homo sapiens
ttattaatgagtacaagttatt

SEQ ID NO: 8777201 - DNA, 22 bp, Homo sapiens
ttattaatgagtacaagttatt

SEQ ID NO: 8777202 - DNA, 22 bp, Homo sapiens
ttattaatgagtacaagttatt

SEQ ID NO: 8777203 - DNA, 22 bp, Homo sapiens
ttattacaatgcagaaaataga

SEQ ID NO: 8777204 - DNA, 22 bp, Homo sapiens
ttattacaatgcagaaaataga

SEQ ID NO: 8777205 - DNA, 22 bp, Homo sapiens
ttattacaatgcagaaaataga

SEQ ID NO: 8777206 - DNA, 22 bp, Homo sapiens
ttattagtgttgatattaggat

SEQ ID NO: 8777207 - DNA, 22 bp, Homo sapiens
ttattaggttattctctgtact

SEQ ID NO: 8777208 - DNA, 22 bp, Homo sapiens
ttattagggtggtttatgttct

SEQ ID NO: 8777209 - DNA, 22 bp, Homo sapiens
ttattagagtgctttgagaaag

SEQ ID NO: 8777210 - DNA, 22 bp, Homo sapiens
ttattacactgaaagaattgcg

SEQ ID NO: 8777211 - DNA, 22 bp, Homo sapiens
ttattacactgaaagaattgcg

SEQ ID NO: 8777212 - DNA, 22 bp, Homo sapiens
ttattcttttctccagaatccc

SEQ ID NO: 8777213 - DNA, 22 bp, Homo sapiens
ttattcttttctccagaatccc

SEQ ID NO: 8777214 - DNA, 22 bp, Homo sapiens
ttattctttaaacatatatgtt

SEQ ID NO: 8777215 - DNA, 22 bp, Homo sapiens
ttattatgtggatgaaagatgt

SEQ ID NO: 8777216 - DNA, 22 bp, Homo sapiens
ttattatgtggatgaaagatgt

SEQ ID NO: 8777217 - DNA, 22 bp, Homo sapiens
ttattatagattatgcaagatt

SEQ ID NO: 8777218 - DNA, 22 bp, Homo sapiens
ttattatggtatttctttgcag

SEQ ID NO: 8777219 - DNA, 22 bp, Homo sapiens
ttattatggcagttttctaggt

SEQ ID NO: 8777220 - DNA, 22 bp, Homo sapiens
ttatagatgccttgagtaaatg

SEQ ID NO: 8777221 - DNA, 22 bp, Homo sapiens
ttatagaatggtggattttctg

SEQ ID NO: 8777222 - DNA, 22 bp, Homo sapiens
ttatagaatggtggattttctg

SEQ ID NO: 8777223 - DNA, 22 bp, Homo sapiens
ttatagcagcatgatttacaat

SEQ ID NO: 8777224 - DNA, 22 bp, Homo sapiens
ttatagcagcatgatttacaat

SEQ ID NO: 8777225 - DNA, 22 bp, Homo sapiens
ttatagcagcatgatttacaat

SEQ ID NO: 8777226 - DNA, 22 bp, Homo sapiens
ttatagcagcatgatttataat

SEQ ID NO: 8777227 - DNA, 22 bp, Homo sapiens
ttatactaaaacgcattgaatt

SEQ ID NO: 8777228 - DNA, 22 bp, Homo sapiens
ttatactttatactacatcatt

SEQ ID NO: 8777229 - DNA, 22 bp, Homo sapiens
ttatactttatactacatcatt

SEQ ID NO: 8777230 - DNA, 22 bp, Homo sapiens
ttatagaaaatgtgggaaatga

SEQ ID NO: 8777231 - DNA, 22 bp, Homo sapiens
ttatagaacggttctgtgcaaa

SEQ ID NO: 8777232 - DNA, 22 bp, Homo sapiens
ttatagaaggagcattcactta

SEQ ID NO: 8777233 - DNA, 22 bp, Homo sapiens
ttatataaagataacttttctt

SEQ ID NO: 8777234 - DNA, 22 bp, Homo sapiens
ttatagttatgaaagactgagg

SEQ ID NO: 8777235 - DNA, 22 bp, Homo sapiens
ttatatactgtggtagtactgt

SEQ ID NO: 8777236 - DNA, 22 bp, Homo sapiens
ttatatactgtggtagtactgt

SEQ ID NO: 8777237 - DNA, 22 bp, Homo sapiens
ttatagttagtaggtcattaaa

SEQ ID NO: 8777238 - DNA, 22 bp, Homo sapiens
ttatataactcaggtgggctca

SEQ ID NO: 8777239 - DNA, 22 bp, Homo sapiens
ttatagtgggcccaacatggcg

SEQ ID NO: 8777240 - DNA, 22 bp, Homo sapiens
ttatagtatgtgcatatgtgtg

SEQ ID NO: 8777241 - DNA, 22 bp, Homo sapiens
ttatagcagcatgatttatagt

SEQ ID NO: 8777242 - DNA, 22 bp, Homo sapiens
ttaggaaagggttttctaacag

SEQ ID NO: 8777243 - DNA, 22 bp, Homo sapiens
ttaggaaagggttttctaacag

SEQ ID NO: 8777244 - DNA, 22 bp, Homo sapiens
ttaggaaaggaacattgaaacg

SEQ ID NO: 8777245 - DNA, 22 bp, Homo sapiens
ttaggaaagaagcagctaggag

SEQ ID NO: 8777246 - DNA, 22 bp, Homo sapiens
ttaggaaagcattgtgtaaaag

SEQ ID NO: 8777247 - DNA, 22 bp, Homo sapiens
ttatacatgtgttttgagatga

SEQ ID NO: 8777248 - DNA, 22 bp, Homo sapiens
ttatacatgtgttttgagatga

SEQ ID NO: 8777249 - DNA, 22 bp, Homo sapiens
ttatacatgtgttttgagatga

SEQ ID NO: 8777250 - DNA, 22 bp, Homo sapiens
ttatacatgtgttttgagatga

SEQ ID NO: 8777251 - DNA, 22 bp, Homo sapiens
ttatacatgtttataaggttga

SEQ ID NO: 8777252 - DNA, 22 bp, Homo sapiens
ttatacatgtttataaggttga

SEQ ID NO: 8777253 - DNA, 19 bp, Homo sapiens
ttaggaaaccactttcctt

SEQ ID NO: 8777254 - DNA, 22 bp, Homo sapiens
ttaggaaacagtagcctttgct

SEQ ID NO: 8777255 - DNA, 22 bp, Homo sapiens
ttaggaaacagtagcctttgct

SEQ ID NO: 8777256 - DNA, 22 bp, Homo sapiens
ttaggaaacagtagcctttgct

SEQ ID NO: 8777257 - DNA, 22 bp, Homo sapiens
ttaggaaacatcatttttgctg

SEQ ID NO: 8777258 - DNA, 22 bp, Homo sapiens
ttaggaaaatcatgagagatga

SEQ ID NO: 8777259 - DNA, 22 bp, Homo sapiens
ttaggaaaagaagacatttcta

SEQ ID NO: 8777260 - DNA, 22 bp, Homo sapiens
ttaggaaaatggagtcctttta

SEQ ID NO: 8777261 - DNA, 22 bp, Homo sapiens
ttagcttttgagaatgatttct

SEQ ID NO: 8777262 - DNA, 22 bp, Homo sapiens
ttagcttttgagaatgatttct

SEQ ID NO: 8777263 - DNA, 21 bp, Homo sapiens
ttagctttctagaatctttgt

SEQ ID NO: 8777264 - DNA, 21 bp, Homo sapiens
ttagccattgggacattcagc

SEQ ID NO: 8777265 - DNA, 22 bp, Homo sapiens
ttagccattctgataggtatgt

SEQ ID NO: 8777266 - DNA, 22 bp, Homo sapiens
ttagccattaaattacaaggtg

SEQ ID NO: 8777267 - DNA, 22 bp, Homo sapiens
ttagccatgttgaagatttaga

SEQ ID NO: 8777268 - DNA, 22 bp, Homo sapiens
ttagccattaatgtcctgtgca

SEQ ID NO: 8777269 - DNA, 23 bp, Homo sapiens
ttagccattccactgacatttga

SEQ ID NO: 8777270 - DNA, 22 bp, Homo sapiens
ttagccatgtgggaaaaacagc

SEQ ID NO: 8777271 - DNA, 16 bp, Homo sapiens
ttagccatggcattct

SEQ ID NO: 8777272 - DNA, 22 bp, Homo sapiens
ttagccatggactgaattgact

SEQ ID NO: 8777273 - DNA, 22 bp, Homo sapiens
ttagccatgccctagaagagga

SEQ ID NO: 8777274 - DNA, 22 bp, Homo sapiens
ttagccatgcttcttgggtcta

SEQ ID NO: 8777275 - DNA, 22 bp, Homo sapiens
ttagccataattgtttttccca

SEQ ID NO: 8777276 - DNA, 22 bp, Homo sapiens
ttagccataattgtttttccca

SEQ ID NO: 8777277 - DNA, 22 bp, Homo sapiens
ttagccatgatgagtatatttg

SEQ ID NO: 8777278 - DNA, 22 bp, Homo sapiens
ttagccatatagaaaaagagct

SEQ ID NO: 8777279 - DNA, 22 bp, Homo sapiens
ttagccatgagctgggcgactc

SEQ ID NO: 8777280 - DNA, 19 bp, Homo sapiens
ttagccatccacagtgaaa

SEQ ID NO: 8777281 - DNA, 22 bp, Homo sapiens
ttagccatatagtgctcttgta

SEQ ID NO: 8777282 - DNA, 21 bp, Homo sapiens
tcctgctgctcctgtcgtgtt

SEQ ID NO: 8777283 - DNA, 22 bp, Homo sapiens
tcctgctgctcacctttttgtc

SEQ ID NO: 8777284 - DNA, 21 bp, Homo sapiens
tcctgctgctcctgtcgtgtt

SEQ ID NO: 8777285 - DNA, 22 bp, Homo sapiens
tcctgctggaagtagggaatga

SEQ ID NO: 8777286 - DNA, 22 bp, Homo sapiens
tcctgctgctcttgggaaacct

SEQ ID NO: 8777287 - DNA, 22 bp, Homo sapiens
tcctgctggactctgagtacaa

SEQ ID NO: 8777288 - DNA, 22 bp, Homo sapiens
ttagccaaacaggtgaaattga

SEQ ID NO: 8777289 - DNA, 22 bp, Homo sapiens
tcctgctggaatggaaaatgaa

SEQ ID NO: 8777290 - DNA, 22 bp, Homo sapiens
tcctgctggaagtagggaatga

SEQ ID NO: 8777291 - DNA, 22 bp, Homo sapiens
ttagctcagaaaatttaaactt

SEQ ID NO: 8777292 - DNA, 22 bp, Homo sapiens
ttagctatagtatgtctgcttt

SEQ ID NO: 8777293 - DNA, 22 bp, Homo sapiens
ttagccatttgaggtcttcatt

SEQ ID NO: 8777294 - DNA, 22 bp, Homo sapiens
ttagccattgtcagcacatggc

SEQ ID NO: 8777295 - DNA, 22 bp, Homo sapiens
ttagccattttatacaagtgta

SEQ ID NO: 8777296 - DNA, 22 bp, Homo sapiens
ttagccatatagtgctcttgta

SEQ ID NO: 8777297 - DNA, 22 bp, Homo sapiens
ttagccttagaagcttagcaaa

SEQ ID NO: 8777298 - DNA, 22 bp, Homo sapiens
ttagctaaactgtaactagaat

SEQ ID NO: 8777299 - DNA, 22 bp, Homo sapiens
ttagccttagaagcttagcaaa

SEQ ID NO: 8777300 - DNA, 22 bp, Homo sapiens
ttagccattttattcagcaggt

SEQ ID NO: 8777301 - DNA, 22 bp, Homo sapiens
ttagctttcagcctttctcacc

SEQ ID NO: 8777302 - DNA, 22 bp, Homo sapiens
ttagctttcagcctttctcacc

SEQ ID NO: 8777303 - DNA, 22 bp, Homo sapiens
ttagctgctgattaaatatgtt

SEQ ID NO: 8777304 - DNA, 22 bp, Homo sapiens
ttagctgagattaagtgaactt

SEQ ID NO: 8777305 - DNA, 18 bp, Homo sapiens
tcctgcctgcgggctccc

SEQ ID NO: 8777306 - DNA, 18 bp, Homo sapiens
tcctgcctgcgggctccc

SEQ ID NO: 8777307 - DNA, 22 bp, Homo sapiens
tcctgcctgcaatcccagcact

SEQ ID NO: 8777308 - DNA, 19 bp, Homo sapiens
tcctgcctggggccgcctg

SEQ ID NO: 8777309 - DNA, 19 bp, Homo sapiens
tcctgcctggggccgcctg

SEQ ID NO: 8777310 - DNA, 18 bp, Homo sapiens
tcctgcctgcgggctccc

SEQ ID NO: 8777311 - DNA, 18 bp, Homo sapiens
tcctgcctgtgccccagg

SEQ ID NO: 8777312 - DNA, 19 bp, Homo sapiens
tcctgcctggggccgcctg

SEQ ID NO: 8777313 - DNA, 18 bp, Homo sapiens
tcctgcctgtgccccagg

SEQ ID NO: 8777314 - DNA, 19 bp, Homo sapiens
tcctgcctggggccgcctg

SEQ ID NO: 8777315 - DNA, 22 bp, Homo sapiens
tcctgcctgtttacctgtactt

SEQ ID NO: 8777316 - DNA, 18 bp, Homo sapiens
tcctgcctgtgccccagg

SEQ ID NO: 8777317 - DNA, 18 bp, Homo sapiens
tcctgcctgtgccccagg

SEQ ID NO: 8777318 - DNA, 18 bp, Homo sapiens
tcctgcctgtgccccagg

SEQ ID NO: 8777319 - DNA, 20 bp, Homo sapiens
tcctgctgccacctcttctt

SEQ ID NO: 8777320 - DNA, 22 bp, Homo sapiens
tcctgctgagcgtctgtcattt

SEQ ID NO: 8777321 - DNA, 22 bp, Homo sapiens
tcctgctgctacctggcccacg

SEQ ID NO: 8777322 - DNA, 22 bp, Homo sapiens
tcctgctgccatttcaagtgct

SEQ ID NO: 8777323 - DNA, 22 bp, Homo sapiens
tcctgctgccatttcaagtgct

SEQ ID NO: 8777324 - DNA, 22 bp, Homo sapiens
tcctgcctgtttacctgtactt

SEQ ID NO: 8777325 - DNA, 22 bp, Homo sapiens
tcctgcctgtttacctgtactt

SEQ ID NO: 8777326 - DNA, 22 bp, Homo sapiens
tcctgcctgtttacctgtactt

SEQ ID NO: 8777327 - DNA, 22 bp, Homo sapiens
tcctgccttagagcaaggaaaa

SEQ ID NO: 8777328 - DNA, 22 bp, Homo sapiens
tcctgcctgtttacctgtactt

SEQ ID NO: 8777329 - DNA, 23 bp, Homo sapiens
tcctgctgaaagctccagctggc

SEQ ID NO: 8777330 - DNA, 23 bp, Homo sapiens
tcctgctgaaagctccagctggc

SEQ ID NO: 8777331 - DNA, 22 bp, Homo sapiens
tcctgccttagagcaaggaaaa

SEQ ID NO: 8777332 - DNA, 23 bp, Homo sapiens
tcctgctgaaagctccagctggc

SEQ ID NO: 8777333 - DNA, 22 bp, Homo sapiens
tcctgctgaccagtaaatgaat

SEQ ID NO: 8777334 - DNA, 22 bp, Homo sapiens
tcctgctgacaaggaaagcatg

SEQ ID NO: 8777335 - DNA, 21 bp, Homo sapiens
tcctgctgagaaacagatggt

SEQ ID NO: 8777336 - DNA, 22 bp, Homo sapiens
ttctctatgtgtgttgtagttt

SEQ ID NO: 8777337 - DNA, 22 bp, Homo sapiens
ttctctatgtgtgttgtagttt

SEQ ID NO: 8777338 - DNA, 19 bp, Homo sapiens
ttctctattatgtcttctc

SEQ ID NO: 8777339 - DNA, 19 bp, Homo sapiens
ttctctattatgtcttctc

SEQ ID NO: 8777340 - DNA, 20 bp, Homo sapiens
ttctctagccttcccctggg

SEQ ID NO: 8777341 - DNA, 22 bp, Homo sapiens
ttctctaggagttctgggatca

SEQ ID NO: 8777342 - DNA, 22 bp, Homo sapiens
ttctctaatggtgatgattaga

SEQ ID NO: 8777343 - DNA, 22 bp, Homo sapiens
ttctctacttgagattttaatg

SEQ ID NO: 8777344 - DNA, 22 bp, Homo sapiens
ttctctacttcacaagggatgg

SEQ ID NO: 8777345 - DNA, 21 bp, Homo sapiens
ttctctacctctagtgctgta

SEQ ID NO: 8777346 - DNA, 22 bp, Homo sapiens
ttctctaagctggctgaggtct

SEQ ID NO: 8777347 - DNA, 22 bp, Homo sapiens
ttctctaagccttagtttcttc

SEQ ID NO: 8777348 - DNA, 22 bp, Homo sapiens
ttctctaaggcttggcttccct

SEQ ID NO: 8777349 - DNA, 22 bp, Homo sapiens
ttctctaaggtcccgttctgga

SEQ ID NO: 8777350 - DNA, 22 bp, Homo sapiens
ttctctaatacattttgacaaa

SEQ ID NO: 8777351 - DNA, 22 bp, Homo sapiens
ttctctccagtcctggattctg

SEQ ID NO: 8777352 - DNA, 21 bp, Homo sapiens
ttctctccatatgcccagccc

SEQ ID NO: 8777353 - DNA, 22 bp, Homo sapiens
ttctctcagttaaactttgtga

SEQ ID NO: 8777354 - DNA, 22 bp, Homo sapiens
ttctctcattcaaattaaagtg

SEQ ID NO: 8777355 - DNA, 22 bp, Homo sapiens
ttctctcattcaaattaaagtg

SEQ ID NO: 8777356 - DNA, 22 bp, Homo sapiens
ttctctccagtcctggattctg

SEQ ID NO: 8777357 - DNA, 22 bp, Homo sapiens
ttctctccagactgcagtgggt

SEQ ID NO: 8777358 - DNA, 22 bp, Homo sapiens
ttctctctgagagcatctggaa

SEQ ID NO: 8777359 - DNA, 22 bp, Homo sapiens
ttctctcctcctagaggctttt

SEQ ID NO: 8777360 - DNA, 22 bp, Homo sapiens
ttctctcctacccagtatccat

SEQ ID NO: 8777361 - DNA, 22 bp, Homo sapiens
ttctctcctacccagtatccat

SEQ ID NO: 8777362 - DNA, 22 bp, Homo sapiens
ttctctcctacccagtatccat

SEQ ID NO: 8777363 - DNA, 22 bp, Homo sapiens
ttctctcccatgaagcttctat

SEQ ID NO: 8777364 - DNA, 22 bp, Homo sapiens
ttctctcccatgaagcttctat

SEQ ID NO: 8777365 - DNA, 22 bp, Homo sapiens
ttctctggaaggctctacggga

SEQ ID NO: 8777366 - DNA, 22 bp, Homo sapiens
ttctctggaactgaaacaagat

SEQ ID NO: 8777367 - DNA, 22 bp, Homo sapiens
ttctctggaactgaaacaagat

SEQ ID NO: 8777368 - DNA, 22 bp, Homo sapiens
ttctctgcctcacaggtctaag

SEQ ID NO: 8777369 - DNA, 22 bp, Homo sapiens
ttctctgcctctagctatattc

SEQ ID NO: 8777370 - DNA, 22 bp, Homo sapiens
ttctctgctctcacatacagaa

SEQ ID NO: 8777371 - DNA, 22 bp, Homo sapiens
ttctctcttttgggtaggaggt

SEQ ID NO: 8777372 - DNA, 22 bp, Homo sapiens
ttctctgcagcttaggcccagt

SEQ ID NO: 8777373 - DNA, 22 bp, Homo sapiens
ttctctgagtacgtttcagtgt

SEQ ID NO: 8777374 - DNA, 22 bp, Homo sapiens
ttctctgagatagactaagtgg

SEQ ID NO: 8777375 - DNA, 22 bp, Homo sapiens
ttctctctgtgtcattatggac

SEQ ID NO: 8777376 - DNA, 22 bp, Homo sapiens
ttctctctgttatggattttac

SEQ ID NO: 8777377 - DNA, 22 bp, Homo sapiens
ttctctcttactgccatgctgt

SEQ ID NO: 8777378 - DNA, 22 bp, Homo sapiens
ttctctctgtgtcattatggac

SEQ ID NO: 8777379 - DNA, 22 bp, Homo sapiens
ttctctctgtggtcccattttg

SEQ ID NO: 8777380 - DNA, 22 bp, Homo sapiens
ttctctctggacctgggatgcg

SEQ ID NO: 8777381 - DNA, 22 bp, Homo sapiens
ttctctctggacctgggatgcg

SEQ ID NO: 8777382 - DNA, 22 bp, Homo sapiens
ttctctgaaggccatgctcact

SEQ ID NO: 8777383 - DNA, 22 bp, Homo sapiens
ttctctcttttgggtaggaggt

SEQ ID NO: 8777384 - DNA, 22 bp, Homo sapiens
ttctctcttccagttcccactt

SEQ ID NO: 8777385 - DNA, 22 bp, Homo sapiens
ttctctaagagttatatgaatt

SEQ ID NO: 8777386 - DNA, 22 bp, Homo sapiens
ttctctaagagatgcagaagtt

SEQ ID NO: 8777387 - DNA, 22 bp, Homo sapiens
ttctccacatggtgtgctgtga

SEQ ID NO: 8777388 - DNA, 18 bp, Homo sapiens
ttctccagaaaacatagc

SEQ ID NO: 8777389 - DNA, 22 bp, Homo sapiens
ttctccaaggttcatatttatc

SEQ ID NO: 8777390 - DNA, 22 bp, Homo sapiens
ttctcaggtagtgctgatgctg

SEQ ID NO: 8777391 - DNA, 22 bp, Homo sapiens
ttctccaagatgaagctgtgta

SEQ ID NO: 8777392 - DNA, 22 bp, Homo sapiens
ttctccaactcttttaagtaat

SEQ ID NO: 8777393 - DNA, 22 bp, Homo sapiens
ttctccaactcttttaagtaat

SEQ ID NO: 8777394 - DNA, 22 bp, Homo sapiens
ttctcaggtcaccagggtgcca

SEQ ID NO: 8777395 - DNA, 22 bp, Homo sapiens
ttctcagggtctggatggcctg

SEQ ID NO: 8777396 - DNA, 22 bp, Homo sapiens
ttctcagggccctgtgttagct

SEQ ID NO: 8777397 - DNA, 22 bp, Homo sapiens
ttctcaggcctttgggatggga

SEQ ID NO: 8777398 - DNA, 22 bp, Homo sapiens
ttctcaggcccctgcctggact

SEQ ID NO: 8777399 - DNA, 22 bp, Homo sapiens
ttctcaggcccctgcctggact

SEQ ID NO: 8777400 - DNA, 22 bp, Homo sapiens
ttctcaggactcctgcctgctt

SEQ ID NO: 8777401 - DNA, 22 bp, Homo sapiens
ttctcaggactcctgcctgctt

SEQ ID NO: 8777402 - DNA, 22 bp, Homo sapiens
ttccttggtagggacaactctg

SEQ ID NO: 8777403 - DNA, 22 bp, Homo sapiens
ttccttggtgtaactgctccta

SEQ ID NO: 8777404 - DNA, 22 bp, Homo sapiens
ttccttgtggaaactatggacg

SEQ ID NO: 8777405 - DNA, 22 bp, Homo sapiens
ttccttgtgagggctctcttcc

SEQ ID NO: 8777406 - DNA, 22 bp, Homo sapiens
ttccttgttctacatccctgcc

SEQ ID NO: 8777407 - DNA, 22 bp, Homo sapiens
ttccttgttctacatccctgcc

SEQ ID NO: 8777408 - DNA, 22 bp, Homo sapiens
ttccttgttaatagtgtctgga

SEQ ID NO: 8777409 - DNA, 22 bp, Homo sapiens
ttccttgttcctaggagatcaa

SEQ ID NO: 8777410 - DNA, 22 bp, Homo sapiens
ttccttgtgtaaactctccatc

SEQ ID NO: 8777411 - DNA, 22 bp, Homo sapiens
ttccagttggtagaatgtaagg

SEQ ID NO: 8777412 - DNA, 22 bp, Homo sapiens
ttccagttctatgaattcaaga

SEQ ID NO: 8777413 - DNA, 22 bp, Homo sapiens
ttccagttctggctttgccact

SEQ ID NO: 8777414 - DNA, 22 bp, Homo sapiens
ttcctgaatcccaaggagagct

SEQ ID NO: 8777415 - DNA, 22 bp, Homo sapiens
ttcctgaatataaagacactag

SEQ ID NO: 8777416 - DNA, 22 bp, Homo sapiens
ttcctgaatataaagacactag

SEQ ID NO: 8777417 - DNA, 22 bp, Homo sapiens
ttcctgaattgagctttagaaa

SEQ ID NO: 8777418 - DNA, 22 bp, Homo sapiens
ttcctgaatcccaaggagagct

SEQ ID NO: 8777419 - DNA, 22 bp, Homo sapiens
ttcctgaatgctgttgtgctgt

SEQ ID NO: 8777420 - DNA, 22 bp, Homo sapiens
ttcctgagaacatggcagctta

SEQ ID NO: 8777421 - DNA, 22 bp, Homo sapiens
ttcctgagaaatttgtacctgg

SEQ ID NO: 8777422 - DNA, 18 bp, Homo sapiens
ttcctgatcctctgctga

SEQ ID NO: 8777423 - DNA, 22 bp, Homo sapiens
ttcctgatcaggttcccatgtg

SEQ ID NO: 8777424 - DNA, 22 bp, Homo sapiens
ttcctgatgcacacagtcattt

SEQ ID NO: 8777425 - DNA, 22 bp, Homo sapiens
ttcctgcaagatctttaaggag

SEQ ID NO: 8777426 - DNA, 22 bp, Homo sapiens
ttcctgcacagcccttcctgag

SEQ ID NO: 8777427 - DNA, 22 bp, Homo sapiens
ttcctgaggaggaccaggacca

SEQ ID NO: 8777428 - DNA, 22 bp, Homo sapiens
ttcctgaggaggaccaggacca

SEQ ID NO: 8777429 - DNA, 22 bp, Homo sapiens
ttcctgagggccccagaggagg

SEQ ID NO: 8777430 - DNA, 21 bp, Homo sapiens
ttcctggggacttccgtggga

SEQ ID NO: 8777431 - DNA, 21 bp, Homo sapiens
ttcctggcggcagaaacgtga

SEQ ID NO: 8777432 - DNA, 21 bp, Homo sapiens
ttcctggggacttccgtggga

SEQ ID NO: 8777433 - DNA, 22 bp, Homo sapiens
ttcctggggcgactgtatctga

SEQ ID NO: 8777434 - DNA, 22 bp, Homo sapiens
ttcctggctcacagcagtgggg

SEQ ID NO: 8777435 - DNA, 22 bp, Homo sapiens
ttcctggcgccacggagccggt

SEQ ID NO: 8777436 - DNA, 22 bp, Homo sapiens
ttcctggcgccacggagccggt

SEQ ID NO: 8777437 - DNA, 22 bp, Homo sapiens
ttcctggcctctctctgagcag

SEQ ID NO: 8777438 - DNA, 22 bp, Homo sapiens
ttcctggcatgaaaaatatcac

SEQ ID NO: 8777439 - DNA, 22 bp, Homo sapiens
ttcctggcctaaggtaggtgac

SEQ ID NO: 8777440 - DNA, 22 bp, Homo sapiens
ttcctggcatagagagggcaca

SEQ ID NO: 8777441 - DNA, 22 bp, Homo sapiens
ttcctggcagaggccccgacag

SEQ ID NO: 8777442 - DNA, 22 bp, Homo sapiens
ttcctggcactgcagtggttga

SEQ ID NO: 8777443 - DNA, 22 bp, Homo sapiens
ttcctggccaagcagagtggaa

SEQ ID NO: 8777444 - DNA, 22 bp, Homo sapiens
ttcctggccccacccctggaga

SEQ ID NO: 8777445 - DNA, 22 bp, Homo sapiens
ttcctgctccatttgctgagct

SEQ ID NO: 8777446 - DNA, 22 bp, Homo sapiens
ttcctgcctacatgccttatgc

SEQ ID NO: 8777447 - DNA, 22 bp, Homo sapiens
ttcctgcgcccttctcgcccgc

SEQ ID NO: 8777448 - DNA, 22 bp, Homo sapiens
ttcctgctccatttgctgagct

SEQ ID NO: 8777449 - DNA, 22 bp, Homo sapiens
ttcctgcccctgagagctccca

SEQ ID NO: 8777450 - DNA, 22 bp, Homo sapiens
ttcctgcccctgagagctccca

SEQ ID NO: 8777451 - DNA, 22 bp, Homo sapiens
ttcctgcatggattgaggctat

SEQ ID NO: 8777452 - DNA, 22 bp, Homo sapiens
ttcctgcccctgagagctccca

SEQ ID NO: 8777453 - DNA, 22 bp, Homo sapiens
ttccttgaggtattcagtttta

SEQ ID NO: 8777454 - DNA, 22 bp, Homo sapiens
ttccttgaggtattcagtttta

SEQ ID NO: 8777455 - DNA, 18 bp, Homo sapiens
ttccttgattagagagaa

SEQ ID NO: 8777456 - DNA, 22 bp, Homo sapiens
ttccttgagatgactgtcttgt

SEQ ID NO: 8777457 - DNA, 22 bp, Homo sapiens
ttccttgaatgagtcatggaaa

SEQ ID NO: 8777458 - DNA, 22 bp, Homo sapiens
ttccttgaaagctggacatggg

SEQ ID NO: 8777459 - DNA, 22 bp, Homo sapiens
ttccttgcctcggggtaccttg

SEQ ID NO: 8777460 - DNA, 20 bp, Homo sapiens
ttcctgtatacaaagagttc

SEQ ID NO: 8777461 - DNA, 18 bp, Homo sapiens
ttccttctgatgtatatg

SEQ ID NO: 8777462 - DNA, 22 bp, Homo sapiens
ttcctgtatctgcttcttacta

SEQ ID NO: 8777463 - DNA, 22 bp, Homo sapiens
ttccttctggaggctccagggg

SEQ ID NO: 8777464 - DNA, 22 bp, Homo sapiens
ttccttcttccagaggctgccc

SEQ ID NO: 8777465 - DNA, 22 bp, Homo sapiens
ttccttcttccagaggctgccc

SEQ ID NO: 8777466 - DNA, 22 bp, Homo sapiens
ttccttcttccagaggctgccc

SEQ ID NO: 8777467 - DNA, 22 bp, Homo sapiens
ttccttcttgtaatgatctgcc

SEQ ID NO: 8777468 - DNA, 22 bp, Homo sapiens
ttcctgggtggtcctggtagag

SEQ ID NO: 8777469 - DNA, 22 bp, Homo sapiens
ttcctgggtggtcctggtagag

SEQ ID NO: 8777470 - DNA, 22 bp, Homo sapiens
ttcctggtggtggtgacagcac

SEQ ID NO: 8777471 - DNA, 22 bp, Homo sapiens
ttcctggtggctttgccaactg

SEQ ID NO: 8777472 - DNA, 22 bp, Homo sapiens
ttcctggtgacctcactggtag

SEQ ID NO: 8777473 - DNA, 22 bp, Homo sapiens
ttcctggtttatacctgtatca

SEQ ID NO: 8777474 - DNA, 22 bp, Homo sapiens
ttcctggttggattctgattaa

SEQ ID NO: 8777475 - DNA, 22 bp, Homo sapiens
ttcctggtttatggaaagcatg

SEQ ID NO: 8777476 - DNA, 22 bp, Homo sapiens
ttcctggtttgcctggaatcca

SEQ ID NO: 8777477 - DNA, 20 bp, Homo sapiens
ttcctgtaaccggcagctgc

SEQ ID NO: 8777478 - DNA, 22 bp, Homo sapiens
ttcctggtctatttagaattgc

SEQ ID NO: 8777479 - DNA, 22 bp, Homo sapiens
ttcctggtcccgttcttcactg

SEQ ID NO: 8777480 - DNA, 22 bp, Homo sapiens
ttcctggtaaattatgtccagg

SEQ ID NO: 8777481 - DNA, 22 bp, Homo sapiens
ttgaaatggcagcagctgacct

SEQ ID NO: 8777482 - DNA, 19 bp, Homo sapiens
ttgaaattgtttgatatgg

SEQ ID NO: 8777483 - DNA, 19 bp, Homo sapiens
ttgaaattgtttgatatgg

SEQ ID NO: 8777484 - DNA, 22 bp, Homo sapiens
ttgaaattttaggccttgcaat

SEQ ID NO: 8777485 - DNA, 22 bp, Homo sapiens
ttgaacactaagtttccaggct

SEQ ID NO: 8777486 - DNA, 19 bp, Homo sapiens
ttgaacactttcttcaagg

SEQ ID NO: 8777487 - DNA, 19 bp, Homo sapiens
ttgaacactttcttcaagg

SEQ ID NO: 8777488 - DNA, 22 bp, Homo sapiens
ttgaacagctgttacattgtta

SEQ ID NO: 8777489 - DNA, 22 bp, Homo sapiens
ttgaacagctgttacattgtta

SEQ ID NO: 8777490 - DNA, 22 bp, Homo sapiens
ttgaacagttttgtcaggttca

SEQ ID NO: 8777491 - DNA, 22 bp, Homo sapiens
ttgaatttagattgtatgttga

SEQ ID NO: 8777492 - DNA, 23 bp, Homo sapiens
ttgaatttctcttgcaatattta

SEQ ID NO: 8777493 - DNA, 23 bp, Homo sapiens
ttgaatttctcttgcaatattta

SEQ ID NO: 8777494 - DNA, 23 bp, Homo sapiens
ttgaatttctcttgcaatattta

SEQ ID NO: 8777495 - DNA, 21 bp, Homo sapiens
ttgaattgtatgattaaactg

SEQ ID NO: 8777496 - DNA, 22 bp, Homo sapiens
ttgaatttagattgtatgttga

SEQ ID NO: 8777497 - DNA, 22 bp, Homo sapiens
ttgaattggcaaaactgcagct

SEQ ID NO: 8777498 - DNA, 17 bp, Homo sapiens
ttgaactgctgagtcag

SEQ ID NO: 8777499 - DNA, 22 bp, Homo sapiens
ttgaagaaattattttatatag

SEQ ID NO: 8777500 - DNA, 22 bp, Homo sapiens
ttgaagaaagtcatatataatg

SEQ ID NO: 8777501 - DNA, 17 bp, Homo sapiens
ttgaacctagacacctt

SEQ ID NO: 8777502 - DNA, 22 bp, Homo sapiens
ttcttttctttaggcattgtgt

SEQ ID NO: 8777503 - DNA, 22 bp, Homo sapiens
ttcttttcttggcaggagtaga

SEQ ID NO: 8777504 - DNA, 22 bp, Homo sapiens
ttcttttcttggcaggagtaga

SEQ ID NO: 8777505 - DNA, 22 bp, Homo sapiens
ttcttttgcaagactattgatt

SEQ ID NO: 8777506 - DNA, 22 bp, Homo sapiens
ttcttttggactcaaagagaac

SEQ ID NO: 8777507 - DNA, 22 bp, Homo sapiens
ttcttttgcaagactattgatt

SEQ ID NO: 8777508 - DNA, 22 bp, Homo sapiens
ttctttttaaagtgtgtatgca

SEQ ID NO: 8777509 - DNA, 22 bp, Homo sapiens
ttctttttaaagtgtgtatgca

SEQ ID NO: 8777510 - DNA, 22 bp, Homo sapiens
ttcttttggactcaaagagaac

SEQ ID NO: 8777511 - DNA, 22 bp, Homo sapiens
ttctttttaaagtgtgtatgca

SEQ ID NO: 8777512 - DNA, 22 bp, Homo sapiens
ttctttttaaagtgtgtatgca

SEQ ID NO: 8777513 - DNA, 22 bp, Homo sapiens
ttgaaaggcacaggcacctggg

SEQ ID NO: 8777514 - DNA, 22 bp, Homo sapiens
ttgaaatggaagtgaaaattct

SEQ ID NO: 8777515 - DNA, 22 bp, Homo sapiens
ttgaaatgctctttggaatcta

SEQ ID NO: 8777516 - DNA, 22 bp, Homo sapiens
ttgaaatgagactaattgattg

SEQ ID NO: 8777517 - DNA, 22 bp, Homo sapiens
ttgaaatatggattgaccttga

SEQ ID NO: 8777518 - DNA, 22 bp, Homo sapiens
ttgaaatgaaatatttaagctc

SEQ ID NO: 8777519 - DNA, 22 bp, Homo sapiens
ttgaaatgaaatatttaagctc

SEQ ID NO: 8777520 - DNA, 22 bp, Homo sapiens
ttgaaatcaccactagcatttg

SEQ ID NO: 8777521 - DNA, 22 bp, Homo sapiens
ttcttcaaccatctacataaac

SEQ ID NO: 8777522 - DNA, 22 bp, Homo sapiens
ttcttcaaccatctacataaac

SEQ ID NO: 8777523 - DNA, 22 bp, Homo sapiens
ttcttcaaatagcagggagtca

SEQ ID NO: 8777524 - DNA, 22 bp, Homo sapiens
ttcttcaaatgctgaaagtcta

SEQ ID NO: 8777525 - DNA, 22 bp, Homo sapiens
ttcttcaaatgctgaaagtcta

SEQ ID NO: 8777526 - DNA, 22 bp, Homo sapiens
ttcttcaaagtccttattcctt

SEQ ID NO: 8777527 - DNA, 22 bp, Homo sapiens
ttcttcaacaaggacactgtta

SEQ ID NO: 8777528 - DNA, 22 bp, Homo sapiens
ttcttcaacaaggacactgtta

SEQ ID NO: 8777529 - DNA, 22 bp, Homo sapiens
ttcttcaacaaggacactgtta

SEQ ID NO: 8777530 - DNA, 22 bp, Homo sapiens
ttcttcaagggtaaaggcaacg

SEQ ID NO: 8777531 - DNA, 22 bp, Homo sapiens
ttcttcaagtctggtccagctt

SEQ ID NO: 8777532 - DNA, 22 bp, Homo sapiens
ttcttcaataaattcccataag

SEQ ID NO: 8777533 - DNA, 22 bp, Homo sapiens
ttcttcaattttccatatactg

SEQ ID NO: 8777534 - DNA, 22 bp, Homo sapiens
ttcttcaagggtaaaggcaacg

SEQ ID NO: 8777535 - DNA, 22 bp, Homo sapiens
ttcttcaattcccatcccggtc

SEQ ID NO: 8777536 - DNA, 22 bp, Homo sapiens
ttcttcaattattggaaagaaa

SEQ ID NO: 8777537 - DNA, 22 bp, Homo sapiens
ttcttcaatgtgccctgttttc

SEQ ID NO: 8777538 - DNA, 19 bp, Homo sapiens
ttctttggtggtggtgacc

SEQ ID NO: 8777539 - DNA, 22 bp, Homo sapiens
ttcttcaattttccatatactg

SEQ ID NO: 8777540 - DNA, 22 bp, Homo sapiens
ttcttatttcccccttcatcat

SEQ ID NO: 8777541 - DNA, 22 bp, Homo sapiens
ttcttatttcccccttcatcat

SEQ ID NO: 8777542 - DNA, 22 bp, Homo sapiens
ttcttattgggagaccttttct

SEQ ID NO: 8777543 - DNA, 22 bp, Homo sapiens
ttcttattatgtgctctgtgaa

SEQ ID NO: 8777544 - DNA, 22 bp, Homo sapiens
ttcttattatgtgctctgtgaa

SEQ ID NO: 8777545 - DNA, 22 bp, Homo sapiens
ttcttcaaaacaacactggcct

SEQ ID NO: 8777546 - DNA, 22 bp, Homo sapiens
ttcttcaaaacaacactggcct

SEQ ID NO: 8777547 - DNA, 22 bp, Homo sapiens
ttcttcaaaatccagcatgatt

SEQ ID NO: 8777548 - DNA, 22 bp, Homo sapiens
ttcttcaaaatccagcatgatt

SEQ ID NO: 8777549 - DNA, 21 bp, Homo sapiens
ttcttcaaagaagaaggcaca

SEQ ID NO: 8777550 - DNA, 22 bp, Homo sapiens
ttcttcaaacaaaagtggcatg

SEQ ID NO: 8777551 - DNA, 22 bp, Homo sapiens
ttcttcaaagtaatagagacta

SEQ ID NO: 8777552 - DNA, 22 bp, Homo sapiens
ttcttcaaagtaatagagacta

SEQ ID NO: 8777553 - DNA, 22 bp, Homo sapiens
ttcttcaaagatgtctgttgga

SEQ ID NO: 8777554 - DNA, 22 bp, Homo sapiens
ttctttgttgagcaagtaggac

SEQ ID NO: 8777555 - DNA, 22 bp, Homo sapiens
ttctttgttgtactttcctaca

SEQ ID NO: 8777556 - DNA, 22 bp, Homo sapiens
ttctttgttgtactttcctaca

SEQ ID NO: 8777557 - DNA, 22 bp, Homo sapiens
ttctttgttgtactttcctaca

SEQ ID NO: 8777558 - DNA, 22 bp, Homo sapiens
ttctttgtttgataagtatgct

SEQ ID NO: 8777559 - DNA, 22 bp, Homo sapiens
ttctttgtggcagtgagctggg

SEQ ID NO: 8777560 - DNA, 20 bp, Homo sapiens
ttctttgttccttacatttg

SEQ ID NO: 8777561 - DNA, 20 bp, Homo sapiens
ttctttgttccttacatttg

SEQ ID NO: 8777562 - DNA, 22 bp, Homo sapiens
ttctttggtgttacccagctca

SEQ ID NO: 8777563 - DNA, 22 bp, Homo sapiens
ttctttggtgttacccagctca

SEQ ID NO: 8777564 - DNA, 22 bp, Homo sapiens
ttctttgtaaagccacagtcct

SEQ ID NO: 8777565 - DNA, 22 bp, Homo sapiens
ttctttgtaaagccacagtcct

SEQ ID NO: 8777566 - DNA, 22 bp, Homo sapiens
ttctttgtgctgaagaagccct

SEQ ID NO: 8777567 - DNA, 22 bp, Homo sapiens
ttctttgtgcatccaattttct

SEQ ID NO: 8777568 - DNA, 22 bp, Homo sapiens
ttctttgtgcatccaattttct

SEQ ID NO: 8777569 - DNA, 22 bp, Homo sapiens
ttcttttaatgtctggctttca

SEQ ID NO: 8777570 - DNA, 22 bp, Homo sapiens
ttcttttaatgtctggctttca

SEQ ID NO: 8777571 - DNA, 22 bp, Homo sapiens
ttcttttaatgtctggctttca

SEQ ID NO: 8777572 - DNA, 22 bp, Homo sapiens
ttcttttaaaagagagcagaaa

SEQ ID NO: 8777573 - DNA, 22 bp, Homo sapiens
ttcttttaatagagatcctgtg

SEQ ID NO: 8777574 - DNA, 17 bp, Homo sapiens
ttcttttctgagccttg

SEQ ID NO: 8777575 - DNA, 17 bp, Homo sapiens
ttcttttctgagccttg

SEQ ID NO: 8777576 - DNA, 22 bp, Homo sapiens
ttcttttaatgtctggctttca

SEQ ID NO: 8777577 - DNA, 22 bp, Homo sapiens
ttcttttctgcagctggtattt

SEQ ID NO: 8777578 - DNA, 22 bp, Homo sapiens
ttctggagctaaagtccactct

SEQ ID NO: 8777579 - DNA, 22 bp, Homo sapiens
ttctggagccgggcctgggcag

SEQ ID NO: 8777580 - DNA, 22 bp, Homo sapiens
ttctggagccccaagatctgta

SEQ ID NO: 8777581 - DNA, 22 bp, Homo sapiens
ttctggagaggaacagaaaggt

SEQ ID NO: 8777582 - DNA, 22 bp, Homo sapiens
ttctggagattgagaaggcatt

SEQ ID NO: 8777583 - DNA, 22 bp, Homo sapiens
ttctggaattcttgcagccact

SEQ ID NO: 8777584 - DNA, 22 bp, Homo sapiens
ttctggaatgcctgttctaatt

SEQ ID NO: 8777585 - DNA, 22 bp, Homo sapiens
ttctggaatcctcaaaacatga

SEQ ID NO: 8777586 - DNA, 22 bp, Homo sapiens
ttctggagagaagaccagtgtg

SEQ ID NO: 8777587 - DNA, 22 bp, Homo sapiens
ttctggagacccagcaacaggg

SEQ ID NO: 8777588 - DNA, 22 bp, Homo sapiens
ttctggagaatcaccaccaggc

SEQ ID NO: 8777589 - DNA, 22 bp, Homo sapiens
ttctggaacatagcaagaagtt

SEQ ID NO: 8777590 - DNA, 18 bp, Homo sapiens
ttctctggtggatgttat

SEQ ID NO: 8777591 - DNA, 21 bp, Homo sapiens
ttctctggtcaagcacacata

SEQ ID NO: 8777592 - DNA, 22 bp, Homo sapiens
ttctggaaatgcacaactaatt

SEQ ID NO: 8777593 - DNA, 22 bp, Homo sapiens
ttctggaaatgcacaactaatt

SEQ ID NO: 8777594 - DNA, 22 bp, Homo sapiens
ttctggaagtggaatttttgta

SEQ ID NO: 8777595 - DNA, 22 bp, Homo sapiens
ttctggaagtggaatttttgta

SEQ ID NO: 8777596 - DNA, 22 bp, Homo sapiens
ttctggaagttggaaatagcag

SEQ ID NO: 8777597 - DNA, 22 bp, Homo sapiens
ttctggaatatttgacacaatt

SEQ ID NO: 8777598 - DNA, 22 bp, Homo sapiens
ttctggaatactaagttccttt

SEQ ID NO: 8777599 - DNA, 22 bp, Homo sapiens
ttctctgggatctggcaaaagg

SEQ ID NO: 8777600 - DNA, 22 bp, Homo sapiens
ttctctgggatctggcaaaagg

SEQ ID NO: 8777601 - DNA, 22 bp, Homo sapiens
ttctctgggcttttcggatccg

SEQ ID NO: 8777602 - DNA, 22 bp, Homo sapiens
ttctctggggactgtctctatt

SEQ ID NO: 8777603 - DNA, 22 bp, Homo sapiens
ttctctggacagtgaagagagg

SEQ ID NO: 8777604 - DNA, 19 bp, Homo sapiens
ttctctggactagatgctg

SEQ ID NO: 8777605 - DNA, 22 bp, Homo sapiens
ttctctgggacaggaacagttt

SEQ ID NO: 8777606 - DNA, 22 bp, Homo sapiens
ttctctgggttaggggaactat

SEQ ID NO: 8777607 - DNA, 16 bp, Homo sapiens
ttctctggggttgtgc

SEQ ID NO: 8777608 - DNA, 16 bp, Homo sapiens
ttctctggggttgtgc

SEQ ID NO: 8777609 - DNA, 22 bp, Homo sapiens
ttctctggtaaacacatgcgta

SEQ ID NO: 8777610 - DNA, 22 bp, Homo sapiens
ttctctgggttaggggaactat

SEQ ID NO: 8777611 - DNA, 22 bp, Homo sapiens
ttctctggggactgtctctatt

SEQ ID NO: 8777612 - DNA, 22 bp, Homo sapiens
ttctctggggacttggttggag

SEQ ID NO: 8777613 - DNA, 22 bp, Homo sapiens
ttctctggggacttggttggag

SEQ ID NO: 8777614 - DNA, 22 bp, Homo sapiens
ttctctggggttcagtatctct

SEQ ID NO: 8777615 - DNA, 22 bp, Homo sapiens
ttctgtgtcttcttgttctgtg

SEQ ID NO: 8777616 - DNA, 22 bp, Homo sapiens
ttctgtgtcttcttgttctgtg

SEQ ID NO: 8777617 - DNA, 22 bp, Homo sapiens
ttctgtgtcttcttgttctgtg

SEQ ID NO: 8777618 - DNA, 22 bp, Homo sapiens
ttctgtggctgggagcctggct

SEQ ID NO: 8777619 - DNA, 22 bp, Homo sapiens
ttctgtggaatatgaactagca

SEQ ID NO: 8777620 - DNA, 22 bp, Homo sapiens
ttctgtggaggtttggaacatt

SEQ ID NO: 8777621 - DNA, 22 bp, Homo sapiens
ttctgtggtctcccatgtctgt

SEQ ID NO: 8777622 - DNA, 22 bp, Homo sapiens
ttctgtgaatggccatgacaag

SEQ ID NO: 8777623 - DNA, 22 bp, Homo sapiens
ttctgtgactcctcagagattt

SEQ ID NO: 8777624 - DNA, 22 bp, Homo sapiens
ttctgtgaggacttctcaagga

SEQ ID NO: 8777625 - DNA, 22 bp, Homo sapiens
ttctgtgattgacatgtggctt

SEQ ID NO: 8777626 - DNA, 22 bp, Homo sapiens
ttctgtgactcctcagagattt

SEQ ID NO: 8777627 - DNA, 22 bp, Homo sapiens
ttctgtgattagttgtctggct

SEQ ID NO: 8777628 - DNA, 22 bp, Homo sapiens
ttctgtgattcctccagccagc

SEQ ID NO: 8777629 - DNA, 22 bp, Homo sapiens
ttctgtcttctcggttgtttac

SEQ ID NO: 8777630 - DNA, 23 bp, Homo sapiens
ttctgtcttgctgtcagctttct

SEQ ID NO: 8777631 - DNA, 23 bp, Homo sapiens
ttctgtcttgctgtcagctttct

SEQ ID NO: 8777632 - DNA, 23 bp, Homo sapiens
ttctgtcttgctgtcagctttct

SEQ ID NO: 8777633 - DNA, 22 bp, Homo sapiens
ttctgtcttctcggttgtttac

SEQ ID NO: 8777634 - DNA, 22 bp, Homo sapiens
ttctgtcttcccactgaggagc

SEQ ID NO: 8777635 - DNA, 22 bp, Homo sapiens
ttctgtcttcccactgaggagc

SEQ ID NO: 8777636 - DNA, 22 bp, Homo sapiens
ttctgtctctgtgtttacatta

SEQ ID NO: 8777637 - DNA, 22 bp, Homo sapiens
ttctgtctggaaaaggacatag

SEQ ID NO: 8777638 - DNA, 22 bp, Homo sapiens
ttctgtctgatggtgccagaac

SEQ ID NO: 8777639 - DNA, 22 bp, Homo sapiens
ttctgtaagggatttattctga

SEQ ID NO: 8777640 - DNA, 22 bp, Homo sapiens
ttctgtaattctgttagtttca

SEQ ID NO: 8777641 - DNA, 22 bp, Homo sapiens
ttctgtgtgctgtcttggcttt

SEQ ID NO: 8777642 - DNA, 22 bp, Homo sapiens
ttctgtgtgccagagttgtgct

SEQ ID NO: 8777643 - DNA, 22 bp, Homo sapiens
ttctgtgtgctgtcttggcttt

SEQ ID NO: 8777644 - DNA, 22 bp, Homo sapiens
ttctgtgtgccagagttgtgct

SEQ ID NO: 8777645 - DNA, 22 bp, Homo sapiens
ttctgtgtgctgtcttggcttt

SEQ ID NO: 8777646 - DNA, 22 bp, Homo sapiens
ttctgtgtgggtagctcctgtt

SEQ ID NO: 8777647 - DNA, 22 bp, Homo sapiens
ttctgtgtgcttactggtgttc

SEQ ID NO: 8777648 - DNA, 22 bp, Homo sapiens
ttctgtgtgcttactggtgttc

SEQ ID NO: 8777649 - DNA, 22 bp, Homo sapiens
ttctgtgtgggtagctcctgtt

SEQ ID NO: 8777650 - DNA, 22 bp, Homo sapiens
ttctgtgtgggtagctcctgtt

SEQ ID NO: 8777651 - DNA, 22 bp, Homo sapiens
ttctgtgtgtctcagcaagctg

SEQ ID NO: 8777652 - DNA, 22 bp, Homo sapiens
ttctgtgtgtctcagcaagctg

SEQ ID NO: 8777653 - DNA, 22 bp, Homo sapiens
ttctgtgtgtctcagcaagctg

SEQ ID NO: 8777654 - DNA, 19 bp, Homo sapiens
ttctgtgttaattccttta

SEQ ID NO: 8777655 - DNA, 19 bp, Homo sapiens
ttctgtgttaattccttta

SEQ ID NO: 8777656 - DNA, 22 bp, Homo sapiens
ttctgtgttctgtgcaatgagc

SEQ ID NO: 8777657 - DNA, 22 bp, Homo sapiens
ttctgtgttctgtgcaatgagc

SEQ ID NO: 8777658 - DNA, 22 bp, Homo sapiens
ttctgtgttgtgacattctaga

SEQ ID NO: 8777659 - DNA, 22 bp, Homo sapiens
ttctgtgttgtgacattctaga

SEQ ID NO: 8777660 - DNA, 22 bp, Homo sapiens
ttctgttacaagtgaaaaaatg

SEQ ID NO: 8777661 - DNA, 22 bp, Homo sapiens
ttctgttacaagtgaaaaaatg

SEQ ID NO: 8777662 - DNA, 22 bp, Homo sapiens
ttcttagagatggttaaaaata

SEQ ID NO: 8777663 - DNA, 22 bp, Homo sapiens
ttcttagatgattaatgatggg

SEQ ID NO: 8777664 - DNA, 22 bp, Homo sapiens
ttcttagaagaaacatctaaaa

SEQ ID NO: 8777665 - DNA, 20 bp, Homo sapiens
ttcttagtagagcatgtatt

SEQ ID NO: 8777666 - DNA, 22 bp, Homo sapiens
ttcttagatgattaatgatggg

SEQ ID NO: 8777667 - DNA, 22 bp, Homo sapiens
ttcttagtcatctgagccagcc

SEQ ID NO: 8777668 - DNA, 22 bp, Homo sapiens
ttcttagtggtagtcatctttg

SEQ ID NO: 8777669 - DNA, 22 bp, Homo sapiens
ttcttagttcaactaaaattta

SEQ ID NO: 8777670 - DNA, 22 bp, Homo sapiens
tttgacagagctcttagtctct

SEQ ID NO: 8777671 - DNA, 22 bp, Homo sapiens
tttgacagaggttgtggtgtat

SEQ ID NO: 8777672 - DNA, 19 bp, Homo sapiens
tttgacagagtttgagcat

SEQ ID NO: 8777673 - DNA, 22 bp, Homo sapiens
tttgacaccaggagagaaaaca

SEQ ID NO: 8777674 - DNA, 22 bp, Homo sapiens
tttgacaattcatgacatttat

SEQ ID NO: 8777675 - DNA, 22 bp, Homo sapiens
tttgacagaaagttattatttt

SEQ ID NO: 8777676 - DNA, 22 bp, Homo sapiens
tttgacagacatttactacatt

SEQ ID NO: 8777677 - DNA, 22 bp, Homo sapiens
tttgacaacgttgttgtgagga

SEQ ID NO: 8777678 - DNA, 22 bp, Homo sapiens
tttgacaacagcaaatgtcaca

SEQ ID NO: 8777679 - DNA, 22 bp, Homo sapiens
tttgacaaccaggcaggtaaga

SEQ ID NO: 8777680 - DNA, 22 bp, Homo sapiens
tttgacaagagcaaatgttctt

SEQ ID NO: 8777681 - DNA, 22 bp, Homo sapiens
tttgacaagagggcatcttcag

SEQ ID NO: 8777682 - DNA, 22 bp, Homo sapiens
tttgacaacacgttatttgcct

SEQ ID NO: 8777683 - DNA, 22 bp, Homo sapiens
tttgacaaatgtatctgcatta

SEQ ID NO: 8777684 - DNA, 22 bp, Homo sapiens
tttgacaaatgtatctgcatta

SEQ ID NO: 8777685 - DNA, 22 bp, Homo sapiens
tttgacaaatatttattggcac

SEQ ID NO: 8777686 - DNA, 22 bp, Homo sapiens
tttgacaaaggaaaaatgcaca

SEQ ID NO: 8777687 - DNA, 22 bp, Homo sapiens
tttgacaaaggaaaaatgcaca

SEQ ID NO: 8777688 - DNA, 22 bp, Homo sapiens
tttgacaaaggaaaaatgcaca

SEQ ID NO: 8777689 - DNA, 22 bp, Homo sapiens
tttgacaaaggaaaaatgcaca

SEQ ID NO: 8777690 - DNA, 22 bp, Homo sapiens
tttgacaaataggggaataagg

SEQ ID NO: 8777691 - DNA, 22 bp, Homo sapiens
tttgacaaatatttattggcac

SEQ ID NO: 8777692 - DNA, 22 bp, Homo sapiens
tttgaatgagaattattgtcat

SEQ ID NO: 8777693 - DNA, 22 bp, Homo sapiens
tttgaatgttggattgacttag

SEQ ID NO: 8777694 - DNA, 22 bp, Homo sapiens
tttgaatgtgtgagttaacttt

SEQ ID NO: 8777695 - DNA, 22 bp, Homo sapiens
tttgaagagccacagtgaaatt

SEQ ID NO: 8777696 - DNA, 22 bp, Homo sapiens
tttgaaagggttatgagactga

SEQ ID NO: 8777697 - DNA, 22 bp, Homo sapiens
tttgaagataaatatggagaaa

SEQ ID NO: 8777698 - DNA, 22 bp, Homo sapiens
tttgaatgacatgattcaggca

SEQ ID NO: 8777699 - DNA, 22 bp, Homo sapiens
tttgaatatacttcaaacaaag

SEQ ID NO: 8777700 - DNA, 22 bp, Homo sapiens
tttgaatatcacaaactttcaa

SEQ ID NO: 8777701 - DNA, 22 bp, Homo sapiens
tttgaatatcacaaactttcaa

SEQ ID NO: 8777702 - DNA, 22 bp, Homo sapiens
tttgaaaggaattaggatgaca

SEQ ID NO: 8777703 - DNA, 22 bp, Homo sapiens
tttgaaagggacaaagtcactg

SEQ ID NO: 8777704 - DNA, 22 bp, Homo sapiens
tttgaaagggaaataaactcct

SEQ ID NO: 8777705 - DNA, 22 bp, Homo sapiens
tttgaaagggaaataaactcct

SEQ ID NO: 8777706 - DNA, 21 bp, Homo sapiens
tttgaaagctacatctatagc

SEQ ID NO: 8777707 - DNA, 21 bp, Homo sapiens
tttgaaagctacatctatagc

SEQ ID NO: 8777708 - DNA, 21 bp, Homo sapiens
tttgaaagctacatctatagc

SEQ ID NO: 8777709 - DNA, 22 bp, Homo sapiens
tttgaaaggaagttaatacttt

SEQ ID NO: 8777710 - DNA, 22 bp, Homo sapiens
tttgaaaggaagttaatacttt

SEQ ID NO: 8777711 - DNA, 22 bp, Homo sapiens
tttgaaaggaagttaatacttt

SEQ ID NO: 8777712 - DNA, 21 bp, Homo sapiens
tttgaaagccctatgttttca

SEQ ID NO: 8777713 - DNA, 22 bp, Homo sapiens
tttcctctgatgctgacttgga

SEQ ID NO: 8777714 - DNA, 22 bp, Homo sapiens
tttcctctgatgctgacttgga

SEQ ID NO: 8777715 - DNA, 22 bp, Homo sapiens
tttcctctgatgctgacttgga

SEQ ID NO: 8777716 - DNA, 18 bp, Homo sapiens
tttctttctgcctggggc

SEQ ID NO: 8777717 - DNA, 21 bp, Homo sapiens
tttctttctggctctcacagt

SEQ ID NO: 8777718 - DNA, 21 bp, Homo sapiens
tttctttctggctctcacagt

SEQ ID NO: 8777719 - DNA, 21 bp, Homo sapiens
tttctttctggctctcacagt

SEQ ID NO: 8777720 - DNA, 22 bp, Homo sapiens
tttctttgagtctcagtttgct

SEQ ID NO: 8777721 - DNA, 22 bp, Homo sapiens
tttctttgagtctcagtttgct

SEQ ID NO: 8777722 - DNA, 22 bp, Homo sapiens
tttctttgagtctcagtttgct

SEQ ID NO: 8777723 - DNA, 22 bp, Homo sapiens
tttctttgagtctcagtttgct

SEQ ID NO: 8777724 - DNA, 21 bp, Homo sapiens
tttctttctggctctcacagt

SEQ ID NO: 8777725 - DNA, 22 bp, Homo sapiens
tttcttttacagtgtggctatt

SEQ ID NO: 8777726 - DNA, 22 bp, Homo sapiens
tttcttttacagtgtggctatt

SEQ ID NO: 8777727 - DNA, 22 bp, Homo sapiens
tttcttttacagtgtggctatt

SEQ ID NO: 8777728 - DNA, 22 bp, Homo sapiens
tttctttgttgttatcacatca

SEQ ID NO: 8777729 - DNA, 22 bp, Homo sapiens
tttctttgtagtagcataatca

SEQ ID NO: 8777730 - DNA, 22 bp, Homo sapiens
tttctttgttgttatcacatca

SEQ ID NO: 8777731 - DNA, 22 bp, Homo sapiens
tttctttgttgttatcacatca

SEQ ID NO: 8777732 - DNA, 22 bp, Homo sapiens
tttcttttccaatatccctact

SEQ ID NO: 8777733 - DNA, 22 bp, Homo sapiens
tttcttttccaatatccctact

SEQ ID NO: 8777734 - DNA, 22 bp, Homo sapiens
tttcttttccaatatccctact

SEQ ID NO: 8777735 - DNA, 19 bp, Homo sapiens
tttcttttcccctcagcac

SEQ ID NO: 8777736 - DNA, 22 bp, Homo sapiens
tttcttttccaatatccctact

SEQ ID NO: 8777737 - DNA, 22 bp, Homo sapiens
tttcttttccaatatccctact

SEQ ID NO: 8777738 - DNA, 19 bp, Homo sapiens
tttcttttcccctcagcac

SEQ ID NO: 8777739 - DNA, 19 bp, Homo sapiens
tttcttttcccctcagcac

SEQ ID NO: 8777740 - DNA, 19 bp, Homo sapiens
tttcttttcccctcagcac

SEQ ID NO: 8777741 - DNA, 19 bp, Homo sapiens
tttcttttcccctcagcac

SEQ ID NO: 8777742 - DNA, 22 bp, Homo sapiens
tttcttttgaatagtgtgtggt

SEQ ID NO: 8777743 - DNA, 22 bp, Homo sapiens
tttcttttgaatagtgtgtggt

SEQ ID NO: 8777744 - DNA, 22 bp, Homo sapiens
tttcttttgccctgtgggttag

SEQ ID NO: 8777745 - DNA, 22 bp, Homo sapiens
tttcttttgctgagaggggcac

SEQ ID NO: 8777746 - DNA, 22 bp, Homo sapiens
tttgaaaaaggcctttggtatg

SEQ ID NO: 8777747 - DNA, 22 bp, Homo sapiens
tttcttttgctgagaggggcac

SEQ ID NO: 8777748 - DNA, 22 bp, Homo sapiens
tttcttttgctgagaggggcac

SEQ ID NO: 8777749 - DNA, 22 bp, Homo sapiens
tttcttttgaatagtgtgtggt

SEQ ID NO: 8777750 - DNA, 22 bp, Homo sapiens
tttcttttgaatagtgtgtggt

SEQ ID NO: 8777751 - DNA, 22 bp, Homo sapiens
tttcttttgccctgtgggttag

SEQ ID NO: 8777752 - DNA, 22 bp, Homo sapiens
tttcttttgccctgtgggttag

SEQ ID NO: 8777753 - DNA, 22 bp, Homo sapiens
tttccctttagcctgagaatcc

SEQ ID NO: 8777754 - DNA, 22 bp, Homo sapiens
tttccgacagaagctgggcgct

SEQ ID NO: 8777755 - DNA, 22 bp, Homo sapiens
tttccgcacggaaactgcgtat

SEQ ID NO: 8777756 - DNA, 22 bp, Homo sapiens
tttcccttctttcctgagtaat

SEQ ID NO: 8777757 - DNA, 22 bp, Homo sapiens
tttcccttgttccttcctctga

SEQ ID NO: 8777758 - DNA, 22 bp, Homo sapiens
tttccctgaggcctggacatta

SEQ ID NO: 8777759 - DNA, 22 bp, Homo sapiens
tttccctctgtgccagcttctc

SEQ ID NO: 8777760 - DNA, 22 bp, Homo sapiens
tttccctctgtgccagcttctc

SEQ ID NO: 8777761 - DNA, 22 bp, Homo sapiens
tttccctacttgtaactggaaa

SEQ ID NO: 8777762 - DNA, 21 bp, Homo sapiens
tttccctcattgtgttggcac

SEQ ID NO: 8777763 - DNA, 22 bp, Homo sapiens
tttccctctcatctctattatt

SEQ ID NO: 8777764 - DNA, 22 bp, Homo sapiens
tttccctctcatctctattatt

SEQ ID NO: 8777765 - DNA, 17 bp, Homo sapiens
tttccctccttccactc

SEQ ID NO: 8777766 - DNA, 22 bp, Homo sapiens
tttcctctgactgctcccctgc

SEQ ID NO: 8777767 - DNA, 22 bp, Homo sapiens
tttcctctgactgctcccctgc

SEQ ID NO: 8777768 - DNA, 22 bp, Homo sapiens
tttcctctgagtgagctgggag

SEQ ID NO: 8777769 - DNA, 22 bp, Homo sapiens
tttcctctgagtgagctgggag

SEQ ID NO: 8777770 - DNA, 22 bp, Homo sapiens
tttcctctccaccaggaggtct

SEQ ID NO: 8777771 - DNA, 22 bp, Homo sapiens
tttcctctccggggcctccagg

SEQ ID NO: 8777772 - DNA, 22 bp, Homo sapiens
tttcctctccggggcctccagg

SEQ ID NO: 8777773 - DNA, 22 bp, Homo sapiens
tttcctctaaacgcatttgctt

SEQ ID NO: 8777774 - DNA, 22 bp, Homo sapiens
tttcctctaaacgcatttgctt

SEQ ID NO: 8777775 - DNA, 22 bp, Homo sapiens
tttcctctaaacgcatttgctt

SEQ ID NO: 8777776 - DNA, 22 bp, Homo sapiens
tttcctctaaacgcatttgctt

SEQ ID NO: 8777777 - DNA, 22 bp, Homo sapiens
tttcctcctagcctccagccgc

SEQ ID NO: 8777778 - DNA, 22 bp, Homo sapiens
tttcctcctagcctccagccgc

SEQ ID NO: 8777779 - DNA, 22 bp, Homo sapiens
tttcctcatttatctgctggga

SEQ ID NO: 8777780 - DNA, 22 bp, Homo sapiens
tttcctcagaagtgtctactat

SEQ ID NO: 8777781 - DNA, 22 bp, Homo sapiens
tttcctcacttcatgagagttt

SEQ ID NO: 8777782 - DNA, 22 bp, Homo sapiens
tttcctcagaagtgtctactat

SEQ ID NO: 8777783 - DNA, 22 bp, Homo sapiens
tttggaaattactcattgtcct

SEQ ID NO: 8777784 - DNA, 22 bp, Homo sapiens
tttggaaataattccatctcat

SEQ ID NO: 8777785 - DNA, 22 bp, Homo sapiens
tttggaaatgaccccgtctaag

SEQ ID NO: 8777786 - DNA, 22 bp, Homo sapiens
tttggaaatacgcgtaggcaga

SEQ ID NO: 8777787 - DNA, 22 bp, Homo sapiens
tttggaaatacgcgtaggcaga

SEQ ID NO: 8777788 - DNA, 22 bp, Homo sapiens
tttggaaagtgtgatttcaagg

SEQ ID NO: 8777789 - DNA, 22 bp, Homo sapiens
tttggaaagttgtcactttaga

SEQ ID NO: 8777790 - DNA, 17 bp, Homo sapiens
tttggaaagtgatcatt

SEQ ID NO: 8777791 - DNA, 22 bp, Homo sapiens
tttgcttttgtgctctagtggt

SEQ ID NO: 8777792 - DNA, 22 bp, Homo sapiens
tttgctttgtttaaaagtggta

SEQ ID NO: 8777793 - DNA, 22 bp, Homo sapiens
tttgctttgtttaaaagtggta

SEQ ID NO: 8777794 - DNA, 22 bp, Homo sapiens
tttgcttttgtgctctagtggt

SEQ ID NO: 8777795 - DNA, 22 bp, Homo sapiens
tttggaaaatattgaactggtt

SEQ ID NO: 8777796 - DNA, 22 bp, Homo sapiens
tttggaaaatattgaactggtt

SEQ ID NO: 8777797 - DNA, 22 bp, Homo sapiens
tttggaaacatctcagaaaata

SEQ ID NO: 8777798 - DNA, 22 bp, Homo sapiens
tttggaaactgatggtacattc

SEQ ID NO: 8777799 - DNA, 22 bp, Homo sapiens
tttggaaactgcctcagctctt

SEQ ID NO: 8777800 - DNA, 22 bp, Homo sapiens
tttggttcttatctttggagat

SEQ ID NO: 8777801 - DNA, 22 bp, Homo sapiens
tttggttgtatcattctatgaa

SEQ ID NO: 8777802 - DNA, 22 bp, Homo sapiens
tttggtttgaatgagcataaga

SEQ ID NO: 8777803 - DNA, 22 bp, Homo sapiens
tttggtttagggtcatttaaca

SEQ ID NO: 8777804 - DNA, 22 bp, Homo sapiens
tttggtttgaatgagcataaga

SEQ ID NO: 8777805 - DNA, 22 bp, Homo sapiens
tttggtttattaaattgtaggc

SEQ ID NO: 8777806 - DNA, 22 bp, Homo sapiens
tttggtttgcctgagtaccctc

SEQ ID NO: 8777807 - DNA, 22 bp, Homo sapiens
tttgtaaaagcccaagctgtag

SEQ ID NO: 8777808 - DNA, 22 bp, Homo sapiens
tttgtaaaagcccaagctgtag

SEQ ID NO: 8777809 - DNA, 22 bp, Homo sapiens
tttgtaaaagcccaagctgtag

SEQ ID NO: 8777810 - DNA, 22 bp, Homo sapiens
tttggtttttacctgctgagag

SEQ ID NO: 8777811 - DNA, 22 bp, Homo sapiens
tttggtttttaatacaaagtac

SEQ ID NO: 8777812 - DNA, 22 bp, Homo sapiens
tttggtccaagttttactcttt

SEQ ID NO: 8777813 - DNA, 22 bp, Homo sapiens
tttggtcatttgcactgccaat

SEQ ID NO: 8777814 - DNA, 22 bp, Homo sapiens
tttggtattgcacactgtcttc

SEQ ID NO: 8777815 - DNA, 22 bp, Homo sapiens
tttggaaattttcatccagaca

SEQ ID NO: 8777816 - DNA, 22 bp, Homo sapiens
tttggaaatttcatcaatagcc

SEQ ID NO: 8777817 - DNA, 22 bp, Homo sapiens
tttgattgtcacctaccttgca

SEQ ID NO: 8777818 - DNA, 22 bp, Homo sapiens
tttgattctggcctctgagaag

SEQ ID NO: 8777819 - DNA, 22 bp, Homo sapiens
tttgattcaatgtttatataaa

SEQ ID NO: 8777820 - DNA, 22 bp, Homo sapiens
tttgattcaatgtttatataaa

SEQ ID NO: 8777821 - DNA, 22 bp, Homo sapiens
tttgatgatgatgataaagttt

SEQ ID NO: 8777822 - DNA, 22 bp, Homo sapiens
tttgatgctaagatttaataaa

SEQ ID NO: 8777823 - DNA, 19 bp, Homo sapiens
tttgatgagaatttaagca

SEQ ID NO: 8777824 - DNA, 22 bp, Homo sapiens
tttgatgaacctatataatttg

SEQ ID NO: 8777825 - DNA, 22 bp, Homo sapiens
tttgatgacttcagatctttgt

SEQ ID NO: 8777826 - DNA, 22 bp, Homo sapiens
tttgatgacctgtatctttttc

SEQ ID NO: 8777827 - DNA, 22 bp, Homo sapiens
tttgctttcttgattcagatta

SEQ ID NO: 8777828 - DNA, 22 bp, Homo sapiens
tttgctttgactgtcagcaagt

SEQ ID NO: 8777829 - DNA, 22 bp, Homo sapiens
tttgctttcttgattcagatta

SEQ ID NO: 8777830 - DNA, 22 bp, Homo sapiens
tttgctttgggaggttgtctgg

SEQ ID NO: 8777831 - DNA, 22 bp, Homo sapiens
tttgctttgggaggttgtctgg

SEQ ID NO: 8777832 - DNA, 22 bp, Homo sapiens
tttgctttgactgtcagcaagt

SEQ ID NO: 8777833 - DNA, 22 bp, Homo sapiens
tttgctttgactgtcagcaagt

SEQ ID NO: 8777834 - DNA, 22 bp, Homo sapiens
tttgctttgactgtcagcaagt

SEQ ID NO: 8777835 - DNA, 22 bp, Homo sapiens
tttgatttactggatattctca

SEQ ID NO: 8777836 - DNA, 22 bp, Homo sapiens
tttgatttactggatattctca

SEQ ID NO: 8777837 - DNA, 22 bp, Homo sapiens
tttgatttactggatattctca

SEQ ID NO: 8777838 - DNA, 22 bp, Homo sapiens
tttgctttcccttgtagaaagt

SEQ ID NO: 8777839 - DNA, 22 bp, Homo sapiens
tttgctttcccttgtagaaagt

SEQ ID NO: 8777840 - DNA, 22 bp, Homo sapiens
tttgcttgttcaagatttctgt

SEQ ID NO: 8777841 - DNA, 22 bp, Homo sapiens
tttgctttctgttgaacagagt

SEQ ID NO: 8777842 - DNA, 22 bp, Homo sapiens
tttgctttctgttgaacagagt

SEQ ID NO: 8777843 - DNA, 18 bp, Homo sapiens
tttgctttccttcttcag

SEQ ID NO: 8777844 - DNA, 18 bp, Homo sapiens
tttgctttccttcttcag

SEQ ID NO: 8777845 - DNA, 18 bp, Homo sapiens
tttgctttccttcttcag

SEQ ID NO: 8777846 - DNA, 18 bp, Homo sapiens
tttgctttccttcttcag

SEQ ID NO: 8777847 - DNA, 22 bp, Homo sapiens
tttgaggttagctagcagatca

SEQ ID NO: 8777848 - DNA, 22 bp, Homo sapiens
tttgagtaggcttatattttgg

SEQ ID NO: 8777849 - DNA, 22 bp, Homo sapiens
tttgaggttagctagcagatca

SEQ ID NO: 8777850 - DNA, 22 bp, Homo sapiens
tttgataagagctgctgaaact

SEQ ID NO: 8777851 - DNA, 22 bp, Homo sapiens
tttgataatacacaagagaaag

SEQ ID NO: 8777852 - DNA, 22 bp, Homo sapiens
tttgataacagtgaatatcatg

SEQ ID NO: 8777853 - DNA, 22 bp, Homo sapiens
tttgagtgcccatgtttcccag

SEQ ID NO: 8777854 - DNA, 22 bp, Homo sapiens
tttgatatgcaaaattatggac

SEQ ID NO: 8777855 - DNA, 22 bp, Homo sapiens
tttgatcagcaagataaataga

SEQ ID NO: 8777856 - DNA, 19 bp, Homo sapiens
tttgatatctgaattatgc

SEQ ID NO: 8777857 - DNA, 19 bp, Homo sapiens
tttgatatctgaattatgc

SEQ ID NO: 8777858 - DNA, 22 bp, Homo sapiens
tttgatctatgcgtggtttccc

SEQ ID NO: 8777859 - DNA, 22 bp, Homo sapiens
tttgatcatgaagaggataaac

SEQ ID NO: 8777860 - DNA, 22 bp, Homo sapiens
tttgatccagggcttacacata

SEQ ID NO: 8777861 - DNA, 22 bp, Homo sapiens
tttgatccgttgctggtgagga

SEQ ID NO: 8777862 - DNA, 22 bp, Homo sapiens
tttgatatcctatacaagtaaa

SEQ ID NO: 8777863 - DNA, 22 bp, Homo sapiens
tttgatatcctatacaagtaaa

SEQ ID NO: 8777864 - DNA, 19 bp, Homo sapiens
tttgatagggcataatata

SEQ ID NO: 8777865 - DNA, 17 bp, Homo sapiens
tttgatagaatcagagt

SEQ ID NO: 8777866 - DNA, 22 bp, Homo sapiens
tttgatagggaagtaagaatga

SEQ ID NO: 8777867 - DNA, 22 bp, Homo sapiens
tttgtaaagtctgttctgagtt

SEQ ID NO: 8777868 - DNA, 22 bp, Homo sapiens
tttgtaaatagcagtactcatg

SEQ ID NO: 8777869 - DNA, 22 bp, Homo sapiens
tttgtaaatagcagtactcatg

SEQ ID NO: 8777870 - DNA, 22 bp, Homo sapiens
tttgtaaaggcctgaatttcag

SEQ ID NO: 8777871 - DNA, 22 bp, Homo sapiens
tttgtaaaggcctgaatttcag

SEQ ID NO: 8777872 - DNA, 22 bp, Homo sapiens
tttgtaaaggcctgaatttcag

SEQ ID NO: 8777873 - DNA, 22 bp, Homo sapiens
tttgtaaaggcctgaatttcag

SEQ ID NO: 8777874 - DNA, 22 bp, Homo sapiens
tttgtaaatagcagtactcatg

SEQ ID NO: 8777875 - DNA, 22 bp, Homo sapiens
tttgtaaatagcagtactcatg

SEQ ID NO: 8777876 - DNA, 22 bp, Homo sapiens
tttgtaacaagttgatctggta

SEQ ID NO: 8777877 - DNA, 22 bp, Homo sapiens
tttgtaaatagcagtactcatg

SEQ ID NO: 8777878 - DNA, 22 bp, Homo sapiens
tttgtaaaaggaggaagcatgg

SEQ ID NO: 8777879 - DNA, 22 bp, Homo sapiens
tttgtaaaaggaggaagcatgg

SEQ ID NO: 8777880 - DNA, 22 bp, Homo sapiens
tttgtaaaaggaggaagcatgg

SEQ ID NO: 8777881 - DNA, 22 bp, Homo sapiens
tttgtaaaaggaggaagcatgg

SEQ ID NO: 8777882 - DNA, 22 bp, Homo sapiens
tttgtaaaaggaggaagcatgg

SEQ ID NO: 8777883 - DNA, 22 bp, Homo sapiens
tttgtaaaaggaggaagcatgg

SEQ ID NO: 8777884 - DNA, 22 bp, Homo sapiens
tttgtaaaattagggaattcaa

SEQ ID NO: 8777885 - DNA, 22 bp, Homo sapiens
tttgtaaaattagggaattcaa

SEQ ID NO: 8777886 - DNA, 22 bp, Homo sapiens
tttgtaaaaggaggaagcatgg

SEQ ID NO: 8777887 - DNA, 22 bp, Homo sapiens
tttgtaaaggcctgaatttcag

SEQ ID NO: 8777888 - DNA, 22 bp, Homo sapiens
tttgtaaaggcctgaatttcag

SEQ ID NO: 8777889 - DNA, 22 bp, Homo sapiens
tttgtaaaggcctgaatttcag

SEQ ID NO: 8777890 - DNA, 22 bp, Homo sapiens
tttgtaaaggcctgaatttcag

SEQ ID NO: 8777891 - DNA, 22 bp, Homo sapiens
tttgtaaaattagggaattcaa

SEQ ID NO: 8777892 - DNA, 22 bp, Homo sapiens
tttgtaaaggcctgaatttcag

SEQ ID NO: 8777893 - DNA, 22 bp, Homo sapiens
tttgtaaggctaaataatattc

SEQ ID NO: 8777894 - DNA, 22 bp, Homo sapiens
tttgtaagcagtgtttttacag

SEQ ID NO: 8777895 - DNA, 22 bp, Homo sapiens
tttgtaaggaatattcttggtg

SEQ ID NO: 8777896 - DNA, 22 bp, Homo sapiens
tttgtaagtggtagatctaaga

SEQ ID NO: 8777897 - DNA, 22 bp, Homo sapiens
tttgtgtgcgtctggcctgggg

SEQ ID NO: 8777898 - DNA, 22 bp, Homo sapiens
tttgtgtgcgtctggcctgggg

SEQ ID NO: 8777899 - DNA, 22 bp, Homo sapiens
tttgtgtgcaacgcatggagtc

SEQ ID NO: 8777900 - DNA, 22 bp, Homo sapiens
tttgtgtgaaaatatttaagtt

SEQ ID NO: 8777901 - DNA, 22 bp, Homo sapiens
tttgtgtgcaacgcatggagtc

SEQ ID NO: 8777902 - DNA, 22 bp, Homo sapiens
tttgtaagagcatatgtaaagg

SEQ ID NO: 8777903 - DNA, 22 bp, Homo sapiens
tttgtaagagcatatgtaaagg

SEQ ID NO: 8777904 - DNA, 22 bp, Homo sapiens
tttgtaagcaaaaagtccattc

SEQ ID NO: 8777905 - DNA, 22 bp, Homo sapiens
tttgtaagcaagttaacatttt

SEQ ID NO: 8777906 - DNA, 22 bp, Homo sapiens
tttgtaacattatggactgctt

SEQ ID NO: 8777907 - DNA, 22 bp, Homo sapiens
tttgtaacctaaagcaccagat

SEQ ID NO: 8777908 - DNA, 22 bp, Homo sapiens
tttgtaactgagtgctcagagc

SEQ ID NO: 8777909 - DNA, 22 bp, Homo sapiens
tttgtaactttagaattgatcc

SEQ ID NO: 8777910 - DNA, 22 bp, Homo sapiens
tttgtaactttagaattgatcc

SEQ ID NO: 8777911 - DNA, 22 bp, Homo sapiens
tttgtaagaactataaattgct

SEQ ID NO: 8777912 - DNA, 22 bp, Homo sapiens
tttgtgtgtatatccttccaga

SEQ ID NO: 8777913 - DNA, 22 bp, Homo sapiens
tttgtgtgtatatgtatataga

SEQ ID NO: 8777914 - DNA, 21 bp, Homo sapiens
tttgtgtgtcacgtgcacagg

SEQ ID NO: 8777915 - DNA, 22 bp, Homo sapiens
tttgtgtgcttggtattgaaga

SEQ ID NO: 8777916 - DNA, 22 bp, Homo sapiens
tttgtgtggatggaaggcagta

SEQ ID NO: 8777917 - DNA, 22 bp, Homo sapiens
tttgtgtggtggatactgggta

SEQ ID NO: 8777918 - DNA, 22 bp, Homo sapiens
tttgtgtggtggatactgggta

SEQ ID NO: 8777919 - DNA, 22 bp, Homo sapiens
tttgttataacaataaaaagtc

SEQ ID NO: 8777920 - DNA, 22 bp, Homo sapiens
tttgttcaacatcacttccacc

SEQ ID NO: 8777921 - DNA, 22 bp, Homo sapiens
tttgttaaggagtattgcttct

SEQ ID NO: 8777922 - DNA, 22 bp, Homo sapiens
tttgttaaggagtattgcttct

SEQ ID NO: 8777923 - DNA, 22 bp, Homo sapiens
tttgttaaatatttattgagtg

SEQ ID NO: 8777924 - DNA, 22 bp, Homo sapiens
tttgttacaaagaaagaagagc

SEQ ID NO: 8777925 - DNA, 22 bp, Homo sapiens
tttgttacattaaaaagtaggt

SEQ ID NO: 8777926 - DNA, 22 bp, Homo sapiens
tttgttaattcttatgttagag

SEQ ID NO: 8777927 - DNA, 22 bp, Homo sapiens
tttgtgttgttttaagccacta

SEQ ID NO: 8777928 - DNA, 22 bp, Homo sapiens
tttgtgtttgtacaatgcacta

SEQ ID NO: 8777929 - DNA, 22 bp, Homo sapiens
tttgtgtttatgaagttattct

SEQ ID NO: 8777930 - DNA, 22 bp, Homo sapiens
tttgtgttgtacttctgtgcat

SEQ ID NO: 8777931 - DNA, 22 bp, Homo sapiens
tttgtgttgtacttctgtgcat

SEQ ID NO: 8777932 - DNA, 22 bp, Homo sapiens
tttgtgttaaatgttaaattca

SEQ ID NO: 8777933 - DNA, 22 bp, Homo sapiens
tttgttaaaatgcagattctgt

SEQ ID NO: 8777934 - DNA, 22 bp, Homo sapiens
tttgttaaaatgcagattctgt

SEQ ID NO: 8777935 - DNA, 22 bp, Homo sapiens
tttgttaaaatgcagattctgt

SEQ ID NO: 8777936 - DNA, 22 bp, Homo sapiens
tttgtgttttcactagcagtgt

SEQ ID NO: 8777937 - DNA, 22 bp, Homo sapiens
tttgtgttttcccatactattg

SEQ ID NO: 8777938 - DNA, 22 bp, Homo sapiens
ttttaagaaatgtatgactgtc

SEQ ID NO: 8777939 - DNA, 22 bp, Homo sapiens
ttttaagaaatgtatgactgtc

SEQ ID NO: 8777940 - DNA, 22 bp, Homo sapiens
ttttaacttaaaatacatagat

SEQ ID NO: 8777941 - DNA, 22 bp, Homo sapiens
ttttaacttaaaatacatagat

SEQ ID NO: 8777942 - DNA, 21 bp, Homo sapiens
ttttaacaaggatttccctag

SEQ ID NO: 8777943 - DNA, 21 bp, Homo sapiens
ttttaacaaggatttccctag

SEQ ID NO: 8777944 - DNA, 22 bp, Homo sapiens
ttttaacactcagcactatctc

SEQ ID NO: 8777945 - DNA, 22 bp, Homo sapiens
ttttaacactcagcactatctc

SEQ ID NO: 8777946 - DNA, 22 bp, Homo sapiens
ttttaacactcagcactatctc

SEQ ID NO: 8777947 - DNA, 22 bp, Homo sapiens
ttttaaaggctgtatgaccaag

SEQ ID NO: 8777948 - DNA, 22 bp, Homo sapiens
ttttaaaggctgtatgaccaag

SEQ ID NO: 8777949 - DNA, 22 bp, Homo sapiens
ttttaaaggctgtatgaccaag

SEQ ID NO: 8777950 - DNA, 22 bp, Homo sapiens
ttttaaatctccagttgacccc

SEQ ID NO: 8777951 - DNA, 22 bp, Homo sapiens
ttttaaatctccagttgacccc

SEQ ID NO: 8777952 - DNA, 22 bp, Homo sapiens
ttttaaatctccagttgacccc

SEQ ID NO: 8777953 - DNA, 22 bp, Homo sapiens
ttttaaatctccagttgacccc

SEQ ID NO: 8777954 - DNA, 22 bp, Homo sapiens
ttttaaatctccagttgacccc

SEQ ID NO: 8777955 - DNA, 22 bp, Homo sapiens
ttttaaaggatactcttgtcta

SEQ ID NO: 8777956 - DNA, 22 bp, Homo sapiens
ttttaaaggatactcttgtcta

SEQ ID NO: 8777957 - DNA, 22 bp, Homo sapiens
ttttaaagagatgctgtgcata

SEQ ID NO: 8777958 - DNA, 22 bp, Homo sapiens
ttttaaagagatgctgtgcata

SEQ ID NO: 8777959 - DNA, 22 bp, Homo sapiens
ttttaaagagatgctgtgcata

SEQ ID NO: 8777960 - DNA, 22 bp, Homo sapiens
ttttaaaggatagctctggttg

SEQ ID NO: 8777961 - DNA, 22 bp, Homo sapiens
ttttaaaggatagctctggttg

SEQ ID NO: 8777962 - DNA, 22 bp, Homo sapiens
ttttaaaggcagattatggctt

SEQ ID NO: 8777963 - DNA, 22 bp, Homo sapiens
ttttaaactgcagaatttagaa

SEQ ID NO: 8777964 - DNA, 22 bp, Homo sapiens
ttttaaactgcagaatttagaa

SEQ ID NO: 8777965 - DNA, 22 bp, Homo sapiens
ttttaaactgcagaatttagaa

SEQ ID NO: 8777966 - DNA, 22 bp, Homo sapiens
ttttaaactgcagaatttagaa

SEQ ID NO: 8777967 - DNA, 21 bp, Homo sapiens
ttttatgcataggaaatatat

SEQ ID NO: 8777968 - DNA, 22 bp, Homo sapiens
ttttatgcaagttatgattaaa

SEQ ID NO: 8777969 - DNA, 22 bp, Homo sapiens
ttttaattgcaattatggtccc

SEQ ID NO: 8777970 - DNA, 22 bp, Homo sapiens
ttttatgtcataaggacactca

SEQ ID NO: 8777971 - DNA, 22 bp, Homo sapiens
ttttatgtgtcaaagcagtggt

SEQ ID NO: 8777972 - DNA, 22 bp, Homo sapiens
ttttatgtaatccttactgtcg

SEQ ID NO: 8777973 - DNA, 22 bp, Homo sapiens
ttttatgtaatccttactgtcg

SEQ ID NO: 8777974 - DNA, 22 bp, Homo sapiens
ttttatgtaataaactgtacac

SEQ ID NO: 8777975 - DNA, 22 bp, Homo sapiens
ttttaatgggcgactattatgg

SEQ ID NO: 8777976 - DNA, 22 bp, Homo sapiens
ttttaatgggcgactattatgg

SEQ ID NO: 8777977 - DNA, 22 bp, Homo sapiens
ttttaagaaatgtatgactgtc

SEQ ID NO: 8777978 - DNA, 22 bp, Homo sapiens
ttttaagaaatgtatgactgtc

SEQ ID NO: 8777979 - DNA, 22 bp, Homo sapiens
ttttaattcaaagtgaatagtg

SEQ ID NO: 8777980 - DNA, 22 bp, Homo sapiens
ttttaattcaaagtgaatagtg

SEQ ID NO: 8777981 - DNA, 22 bp, Homo sapiens
ttttaatgtgctctgcaatgat

SEQ ID NO: 8777982 - DNA, 22 bp, Homo sapiens
ttttaatgtgctctgcaatgat

SEQ ID NO: 8777983 - DNA, 22 bp, Homo sapiens
ttttaatgggcgactattatgg

SEQ ID NO: 8777984 - DNA, 22 bp, Homo sapiens
ttttcatagtaatggtgcatgt

SEQ ID NO: 8777985 - DNA, 22 bp, Homo sapiens
ttttcatgaggaaatactgccc

SEQ ID NO: 8777986 - DNA, 22 bp, Homo sapiens
ttttcatctctgctttgtacct

SEQ ID NO: 8777987 - DNA, 22 bp, Homo sapiens
ttttcatgtcatgtccttgagg

SEQ ID NO: 8777988 - DNA, 22 bp, Homo sapiens
ttttcatggccaccgcaagtga

SEQ ID NO: 8777989 - DNA, 22 bp, Homo sapiens
ttttcagtttgcactgcagtgc

SEQ ID NO: 8777990 - DNA, 22 bp, Homo sapiens
ttttattggagtgataccaagc

SEQ ID NO: 8777991 - DNA, 22 bp, Homo sapiens
ttttattggagtgataccaagc

SEQ ID NO: 8777992 - DNA, 22 bp, Homo sapiens
ttttcacacaaggtgataagtt

SEQ ID NO: 8777993 - DNA, 22 bp, Homo sapiens
ttttcattgtaaatcaggaaac

SEQ ID NO: 8777994 - DNA, 22 bp, Homo sapiens
ttttcattgtaaatcaggaaac

SEQ ID NO: 8777995 - DNA, 22 bp, Homo sapiens
ttttcattgttactatgagcta

SEQ ID NO: 8777996 - DNA, 22 bp, Homo sapiens
ttttcattgttactatgagcta

SEQ ID NO: 8777997 - DNA, 22 bp, Homo sapiens
ttttcattgttcctcgagcatt

SEQ ID NO: 8777998 - DNA, 22 bp, Homo sapiens
ttttcattgttcctcgagcatt

SEQ ID NO: 8777999 - DNA, 22 bp, Homo sapiens
ttttcattgttcctcgagcatt

SEQ ID NO: 8778000 - DNA, 22 bp, Homo sapiens
ttttcattgttactatgagcta

SEQ ID NO: 8778001 - DNA, 22 bp, Homo sapiens
ttttcattgttcctcgagcatt

SEQ ID NO: 8778002 - DNA, 22 bp, Homo sapiens
ttttcattagaatgactgagaa

SEQ ID NO: 8778003 - DNA, 22 bp, Homo sapiens
ttttcattagaatgactgagaa

SEQ ID NO: 8778004 - DNA, 22 bp, Homo sapiens
ttttcatgttccttgttaagtg

SEQ ID NO: 8778005 - DNA, 22 bp, Homo sapiens
ttttcatgttccttgttaagtg

SEQ ID NO: 8778006 - DNA, 22 bp, Homo sapiens
ttttcatgtgatgtgacatttc

SEQ ID NO: 8778007 - DNA, 22 bp, Homo sapiens
ttttcattgagcacctgagtaa

SEQ ID NO: 8778008 - DNA, 22 bp, Homo sapiens
ttttcattgagcacctgagtaa

SEQ ID NO: 8778009 - DNA, 22 bp, Homo sapiens
ttttcattagaatgactgagaa

SEQ ID NO: 8778010 - DNA, 22 bp, Homo sapiens
ttttcattgtaaatcaggaaac

SEQ ID NO: 8778011 - DNA, 21 bp, Homo sapiens
ttttattgatgaatggccact

SEQ ID NO: 8778012 - DNA, 22 bp, Homo sapiens
ttttattatctttgaatgggac

SEQ ID NO: 8778013 - DNA, 22 bp, Homo sapiens
ttttattggagtgataccaagc

SEQ ID NO: 8778014 - DNA, 22 bp, Homo sapiens
ttttattggagtgataccaagc

SEQ ID NO: 8778015 - DNA, 22 bp, Homo sapiens
ttttattggagtgataccaagc

SEQ ID NO: 8778016 - DNA, 22 bp, Homo sapiens
ttttattggagtgataccaagc

SEQ ID NO: 8778017 - DNA, 22 bp, Homo sapiens
ttttattgcaataaagtgtgta

SEQ ID NO: 8778018 - DNA, 22 bp, Homo sapiens
ttttattgcaataaagtgtgta

SEQ ID NO: 8778019 - DNA, 22 bp, Homo sapiens
ttttatgttcctgaagctatct

SEQ ID NO: 8778020 - DNA, 22 bp, Homo sapiens
ttttatgttcctgaagctatct

SEQ ID NO: 8778021 - DNA, 22 bp, Homo sapiens
ttttatgttgctataataggta

SEQ ID NO: 8778022 - DNA, 22 bp, Homo sapiens
ttttatgtgtgaaatgctgtct

SEQ ID NO: 8778023 - DNA, 22 bp, Homo sapiens
ttttatgtgtcaaagcagtggt

SEQ ID NO: 8778024 - DNA, 22 bp, Homo sapiens
ttttatgtgtcaaagcagtggt

SEQ ID NO: 8778025 - DNA, 22 bp, Homo sapiens
ttttatgttcctctttatgcga

SEQ ID NO: 8778026 - DNA, 22 bp, Homo sapiens
ttttatgttcctctttatgcga

SEQ ID NO: 8778027 - DNA, 22 bp, Homo sapiens
ttttatgttcctctttatgcga

SEQ ID NO: 8778028 - DNA, 22 bp, Homo sapiens
ttttctcttgttaatgtactga

SEQ ID NO: 8778029 - DNA, 22 bp, Homo sapiens
ttttctcttgttaatgtactga

SEQ ID NO: 8778030 - DNA, 22 bp, Homo sapiens
ttttctgaagtttaagacattt

SEQ ID NO: 8778031 - DNA, 19 bp, Homo sapiens
ttttctcagcttctagcgg

SEQ ID NO: 8778032 - DNA, 19 bp, Homo sapiens
ttttctcagcttctagcgg

SEQ ID NO: 8778033 - DNA, 22 bp, Homo sapiens
ttttctcttccctctggacctg

SEQ ID NO: 8778034 - DNA, 22 bp, Homo sapiens
ttttctcttgttaatgtactga

SEQ ID NO: 8778035 - DNA, 22 bp, Homo sapiens
ttttctcagctgcactgtatta

SEQ ID NO: 8778036 - DNA, 22 bp, Homo sapiens
ttttctcagctgcactgtatta

SEQ ID NO: 8778037 - DNA, 22 bp, Homo sapiens
ttttctattcattgtctatggt

SEQ ID NO: 8778038 - DNA, 22 bp, Homo sapiens
ttttccaaattagaagtagaga

SEQ ID NO: 8778039 - DNA, 22 bp, Homo sapiens
ttttcatttttgtagatgcaag

SEQ ID NO: 8778040 - DNA, 19 bp, Homo sapiens
ttttccacagaaatatgtt

SEQ ID NO: 8778041 - DNA, 22 bp, Homo sapiens
ttttccaccttctagagattgt

SEQ ID NO: 8778042 - DNA, 22 bp, Homo sapiens
ttttccaccttctagagattgt

SEQ ID NO: 8778043 - DNA, 22 bp, Homo sapiens
ttttctattcattgtctatggt

SEQ ID NO: 8778044 - DNA, 22 bp, Homo sapiens
ttttcatttacattagggaaga

SEQ ID NO: 8778045 - DNA, 22 bp, Homo sapiens
ttttcatttacattagggaaga

SEQ ID NO: 8778046 - DNA, 22 bp, Homo sapiens
ttttcatttacattagggaaga

SEQ ID NO: 8778047 - DNA, 22 bp, Homo sapiens
ttttcatttacattagggaaga

SEQ ID NO: 8778048 - DNA, 22 bp, Homo sapiens
ttttcatttacattagggaaga

SEQ ID NO: 8778049 - DNA, 22 bp, Homo sapiens
ttttcatttttgtagatgcaag

SEQ ID NO: 8778050 - DNA, 22 bp, Homo sapiens
ttttcatttttgtagatgcaag

SEQ ID NO: 8778051 - DNA, 22 bp, Homo sapiens
ttttcatttttgtagatgcaag

SEQ ID NO: 8778052 - DNA, 22 bp, Homo sapiens
ttttcatttttgtagatgcaag

SEQ ID NO: 8778053 - DNA, 22 bp, Homo sapiens
ttttcatttttgtagatgcaag

SEQ ID NO: 8778054 - DNA, 20 bp, Homo sapiens
ttttctgtgccaagaaaact

SEQ ID NO: 8778055 - DNA, 20 bp, Homo sapiens
ttttctgtgccaagaaaact

SEQ ID NO: 8778056 - DNA, 22 bp, Homo sapiens
ttttctgtggtcagagcttgag

SEQ ID NO: 8778057 - DNA, 22 bp, Homo sapiens
ttttctgtgccctgctagctgg

SEQ ID NO: 8778058 - DNA, 20 bp, Homo sapiens
ttttctgtgccaagaaaact

SEQ ID NO: 8778059 - DNA, 20 bp, Homo sapiens
ttttctgtgccaagaaaact

SEQ ID NO: 8778060 - DNA, 20 bp, Homo sapiens
ttttctgtgccaagaaaact

SEQ ID NO: 8778061 - DNA, 22 bp, Homo sapiens
ttttctgtgattctgaggttgg

SEQ ID NO: 8778062 - DNA, 22 bp, Homo sapiens
ttttctgtattattgtgcttca

SEQ ID NO: 8778063 - DNA, 22 bp, Homo sapiens
ttttctgtgattctgaggttgg

SEQ ID NO: 8778064 - DNA, 22 bp, Homo sapiens
ttttctgtttacagagggacct

SEQ ID NO: 8778065 - DNA, 22 bp, Homo sapiens
ttttctgttacaaagtacagcg

SEQ ID NO: 8778066 - DNA, 22 bp, Homo sapiens
ttttctgttacaaagtacagcg

SEQ ID NO: 8778067 - DNA, 22 bp, Homo sapiens
ttttctgtgtatccaggcttcc

SEQ ID NO: 8778068 - DNA, 22 bp, Homo sapiens
ttttctgtgtatccaggcttcc

SEQ ID NO: 8778069 - DNA, 22 bp, Homo sapiens
ttttctgtgtgtccctcgacag

SEQ ID NO: 8778070 - DNA, 22 bp, Homo sapiens
ttttctgtgtgtccctcgacag

SEQ ID NO: 8778071 - DNA, 22 bp, Homo sapiens
ttttctgtgccctgctagctgg

SEQ ID NO: 8778072 - DNA, 22 bp, Homo sapiens
ttttctgtggtcagagcttgag

SEQ ID NO: 8778073 - DNA, 22 bp, Homo sapiens
ttttctgtattattgtgcttca

SEQ ID NO: 8778074 - DNA, 22 bp, Homo sapiens
ttttctgtattattgtgcttca

SEQ ID NO: 8778075 - DNA, 22 bp, Homo sapiens
ttttctgtattattgtgcttca

SEQ ID NO: 8778076 - DNA, 22 bp, Homo sapiens
ttttctgtattattgtgcttca

SEQ ID NO: 8778077 - DNA, 22 bp, Homo sapiens
ttttctgtaagaggactttaat

SEQ ID NO: 8778078 - DNA, 22 bp, Homo sapiens
ttttctgtaagaggactttaat

SEQ ID NO: 8778079 - DNA, 22 bp, Homo sapiens
ttttctgtaagaggactttaat

SEQ ID NO: 8778080 - DNA, 22 bp, Homo sapiens
ttttctgcggtgtgaatggcct

SEQ ID NO: 8778081 - DNA, 22 bp, Homo sapiens
ttttctgcctgcgtgtttagga

SEQ ID NO: 8778082 - DNA, 22 bp, Homo sapiens
ttttctgacctatctacattta

SEQ ID NO: 8778083 - DNA, 22 bp, Homo sapiens
ttttctgtttgcttcaagacat

SEQ ID NO: 8778084 - DNA, 22 bp, Homo sapiens
ttttcttactgtctgtgatcct

SEQ ID NO: 8778085 - DNA, 22 bp, Homo sapiens
ttttcttaggtgctccaagtag

SEQ ID NO: 8778086 - DNA, 22 bp, Homo sapiens
ttttcttactgtctgtgatcct

SEQ ID NO: 8778087 - DNA, 22 bp, Homo sapiens
ttttcttatggtgaagcacaaa

SEQ ID NO: 8778088 - DNA, 22 bp, Homo sapiens
ttttcttatggtgaagcacaaa

SEQ ID NO: 8778089 - DNA, 22 bp, Homo sapiens
ttttcttatagagcttaaagtt

SEQ ID NO: 8778090 - DNA, 22 bp, Homo sapiens
ttttcttatagagcttaaagtt

SEQ ID NO: 8778091 - DNA, 22 bp, Homo sapiens
ttttcttatgtgcagctatatg

SEQ ID NO: 8778092 - DNA, 22 bp, Homo sapiens
tttttagaattggctgagaatt

SEQ ID NO: 8778093 - DNA, 22 bp, Homo sapiens
tttttagaattggctgagaatt

SEQ ID NO: 8778094 - DNA, 22 bp, Homo sapiens
tttttagccaagccataggtct

SEQ ID NO: 8778095 - DNA, 22 bp, Homo sapiens
tttttagccaagccataggtct

SEQ ID NO: 8778096 - DNA, 19 bp, Homo sapiens
tttttagcagggtacacct

SEQ ID NO: 8778097 - DNA, 22 bp, Homo sapiens
tttttagattactcagccacca

SEQ ID NO: 8778098 - DNA, 22 bp, Homo sapiens
tttttagagtgttaccagtata

SEQ ID NO: 8778099 - DNA, 23 bp, Homo sapiens
tttttagttacacctctgccacc

SEQ ID NO: 8778100 - DNA, 22 bp, Homo sapiens
tttttataactcttttgtgaca

SEQ ID NO: 8778101 - DNA, 22 bp, Homo sapiens
tttttataactcttttgtgaca

SEQ ID NO: 8778102 - DNA, 22 bp, Homo sapiens
tttttataccacctctcactta

SEQ ID NO: 8778103 - DNA, 22 bp, Homo sapiens
tttttataccacctctcactta

SEQ ID NO: 8778104 - DNA, 22 bp, Homo sapiens
tttttataccacctctcactta

SEQ ID NO: 8778105 - DNA, 22 bp, Homo sapiens
tttttataccacctctcactta

SEQ ID NO: 8778106 - DNA, 22 bp, Homo sapiens
ttttgttgtaatatacctatcc

SEQ ID NO: 8778107 - DNA, 22 bp, Homo sapiens
ttttcttcctggattttggcat

SEQ ID NO: 8778108 - DNA, 22 bp, Homo sapiens
ttttgttggcttaagaaataca

SEQ ID NO: 8778109 - DNA, 22 bp, Homo sapiens
ttttgttggcttaagaaataca

SEQ ID NO: 8778110 - DNA, 22 bp, Homo sapiens
ttttgttggcttaagaaataca

SEQ ID NO: 8778111 - DNA, 22 bp, Homo sapiens
ttttcttcctggattttggcat

SEQ ID NO: 8778112 - DNA, 22 bp, Homo sapiens
tttttacacttagcattgagcg

SEQ ID NO: 8778113 - DNA, 22 bp, Homo sapiens
tttttacacttagcattgagcg

SEQ ID NO: 8778114 - DNA, 22 bp, Homo sapiens
tttttacacttagcattgagcg

SEQ ID NO: 8778115 - DNA, 22 bp, Homo sapiens
ttttgtttaaaatcctggatgg

SEQ ID NO: 8778116 - DNA, 22 bp, Homo sapiens
tttttacacttagcattgagcg

SEQ ID NO: 8778117 - DNA, 22 bp, Homo sapiens
tttttacagtcatggtcactca

SEQ ID NO: 8778118 - DNA, 22 bp, Homo sapiens
ttttgtttgtgtccactgcagt

SEQ ID NO: 8778119 - DNA, 22 bp, Homo sapiens
tttttacacttagcattgagcg

SEQ ID NO: 8778120 - DNA, 22 bp, Homo sapiens
tttttacacttagcattgagcg

SEQ ID NO: 8778121 - DNA, 22 bp, Homo sapiens
tttttatctacagattctcagc

SEQ ID NO: 8778122 - DNA, 22 bp, Homo sapiens
tttttatctacagattctcagc

SEQ ID NO: 8778123 - DNA, 22 bp, Homo sapiens
tttttatatgaaggatagtgcg

SEQ ID NO: 8778124 - DNA, 22 bp, Homo sapiens
tttttatatgaaggatagtgcg

SEQ ID NO: 8778125 - DNA, 22 bp, Homo sapiens
tttttatatgaaggatagtgcg

SEQ ID NO: 8778126 - DNA, 22 bp, Homo sapiens
tttttatgcctacgctgaaaag

SEQ ID NO: 8778127 - DNA, 22 bp, Homo sapiens
tttttatcttgtatgtgtctct

SEQ ID NO: 8778128 - DNA, 22 bp, Homo sapiens
tttttatcttgtatgtgtctct

SEQ ID NO: 8778129 - DNA, 22 bp, Homo sapiens
tttttcaagacaacctgcatgt

SEQ ID NO: 8778130 - DNA, 22 bp, Homo sapiens
tttttcaagacaacctgcatgt

SEQ ID NO: 8778131 - DNA, 22 bp, Homo sapiens
tttttatactttgctcaagatt

SEQ ID NO: 8778132 - DNA, 22 bp, Homo sapiens
tttttatactttgctcaagatt

SEQ ID NO: 8778133 - DNA, 22 bp, Homo sapiens
tttttatactttgctcaagatt

SEQ ID NO: 8778134 - DNA, 22 bp, Homo sapiens
tttttataccacctctcactta

SEQ ID NO: 8778135 - DNA, 22 bp, Homo sapiens
tttttataccacctctcactta

SEQ ID NO: 8778136 - DNA, 22 bp, Homo sapiens
tttttatatgaaggatagtgcg

SEQ ID NO: 8778137 - DNA, 22 bp, Homo sapiens
tttttatactttgctcaagatt

SEQ ID NO: 8778138 - DNA, 22 bp, Homo sapiens
tttttcagccatgaattacact

SEQ ID NO: 8778139 - DNA, 22 bp, Homo sapiens
tttttcatattcccctctctgg

SEQ ID NO: 8778140 - DNA, 22 bp, Homo sapiens
tttttcatattcccctctctgg

SEQ ID NO: 8778141 - DNA, 22 bp, Homo sapiens
tttttcatattcccctctctgg

SEQ ID NO: 8778142 - DNA, 22 bp, Homo sapiens
tttttcatattcccctctctgg

SEQ ID NO: 8778143 - DNA, 22 bp, Homo sapiens
tttttcatctgattgataactc

SEQ ID NO: 8778144 - DNA, 22 bp, Homo sapiens
tttttcatctgattgataactc

SEQ ID NO: 8778145 - DNA, 22 bp, Homo sapiens
cagaagcagattctaaagcaag

SEQ ID NO: 8778146 - DNA, 22 bp, Homo sapiens
cagaagcagattctaaagcaag

SEQ ID NO: 8778147 - DNA, 22 bp, Homo sapiens
cagaagcagattctaaagcaag

SEQ ID NO: 8778148 - DNA, 22 bp, Homo sapiens
cagaagcactaggaggaaacgt

SEQ ID NO: 8778149 - DNA, 22 bp, Homo sapiens
cagaagcactaggaggaaacgt

SEQ ID NO: 8778150 - DNA, 22 bp, Homo sapiens
cagaagcagaacactagattta

SEQ ID NO: 8778151 - DNA, 22 bp, Homo sapiens
cagaagcagaacactagattta

SEQ ID NO: 8778152 - DNA, 22 bp, Homo sapiens
cagaagcagaacactagattta

SEQ ID NO: 8778153 - DNA, 22 bp, Homo sapiens
cagaagcagaacactagattta

SEQ ID NO: 8778154 - DNA, 23 bp, Homo sapiens
cagaagcacctgttgactgctgc

SEQ ID NO: 8778155 - DNA, 23 bp, Homo sapiens
cagaagcacctgttgactgctgc

SEQ ID NO: 8778156 - DNA, 23 bp, Homo sapiens
cagaagcacctgttgactgctgc

SEQ ID NO: 8778157 - DNA, 22 bp, Homo sapiens
cagaagcactaggaggaaacgt

SEQ ID NO: 8778158 - DNA, 22 bp, Homo sapiens
cagaagcacatgtttacatgta

SEQ ID NO: 8778159 - DNA, 22 bp, Homo sapiens
cagaagcacatgtttacatgta

SEQ ID NO: 8778160 - DNA, 22 bp, Homo sapiens
cagaagcacatgtttacatgta

SEQ ID NO: 8778161 - DNA, 22 bp, Homo sapiens
cagaagcacatgtttacatgta

SEQ ID NO: 8778162 - DNA, 22 bp, Homo sapiens
cagaagagtagctgaacaagtt

SEQ ID NO: 8778163 - DNA, 22 bp, Homo sapiens
cagaagagtagctgaacaagtt

SEQ ID NO: 8778164 - DNA, 22 bp, Homo sapiens
cagaagagtagctgaacaagtt

SEQ ID NO: 8778165 - DNA, 22 bp, Homo sapiens
cagaagcaaatgccttgctgag

SEQ ID NO: 8778166 - DNA, 22 bp, Homo sapiens
cagaagcaaatgccttgctgag

SEQ ID NO: 8778167 - DNA, 22 bp, Homo sapiens
cagaagcaaatgccttgctgag

SEQ ID NO: 8778168 - DNA, 22 bp, Homo sapiens
cagaagatgctttgtaaaatga

SEQ ID NO: 8778169 - DNA, 20 bp, Homo sapiens
cagaagcaaggcaggtacct

SEQ ID NO: 8778170 - DNA, 20 bp, Homo sapiens
cagaagcaaggcaggtacct

SEQ ID NO: 8778171 - DNA, 20 bp, Homo sapiens
cagaagcaaggcaggtacct

SEQ ID NO: 8778172 - DNA, 22 bp, Homo sapiens
cagaagcaagagccggagctag

SEQ ID NO: 8778173 - DNA, 22 bp, Homo sapiens
cagaagcaagagccggagctag

SEQ ID NO: 8778174 - DNA, 22 bp, Homo sapiens
cagaagcaagggccaaagtctt

SEQ ID NO: 8778175 - DNA, 22 bp, Homo sapiens
cagaagcaagggccaaagtctt

SEQ ID NO: 8778176 - DNA, 22 bp, Homo sapiens
cagaagcaagggccaaagtctt

SEQ ID NO: 8778177 - DNA, 22 bp, Homo sapiens
cagaagcaagggccaaagtctt

SEQ ID NO: 8778178 - DNA, 22 bp, Homo sapiens
cagaagcaagtagtgattcttt

SEQ ID NO: 8778179 - DNA, 22 bp, Homo sapiens
cagaagcaagtagtgattcttt

SEQ ID NO: 8778180 - DNA, 22 bp, Homo sapiens
cagaagcaagtagtgattcttt

SEQ ID NO: 8778181 - DNA, 22 bp, Homo sapiens
cagagacagtttcacagggtct

SEQ ID NO: 8778182 - DNA, 20 bp, Homo sapiens
cagagacctgtcttcacaga

SEQ ID NO: 8778183 - DNA, 20 bp, Homo sapiens
cagagacctgtcttcacaga

SEQ ID NO: 8778184 - DNA, 22 bp, Homo sapiens
cagagacagtttcacagggtct

SEQ ID NO: 8778185 - DNA, 18 bp, Homo sapiens
cagaagcaggcagtgcag

SEQ ID NO: 8778186 - DNA, 18 bp, Homo sapiens
cagaagcaggcagtgcag

SEQ ID NO: 8778187 - DNA, 18 bp, Homo sapiens
cagaagcaggcagtgcag

SEQ ID NO: 8778188 - DNA, 18 bp, Homo sapiens
cagaagcaggcagtgcag

SEQ ID NO: 8778189 - DNA, 22 bp, Homo sapiens
cagagagaatcttggcagctga

SEQ ID NO: 8778190 - DNA, 22 bp, Homo sapiens
cagagagaatcttggcagctga

SEQ ID NO: 8778191 - DNA, 22 bp, Homo sapiens
cagagagaatcttggcagctga

SEQ ID NO: 8778192 - DNA, 22 bp, Homo sapiens
cagagagaatatgtagtatgga

SEQ ID NO: 8778193 - DNA, 22 bp, Homo sapiens
cagagagaatatgtagtatgga

SEQ ID NO: 8778194 - DNA, 22 bp, Homo sapiens
cagagagaatcttggcagctga

SEQ ID NO: 8778195 - DNA, 22 bp, Homo sapiens
cagagagaatcttggcagctga

SEQ ID NO: 8778196 - DNA, 22 bp, Homo sapiens
cagagagaatcttggcagctga

SEQ ID NO: 8778197 - DNA, 22 bp, Homo sapiens
cagagagaatcttggcagctga

SEQ ID NO: 8778198 - DNA, 22 bp, Homo sapiens
cagagagagcaggaaacctccg

SEQ ID NO: 8778199 - DNA, 19 bp, Homo sapiens
cagagagaccaaggcgcca

SEQ ID NO: 8778200 - DNA, 19 bp, Homo sapiens
cagagagaccaaggcgcca

SEQ ID NO: 8778201 - DNA, 19 bp, Homo sapiens
cagagagaccaaggcgcca

SEQ ID NO: 8778202 - DNA, 22 bp, Homo sapiens
cagagagaatcttggcagctga

SEQ ID NO: 8778203 - DNA, 19 bp, Homo sapiens
cagagagaccaaggcgcca

SEQ ID NO: 8778204 - DNA, 22 bp, Homo sapiens
cagagagaggccactgctatta

SEQ ID NO: 8778205 - DNA, 22 bp, Homo sapiens
cagagagagcaggaaacctccg

SEQ ID NO: 8778206 - DNA, 22 bp, Homo sapiens
cagagagaggccactgctatta

SEQ ID NO: 8778207 - DNA, 22 bp, Homo sapiens
cagagagagcaggaaacctccg

SEQ ID NO: 8778208 - DNA, 22 bp, Homo sapiens
cagagagagcaggaaacctccg

SEQ ID NO: 8778209 - DNA, 22 bp, Homo sapiens
cagagagagtctgtccctgaag

SEQ ID NO: 8778210 - DNA, 22 bp, Homo sapiens
cagagagagtcaaatctttgct

SEQ ID NO: 8778211 - DNA, 22 bp, Homo sapiens
cagagagagtcaaatctttgct

SEQ ID NO: 8778212 - DNA, 22 bp, Homo sapiens
cagagagagtctgtccctgaag

SEQ ID NO: 8778213 - DNA, 22 bp, Homo sapiens
cagagagagtcaaatctttgct

SEQ ID NO: 8778214 - DNA, 22 bp, Homo sapiens
cagagagaggtgccgataatgg

SEQ ID NO: 8778215 - DNA, 22 bp, Homo sapiens
cagagagaggggctgcctggcc

SEQ ID NO: 8778216 - DNA, 22 bp, Homo sapiens
cagagagaggtgccgataatgg

SEQ ID NO: 8778217 - DNA, 22 bp, Homo sapiens
cagagagaggggctgcctggcc

SEQ ID NO: 8778218 - DNA, 22 bp, Homo sapiens
cagagagaggggctgcctggcc

SEQ ID NO: 8778219 - DNA, 22 bp, Homo sapiens
cagagagaggggctgcctggcc

SEQ ID NO: 8778220 - DNA, 22 bp, Homo sapiens
cagagagaggccactgctatta

SEQ ID NO: 8778221 - DNA, 20 bp, Homo sapiens
gggccctgggattcagagca

SEQ ID NO: 8778222 - DNA, 22 bp, Homo sapiens
gggccctggctttcctgttctt

SEQ ID NO: 8778223 - DNA, 22 bp, Homo sapiens
gggccctggctttcctgttctt

SEQ ID NO: 8778224 - DNA, 18 bp, Homo sapiens
gggccctggcgtccgccc

SEQ ID NO: 8778225 - DNA, 18 bp, Homo sapiens
gggccctggcgtccgccc

SEQ ID NO: 8778226 - DNA, 18 bp, Homo sapiens
cagagcagaggtggagcg

SEQ ID NO: 8778227 - DNA, 18 bp, Homo sapiens
cagagcagaggtggagcg

SEQ ID NO: 8778228 - DNA, 22 bp, Homo sapiens
cagagcagatttctaagtattg

SEQ ID NO: 8778229 - DNA, 21 bp, Homo sapiens
cagagcagcgttctgctgtgg

SEQ ID NO: 8778230 - DNA, 22 bp, Homo sapiens
gggcgctgggtgtcgagactca

SEQ ID NO: 8778231 - DNA, 21 bp, Homo sapiens
cagagcagcgttctgctgtgg

SEQ ID NO: 8778232 - DNA, 21 bp, Homo sapiens
cagagcagcgttctgctgtgg

SEQ ID NO: 8778233 - DNA, 21 bp, Homo sapiens
cagagcagcgttctgctgtgg

SEQ ID NO: 8778234 - DNA, 21 bp, Homo sapiens
cagagcagcgttctgctgtgg

SEQ ID NO: 8778235 - DNA, 22 bp, Homo sapiens
cagagcagcctccagggggagc

SEQ ID NO: 8778236 - DNA, 16 bp, Homo sapiens
cagagaggacagaggc

SEQ ID NO: 8778237 - DNA, 22 bp, Homo sapiens
gggccagctctgtgatgtaggg

SEQ ID NO: 8778238 - DNA, 22 bp, Homo sapiens
gggccctgcgactcgcggcgga

SEQ ID NO: 8778239 - DNA, 22 bp, Homo sapiens
gggccctgcgtccggaagtctg

SEQ ID NO: 8778240 - DNA, 22 bp, Homo sapiens
gggccctggacgtggcggcaga

SEQ ID NO: 8778241 - DNA, 22 bp, Homo sapiens
gggccctgcgtccggaagtctg

SEQ ID NO: 8778242 - DNA, 22 bp, Homo sapiens
gggccctggccgaatccctctg

SEQ ID NO: 8778243 - DNA, 22 bp, Homo sapiens
gggccctggccgaatccctctg

SEQ ID NO: 8778244 - DNA, 22 bp, Homo sapiens
gggccctggatttaagcatgga

SEQ ID NO: 8778245 - DNA, 22 bp, Homo sapiens
gggccctggatttaagcatgga

SEQ ID NO: 8778246 - DNA, 22 bp, Homo sapiens
gggccctggacgtggcggcaga

SEQ ID NO: 8778247 - DNA, 22 bp, Homo sapiens
gggccctggacgtggcggcaga

SEQ ID NO: 8778248 - DNA, 22 bp, Homo sapiens
gggccctggacgtggcggcaga

SEQ ID NO: 8778249 - DNA, 22 bp, Homo sapiens
cagagagagtggggtgtggatt

SEQ ID NO: 8778250 - DNA, 22 bp, Homo sapiens
cagagagagtggggtgtggatt

SEQ ID NO: 8778251 - DNA, 22 bp, Homo sapiens
cagagagagtggggtgtggatt

SEQ ID NO: 8778252 - DNA, 22 bp, Homo sapiens
cagagagagtctgtccctgaag

SEQ ID NO: 8778253 - DNA, 22 bp, Homo sapiens
cagagagagtggggtgtggatt

SEQ ID NO: 8778254 - DNA, 22 bp, Homo sapiens
cagagagagtctgtccctgaag

SEQ ID NO: 8778255 - DNA, 22 bp, Homo sapiens
cagagagagtctgtccctgaag

SEQ ID NO: 8778256 - DNA, 22 bp, Homo sapiens
cagagagcttagtgtgctgcat

SEQ ID NO: 8778257 - DNA, 16 bp, Homo sapiens
cagagaggacagaggc

SEQ ID NO: 8778258 - DNA, 16 bp, Homo sapiens
cagagaggacagaggc

SEQ ID NO: 8778259 - DNA, 22 bp, Homo sapiens
cagagagcttgcccttgtatat

SEQ ID NO: 8778260 - DNA, 16 bp, Homo sapiens
cagagaggacagaggc

SEQ ID NO: 8778261 - DNA, 21 bp, Homo sapiens
cagagagctagaacttcatga

SEQ ID NO: 8778262 - DNA, 22 bp, Homo sapiens
cagagagcatgggaggcccgag

SEQ ID NO: 8778263 - DNA, 22 bp, Homo sapiens
cagagagcttagtgtgctgcat

SEQ ID NO: 8778264 - DNA, 22 bp, Homo sapiens
gggctcaggcctggcctctcac

SEQ ID NO: 8778265 - DNA, 22 bp, Homo sapiens
gggctcaggtcagggcatcagc

SEQ ID NO: 8778266 - DNA, 22 bp, Homo sapiens
gggctcaggtcagggcatcagc

SEQ ID NO: 8778267 - DNA, 22 bp, Homo sapiens
gggctctgcagtgacttgaggg

SEQ ID NO: 8778268 - DNA, 22 bp, Homo sapiens
gggctctgcagagaactggctc

SEQ ID NO: 8778269 - DNA, 21 bp, Homo sapiens
gggctcagtggaaaagagtgt

SEQ ID NO: 8778270 - DNA, 18 bp, Homo sapiens
gggctctgatccttcacc

SEQ ID NO: 8778271 - DNA, 22 bp, Homo sapiens
gggctcagtctgcggcgcgcgg

SEQ ID NO: 8778272 - DNA, 22 bp, Homo sapiens
gggctcagtctggcgtggaatg

SEQ ID NO: 8778273 - DNA, 21 bp, Homo sapiens
gggctctgccctcctggagct

SEQ ID NO: 8778274 - DNA, 20 bp, Homo sapiens
gggctctgcatccatcagcc

SEQ ID NO: 8778275 - DNA, 21 bp, Homo sapiens
gggctctgccctcctggagct

SEQ ID NO: 8778276 - DNA, 21 bp, Homo sapiens
gggctctgccctcctggagct

SEQ ID NO: 8778277 - DNA, 22 bp, Homo sapiens
gggctctgcctggctgggagta

SEQ ID NO: 8778278 - DNA, 22 bp, Homo sapiens
gggctctgcgctcagctccagc

SEQ ID NO: 8778279 - DNA, 22 bp, Homo sapiens
gggctctgcgctcagctccagc

SEQ ID NO: 8778280 - DNA, 22 bp, Homo sapiens
cagagctgtcatttgccagtga

SEQ ID NO: 8778281 - DNA, 22 bp, Homo sapiens
cagagcttctgacagctgctgc

SEQ ID NO: 8778282 - DNA, 22 bp, Homo sapiens
cagaggaaagtatttctggaag

SEQ ID NO: 8778283 - DNA, 22 bp, Homo sapiens
cagagctttgtgtcagggctgt

SEQ ID NO: 8778284 - DNA, 22 bp, Homo sapiens
cagagctttttacattaatgat

SEQ ID NO: 8778285 - DNA, 22 bp, Homo sapiens
cagaggaaagtatttctggaag

SEQ ID NO: 8778286 - DNA, 22 bp, Homo sapiens
cagagcttgaatgtccatggtt

SEQ ID NO: 8778287 - DNA, 22 bp, Homo sapiens
cagagcttgaatccaacaaaga

SEQ ID NO: 8778288 - DNA, 22 bp, Homo sapiens
cagagcttggctgtggttgtga

SEQ ID NO: 8778289 - DNA, 22 bp, Homo sapiens
cagagctttctgtcacattagt

SEQ ID NO: 8778290 - DNA, 22 bp, Homo sapiens
cagagctttctgtcacattagt

SEQ ID NO: 8778291 - DNA, 22 bp, Homo sapiens
cagagctttctgtcacattagt

SEQ ID NO: 8778292 - DNA, 22 bp, Homo sapiens
cagagctttgtgtcagggctgt

SEQ ID NO: 8778293 - DNA, 22 bp, Homo sapiens
cagaggaaatgggaaggagata

SEQ ID NO: 8778294 - DNA, 22 bp, Homo sapiens
cagaggaacgtttggattgatt

SEQ ID NO: 8778295 - DNA, 22 bp, Homo sapiens
cagaggaaatgggaaggagata

SEQ ID NO: 8778296 - DNA, 22 bp, Homo sapiens
cagaggaacgtttggattgatt

SEQ ID NO: 8778297 - DNA, 22 bp, Homo sapiens
cagaggaacgtttggattgatt

SEQ ID NO: 8778298 - DNA, 22 bp, Homo sapiens
cagaggaagagatacaagccct

SEQ ID NO: 8778299 - DNA, 22 bp, Homo sapiens
cagaggaagagatacaagccct

SEQ ID NO: 8778300 - DNA, 22 bp, Homo sapiens
cagaggcagccgggggagaacg

SEQ ID NO: 8778301 - DNA, 22 bp, Homo sapiens
cagaggcagccgggggagaacg

SEQ ID NO: 8778302 - DNA, 22 bp, Homo sapiens
cagaggcaggaagatgggcagt

SEQ ID NO: 8778303 - DNA, 22 bp, Homo sapiens
cagaggcagccgggggagaacg

SEQ ID NO: 8778304 - DNA, 22 bp, Homo sapiens
cagaggcaggaagatgggcagt

SEQ ID NO: 8778305 - DNA, 22 bp, Homo sapiens
cagaggcagaatggagatttgg

SEQ ID NO: 8778306 - DNA, 22 bp, Homo sapiens
cagaggcagaggtcatctctgg

SEQ ID NO: 8778307 - DNA, 22 bp, Homo sapiens
cagaggcagaggtcatctctgg

SEQ ID NO: 8778308 - DNA, 22 bp, Homo sapiens
cagaggcagaccctccagggcg

SEQ ID NO: 8778309 - DNA, 22 bp, Homo sapiens
gggggcagtaaggatatggaaa

SEQ ID NO: 8778310 - DNA, 19 bp, Homo sapiens
cagaggcactttctcttag

SEQ ID NO: 8778311 - DNA, 22 bp, Homo sapiens
gggggcagtaaggatatggaaa

SEQ ID NO: 8778312 - DNA, 19 bp, Homo sapiens
cagaggcactttctcttag

SEQ ID NO: 8778313 - DNA, 22 bp, Homo sapiens
gggggcagtaacctcaaagtgt

SEQ ID NO: 8778314 - DNA, 22 bp, Homo sapiens
gggggcagtaacctcaaagtgt

SEQ ID NO: 8778315 - DNA, 22 bp, Homo sapiens
gggggcaggtctggaactttga

SEQ ID NO: 8778316 - DNA, 22 bp, Homo sapiens
gggggcagtaacctcaaagtgt

SEQ ID NO: 8778317 - DNA, 22 bp, Homo sapiens
gggggcagaatgtactcttgtc

SEQ ID NO: 8778318 - DNA, 22 bp, Homo sapiens
gggggcagaatgtactcttgtc

SEQ ID NO: 8778319 - DNA, 22 bp, Homo sapiens
gggggcaggtctggaactttga

SEQ ID NO: 8778320 - DNA, 22 bp, Homo sapiens
gggggcaggtctggaactttga

SEQ ID NO: 8778321 - DNA, 22 bp, Homo sapiens
cagaggaagcagacacatcttg

SEQ ID NO: 8778322 - DNA, 22 bp, Homo sapiens
cagaggaagcagacacatcttg

SEQ ID NO: 8778323 - DNA, 22 bp, Homo sapiens
cagaggaagctgggtgtggagt

SEQ ID NO: 8778324 - DNA, 22 bp, Homo sapiens
cagaggaagcagacacatcttg

SEQ ID NO: 8778325 - DNA, 22 bp, Homo sapiens
cagaggaagctgggtgtggagt

SEQ ID NO: 8778326 - DNA, 22 bp, Homo sapiens
cagaggaagctgggtgtggagt

SEQ ID NO: 8778327 - DNA, 22 bp, Homo sapiens
cagaggaagctgggtgtggagt

SEQ ID NO: 8778328 - DNA, 22 bp, Homo sapiens
cagaggaaggctctgggaatgt

SEQ ID NO: 8778329 - DNA, 22 bp, Homo sapiens
cagaggaagttccttgatgaga

SEQ ID NO: 8778330 - DNA, 22 bp, Homo sapiens
cagaggacaactggggcaagga

SEQ ID NO: 8778331 - DNA, 22 bp, Homo sapiens
cagaggacaactggggcaagga

SEQ ID NO: 8778332 - DNA, 22 bp, Homo sapiens
cagaggacaactggggcaagga

SEQ ID NO: 8778333 - DNA, 22 bp, Homo sapiens
cagaggaagttccttgatgaga

SEQ ID NO: 8778334 - DNA, 22 bp, Homo sapiens
cagaggaagggtgctgcgaaag

SEQ ID NO: 8778335 - DNA, 22 bp, Homo sapiens
cagaggaaggctctgggaatgt

SEQ ID NO: 8778336 - DNA, 22 bp, Homo sapiens
cagaggaagggtgctgcgaaag

SEQ ID NO: 8778337 - DNA, 22 bp, Homo sapiens
gggggaggtgaatgcaataagg

SEQ ID NO: 8778338 - DNA, 22 bp, Homo sapiens
gggggaggtgaatgcaataagg

SEQ ID NO: 8778339 - DNA, 22 bp, Homo sapiens
gggggaggtgaatgcaataagg

SEQ ID NO: 8778340 - DNA, 22 bp, Homo sapiens
gggggaggtgaatgcaataagg

SEQ ID NO: 8778341 - DNA, 22 bp, Homo sapiens
gggggagctgttattggcaggg

SEQ ID NO: 8778342 - DNA, 22 bp, Homo sapiens
cagaggacttcccactcatctg

SEQ ID NO: 8778343 - DNA, 22 bp, Homo sapiens
cagaggacttcccactcatctg

SEQ ID NO: 8778344 - DNA, 22 bp, Homo sapiens
ggggcggggctctgagaagcat

SEQ ID NO: 8778345 - DNA, 22 bp, Homo sapiens
cagaggaccagaaaggggccca

SEQ ID NO: 8778346 - DNA, 22 bp, Homo sapiens
cagaggacatgaaaactcgctc

SEQ ID NO: 8778347 - DNA, 22 bp, Homo sapiens
cagaggacctgtgtggccagag

SEQ ID NO: 8778348 - DNA, 22 bp, Homo sapiens
cagaggacctgtgtggccagag

SEQ ID NO: 8778349 - DNA, 22 bp, Homo sapiens
cagaggacctgtgtggccagag

SEQ ID NO: 8778350 - DNA, 22 bp, Homo sapiens
ggggtgagatcaaggaagccct

SEQ ID NO: 8778351 - DNA, 22 bp, Homo sapiens
ggggtgagatcaaggaagccct

SEQ ID NO: 8778352 - DNA, 22 bp, Homo sapiens
ggggtgagctgggcctgtgcct

SEQ ID NO: 8778353 - DNA, 22 bp, Homo sapiens
ggggtgagctgggcctgtgcct

SEQ ID NO: 8778354 - DNA, 23 bp, Homo sapiens
ggggtcttggaacaggtggccct

SEQ ID NO: 8778355 - DNA, 22 bp, Homo sapiens
ggggtcctggaggccagctgga

SEQ ID NO: 8778356 - DNA, 22 bp, Homo sapiens
ggggtcctcggagcctgggtct

SEQ ID NO: 8778357 - DNA, 22 bp, Homo sapiens
ggggtccctgcaccagcatgtc

SEQ ID NO: 8778358 - DNA, 22 bp, Homo sapiens
cagagtttaaacaaatgaaata

SEQ ID NO: 8778359 - DNA, 22 bp, Homo sapiens
cagagtttaaacaaatgaaata

SEQ ID NO: 8778360 - DNA, 22 bp, Homo sapiens
cagagtgtggcatcttccaact

SEQ ID NO: 8778361 - DNA, 22 bp, Homo sapiens
cagagtttcggtaagcatagaa

SEQ ID NO: 8778362 - DNA, 22 bp, Homo sapiens
cagagtttcggtaagcatagaa

SEQ ID NO: 8778363 - DNA, 19 bp, Homo sapiens
cagagtttgcaggcagagg

SEQ ID NO: 8778364 - DNA, 22 bp, Homo sapiens
cagagttttatcatacgtggat

SEQ ID NO: 8778365 - DNA, 22 bp, Homo sapiens
cagagttttatgtatgcatgta

SEQ ID NO: 8778366 - DNA, 22 bp, Homo sapiens
cagagttttatgtatgcatgta

SEQ ID NO: 8778367 - DNA, 22 bp, Homo sapiens
cagagttttatgtatgcatgta

SEQ ID NO: 8778368 - DNA, 22 bp, Homo sapiens
cagagtggtgcaagggcagtgt

SEQ ID NO: 8778369 - DNA, 22 bp, Homo sapiens
cagagtgttgaccataagccca

SEQ ID NO: 8778370 - DNA, 22 bp, Homo sapiens
cagagtgttagcgctggttggg

SEQ ID NO: 8778371 - DNA, 22 bp, Homo sapiens
cagagtgtattctgcagttgca

SEQ ID NO: 8778372 - DNA, 22 bp, Homo sapiens
cagagtgggctgtcagccacca

SEQ ID NO: 8778373 - DNA, 22 bp, Homo sapiens
cagagtgggctgtcagccacca

SEQ ID NO: 8778374 - DNA, 22 bp, Homo sapiens
cagagtgggctgtcagccacca

SEQ ID NO: 8778375 - DNA, 21 bp, Homo sapiens
cagaggctgagagggcaatct

SEQ ID NO: 8778376 - DNA, 22 bp, Homo sapiens
cagaggcaggataagaactgcg

SEQ ID NO: 8778377 - DNA, 22 bp, Homo sapiens
cagaggcaggataagaactgcg

SEQ ID NO: 8778378 - DNA, 22 bp, Homo sapiens
cagaggcctttctacagtgata

SEQ ID NO: 8778379 - DNA, 22 bp, Homo sapiens
cagaggcaggataagaactgcg

SEQ ID NO: 8778380 - DNA, 22 bp, Homo sapiens
cagaggcaggataagaactgcg

SEQ ID NO: 8778381 - DNA, 22 bp, Homo sapiens
cagaggcctttctacagtgata

SEQ ID NO: 8778382 - DNA, 22 bp, Homo sapiens
cagaggctgaccctgctgttgt

SEQ ID NO: 8778383 - DNA, 22 bp, Homo sapiens
ggggtagggtgattgtgaagta

SEQ ID NO: 8778384 - DNA, 22 bp, Homo sapiens
ggggtagtcctggtgatggctg

SEQ ID NO: 8778385 - DNA, 22 bp, Homo sapiens
cagaggctgccagccatgtgca

SEQ ID NO: 8778386 - DNA, 22 bp, Homo sapiens
cagaggctgatgtgggatgggc

SEQ ID NO: 8778387 - DNA, 22 bp, Homo sapiens
cagaggctgatgtgggatgggc

SEQ ID NO: 8778388 - DNA, 22 bp, Homo sapiens
cagaggctgccagccatgtgca

SEQ ID NO: 8778389 - DNA, 22 bp, Homo sapiens
cagaggctgccagccatgtgca

SEQ ID NO: 8778390 - DNA, 22 bp, Homo sapiens
cagaggctgccagccatgtgca

SEQ ID NO: 8778391 - DNA, 18 bp, Homo sapiens
cagatgctaggcctccag

SEQ ID NO: 8778392 - DNA, 22 bp, Homo sapiens
ggtgcaggaaaattacctggag

SEQ ID NO: 8778393 - DNA, 22 bp, Homo sapiens
ggtgcagctgcagcctgggagc

SEQ ID NO: 8778394 - DNA, 16 bp, Homo sapiens
cagatgcttgctggca

SEQ ID NO: 8778395 - DNA, 22 bp, Homo sapiens
cagatgcttcgtgggtgagcac

SEQ ID NO: 8778396 - DNA, 20 bp, Homo sapiens
cagatgctggatcttggtcc

SEQ ID NO: 8778397 - DNA, 20 bp, Homo sapiens
cagatgctggatcttggtcc

SEQ ID NO: 8778398 - DNA, 22 bp, Homo sapiens
cagatgctggtatgggggaggt

SEQ ID NO: 8778399 - DNA, 20 bp, Homo sapiens
cagatgctggatcttggtcc

SEQ ID NO: 8778400 - DNA, 22 bp, Homo sapiens
cagatgctatagtgctgccata

SEQ ID NO: 8778401 - DNA, 22 bp, Homo sapiens
cagatgctatagtgctgccata

SEQ ID NO: 8778402 - DNA, 22 bp, Homo sapiens
cagatgctatgtattatgtatg

SEQ ID NO: 8778403 - DNA, 22 bp, Homo sapiens
cagatgctgctcacctgattat

SEQ ID NO: 8778404 - DNA, 22 bp, Homo sapiens
cagatgctgctatttcaccctg

SEQ ID NO: 8778405 - DNA, 22 bp, Homo sapiens
cagatgctgcctgggaatgtct

SEQ ID NO: 8778406 - DNA, 22 bp, Homo sapiens
cagatgctatagtgctgccata

SEQ ID NO: 8778407 - DNA, 22 bp, Homo sapiens
ggtgcagaggagccagctgggg

SEQ ID NO: 8778408 - DNA, 19 bp, Homo sapiens
ggtgcactgggaatgcagc

SEQ ID NO: 8778409 - DNA, 22 bp, Homo sapiens
ggtgcaaacgtaattgtggttt

SEQ ID NO: 8778410 - DNA, 22 bp, Homo sapiens
ggtgcaaaagtagttctgcttt

SEQ ID NO: 8778411 - DNA, 22 bp, Homo sapiens
ggtgcaaaagtaatttggtttt

SEQ ID NO: 8778412 - DNA, 22 bp, Homo sapiens
cagatagctgtaaataaatgga

SEQ ID NO: 8778413 - DNA, 22 bp, Homo sapiens
cagatagcgtttgagagcataa

SEQ ID NO: 8778414 - DNA, 22 bp, Homo sapiens
cagataggaaagggcatcccag

SEQ ID NO: 8778415 - DNA, 22 bp, Homo sapiens
cagatagcaaatgggtaagcta

SEQ ID NO: 8778416 - DNA, 22 bp, Homo sapiens
cagatagcgtttgagagcataa

SEQ ID NO: 8778417 - DNA, 22 bp, Homo sapiens
cagatagcaatttgggcagggg

SEQ ID NO: 8778418 - DNA, 22 bp, Homo sapiens
cagatagcaatttgggcagggg

SEQ ID NO: 8778419 - DNA, 22 bp, Homo sapiens
cagatacattaaaatgatgatt

SEQ ID NO: 8778420 - DNA, 22 bp, Homo sapiens
cagatacctgggtatcatttag

SEQ ID NO: 8778421 - DNA, 22 bp, Homo sapiens
cagatagaatgcaagacctctc

SEQ ID NO: 8778422 - DNA, 22 bp, Homo sapiens
cagatactcaagcttagacttt

SEQ ID NO: 8778423 - DNA, 22 bp, Homo sapiens
cagatacattaaaatgatgatt

SEQ ID NO: 8778424 - DNA, 22 bp, Homo sapiens
cagatatattttatttggtcaa

SEQ ID NO: 8778425 - DNA, 22 bp, Homo sapiens
cagatatagtggcttgcctggg

SEQ ID NO: 8778426 - DNA, 22 bp, Homo sapiens
cagatataaatggatgtggtag

SEQ ID NO: 8778427 - DNA, 22 bp, Homo sapiens
cagataaatagatagataaact

SEQ ID NO: 8778428 - DNA, 22 bp, Homo sapiens
cagataaatagatagataaact

SEQ ID NO: 8778429 - DNA, 22 bp, Homo sapiens
cagataaatagatagataaact

SEQ ID NO: 8778430 - DNA, 22 bp, Homo sapiens
cagatacaggtttttgttagat

SEQ ID NO: 8778431 - DNA, 22 bp, Homo sapiens
cagataatccaagtagttttca

SEQ ID NO: 8778432 - DNA, 22 bp, Homo sapiens
cagataactgaaatatcatacc

SEQ ID NO: 8778433 - DNA, 22 bp, Homo sapiens
cagataaaggcttactagtagt

SEQ ID NO: 8778434 - DNA, 22 bp, Homo sapiens
cagataaaggcttactagtagt

SEQ ID NO: 8778435 - DNA, 22 bp, Homo sapiens
cagataaaattaatattaccaa

SEQ ID NO: 8778436 - DNA, 22 bp, Homo sapiens
cagataaaattaatattaccaa

SEQ ID NO: 8778437 - DNA, 22 bp, Homo sapiens
cagagttttgtgaacaacttgg

SEQ ID NO: 8778438 - DNA, 22 bp, Homo sapiens
cagagttttatcatacgtggat

SEQ ID NO: 8778439 - DNA, 20 bp, Homo sapiens
cagataaacgggaaagaagc

SEQ ID NO: 8778440 - DNA, 20 bp, Homo sapiens
cagataaacgggaaagaagc

SEQ ID NO: 8778441 - DNA, 22 bp, Homo sapiens
gtaagccatcctcaggggcctg

SEQ ID NO: 8778442 - DNA, 22 bp, Homo sapiens
gtaaggcaatagtaaggagtcc

SEQ ID NO: 8778443 - DNA, 22 bp, Homo sapiens
gtaaggcttagggtgcctagat

SEQ ID NO: 8778444 - DNA, 17 bp, Homo sapiens
gtaaggcttgcagatgc

SEQ ID NO: 8778445 - DNA, 20 bp, Homo sapiens
cagcagagacccatggggag

SEQ ID NO: 8778446 - DNA, 20 bp, Homo sapiens
cagcagagacccatggggag

SEQ ID NO: 8778447 - DNA, 22 bp, Homo sapiens
cagcagagacggtaagcagaac

SEQ ID NO: 8778448 - DNA, 22 bp, Homo sapiens
gtaagaaaaccttctttctaat

SEQ ID NO: 8778449 - DNA, 22 bp, Homo sapiens
gtaagaaaaccttctttctaat

SEQ ID NO: 8778450 - DNA, 22 bp, Homo sapiens
gtaactttggatttagggtacc

SEQ ID NO: 8778451 - DNA, 22 bp, Homo sapiens
gtaactttggatttagggtacc

SEQ ID NO: 8778452 - DNA, 22 bp, Homo sapiens
gtaactttggatttagggtacc

SEQ ID NO: 8778453 - DNA, 22 bp, Homo sapiens
gtaacttatcatttcaatatag

SEQ ID NO: 8778454 - DNA, 18 bp, Homo sapiens
gtaagcaaagactttata

SEQ ID NO: 8778455 - DNA, 22 bp, Homo sapiens
gtaagcaaacagcaaatgattt

SEQ ID NO: 8778456 - DNA, 22 bp, Homo sapiens
gtaaacatgctgtgtactcagc

SEQ ID NO: 8778457 - DNA, 22 bp, Homo sapiens
gtaaacatcgacccaacagggg

SEQ ID NO: 8778458 - DNA, 22 bp, Homo sapiens
gtaaacatcagccactctattt

SEQ ID NO: 8778459 - DNA, 22 bp, Homo sapiens
gtaaacatcagccactctattt

SEQ ID NO: 8778460 - DNA, 22 bp, Homo sapiens
gtaaacatcagccactctattt

SEQ ID NO: 8778461 - DNA, 22 bp, Homo sapiens
ggtgtgactcgccctcagggac

SEQ ID NO: 8778462 - DNA, 22 bp, Homo sapiens
ggtgtgcagtagcaggaggcct

SEQ ID NO: 8778463 - DNA, 22 bp, Homo sapiens
ggtgtgattatgacatgtgact

SEQ ID NO: 8778464 - DNA, 22 bp, Homo sapiens
gtaacatttacagttcctagag

SEQ ID NO: 8778465 - DNA, 22 bp, Homo sapiens
gtaacattctagaaacttaaca

SEQ ID NO: 8778466 - DNA, 22 bp, Homo sapiens
gtaacctgtcggaaagccttgt

SEQ ID NO: 8778467 - DNA, 22 bp, Homo sapiens
gtaacctgggatgtagcacaga

SEQ ID NO: 8778468 - DNA, 22 bp, Homo sapiens
gtaacctggaagtttagggaag

SEQ ID NO: 8778469 - DNA, 22 bp, Homo sapiens
gtaactgaggcagcttttaaga

SEQ ID NO: 8778470 - DNA, 22 bp, Homo sapiens
cagcagactggagtaggcagtg

SEQ ID NO: 8778471 - DNA, 22 bp, Homo sapiens
cagcagacttactagaatgtaa

SEQ ID NO: 8778472 - DNA, 22 bp, Homo sapiens
cagcagagaaattaaacttctg

SEQ ID NO: 8778473 - DNA, 22 bp, Homo sapiens
cagcagactggagtaggcagtg

SEQ ID NO: 8778474 - DNA, 22 bp, Homo sapiens
cagcagactggagtaggcagtg

SEQ ID NO: 8778475 - DNA, 22 bp, Homo sapiens
cagcagaagtccgactccagtc

SEQ ID NO: 8778476 - DNA, 22 bp, Homo sapiens
cagcagaagtgcatttgtgatt

SEQ ID NO: 8778477 - DNA, 21 bp, Homo sapiens
cagcagaagcatctatggaag

SEQ ID NO: 8778478 - DNA, 22 bp, Homo sapiens
cagcagagaaattacatatttg

SEQ ID NO: 8778479 - DNA, 22 bp, Homo sapiens
cagcagagaaattaaacttctg

SEQ ID NO: 8778480 - DNA, 22 bp, Homo sapiens
cagcagagaaattaaacttctg

SEQ ID NO: 8778481 - DNA, 18 bp, Homo sapiens
cagcagagacattcaaaa

SEQ ID NO: 8778482 - DNA, 18 bp, Homo sapiens
cagcagagacattcaaaa

SEQ ID NO: 8778483 - DNA, 22 bp, Homo sapiens
cagcagagaccaagtgatttga

SEQ ID NO: 8778484 - DNA, 22 bp, Homo sapiens
cagcagagaccaagtgatttga

SEQ ID NO: 8778485 - DNA, 22 bp, Homo sapiens
ggtgtctatgattcagtttatg

SEQ ID NO: 8778486 - DNA, 22 bp, Homo sapiens
ggtgtctgattccaaggccaca

SEQ ID NO: 8778487 - DNA, 22 bp, Homo sapiens
ggtgtctgatggtggcttctca

SEQ ID NO: 8778488 - DNA, 22 bp, Homo sapiens
ggtgtctggacagtgagccagg

SEQ ID NO: 8778489 - DNA, 22 bp, Homo sapiens
ggtgtctgtgatggcatataac

SEQ ID NO: 8778490 - DNA, 22 bp, Homo sapiens
ggtgtctgttgcctcctggtta

SEQ ID NO: 8778491 - DNA, 22 bp, Homo sapiens
ggtgtctgcttccctccagctg

SEQ ID NO: 8778492 - DNA, 22 bp, Homo sapiens
ggtgtctgcttccctccagctg

SEQ ID NO: 8778493 - DNA, 22 bp, Homo sapiens
ggtgtctgcttccctccagctg

SEQ ID NO: 8778494 - DNA, 22 bp, Homo sapiens
ggtgggaaggccactgaaggtt

SEQ ID NO: 8778495 - DNA, 22 bp, Homo sapiens
cagcactgctgctgtacacaca

SEQ ID NO: 8778496 - DNA, 22 bp, Homo sapiens
cagcactgctgctgtacacaca

SEQ ID NO: 8778497 - DNA, 22 bp, Homo sapiens
cagcagaacaggcagggaagct

SEQ ID NO: 8778498 - DNA, 22 bp, Homo sapiens
cagcagaacagttaaagaaacc

SEQ ID NO: 8778499 - DNA, 22 bp, Homo sapiens
cagcagaacagttaaagaaacc

SEQ ID NO: 8778500 - DNA, 22 bp, Homo sapiens
cagcagaagcaacattcaggct

SEQ ID NO: 8778501 - DNA, 22 bp, Homo sapiens
ggtggcagtggtctctgacaga

SEQ ID NO: 8778502 - DNA, 22 bp, Homo sapiens
ggtggcagtgcttgcgggtcta

SEQ ID NO: 8778503 - DNA, 22 bp, Homo sapiens
ggtggctgcttcctcaagagga

SEQ ID NO: 8778504 - DNA, 22 bp, Homo sapiens
ggtggctgcaccctggctaact

SEQ ID NO: 8778505 - DNA, 22 bp, Homo sapiens
ggtggctgcttcctcaagagga

SEQ ID NO: 8778506 - DNA, 22 bp, Homo sapiens
ggtggctgcttcctcaagagga

SEQ ID NO: 8778507 - DNA, 22 bp, Homo sapiens
ggtggctggaggagctgatgga

SEQ ID NO: 8778508 - DNA, 22 bp, Homo sapiens
ggtggctggaggagctgatgga

SEQ ID NO: 8778509 - DNA, 22 bp, Homo sapiens
ggtggcagtgcttgcgggtcta

SEQ ID NO: 8778510 - DNA, 22 bp, Homo sapiens
ggtggctggaggagctgatgga

SEQ ID NO: 8778511 - DNA, 22 bp, Homo sapiens
ggtggctgggattagtagccca

SEQ ID NO: 8778512 - DNA, 22 bp, Homo sapiens
ggtggctgggattagtagccca

SEQ ID NO: 8778513 - DNA, 22 bp, Homo sapiens
ggtggctgggattagtagccca

SEQ ID NO: 8778514 - DNA, 22 bp, Homo sapiens
ggtggctggaggagctgatgga

SEQ ID NO: 8778515 - DNA, 22 bp, Homo sapiens
ggtggctgggattagtagccca

SEQ ID NO: 8778516 - DNA, 22 bp, Homo sapiens
ggtggctgggattagtagccca

SEQ ID NO: 8778517 - DNA, 18 bp, Homo sapiens
ggtggctggggacggaca

SEQ ID NO: 8778518 - DNA, 18 bp, Homo sapiens
ggtggctggggacggaca

SEQ ID NO: 8778519 - DNA, 22 bp, Homo sapiens
ggtggctgggattagtagccca

SEQ ID NO: 8778520 - DNA, 18 bp, Homo sapiens
ggtggctggggacggaca

SEQ ID NO: 8778521 - DNA, 18 bp, Homo sapiens
ggtggctggggacggaca

SEQ ID NO: 8778522 - DNA, 22 bp, Homo sapiens
ggtggctggttttataagaggt

SEQ ID NO: 8778523 - DNA, 22 bp, Homo sapiens
ggtggctgtgagcattatgtga

SEQ ID NO: 8778524 - DNA, 22 bp, Homo sapiens
ggtggctggttttataagaggt

SEQ ID NO: 8778525 - DNA, 22 bp, Homo sapiens
ggtggctgtgagcattatgtga

SEQ ID NO: 8778526 - DNA, 22 bp, Homo sapiens
ggtgctggttcagggtggctgt

SEQ ID NO: 8778527 - DNA, 22 bp, Homo sapiens
ggtggcagggagtgtccctggg

SEQ ID NO: 8778528 - DNA, 16 bp, Homo sapiens
cagatggatctaactc

SEQ ID NO: 8778529 - DNA, 22 bp, Homo sapiens
cagatggagtcccgtggagttc

SEQ ID NO: 8778530 - DNA, 22 bp, Homo sapiens
cagatggattttgtaggctgat

SEQ ID NO: 8778531 - DNA, 22 bp, Homo sapiens
cagatggcaacagctctgtgac

SEQ ID NO: 8778532 - DNA, 22 bp, Homo sapiens
cagatgcttgttggctggtctc

SEQ ID NO: 8778533 - DNA, 22 bp, Homo sapiens
cagatgcttggaggacacttgg

SEQ ID NO: 8778534 - DNA, 22 bp, Homo sapiens
cagatgcttgttggctggtctc

SEQ ID NO: 8778535 - DNA, 22 bp, Homo sapiens
cagatgcttggaggacacttgg

SEQ ID NO: 8778536 - DNA, 22 bp, Homo sapiens
cagatgcttttgattctggggt

SEQ ID NO: 8778537 - DNA, 22 bp, Homo sapiens
cagatggaacacagaaaggaga

SEQ ID NO: 8778538 - DNA, 22 bp, Homo sapiens
cagatggaaggcatagaggttt

SEQ ID NO: 8778539 - DNA, 22 bp, Homo sapiens
cagatggaggataaaacatgca

SEQ ID NO: 8778540 - DNA, 22 bp, Homo sapiens
ggtggcagtcttaagagatctt

SEQ ID NO: 8778541 - DNA, 22 bp, Homo sapiens
ggtggcagtgcttgcgggtcta

SEQ ID NO: 8778542 - DNA, 22 bp, Homo sapiens
ggtggcagtagcactgggcctg

SEQ ID NO: 8778543 - DNA, 22 bp, Homo sapiens
ggtggcagtagcactgggcctg

SEQ ID NO: 8778544 - DNA, 18 bp, Homo sapiens
ggtggcaggtcagatgcc

SEQ ID NO: 8778545 - DNA, 22 bp, Homo sapiens
ggtggcagggagtgtccctggg

SEQ ID NO: 8778546 - DNA, 18 bp, Homo sapiens
ggtggcaggtcagatgcc

SEQ ID NO: 8778547 - DNA, 22 bp, Homo sapiens
gtgcaaaagtaattacagtttt

SEQ ID NO: 8778548 - DNA, 22 bp, Homo sapiens
gtgcaaaagtaatggcagtttt

SEQ ID NO: 8778549 - DNA, 22 bp, Homo sapiens
gtgcaaaagtcattgtggtttt

SEQ ID NO: 8778550 - DNA, 22 bp, Homo sapiens
gtgcaaaagtaattgtggtttt

SEQ ID NO: 8778551 - DNA, 22 bp, Homo sapiens
gtgcaaaagtaattgctgtttt

SEQ ID NO: 8778552 - DNA, 22 bp, Homo sapiens
gtgcaaaagtaattgcagtttt

SEQ ID NO: 8778553 - DNA, 22 bp, Homo sapiens
gtgaagttgattgttatcgtca

SEQ ID NO: 8778554 - DNA, 22 bp, Homo sapiens
gtgaatgccgcagtctgttgct

SEQ ID NO: 8778555 - DNA, 22 bp, Homo sapiens
gtgaatgcaaactgtttctgat

SEQ ID NO: 8778556 - DNA, 22 bp, Homo sapiens
gtgaatatgatcttatttggaa

SEQ ID NO: 8778557 - DNA, 22 bp, Homo sapiens
gtgaatgcaaactgtttctgat

SEQ ID NO: 8778558 - DNA, 22 bp, Homo sapiens
gtgaatggggcaggaaggatgg

SEQ ID NO: 8778559 - DNA, 22 bp, Homo sapiens
gtgcagctgccgatcagatagg

SEQ ID NO: 8778560 - DNA, 22 bp, Homo sapiens
gtgcagctcagttgaaatgcag

SEQ ID NO: 8778561 - DNA, 22 bp, Homo sapiens
gtgcagctgcaggagtcaggtc

SEQ ID NO: 8778562 - DNA, 22 bp, Homo sapiens
gtgcaggagcaggagccatgtc

SEQ ID NO: 8778563 - DNA, 22 bp, Homo sapiens
gtgcagcttcctggtctcagcc

SEQ ID NO: 8778564 - DNA, 22 bp, Homo sapiens
gtgcaaatgtaattgccattga

SEQ ID NO: 8778565 - DNA, 22 bp, Homo sapiens
gtgcaaatgtaattgccattga

SEQ ID NO: 8778566 - DNA, 22 bp, Homo sapiens
gtgcaaatgattctaatgggta

SEQ ID NO: 8778567 - DNA, 22 bp, Homo sapiens
gtgcaaatgtaattgcagtttt

SEQ ID NO: 8778568 - DNA, 22 bp, Homo sapiens
gtgcagcagggggaagacagtg

SEQ ID NO: 8778569 - DNA, 23 bp, Homo sapiens
gtgcagcagtgtctgcagtcatg

SEQ ID NO: 8778570 - DNA, 20 bp, Homo sapiens
gtgcagccaagctgagccgc

SEQ ID NO: 8778571 - DNA, 22 bp, Homo sapiens
gtgcagccatttgcatgcttcc

SEQ ID NO: 8778572 - DNA, 20 bp, Homo sapiens
gtgcagccaagctgagccgc

SEQ ID NO: 8778573 - DNA, 20 bp, Homo sapiens
gtgcagccaagctgagccgc

SEQ ID NO: 8778574 - DNA, 22 bp, Homo sapiens
gtgcaaacatcatagagtgtac

SEQ ID NO: 8778575 - DNA, 22 bp, Homo sapiens
gtgcaaacatcatagagtgtac

SEQ ID NO: 8778576 - DNA, 22 bp, Homo sapiens
gtgcaaatgagatggattcaag

SEQ ID NO: 8778577 - DNA, 18 bp, Homo sapiens
gtgcaaatacttgctgac

SEQ ID NO: 8778578 - DNA, 22 bp, Homo sapiens
gtgcaaagtgcatggggaaggg

SEQ ID NO: 8778579 - DNA, 22 bp, Homo sapiens
gtgcaaaatttggccaataaca

SEQ ID NO: 8778580 - DNA, 22 bp, Homo sapiens
gtgcaaatacatatgctgtgga

SEQ ID NO: 8778581 - DNA, 22 bp, Homo sapiens
gtgaagtcaagaatgcaatttg

SEQ ID NO: 8778582 - DNA, 22 bp, Homo sapiens
gtgaaggtggggagcctcagtt

SEQ ID NO: 8778583 - DNA, 22 bp, Homo sapiens
gtgaaggtgtgtccactgcggc

SEQ ID NO: 8778584 - DNA, 22 bp, Homo sapiens
gtgaaggtgtgagccagctgca

SEQ ID NO: 8778585 - DNA, 22 bp, Homo sapiens
gtgaaggtgggagacaggtgag

SEQ ID NO: 8778586 - DNA, 22 bp, Homo sapiens
gtgaaggtcagtggccctgggg

SEQ ID NO: 8778587 - DNA, 22 bp, Homo sapiens
gtgaaggtagactgggcttcct

SEQ ID NO: 8778588 - DNA, 22 bp, Homo sapiens
gtctttggatgtaagataaagt

SEQ ID NO: 8778589 - DNA, 18 bp, Homo sapiens
gtctttggagtggaggta

SEQ ID NO: 8778590 - DNA, 22 bp, Homo sapiens
gtctttggaggcactgttgagt

SEQ ID NO: 8778591 - DNA, 22 bp, Homo sapiens
gtctttggaaagacaaagttca

SEQ ID NO: 8778592 - DNA, 22 bp, Homo sapiens
gtctttgctgtctttgctctca

SEQ ID NO: 8778593 - DNA, 22 bp, Homo sapiens
gtctttcttcagagcttggact

SEQ ID NO: 8778594 - DNA, 22 bp, Homo sapiens
gtctttggagaggtgccatttc

SEQ ID NO: 8778595 - DNA, 22 bp, Homo sapiens
gtctttctctggaacagtaaaa

SEQ ID NO: 8778596 - DNA, 22 bp, Homo sapiens
gtctttctgccatgtgaagaga

SEQ ID NO: 8778597 - DNA, 22 bp, Homo sapiens
gtctttctgctgcacggactgc

SEQ ID NO: 8778598 - DNA, 22 bp, Homo sapiens
gtctttcttaaacaacagaaca

SEQ ID NO: 8778599 - DNA, 22 bp, Homo sapiens
gtctttcttaaacaacagaaca

SEQ ID NO: 8778600 - DNA, 22 bp, Homo sapiens
gtctcttctttgccggtcctgc

SEQ ID NO: 8778601 - DNA, 22 bp, Homo sapiens
gtctcttatgggcaggagcaca

SEQ ID NO: 8778602 - DNA, 22 bp, Homo sapiens
gtctcttagtcaatattttctg

SEQ ID NO: 8778603 - DNA, 22 bp, Homo sapiens
gtctcttagtctcattttctgc

SEQ ID NO: 8778604 - DNA, 17 bp, Homo sapiens
gtctcttagcaccgtat

SEQ ID NO: 8778605 - DNA, 22 bp, Homo sapiens
gtctcttagaatcgcatattgt

SEQ ID NO: 8778606 - DNA, 22 bp, Homo sapiens
gtctgtttggggacctgtggcc

SEQ ID NO: 8778607 - DNA, 22 bp, Homo sapiens
gtctttctatgcatagagcaga

SEQ ID NO: 8778608 - DNA, 22 bp, Homo sapiens
gtcttaccgcacctcatgaact

SEQ ID NO: 8778609 - DNA, 18 bp, Homo sapiens
gtctcaggagtggcacgt

SEQ ID NO: 8778610 - DNA, 22 bp, Homo sapiens
gtctcagattcagacatctaca

SEQ ID NO: 8778611 - DNA, 22 bp, Homo sapiens
gtctcagagtcctacttattcc

SEQ ID NO: 8778612 - DNA, 22 bp, Homo sapiens
gtctcagtaagaaaggctcctg

SEQ ID NO: 8778613 - DNA, 22 bp, Homo sapiens
gtctcaggttcgagcctcctta

SEQ ID NO: 8778614 - DNA, 20 bp, Homo sapiens
gtctccactgggggttaacc

SEQ ID NO: 8778615 - DNA, 22 bp, Homo sapiens
gtctcatatgatataaatgcag

SEQ ID NO: 8778616 - DNA, 22 bp, Homo sapiens
gtctcagttttccaaactgtca

SEQ ID NO: 8778617 - DNA, 22 bp, Homo sapiens
gtctctgtgcccccatttccgt

SEQ ID NO: 8778618 - DNA, 18 bp, Homo sapiens
gtctctgtgggaattggc

SEQ ID NO: 8778619 - DNA, 22 bp, Homo sapiens
gtctctgtggctggctccttcc

SEQ ID NO: 8778620 - DNA, 22 bp, Homo sapiens
gtctctgtgtctgagagagccc

SEQ ID NO: 8778621 - DNA, 22 bp, Homo sapiens
gtctctgttatttccagggtca

SEQ ID NO: 8778622 - DNA, 21 bp, Homo sapiens
gtctcttaaggctttggctca

SEQ ID NO: 8778623 - DNA, 22 bp, Homo sapiens
gtctcttagaaccttgttttgg

SEQ ID NO: 8778624 - DNA, 22 bp, Homo sapiens
gtctctgggttaagcagtgcat

SEQ ID NO: 8778625 - DNA, 22 bp, Homo sapiens
gtctctgggttaagcagtgcat

SEQ ID NO: 8778626 - DNA, 22 bp, Homo sapiens
gtctctgggtgtgtgatgccaa

SEQ ID NO: 8778627 - DNA, 22 bp, Homo sapiens
gtctctggctttatgctggttt

SEQ ID NO: 8778628 - DNA, 22 bp, Homo sapiens
gtctctgggtgtgtgatgccaa

SEQ ID NO: 8778629 - DNA, 22 bp, Homo sapiens
gtctctgggttaagcagtgcat

SEQ ID NO: 8778630 - DNA, 22 bp, Homo sapiens
cagcatcttctagatccaggct

SEQ ID NO: 8778631 - DNA, 22 bp, Homo sapiens
cagcatcttctagatccaggct

SEQ ID NO: 8778632 - DNA, 22 bp, Homo sapiens
cagcatcttctccaaagctgcc

SEQ ID NO: 8778633 - DNA, 22 bp, Homo sapiens
cagcatcttgaagggtaaacca

SEQ ID NO: 8778634 - DNA, 22 bp, Homo sapiens
cagcatcttcatgtgcatctcc

SEQ ID NO: 8778635 - DNA, 22 bp, Homo sapiens
cagcatcttcatgtgcatctcc

SEQ ID NO: 8778636 - DNA, 18 bp, Homo sapiens
cagcatcttcattaggcc

SEQ ID NO: 8778637 - DNA, 18 bp, Homo sapiens
cagcatcttcattaggcc

SEQ ID NO: 8778638 - DNA, 22 bp, Homo sapiens
gtcctgcaaagttcagcttgct

SEQ ID NO: 8778639 - DNA, 22 bp, Homo sapiens
cagcatcttattttctatggaa

SEQ ID NO: 8778640 - DNA, 22 bp, Homo sapiens
cagcatctttctcttctggagt

SEQ ID NO: 8778641 - DNA, 22 bp, Homo sapiens
cagcatctttataaaaagtaaa

SEQ ID NO: 8778642 - DNA, 22 bp, Homo sapiens
cagcatctttctcttctggagt

SEQ ID NO: 8778643 - DNA, 22 bp, Homo sapiens
cagcatgaaaagtgttgctatc

SEQ ID NO: 8778644 - DNA, 22 bp, Homo sapiens
cagcatgacagtctgcagcaga

SEQ ID NO: 8778645 - DNA, 22 bp, Homo sapiens
cagcatgaccctggagcctgca

SEQ ID NO: 8778646 - DNA, 22 bp, Homo sapiens
cagcatgatgctcacacaaaac

SEQ ID NO: 8778647 - DNA, 22 bp, Homo sapiens
cagcatgatgagtgcagtttgg

SEQ ID NO: 8778648 - DNA, 22 bp, Homo sapiens
cagcatgagggtctccatgcag

SEQ ID NO: 8778649 - DNA, 22 bp, Homo sapiens
gtctcaaactcctaggctaaag

SEQ ID NO: 8778650 - DNA, 22 bp, Homo sapiens
gtctcagaccaccctctttggc

SEQ ID NO: 8778651 - DNA, 22 bp, Homo sapiens
gtcctgtgggcccaccatgagc

SEQ ID NO: 8778652 - DNA, 22 bp, Homo sapiens
gtctcagagagctactctctta

SEQ ID NO: 8778653 - DNA, 22 bp, Homo sapiens
gtctcagagtcctacttattcc

SEQ ID NO: 8778654 - DNA, 22 bp, Homo sapiens
gtcctgtgggagcattgctttg

SEQ ID NO: 8778655 - DNA, 22 bp, Homo sapiens
gtcctgtgggagcattgctttg

SEQ ID NO: 8778656 - DNA, 22 bp, Homo sapiens
gtcctgaatgcctttaggcaga

SEQ ID NO: 8778657 - DNA, 22 bp, Homo sapiens
gtcctgacggctgattggcctg

SEQ ID NO: 8778658 - DNA, 22 bp, Homo sapiens
gtcctgaatgcctttaggcaga

SEQ ID NO: 8778659 - DNA, 22 bp, Homo sapiens
gtcctgagaatactaggcacaa

SEQ ID NO: 8778660 - DNA, 22 bp, Homo sapiens
gtcctgagatgtcacaaggttt

SEQ ID NO: 8778661 - DNA, 22 bp, Homo sapiens
gtcctgagccctcagcacagca

SEQ ID NO: 8778662 - DNA, 22 bp, Homo sapiens
gtcctgaggcaggatgggtttc

SEQ ID NO: 8778663 - DNA, 22 bp, Homo sapiens
gtcctgaggcaggatgggtttc

SEQ ID NO: 8778664 - DNA, 22 bp, Homo sapiens
gtcctgaggcaggatgggtttc

SEQ ID NO: 8778665 - DNA, 22 bp, Homo sapiens
cagcatctgtttttctgaccca

SEQ ID NO: 8778666 - DNA, 22 bp, Homo sapiens
cagcatctgtttttctgaccca

SEQ ID NO: 8778667 - DNA, 22 bp, Homo sapiens
gtcctaaatatagtgattcatg

SEQ ID NO: 8778668 - DNA, 22 bp, Homo sapiens
gtcctaaatatagtgattcatg

SEQ ID NO: 8778669 - DNA, 22 bp, Homo sapiens
gtccggtgcatttcaccaggag

SEQ ID NO: 8778670 - DNA, 22 bp, Homo sapiens
gtccggtgagggggctgcagag

SEQ ID NO: 8778671 - DNA, 22 bp, Homo sapiens
gtcctagagctattaatgtgga

SEQ ID NO: 8778672 - DNA, 22 bp, Homo sapiens
gtcctaatctcttcttataagg

SEQ ID NO: 8778673 - DNA, 22 bp, Homo sapiens
gtcctaccatgaattcactcca

SEQ ID NO: 8778674 - DNA, 22 bp, Homo sapiens
cagcagtggctgcaggcagctg

SEQ ID NO: 8778675 - DNA, 22 bp, Homo sapiens
cagcagtggctgcaggcagctg

SEQ ID NO: 8778676 - DNA, 22 bp, Homo sapiens
cagcagtggctgcaggcagctg

SEQ ID NO: 8778677 - DNA, 22 bp, Homo sapiens
gtcctatattcttttaaaattt

SEQ ID NO: 8778678 - DNA, 22 bp, Homo sapiens
gtcctagtgcctggaagctggg

SEQ ID NO: 8778679 - DNA, 23 bp, Homo sapiens
gtcctagtgcttggtgcccaggc

SEQ ID NO: 8778680 - DNA, 22 bp, Homo sapiens
gtcctctgtgtaggctgcagac

SEQ ID NO: 8778681 - DNA, 22 bp, Homo sapiens
gtcctctgtgtaggctgcagac

SEQ ID NO: 8778682 - DNA, 22 bp, Homo sapiens
gtcctctgtgtaggctgcagac

SEQ ID NO: 8778683 - DNA, 22 bp, Homo sapiens
gtcctctgttagaaatgtgctt

SEQ ID NO: 8778684 - DNA, 22 bp, Homo sapiens
gtcctctgtttccatctgactt

SEQ ID NO: 8778685 - DNA, 22 bp, Homo sapiens
cagcaggtcccactgagggccc

SEQ ID NO: 8778686 - DNA, 22 bp, Homo sapiens
cagcaggtctcagcagctcctt

SEQ ID NO: 8778687 - DNA, 22 bp, Homo sapiens
cagcagagctgtgtgggaaggg

SEQ ID NO: 8778688 - DNA, 22 bp, Homo sapiens
cagcagagctgggctttgaatt

SEQ ID NO: 8778689 - DNA, 22 bp, Homo sapiens
cagcagggaagctgtgctgttt

SEQ ID NO: 8778690 - DNA, 22 bp, Homo sapiens
cagcagggaagctgtgctgttt

SEQ ID NO: 8778691 - DNA, 22 bp, Homo sapiens
cagcagggttaagtgactcacc

SEQ ID NO: 8778692 - DNA, 22 bp, Homo sapiens
cagcagggttaagtgactcacc

SEQ ID NO: 8778693 - DNA, 22 bp, Homo sapiens
cagcagggttaagtgactcacc

SEQ ID NO: 8778694 - DNA, 22 bp, Homo sapiens
cagcagagcatttggtaggagg

SEQ ID NO: 8778695 - DNA, 22 bp, Homo sapiens
cagcagagcatttggtaggagg

SEQ ID NO: 8778696 - DNA, 22 bp, Homo sapiens
cagcagagcatttggtaggagg

SEQ ID NO: 8778697 - DNA, 22 bp, Homo sapiens
cagcagagcatttggtaggagg

SEQ ID NO: 8778698 - DNA, 22 bp, Homo sapiens
cagcagagctgggctttgaatt

SEQ ID NO: 8778699 - DNA, 22 bp, Homo sapiens
cagcagagctgggctttgaatt

SEQ ID NO: 8778700 - DNA, 22 bp, Homo sapiens
cagcagagctgggaataaaatt

SEQ ID NO: 8778701 - DNA, 22 bp, Homo sapiens
cagcagagctgggaataaaatt

SEQ ID NO: 8778702 - DNA, 22 bp, Homo sapiens
cagcagagacggtaagcagaac

SEQ ID NO: 8778703 - DNA, 22 bp, Homo sapiens
cagcagagacggtaagcagaac

SEQ ID NO: 8778704 - DNA, 22 bp, Homo sapiens
cagcagagacggtaagcagaac

SEQ ID NO: 8778705 - DNA, 22 bp, Homo sapiens
cagcagagacggtaagcagaac

SEQ ID NO: 8778706 - DNA, 22 bp, Homo sapiens
cagcagagacggtaagcagaac

SEQ ID NO: 8778707 - DNA, 23 bp, Homo sapiens
cagcagagagcagacctttgtgt

SEQ ID NO: 8778708 - DNA, 23 bp, Homo sapiens
cagcagagagcagacctttgtgt

SEQ ID NO: 8778709 - DNA, 22 bp, Homo sapiens
cagcagagatgagattcctata

SEQ ID NO: 8778710 - DNA, 22 bp, Homo sapiens
cagcaggttaacagaggctggt

SEQ ID NO: 8778711 - DNA, 22 bp, Homo sapiens
cagcagtaattagtgctgcatg

SEQ ID NO: 8778712 - DNA, 22 bp, Homo sapiens
cagcagtacttctcagaggtat

SEQ ID NO: 8778713 - DNA, 22 bp, Homo sapiens
cagcaggtggacacactcacct

SEQ ID NO: 8778714 - DNA, 21 bp, Homo sapiens
cagcaggtggagcctcttgtc

SEQ ID NO: 8778715 - DNA, 22 bp, Homo sapiens
cagcaggtgctgcctgtcaccc

SEQ ID NO: 8778716 - DNA, 22 bp, Homo sapiens
cagcaggtgcaggtgcggccgc

SEQ ID NO: 8778717 - DNA, 22 bp, Homo sapiens
cagcaggtggacacactcacct

SEQ ID NO: 8778718 - DNA, 22 bp, Homo sapiens
cagcaggtcttgttgctgctga

SEQ ID NO: 8778719 - DNA, 22 bp, Homo sapiens
cagcaggtgcaggtgcggccgc

SEQ ID NO: 8778720 - DNA, 22 bp, Homo sapiens
cagcagtgcttcagtgtgagat

SEQ ID NO: 8778721 - DNA, 22 bp, Homo sapiens
cagcagtggaactacccaggga

SEQ ID NO: 8778722 - DNA, 22 bp, Homo sapiens
cagcagtggctgcaggcagctg

SEQ ID NO: 8778723 - DNA, 22 bp, Homo sapiens
cagcagtggccatctgtgtggt

SEQ ID NO: 8778724 - DNA, 23 bp, Homo sapiens
cagctccagtgcactcaggtagc

SEQ ID NO: 8778725 - DNA, 22 bp, Homo sapiens
cagctccagctctgggcgcctc

SEQ ID NO: 8778726 - DNA, 22 bp, Homo sapiens
cagctccagctctgggcgcctc

SEQ ID NO: 8778727 - DNA, 22 bp, Homo sapiens
cagctccagcccaggcagctcc

SEQ ID NO: 8778728 - DNA, 22 bp, Homo sapiens
cagctcccagtggcagctcctt

SEQ ID NO: 8778729 - DNA, 22 bp, Homo sapiens
cagctccccatggttcctgaag

SEQ ID NO: 8778730 - DNA, 22 bp, Homo sapiens
cagctcccagtggcagctcctt

SEQ ID NO: 8778731 - DNA, 22 bp, Homo sapiens
cagctcccagagtgaccagcag

SEQ ID NO: 8778732 - DNA, 22 bp, Homo sapiens
cagctcccagagtgaccagcag

SEQ ID NO: 8778733 - DNA, 22 bp, Homo sapiens
cagctcagcttcctgggtgtgt

SEQ ID NO: 8778734 - DNA, 22 bp, Homo sapiens
gtgctgaggtgggtgggcagcc

SEQ ID NO: 8778735 - DNA, 22 bp, Homo sapiens
gtgctgaggtgggtgggcagcc

SEQ ID NO: 8778736 - DNA, 22 bp, Homo sapiens
gtgctgaggtgggtgggcagcc

SEQ ID NO: 8778737 - DNA, 21 bp, Homo sapiens
cagctccactaaagcagctgt

SEQ ID NO: 8778738 - DNA, 22 bp, Homo sapiens
cagctccacttgagtggggcct

SEQ ID NO: 8778739 - DNA, 22 bp, Homo sapiens
cagctccacttgagtggggcct

SEQ ID NO: 8778740 - DNA, 21 bp, Homo sapiens
cagctccactaaagcagctgt

SEQ ID NO: 8778741 - DNA, 22 bp, Homo sapiens
cagctccagcccaggcagctcc

SEQ ID NO: 8778742 - DNA, 22 bp, Homo sapiens
cagctccagcccaggcagctcc

SEQ ID NO: 8778743 - DNA, 22 bp, Homo sapiens
cagctccagcccaggcagctcc

SEQ ID NO: 8778744 - DNA, 22 bp, Homo sapiens
cagctccagcccaggcagctcc

SEQ ID NO: 8778745 - DNA, 22 bp, Homo sapiens
cagctccagccaccggggggtg

SEQ ID NO: 8778746 - DNA, 22 bp, Homo sapiens
gtgcctggtatgtaggtagcgg

SEQ ID NO: 8778747 - DNA, 22 bp, Homo sapiens
gtgcctggggttgagctatgaa

SEQ ID NO: 8778748 - DNA, 22 bp, Homo sapiens
gtgcctggtttggggaatgttc

SEQ ID NO: 8778749 - DNA, 22 bp, Homo sapiens
gtgctgagaattgatgtccttg

SEQ ID NO: 8778750 - DNA, 22 bp, Homo sapiens
gtgctgagagtttattatgata

SEQ ID NO: 8778751 - DNA, 22 bp, Homo sapiens
gtgcctgtgccaggggtgtgct

SEQ ID NO: 8778752 - DNA, 22 bp, Homo sapiens
gtgcctgtaagttgtatgggct

SEQ ID NO: 8778753 - DNA, 22 bp, Homo sapiens
gtgcctggtttggggagtgttc

SEQ ID NO: 8778754 - DNA, 22 bp, Homo sapiens
gtgctgagattacaggtgtgag

SEQ ID NO: 8778755 - DNA, 22 bp, Homo sapiens
gtgctgagattggagtgagcag

SEQ ID NO: 8778756 - DNA, 22 bp, Homo sapiens
gtgctgagattggagtgagcag

SEQ ID NO: 8778757 - DNA, 22 bp, Homo sapiens
gtgctgagattacaggtgtgag

SEQ ID NO: 8778758 - DNA, 22 bp, Homo sapiens
gtgctgagattacaggtgtgag

SEQ ID NO: 8778759 - DNA, 19 bp, Homo sapiens
gtgctgagatgtggtacta

SEQ ID NO: 8778760 - DNA, 22 bp, Homo sapiens
gtgctgagattacaggtgtgag

SEQ ID NO: 8778761 - DNA, 22 bp, Homo sapiens
gtgctgagcacaaggcccagag

SEQ ID NO: 8778762 - DNA, 22 bp, Homo sapiens
gtgctgagcacaaggcccagag

SEQ ID NO: 8778763 - DNA, 22 bp, Homo sapiens
gtgctgagcacagctgcccagg

SEQ ID NO: 8778764 - DNA, 22 bp, Homo sapiens
gtgctgagcacaccttggagca

SEQ ID NO: 8778765 - DNA, 22 bp, Homo sapiens
gtgctgaggatacagctgtgaa

SEQ ID NO: 8778766 - DNA, 22 bp, Homo sapiens
gtgctgaggatacagctgtgaa

SEQ ID NO: 8778767 - DNA, 21 bp, Homo sapiens
gtgctgaggatacagtagtaa

SEQ ID NO: 8778768 - DNA, 21 bp, Homo sapiens
gtgctgaggatacagtagtaa

SEQ ID NO: 8778769 - DNA, 22 bp, Homo sapiens
gtgctgaggatacagctgtgaa

SEQ ID NO: 8778770 - DNA, 21 bp, Homo sapiens
gtgctgaggatacagtagtaa

SEQ ID NO: 8778771 - DNA, 22 bp, Homo sapiens
gtgctgaggccaatgtcagggt

SEQ ID NO: 8778772 - DNA, 22 bp, Homo sapiens
gtgctgaggccaatgtcagggt

SEQ ID NO: 8778773 - DNA, 22 bp, Homo sapiens
gtgctgagctgcagatgcgctc

SEQ ID NO: 8778774 - DNA, 22 bp, Homo sapiens
gtgctgagcatcatgaggcact

SEQ ID NO: 8778775 - DNA, 22 bp, Homo sapiens
gtgctgagcatcatgaggcact

SEQ ID NO: 8778776 - DNA, 22 bp, Homo sapiens
gtgctgagcatcatgaggcact

SEQ ID NO: 8778777 - DNA, 22 bp, Homo sapiens
gtgcctgggggtaatgtaggat

SEQ ID NO: 8778778 - DNA, 22 bp, Homo sapiens
gtgcctgggggtaatgtaggat

SEQ ID NO: 8778779 - DNA, 22 bp, Homo sapiens
gtgcctggggttgagctatgaa

SEQ ID NO: 8778780 - DNA, 22 bp, Homo sapiens
gtgcctgggcatgagcttgttg

SEQ ID NO: 8778781 - DNA, 22 bp, Homo sapiens
gtgcctgggacttgctccggat

SEQ ID NO: 8778782 - DNA, 22 bp, Homo sapiens
gtgcctgggacttgctccggat

SEQ ID NO: 8778783 - DNA, 22 bp, Homo sapiens
gtgcctgggacttgctccggat

SEQ ID NO: 8778784 - DNA, 20 bp, Homo sapiens
cagcctccactcactcagct

SEQ ID NO: 8778785 - DNA, 19 bp, Homo sapiens
cagcctcaatccctcgggc

SEQ ID NO: 8778786 - DNA, 22 bp, Homo sapiens
gtgccctgaaagagttaattca

SEQ ID NO: 8778787 - DNA, 22 bp, Homo sapiens
gtgccctgacacacctggtgtg

SEQ ID NO: 8778788 - DNA, 22 bp, Homo sapiens
gtgcctgggacacagcagatac

SEQ ID NO: 8778789 - DNA, 20 bp, Homo sapiens
cagccctttatcctcctatg

SEQ ID NO: 8778790 - DNA, 22 bp, Homo sapiens
cagccctttccttctcagcttt

SEQ ID NO: 8778791 - DNA, 22 bp, Homo sapiens
cagcctaacccatctgatgcag

SEQ ID NO: 8778792 - DNA, 20 bp, Homo sapiens
cagccctttatcctcctatg

SEQ ID NO: 8778793 - DNA, 22 bp, Homo sapiens
cagccctgttgcgcttccggcg

SEQ ID NO: 8778794 - DNA, 22 bp, Homo sapiens
cagccctgttgcgcttccggcg

SEQ ID NO: 8778795 - DNA, 22 bp, Homo sapiens
cagcccttaagagtcatccctc

SEQ ID NO: 8778796 - DNA, 22 bp, Homo sapiens
cagcccttaagagtcatccctc

SEQ ID NO: 8778797 - DNA, 22 bp, Homo sapiens
cagcccttgcgacaccctggct

SEQ ID NO: 8778798 - DNA, 22 bp, Homo sapiens
gtgcaggagcttctggcctgac

SEQ ID NO: 8778799 - DNA, 22 bp, Homo sapiens
gtgcaggagctcccgcagtggt

SEQ ID NO: 8778800 - DNA, 22 bp, Homo sapiens
gtgcaggagccaggggtaggaa

SEQ ID NO: 8778801 - DNA, 22 bp, Homo sapiens
gtgcaggagcttctggcctgac

SEQ ID NO: 8778802 - DNA, 22 bp, Homo sapiens
gtgcatgaagactcagaaagtc

SEQ ID NO: 8778803 - DNA, 22 bp, Homo sapiens
gtgcatgcacacatgtgtgagg

SEQ ID NO: 8778804 - DNA, 22 bp, Homo sapiens
gtgcatggggagggaagcgctc

SEQ ID NO: 8778805 - DNA, 22 bp, Homo sapiens
gtgcatggccagggtggtctgg

SEQ ID NO: 8778806 - DNA, 21 bp, Homo sapiens
gtgcatggagaaaggcttgct

SEQ ID NO: 8778807 - DNA, 18 bp, Homo sapiens
gtgcatgcatgctctgcc

SEQ ID NO: 8778808 - DNA, 22 bp, Homo sapiens
gtgcatgcagtaagtgttttaa

SEQ ID NO: 8778809 - DNA, 22 bp, Homo sapiens
gtgcatggtaagatgcttcaca

SEQ ID NO: 8778810 - DNA, 22 bp, Homo sapiens
gtgcatggtaagatgcttcaca

SEQ ID NO: 8778811 - DNA, 22 bp, Homo sapiens
gtgcatggtaagatgcttcaca

SEQ ID NO: 8778812 - DNA, 22 bp, Homo sapiens
cagccctgtgctaagcaccctc

SEQ ID NO: 8778813 - DNA, 22 bp, Homo sapiens
cagccctgtgctaagcaccctc

SEQ ID NO: 8778814 - DNA, 22 bp, Homo sapiens
cagccctgtgcggagggccctg

SEQ ID NO: 8778815 - DNA, 22 bp, Homo sapiens
cagccctgtgcggagggccctg

SEQ ID NO: 8778816 - DNA, 22 bp, Homo sapiens
cagccctgtgcggagggccctg

SEQ ID NO: 8778817 - DNA, 22 bp, Homo sapiens
gtgcattattcttacctttctt

SEQ ID NO: 8778818 - DNA, 22 bp, Homo sapiens
gtgcattaggctggaatgttga

SEQ ID NO: 8778819 - DNA, 22 bp, Homo sapiens
gtgcattagtttcctattgctg

SEQ ID NO: 8778820 - DNA, 22 bp, Homo sapiens
gtgcattacatgtaataaaata

SEQ ID NO: 8778821 - DNA, 22 bp, Homo sapiens
gtgcattaacaacccagaactc

SEQ ID NO: 8778822 - DNA, 17 bp, Homo sapiens
cagctctgcagacttcc

SEQ ID NO: 8778823 - DNA, 17 bp, Homo sapiens
cagctctgcagacttcc

SEQ ID NO: 8778824 - DNA, 22 bp, Homo sapiens
cagctcctgcagctggctccca

SEQ ID NO: 8778825 - DNA, 22 bp, Homo sapiens
cagctcctgcagctgctgccgt

SEQ ID NO: 8778826 - DNA, 22 bp, Homo sapiens
cagctcctgaggactgctggga

SEQ ID NO: 8778827 - DNA, 22 bp, Homo sapiens
cagctctgaggaacactccttt

SEQ ID NO: 8778828 - DNA, 22 bp, Homo sapiens
cagctctgaggaacactccttt

SEQ ID NO: 8778829 - DNA, 21 bp, Homo sapiens
cagctctgagatttctactag

SEQ ID NO: 8778830 - DNA, 21 bp, Homo sapiens
cagctctgagatttctactag

SEQ ID NO: 8778831 - DNA, 22 bp, Homo sapiens
cagctctgagactgaggctatg

SEQ ID NO: 8778832 - DNA, 22 bp, Homo sapiens
cagctctgatgaaatgtaccag

SEQ ID NO: 8778833 - DNA, 22 bp, Homo sapiens
cagctcccctctgtggggcagt

SEQ ID NO: 8778834 - DNA, 22 bp, Homo sapiens
cagctcccctctgtggggcagt

SEQ ID NO: 8778835 - DNA, 22 bp, Homo sapiens
cagctcccctctgtggggcagt

SEQ ID NO: 8778836 - DNA, 22 bp, Homo sapiens
cagctcccgccatcgggaggca

SEQ ID NO: 8778837 - DNA, 22 bp, Homo sapiens
cagctccctatggtgaggcgac

SEQ ID NO: 8778838 - DNA, 22 bp, Homo sapiens
cagctcctattagacactgaat

SEQ ID NO: 8778839 - DNA, 22 bp, Homo sapiens
cagctcctctgttagccctggg

SEQ ID NO: 8778840 - DNA, 22 bp, Homo sapiens
cagctcctctgttagccctggg

SEQ ID NO: 8778841 - DNA, 22 bp, Homo sapiens
cagctcctctggccagccctgc

SEQ ID NO: 8778842 - DNA, 22 bp, Homo sapiens
cagctcctcagccctgccttgg

SEQ ID NO: 8778843 - DNA, 22 bp, Homo sapiens
cagctcctcacgagtcttgaaa

SEQ ID NO: 8778844 - DNA, 22 bp, Homo sapiens
cagctcctcacgagtcttgaaa

SEQ ID NO: 8778845 - DNA, 22 bp, Homo sapiens
ggaacacagtgccttacaaact

SEQ ID NO: 8778846 - DNA, 22 bp, Homo sapiens
ggaacactcagtaattcagata

SEQ ID NO: 8778847 - DNA, 22 bp, Homo sapiens
ggaacactcagtaattcagata

SEQ ID NO: 8778848 - DNA, 22 bp, Homo sapiens
ggaacacaaatgggagagctgg

SEQ ID NO: 8778849 - DNA, 22 bp, Homo sapiens
ggaacacaaatgggagagctgg

SEQ ID NO: 8778850 - DNA, 17 bp, Homo sapiens
ggaacaaatactatgca

SEQ ID NO: 8778851 - DNA, 22 bp, Homo sapiens
ggaaacaaaccactcatggtgg

SEQ ID NO: 8778852 - DNA, 22 bp, Homo sapiens
ggaaatgtcatagaaatataag

SEQ ID NO: 8778853 - DNA, 22 bp, Homo sapiens
gcttccagggctcagtcactgc

SEQ ID NO: 8778854 - DNA, 22 bp, Homo sapiens
ggaaaatttccttcaaaatgtg

SEQ ID NO: 8778855 - DNA, 22 bp, Homo sapiens
ggaaacaaaccactcatggtgg

SEQ ID NO: 8778856 - DNA, 20 bp, Homo sapiens
gcttccaggagggctgatat

SEQ ID NO: 8778857 - DNA, 20 bp, Homo sapiens
gcttccaggagggctgatat

SEQ ID NO: 8778858 - DNA, 20 bp, Homo sapiens
gcttccaggcccggaaaacc

SEQ ID NO: 8778859 - DNA, 20 bp, Homo sapiens
gcttccaggcccggaaaacc

SEQ ID NO: 8778860 - DNA, 20 bp, Homo sapiens
gcttccaggcccggaaaacc

SEQ ID NO: 8778861 - DNA, 22 bp, Homo sapiens
gcttccaggcttcctacctttg

SEQ ID NO: 8778862 - DNA, 22 bp, Homo sapiens
gcttccagggctcagtcactgc

SEQ ID NO: 8778863 - DNA, 22 bp, Homo sapiens
gcttccagggctcagtcactgc

SEQ ID NO: 8778864 - DNA, 22 bp, Homo sapiens
gcttccaggcttcctacctttg

SEQ ID NO: 8778865 - DNA, 20 bp, Homo sapiens
gcttccaggagggctgatat

SEQ ID NO: 8778866 - DNA, 20 bp, Homo sapiens
gcttccaggagggctgatat

SEQ ID NO: 8778867 - DNA, 22 bp, Homo sapiens
gcttccagccttttctcctctg

SEQ ID NO: 8778868 - DNA, 22 bp, Homo sapiens
gcttccagccttttctcctctg

SEQ ID NO: 8778869 - DNA, 19 bp, Homo sapiens
gcttccagcactgcaggag

SEQ ID NO: 8778870 - DNA, 19 bp, Homo sapiens
gcttccagcactgcaggag

SEQ ID NO: 8778871 - DNA, 22 bp, Homo sapiens
gcttccagcaccagcagagggg

SEQ ID NO: 8778872 - DNA, 22 bp, Homo sapiens
gcttccagcaccagcagagggg

SEQ ID NO: 8778873 - DNA, 22 bp, Homo sapiens
gcttccagcaccagcagagggg

SEQ ID NO: 8778874 - DNA, 19 bp, Homo sapiens
gcttccagcactgcaggag

SEQ ID NO: 8778875 - DNA, 21 bp, Homo sapiens
caatggcgagatcttggctca

SEQ ID NO: 8778876 - DNA, 22 bp, Homo sapiens
caatggatattttatgtgagaa

SEQ ID NO: 8778877 - DNA, 22 bp, Homo sapiens
caatggcactgcccaaagagaa

SEQ ID NO: 8778878 - DNA, 22 bp, Homo sapiens
caatggcactgcccaaagagaa

SEQ ID NO: 8778879 - DNA, 22 bp, Homo sapiens
caatggcactgcccaaagagaa

SEQ ID NO: 8778880 - DNA, 22 bp, Homo sapiens
caatgctgtgctcctcatgagg

SEQ ID NO: 8778881 - DNA, 22 bp, Homo sapiens
caatgcttcaggctccttatag

SEQ ID NO: 8778882 - DNA, 22 bp, Homo sapiens
caatgcttctcattagccaatg

SEQ ID NO: 8778883 - DNA, 22 bp, Homo sapiens
caatgcccctgagggctgcacc

SEQ ID NO: 8778884 - DNA, 22 bp, Homo sapiens
caatgctaggcagatcctgcgt

SEQ ID NO: 8778885 - DNA, 22 bp, Homo sapiens
caatgctttatttcctcccctt

SEQ ID NO: 8778886 - DNA, 22 bp, Homo sapiens
caatgcttctcattagccaatg

SEQ ID NO: 8778887 - DNA, 23 bp, Homo sapiens
gcttccagaagactcattgacat

SEQ ID NO: 8778888 - DNA, 22 bp, Homo sapiens
gcttccacctactaaatgccac

SEQ ID NO: 8778889 - DNA, 22 bp, Homo sapiens
gcttccagaatgactaggatgt

SEQ ID NO: 8778890 - DNA, 22 bp, Homo sapiens
gcttccagaatgactaggatgt

SEQ ID NO: 8778891 - DNA, 22 bp, Homo sapiens
gcttccagaccccagtccctca

SEQ ID NO: 8778892 - DNA, 22 bp, Homo sapiens
caatgtaaatattttctaatca

SEQ ID NO: 8778893 - DNA, 22 bp, Homo sapiens
caatgtaaatattttctaatca

SEQ ID NO: 8778894 - DNA, 22 bp, Homo sapiens
caatgtactacaaagattgtca

SEQ ID NO: 8778895 - DNA, 22 bp, Homo sapiens
caatgtacaaaataattacaca

SEQ ID NO: 8778896 - DNA, 22 bp, Homo sapiens
caatgtacaaaataattacaca

SEQ ID NO: 8778897 - DNA, 22 bp, Homo sapiens
gcttccagatcccatgctctta

SEQ ID NO: 8778898 - DNA, 23 bp, Homo sapiens
gcttccagaagactcattgacat

SEQ ID NO: 8778899 - DNA, 22 bp, Homo sapiens
gcttccagatcccatgctctta

SEQ ID NO: 8778900 - DNA, 22 bp, Homo sapiens
gcttccagcaaacactggctgc

SEQ ID NO: 8778901 - DNA, 22 bp, Homo sapiens
gcttccagcaaacactggctgc

SEQ ID NO: 8778902 - DNA, 20 bp, Homo sapiens
gcttccagaggaggccccgt

SEQ ID NO: 8778903 - DNA, 20 bp, Homo sapiens
gcttccagaggaggccccgt

SEQ ID NO: 8778904 - DNA, 20 bp, Homo sapiens
gcttccagaggaggccccgt

SEQ ID NO: 8778905 - DNA, 22 bp, Homo sapiens
gcttccagaccccagtccctca

SEQ ID NO: 8778906 - DNA, 22 bp, Homo sapiens
gcttccagaccccagtccctca

SEQ ID NO: 8778907 - DNA, 22 bp, Homo sapiens
gcttccagacgatcatgtaaga

SEQ ID NO: 8778908 - DNA, 22 bp, Homo sapiens
gcttccagacgatcatgtaaga

SEQ ID NO: 8778909 - DNA, 22 bp, Homo sapiens
gcttccagacgatcatgtaaga

SEQ ID NO: 8778910 - DNA, 22 bp, Homo sapiens
gcttccagagagccccgcctgg

SEQ ID NO: 8778911 - DNA, 22 bp, Homo sapiens
gcttccagagagccccgcctgg

SEQ ID NO: 8778912 - DNA, 22 bp, Homo sapiens
gcttccagagactgagctcttc

SEQ ID NO: 8778913 - DNA, 22 bp, Homo sapiens
gcttccagagactgagctcttc

SEQ ID NO: 8778914 - DNA, 22 bp, Homo sapiens
caagttatcagggcagttagag

SEQ ID NO: 8778915 - DNA, 22 bp, Homo sapiens
caagttcacatgcatccttgct

SEQ ID NO: 8778916 - DNA, 22 bp, Homo sapiens
caagttcaagtcctggctctgc

SEQ ID NO: 8778917 - DNA, 22 bp, Homo sapiens
caagttcaagtcctggctctgc

SEQ ID NO: 8778918 - DNA, 20 bp, Homo sapiens
caagttcaccttctcctctc

SEQ ID NO: 8778919 - DNA, 22 bp, Homo sapiens
caagttcacatgcatccttgct

SEQ ID NO: 8778920 - DNA, 22 bp, Homo sapiens
caagttcacatgcatccttgct

SEQ ID NO: 8778921 - DNA, 22 bp, Homo sapiens
caagttcaagtcctggctctgc

SEQ ID NO: 8778922 - DNA, 22 bp, Homo sapiens
caagttcacgttgctttttgag

SEQ ID NO: 8778923 - DNA, 22 bp, Homo sapiens
caagttcacgttgctttttgag

SEQ ID NO: 8778924 - DNA, 22 bp, Homo sapiens
caagttcacgttgctttttgag

SEQ ID NO: 8778925 - DNA, 20 bp, Homo sapiens
caagttcaccttctcctctc

SEQ ID NO: 8778926 - DNA, 22 bp, Homo sapiens
caagttcattgtagcattattg

SEQ ID NO: 8778927 - DNA, 22 bp, Homo sapiens
caagttcattgtagcattattg

SEQ ID NO: 8778928 - DNA, 22 bp, Homo sapiens
caagttcattgtagcattattg

SEQ ID NO: 8778929 - DNA, 21 bp, Homo sapiens
caagttcagaaggttgggctg

SEQ ID NO: 8778930 - DNA, 22 bp, Homo sapiens
caagttcacttgtctacaaggg

SEQ ID NO: 8778931 - DNA, 21 bp, Homo sapiens
caagttcagaaggttgggctg

SEQ ID NO: 8778932 - DNA, 22 bp, Homo sapiens
caagttcacttgtctacaaggg

SEQ ID NO: 8778933 - DNA, 22 bp, Homo sapiens
caagttgctctgcctctgtagg

SEQ ID NO: 8778934 - DNA, 22 bp, Homo sapiens
caagttgtgaatgacagacttc

SEQ ID NO: 8778935 - DNA, 22 bp, Homo sapiens
caagttgtgaatgacagacttc

SEQ ID NO: 8778936 - DNA, 22 bp, Homo sapiens
caagttgtttaggaggtgttgt

SEQ ID NO: 8778937 - DNA, 22 bp, Homo sapiens
caagtgtcttcaaaggctaaaa

SEQ ID NO: 8778938 - DNA, 22 bp, Homo sapiens
caagtgtgactattttttcata

SEQ ID NO: 8778939 - DNA, 22 bp, Homo sapiens
caagtgtctatatcagtgcttg

SEQ ID NO: 8778940 - DNA, 22 bp, Homo sapiens
caagtggggcagattctcttcc

SEQ ID NO: 8778941 - DNA, 22 bp, Homo sapiens
caagttaattggtattttgatc

SEQ ID NO: 8778942 - DNA, 22 bp, Homo sapiens
caagttaatatatagaattttg

SEQ ID NO: 8778943 - DNA, 22 bp, Homo sapiens
caagttaaatttgcatttcaga

SEQ ID NO: 8778944 - DNA, 22 bp, Homo sapiens
caagttaatatatagaattttg

SEQ ID NO: 8778945 - DNA, 22 bp, Homo sapiens
caagttaaatttgcatttcaga

SEQ ID NO: 8778946 - DNA, 19 bp, Homo sapiens
caagttaaaatgaggtcat

SEQ ID NO: 8778947 - DNA, 22 bp, Homo sapiens
caagtcacatggccaactgatg

SEQ ID NO: 8778948 - DNA, 22 bp, Homo sapiens
gctgggctcaccaggccactag

SEQ ID NO: 8778949 - DNA, 22 bp, Homo sapiens
caagtcaatgattataagagtc

SEQ ID NO: 8778950 - DNA, 22 bp, Homo sapiens
caagtgtccatgatagtcttag

SEQ ID NO: 8778951 - DNA, 22 bp, Homo sapiens
caagtgtccatgatagtcttag

SEQ ID NO: 8778952 - DNA, 20 bp, Homo sapiens
caagtgtagaaactaataag

SEQ ID NO: 8778953 - DNA, 22 bp, Homo sapiens
caagtgggacctgtctgattcc

SEQ ID NO: 8778954 - DNA, 22 bp, Homo sapiens
caagtggtttatgggagttcca

SEQ ID NO: 8778955 - DNA, 22 bp, Homo sapiens
caagtgcacacacatcctgtgc

SEQ ID NO: 8778956 - DNA, 22 bp, Homo sapiens
caatctctggtgcttctgagag

SEQ ID NO: 8778957 - DNA, 22 bp, Homo sapiens
caatgcaagcaagatggtcaca

SEQ ID NO: 8778958 - DNA, 22 bp, Homo sapiens
caatgcaatgcaatgcaatgca

SEQ ID NO: 8778959 - DNA, 22 bp, Homo sapiens
caatgcaatgcaatgcaatgca

SEQ ID NO: 8778960 - DNA, 22 bp, Homo sapiens
caatgcacatggacatcaggct

SEQ ID NO: 8778961 - DNA, 22 bp, Homo sapiens
caatgcaagcaagatggtcaca

SEQ ID NO: 8778962 - DNA, 22 bp, Homo sapiens
gctggttagaaaacagagctca

SEQ ID NO: 8778963 - DNA, 22 bp, Homo sapiens
gctggttcacctggctcctccc

SEQ ID NO: 8778964 - DNA, 22 bp, Homo sapiens
gctggtgtctaacctggctctt

SEQ ID NO: 8778965 - DNA, 22 bp, Homo sapiens
gctggtggttaccgtgctaatg

SEQ ID NO: 8778966 - DNA, 22 bp, Homo sapiens
gctggtggtgggccagttctgt

SEQ ID NO: 8778967 - DNA, 22 bp, Homo sapiens
gctggtggcagagacatcaggt

SEQ ID NO: 8778968 - DNA, 22 bp, Homo sapiens
gctggtggcagagctccgcggc

SEQ ID NO: 8778969 - DNA, 20 bp, Homo sapiens
gctggtgggggcttgacatg

SEQ ID NO: 8778970 - DNA, 20 bp, Homo sapiens
gctggtgggggcttgacatg

SEQ ID NO: 8778971 - DNA, 20 bp, Homo sapiens
gctggtgggggcttgacatg

SEQ ID NO: 8778972 - DNA, 22 bp, Homo sapiens
gctggtggtaaggaggaaaaag

SEQ ID NO: 8778973 - DNA, 22 bp, Homo sapiens
gctggtggtaaggaggaaaaag

SEQ ID NO: 8778974 - DNA, 22 bp, Homo sapiens
gctggtgagattttatgtttcc

SEQ ID NO: 8778975 - DNA, 22 bp, Homo sapiens
gctggtgagattttatgtttcc

SEQ ID NO: 8778976 - DNA, 22 bp, Homo sapiens
gctggtgagcaaaggagaagga

SEQ ID NO: 8778977 - DNA, 22 bp, Homo sapiens
gctggtgattgcctcaggaggc

SEQ ID NO: 8778978 - DNA, 22 bp, Homo sapiens
caagtttaaggcactgataagt

SEQ ID NO: 8778979 - DNA, 22 bp, Homo sapiens
gctggtcccaatgtgtttcctt

SEQ ID NO: 8778980 - DNA, 22 bp, Homo sapiens
gctggtcctcaagggcacagcc

SEQ ID NO: 8778981 - DNA, 22 bp, Homo sapiens
caaatttaagtgaggtctttgt

SEQ ID NO: 8778982 - DNA, 22 bp, Homo sapiens
caaatttaagtgaggtctttgt

SEQ ID NO: 8778983 - DNA, 22 bp, Homo sapiens
caaattgctaactgtcagacta

SEQ ID NO: 8778984 - DNA, 22 bp, Homo sapiens
caaatttaagttagaaagcaat

SEQ ID NO: 8778985 - DNA, 22 bp, Homo sapiens
caaatttaagttagaaagcaat

SEQ ID NO: 8778986 - DNA, 22 bp, Homo sapiens
caaatttaagttagaaagcaat

SEQ ID NO: 8778987 - DNA, 22 bp, Homo sapiens
caaatttaagttagaaagcaat

SEQ ID NO: 8778988 - DNA, 18 bp, Homo sapiens
caaattctcattgatttc

SEQ ID NO: 8778989 - DNA, 18 bp, Homo sapiens
caaattcagtgctggaag

SEQ ID NO: 8778990 - DNA, 22 bp, Homo sapiens
caaattcagaaaattggtagag

SEQ ID NO: 8778991 - DNA, 22 bp, Homo sapiens
caaattcagaaaattggtagag

SEQ ID NO: 8778992 - DNA, 18 bp, Homo sapiens
caaattcagtgctggaag

SEQ ID NO: 8778993 - DNA, 18 bp, Homo sapiens
caaattcagtgctggaag

SEQ ID NO: 8778994 - DNA, 22 bp, Homo sapiens
caaatttaggtaacagtctgta

SEQ ID NO: 8778995 - DNA, 22 bp, Homo sapiens
caaatttaggtaacagtctgta

SEQ ID NO: 8778996 - DNA, 22 bp, Homo sapiens
caaatttaggtaacagtctgta

SEQ ID NO: 8778997 - DNA, 22 bp, Homo sapiens
gctgaggtaggaggttgcagtg

SEQ ID NO: 8778998 - DNA, 22 bp, Homo sapiens
gctgaggtcaggagctgtgggg

SEQ ID NO: 8778999 - DNA, 22 bp, Homo sapiens
gctgaggtcaggagctgtgggg

SEQ ID NO: 8779000 - DNA, 22 bp, Homo sapiens
gctgaggtggagattgcagtga

SEQ ID NO: 8779001 - DNA, 23 bp, Homo sapiens
gctgaggtcctgctgagtggtgg

SEQ ID NO: 8779002 - DNA, 20 bp, Homo sapiens
gctgaggtccctgtggtttt

SEQ ID NO: 8779003 - DNA, 22 bp, Homo sapiens
gctggcagagagctggtgagga

SEQ ID NO: 8779004 - DNA, 22 bp, Homo sapiens
gctggcagagagctggtgagga

SEQ ID NO: 8779005 - DNA, 22 bp, Homo sapiens
gctggcagagagctggtgagga

SEQ ID NO: 8779006 - DNA, 22 bp, Homo sapiens
gctggcagagctctgggctggg

SEQ ID NO: 8779007 - DNA, 20 bp, Homo sapiens
gctggcagatgtcttgagat

SEQ ID NO: 8779008 - DNA, 22 bp, Homo sapiens
gctggcagagctctgggctggg

SEQ ID NO: 8779009 - DNA, 22 bp, Homo sapiens
gctggcagagctctgggctggg

SEQ ID NO: 8779010 - DNA, 22 bp, Homo sapiens
gctggaggctggagtgcagtgg

SEQ ID NO: 8779011 - DNA, 20 bp, Homo sapiens
gctgaggtccctgtggtttt

SEQ ID NO: 8779012 - DNA, 20 bp, Homo sapiens
gctggcagatgtcttgagat

SEQ ID NO: 8779013 - DNA, 20 bp, Homo sapiens
gctggcagatgtcttgagat

SEQ ID NO: 8779014 - DNA, 19 bp, Homo sapiens
gctggcagatgtggccgtg

SEQ ID NO: 8779015 - DNA, 19 bp, Homo sapiens
gctggcagatgtggccgtg

SEQ ID NO: 8779016 - DNA, 19 bp, Homo sapiens
gctggcagatgtggccgtg

SEQ ID NO: 8779017 - DNA, 22 bp, Homo sapiens
gctggcagcattagaccctggg

SEQ ID NO: 8779018 - DNA, 22 bp, Homo sapiens
gctggcagcattagaccctggg

SEQ ID NO: 8779019 - DNA, 22 bp, Homo sapiens
gctggcagcattagaccctggg

SEQ ID NO: 8779020 - DNA, 22 bp, Homo sapiens
gctggcagcattagaccctggg

SEQ ID NO: 8779021 - DNA, 22 bp, Homo sapiens
gctggcagcattagaccctggg

SEQ ID NO: 8779022 - DNA, 22 bp, Homo sapiens
gctggcagccaagtgaagaggg

SEQ ID NO: 8779023 - DNA, 22 bp, Homo sapiens
gctggcagccaagtgaagaggg

SEQ ID NO: 8779024 - DNA, 22 bp, Homo sapiens
gctggcagccaagtgaagaggg

SEQ ID NO: 8779025 - DNA, 22 bp, Homo sapiens
gctggccagtgtggtgaccacc

SEQ ID NO: 8779026 - DNA, 22 bp, Homo sapiens
gctggccagtgtggtgaccacc

SEQ ID NO: 8779027 - DNA, 21 bp, Homo sapiens
gctggctgtctcttacacggt

SEQ ID NO: 8779028 - DNA, 22 bp, Homo sapiens
gctgggagcaaagccatgcata

SEQ ID NO: 8779029 - DNA, 21 bp, Homo sapiens
gctggctgtctcttacacggt

SEQ ID NO: 8779030 - DNA, 22 bp, Homo sapiens
gctggctgtgattttgccaaca

SEQ ID NO: 8779031 - DNA, 22 bp, Homo sapiens
gctgggagcaaagccatgcata

SEQ ID NO: 8779032 - DNA, 22 bp, Homo sapiens
gctgggagcaagtactcatctt

SEQ ID NO: 8779033 - DNA, 22 bp, Homo sapiens
gctgggagccctggtctgctcc

SEQ ID NO: 8779034 - DNA, 19 bp, Homo sapiens
gctgggagcagaccctccc

SEQ ID NO: 8779035 - DNA, 19 bp, Homo sapiens
gctgggagcagaccctccc

SEQ ID NO: 8779036 - DNA, 22 bp, Homo sapiens
gctgggagccccgagccagcgc

SEQ ID NO: 8779037 - DNA, 22 bp, Homo sapiens
gctgggagccccgagccagcgc

SEQ ID NO: 8779038 - DNA, 22 bp, Homo sapiens
gctggccatatattttgctgtt

SEQ ID NO: 8779039 - DNA, 22 bp, Homo sapiens
gctggccatggcctgcgccatc

SEQ ID NO: 8779040 - DNA, 22 bp, Homo sapiens
gctggccatatattttgctgtt

SEQ ID NO: 8779041 - DNA, 22 bp, Homo sapiens
gctggccatggggagtgaggag

SEQ ID NO: 8779042 - DNA, 22 bp, Homo sapiens
gctggccatatattttgctgtt

SEQ ID NO: 8779043 - DNA, 22 bp, Homo sapiens
gctggccatggcctgcgccatc

SEQ ID NO: 8779044 - DNA, 22 bp, Homo sapiens
gctggccatggcctgcgccatc

SEQ ID NO: 8779045 - DNA, 22 bp, Homo sapiens
gctggccatagaagccaaagag

SEQ ID NO: 8779046 - DNA, 22 bp, Homo sapiens
gctggccagtgtggtgaccacc

SEQ ID NO: 8779047 - DNA, 22 bp, Homo sapiens
gctggccagtgtggtgaccacc

SEQ ID NO: 8779048 - DNA, 22 bp, Homo sapiens
gctggccatagaagccaaagag

SEQ ID NO: 8779049 - DNA, 22 bp, Homo sapiens
gctggccatagaagccaaagag

SEQ ID NO: 8779050 - DNA, 22 bp, Homo sapiens
gctggccatatattttgctgtt

SEQ ID NO: 8779051 - DNA, 22 bp, Homo sapiens
gctggcccagcgcccagggcag

SEQ ID NO: 8779052 - DNA, 22 bp, Homo sapiens
gctggccattctctttgagatg

SEQ ID NO: 8779053 - DNA, 22 bp, Homo sapiens
gctggccatggggagtgaggag

SEQ ID NO: 8779054 - DNA, 22 bp, Homo sapiens
gctggccattctctttgagatg

SEQ ID NO: 8779055 - DNA, 22 bp, Homo sapiens
gctggccatggggagtgaggag

SEQ ID NO: 8779056 - DNA, 22 bp, Homo sapiens
gctggccatggggagtgaggag

SEQ ID NO: 8779057 - DNA, 22 bp, Homo sapiens
gctggccatggggagtgaggag

SEQ ID NO: 8779058 - DNA, 22 bp, Homo sapiens
gctggccatggggagtgaggag

SEQ ID NO: 8779059 - DNA, 20 bp, Homo sapiens
gctgggctaccactggccct

SEQ ID NO: 8779060 - DNA, 20 bp, Homo sapiens
gctgggctaccactggccct

SEQ ID NO: 8779061 - DNA, 22 bp, Homo sapiens
gctgggccttccgattctcaag

SEQ ID NO: 8779062 - DNA, 21 bp, Homo sapiens
gctgggcctgtacttgccctg

SEQ ID NO: 8779063 - DNA, 21 bp, Homo sapiens
gctgggcctgtacttgccctg

SEQ ID NO: 8779064 - DNA, 22 bp, Homo sapiens
gctgggccccttgaaaggcgtc

SEQ ID NO: 8779065 - DNA, 22 bp, Homo sapiens
gctgggccccatccctcgagca

SEQ ID NO: 8779066 - DNA, 22 bp, Homo sapiens
gctgggccgacctgggctgcag

SEQ ID NO: 8779067 - DNA, 22 bp, Homo sapiens
gctgggccgacctgggctgcag

SEQ ID NO: 8779068 - DNA, 22 bp, Homo sapiens
gctgggccgacctgggctgcag

SEQ ID NO: 8779069 - DNA, 22 bp, Homo sapiens
gctgggccgacctgggctgcag

SEQ ID NO: 8779070 - DNA, 22 bp, Homo sapiens
gctgggccgacctgggctgcag

SEQ ID NO: 8779071 - DNA, 22 bp, Homo sapiens
gctgggccgacctgggctgcag

SEQ ID NO: 8779072 - DNA, 22 bp, Homo sapiens
gctgggccctgggtgccctagc

SEQ ID NO: 8779073 - DNA, 22 bp, Homo sapiens
gctgggagccctggtctgctcc

SEQ ID NO: 8779074 - DNA, 22 bp, Homo sapiens
gctgggagccctggtctgctcc

SEQ ID NO: 8779075 - DNA, 22 bp, Homo sapiens
gctgggagccctggtctgctcc

SEQ ID NO: 8779076 - DNA, 22 bp, Homo sapiens
gctgggagccgtacctgtcacg

SEQ ID NO: 8779077 - DNA, 22 bp, Homo sapiens
gctgggagccgtacctgtcacg

SEQ ID NO: 8779078 - DNA, 22 bp, Homo sapiens
gctgggagccgtacctgtcacg

SEQ ID NO: 8779079 - DNA, 22 bp, Homo sapiens
gctgggccagccagacatgtga

SEQ ID NO: 8779080 - DNA, 22 bp, Homo sapiens
gctgggcccagatcccaggatc

SEQ ID NO: 8779081 - DNA, 22 bp, Homo sapiens
gctgggcccagatcccaggatc

SEQ ID NO: 8779082 - DNA, 22 bp, Homo sapiens
gctgggccccatccctcgagca

SEQ ID NO: 8779083 - DNA, 22 bp, Homo sapiens
cacagagaatactgctcttgct

SEQ ID NO: 8779084 - DNA, 22 bp, Homo sapiens
cacagagaactgtgggagtgtg

SEQ ID NO: 8779085 - DNA, 22 bp, Homo sapiens
cacagagaatactgctcttgct

SEQ ID NO: 8779086 - DNA, 22 bp, Homo sapiens
cacagagaatgatgagtcactg

SEQ ID NO: 8779087 - DNA, 22 bp, Homo sapiens
cacagagaatgatgagtcactg

SEQ ID NO: 8779088 - DNA, 22 bp, Homo sapiens
cacagagaactgtgggagtgtg

SEQ ID NO: 8779089 - DNA, 22 bp, Homo sapiens
cacagagaactgtgggagtgtg

SEQ ID NO: 8779090 - DNA, 22 bp, Homo sapiens
cacagagaactgtgggagtgtg

SEQ ID NO: 8779091 - DNA, 22 bp, Homo sapiens
cacagagaactgtgggagtgtg

SEQ ID NO: 8779092 - DNA, 23 bp, Homo sapiens
ggagatcagagactagggcagtt

SEQ ID NO: 8779093 - DNA, 22 bp, Homo sapiens
ggagatatggtctagtatagag

SEQ ID NO: 8779094 - DNA, 22 bp, Homo sapiens
ggagatattgcctgatgaagaa

SEQ ID NO: 8779095 - DNA, 22 bp, Homo sapiens
cacagagacagaagcacttatg

SEQ ID NO: 8779096 - DNA, 22 bp, Homo sapiens
cacagagacagatctattttgc

SEQ ID NO: 8779097 - DNA, 22 bp, Homo sapiens
cacagagacagaagcacttatg

SEQ ID NO: 8779098 - DNA, 22 bp, Homo sapiens
cacagagaatgatgagtcactg

SEQ ID NO: 8779099 - DNA, 22 bp, Homo sapiens
cacagagaatgatgagtcactg

SEQ ID NO: 8779100 - DNA, 22 bp, Homo sapiens
cacagagaatgatgagtcactg

SEQ ID NO: 8779101 - DNA, 22 bp, Homo sapiens
cacagagaattcccatatgtga

SEQ ID NO: 8779102 - DNA, 22 bp, Homo sapiens
cacagagaattcccatatgtga

SEQ ID NO: 8779103 - DNA, 22 bp, Homo sapiens
cacagagaattcccatatgtga

SEQ ID NO: 8779104 - DNA, 22 bp, Homo sapiens
cacagagacatgatgtcattgc

SEQ ID NO: 8779105 - DNA, 22 bp, Homo sapiens
cacagcaaaggcttcggctgat

SEQ ID NO: 8779106 - DNA, 22 bp, Homo sapiens
ggagagtggattccagctgtat

SEQ ID NO: 8779107 - DNA, 22 bp, Homo sapiens
ggagagtggattccagctgtat

SEQ ID NO: 8779108 - DNA, 22 bp, Homo sapiens
ggagagtggattccagctgtat

SEQ ID NO: 8779109 - DNA, 18 bp, Homo sapiens
ggagagtgagatcaaaca

SEQ ID NO: 8779110 - DNA, 18 bp, Homo sapiens
ggagagtgacagagtcgt

SEQ ID NO: 8779111 - DNA, 18 bp, Homo sapiens
ggagagtgacagagtcgt

SEQ ID NO: 8779112 - DNA, 22 bp, Homo sapiens
ggagagttgtttttgcctagat

SEQ ID NO: 8779113 - DNA, 22 bp, Homo sapiens
ggagagttcatgtggagtgggg

SEQ ID NO: 8779114 - DNA, 17 bp, Homo sapiens
ggagagtgggaatggcc

SEQ ID NO: 8779115 - DNA, 17 bp, Homo sapiens
ggagagtgggaatggcc

SEQ ID NO: 8779116 - DNA, 17 bp, Homo sapiens
ggagagtgggaatggcc

SEQ ID NO: 8779117 - DNA, 17 bp, Homo sapiens
ggagagtgggaatggcc

SEQ ID NO: 8779118 - DNA, 22 bp, Homo sapiens
ggagagtctgccgagccagccc

SEQ ID NO: 8779119 - DNA, 22 bp, Homo sapiens
ggagagtctgagcctgctggag

SEQ ID NO: 8779120 - DNA, 22 bp, Homo sapiens
ggagagtctgagcctgctggag

SEQ ID NO: 8779121 - DNA, 18 bp, Homo sapiens
ggagagtgacagagtcgt

SEQ ID NO: 8779122 - DNA, 18 bp, Homo sapiens
ggagagtgacagagtcgt

SEQ ID NO: 8779123 - DNA, 22 bp, Homo sapiens
ggagagctgacatcatgatgtt

SEQ ID NO: 8779124 - DNA, 22 bp, Homo sapiens
ggagagctgacatcatgatgtt

SEQ ID NO: 8779125 - DNA, 22 bp, Homo sapiens
ggagaggttatccgtgttatgt

SEQ ID NO: 8779126 - DNA, 22 bp, Homo sapiens
ggacagcatatcagcagggcag

SEQ ID NO: 8779127 - DNA, 22 bp, Homo sapiens
ggacagcattcctagttccaaa

SEQ ID NO: 8779128 - DNA, 22 bp, Homo sapiens
ggacagcatatcagcagggcag

SEQ ID NO: 8779129 - DNA, 22 bp, Homo sapiens
ggacagctctgccaggagctca

SEQ ID NO: 8779130 - DNA, 22 bp, Homo sapiens
ggacagctgctttcaggccaca

SEQ ID NO: 8779131 - DNA, 22 bp, Homo sapiens
ggacagctcctgcacttgagta

SEQ ID NO: 8779132 - DNA, 22 bp, Homo sapiens
ggacagcccatacacatgtctg

SEQ ID NO: 8779133 - DNA, 22 bp, Homo sapiens
ggacaaattccctatttgcatg

SEQ ID NO: 8779134 - DNA, 22 bp, Homo sapiens
ggacaaaggtctggggaacctg

SEQ ID NO: 8779135 - DNA, 22 bp, Homo sapiens
ggacaacacttcattccagcta

SEQ ID NO: 8779136 - DNA, 22 bp, Homo sapiens
ggacaaattccctatttgcatg

SEQ ID NO: 8779137 - DNA, 22 bp, Homo sapiens
ggacaaattccctatttgcatg

SEQ ID NO: 8779138 - DNA, 22 bp, Homo sapiens
ggacaagcctcagacaaaactc

SEQ ID NO: 8779139 - DNA, 22 bp, Homo sapiens
ggacaagcctgtgagtgggttt

SEQ ID NO: 8779140 - DNA, 22 bp, Homo sapiens
ggacaacatgttttaattaagg

SEQ ID NO: 8779141 - DNA, 22 bp, Homo sapiens
ggacaagcctgtgagtgggttt

SEQ ID NO: 8779142 - DNA, 22 bp, Homo sapiens
ggacaagcctgtgagtgggttt

SEQ ID NO: 8779143 - DNA, 22 bp, Homo sapiens
ggacaagcctgtgagtgggttt

SEQ ID NO: 8779144 - DNA, 22 bp, Homo sapiens
ggacaagcctgtgagtgggttt

SEQ ID NO: 8779145 - DNA, 22 bp, Homo sapiens
ggacaagcctgtgagtgggttt

SEQ ID NO: 8779146 - DNA, 22 bp, Homo sapiens
ggacaaagctctgctgcctccc

SEQ ID NO: 8779147 - DNA, 22 bp, Homo sapiens
ggacaaagcctggtggcaggtg

SEQ ID NO: 8779148 - DNA, 22 bp, Homo sapiens
ggacaaaggtagacagtctctg

SEQ ID NO: 8779149 - DNA, 22 bp, Homo sapiens
ggacaaagggtggagcctctga

SEQ ID NO: 8779150 - DNA, 22 bp, Homo sapiens
ggacacagataatcacacagat

SEQ ID NO: 8779151 - DNA, 22 bp, Homo sapiens
ggacacagataatcacacagat

SEQ ID NO: 8779152 - DNA, 22 bp, Homo sapiens
ggacagattgagctaggcgttt

SEQ ID NO: 8779153 - DNA, 22 bp, Homo sapiens
ggacagagggttgacagagtat

SEQ ID NO: 8779154 - DNA, 23 bp, Homo sapiens
ggacacagagataagtgagacaa

SEQ ID NO: 8779155 - DNA, 22 bp, Homo sapiens
ggacacagataatcacacagat

SEQ ID NO: 8779156 - DNA, 19 bp, Homo sapiens
ggacacagaaagctgcatt

SEQ ID NO: 8779157 - DNA, 19 bp, Homo sapiens
ggacacagaaagctgcatt

SEQ ID NO: 8779158 - DNA, 22 bp, Homo sapiens
ggacacagacctttctgttcta

SEQ ID NO: 8779159 - DNA, 22 bp, Homo sapiens
ggacacaagctccggggctgca

SEQ ID NO: 8779160 - DNA, 22 bp, Homo sapiens
ggaagagaatttctctcttttt

SEQ ID NO: 8779161 - DNA, 22 bp, Homo sapiens
ggaagagaatgatggctatggg

SEQ ID NO: 8779162 - DNA, 22 bp, Homo sapiens
ggaagagaatttctctcttttt

SEQ ID NO: 8779163 - DNA, 22 bp, Homo sapiens
ggaagagaatttctctcttttt

SEQ ID NO: 8779164 - DNA, 22 bp, Homo sapiens
ggaagagagatcccatagatgt

SEQ ID NO: 8779165 - DNA, 22 bp, Homo sapiens
ggaagagagatcccatagatgt

SEQ ID NO: 8779166 - DNA, 22 bp, Homo sapiens
ggaagagagatcccatagatgt

SEQ ID NO: 8779167 - DNA, 19 bp, Homo sapiens
ggaagagaggaaaggtgga

SEQ ID NO: 8779168 - DNA, 19 bp, Homo sapiens
ggaagagaggaaaggtgga

SEQ ID NO: 8779169 - DNA, 22 bp, Homo sapiens
ggaagagagggctgggcctcaa

SEQ ID NO: 8779170 - DNA, 22 bp, Homo sapiens
ggaagagaggttcagccctaag

SEQ ID NO: 8779171 - DNA, 22 bp, Homo sapiens
ggaagagagggctgggcctcaa

SEQ ID NO: 8779172 - DNA, 22 bp, Homo sapiens
ggaagagattctttacattcat

SEQ ID NO: 8779173 - DNA, 22 bp, Homo sapiens
ggaagagaggttcagccctaag

SEQ ID NO: 8779174 - DNA, 22 bp, Homo sapiens
ggaagagaggttcagccctaag

SEQ ID NO: 8779175 - DNA, 22 bp, Homo sapiens
ggaagagaaatgagtcaagact

SEQ ID NO: 8779176 - DNA, 22 bp, Homo sapiens
ggaagagaaatgagtcaagact

SEQ ID NO: 8779177 - DNA, 22 bp, Homo sapiens
ggaagacatctgcttgcaccag

SEQ ID NO: 8779178 - DNA, 22 bp, Homo sapiens
ggaagactgcatggcatagtga

SEQ ID NO: 8779179 - DNA, 22 bp, Homo sapiens
ggaacagggatttggcctggtt

SEQ ID NO: 8779180 - DNA, 22 bp, Homo sapiens
ggaacactgccttttattttcc

SEQ ID NO: 8779181 - DNA, 22 bp, Homo sapiens
ggaacacagtgccttacaaact

SEQ ID NO: 8779182 - DNA, 22 bp, Homo sapiens
ggaacagactgacttcttgaat

SEQ ID NO: 8779183 - DNA, 18 bp, Homo sapiens
ggaacagctcagggcagc

SEQ ID NO: 8779184 - DNA, 22 bp, Homo sapiens
cacagcagggcatggctgttgt

SEQ ID NO: 8779185 - DNA, 22 bp, Homo sapiens
cacagcagggatgaatggagtg

SEQ ID NO: 8779186 - DNA, 22 bp, Homo sapiens
cacagcaggcactatacagggc

SEQ ID NO: 8779187 - DNA, 22 bp, Homo sapiens
cacagcaggcactatacagggc

SEQ ID NO: 8779188 - DNA, 22 bp, Homo sapiens
cacagcagtctttcactaaata

SEQ ID NO: 8779189 - DNA, 22 bp, Homo sapiens
cacagcataatgaaatatactt

SEQ ID NO: 8779190 - DNA, 22 bp, Homo sapiens
cacagcataatgaaatatactt

SEQ ID NO: 8779191 - DNA, 21 bp, Homo sapiens
cacagcagggttcctgggctc

SEQ ID NO: 8779192 - DNA, 21 bp, Homo sapiens
cacagcagggttcctgggctc

SEQ ID NO: 8779193 - DNA, 21 bp, Homo sapiens
cacagcagggttcctgggctc

SEQ ID NO: 8779194 - DNA, 22 bp, Homo sapiens
cacagcaggtgcttaatgatta

SEQ ID NO: 8779195 - DNA, 22 bp, Homo sapiens
cacagccatgtcctcattcttc

SEQ ID NO: 8779196 - DNA, 22 bp, Homo sapiens
cacagcccccttgacactctgg

SEQ ID NO: 8779197 - DNA, 22 bp, Homo sapiens
cacagccctgcgccccagtttg

SEQ ID NO: 8779198 - DNA, 22 bp, Homo sapiens
cacagcctcctctggctcacgg

SEQ ID NO: 8779199 - DNA, 22 bp, Homo sapiens
cacagcattgccttccaaaagg

SEQ ID NO: 8779200 - DNA, 22 bp, Homo sapiens
cacagcagtctttcactaaata

SEQ ID NO: 8779201 - DNA, 22 bp, Homo sapiens
cacagcattgccttccaaaagg

SEQ ID NO: 8779202 - DNA, 22 bp, Homo sapiens
cacagcattgccttccaaaagg

SEQ ID NO: 8779203 - DNA, 22 bp, Homo sapiens
cacagcattcacagaaagacat

SEQ ID NO: 8779204 - DNA, 22 bp, Homo sapiens
cacagcattaactgggacagct

SEQ ID NO: 8779205 - DNA, 22 bp, Homo sapiens
ggagcagccgcgtctcagggca

SEQ ID NO: 8779206 - DNA, 22 bp, Homo sapiens
ggagcagccacgtctcagggca

SEQ ID NO: 8779207 - DNA, 22 bp, Homo sapiens
ggaggagacggagtgattagtg

SEQ ID NO: 8779208 - DNA, 22 bp, Homo sapiens
ggaggagacggagtgattagtg

SEQ ID NO: 8779209 - DNA, 22 bp, Homo sapiens
ggaggagacggagtgattagtg

SEQ ID NO: 8779210 - DNA, 22 bp, Homo sapiens
ggaggagacggagtgattagtg

SEQ ID NO: 8779211 - DNA, 22 bp, Homo sapiens
ggaggagagaggttgcaaacac

SEQ ID NO: 8779212 - DNA, 22 bp, Homo sapiens
ggaggagaccctgtgtcagttt

SEQ ID NO: 8779213 - DNA, 22 bp, Homo sapiens
ggaggagattcccctctcactt

SEQ ID NO: 8779214 - DNA, 22 bp, Homo sapiens
ggaggagattcccctctcactt

SEQ ID NO: 8779215 - DNA, 22 bp, Homo sapiens
ggaggagcacttctgagctcag

SEQ ID NO: 8779216 - DNA, 22 bp, Homo sapiens
ggaggagcacttctgagctcag

SEQ ID NO: 8779217 - DNA, 22 bp, Homo sapiens
ggaggagcacttgacggggtct

SEQ ID NO: 8779218 - DNA, 22 bp, Homo sapiens
ggaggagcacttctgagctcag

SEQ ID NO: 8779219 - DNA, 22 bp, Homo sapiens
ggaggagcacttctgagctcag

SEQ ID NO: 8779220 - DNA, 22 bp, Homo sapiens
ggaggagcacttgacggggtct

SEQ ID NO: 8779221 - DNA, 22 bp, Homo sapiens
ggaggagcacttgacggggtct

SEQ ID NO: 8779222 - DNA, 22 bp, Homo sapiens
ggaggagcacttgacggggtct

SEQ ID NO: 8779223 - DNA, 22 bp, Homo sapiens
ggaggactcaggtctggccatg

SEQ ID NO: 8779224 - DNA, 22 bp, Homo sapiens
ggagctggccctctgagtttgt

SEQ ID NO: 8779225 - DNA, 22 bp, Homo sapiens
ggaggagacagtaaaaagcacg

SEQ ID NO: 8779226 - DNA, 22 bp, Homo sapiens
ggaggagacagtaaaaagcacg

SEQ ID NO: 8779227 - DNA, 22 bp, Homo sapiens
ggaggagacagtaaaaagcacg

SEQ ID NO: 8779228 - DNA, 22 bp, Homo sapiens
ggaggagacagtaaaaagcacg

SEQ ID NO: 8779229 - DNA, 22 bp, Homo sapiens
ggagcagcttgcatgctcaggg

SEQ ID NO: 8779230 - DNA, 22 bp, Homo sapiens
ggagcagcttgcatgctcaggg

SEQ ID NO: 8779231 - DNA, 22 bp, Homo sapiens
ggagcagcttgcatgctcaggg

SEQ ID NO: 8779232 - DNA, 22 bp, Homo sapiens
ggagcagcttgcatgctcaggg

SEQ ID NO: 8779233 - DNA, 22 bp, Homo sapiens
cacaggagaaaggggaagctcg

SEQ ID NO: 8779234 - DNA, 22 bp, Homo sapiens
cacaggagaacccacagattct

SEQ ID NO: 8779235 - DNA, 22 bp, Homo sapiens
cacaggagagctgggaggtgcc

SEQ ID NO: 8779236 - DNA, 22 bp, Homo sapiens
cacaggagagctgggaggtgcc

SEQ ID NO: 8779237 - DNA, 18 bp, Homo sapiens
cacaggagatgacctgac

SEQ ID NO: 8779238 - DNA, 18 bp, Homo sapiens
cacaggagatgacctgac

SEQ ID NO: 8779239 - DNA, 22 bp, Homo sapiens
cacaggagaggttaatgggggc

SEQ ID NO: 8779240 - DNA, 22 bp, Homo sapiens
cacaggagagctgggaggtgcc

SEQ ID NO: 8779241 - DNA, 22 bp, Homo sapiens
ggaggggccggctgcctgccac

SEQ ID NO: 8779242 - DNA, 22 bp, Homo sapiens
ggaggggccggctgcctgccac

SEQ ID NO: 8779243 - DNA, 22 bp, Homo sapiens
ggaggggcatagttcaccatca

SEQ ID NO: 8779244 - DNA, 22 bp, Homo sapiens
ggaggggcatagttcaccatca

SEQ ID NO: 8779245 - DNA, 22 bp, Homo sapiens
ggaggggcatagttcaccatca

SEQ ID NO: 8779246 - DNA, 22 bp, Homo sapiens
ggaggggccggctgcctgccac

SEQ ID NO: 8779247 - DNA, 22 bp, Homo sapiens
ggaggggccggctgcctgccac

SEQ ID NO: 8779248 - DNA, 22 bp, Homo sapiens
ggaggggccggctgcctgccac

SEQ ID NO: 8779249 - DNA, 22 bp, Homo sapiens
cacaggagaaaggggaagctcg

SEQ ID NO: 8779250 - DNA, 22 bp, Homo sapiens
ggaggggcagccatggaactcc

SEQ ID NO: 8779251 - DNA, 22 bp, Homo sapiens
ggaggggcagccatggaactcc

SEQ ID NO: 8779252 - DNA, 22 bp, Homo sapiens
ggaggggcaggtcccaagttgt

SEQ ID NO: 8779253 - DNA, 22 bp, Homo sapiens
ggaggggcatagttcaccatca

SEQ ID NO: 8779254 - DNA, 22 bp, Homo sapiens
ggaggggcaggtcccaagttgt

SEQ ID NO: 8779255 - DNA, 22 bp, Homo sapiens
ggaggggatggtttgaccctgg

SEQ ID NO: 8779256 - DNA, 22 bp, Homo sapiens
ggaggggatggtttgaccctgg

SEQ ID NO: 8779257 - DNA, 19 bp, Homo sapiens
cacagctctgctcagggaa

SEQ ID NO: 8779258 - DNA, 22 bp, Homo sapiens
cacagctagactaattgctggg

SEQ ID NO: 8779259 - DNA, 22 bp, Homo sapiens
cacagctatgagcagcctagct

SEQ ID NO: 8779260 - DNA, 22 bp, Homo sapiens
cacagctatggggctgtagcct

SEQ ID NO: 8779261 - DNA, 22 bp, Homo sapiens
ggagggcaacttttcagtaggt

SEQ ID NO: 8779262 - DNA, 22 bp, Homo sapiens
cacagccttgagcgaggacaag

SEQ ID NO: 8779263 - DNA, 22 bp, Homo sapiens
cacagcctccttcagagagcat

SEQ ID NO: 8779264 - DNA, 22 bp, Homo sapiens
cacagccttactgagatccact

SEQ ID NO: 8779265 - DNA, 22 bp, Homo sapiens
cacagcctgctgcactcaagaa

SEQ ID NO: 8779266 - DNA, 22 bp, Homo sapiens
cacagcctcctctggctcacgg

SEQ ID NO: 8779267 - DNA, 22 bp, Homo sapiens
cacagcctccttcagagagcat

SEQ ID NO: 8779268 - DNA, 22 bp, Homo sapiens
cacagctagatggatagataga

SEQ ID NO: 8779269 - DNA, 22 bp, Homo sapiens
cacagctagactaattgctggg

SEQ ID NO: 8779270 - DNA, 22 bp, Homo sapiens
cacagctacctgcatgcctgct

SEQ ID NO: 8779271 - DNA, 22 bp, Homo sapiens
cacagcctttagggtacacaca

SEQ ID NO: 8779272 - DNA, 19 bp, Homo sapiens
cacagcgaagacaaggtgg

SEQ ID NO: 8779273 - DNA, 22 bp, Homo sapiens
cacagcgccttccccgggagcg

SEQ ID NO: 8779274 - DNA, 17 bp, Homo sapiens
ggatagtgctgggctgg

SEQ ID NO: 8779275 - DNA, 22 bp, Homo sapiens
ggatagtgggagaatgctatgt

SEQ ID NO: 8779276 - DNA, 22 bp, Homo sapiens
ggatattctttatagatacagt

SEQ ID NO: 8779277 - DNA, 22 bp, Homo sapiens
ggataagaaaattgtaataact

SEQ ID NO: 8779278 - DNA, 19 bp, Homo sapiens
ggataaggttggagtgatc

SEQ ID NO: 8779279 - DNA, 22 bp, Homo sapiens
ggatacagcggcttctgcgcga

SEQ ID NO: 8779280 - DNA, 22 bp, Homo sapiens
ggatacagcggcttctgcgcga

SEQ ID NO: 8779281 - DNA, 22 bp, Homo sapiens
ggatacaactagaagatggcag

SEQ ID NO: 8779282 - DNA, 22 bp, Homo sapiens
ggatacaaggtgttctatcact

SEQ ID NO: 8779283 - DNA, 23 bp, Homo sapiens
ggatacaaagattaatagtagag

SEQ ID NO: 8779284 - DNA, 23 bp, Homo sapiens
ggatacaaagattaatagtagag

SEQ ID NO: 8779285 - DNA, 22 bp, Homo sapiens
ggatcattaagaatagctacta

SEQ ID NO: 8779286 - DNA, 22 bp, Homo sapiens
ggcaggaagctcatgtggactg

SEQ ID NO: 8779287 - DNA, 22 bp, Homo sapiens
ggcaggaagctcatgtggactg

SEQ ID NO: 8779288 - DNA, 22 bp, Homo sapiens
ggcaggaagtagcagtctgagc

SEQ ID NO: 8779289 - DNA, 22 bp, Homo sapiens
ggcaggaagaggagggtgaact

SEQ ID NO: 8779290 - DNA, 22 bp, Homo sapiens
ggcaggaaaacaatgagccagg

SEQ ID NO: 8779291 - DNA, 22 bp, Homo sapiens
ggcagcttttccaggctctcca

SEQ ID NO: 8779292 - DNA, 22 bp, Homo sapiens
ggatccagtccagggctgtgtg

SEQ ID NO: 8779293 - DNA, 22 bp, Homo sapiens
ggcagctgcaaatctgctctgt

SEQ ID NO: 8779294 - DNA, 22 bp, Homo sapiens
ggcagctgcaaatctgctctgt

SEQ ID NO: 8779295 - DNA, 22 bp, Homo sapiens
ggagtgaatcactagatgcaga

SEQ ID NO: 8779296 - DNA, 22 bp, Homo sapiens
ggagtgagcaaatagagatttg

SEQ ID NO: 8779297 - DNA, 19 bp, Homo sapiens
ggagtttccaatgggtaaa

SEQ ID NO: 8779298 - DNA, 22 bp, Homo sapiens
ggagtgactctcggggccacta

SEQ ID NO: 8779299 - DNA, 22 bp, Homo sapiens
ggagtgactctcggggccacta

SEQ ID NO: 8779300 - DNA, 22 bp, Homo sapiens
ggagtttgcctattgcttttgg

SEQ ID NO: 8779301 - DNA, 21 bp, Homo sapiens
ggagtttttctggaagggact

SEQ ID NO: 8779302 - DNA, 21 bp, Homo sapiens
ggagtttttctggaagggact

SEQ ID NO: 8779303 - DNA, 23 bp, Homo sapiens
ggataaatctcagcttcttccat

SEQ ID NO: 8779304 - DNA, 23 bp, Homo sapiens
ggataaatctcagcttcttccat

SEQ ID NO: 8779305 - DNA, 22 bp, Homo sapiens
ggagtctgcggcagacactgta

SEQ ID NO: 8779306 - DNA, 22 bp, Homo sapiens
ggagtctgctcccagacatgat

SEQ ID NO: 8779307 - DNA, 22 bp, Homo sapiens
ggagtctgctcccagacatgat

SEQ ID NO: 8779308 - DNA, 22 bp, Homo sapiens
ggagtctggagtggggcccaag

SEQ ID NO: 8779309 - DNA, 22 bp, Homo sapiens
ggagtctggagtggggcccaag

SEQ ID NO: 8779310 - DNA, 22 bp, Homo sapiens
ggagtctggagtggggcccaag

SEQ ID NO: 8779311 - DNA, 22 bp, Homo sapiens
ggagtctgtcacctgtttctct

SEQ ID NO: 8779312 - DNA, 22 bp, Homo sapiens
ggagtctgggaattggagagaa

SEQ ID NO: 8779313 - DNA, 21 bp, Homo sapiens
ggagtctgtggatgctgtttc

SEQ ID NO: 8779314 - DNA, 22 bp, Homo sapiens
ggagtctgttttacatgcagga

SEQ ID NO: 8779315 - DNA, 22 bp, Homo sapiens
ggagtctgttttacatgcagga

SEQ ID NO: 8779316 - DNA, 22 bp, Homo sapiens
ggagtcttggcctgctgagaaa

SEQ ID NO: 8779317 - DNA, 22 bp, Homo sapiens
ggcaggacattgactacagtga

SEQ ID NO: 8779318 - DNA, 20 bp, Homo sapiens
ggcaggaccccagtggcatc

SEQ ID NO: 8779319 - DNA, 20 bp, Homo sapiens
ggcaggaccccagtggcatc

SEQ ID NO: 8779320 - DNA, 20 bp, Homo sapiens
ggcaggacccggtagggagc

SEQ ID NO: 8779321 - DNA, 22 bp, Homo sapiens
ggcaggagaaaggtctcttctt

SEQ ID NO: 8779322 - DNA, 22 bp, Homo sapiens
ggcaggactcttctgtgggccg

SEQ ID NO: 8779323 - DNA, 22 bp, Homo sapiens
ggcaggactcttctgtgggccg

SEQ ID NO: 8779324 - DNA, 22 bp, Homo sapiens
ggcaggactgatcagtgggatg

SEQ ID NO: 8779325 - DNA, 23 bp, Homo sapiens
cacatgcaggcagtggccttcaa

SEQ ID NO: 8779326 - DNA, 22 bp, Homo sapiens
ggcaggagaaaggtctcttctt

SEQ ID NO: 8779327 - DNA, 22 bp, Homo sapiens
cacatgcagttttccagcagtc

SEQ ID NO: 8779328 - DNA, 22 bp, Homo sapiens
cacatgcatacctatgtgtata

SEQ ID NO: 8779329 - DNA, 22 bp, Homo sapiens
cacatgcatacctatgtgtata

SEQ ID NO: 8779330 - DNA, 22 bp, Homo sapiens
cacatgcataaggataattact

SEQ ID NO: 8779331 - DNA, 22 bp, Homo sapiens
cacatgcatctgtcatgtttgg

SEQ ID NO: 8779332 - DNA, 21 bp, Homo sapiens
cacatgcatgcacaggttgta

SEQ ID NO: 8779333 - DNA, 22 bp, Homo sapiens
cacatgcattggcaaaagtgta

SEQ ID NO: 8779334 - DNA, 22 bp, Homo sapiens
ggcagtcacttttgcttgtgcc

SEQ ID NO: 8779335 - DNA, 19 bp, Homo sapiens
ggcagtcacggtcaggagc

SEQ ID NO: 8779336 - DNA, 22 bp, Homo sapiens
ggcagtcaagagggagtctgaa

SEQ ID NO: 8779337 - DNA, 22 bp, Homo sapiens
ggcaggtgtttttatattaaag

SEQ ID NO: 8779338 - DNA, 22 bp, Homo sapiens
ggcaggtgtggtgaccagagat

SEQ ID NO: 8779339 - DNA, 22 bp, Homo sapiens
ggcaggtgtggtgaccagagat

SEQ ID NO: 8779340 - DNA, 22 bp, Homo sapiens
ggcagtagccagggactggcag

SEQ ID NO: 8779341 - DNA, 22 bp, Homo sapiens
ggcaggtgtggtgaccagagat

SEQ ID NO: 8779342 - DNA, 22 bp, Homo sapiens
ggcaggtgtttttatattaaag

SEQ ID NO: 8779343 - DNA, 22 bp, Homo sapiens
ggcagtagccagggactggcag

SEQ ID NO: 8779344 - DNA, 22 bp, Homo sapiens
ggcaggtgtggagtgttatttt

SEQ ID NO: 8779345 - DNA, 19 bp, Homo sapiens
ggcaggtgtgcttatgctt

SEQ ID NO: 8779346 - DNA, 22 bp, Homo sapiens
ggcaggtgtggtgaccagagat

SEQ ID NO: 8779347 - DNA, 22 bp, Homo sapiens
ggcaggtgtggagtgttatttt

SEQ ID NO: 8779348 - DNA, 22 bp, Homo sapiens
ggcaggtgtgagctgtaaagga

SEQ ID NO: 8779349 - DNA, 22 bp, Homo sapiens
ggcaggtgtgagatcgaggcca

SEQ ID NO: 8779350 - DNA, 22 bp, Homo sapiens
ggcaggtgtgagctgtaaagga

SEQ ID NO: 8779351 - DNA, 22 bp, Homo sapiens
ggcaggtgtgagctgtaaagga

SEQ ID NO: 8779352 - DNA, 22 bp, Homo sapiens
cacatgctcattggcactgttc

SEQ ID NO: 8779353 - DNA, 22 bp, Homo sapiens
cacatgctcattggcactgttc

SEQ ID NO: 8779354 - DNA, 22 bp, Homo sapiens
cacatgctcattggcactgttc

SEQ ID NO: 8779355 - DNA, 22 bp, Homo sapiens
cacatgcccagaacttctcatt

SEQ ID NO: 8779356 - DNA, 22 bp, Homo sapiens
cacatgccttcctcaggcctct

SEQ ID NO: 8779357 - DNA, 22 bp, Homo sapiens
ggcaggtgtgagatcgaggcca

SEQ ID NO: 8779358 - DNA, 22 bp, Homo sapiens
ggcaggtgccttctgtgctagc

SEQ ID NO: 8779359 - DNA, 22 bp, Homo sapiens
ggcaggtgccttctgtgctagc

SEQ ID NO: 8779360 - DNA, 22 bp, Homo sapiens
ggcaggtgccttctgtgctagc

SEQ ID NO: 8779361 - DNA, 22 bp, Homo sapiens
ggcaggtgccttctgtgctagc

SEQ ID NO: 8779362 - DNA, 21 bp, Homo sapiens
caccaacacctgggataggtc

SEQ ID NO: 8779363 - DNA, 22 bp, Homo sapiens
caccaagactgtataccaggca

SEQ ID NO: 8779364 - DNA, 17 bp, Homo sapiens
caccaattaagaccctc

SEQ ID NO: 8779365 - DNA, 20 bp, Homo sapiens
caccacagaattggggacag

SEQ ID NO: 8779366 - DNA, 22 bp, Homo sapiens
caccacagcatccactagaagg

SEQ ID NO: 8779367 - DNA, 22 bp, Homo sapiens
caccacagcatccactagaagg

SEQ ID NO: 8779368 - DNA, 22 bp, Homo sapiens
caccactgaattgttcactttc

SEQ ID NO: 8779369 - DNA, 19 bp, Homo sapiens
cacattttgagtctgagat

SEQ ID NO: 8779370 - DNA, 19 bp, Homo sapiens
cacattttgagtctgagat

SEQ ID NO: 8779371 - DNA, 22 bp, Homo sapiens
cacatttttactgccaacttaa

SEQ ID NO: 8779372 - DNA, 19 bp, Homo sapiens
cacattttgagtctgagat

SEQ ID NO: 8779373 - DNA, 19 bp, Homo sapiens
cacattttgagtctgagat

SEQ ID NO: 8779374 - DNA, 22 bp, Homo sapiens
cacatttgaaggaattagcatt

SEQ ID NO: 8779375 - DNA, 21 bp, Homo sapiens
cacatttgaacctcacagcaa

SEQ ID NO: 8779376 - DNA, 21 bp, Homo sapiens
cacatttgaacctcacagcaa

SEQ ID NO: 8779377 - DNA, 18 bp, Homo sapiens
ggccagccccaggccagc

SEQ ID NO: 8779378 - DNA, 22 bp, Homo sapiens
ggccactgtttcctgggcagtt

SEQ ID NO: 8779379 - DNA, 23 bp, Homo sapiens
ggccactttgtgtcagtatgtgc

SEQ ID NO: 8779380 - DNA, 23 bp, Homo sapiens
ggccactttgtgtcagtatgtgc

SEQ ID NO: 8779381 - DNA, 22 bp, Homo sapiens
ggccagcctggggctcccagac

SEQ ID NO: 8779382 - DNA, 22 bp, Homo sapiens
ggccagcctggggctcccagac

SEQ ID NO: 8779383 - DNA, 22 bp, Homo sapiens
ggccagccctcctccctgggtt

SEQ ID NO: 8779384 - DNA, 18 bp, Homo sapiens
ggccagccccaggccagc

SEQ ID NO: 8779385 - DNA, 22 bp, Homo sapiens
ggccagccctcctccctgggtt

SEQ ID NO: 8779386 - DNA, 22 bp, Homo sapiens
ggccagctacccatctgcgtca

SEQ ID NO: 8779387 - DNA, 22 bp, Homo sapiens
ggccagcggcacagcctggccc

SEQ ID NO: 8779388 - DNA, 22 bp, Homo sapiens
ggccagcggcacagcctggccc

SEQ ID NO: 8779389 - DNA, 22 bp, Homo sapiens
ggccagcctggggctcccagac

SEQ ID NO: 8779390 - DNA, 22 bp, Homo sapiens
cacccaggacaggccagatgtg

SEQ ID NO: 8779391 - DNA, 22 bp, Homo sapiens
cacccaggacaggccagatgtg

SEQ ID NO: 8779392 - DNA, 22 bp, Homo sapiens
cacccaggacaggccagatgtg

SEQ ID NO: 8779393 - DNA, 22 bp, Homo sapiens
cacccaggacaggccagatgtg

SEQ ID NO: 8779394 - DNA, 22 bp, Homo sapiens
cacccaggcaaggattctgcaa

SEQ ID NO: 8779395 - DNA, 22 bp, Homo sapiens
ggccagggcctggggactgtcc

SEQ ID NO: 8779396 - DNA, 22 bp, Homo sapiens
ggccagggcctggggactgtcc

SEQ ID NO: 8779397 - DNA, 22 bp, Homo sapiens
cacccaggctagagtgcagtgg

SEQ ID NO: 8779398 - DNA, 22 bp, Homo sapiens
cacccaggctagagtgcagtgg

SEQ ID NO: 8779399 - DNA, 22 bp, Homo sapiens
cacccaggcaggtggctgagaa

SEQ ID NO: 8779400 - DNA, 22 bp, Homo sapiens
cacccaggcaggtggctgagaa

SEQ ID NO: 8779401 - DNA, 22 bp, Homo sapiens
cacccagcttttgcatcctccg

SEQ ID NO: 8779402 - DNA, 22 bp, Homo sapiens
cacccagccttcacacaggagt

SEQ ID NO: 8779403 - DNA, 22 bp, Homo sapiens
cacccagccttcacacaggagt

SEQ ID NO: 8779404 - DNA, 22 bp, Homo sapiens
ggccagctcagtctccatcagg

SEQ ID NO: 8779405 - DNA, 22 bp, Homo sapiens
ggccagctcagggtccttgggc

SEQ ID NO: 8779406 - DNA, 22 bp, Homo sapiens
ggccagctcagggtccttgggc

SEQ ID NO: 8779407 - DNA, 18 bp, Homo sapiens
ggccagctcctgaggcag

SEQ ID NO: 8779408 - DNA, 22 bp, Homo sapiens
ggccagctccttggcagtgcct

SEQ ID NO: 8779409 - DNA, 18 bp, Homo sapiens
ggccagctcctgaggcag

SEQ ID NO: 8779410 - DNA, 22 bp, Homo sapiens
ggcccagagctccctggcacct

SEQ ID NO: 8779411 - DNA, 22 bp, Homo sapiens
ggcccagagggtcaggagctga

SEQ ID NO: 8779412 - DNA, 22 bp, Homo sapiens
ggcccagagctctgggggagct

SEQ ID NO: 8779413 - DNA, 22 bp, Homo sapiens
ggcccagagggtcaggagctga

SEQ ID NO: 8779414 - DNA, 22 bp, Homo sapiens
ggcccagagtctgcaatggagt

SEQ ID NO: 8779415 - DNA, 21 bp, Homo sapiens
ggccccagcccatgggttctc

SEQ ID NO: 8779416 - DNA, 21 bp, Homo sapiens
ggccccagcccatgggttctc

SEQ ID NO: 8779417 - DNA, 21 bp, Homo sapiens
ggccccagcccatgggttctc

SEQ ID NO: 8779418 - DNA, 22 bp, Homo sapiens
ggccccagcctcagtcccctga

SEQ ID NO: 8779419 - DNA, 22 bp, Homo sapiens
ggccccagcctcagtcccctga

SEQ ID NO: 8779420 - DNA, 21 bp, Homo sapiens
ggccccagcccatgggttctc

SEQ ID NO: 8779421 - DNA, 22 bp, Homo sapiens
ggccccagcagtgcttgtttat

SEQ ID NO: 8779422 - DNA, 19 bp, Homo sapiens
ggccccagccagggtatca

SEQ ID NO: 8779423 - DNA, 19 bp, Homo sapiens
ggccccagccagggtatca

SEQ ID NO: 8779424 - DNA, 19 bp, Homo sapiens
ggccccagccagggtatca

SEQ ID NO: 8779425 - DNA, 22 bp, Homo sapiens
ggccccagcagtgcttgtttat

SEQ ID NO: 8779426 - DNA, 22 bp, Homo sapiens
ggccccagcagaccctcctctg

SEQ ID NO: 8779427 - DNA, 22 bp, Homo sapiens
ggccccagcagaccctcctctg

SEQ ID NO: 8779428 - DNA, 22 bp, Homo sapiens
ggccccagcagaccctcctctg

SEQ ID NO: 8779429 - DNA, 22 bp, Homo sapiens
ggcccagcccgagtcagccttc

SEQ ID NO: 8779430 - DNA, 22 bp, Homo sapiens
ggcccagcccgagtcagccttc

SEQ ID NO: 8779431 - DNA, 22 bp, Homo sapiens
ggcccagcacagtgcttggggg

SEQ ID NO: 8779432 - DNA, 22 bp, Homo sapiens
ggcccagcacagtgcttggggg

SEQ ID NO: 8779433 - DNA, 22 bp, Homo sapiens
ggcccagcatcttgtgaagttt

SEQ ID NO: 8779434 - DNA, 22 bp, Homo sapiens
ggcccagcatcttgtgaagttt

SEQ ID NO: 8779435 - DNA, 22 bp, Homo sapiens
ggcgcaggccttggatcctggt

SEQ ID NO: 8779436 - DNA, 22 bp, Homo sapiens
ggcgcaggccttggatcctggt

SEQ ID NO: 8779437 - DNA, 22 bp, Homo sapiens
ggcgcacaatgtgcaggtttgt

SEQ ID NO: 8779438 - DNA, 17 bp, Homo sapiens
ggcctgtgtggctgcag

SEQ ID NO: 8779439 - DNA, 22 bp, Homo sapiens
ggcgagggagcagtgcggtggg

SEQ ID NO: 8779440 - DNA, 22 bp, Homo sapiens
ggcgagggagcagtgcggtggg

SEQ ID NO: 8779441 - DNA, 22 bp, Homo sapiens
ggcgagggagcagtgcggtggg

SEQ ID NO: 8779442 - DNA, 22 bp, Homo sapiens
ggcgccccatatagttcttaat

SEQ ID NO: 8779443 - DNA, 22 bp, Homo sapiens
ggcgcccccttcaaacagagca

SEQ ID NO: 8779444 - DNA, 22 bp, Homo sapiens
ggcgcccccttcaaacagagca

SEQ ID NO: 8779445 - DNA, 22 bp, Homo sapiens
ggcgcccccttcaaacagagca

SEQ ID NO: 8779446 - DNA, 22 bp, Homo sapiens
ggcgccagcccaggccgtcgtg

SEQ ID NO: 8779447 - DNA, 22 bp, Homo sapiens
ggcgccagcccaggccgtcgtg

SEQ ID NO: 8779448 - DNA, 22 bp, Homo sapiens
ggcgccagcactgcagcgcctc

SEQ ID NO: 8779449 - DNA, 22 bp, Homo sapiens
ggcgcaggccttggatcctggt

SEQ ID NO: 8779450 - DNA, 22 bp, Homo sapiens
ggccccagggattaggccaacc

SEQ ID NO: 8779451 - DNA, 17 bp, Homo sapiens
ggcctgtgtggctgcag

SEQ ID NO: 8779452 - DNA, 22 bp, Homo sapiens
ggccccagggattaggccaacc

SEQ ID NO: 8779453 - DNA, 22 bp, Homo sapiens
ggccccagggattaggccaacc

SEQ ID NO: 8779454 - DNA, 22 bp, Homo sapiens
ggccccagggaagaaggtggtc

SEQ ID NO: 8779455 - DNA, 22 bp, Homo sapiens
ggccccagggaagaaggtggtc

SEQ ID NO: 8779456 - DNA, 22 bp, Homo sapiens
ggccccagggaagaaggtggtc

SEQ ID NO: 8779457 - DNA, 22 bp, Homo sapiens
ggccccaggcctttggtctggc

SEQ ID NO: 8779458 - DNA, 22 bp, Homo sapiens
ggccccaggcctttggtctggc

SEQ ID NO: 8779459 - DNA, 22 bp, Homo sapiens
ggccccaggcctttggtctggc

SEQ ID NO: 8779460 - DNA, 22 bp, Homo sapiens
ggccccaggacctccacggtcc

SEQ ID NO: 8779461 - DNA, 22 bp, Homo sapiens
ggccccaggacctccacggtcc

SEQ ID NO: 8779462 - DNA, 22 bp, Homo sapiens
ggccccaggacctccacggtcc

SEQ ID NO: 8779463 - DNA, 22 bp, Homo sapiens
ggccccaggcctttggtctggc

SEQ ID NO: 8779464 - DNA, 22 bp, Homo sapiens
ggccccagcctcagtcccctga

SEQ ID NO: 8779465 - DNA, 22 bp, Homo sapiens
ggccccagctgtggtgaataga

SEQ ID NO: 8779466 - DNA, 22 bp, Homo sapiens
ggccccagcttcaaccccgtgg

SEQ ID NO: 8779467 - DNA, 22 bp, Homo sapiens
ggccccagctgtggtgaataga

SEQ ID NO: 8779468 - DNA, 22 bp, Homo sapiens
ggccccagcttcaaccccgtgg

SEQ ID NO: 8779469 - DNA, 22 bp, Homo sapiens
ggctgctggtaggggtaggaag

SEQ ID NO: 8779470 - DNA, 22 bp, Homo sapiens
ggctgctgggtcatgatgcaga

SEQ ID NO: 8779471 - DNA, 22 bp, Homo sapiens
ggctgctggtggaatggtaggc

SEQ ID NO: 8779472 - DNA, 22 bp, Homo sapiens
ggctgctggtaggggtaggaag

SEQ ID NO: 8779473 - DNA, 22 bp, Homo sapiens
ggctgctggtggaatggtaggc

SEQ ID NO: 8779474 - DNA, 21 bp, Homo sapiens
ggctgctgtcaccgctgtcac

SEQ ID NO: 8779475 - DNA, 20 bp, Homo sapiens
ggctgctggtttggctctgt

SEQ ID NO: 8779476 - DNA, 19 bp, Homo sapiens
ggctgctggttacagaggc

SEQ ID NO: 8779477 - DNA, 22 bp, Homo sapiens
cagaaatggagcccaggaatct

SEQ ID NO: 8779478 - DNA, 22 bp, Homo sapiens
cagaaatggaagttctggttta

SEQ ID NO: 8779479 - DNA, 22 bp, Homo sapiens
cagaaatggtctgttcagctta

SEQ ID NO: 8779480 - DNA, 22 bp, Homo sapiens
cagaaatgtactgacatgcagt

SEQ ID NO: 8779481 - DNA, 22 bp, Homo sapiens
cagaaatgtactgacatgcagt

SEQ ID NO: 8779482 - DNA, 22 bp, Homo sapiens
cagaaatggtctgttcagctta

SEQ ID NO: 8779483 - DNA, 22 bp, Homo sapiens
cagaaatgtactgacatgcagt

SEQ ID NO: 8779484 - DNA, 22 bp, Homo sapiens
cagaaatgtactgacatgcagt

SEQ ID NO: 8779485 - DNA, 22 bp, Homo sapiens
cagaaatgcctgcttctctctc

SEQ ID NO: 8779486 - DNA, 22 bp, Homo sapiens
ggctgctgtgacctcaggtgat

SEQ ID NO: 8779487 - DNA, 22 bp, Homo sapiens
cagaaatagacaatggcagtgg

SEQ ID NO: 8779488 - DNA, 22 bp, Homo sapiens
ggctgggagccccacagagtca

SEQ ID NO: 8779489 - DNA, 22 bp, Homo sapiens
ggctgggacgatgaggattagt

SEQ ID NO: 8779490 - DNA, 22 bp, Homo sapiens
ggctgggacgatgaggattagt

SEQ ID NO: 8779491 - DNA, 22 bp, Homo sapiens
ggctggctttctctccgcacct

SEQ ID NO: 8779492 - DNA, 22 bp, Homo sapiens
ggctgggagccccacagagtca

SEQ ID NO: 8779493 - DNA, 23 bp, Homo sapiens
ggctgggagctccgggtgcacgt

SEQ ID NO: 8779494 - DNA, 22 bp, Homo sapiens
ggctgggagccccacagagtca

SEQ ID NO: 8779495 - DNA, 23 bp, Homo sapiens
ggctgggagctccgggtgcacgt

SEQ ID NO: 8779496 - DNA, 22 bp, Homo sapiens
cagaaattcccatttcagattc

SEQ ID NO: 8779497 - DNA, 22 bp, Homo sapiens
cagaaatgtttatgcttttgaa

SEQ ID NO: 8779498 - DNA, 22 bp, Homo sapiens
cagaaatgtttatatgtggtgt

SEQ ID NO: 8779499 - DNA, 22 bp, Homo sapiens
cagaaatgttctaatgattcag

SEQ ID NO: 8779500 - DNA, 22 bp, Homo sapiens
cagaaatgtgatgtacacacac

SEQ ID NO: 8779501 - DNA, 22 bp, Homo sapiens
cagaacagaatcgtgtggtgag

SEQ ID NO: 8779502 - DNA, 22 bp, Homo sapiens
cagaacagaatcgtgtggtgag

SEQ ID NO: 8779503 - DNA, 22 bp, Homo sapiens
cagaacagaaacgttgttccat

SEQ ID NO: 8779504 - DNA, 22 bp, Homo sapiens
cagaaattggaatagagaaata

SEQ ID NO: 8779505 - DNA, 22 bp, Homo sapiens
cagaaattggaatagagaaata

SEQ ID NO: 8779506 - DNA, 20 bp, Homo sapiens
cagaaatttgtaaaagggat

SEQ ID NO: 8779507 - DNA, 22 bp, Homo sapiens
cagaacacaggctaaactgaga

SEQ ID NO: 8779508 - DNA, 22 bp, Homo sapiens
cagaacacattttcagagtcaa

SEQ ID NO: 8779509 - DNA, 22 bp, Homo sapiens
cagaacacaggctaaactgaga

SEQ ID NO: 8779510 - DNA, 22 bp, Homo sapiens
cagaacagtacctagcacatag

SEQ ID NO: 8779511 - DNA, 22 bp, Homo sapiens
cagaacagtacctagcacatag

SEQ ID NO: 8779512 - DNA, 22 bp, Homo sapiens
cagaacagtacctagcacatag

SEQ ID NO: 8779513 - DNA, 22 bp, Homo sapiens
cagaacagggcccaaggggtcg

SEQ ID NO: 8779514 - DNA, 22 bp, Homo sapiens
cagaacagggcccaaggggtcg

SEQ ID NO: 8779515 - DNA, 23 bp, Homo sapiens
cagaacagtaaaagatgccatgg

SEQ ID NO: 8779516 - DNA, 19 bp, Homo sapiens
cagaacagctgggaagaga

SEQ ID NO: 8779517 - DNA, 19 bp, Homo sapiens
cagaacaggaccaggggcc

SEQ ID NO: 8779518 - DNA, 19 bp, Homo sapiens
cagaacagaggtcatggcc

SEQ ID NO: 8779519 - DNA, 19 bp, Homo sapiens
cagaacagaggtcatggcc

SEQ ID NO: 8779520 - DNA, 19 bp, Homo sapiens
cagaacagaggtcatggcc

SEQ ID NO: 8779521 - DNA, 22 bp, Homo sapiens
cagaacattccatgtgccctgc

SEQ ID NO: 8779522 - DNA, 22 bp, Homo sapiens
cagaagaggactgggtagctca

SEQ ID NO: 8779523 - DNA, 22 bp, Homo sapiens
cagaacagtcgcctgcatggat

SEQ ID NO: 8779524 - DNA, 22 bp, Homo sapiens
cagaacagtcgcctgcatggat

SEQ ID NO: 8779525 - DNA, 20 bp, Homo sapiens
cagaacagtctgagaggcca

SEQ ID NO: 8779526 - DNA, 22 bp, Homo sapiens
cagaacatccccactgctacct

SEQ ID NO: 8779527 - DNA, 20 bp, Homo sapiens
cagaacatgagcatcgagcc

SEQ ID NO: 8779528 - DNA, 22 bp, Homo sapiens
cagaacatgatataaacagaag

SEQ ID NO: 8779529 - DNA, 22 bp, Homo sapiens
cagaacatgatataaacagaag

SEQ ID NO: 8779530 - DNA, 22 bp, Homo sapiens
cagaacagacttaacagggctg

SEQ ID NO: 8779531 - DNA, 22 bp, Homo sapiens
cagaacagagcctgaatctctc

SEQ ID NO: 8779532 - DNA, 22 bp, Homo sapiens
cagaacagacttaacagggctg

SEQ ID NO: 8779533 - DNA, 22 bp, Homo sapiens
ggcttggcagaggtgggtgctt

SEQ ID NO: 8779534 - DNA, 22 bp, Homo sapiens
ggcttggcaggtgccctgcgca

SEQ ID NO: 8779535 - DNA, 23 bp, Homo sapiens
ggcttgagctggaacagcttggt

SEQ ID NO: 8779536 - DNA, 22 bp, Homo sapiens
ggcttgagacccgggagccaga

SEQ ID NO: 8779537 - DNA, 22 bp, Homo sapiens
ggcttgcacacagcctcagttt

SEQ ID NO: 8779538 - DNA, 22 bp, Homo sapiens
ggcttgctgcatttcccaaaga

SEQ ID NO: 8779539 - DNA, 20 bp, Homo sapiens
ggcttgagtcagatcttgga

SEQ ID NO: 8779540 - DNA, 22 bp, Homo sapiens
ggcttgcttcttgtccaggaat

SEQ ID NO: 8779541 - DNA, 22 bp, Homo sapiens
ggcttgaaagaataggaatgca

SEQ ID NO: 8779542 - DNA, 22 bp, Homo sapiens
ggcttctttcactaagtagaga

SEQ ID NO: 8779543 - DNA, 20 bp, Homo sapiens
ggcttctttacatctgtgtt

SEQ ID NO: 8779544 - DNA, 23 bp, Homo sapiens
ggcttcttgcctgtcttggtgct

SEQ ID NO: 8779545 - DNA, 22 bp, Homo sapiens
ggcttcttgtgtgtcaggctct

SEQ ID NO: 8779546 - DNA, 23 bp, Homo sapiens
ggctgggagctccgggtgcacgt

SEQ ID NO: 8779547 - DNA, 22 bp, Homo sapiens
ggctgggagctggacaggccgg

SEQ ID NO: 8779548 - DNA, 22 bp, Homo sapiens
ggctgggagctggacaggccgg

SEQ ID NO: 8779549 - DNA, 22 bp, Homo sapiens
ggctgggagctggacaggccgg

SEQ ID NO: 8779550 - DNA, 22 bp, Homo sapiens
cactgattaagtctgctagagg

SEQ ID NO: 8779551 - DNA, 22 bp, Homo sapiens
cactgcaacctccacctcctgg

SEQ ID NO: 8779552 - DNA, 22 bp, Homo sapiens
cactgcaacaacctctacctcc

SEQ ID NO: 8779553 - DNA, 22 bp, Homo sapiens
cactgattaagtctgctagagg

SEQ ID NO: 8779554 - DNA, 22 bp, Homo sapiens
cactgcaaaggggaaagaagca

SEQ ID NO: 8779555 - DNA, 20 bp, Homo sapiens
cactgaggtgcagctcatgc

SEQ ID NO: 8779556 - DNA, 21 bp, Homo sapiens
cactgaggtcaggggtagggt

SEQ ID NO: 8779557 - DNA, 22 bp, Homo sapiens
cactgcaacctccacctcctgg

SEQ ID NO: 8779558 - DNA, 22 bp, Homo sapiens
ggctccagtttccccttggggc

SEQ ID NO: 8779559 - DNA, 22 bp, Homo sapiens
ggctccagtttgtgccttcagc

SEQ ID NO: 8779560 - DNA, 19 bp, Homo sapiens
ggctcctggggctcagccc

SEQ ID NO: 8779561 - DNA, 19 bp, Homo sapiens
ggctcctggggctcagccc

SEQ ID NO: 8779562 - DNA, 22 bp, Homo sapiens
cactgaggctgggggagaaggt

SEQ ID NO: 8779563 - DNA, 22 bp, Homo sapiens
cactgaggcttccttaggcaat

SEQ ID NO: 8779564 - DNA, 22 bp, Homo sapiens
cactgagggcggagcccaggga

SEQ ID NO: 8779565 - DNA, 22 bp, Homo sapiens
cactgagggagggtttcttctg

SEQ ID NO: 8779566 - DNA, 22 bp, Homo sapiens
cactgagggcggagcccaggga

SEQ ID NO: 8779567 - DNA, 22 bp, Homo sapiens
cactgagggggtggtttcagga

SEQ ID NO: 8779568 - DNA, 22 bp, Homo sapiens
cactgagggcggagcccaggga

SEQ ID NO: 8779569 - DNA, 22 bp, Homo sapiens
ggcgctggccacggtggctctg

SEQ ID NO: 8779570 - DNA, 22 bp, Homo sapiens
cactgaggctgggggagaaggt

SEQ ID NO: 8779571 - DNA, 22 bp, Homo sapiens
ggcgctcagtgttgccccagag

SEQ ID NO: 8779572 - DNA, 22 bp, Homo sapiens
ggcgctcagtgttgccccagag

SEQ ID NO: 8779573 - DNA, 22 bp, Homo sapiens
ggcgctcagtgttgccccagag

SEQ ID NO: 8779574 - DNA, 22 bp, Homo sapiens
ggcgccgcactcggtgcagccg

SEQ ID NO: 8779575 - DNA, 22 bp, Homo sapiens
ggcgccgcactcggtgcagccg

SEQ ID NO: 8779576 - DNA, 22 bp, Homo sapiens
ggcgccgcactcggtgcagccg

SEQ ID NO: 8779577 - DNA, 22 bp, Homo sapiens
ggctcctgggggtgctcctgcc

SEQ ID NO: 8779578 - DNA, 22 bp, Homo sapiens
ggctcctgggggtgctcctgcc

SEQ ID NO: 8779579 - DNA, 22 bp, Homo sapiens
ggctcctgggggtgctcctgcc

SEQ ID NO: 8779580 - DNA, 16 bp, Homo sapiens
ggctcctggttccttc

SEQ ID NO: 8779581 - DNA, 22 bp, Homo sapiens
ggctcctgtcccctcagctgct

SEQ ID NO: 8779582 - DNA, 22 bp, Homo sapiens
ggctcctgtcccctcagctgct

SEQ ID NO: 8779583 - DNA, 22 bp, Homo sapiens
ggctcctgtcctcctggagctc

SEQ ID NO: 8779584 - DNA, 22 bp, Homo sapiens
ggctcctgtggcaagacagctt

SEQ ID NO: 8779585 - DNA, 22 bp, Homo sapiens
ggctcctgtggcaagacagctt

SEQ ID NO: 8779586 - DNA, 22 bp, Homo sapiens
cactgcccaggacctgccaccc

SEQ ID NO: 8779587 - DNA, 22 bp, Homo sapiens
cactgcccaggacctgccaccc

SEQ ID NO: 8779588 - DNA, 22 bp, Homo sapiens
cactgcccaggcacccatcttg

SEQ ID NO: 8779589 - DNA, 22 bp, Homo sapiens
cactgcccagcgtcttaggcac

SEQ ID NO: 8779590 - DNA, 22 bp, Homo sapiens
cactgcccagcgtcttaggcac

SEQ ID NO: 8779591 - DNA, 22 bp, Homo sapiens
cactgcccagagggcagcattg

SEQ ID NO: 8779592 - DNA, 19 bp, Homo sapiens
ggctcctgtggctgcagcc

SEQ ID NO: 8779593 - DNA, 19 bp, Homo sapiens
ggctcctgtggctgcagcc

SEQ ID NO: 8779594 - DNA, 19 bp, Homo sapiens
ggctcctgtggctgcagcc

SEQ ID NO: 8779595 - DNA, 20 bp, Homo sapiens
cactgccctccagcctgagc

SEQ ID NO: 8779596 - DNA, 22 bp, Homo sapiens
cactgccctcactgtggttctc

SEQ ID NO: 8779597 - DNA, 20 bp, Homo sapiens
cactgccctccagcctgagc

SEQ ID NO: 8779598 - DNA, 22 bp, Homo sapiens
cactgcccaggcacccatcttg

SEQ ID NO: 8779599 - DNA, 22 bp, Homo sapiens
cactgcccaggacctgccaccc

SEQ ID NO: 8779600 - DNA, 22 bp, Homo sapiens
cactgcccaggcacccatcttg

SEQ ID NO: 8779601 - DNA, 22 bp, Homo sapiens
cactgccctgggggttgccatc

SEQ ID NO: 8779602 - DNA, 22 bp, Homo sapiens
cactgcccttacatgccctgca

SEQ ID NO: 8779603 - DNA, 22 bp, Homo sapiens
cactgcccttacatgccctgca

SEQ ID NO: 8779604 - DNA, 22 bp, Homo sapiens
cactgcctataaatttggccaa

SEQ ID NO: 8779605 - DNA, 20 bp, Homo sapiens
cactgccctccagcctgagc

SEQ ID NO: 8779606 - DNA, 22 bp, Homo sapiens
cactgtccatgcttgctaaccc

SEQ ID NO: 8779607 - DNA, 22 bp, Homo sapiens
cactgtcctagtcttcctggag

SEQ ID NO: 8779608 - DNA, 22 bp, Homo sapiens
ggctgcagcggattggggattg

SEQ ID NO: 8779609 - DNA, 22 bp, Homo sapiens
cactgtccctgtttcctggaaa

SEQ ID NO: 8779610 - DNA, 19 bp, Homo sapiens
cactgtcctagtcgaggcc

SEQ ID NO: 8779611 - DNA, 22 bp, Homo sapiens
ggctgcagccctcgcctagcca

SEQ ID NO: 8779612 - DNA, 22 bp, Homo sapiens
ggctgcagccctcgcctagcca

SEQ ID NO: 8779613 - DNA, 22 bp, Homo sapiens
ggctgcagccctcgcctagcca

SEQ ID NO: 8779614 - DNA, 22 bp, Homo sapiens
ggctgcagccctcgcctagcca

SEQ ID NO: 8779615 - DNA, 22 bp, Homo sapiens
ggctgcagccctcgcctagcca

SEQ ID NO: 8779616 - DNA, 22 bp, Homo sapiens
ggctgcagcagagggactcacg

SEQ ID NO: 8779617 - DNA, 22 bp, Homo sapiens
ggctgcagcagagggactcacg

SEQ ID NO: 8779618 - DNA, 22 bp, Homo sapiens
ggctgcagcagagggactcacg

SEQ ID NO: 8779619 - DNA, 22 bp, Homo sapiens
ggctgcagattgtagtctgtta

SEQ ID NO: 8779620 - DNA, 22 bp, Homo sapiens
ggctgcagattgtagtctgtta

SEQ ID NO: 8779621 - DNA, 22 bp, Homo sapiens
ggctgcagattgtagtctgtta

SEQ ID NO: 8779622 - DNA, 22 bp, Homo sapiens
ggctgcagatagccagccacca

SEQ ID NO: 8779623 - DNA, 22 bp, Homo sapiens
ggctgcagatagccagccacca

SEQ ID NO: 8779624 - DNA, 22 bp, Homo sapiens
ggctgcagatagccagccacca

SEQ ID NO: 8779625 - DNA, 22 bp, Homo sapiens
ggctgcagaggtcactttatag

SEQ ID NO: 8779626 - DNA, 22 bp, Homo sapiens
ggctgcagaggtcactttatag

SEQ ID NO: 8779627 - DNA, 22 bp, Homo sapiens
cactgcctgctggctgtcactt

SEQ ID NO: 8779628 - DNA, 22 bp, Homo sapiens
cactgcctccccaggctccaca

SEQ ID NO: 8779629 - DNA, 22 bp, Homo sapiens
cactgcctctgcctcctgggtt

SEQ ID NO: 8779630 - DNA, 22 bp, Homo sapiens
ggctgaggctcatgccatcttg

SEQ ID NO: 8779631 - DNA, 22 bp, Homo sapiens
ggctgaggctcatgccatcttg

SEQ ID NO: 8779632 - DNA, 22 bp, Homo sapiens
ggctgaggctcatgccatcttg

SEQ ID NO: 8779633 - DNA, 22 bp, Homo sapiens
ggctgaggctcatgccatcttg

SEQ ID NO: 8779634 - DNA, 22 bp, Homo sapiens
ggctgaggctcatgccatcttg

SEQ ID NO: 8779635 - DNA, 22 bp, Homo sapiens
ggctgcagaggcgatctgaggt

SEQ ID NO: 8779636 - DNA, 22 bp, Homo sapiens
ggctgctcctttaccctggcag

SEQ ID NO: 8779637 - DNA, 22 bp, Homo sapiens
ggctgctcctttaccctggcag

SEQ ID NO: 8779638 - DNA, 22 bp, Homo sapiens
ggctgctagcaatgctcaggcg

SEQ ID NO: 8779639 - DNA, 22 bp, Homo sapiens
ggctgctcaaggactctgatcg

SEQ ID NO: 8779640 - DNA, 22 bp, Homo sapiens
ggctgcggccgcgggtctgtgc

SEQ ID NO: 8779641 - DNA, 22 bp, Homo sapiens
ggctgcggccgcgggtctgtgc

SEQ ID NO: 8779642 - DNA, 22 bp, Homo sapiens
cactgtctgcttcgactcttca

SEQ ID NO: 8779643 - DNA, 22 bp, Homo sapiens
cactgtcttttgtgaagacaat

SEQ ID NO: 8779644 - DNA, 22 bp, Homo sapiens
cactgtgctccttccttagcac

SEQ ID NO: 8779645 - DNA, 22 bp, Homo sapiens
cactgtgctcctaactagctgt

SEQ ID NO: 8779646 - DNA, 22 bp, Homo sapiens
gagttatctatttaaaatgtcc

SEQ ID NO: 8779647 - DNA, 22 bp, Homo sapiens
gagttattagtcaaatagggaa

SEQ ID NO: 8779648 - DNA, 22 bp, Homo sapiens
gagttattctaggtcctttgta

SEQ ID NO: 8779649 - DNA, 22 bp, Homo sapiens
gagttattgagtatagaatgta

SEQ ID NO: 8779650 - DNA, 22 bp, Homo sapiens
gagttagggccccgcggccgtg

SEQ ID NO: 8779651 - DNA, 22 bp, Homo sapiens
gagttaattcgaatattctagc

SEQ ID NO: 8779652 - DNA, 22 bp, Homo sapiens
gagttacagagaggattatggt

SEQ ID NO: 8779653 - DNA, 22 bp, Homo sapiens
gagttaattcgaatattctagc

SEQ ID NO: 8779654 - DNA, 22 bp, Homo sapiens
gagttacatggacattctctcc

SEQ ID NO: 8779655 - DNA, 22 bp, Homo sapiens
gagttacatttggtgacacttc

SEQ ID NO: 8779656 - DNA, 22 bp, Homo sapiens
gatatttacaaatttgccaata

SEQ ID NO: 8779657 - DNA, 22 bp, Homo sapiens
gagttattgagtatagaatgta

SEQ ID NO: 8779658 - DNA, 22 bp, Homo sapiens
gagttattaatggctgagtttg

SEQ ID NO: 8779659 - DNA, 22 bp, Homo sapiens
gagttattctaggtcctttgta

SEQ ID NO: 8779660 - DNA, 19 bp, Homo sapiens
gagttattgccagggcatg

SEQ ID NO: 8779661 - DNA, 22 bp, Homo sapiens
gagttattgggtggaaaggtag

SEQ ID NO: 8779662 - DNA, 22 bp, Homo sapiens
gagttatttggtttgcatgcag

SEQ ID NO: 8779663 - DNA, 22 bp, Homo sapiens
gagttatttcagaaggaaagat

SEQ ID NO: 8779664 - DNA, 22 bp, Homo sapiens
gatatttaactctcacaggtcc

SEQ ID NO: 8779665 - DNA, 22 bp, Homo sapiens
gatcgggtgggttctgccatca

SEQ ID NO: 8779666 - DNA, 22 bp, Homo sapiens
gatctagaaggcaaatatagtg

SEQ ID NO: 8779667 - DNA, 18 bp, Homo sapiens
gatcgggggcgccccaag

SEQ ID NO: 8779668 - DNA, 22 bp, Homo sapiens
gatcgagttgtttgttctgggg

SEQ ID NO: 8779669 - DNA, 22 bp, Homo sapiens
gatccttacagttttgactcat

SEQ ID NO: 8779670 - DNA, 22 bp, Homo sapiens
gatccttatccttaaagatgct

SEQ ID NO: 8779671 - DNA, 22 bp, Homo sapiens
gatccttatttggtcaagcttc

SEQ ID NO: 8779672 - DNA, 22 bp, Homo sapiens
gatccttacagttagacgttgg

SEQ ID NO: 8779673 - DNA, 22 bp, Homo sapiens
gatctcagacaggtggacaggg

SEQ ID NO: 8779674 - DNA, 22 bp, Homo sapiens
gatctctgaatctgaagccttc

SEQ ID NO: 8779675 - DNA, 22 bp, Homo sapiens
gatctatttactcttttcctag

SEQ ID NO: 8779676 - DNA, 22 bp, Homo sapiens
gatctagaccagaagctgttgt

SEQ ID NO: 8779677 - DNA, 21 bp, Homo sapiens
gatctagacttgggcccagta

SEQ ID NO: 8779678 - DNA, 22 bp, Homo sapiens
gatctctgggtcctgttggcct

SEQ ID NO: 8779679 - DNA, 22 bp, Homo sapiens
gatctctgtggactcttagcac

SEQ ID NO: 8779680 - DNA, 22 bp, Homo sapiens
gatctggaatctgaaggctgag

SEQ ID NO: 8779681 - DNA, 22 bp, Homo sapiens
gatctgaatcaatagaataact

SEQ ID NO: 8779682 - DNA, 22 bp, Homo sapiens
gatctgagatctaaaccagagg

SEQ ID NO: 8779683 - DNA, 22 bp, Homo sapiens
atgtttccatagaagtcacagt

SEQ ID NO: 8779684 - DNA, 22 bp, Homo sapiens
atgtttccatagaagtcacagt

SEQ ID NO: 8779685 - DNA, 22 bp, Homo sapiens
atgtttccatagaagtcacagt

SEQ ID NO: 8779686 - DNA, 22 bp, Homo sapiens
atgtttccagctcagctgcagg

SEQ ID NO: 8779687 - DNA, 22 bp, Homo sapiens
atgtttccagctcagctgcagg

SEQ ID NO: 8779688 - DNA, 22 bp, Homo sapiens
atgtttccagctcagctgcagg

SEQ ID NO: 8779689 - DNA, 22 bp, Homo sapiens
atgtttcatttagatatcaggc

SEQ ID NO: 8779690 - DNA, 22 bp, Homo sapiens
atgtttccagatatgtcaccct

SEQ ID NO: 8779691 - DNA, 22 bp, Homo sapiens
atgtttcccagagcaaatctgg

SEQ ID NO: 8779692 - DNA, 22 bp, Homo sapiens
atgtttccattttcttgtatca

SEQ ID NO: 8779693 - DNA, 22 bp, Homo sapiens
atgtttccattttcttgtatca

SEQ ID NO: 8779694 - DNA, 22 bp, Homo sapiens
atgtttccatgttcaatttact

SEQ ID NO: 8779695 - DNA, 22 bp, Homo sapiens
atgtttccattttcttgtatca

SEQ ID NO: 8779696 - DNA, 22 bp, Homo sapiens
atgtttcccttctgatttggga

SEQ ID NO: 8779697 - DNA, 22 bp, Homo sapiens
atgtttcctgttggattggccc

SEQ ID NO: 8779698 - DNA, 22 bp, Homo sapiens
atgtttccttatagataaaagc

SEQ ID NO: 8779699 - DNA, 22 bp, Homo sapiens
atgtttcgtggaaaaagagtct

SEQ ID NO: 8779700 - DNA, 22 bp, Homo sapiens
gagtccagttctttccagcagt

SEQ ID NO: 8779701 - DNA, 22 bp, Homo sapiens
gagtccagttagtgaggctggg

SEQ ID NO: 8779702 - DNA, 23 bp, Homo sapiens
gagtgcagaatagacatgcagtg

SEQ ID NO: 8779703 - DNA, 22 bp, Homo sapiens
gagtccagttagtgaggctggg

SEQ ID NO: 8779704 - DNA, 22 bp, Homo sapiens
gagtccagttagtgaggctggg

SEQ ID NO: 8779705 - DNA, 22 bp, Homo sapiens
gagtccagttagtgaggctggg

SEQ ID NO: 8779706 - DNA, 22 bp, Homo sapiens
gagtccagtagttaggacagag

SEQ ID NO: 8779707 - DNA, 22 bp, Homo sapiens
gagtccagtagttaggacagag

SEQ ID NO: 8779708 - DNA, 20 bp, Homo sapiens
gagtccaggggcctgtagca

SEQ ID NO: 8779709 - DNA, 22 bp, Homo sapiens
gagtccaggctgttgctcatct

SEQ ID NO: 8779710 - DNA, 22 bp, Homo sapiens
gagtccaggctgttgctcatct

SEQ ID NO: 8779711 - DNA, 22 bp, Homo sapiens
gagtccaggctggtcaaatagc

SEQ ID NO: 8779712 - DNA, 23 bp, Homo sapiens
gagtgcagaatagacatgcagtg

SEQ ID NO: 8779713 - DNA, 21 bp, Homo sapiens
gagtgcagcaaggtagagtct

SEQ ID NO: 8779714 - DNA, 22 bp, Homo sapiens
gagtgcaggcctgagcaccatc

SEQ ID NO: 8779715 - DNA, 21 bp, Homo sapiens
gagtgcaggtctgatgccatc

SEQ ID NO: 8779716 - DNA, 22 bp, Homo sapiens
gagttaaatagcttaggattca

SEQ ID NO: 8779717 - DNA, 22 bp, Homo sapiens
gagttaaatagcttaggattca

SEQ ID NO: 8779718 - DNA, 22 bp, Homo sapiens
gagttaaatattttctgaagtt

SEQ ID NO: 8779719 - DNA, 22 bp, Homo sapiens
gagttaaatgacttggttaagg

SEQ ID NO: 8779720 - DNA, 22 bp, Homo sapiens
gagttaaatgacttggttaagg

SEQ ID NO: 8779721 - DNA, 22 bp, Homo sapiens
atgtttcatgactgagcaaaat

SEQ ID NO: 8779722 - DNA, 22 bp, Homo sapiens
atgtttcatccactggcctttc

SEQ ID NO: 8779723 - DNA, 22 bp, Homo sapiens
atgtttcatccactggcctttc

SEQ ID NO: 8779724 - DNA, 22 bp, Homo sapiens
atgtttcatcagtaaggttttg

SEQ ID NO: 8779725 - DNA, 22 bp, Homo sapiens
atgtttcaggcgaactaacatg

SEQ ID NO: 8779726 - DNA, 22 bp, Homo sapiens
atgtttcaggcgaactaacatg

SEQ ID NO: 8779727 - DNA, 22 bp, Homo sapiens
atgtttcagatacagatcaaat

SEQ ID NO: 8779728 - DNA, 21 bp, Homo sapiens
gagtgcaggtctgatgccatc

SEQ ID NO: 8779729 - DNA, 21 bp, Homo sapiens
gagtgcaggtctgatgccatc

SEQ ID NO: 8779730 - DNA, 22 bp, Homo sapiens
atgtttattgttttaagctgct

SEQ ID NO: 8779731 - DNA, 22 bp, Homo sapiens
atgtttattgttttaagctgct

SEQ ID NO: 8779732 - DNA, 22 bp, Homo sapiens
atgtttcaccagttttataaga

SEQ ID NO: 8779733 - DNA, 22 bp, Homo sapiens
atgtttcaatgcactttagcct

SEQ ID NO: 8779734 - DNA, 22 bp, Homo sapiens
atgtttcaagagaaaaagagac

SEQ ID NO: 8779735 - DNA, 22 bp, Homo sapiens
gaggggggcgccctgcagtgca

SEQ ID NO: 8779736 - DNA, 22 bp, Homo sapiens
gagggggctctgccaacctgtc

SEQ ID NO: 8779737 - DNA, 22 bp, Homo sapiens
gagggggctccctgaagccagt

SEQ ID NO: 8779738 - DNA, 22 bp, Homo sapiens
gagggggctccctgaagccagt

SEQ ID NO: 8779739 - DNA, 22 bp, Homo sapiens
gagggggctagcgcagtgccca

SEQ ID NO: 8779740 - DNA, 22 bp, Homo sapiens
gagggggctagcgcagtgccca

SEQ ID NO: 8779741 - DNA, 22 bp, Homo sapiens
gagggcaccagaagagccagat

SEQ ID NO: 8779742 - DNA, 22 bp, Homo sapiens
gagggcaccagaagagccagat

SEQ ID NO: 8779743 - DNA, 22 bp, Homo sapiens
gagggcaccagaagagccagat

SEQ ID NO: 8779744 - DNA, 22 bp, Homo sapiens
gagggcaccagaagagccagat

SEQ ID NO: 8779745 - DNA, 22 bp, Homo sapiens
gagggcagaaaattatgcggtg

SEQ ID NO: 8779746 - DNA, 22 bp, Homo sapiens
gagggcagaaaattatgcggtg

SEQ ID NO: 8779747 - DNA, 19 bp, Homo sapiens
gaggggaggaattgacaag

SEQ ID NO: 8779748 - DNA, 19 bp, Homo sapiens
gaggggaggaattgacaag

SEQ ID NO: 8779749 - DNA, 22 bp, Homo sapiens
gagggggcgtgcaaggctccgc

SEQ ID NO: 8779750 - DNA, 22 bp, Homo sapiens
gagggggcgtgcaaggctccgc

SEQ ID NO: 8779751 - DNA, 22 bp, Homo sapiens
gagggggcgtgcaaggctccgc

SEQ ID NO: 8779752 - DNA, 22 bp, Homo sapiens
gagtccaggatttgagctctgt

SEQ ID NO: 8779753 - DNA, 22 bp, Homo sapiens
gagtccagctctgcctcttact

SEQ ID NO: 8779754 - DNA, 18 bp, Homo sapiens
gagtccaggctcttcacc

SEQ ID NO: 8779755 - DNA, 22 bp, Homo sapiens
gagtccaggcatccctcccata

SEQ ID NO: 8779756 - DNA, 22 bp, Homo sapiens
gagtccagccctgttctagtaa

SEQ ID NO: 8779757 - DNA, 22 bp, Homo sapiens
gagtccagcagaatgagccaag

SEQ ID NO: 8779758 - DNA, 22 bp, Homo sapiens
gaggttggtgaggggacacggt

SEQ ID NO: 8779759 - DNA, 22 bp, Homo sapiens
gaggtagggcagaggctgaatg

SEQ ID NO: 8779760 - DNA, 22 bp, Homo sapiens
gaggtaggctgtgaaagggggt

SEQ ID NO: 8779761 - DNA, 22 bp, Homo sapiens
gaggttggggctgcagtgagct

SEQ ID NO: 8779762 - DNA, 22 bp, Homo sapiens
gaggttggggctgcagtgagct

SEQ ID NO: 8779763 - DNA, 22 bp, Homo sapiens
gaggttggggctgcagtgagct

SEQ ID NO: 8779764 - DNA, 22 bp, Homo sapiens
gaggtagacttcttggaagtag

SEQ ID NO: 8779765 - DNA, 22 bp, Homo sapiens
gaggtaagggcaggagagtgaa

SEQ ID NO: 8779766 - DNA, 22 bp, Homo sapiens
gaggggtcacatgggctggctt

SEQ ID NO: 8779767 - DNA, 22 bp, Homo sapiens
gaggggtcacatgggctggctt

SEQ ID NO: 8779768 - DNA, 22 bp, Homo sapiens
gaggggtcacatgggctggctt

SEQ ID NO: 8779769 - DNA, 17 bp, Homo sapiens
gaggtaggaagtgagtc

SEQ ID NO: 8779770 - DNA, 22 bp, Homo sapiens
gaggtagcgagtggacagtgca

SEQ ID NO: 8779771 - DNA, 17 bp, Homo sapiens
gaggtaggaagtgagtc

SEQ ID NO: 8779772 - DNA, 17 bp, Homo sapiens
gaggtaggaagtgagtc

SEQ ID NO: 8779773 - DNA, 17 bp, Homo sapiens
gaggtaggaagtgagtc

SEQ ID NO: 8779774 - DNA, 22 bp, Homo sapiens
gagggatggtgtgagaggctca

SEQ ID NO: 8779775 - DNA, 22 bp, Homo sapiens
gagggaagaaagaattgatgcg

SEQ ID NO: 8779776 - DNA, 22 bp, Homo sapiens
gagggaagaaagaattgatgcg

SEQ ID NO: 8779777 - DNA, 22 bp, Homo sapiens
gagggaaaggttaatacatgat

SEQ ID NO: 8779778 - DNA, 22 bp, Homo sapiens
gagggatgtgcctgaaggcagg

SEQ ID NO: 8779779 - DNA, 22 bp, Homo sapiens
gagggatgtgcctgaaggcagg

SEQ ID NO: 8779780 - DNA, 22 bp, Homo sapiens
gagggatggtgtgagaggctca

SEQ ID NO: 8779781 - DNA, 22 bp, Homo sapiens
gagggatggtgtgagaggctca

SEQ ID NO: 8779782 - DNA, 22 bp, Homo sapiens
gaggcttgggacattagttgca

SEQ ID NO: 8779783 - DNA, 22 bp, Homo sapiens
gaggctttacctagtaaagtgg

SEQ ID NO: 8779784 - DNA, 22 bp, Homo sapiens
gaggctttataactatttgttc

SEQ ID NO: 8779785 - DNA, 22 bp, Homo sapiens
gaggctttcacaaggttagttc

SEQ ID NO: 8779786 - DNA, 22 bp, Homo sapiens
gaggcttctgtaaccctgtcct

SEQ ID NO: 8779787 - DNA, 22 bp, Homo sapiens
gaggcttctgttcactcacgct

SEQ ID NO: 8779788 - DNA, 22 bp, Homo sapiens
gaggcttgcaccatgagcacca

SEQ ID NO: 8779789 - DNA, 22 bp, Homo sapiens
gaggcttcccgcccatgctgga

SEQ ID NO: 8779790 - DNA, 22 bp, Homo sapiens
gaggcttctggaaagcctggca

SEQ ID NO: 8779791 - DNA, 22 bp, Homo sapiens
gaggcttctgtaaccctgtcct

SEQ ID NO: 8779792 - DNA, 22 bp, Homo sapiens
gaggctgttggctgatctgagt

SEQ ID NO: 8779793 - DNA, 22 bp, Homo sapiens
gaggcttcccgcccatgctgga

SEQ ID NO: 8779794 - DNA, 22 bp, Homo sapiens
gaggctgtttgtggcagtgatg

SEQ ID NO: 8779795 - DNA, 22 bp, Homo sapiens
gaggctgctttgatgacaggag

SEQ ID NO: 8779796 - DNA, 22 bp, Homo sapiens
gaggctgctttgatgacaggag

SEQ ID NO: 8779797 - DNA, 22 bp, Homo sapiens
gaggctgttaggagggactctg

SEQ ID NO: 8779798 - DNA, 22 bp, Homo sapiens
gaggctgttaggagggactctg

SEQ ID NO: 8779799 - DNA, 22 bp, Homo sapiens
gaggctgttaggagggactctg

SEQ ID NO: 8779800 - DNA, 22 bp, Homo sapiens
gaggctgtgtcttggggtggaa

SEQ ID NO: 8779801 - DNA, 22 bp, Homo sapiens
gaggccacagtcctgaggcatc

SEQ ID NO: 8779802 - DNA, 22 bp, Homo sapiens
gaggccacagtcctgaggcatc

SEQ ID NO: 8779803 - DNA, 22 bp, Homo sapiens
atgtcacatctgggatggccct

SEQ ID NO: 8779804 - DNA, 22 bp, Homo sapiens
atgtcacagttgcaacatgaat

SEQ ID NO: 8779805 - DNA, 22 bp, Homo sapiens
atgtcacattggagctgctgga

SEQ ID NO: 8779806 - DNA, 22 bp, Homo sapiens
atgtcacccagctcccaacttt

SEQ ID NO: 8779807 - DNA, 22 bp, Homo sapiens
atgtcacattggagctgctgga

SEQ ID NO: 8779808 - DNA, 22 bp, Homo sapiens
gaggccaatgaagtgagtttaa

SEQ ID NO: 8779809 - DNA, 22 bp, Homo sapiens
gaggcattaaagggaatcttct

SEQ ID NO: 8779810 - DNA, 22 bp, Homo sapiens
gaggccaaggtgggcagatcac

SEQ ID NO: 8779811 - DNA, 22 bp, Homo sapiens
gaggccaagggagaagatctct

SEQ ID NO: 8779812 - DNA, 17 bp, Homo sapiens
gaggccaaggcaggcgg

SEQ ID NO: 8779813 - DNA, 22 bp, Homo sapiens
atgtaacacccacttttatagc

SEQ ID NO: 8779814 - DNA, 22 bp, Homo sapiens
atgtaacacccacttttatagc

SEQ ID NO: 8779815 - DNA, 22 bp, Homo sapiens
atgtaacaggtgaagctctgag

SEQ ID NO: 8779816 - DNA, 22 bp, Homo sapiens
atgtaacaggtgaagctctgag

SEQ ID NO: 8779817 - DNA, 22 bp, Homo sapiens
atgtaacattgaattatatagt

SEQ ID NO: 8779818 - DNA, 22 bp, Homo sapiens
atgtaacattgaattatatagt

SEQ ID NO: 8779819 - DNA, 22 bp, Homo sapiens
atgtaactgaaggaaatgcatg

SEQ ID NO: 8779820 - DNA, 22 bp, Homo sapiens
atgtaacatatgtgatcgcatt

SEQ ID NO: 8779821 - DNA, 22 bp, Homo sapiens
atgtaacattgaattatatagt

SEQ ID NO: 8779822 - DNA, 22 bp, Homo sapiens
atgtaacaaatggtatacatgt

SEQ ID NO: 8779823 - DNA, 22 bp, Homo sapiens
atgtaaattgtactgacacacg

SEQ ID NO: 8779824 - DNA, 22 bp, Homo sapiens
atgtaaattgtactgacacacg

SEQ ID NO: 8779825 - DNA, 22 bp, Homo sapiens
atggtttacaatgttttcagtt

SEQ ID NO: 8779826 - DNA, 22 bp, Homo sapiens
atgtaaagtataaagtaagggg

SEQ ID NO: 8779827 - DNA, 22 bp, Homo sapiens
atgtaaatcaagcagtgctggt

SEQ ID NO: 8779828 - DNA, 22 bp, Homo sapiens
atgtaaagttacttgagttttg

SEQ ID NO: 8779829 - DNA, 22 bp, Homo sapiens
atgtaaggtttcttcctgttcc

SEQ ID NO: 8779830 - DNA, 22 bp, Homo sapiens
atgtaaggagccacagtggggg

SEQ ID NO: 8779831 - DNA, 22 bp, Homo sapiens
atgtaacttctgtgaatctgac

SEQ ID NO: 8779832 - DNA, 22 bp, Homo sapiens
atgtaacttcctcagggatggt

SEQ ID NO: 8779833 - DNA, 22 bp, Homo sapiens
atgtaactgttatattttgttg

SEQ ID NO: 8779834 - DNA, 22 bp, Homo sapiens
atgtaagagtctaagattgtag

SEQ ID NO: 8779835 - DNA, 22 bp, Homo sapiens
atgtaagactttaagaacctaa

SEQ ID NO: 8779836 - DNA, 22 bp, Homo sapiens
atgtaatgattgcaatgctgct

SEQ ID NO: 8779837 - DNA, 22 bp, Homo sapiens
atgtaatagggtaacataacat

SEQ ID NO: 8779838 - DNA, 22 bp, Homo sapiens
atgtaattgtagcaaaatgatg

SEQ ID NO: 8779839 - DNA, 22 bp, Homo sapiens
atgtaattctaagactgaagaa

SEQ ID NO: 8779840 - DNA, 22 bp, Homo sapiens
atgtaattgtagcaaaatgatg

SEQ ID NO: 8779841 - DNA, 22 bp, Homo sapiens
atgtaattgtagcaaaatgatg

SEQ ID NO: 8779842 - DNA, 22 bp, Homo sapiens
atgtaatttagaaatgaacaca

SEQ ID NO: 8779843 - DNA, 22 bp, Homo sapiens
atgtaatttgccctcaagttaa

SEQ ID NO: 8779844 - DNA, 22 bp, Homo sapiens
atgtaatttgccctcaagttaa

SEQ ID NO: 8779845 - DNA, 22 bp, Homo sapiens
atgtaatttatgttatccataa

SEQ ID NO: 8779846 - DNA, 22 bp, Homo sapiens
atgtaatttagaaatgaacaca

SEQ ID NO: 8779847 - DNA, 22 bp, Homo sapiens
atgtaatttagaaatgaacaca

SEQ ID NO: 8779848 - DNA, 22 bp, Homo sapiens
atgtaatttagaaatgaacaca

SEQ ID NO: 8779849 - DNA, 22 bp, Homo sapiens
atgtaagtattcaaaatatttc

SEQ ID NO: 8779850 - DNA, 22 bp, Homo sapiens
atgtaatttatgttatccataa

SEQ ID NO: 8779851 - DNA, 22 bp, Homo sapiens
atgtaatttatgttatccataa

SEQ ID NO: 8779852 - DNA, 22 bp, Homo sapiens
atgtacaaaatgccactgaatt

SEQ ID NO: 8779853 - DNA, 22 bp, Homo sapiens
atgtacaaaatgttttgaaatg

SEQ ID NO: 8779854 - DNA, 22 bp, Homo sapiens
atgtacaaaatgttttgaaatg

SEQ ID NO: 8779855 - DNA, 22 bp, Homo sapiens
atgtacaaaatgttttgaaatg

SEQ ID NO: 8779856 - DNA, 22 bp, Homo sapiens
atgtacaacctgcatgacagtc

SEQ ID NO: 8779857 - DNA, 22 bp, Homo sapiens
atgtacaacctgcatgacagtc

SEQ ID NO: 8779858 - DNA, 22 bp, Homo sapiens
atgtacaacctgcatgacagtc

SEQ ID NO: 8779859 - DNA, 22 bp, Homo sapiens
atgtacaagctgttttactgca

SEQ ID NO: 8779860 - DNA, 22 bp, Homo sapiens
atgtacaatctatcacaagaag

SEQ ID NO: 8779861 - DNA, 22 bp, Homo sapiens
atgtacaatctatcacaagaag

SEQ ID NO: 8779862 - DNA, 22 bp, Homo sapiens
atgtacaatctagggtttgcat

SEQ ID NO: 8779863 - DNA, 22 bp, Homo sapiens
atgtacaagctgttttactgca

SEQ ID NO: 8779864 - DNA, 22 bp, Homo sapiens
atgtcacagttgcaacatgaat

SEQ ID NO: 8779865 - DNA, 22 bp, Homo sapiens
atgtcacagtctgactcagtga

SEQ ID NO: 8779866 - DNA, 22 bp, Homo sapiens
atgtcacagtctgactcagtga

SEQ ID NO: 8779867 - DNA, 22 bp, Homo sapiens
atgtcacagtctgactcagtga

SEQ ID NO: 8779868 - DNA, 22 bp, Homo sapiens
atgtcacagtctgactcagtga

SEQ ID NO: 8779869 - DNA, 22 bp, Homo sapiens
atgtcacaggcaacaagattgc

SEQ ID NO: 8779870 - DNA, 22 bp, Homo sapiens
atgtcacagcaggagtattctt

SEQ ID NO: 8779871 - DNA, 22 bp, Homo sapiens
atgtcacagcaggagtattctt

SEQ ID NO: 8779872 - DNA, 22 bp, Homo sapiens
atgtcacagcaggagtattctt

SEQ ID NO: 8779873 - DNA, 21 bp, Homo sapiens
atgtcaaatgctttattttat

SEQ ID NO: 8779874 - DNA, 22 bp, Homo sapiens
atgtcaagactatactttgcct

SEQ ID NO: 8779875 - DNA, 18 bp, Homo sapiens
atgtcacagagggctgaa

SEQ ID NO: 8779876 - DNA, 22 bp, Homo sapiens
atgtacaatctatcacaagaag

SEQ ID NO: 8779877 - DNA, 22 bp, Homo sapiens
atgtatttgaaatttgagacat

SEQ ID NO: 8779878 - DNA, 22 bp, Homo sapiens
gaggaagatggttgagtggtcc

SEQ ID NO: 8779879 - DNA, 22 bp, Homo sapiens
gaggaagcagggcttggctgag

SEQ ID NO: 8779880 - DNA, 22 bp, Homo sapiens
gaggaagccccattgaagccag

SEQ ID NO: 8779881 - DNA, 22 bp, Homo sapiens
gagctttgtctcctggagaccc

SEQ ID NO: 8779882 - DNA, 22 bp, Homo sapiens
gagctttgttccgtggtggcac

SEQ ID NO: 8779883 - DNA, 22 bp, Homo sapiens
gagctttgtgctggtaggtggt

SEQ ID NO: 8779884 - DNA, 22 bp, Homo sapiens
gagctttgttccgtggtggcac

SEQ ID NO: 8779885 - DNA, 22 bp, Homo sapiens
gagctttgtaaaaaacttgcac

SEQ ID NO: 8779886 - DNA, 22 bp, Homo sapiens
gagctttggtgccaagtatttg

SEQ ID NO: 8779887 - DNA, 22 bp, Homo sapiens
gagctttgtcccttgggggctc

SEQ ID NO: 8779888 - DNA, 22 bp, Homo sapiens
gagctttgtagcaggaaggaag

SEQ ID NO: 8779889 - DNA, 22 bp, Homo sapiens
gagctttgtcccttgggggctc

SEQ ID NO: 8779890 - DNA, 22 bp, Homo sapiens
gagctttgctggaagcctgggg

SEQ ID NO: 8779891 - DNA, 22 bp, Homo sapiens
gagctttggggaagaatacaga

SEQ ID NO: 8779892 - DNA, 22 bp, Homo sapiens
gagctttgcattattcagaagc

SEQ ID NO: 8779893 - DNA, 22 bp, Homo sapiens
gagctttgctggaagcctgggg

SEQ ID NO: 8779894 - DNA, 22 bp, Homo sapiens
gagctttgcctaaaactagaat

SEQ ID NO: 8779895 - DNA, 22 bp, Homo sapiens
gaggaaggagggaaagcgcgcg

SEQ ID NO: 8779896 - DNA, 22 bp, Homo sapiens
gaggaaggaatgcagtgtatgc

SEQ ID NO: 8779897 - DNA, 22 bp, Homo sapiens
gaggaaggagggaaagcgcgcg

SEQ ID NO: 8779898 - DNA, 22 bp, Homo sapiens
gaggaaggaatgcagtgtatgc

SEQ ID NO: 8779899 - DNA, 22 bp, Homo sapiens
gaggaaggaatgcagtgtatgc

SEQ ID NO: 8779900 - DNA, 22 bp, Homo sapiens
gaggaaggaatgcagtgtatgc

SEQ ID NO: 8779901 - DNA, 22 bp, Homo sapiens
gaggaaggaatgcagtgtatgc

SEQ ID NO: 8779902 - DNA, 22 bp, Homo sapiens
atggtttaaagagtatgacttt

SEQ ID NO: 8779903 - DNA, 22 bp, Homo sapiens
atggtttaagggagaatattga

SEQ ID NO: 8779904 - DNA, 22 bp, Homo sapiens
atggttcatattatgcatctga

SEQ ID NO: 8779905 - DNA, 22 bp, Homo sapiens
atggttattggccagatgccat

SEQ ID NO: 8779906 - DNA, 22 bp, Homo sapiens
gaggaaggctaaggggcttaga

SEQ ID NO: 8779907 - DNA, 22 bp, Homo sapiens
gaggaaggatttagtttgaggg

SEQ ID NO: 8779908 - DNA, 22 bp, Homo sapiens
gagctttgagattcttatggta

SEQ ID NO: 8779909 - DNA, 22 bp, Homo sapiens
gagctttgatcgctaagcctca

SEQ ID NO: 8779910 - DNA, 22 bp, Homo sapiens
gagctttacttctgactggtgc

SEQ ID NO: 8779911 - DNA, 22 bp, Homo sapiens
gagcttggtgttatttctgtgg

SEQ ID NO: 8779912 - DNA, 22 bp, Homo sapiens
gagcttggtgctgcctgttgtc

SEQ ID NO: 8779913 - DNA, 22 bp, Homo sapiens
gagcttggtgctgcctgttgtc

SEQ ID NO: 8779914 - DNA, 22 bp, Homo sapiens
gagcttggtgcacagtggttaa

SEQ ID NO: 8779915 - DNA, 22 bp, Homo sapiens
gagcttggctggacctcacgga

SEQ ID NO: 8779916 - DNA, 22 bp, Homo sapiens
gagctggggcggatactcagct

SEQ ID NO: 8779917 - DNA, 22 bp, Homo sapiens
gagctggggcggatactcagct

SEQ ID NO: 8779918 - DNA, 22 bp, Homo sapiens
gagctggggcggatactcagct

SEQ ID NO: 8779919 - DNA, 22 bp, Homo sapiens
gagcttggtgatgcctcctggt

SEQ ID NO: 8779920 - DNA, 22 bp, Homo sapiens
gagcttggtgcacagtggttaa

SEQ ID NO: 8779921 - DNA, 22 bp, Homo sapiens
gagcttggggcatatggtgcta

SEQ ID NO: 8779922 - DNA, 22 bp, Homo sapiens
gagcttgggtgccatgctgagc

SEQ ID NO: 8779923 - DNA, 22 bp, Homo sapiens
gagctctggacgaggggagtgg

SEQ ID NO: 8779924 - DNA, 22 bp, Homo sapiens
gagctctggcagggcaggtctg

SEQ ID NO: 8779925 - DNA, 22 bp, Homo sapiens
gagctctggcagggcaggtctg

SEQ ID NO: 8779926 - DNA, 22 bp, Homo sapiens
gagctctgcttgggttcttagg

SEQ ID NO: 8779927 - DNA, 22 bp, Homo sapiens
gagctctgcttgggttcttagg

SEQ ID NO: 8779928 - DNA, 22 bp, Homo sapiens
gagctctggacgaggggagtgg

SEQ ID NO: 8779929 - DNA, 22 bp, Homo sapiens
gagctctgctactcaaagtatg

SEQ ID NO: 8779930 - DNA, 22 bp, Homo sapiens
gagctctgcggaaaacgtgccg

SEQ ID NO: 8779931 - DNA, 22 bp, Homo sapiens
gagctctgtacacagagggtgt

SEQ ID NO: 8779932 - DNA, 22 bp, Homo sapiens
gagctctgtgaatgtggggagg

SEQ ID NO: 8779933 - DNA, 22 bp, Homo sapiens
gagctctgtgaatgtggggagg

SEQ ID NO: 8779934 - DNA, 22 bp, Homo sapiens
gagctctgtccacacttggaga

SEQ ID NO: 8779935 - DNA, 22 bp, Homo sapiens
gagctctgtccacacttggaga

SEQ ID NO: 8779936 - DNA, 22 bp, Homo sapiens
gagctctgggaaacaaagtgta

SEQ ID NO: 8779937 - DNA, 22 bp, Homo sapiens
gagctctgggtggcaggtgtct

SEQ ID NO: 8779938 - DNA, 22 bp, Homo sapiens
gagctctgggtggcaggtgtct

SEQ ID NO: 8779939 - DNA, 22 bp, Homo sapiens
gagctctgggtgtgttgtcagt

SEQ ID NO: 8779940 - DNA, 22 bp, Homo sapiens
gagctctgggtgtgttgtcagt

SEQ ID NO: 8779941 - DNA, 22 bp, Homo sapiens
gagctctggttcatgatctatt

SEQ ID NO: 8779942 - DNA, 22 bp, Homo sapiens
gagcagggagacaactctggtg

SEQ ID NO: 8779943 - DNA, 22 bp, Homo sapiens
gagcagggagacaactctggtg

SEQ ID NO: 8779944 - DNA, 22 bp, Homo sapiens
gagcagggagacaactctggtg

SEQ ID NO: 8779945 - DNA, 22 bp, Homo sapiens
gagcagggagacaactctggtg

SEQ ID NO: 8779946 - DNA, 19 bp, Homo sapiens
gagcagctgcacccattga

SEQ ID NO: 8779947 - DNA, 22 bp, Homo sapiens
gagcagctgagctggaatgaga

SEQ ID NO: 8779948 - DNA, 22 bp, Homo sapiens
gagcagctgagctggaatgaga

SEQ ID NO: 8779949 - DNA, 22 bp, Homo sapiens
gagcagctgagctggaatgaga

SEQ ID NO: 8779950 - DNA, 22 bp, Homo sapiens
gagcagctgagctggaatgaga

SEQ ID NO: 8779951 - DNA, 22 bp, Homo sapiens
gagcagctctgggtgacccagt

SEQ ID NO: 8779952 - DNA, 22 bp, Homo sapiens
gagcagctctgggtgacccagt

SEQ ID NO: 8779953 - DNA, 22 bp, Homo sapiens
gagcagctctgtgcctggagac

SEQ ID NO: 8779954 - DNA, 22 bp, Homo sapiens
gagcagggccacttctgtacct

SEQ ID NO: 8779955 - DNA, 22 bp, Homo sapiens
gagcagggccacttctgtacct

SEQ ID NO: 8779956 - DNA, 17 bp, Homo sapiens
gagcagggatgcggttc

SEQ ID NO: 8779957 - DNA, 17 bp, Homo sapiens
gagcagggatgcggttc

SEQ ID NO: 8779958 - DNA, 22 bp, Homo sapiens
gagcagggcttgtcctcctcat

SEQ ID NO: 8779959 - DNA, 22 bp, Homo sapiens
gagcagggcttgtcctcctcat

SEQ ID NO: 8779960 - DNA, 22 bp, Homo sapiens
gagcagggcttgtcctcctcat

SEQ ID NO: 8779961 - DNA, 22 bp, Homo sapiens
gagcagggcttgtcctcctcat

SEQ ID NO: 8779962 - DNA, 22 bp, Homo sapiens
gagcctggattgtcaccgactt

SEQ ID NO: 8779963 - DNA, 22 bp, Homo sapiens
gagccctcttgtctatatggta

SEQ ID NO: 8779964 - DNA, 20 bp, Homo sapiens
gagccctctgcactagcgcc

SEQ ID NO: 8779965 - DNA, 22 bp, Homo sapiens
gagccctcttccctagtgatcg

SEQ ID NO: 8779966 - DNA, 22 bp, Homo sapiens
gagccctcttccctagtgatcg

SEQ ID NO: 8779967 - DNA, 22 bp, Homo sapiens
gagcagtgaagacagaagtaca

SEQ ID NO: 8779968 - DNA, 22 bp, Homo sapiens
gagcagtaggagaaccctgagc

SEQ ID NO: 8779969 - DNA, 22 bp, Homo sapiens
gagcagtgaagacagaagtaca

SEQ ID NO: 8779970 - DNA, 22 bp, Homo sapiens
gagcagtaggagaaccctgagc

SEQ ID NO: 8779971 - DNA, 22 bp, Homo sapiens
gagcaggtgcctgtagctctct

SEQ ID NO: 8779972 - DNA, 22 bp, Homo sapiens
gagcagtaggagaaccctgagc

SEQ ID NO: 8779973 - DNA, 22 bp, Homo sapiens
gagcctggcctcctgcctcagc

SEQ ID NO: 8779974 - DNA, 22 bp, Homo sapiens
gagcctggcctcctgcctcagc

SEQ ID NO: 8779975 - DNA, 22 bp, Homo sapiens
gagcctggcctcctgcctcagc

SEQ ID NO: 8779976 - DNA, 22 bp, Homo sapiens
gagcctggcctcctgcctcagc

SEQ ID NO: 8779977 - DNA, 22 bp, Homo sapiens
gagcctggcctcctgcctcagc

SEQ ID NO: 8779978 - DNA, 22 bp, Homo sapiens
gagcctggcctcctgcctcagc

SEQ ID NO: 8779979 - DNA, 22 bp, Homo sapiens
gagcctgggactgggggtcatg

SEQ ID NO: 8779980 - DNA, 22 bp, Homo sapiens
gagcctgggactgggggtcatg

SEQ ID NO: 8779981 - DNA, 22 bp, Homo sapiens
gagcctgggactgggggtcatg

SEQ ID NO: 8779982 - DNA, 22 bp, Homo sapiens
gagcctgggactgggggtcatg

SEQ ID NO: 8779983 - DNA, 22 bp, Homo sapiens
gagcctgggtccttccctggga

SEQ ID NO: 8779984 - DNA, 22 bp, Homo sapiens
gagcctgggtccttccctggga

SEQ ID NO: 8779985 - DNA, 22 bp, Homo sapiens
gagcctggggaccctcctgagt

SEQ ID NO: 8779986 - DNA, 22 bp, Homo sapiens
gagcctgggtccttccctggga

SEQ ID NO: 8779987 - DNA, 22 bp, Homo sapiens
gagcctgggtccttccctggga

SEQ ID NO: 8779988 - DNA, 22 bp, Homo sapiens
gagcctgggtccttccctggga

SEQ ID NO: 8779989 - DNA, 22 bp, Homo sapiens
gagcctggggaccctcctgagt

SEQ ID NO: 8779990 - DNA, 22 bp, Homo sapiens
gagcctggggaccctcctgagt

SEQ ID NO: 8779991 - DNA, 22 bp, Homo sapiens
gagcctgggactgggggtcatg

SEQ ID NO: 8779992 - DNA, 22 bp, Homo sapiens
gagcctgggactgggggtcatg

SEQ ID NO: 8779993 - DNA, 22 bp, Homo sapiens
gagcctggggaccctcctgagt

SEQ ID NO: 8779994 - DNA, 22 bp, Homo sapiens
gagctctgccatggctcccacc

SEQ ID NO: 8779995 - DNA, 18 bp, Homo sapiens
gagctctgcctcccagtc

SEQ ID NO: 8779996 - DNA, 18 bp, Homo sapiens
gagctctgcctcccagtc

SEQ ID NO: 8779997 - DNA, 22 bp, Homo sapiens
gagcggaggcttggaggccagc

SEQ ID NO: 8779998 - DNA, 22 bp, Homo sapiens
gagcggaggcttggaggccagc

SEQ ID NO: 8779999 - DNA, 23 bp, Homo sapiens
gagctctgcactaggccctggga

SEQ ID NO: 8780000 - DNA, 23 bp, Homo sapiens
gagctctgcactaggccctggga

SEQ ID NO: 8780001 - DNA, 23 bp, Homo sapiens
gagctctgcactaggccctggga

SEQ ID NO: 8780002 - DNA, 22 bp, Homo sapiens
gagctctgcagattgttttagg

SEQ ID NO: 8780003 - DNA, 19 bp, Homo sapiens
gagcgcagagggcagggga

SEQ ID NO: 8780004 - DNA, 22 bp, Homo sapiens
gagcggaggcttggaggccagc

SEQ ID NO: 8780005 - DNA, 19 bp, Homo sapiens
gagcgcagagggcagggga

SEQ ID NO: 8780006 - DNA, 21 bp, Homo sapiens
gagcgccgctcacctcccctg

SEQ ID NO: 8780007 - DNA, 22 bp, Homo sapiens
gagcctttgaagccctcagaga

SEQ ID NO: 8780008 - DNA, 22 bp, Homo sapiens
gagcgattgcgggggtcagagg

SEQ ID NO: 8780009 - DNA, 19 bp, Homo sapiens
gagcgcagagggcagggga

SEQ ID NO: 8780010 - DNA, 22 bp, Homo sapiens
gagcctgggtccttccctggga

SEQ ID NO: 8780011 - DNA, 22 bp, Homo sapiens
gagcctgtgtttcctgtagcca

SEQ ID NO: 8780012 - DNA, 21 bp, Homo sapiens
gagccttccctctgccctttc

SEQ ID NO: 8780013 - DNA, 22 bp, Homo sapiens
gagaggaatatcattatattag

SEQ ID NO: 8780014 - DNA, 21 bp, Homo sapiens
atggaaaaacaggtagagcat

SEQ ID NO: 8780015 - DNA, 22 bp, Homo sapiens
atgcttttggtctttggtccgg

SEQ ID NO: 8780016 - DNA, 22 bp, Homo sapiens
atgcttttcctaaaatgatgcc

SEQ ID NO: 8780017 - DNA, 22 bp, Homo sapiens
atgcttttcctaaaatgatgcc

SEQ ID NO: 8780018 - DNA, 22 bp, Homo sapiens
atgctttttaaacttaattgga

SEQ ID NO: 8780019 - DNA, 22 bp, Homo sapiens
atgcttttggtctttggtccgg

SEQ ID NO: 8780020 - DNA, 22 bp, Homo sapiens
atgcttttggtctttggtccgg

SEQ ID NO: 8780021 - DNA, 22 bp, Homo sapiens
atgcttttggtctttggtccgg

SEQ ID NO: 8780022 - DNA, 22 bp, Homo sapiens
gagaggctctgaggactggggt

SEQ ID NO: 8780023 - DNA, 22 bp, Homo sapiens
gagaggaatgaggttaaggact

SEQ ID NO: 8780024 - DNA, 22 bp, Homo sapiens
gagaggctccgccactgctcag

SEQ ID NO: 8780025 - DNA, 22 bp, Homo sapiens
gagaggctggcagtgccaggtt

SEQ ID NO: 8780026 - DNA, 22 bp, Homo sapiens
gagaggtagaggctctgcttaa

SEQ ID NO: 8780027 - DNA, 22 bp, Homo sapiens
gagaggctgcatatgcacactg

SEQ ID NO: 8780028 - DNA, 22 bp, Homo sapiens
gagaggctgatcctgcagagaa

SEQ ID NO: 8780029 - DNA, 22 bp, Homo sapiens
gagaggctggcagtgccaggtt

SEQ ID NO: 8780030 - DNA, 22 bp, Homo sapiens
gagaggctgactggctgtcctg

SEQ ID NO: 8780031 - DNA, 22 bp, Homo sapiens
gagaggctgatcctgcagagaa

SEQ ID NO: 8780032 - DNA, 22 bp, Homo sapiens
gagaggctgatcctgcagagaa

SEQ ID NO: 8780033 - DNA, 22 bp, Homo sapiens
gagaggctgatcctgcagagaa

SEQ ID NO: 8780034 - DNA, 22 bp, Homo sapiens
gagaggctgaaatcacaggagc

SEQ ID NO: 8780035 - DNA, 22 bp, Homo sapiens
gagaggctgaaatcacaggagc

SEQ ID NO: 8780036 - DNA, 22 bp, Homo sapiens
gagaggctgaaatcacaggagc

SEQ ID NO: 8780037 - DNA, 22 bp, Homo sapiens
gagaggctgaaatcacaggagc

SEQ ID NO: 8780038 - DNA, 22 bp, Homo sapiens
gagaggtcggggacactgcaaa

SEQ ID NO: 8780039 - DNA, 22 bp, Homo sapiens
gagaggtgaatgtggatgccac

SEQ ID NO: 8780040 - DNA, 22 bp, Homo sapiens
gagaggtggaggttgcagtgag

SEQ ID NO: 8780041 - DNA, 22 bp, Homo sapiens
gagaggtggaggttgcagtgag

SEQ ID NO: 8780042 - DNA, 22 bp, Homo sapiens
gagaggtggaggttgcagtgag

SEQ ID NO: 8780043 - DNA, 22 bp, Homo sapiens
gagaggtggaggttgcagtgag

SEQ ID NO: 8780044 - DNA, 22 bp, Homo sapiens
gagcacagggaatagacagata

SEQ ID NO: 8780045 - DNA, 22 bp, Homo sapiens
gagcacagggaatagacagata

SEQ ID NO: 8780046 - DNA, 22 bp, Homo sapiens
gagcacagggaatagacagata

SEQ ID NO: 8780047 - DNA, 16 bp, Homo sapiens
gagcagcctgggcctt

SEQ ID NO: 8780048 - DNA, 16 bp, Homo sapiens
gagcagcctgggcctt

SEQ ID NO: 8780049 - DNA, 22 bp, Homo sapiens
gagcagctaaaattctcatgca

SEQ ID NO: 8780050 - DNA, 22 bp, Homo sapiens
gagcagctaaaattctcatgca

SEQ ID NO: 8780051 - DNA, 22 bp, Homo sapiens
gagcagctagataaagcccttc

SEQ ID NO: 8780052 - DNA, 22 bp, Homo sapiens
gagcagctcagaggactagtgt

SEQ ID NO: 8780053 - DNA, 22 bp, Homo sapiens
gagcagctcaggcacttagcca

SEQ ID NO: 8780054 - DNA, 22 bp, Homo sapiens
gagcagctcaggcacttagcca

SEQ ID NO: 8780055 - DNA, 22 bp, Homo sapiens
gagcagctccagccgcatgact

SEQ ID NO: 8780056 - DNA, 22 bp, Homo sapiens
gagcagctcgagaaggaagcag

SEQ ID NO: 8780057 - DNA, 22 bp, Homo sapiens
gagcagctcgagaaggaagcag

SEQ ID NO: 8780058 - DNA, 22 bp, Homo sapiens
gagcagctcgagaaggaagcag

SEQ ID NO: 8780059 - DNA, 22 bp, Homo sapiens
gagcagctcgagaaggaagcag

SEQ ID NO: 8780060 - DNA, 22 bp, Homo sapiens
gagcagctcgagaaggaagcag

SEQ ID NO: 8780061 - DNA, 22 bp, Homo sapiens
gagcagctcgagaaggaagcag

SEQ ID NO: 8780062 - DNA, 22 bp, Homo sapiens
atgaatgattaaagagtacagt

SEQ ID NO: 8780063 - DNA, 19 bp, Homo sapiens
atgaatgatccggtttctc

SEQ ID NO: 8780064 - DNA, 19 bp, Homo sapiens
atgaatgagctgtgaggtt

SEQ ID NO: 8780065 - DNA, 22 bp, Homo sapiens
atgaatgagattaccaatgtga

SEQ ID NO: 8780066 - DNA, 22 bp, Homo sapiens
atgaatgagaaagctgaaatct

SEQ ID NO: 8780067 - DNA, 22 bp, Homo sapiens
atgaatgagaaagctgaaatct

SEQ ID NO: 8780068 - DNA, 22 bp, Homo sapiens
atgaatgcagcactgtttttct

SEQ ID NO: 8780069 - DNA, 22 bp, Homo sapiens
atgaatgcaatattttatgaca

SEQ ID NO: 8780070 - DNA, 22 bp, Homo sapiens
atgaatgcatacatttgtcaag

SEQ ID NO: 8780071 - DNA, 22 bp, Homo sapiens
atgaatgcatgcttattttgca

SEQ ID NO: 8780072 - DNA, 22 bp, Homo sapiens
atgaatgcatacatttgtcaag

SEQ ID NO: 8780073 - DNA, 22 bp, Homo sapiens
atgaatgctgggacaaatatat

SEQ ID NO: 8780074 - DNA, 22 bp, Homo sapiens
atgaatgctgggacaaatatat

SEQ ID NO: 8780075 - DNA, 22 bp, Homo sapiens
atgaatgctgaattatgaactg

SEQ ID NO: 8780076 - DNA, 22 bp, Homo sapiens
atgaatgcttattaaattgaaa

SEQ ID NO: 8780077 - DNA, 22 bp, Homo sapiens
atgaatgctgggacaaatatat

SEQ ID NO: 8780078 - DNA, 22 bp, Homo sapiens
ctttttccagcttcagggtggg

SEQ ID NO: 8780079 - DNA, 22 bp, Homo sapiens
gaaaacatccagagatagacct

SEQ ID NO: 8780080 - DNA, 22 bp, Homo sapiens
ctttttccagcttcagggtggg

SEQ ID NO: 8780081 - DNA, 19 bp, Homo sapiens
gaaaacatgggtgagggtc

SEQ ID NO: 8780082 - DNA, 19 bp, Homo sapiens
gaaaacatgggtgagggtc

SEQ ID NO: 8780083 - DNA, 22 bp, Homo sapiens
gaaaaccacctcccatcaagca

SEQ ID NO: 8780084 - DNA, 21 bp, Homo sapiens
gaaaaccatttgcatcatgag

SEQ ID NO: 8780085 - DNA, 21 bp, Homo sapiens
gaaaaccatttgcatcatgag

SEQ ID NO: 8780086 - DNA, 19 bp, Homo sapiens
gaaaacatgggtgagggtc

SEQ ID NO: 8780087 - DNA, 22 bp, Homo sapiens
atgaatggatggggtcaagata

SEQ ID NO: 8780088 - DNA, 22 bp, Homo sapiens
atgaatgcttattaaattgaaa

SEQ ID NO: 8780089 - DNA, 22 bp, Homo sapiens
atgaatgtttggtgatcagata

SEQ ID NO: 8780090 - DNA, 22 bp, Homo sapiens
atgaatgtgatgattctgttac

SEQ ID NO: 8780091 - DNA, 22 bp, Homo sapiens
atgaattgaggaaaacagtcgt

SEQ ID NO: 8780092 - DNA, 22 bp, Homo sapiens
atgaattgaggaaaacagtcgt

SEQ ID NO: 8780093 - DNA, 22 bp, Homo sapiens
atgaattgaggaaaacagtcgt

SEQ ID NO: 8780094 - DNA, 22 bp, Homo sapiens
gaaaataggctgcatctccttc

SEQ ID NO: 8780095 - DNA, 22 bp, Homo sapiens
gaaaatagttcatcacaatgat

SEQ ID NO: 8780096 - DNA, 22 bp, Homo sapiens
gaaaatagttcatcacaatgat

SEQ ID NO: 8780097 - DNA, 22 bp, Homo sapiens
gaaaatctgcttatattatttt

SEQ ID NO: 8780098 - DNA, 20 bp, Homo sapiens
gaaaataggccagccaggta

SEQ ID NO: 8780099 - DNA, 22 bp, Homo sapiens
gaaaatgagcctcagctacatt

SEQ ID NO: 8780100 - DNA, 22 bp, Homo sapiens
gaaaatgagcctcagctacatt

SEQ ID NO: 8780101 - DNA, 22 bp, Homo sapiens
gaaaatgagcctcagctacatt

SEQ ID NO: 8780102 - DNA, 22 bp, Homo sapiens
gaaaatagcagatagaccaatg

SEQ ID NO: 8780103 - DNA, 22 bp, Homo sapiens
gaaaataggcagatgcattgta

SEQ ID NO: 8780104 - DNA, 20 bp, Homo sapiens
gaaaataggccagccaggta

SEQ ID NO: 8780105 - DNA, 22 bp, Homo sapiens
gaaaatagcagatagaccaatg

SEQ ID NO: 8780106 - DNA, 20 bp, Homo sapiens
gaaaataggccagccaggta

SEQ ID NO: 8780107 - DNA, 22 bp, Homo sapiens
gaaaagagaacatctgaggatc

SEQ ID NO: 8780108 - DNA, 22 bp, Homo sapiens
gaaaagaactgcatgggattaa

SEQ ID NO: 8780109 - DNA, 22 bp, Homo sapiens
gaaaagaactgcatgggattaa

SEQ ID NO: 8780110 - DNA, 22 bp, Homo sapiens
gaaaagaactgcatgggattaa

SEQ ID NO: 8780111 - DNA, 22 bp, Homo sapiens
gaaaacttggatctctagaatg

SEQ ID NO: 8780112 - DNA, 22 bp, Homo sapiens
gaaaacttggatctctagaatg

SEQ ID NO: 8780113 - DNA, 22 bp, Homo sapiens
gaaaacttggatctctagaatg

SEQ ID NO: 8780114 - DNA, 22 bp, Homo sapiens
gaaaactattggcctagaacaa

SEQ ID NO: 8780115 - DNA, 22 bp, Homo sapiens
gaaaactaacggaaaagttagg

SEQ ID NO: 8780116 - DNA, 23 bp, Homo sapiens
atgaatgaataaggcaggaaagc

SEQ ID NO: 8780117 - DNA, 22 bp, Homo sapiens
atgaatgaataccatgcaacta

SEQ ID NO: 8780118 - DNA, 22 bp, Homo sapiens
atgaatgaaatacagagtactt

SEQ ID NO: 8780119 - DNA, 22 bp, Homo sapiens
atgaatctgttttttgtcaata

SEQ ID NO: 8780120 - DNA, 22 bp, Homo sapiens
atgaatcaagtgagaacagcat

SEQ ID NO: 8780121 - DNA, 22 bp, Homo sapiens
atgaatcaaagttcatttgatc

SEQ ID NO: 8780122 - DNA, 22 bp, Homo sapiens
atgaatcaagtgagaacagcat

SEQ ID NO: 8780123 - DNA, 22 bp, Homo sapiens
atgaataagtaaactcctttgg

SEQ ID NO: 8780124 - DNA, 22 bp, Homo sapiens
atgaatcaaactgtacactgag

SEQ ID NO: 8780125 - DNA, 22 bp, Homo sapiens
atgaatcaaactgtacactgag

SEQ ID NO: 8780126 - DNA, 22 bp, Homo sapiens
atgaatcaaactgtacactgag

SEQ ID NO: 8780127 - DNA, 22 bp, Homo sapiens
atgaatcaaactgtacactgag

SEQ ID NO: 8780128 - DNA, 22 bp, Homo sapiens
atgaatcaaactgtacactgag

SEQ ID NO: 8780129 - DNA, 22 bp, Homo sapiens
atgaagcagttaaggtgcatga

SEQ ID NO: 8780130 - DNA, 22 bp, Homo sapiens
cttgagtaaagaagtattttag

SEQ ID NO: 8780131 - DNA, 22 bp, Homo sapiens
cttgagtacagatcatattatt

SEQ ID NO: 8780132 - DNA, 22 bp, Homo sapiens
atgaataaaacattttaatcag

SEQ ID NO: 8780133 - DNA, 22 bp, Homo sapiens
atgaataaaacattttaatcag

SEQ ID NO: 8780134 - DNA, 22 bp, Homo sapiens
atgaataaaacattttaatcag

SEQ ID NO: 8780135 - DNA, 22 bp, Homo sapiens
cttgaggttttgactcagcttt

SEQ ID NO: 8780136 - DNA, 22 bp, Homo sapiens
cttgagggcaggattctgtttt

SEQ ID NO: 8780137 - DNA, 22 bp, Homo sapiens
cttgagctgaagccagttgaaa

SEQ ID NO: 8780138 - DNA, 22 bp, Homo sapiens
cttgagctctcagccactagct

SEQ ID NO: 8780139 - DNA, 22 bp, Homo sapiens
cttgagcatcggatggaatttc

SEQ ID NO: 8780140 - DNA, 22 bp, Homo sapiens
atcttcaattgaaaactagcct

SEQ ID NO: 8780141 - DNA, 22 bp, Homo sapiens
atcttcagcgaggtttcctttc

SEQ ID NO: 8780142 - DNA, 22 bp, Homo sapiens
atcttcagcgaggtttcctttc

SEQ ID NO: 8780143 - DNA, 22 bp, Homo sapiens
atcttcagttttcagtgagcca

SEQ ID NO: 8780144 - DNA, 22 bp, Homo sapiens
atcttcagttttcagtgagcca

SEQ ID NO: 8780145 - DNA, 22 bp, Homo sapiens
atcttcatcaagttcacagtgg

SEQ ID NO: 8780146 - DNA, 22 bp, Homo sapiens
atcttcaatatttttgtgtaga

SEQ ID NO: 8780147 - DNA, 22 bp, Homo sapiens
atcttcaagggaagaaagagta

SEQ ID NO: 8780148 - DNA, 22 bp, Homo sapiens
atcttcaaggaaaaaatacagt

SEQ ID NO: 8780149 - DNA, 22 bp, Homo sapiens
atcttcaaggaaaaaatacagt

SEQ ID NO: 8780150 - DNA, 22 bp, Homo sapiens
atcttcaactttggggctgcct

SEQ ID NO: 8780151 - DNA, 21 bp, Homo sapiens
atcttcaactgattggaggag

SEQ ID NO: 8780152 - DNA, 22 bp, Homo sapiens
atcttcaacttgatcatttgaa

SEQ ID NO: 8780153 - DNA, 22 bp, Homo sapiens
atcttcaaagcacatcgtttgt

SEQ ID NO: 8780154 - DNA, 19 bp, Homo sapiens
atcttcaaagccagcagca

SEQ ID NO: 8780155 - DNA, 22 bp, Homo sapiens
atcttcaaagggatgtccatgg

SEQ ID NO: 8780156 - DNA, 22 bp, Homo sapiens
atcttcaacaacaaattgcctc

SEQ ID NO: 8780157 - DNA, 22 bp, Homo sapiens
atcttcaactcagagagtgctg

SEQ ID NO: 8780158 - DNA, 22 bp, Homo sapiens
cttgagaaaggaacaggaagct

SEQ ID NO: 8780159 - DNA, 22 bp, Homo sapiens
cttgagaaaggaacaggaagct

SEQ ID NO: 8780160 - DNA, 22 bp, Homo sapiens
cttgagaaaggaacaggaagct

SEQ ID NO: 8780161 - DNA, 22 bp, Homo sapiens
cttgagaaggaggaagggcttt

SEQ ID NO: 8780162 - DNA, 22 bp, Homo sapiens
cttgagaagcattaagaggtag

SEQ ID NO: 8780163 - DNA, 22 bp, Homo sapiens
cttgagaagcattaagaggtag

SEQ ID NO: 8780164 - DNA, 22 bp, Homo sapiens
cttgagaagagatttatatttg

SEQ ID NO: 8780165 - DNA, 22 bp, Homo sapiens
cttgagaacagggttaggtaac

SEQ ID NO: 8780166 - DNA, 22 bp, Homo sapiens
cttgagaatgtgagccacagat

SEQ ID NO: 8780167 - DNA, 21 bp, Homo sapiens
cttgagaattaactgttcatt

SEQ ID NO: 8780168 - DNA, 21 bp, Homo sapiens
cttgagaattaactgttcatt

SEQ ID NO: 8780169 - DNA, 22 bp, Homo sapiens
cttgagaatcttgatgtctacc

SEQ ID NO: 8780170 - DNA, 22 bp, Homo sapiens
cttgagaatcttctctgaagag

SEQ ID NO: 8780171 - DNA, 22 bp, Homo sapiens
atgaggcagtctggcctgaggg

SEQ ID NO: 8780172 - DNA, 22 bp, Homo sapiens
gaaatgatgtctgtgctgccac

SEQ ID NO: 8780173 - DNA, 22 bp, Homo sapiens
gaaatgacaaggacattcctgt

SEQ ID NO: 8780174 - DNA, 22 bp, Homo sapiens
gaaatgacaaggacattcctgt

SEQ ID NO: 8780175 - DNA, 16 bp, Homo sapiens
atgaggcataggctgc

SEQ ID NO: 8780176 - DNA, 22 bp, Homo sapiens
atgaggcatagcagggatcgga

SEQ ID NO: 8780177 - DNA, 22 bp, Homo sapiens
atgaggcatagcagggatcgga

SEQ ID NO: 8780178 - DNA, 22 bp, Homo sapiens
atgaggcatagcagggatcgga

SEQ ID NO: 8780179 - DNA, 22 bp, Homo sapiens
atgaggcatgggatcaaaatga

SEQ ID NO: 8780180 - DNA, 21 bp, Homo sapiens
atgaggcatgagagggtttct

SEQ ID NO: 8780181 - DNA, 22 bp, Homo sapiens
atgaggcatctgcagtcactag

SEQ ID NO: 8780182 - DNA, 22 bp, Homo sapiens
atgaggcatctaacattgcaaa

SEQ ID NO: 8780183 - DNA, 22 bp, Homo sapiens
atgaggcatctgcagtcactag

SEQ ID NO: 8780184 - DNA, 16 bp, Homo sapiens
atgaggcataggctgc

SEQ ID NO: 8780185 - DNA, 22 bp, Homo sapiens
atgaggcatctaacattgcaaa

SEQ ID NO: 8780186 - DNA, 22 bp, Homo sapiens
atgaggcatatcctcctatggt

SEQ ID NO: 8780187 - DNA, 22 bp, Homo sapiens
atgaggcatgtgaggagaaggg

SEQ ID NO: 8780188 - DNA, 22 bp, Homo sapiens
atgaggcatgtgaggagaaggg

SEQ ID NO: 8780189 - DNA, 23 bp, Homo sapiens
atgaggcattaaacaggcttttt

SEQ ID NO: 8780190 - DNA, 22 bp, Homo sapiens
atgaggcattcacagaaggcac

SEQ ID NO: 8780191 - DNA, 22 bp, Homo sapiens
atgaggcattccactcaaactc

SEQ ID NO: 8780192 - DNA, 22 bp, Homo sapiens
atgaggcattcacagaaggcac

SEQ ID NO: 8780193 - DNA, 22 bp, Homo sapiens
atgaggcattcacagaaggcac

SEQ ID NO: 8780194 - DNA, 22 bp, Homo sapiens
atgaggcattccactcaaactc

SEQ ID NO: 8780195 - DNA, 22 bp, Homo sapiens
gaacaatgaaagacataaactc

SEQ ID NO: 8780196 - DNA, 15 bp, Homo sapiens
atgaggcatttgggg

SEQ ID NO: 8780197 - DNA, 22 bp, Homo sapiens
gaacaatgagtcattcaggtga

SEQ ID NO: 8780198 - DNA, 19 bp, Homo sapiens
gaacaatttgttagctctc

SEQ ID NO: 8780199 - DNA, 22 bp, Homo sapiens
gaacataactattgtgaatagt

SEQ ID NO: 8780200 - DNA, 22 bp, Homo sapiens
gaacatcatgaagaaaacatat

SEQ ID NO: 8780201 - DNA, 22 bp, Homo sapiens
gaacatcagtcataatttaacg

SEQ ID NO: 8780202 - DNA, 22 bp, Homo sapiens
gaacatcaaggtctgtgtctag

SEQ ID NO: 8780203 - DNA, 22 bp, Homo sapiens
gaacatcagtcataatttaacg

SEQ ID NO: 8780204 - DNA, 22 bp, Homo sapiens
gaacatcaaggtctgtgtctag

SEQ ID NO: 8780205 - DNA, 22 bp, Homo sapiens
gaaatatacatgaagtcggctg

SEQ ID NO: 8780206 - DNA, 22 bp, Homo sapiens
gaaatctacttagtgtctggat

SEQ ID NO: 8780207 - DNA, 22 bp, Homo sapiens
gaaatatacattgcaggaagag

SEQ ID NO: 8780208 - DNA, 23 bp, Homo sapiens
gaaatctagtcatttttagtctg

SEQ ID NO: 8780209 - DNA, 22 bp, Homo sapiens
gaaaatgagcctcagctacatt

SEQ ID NO: 8780210 - DNA, 22 bp, Homo sapiens
gaaaatgagcctcagctacatt

SEQ ID NO: 8780211 - DNA, 22 bp, Homo sapiens
gaaaatgcctctggcattaaac

SEQ ID NO: 8780212 - DNA, 22 bp, Homo sapiens
gaaaatgtgcctttgggtattg

SEQ ID NO: 8780213 - DNA, 22 bp, Homo sapiens
gaaaatgtgcctttgggtattg

SEQ ID NO: 8780214 - DNA, 22 bp, Homo sapiens
gaaatatacatgaagtcggctg

SEQ ID NO: 8780215 - DNA, 22 bp, Homo sapiens
gaaaatgtgtcatccctactgt

SEQ ID NO: 8780216 - DNA, 22 bp, Homo sapiens
gaaaatgtgtcatccctactgt

SEQ ID NO: 8780217 - DNA, 22 bp, Homo sapiens
gaaatcttttaaccattcattt

SEQ ID NO: 8780218 - DNA, 22 bp, Homo sapiens
gaaatctttatggaaataacaa

SEQ ID NO: 8780219 - DNA, 22 bp, Homo sapiens
gaaatcttttaaccattcattt

SEQ ID NO: 8780220 - DNA, 22 bp, Homo sapiens
gaaatctttgccttagctgtgt

SEQ ID NO: 8780221 - DNA, 22 bp, Homo sapiens
gaaatgaaacaggcttttaagg

SEQ ID NO: 8780222 - DNA, 22 bp, Homo sapiens
gaaatgaaacaggcttttaagg

SEQ ID NO: 8780223 - DNA, 22 bp, Homo sapiens
gaaatgaaacaggcttttaagg

SEQ ID NO: 8780224 - DNA, 22 bp, Homo sapiens
gaaatgaaacaggcttttaagg

SEQ ID NO: 8780225 - DNA, 22 bp, Homo sapiens
gaaatgaactgattatcattgc

SEQ ID NO: 8780226 - DNA, 22 bp, Homo sapiens
gaaatgaactgattatcattgc

SEQ ID NO: 8780227 - DNA, 22 bp, Homo sapiens
gaaatcttttaaccattcattt

SEQ ID NO: 8780228 - DNA, 22 bp, Homo sapiens
gaaatgaactgattatcattgc

SEQ ID NO: 8780229 - DNA, 22 bp, Homo sapiens
gaactttaatcccttgggctta

SEQ ID NO: 8780230 - DNA, 22 bp, Homo sapiens
gaactttaatcccttgggctta

SEQ ID NO: 8780231 - DNA, 22 bp, Homo sapiens
gaacatttgatgatgacattgg

SEQ ID NO: 8780232 - DNA, 22 bp, Homo sapiens
gaactttaccatttaggtaact

SEQ ID NO: 8780233 - DNA, 22 bp, Homo sapiens
gaactttaccatttaggtaact

SEQ ID NO: 8780234 - DNA, 22 bp, Homo sapiens
gaactttaattagcttttgtct

SEQ ID NO: 8780235 - DNA, 22 bp, Homo sapiens
gaactttaattagcttttgtct

SEQ ID NO: 8780236 - DNA, 22 bp, Homo sapiens
gaactttaggattttcacaggt

SEQ ID NO: 8780237 - DNA, 22 bp, Homo sapiens
gaactttataactgtaaatgtc

SEQ ID NO: 8780238 - DNA, 22 bp, Homo sapiens
gaactttaggattttcacaggt

SEQ ID NO: 8780239 - DNA, 22 bp, Homo sapiens
gaactttggatcatgttcttgg

SEQ ID NO: 8780240 - DNA, 22 bp, Homo sapiens
gaactttgcaaatgtcagaagc

SEQ ID NO: 8780241 - DNA, 22 bp, Homo sapiens
gaactttatcaaaagttgttta

SEQ ID NO: 8780242 - DNA, 22 bp, Homo sapiens
gaactttattccagaagaaagc

SEQ ID NO: 8780243 - DNA, 22 bp, Homo sapiens
gaactttgtggggctgagagga

SEQ ID NO: 8780244 - DNA, 22 bp, Homo sapiens
gaactttgtggggctgagagga

SEQ ID NO: 8780245 - DNA, 22 bp, Homo sapiens
gaactttgtggggctgagagga

SEQ ID NO: 8780246 - DNA, 22 bp, Homo sapiens
gaactttgtggggctgagagga

SEQ ID NO: 8780247 - DNA, 17 bp, Homo sapiens
gaacttttattaaattc

SEQ ID NO: 8780248 - DNA, 17 bp, Homo sapiens
gaacttttattaaattc

SEQ ID NO: 8780249 - DNA, 18 bp, Homo sapiens
gaacttttggctttgtgt

SEQ ID NO: 8780250 - DNA, 18 bp, Homo sapiens
gaacttttggctttgtgt

SEQ ID NO: 8780251 - DNA, 22 bp, Homo sapiens
gaacttttgggaagccgtgtga

SEQ ID NO: 8780252 - DNA, 22 bp, Homo sapiens
gaacatgatggctgttattttg

SEQ ID NO: 8780253 - DNA, 22 bp, Homo sapiens
gaacatgaaaagtcttacacgc

SEQ ID NO: 8780254 - DNA, 22 bp, Homo sapiens
gaacatctttaggggaccatca

SEQ ID NO: 8780255 - DNA, 22 bp, Homo sapiens
gaacatctgtgatctctttggg

SEQ ID NO: 8780256 - DNA, 22 bp, Homo sapiens
gaacatctgggatcattgctgt

SEQ ID NO: 8780257 - DNA, 22 bp, Homo sapiens
gaacatctgccttgtggctgcc

SEQ ID NO: 8780258 - DNA, 20 bp, Homo sapiens
gaacatggcaggtggagggg

SEQ ID NO: 8780259 - DNA, 22 bp, Homo sapiens
gaacattactgcttgggagagg

SEQ ID NO: 8780260 - DNA, 22 bp, Homo sapiens
gaacattattgtacaaatgtct

SEQ ID NO: 8780261 - DNA, 22 bp, Homo sapiens
gaacattactgcttgggagagg

SEQ ID NO: 8780262 - DNA, 22 bp, Homo sapiens
gaacattattgtacaaatgtct

SEQ ID NO: 8780263 - DNA, 22 bp, Homo sapiens
gaacattgctttatttcttcta

SEQ ID NO: 8780264 - DNA, 22 bp, Homo sapiens
gaacattcttgggcaagttact

SEQ ID NO: 8780265 - DNA, 22 bp, Homo sapiens
gaacatttatattagatagcta

SEQ ID NO: 8780266 - DNA, 22 bp, Homo sapiens
gaacattcttggaggaaataac

SEQ ID NO: 8780267 - DNA, 22 bp, Homo sapiens
gaacattcttggaggaaataac

SEQ ID NO: 8780268 - DNA, 23 bp, Homo sapiens
gaacattcattggttgctttaga

SEQ ID NO: 8780269 - DNA, 22 bp, Homo sapiens
gaacattcctggaagagtgctt

SEQ ID NO: 8780270 - DNA, 22 bp, Homo sapiens
gaacattcacagactcaccatt

SEQ ID NO: 8780271 - DNA, 22 bp, Homo sapiens
gaacatttatgatgcaatacct

SEQ ID NO: 8780272 - DNA, 22 bp, Homo sapiens
gaacatttccagaaaggaacta

SEQ ID NO: 8780273 - DNA, 22 bp, Homo sapiens
gaacatttgatgatgacattgg

SEQ ID NO: 8780274 - DNA, 22 bp, Homo sapiens
atgcacaacagtggctgccttg

SEQ ID NO: 8780275 - DNA, 22 bp, Homo sapiens
atgcacaaacccacaattagtc

SEQ ID NO: 8780276 - DNA, 21 bp, Homo sapiens
atgcacaaaaagactctttct

SEQ ID NO: 8780277 - DNA, 22 bp, Homo sapiens
atgcaatcatatggcatacagc

SEQ ID NO: 8780278 - DNA, 22 bp, Homo sapiens
atgcaatatgtgtttctgttta

SEQ ID NO: 8780279 - DNA, 22 bp, Homo sapiens
atgcaatttactgtacataaat

SEQ ID NO: 8780280 - DNA, 22 bp, Homo sapiens
atgcaatgttcctttcttcacc

SEQ ID NO: 8780281 - DNA, 22 bp, Homo sapiens
atgcaatatagggaagatagat

SEQ ID NO: 8780282 - DNA, 22 bp, Homo sapiens
atgcaataccttctgaaaataa

SEQ ID NO: 8780283 - DNA, 22 bp, Homo sapiens
atgcaatagtaattctagtctg

SEQ ID NO: 8780284 - DNA, 22 bp, Homo sapiens
atgcaatagtaattctagtctg

SEQ ID NO: 8780285 - DNA, 22 bp, Homo sapiens
atgcaagggttgcctttccagc

SEQ ID NO: 8780286 - DNA, 22 bp, Homo sapiens
atgcaagggttgcctttccagc

SEQ ID NO: 8780287 - DNA, 18 bp, Homo sapiens
atgcaagctatggatttg

SEQ ID NO: 8780288 - DNA, 22 bp, Homo sapiens
atgcaagcaatctgagctttgg

SEQ ID NO: 8780289 - DNA, 22 bp, Homo sapiens
atgcaataaatactttccagct

SEQ ID NO: 8780290 - DNA, 22 bp, Homo sapiens
atgcaagtcttaatagtttagg

SEQ ID NO: 8780291 - DNA, 22 bp, Homo sapiens
atgcaaatgctagagaatgttg

SEQ ID NO: 8780292 - DNA, 22 bp, Homo sapiens
atgcaaatgcagccattgcaga

SEQ ID NO: 8780293 - DNA, 22 bp, Homo sapiens
atgcaaatgcagccattgcaga

SEQ ID NO: 8780294 - DNA, 22 bp, Homo sapiens
atgcaagattcagcaggaagat

SEQ ID NO: 8780295 - DNA, 22 bp, Homo sapiens
atgcaagcaacattttgcacat

SEQ ID NO: 8780296 - DNA, 22 bp, Homo sapiens
atgcaagagcaatatggtatgc

SEQ ID NO: 8780297 - DNA, 23 bp, Homo sapiens
atgcaagagtttctcaaactgga

SEQ ID NO: 8780298 - DNA, 22 bp, Homo sapiens
gaagaaagatcaaatagtttcc

SEQ ID NO: 8780299 - DNA, 22 bp, Homo sapiens
gaagaaagatcaaatagtttcc

SEQ ID NO: 8780300 - DNA, 22 bp, Homo sapiens
gaagaaactgaaaggggttggt

SEQ ID NO: 8780301 - DNA, 22 bp, Homo sapiens
gaagaaacaggggcttggggag

SEQ ID NO: 8780302 - DNA, 22 bp, Homo sapiens
gaagaaacaggggcttggggag

SEQ ID NO: 8780303 - DNA, 22 bp, Homo sapiens
atgcaaatgaacatgttgctag

SEQ ID NO: 8780304 - DNA, 22 bp, Homo sapiens
gaagaaagattggcatgcttca

SEQ ID NO: 8780305 - DNA, 22 bp, Homo sapiens
gaagaaagattggcatgcttca

SEQ ID NO: 8780306 - DNA, 22 bp, Homo sapiens
gaagaaagattggcatgcttca

SEQ ID NO: 8780307 - DNA, 22 bp, Homo sapiens
atgcatatagaacatttgacat

SEQ ID NO: 8780308 - DNA, 22 bp, Homo sapiens
gaatgtgtgactctattgagca

SEQ ID NO: 8780309 - DNA, 22 bp, Homo sapiens
gaatgtgtcaccctgtcccatg

SEQ ID NO: 8780310 - DNA, 22 bp, Homo sapiens
gaatgtaatagtcagtagaaca

SEQ ID NO: 8780311 - DNA, 22 bp, Homo sapiens
gaatgtcagggccagaagaggc

SEQ ID NO: 8780312 - DNA, 22 bp, Homo sapiens
gaatgtcctcctggatcactcc

SEQ ID NO: 8780313 - DNA, 22 bp, Homo sapiens
gaatgtctatgtaaccgagggg

SEQ ID NO: 8780314 - DNA, 22 bp, Homo sapiens
gaatgtctccaacttggggaaa

SEQ ID NO: 8780315 - DNA, 22 bp, Homo sapiens
gaatgtctaaacatagctttta

SEQ ID NO: 8780316 - DNA, 21 bp, Homo sapiens
gaatgtctgccttcacaatga

SEQ ID NO: 8780317 - DNA, 22 bp, Homo sapiens
gaatgtcttctgttcccagctg

SEQ ID NO: 8780318 - DNA, 22 bp, Homo sapiens
gaatgtcttattgctcgttgta

SEQ ID NO: 8780319 - DNA, 22 bp, Homo sapiens
gaatgtcttcaaaactagactg

SEQ ID NO: 8780320 - DNA, 22 bp, Homo sapiens
gaatgtcttctgttcccagctg

SEQ ID NO: 8780321 - DNA, 22 bp, Homo sapiens
gaatgtctttttggtacttata

SEQ ID NO: 8780322 - DNA, 21 bp, Homo sapiens
gaatgtctgccttcacaatga

SEQ ID NO: 8780323 - DNA, 22 bp, Homo sapiens
gaatgtctgtttcaacaagcac

SEQ ID NO: 8780324 - DNA, 19 bp, Homo sapiens
gaatgtctcctacttctga

SEQ ID NO: 8780325 - DNA, 19 bp, Homo sapiens
gaatgtctcctacttctga

SEQ ID NO: 8780326 - DNA, 22 bp, Homo sapiens
gaagcagagcctaaggcagaca

SEQ ID NO: 8780327 - DNA, 22 bp, Homo sapiens
gaagcagagcctaaggcagaca

SEQ ID NO: 8780328 - DNA, 22 bp, Homo sapiens
gaatcaggattcaagatcagct

SEQ ID NO: 8780329 - DNA, 23 bp, Homo sapiens
gaatcagtggctaacaaggaaac

SEQ ID NO: 8780330 - DNA, 22 bp, Homo sapiens
gaatgtaatagtcagtagaaca

SEQ ID NO: 8780331 - DNA, 22 bp, Homo sapiens
gaagcactgccataattcagac

SEQ ID NO: 8780332 - DNA, 22 bp, Homo sapiens
gaagcactgccataattcagac

SEQ ID NO: 8780333 - DNA, 22 bp, Homo sapiens
gaagcactgcatttcaagatca

SEQ ID NO: 8780334 - DNA, 22 bp, Homo sapiens
gaagcacattagatgtgtcttc

SEQ ID NO: 8780335 - DNA, 22 bp, Homo sapiens
gaagcagagcctaaggcagaca

SEQ ID NO: 8780336 - DNA, 22 bp, Homo sapiens
gaagcacatggctgtgagcaac

SEQ ID NO: 8780337 - DNA, 22 bp, Homo sapiens
gaagcacagaatggttaacatg

SEQ ID NO: 8780338 - DNA, 22 bp, Homo sapiens
gaagcacaaagtgtagttccga

SEQ ID NO: 8780339 - DNA, 22 bp, Homo sapiens
gaagcaatttagaatcagaagc

SEQ ID NO: 8780340 - DNA, 23 bp, Homo sapiens
atgcacaagccagcaggggacag

SEQ ID NO: 8780341 - DNA, 22 bp, Homo sapiens
gaagcaatctggctcccagcca

SEQ ID NO: 8780342 - DNA, 22 bp, Homo sapiens
atgcacaacagacgaatggaag

SEQ ID NO: 8780343 - DNA, 22 bp, Homo sapiens
atgcacaagcaagagataatgg

SEQ ID NO: 8780344 - DNA, 22 bp, Homo sapiens
atgcacaagaggctagaaaaga

SEQ ID NO: 8780345 - DNA, 22 bp, Homo sapiens
gaagcaattaagtttgtgatct

SEQ ID NO: 8780346 - DNA, 22 bp, Homo sapiens
gaagcaatttagaatcagaagc

SEQ ID NO: 8780347 - DNA, 22 bp, Homo sapiens
gaagcaattaagtttgtgatct

SEQ ID NO: 8780348 - DNA, 22 bp, Homo sapiens
gaagcaatgtgttttcaacatt

SEQ ID NO: 8780349 - DNA, 22 bp, Homo sapiens
gaagcaatgtgttttcaacatt

SEQ ID NO: 8780350 - DNA, 22 bp, Homo sapiens
gaagcaatctggctcccagcca

SEQ ID NO: 8780351 - DNA, 22 bp, Homo sapiens
gaagcaatgtgttttcaacatt

SEQ ID NO: 8780352 - DNA, 22 bp, Homo sapiens
atgccacttcattccagcctcg

SEQ ID NO: 8780353 - DNA, 22 bp, Homo sapiens
atgccacttcattccagcctcg

SEQ ID NO: 8780354 - DNA, 22 bp, Homo sapiens
atgccacttcattccagcctcg

SEQ ID NO: 8780355 - DNA, 22 bp, Homo sapiens
atgccattttatactcattcaa

SEQ ID NO: 8780356 - DNA, 22 bp, Homo sapiens
atgcccaatgtcacaatttttg

SEQ ID NO: 8780357 - DNA, 22 bp, Homo sapiens
atgcatatctcctatctcctca

SEQ ID NO: 8780358 - DNA, 22 bp, Homo sapiens
atgcatatcagtgattgtttgc

SEQ ID NO: 8780359 - DNA, 22 bp, Homo sapiens
atgccctgagcaggccttcaag

SEQ ID NO: 8780360 - DNA, 22 bp, Homo sapiens
atgccctgagcaggccttcaag

SEQ ID NO: 8780361 - DNA, 22 bp, Homo sapiens
atgccctgaaagattcaaaggc

SEQ ID NO: 8780362 - DNA, 22 bp, Homo sapiens
atgccctctgtttcccaaggcc

SEQ ID NO: 8780363 - DNA, 22 bp, Homo sapiens
atgcccccatctctgttggctc

SEQ ID NO: 8780364 - DNA, 22 bp, Homo sapiens
atgcccaggcccatacctagat

SEQ ID NO: 8780365 - DNA, 22 bp, Homo sapiens
atgcccagaaccccctggatgg

SEQ ID NO: 8780366 - DNA, 22 bp, Homo sapiens
atgcccagggctggtgaggtcc

SEQ ID NO: 8780367 - DNA, 22 bp, Homo sapiens
atgccctgctctcgggaaggga

SEQ ID NO: 8780368 - DNA, 22 bp, Homo sapiens
atgccctgctgccatctggccg

SEQ ID NO: 8780369 - DNA, 22 bp, Homo sapiens
atgccctgctgctggggcagtg

SEQ ID NO: 8780370 - DNA, 22 bp, Homo sapiens
atgccctgctgccatctggccg

SEQ ID NO: 8780371 - DNA, 22 bp, Homo sapiens
atgccctggactagctatactt

SEQ ID NO: 8780372 - DNA, 22 bp, Homo sapiens
atgccctgctgctggggcagtg

SEQ ID NO: 8780373 - DNA, 22 bp, Homo sapiens
atgccctgctgctggggcagtg

SEQ ID NO: 8780374 - DNA, 22 bp, Homo sapiens
atgccctgctctcgggaaggga

SEQ ID NO: 8780375 - DNA, 22 bp, Homo sapiens
atgccctgccaagcaggctaaa

SEQ ID NO: 8780376 - DNA, 22 bp, Homo sapiens
atgccctgccaagcaggctaaa

SEQ ID NO: 8780377 - DNA, 22 bp, Homo sapiens
atgccctgcatcaagtgacact

SEQ ID NO: 8780378 - DNA, 22 bp, Homo sapiens
atgccctgcatcaagtgacact

SEQ ID NO: 8780379 - DNA, 22 bp, Homo sapiens
atgccctgaggaatgtcacgct

SEQ ID NO: 8780380 - DNA, 22 bp, Homo sapiens
atgccctgtgactctcctggac

SEQ ID NO: 8780381 - DNA, 23 bp, Homo sapiens
atgccctgtgcagaaatgtggaa

SEQ ID NO: 8780382 - DNA, 22 bp, Homo sapiens
atgccctgtgactctcctggac

SEQ ID NO: 8780383 - DNA, 22 bp, Homo sapiens
atgccctgtggcagtacatatt

SEQ ID NO: 8780384 - DNA, 23 bp, Homo sapiens
atgccctgtgcagaaatgtggaa

SEQ ID NO: 8780385 - DNA, 20 bp, Homo sapiens
atgccctgtcctcttctgtt

SEQ ID NO: 8780386 - DNA, 22 bp, Homo sapiens
atgccctgtgactctcctggac

SEQ ID NO: 8780387 - DNA, 22 bp, Homo sapiens
atgccctgggagtgctgtacca

SEQ ID NO: 8780388 - DNA, 22 bp, Homo sapiens
atgccctgggagtgctgtacca

SEQ ID NO: 8780389 - DNA, 22 bp, Homo sapiens
atgccctggacttctagtattc

SEQ ID NO: 8780390 - DNA, 22 bp, Homo sapiens
atgccctggggctacctctgag

SEQ ID NO: 8780391 - DNA, 22 bp, Homo sapiens
atgccctggggctacctctgag

SEQ ID NO: 8780392 - DNA, 23 bp, Homo sapiens
atgccctgtagaggctgctgacc

SEQ ID NO: 8780393 - DNA, 23 bp, Homo sapiens
atgccctgtagaggctgctgacc

SEQ ID NO: 8780394 - DNA, 18 bp, Homo sapiens
atgccctgttgacttcag

SEQ ID NO: 8780395 - DNA, 22 bp, Homo sapiens
atgccctgtggttcatgtgaga

SEQ ID NO: 8780396 - DNA, 22 bp, Homo sapiens
atgcccttcaacgtgaggattt

SEQ ID NO: 8780397 - DNA, 22 bp, Homo sapiens
atgcctgcttactccaggtgct

SEQ ID NO: 8780398 - DNA, 22 bp, Homo sapiens
gacagggacgaggcttcaggca

SEQ ID NO: 8780399 - DNA, 22 bp, Homo sapiens
gacaggaaatatgggggttgtt

SEQ ID NO: 8780400 - DNA, 22 bp, Homo sapiens
atgcctgccatttagaagtctt

SEQ ID NO: 8780401 - DNA, 20 bp, Homo sapiens
atgcctctaattttgcaaac

SEQ ID NO: 8780402 - DNA, 22 bp, Homo sapiens
atgcctggactgacatgcactg

SEQ ID NO: 8780403 - DNA, 22 bp, Homo sapiens
atgcctgcttactccaggtgct

SEQ ID NO: 8780404 - DNA, 22 bp, Homo sapiens
atgcctgccatttagaagtctt

SEQ ID NO: 8780405 - DNA, 22 bp, Homo sapiens
atgcctgcttactccaggtgct

SEQ ID NO: 8780406 - DNA, 22 bp, Homo sapiens
atgctttacagttttccaaaca

SEQ ID NO: 8780407 - DNA, 22 bp, Homo sapiens
atgctttacccacaccaggatg

SEQ ID NO: 8780408 - DNA, 22 bp, Homo sapiens
atgctttaaaacgtatgtgtaa

SEQ ID NO: 8780409 - DNA, 22 bp, Homo sapiens
gacataaagttcttgcttgaat

SEQ ID NO: 8780410 - DNA, 22 bp, Homo sapiens
gacataaagttcttgcttgaat

SEQ ID NO: 8780411 - DNA, 22 bp, Homo sapiens
atgcttggttcctacttctggc

SEQ ID NO: 8780412 - DNA, 22 bp, Homo sapiens
atgcttgggactccctgtagca

SEQ ID NO: 8780413 - DNA, 22 bp, Homo sapiens
atgcttgtactaaaaaaatatt

SEQ ID NO: 8780414 - DNA, 22 bp, Homo sapiens
atgcttggcgtttcacttcctg

SEQ ID NO: 8780415 - DNA, 22 bp, Homo sapiens
atgcttggcccctttatagcct

SEQ ID NO: 8780416 - DNA, 22 bp, Homo sapiens
atgcttgggactccctgtagca

SEQ ID NO: 8780417 - DNA, 22 bp, Homo sapiens
atgcttgggactccctgtagca

SEQ ID NO: 8780418 - DNA, 22 bp, Homo sapiens
atgcttggcgtttcacttcctg

SEQ ID NO: 8780419 - DNA, 22 bp, Homo sapiens
gacataaaccttgagatattaa

SEQ ID NO: 8780420 - DNA, 22 bp, Homo sapiens
gacataaaccttgagatattaa

SEQ ID NO: 8780421 - DNA, 22 bp, Homo sapiens
gacataaaattcaataatttgt

SEQ ID NO: 8780422 - DNA, 22 bp, Homo sapiens
gacagtttggatgggggtttgc

SEQ ID NO: 8780423 - DNA, 22 bp, Homo sapiens
gacataaaatggaattctgttg

SEQ ID NO: 8780424 - DNA, 22 bp, Homo sapiens
gacataaaatggaattctgttg

SEQ ID NO: 8780425 - DNA, 22 bp, Homo sapiens
gacagggaggagcagagcttct

SEQ ID NO: 8780426 - DNA, 22 bp, Homo sapiens
gacagggccaaaccggctgatc

SEQ ID NO: 8780427 - DNA, 22 bp, Homo sapiens
gacagggccaaaccggctgatc

SEQ ID NO: 8780428 - DNA, 22 bp, Homo sapiens
gacagggccaaaccggctgatc

SEQ ID NO: 8780429 - DNA, 22 bp, Homo sapiens
gacagggcatggtgcagagttc

SEQ ID NO: 8780430 - DNA, 22 bp, Homo sapiens
gacagggcgagactcagtctca

SEQ ID NO: 8780431 - DNA, 22 bp, Homo sapiens
gacagggcgcccagcctgtttc

SEQ ID NO: 8780432 - DNA, 23 bp, Homo sapiens
gacagggctgacttggcagctgc

SEQ ID NO: 8780433 - DNA, 22 bp, Homo sapiens
gacagggcgcccagcctgtttc

SEQ ID NO: 8780434 - DNA, 22 bp, Homo sapiens
gacagttacccccaaaagaatt

SEQ ID NO: 8780435 - DNA, 22 bp, Homo sapiens
gacagtgtccctctggggtgga

SEQ ID NO: 8780436 - DNA, 22 bp, Homo sapiens
gacagttaggacaactgacttc

SEQ ID NO: 8780437 - DNA, 22 bp, Homo sapiens
gacagttaggggctggatgcca

SEQ ID NO: 8780438 - DNA, 22 bp, Homo sapiens
gacagttaggacaactgacttc

SEQ ID NO: 8780439 - DNA, 22 bp, Homo sapiens
gacagtttaagcacctaatatt

SEQ ID NO: 8780440 - DNA, 23 bp, Homo sapiens
gacagggctgacttggcagctgc

SEQ ID NO: 8780441 - DNA, 22 bp, Homo sapiens
gacagtgctatggtaggacatt

SEQ ID NO: 8780442 - DNA, 22 bp, Homo sapiens
gacagtggttccaaggcagctt

SEQ ID NO: 8780443 - DNA, 22 bp, Homo sapiens
gacagtgctatggtaggacatt

SEQ ID NO: 8780444 - DNA, 22 bp, Homo sapiens
gacagtggtgttttccattgca

SEQ ID NO: 8780445 - DNA, 20 bp, Homo sapiens
atgctttcttgtgtgctgct

SEQ ID NO: 8780446 - DNA, 18 bp, Homo sapiens
atgctttgcttacgttat

SEQ ID NO: 8780447 - DNA, 22 bp, Homo sapiens
atgctttcttctttcctgtaag

SEQ ID NO: 8780448 - DNA, 22 bp, Homo sapiens
atgctttctaggtgatctgagg

SEQ ID NO: 8780449 - DNA, 22 bp, Homo sapiens
atgctttggccaatgagaagtg

SEQ ID NO: 8780450 - DNA, 22 bp, Homo sapiens
atgcttttaactcctttatccc

SEQ ID NO: 8780451 - DNA, 22 bp, Homo sapiens
atgcttttatgtcacatggtca

SEQ ID NO: 8780452 - DNA, 22 bp, Homo sapiens
atgcttttatgtcacatggtca

SEQ ID NO: 8780453 - DNA, 22 bp, Homo sapiens
atgcttttccaggagaaatata

SEQ ID NO: 8780454 - DNA, 22 bp, Homo sapiens
atgcttttatgtcacatggtca

SEQ ID NO: 8780455 - DNA, 22 bp, Homo sapiens
atgcttttatgtcacatggtca

SEQ ID NO: 8780456 - DNA, 22 bp, Homo sapiens
atgcttttccaggagaaatata

SEQ ID NO: 8780457 - DNA, 22 bp, Homo sapiens
atgcttttccaggagaaatata

SEQ ID NO: 8780458 - DNA, 22 bp, Homo sapiens
atgcttttcctaaaatgatgcc

SEQ ID NO: 8780459 - DNA, 22 bp, Homo sapiens
atgcttttccaggagaaatata

SEQ ID NO: 8780460 - DNA, 21 bp, Homo sapiens
gactttcttaccagatttttg

SEQ ID NO: 8780461 - DNA, 22 bp, Homo sapiens
gactttctgagtcaaagaaagg

SEQ ID NO: 8780462 - DNA, 22 bp, Homo sapiens
gactttgaacagtgtatcagta

SEQ ID NO: 8780463 - DNA, 22 bp, Homo sapiens
gactttgccactgacctccaac

SEQ ID NO: 8780464 - DNA, 22 bp, Homo sapiens
gactttgccacttgctccagct

SEQ ID NO: 8780465 - DNA, 19 bp, Homo sapiens
gactttggaaatgctgttt

SEQ ID NO: 8780466 - DNA, 19 bp, Homo sapiens
gactttggaaatgctgttt

SEQ ID NO: 8780467 - DNA, 22 bp, Homo sapiens
gactttgccctaatgaggtctc

SEQ ID NO: 8780468 - DNA, 22 bp, Homo sapiens
gactttgctgtgtcagcttcag

SEQ ID NO: 8780469 - DNA, 17 bp, Homo sapiens
gactttggagtttcata

SEQ ID NO: 8780470 - DNA, 17 bp, Homo sapiens
gactttggagtttcata

SEQ ID NO: 8780471 - DNA, 22 bp, Homo sapiens
gactttggagcagctacttcct

SEQ ID NO: 8780472 - DNA, 22 bp, Homo sapiens
gactttggcttttattctaggt

SEQ ID NO: 8780473 - DNA, 22 bp, Homo sapiens
gactttggcatctagacattgt

SEQ ID NO: 8780474 - DNA, 22 bp, Homo sapiens
gactttggtataccttgcttta

SEQ ID NO: 8780475 - DNA, 22 bp, Homo sapiens
gactttggcatctagacattgt

SEQ ID NO: 8780476 - DNA, 17 bp, Homo sapiens
gactttggagtttcata

SEQ ID NO: 8780477 - DNA, 22 bp, Homo sapiens
gaccctctagatggaagcactg

SEQ ID NO: 8780478 - DNA, 22 bp, Homo sapiens
gaccctctagatggaagcactg

SEQ ID NO: 8780479 - DNA, 22 bp, Homo sapiens
gaccctctagatggaagcactg

SEQ ID NO: 8780480 - DNA, 22 bp, Homo sapiens
gaccctctagatggaagcactg

SEQ ID NO: 8780481 - DNA, 22 bp, Homo sapiens
gaccctgagcaaaagcagttct

SEQ ID NO: 8780482 - DNA, 22 bp, Homo sapiens
gaccctgaggatgcaccagcag

SEQ ID NO: 8780483 - DNA, 22 bp, Homo sapiens
gaccctgactctaatgcttggc

SEQ ID NO: 8780484 - DNA, 22 bp, Homo sapiens
gaccctgactctaatgcttggc

SEQ ID NO: 8780485 - DNA, 22 bp, Homo sapiens
gaccctgaggattccctgctga

SEQ ID NO: 8780486 - DNA, 22 bp, Homo sapiens
gaccctgataggagtagaagaa

SEQ ID NO: 8780487 - DNA, 22 bp, Homo sapiens
gaccctggaactttcagcagag

SEQ ID NO: 8780488 - DNA, 22 bp, Homo sapiens
gactttccaggtcctgggctat

SEQ ID NO: 8780489 - DNA, 21 bp, Homo sapiens
gaccccagaccagcagacaca

SEQ ID NO: 8780490 - DNA, 21 bp, Homo sapiens
gaccccagaccagcagacaca

SEQ ID NO: 8780491 - DNA, 22 bp, Homo sapiens
gaccctcctgtcttctaaccaa

SEQ ID NO: 8780492 - DNA, 22 bp, Homo sapiens
gaccctccactcactgctgtgt

SEQ ID NO: 8780493 - DNA, 22 bp, Homo sapiens
gacccggctccaggcccagcag

SEQ ID NO: 8780494 - DNA, 22 bp, Homo sapiens
gaccctccactcactgctgtgt

SEQ ID NO: 8780495 - DNA, 22 bp, Homo sapiens
gaccctccactcactgctgtgt

SEQ ID NO: 8780496 - DNA, 22 bp, Homo sapiens
gaccccaggcagatcagggggt

SEQ ID NO: 8780497 - DNA, 18 bp, Homo sapiens
gaccccgggatctgtcga

SEQ ID NO: 8780498 - DNA, 22 bp, Homo sapiens
gcaaaagtacagccggatttct

SEQ ID NO: 8780499 - DNA, 22 bp, Homo sapiens
gcaaaacagtcgatgcctccca

SEQ ID NO: 8780500 - DNA, 22 bp, Homo sapiens
gcaaaactcgcaattacttttg

SEQ ID NO: 8780501 - DNA, 22 bp, Homo sapiens
gcaaaactcgcaattacttttg

SEQ ID NO: 8780502 - DNA, 22 bp, Homo sapiens
gcaaacaagctgcctgaagatt

SEQ ID NO: 8780503 - DNA, 22 bp, Homo sapiens
gcaaacaagctgcctgaagatt

SEQ ID NO: 8780504 - DNA, 22 bp, Homo sapiens
gcaaacaagctgcctgaagatt

SEQ ID NO: 8780505 - DNA, 22 bp, Homo sapiens
gcaaaatttacactccttcttc

SEQ ID NO: 8780506 - DNA, 22 bp, Homo sapiens
gcaaaattaaacttagcatcat

SEQ ID NO: 8780507 - DNA, 22 bp, Homo sapiens
gcaaaatgatcttcttcaggct

SEQ ID NO: 8780508 - DNA, 22 bp, Homo sapiens
gcaaaagtacagccggatttct

SEQ ID NO: 8780509 - DNA, 20 bp, Homo sapiens
gcaaaataggctctgttggt

SEQ ID NO: 8780510 - DNA, 22 bp, Homo sapiens
gcaaaatgatcttcttcaggct

SEQ ID NO: 8780511 - DNA, 22 bp, Homo sapiens
atgtttctagttgtatgtcact

SEQ ID NO: 8780512 - DNA, 22 bp, Homo sapiens
atgtttctagttgtatgtcact

SEQ ID NO: 8780513 - DNA, 22 bp, Homo sapiens
atgtttctaaaacttgcatggc

SEQ ID NO: 8780514 - DNA, 22 bp, Homo sapiens
atgtttctaaaacttgcatggc

SEQ ID NO: 8780515 - DNA, 22 bp, Homo sapiens
atgtttctacagcgtccactga

SEQ ID NO: 8780516 - DNA, 22 bp, Homo sapiens
gatttctgtaacacttcagata

SEQ ID NO: 8780517 - DNA, 22 bp, Homo sapiens
gcaaaaaatgcttgttgcttag

SEQ ID NO: 8780518 - DNA, 22 bp, Homo sapiens
gcaaaaaatgcttgttgcttag

SEQ ID NO: 8780519 - DNA, 22 bp, Homo sapiens
gcaaaaaccacaattactttta

SEQ ID NO: 8780520 - DNA, 22 bp, Homo sapiens
gcaaaaactgcaattacttttg

SEQ ID NO: 8780521 - DNA, 22 bp, Homo sapiens
gcaaaaaccacaattacttttg

SEQ ID NO: 8780522 - DNA, 22 bp, Homo sapiens
gcaaacaaggacatacatcctg

SEQ ID NO: 8780523 - DNA, 22 bp, Homo sapiens
gcaaatgctctccagcctgggt

SEQ ID NO: 8780524 - DNA, 22 bp, Homo sapiens
gcaaatgctctccttggtcagg

SEQ ID NO: 8780525 - DNA, 22 bp, Homo sapiens
gcaaacaaggacatacatcctg

SEQ ID NO: 8780526 - DNA, 22 bp, Homo sapiens
gcaaacaaggacatacatcctg

SEQ ID NO: 8780527 - DNA, 22 bp, Homo sapiens
gcaaacaagctgcctgaagatt

SEQ ID NO: 8780528 - DNA, 22 bp, Homo sapiens
gcaaatggagtgaagagctgga

SEQ ID NO: 8780529 - DNA, 21 bp, Homo sapiens
gcaaatgttcaggaaaaaaga

SEQ ID NO: 8780530 - DNA, 22 bp, Homo sapiens
gcaaatgttcacggggagcata

SEQ ID NO: 8780531 - DNA, 22 bp, Homo sapiens
gcaaatgtggcttcctttctag

SEQ ID NO: 8780532 - DNA, 22 bp, Homo sapiens
gcaaatgtggcttcctttctag

SEQ ID NO: 8780533 - DNA, 22 bp, Homo sapiens
gcaaattcttaactggactgtg

SEQ ID NO: 8780534 - DNA, 22 bp, Homo sapiens
gcaaattcttaactggactgtg

SEQ ID NO: 8780535 - DNA, 22 bp, Homo sapiens
gcaacacagatcttctttgttg

SEQ ID NO: 8780536 - DNA, 22 bp, Homo sapiens
gcaacaagtgtaaacatgcatt

SEQ ID NO: 8780537 - DNA, 22 bp, Homo sapiens
gcaaatgttctatatttgctgt

SEQ ID NO: 8780538 - DNA, 22 bp, Homo sapiens
gcaaatgttctatatttgctgt

SEQ ID NO: 8780539 - DNA, 22 bp, Homo sapiens
gcaaatgtttttgagtgtttac

SEQ ID NO: 8780540 - DNA, 22 bp, Homo sapiens
gcaaattcaacagcacattctc

SEQ ID NO: 8780541 - DNA, 22 bp, Homo sapiens
gcaaattctaggcccctctcca

SEQ ID NO: 8780542 - DNA, 22 bp, Homo sapiens
gcaaatgtttttgagtgtttac

SEQ ID NO: 8780543 - DNA, 23 bp, Homo sapiens
gcaacagagaagtaggagatggc

SEQ ID NO: 8780544 - DNA, 23 bp, Homo sapiens
gcaacagagaagtaggagatggc

SEQ ID NO: 8780545 - DNA, 18 bp, Homo sapiens
gcaacagatcaacagaaa

SEQ ID NO: 8780546 - DNA, 18 bp, Homo sapiens
gcaacagatcaacagaaa

SEQ ID NO: 8780547 - DNA, 18 bp, Homo sapiens
gcaacagatcaacagaaa

SEQ ID NO: 8780548 - DNA, 22 bp, Homo sapiens
gcaacattaaaccaataattgt

SEQ ID NO: 8780549 - DNA, 22 bp, Homo sapiens
gcaacattaaaccaataattgt

SEQ ID NO: 8780550 - DNA, 22 bp, Homo sapiens
gcaacattcatgttctgtaacc

SEQ ID NO: 8780551 - DNA, 20 bp, Homo sapiens
gcaactcacccacagcagct

SEQ ID NO: 8780552 - DNA, 20 bp, Homo sapiens
gcaactcacccacagcagct

SEQ ID NO: 8780553 - DNA, 21 bp, Homo sapiens
gcaaccagaccacagggcagt

SEQ ID NO: 8780554 - DNA, 22 bp, Homo sapiens
gcacacaggggagttctcagaa

SEQ ID NO: 8780555 - DNA, 22 bp, Homo sapiens
gcaactgtgatttgttatcttg

SEQ ID NO: 8780556 - DNA, 22 bp, Homo sapiens
gcaactgaacatgtgtgtggcc

SEQ ID NO: 8780557 - DNA, 22 bp, Homo sapiens
gcacagggccctgtgcgtaggt

SEQ ID NO: 8780558 - DNA, 22 bp, Homo sapiens
gcactgggggcagcagtgaggg

SEQ ID NO: 8780559 - DNA, 22 bp, Homo sapiens
gcactgggggcagcagtgaggg

SEQ ID NO: 8780560 - DNA, 23 bp, Homo sapiens
gcactgggctctcagcaaggtgt

SEQ ID NO: 8780561 - DNA, 22 bp, Homo sapiens
gcacagggaggctggcctggcc

SEQ ID NO: 8780562 - DNA, 22 bp, Homo sapiens
gcacagggaggctggcctggcc

SEQ ID NO: 8780563 - DNA, 22 bp, Homo sapiens
gcacagggcaacaggtctgtta

SEQ ID NO: 8780564 - DNA, 22 bp, Homo sapiens
gcacagggaggctggcctggcc

SEQ ID NO: 8780565 - DNA, 22 bp, Homo sapiens
gcactggtttatttaagaacaa

SEQ ID NO: 8780566 - DNA, 22 bp, Homo sapiens
gcactgtgacagcaagagtgag

SEQ ID NO: 8780567 - DNA, 22 bp, Homo sapiens
gcactggtgtgttagtaaggga

SEQ ID NO: 8780568 - DNA, 22 bp, Homo sapiens
gcactgggtgggagatctgaat

SEQ ID NO: 8780569 - DNA, 22 bp, Homo sapiens
gcactgggtgtgaggcagcgtc

SEQ ID NO: 8780570 - DNA, 22 bp, Homo sapiens
gcactgggtgtgaggcagcgtc

SEQ ID NO: 8780571 - DNA, 22 bp, Homo sapiens
gcactgggtgtgaggcagcgtc

SEQ ID NO: 8780572 - DNA, 22 bp, Homo sapiens
gcactgggtgtgaggcagcgtc

SEQ ID NO: 8780573 - DNA, 22 bp, Homo sapiens
gcactgggtgtgaggcagcgtc

SEQ ID NO: 8780574 - DNA, 22 bp, Homo sapiens
gcactgggtgtgaggcagcgtc

SEQ ID NO: 8780575 - DNA, 22 bp, Homo sapiens
gcactggggtcatagcctccag

SEQ ID NO: 8780576 - DNA, 22 bp, Homo sapiens
gcactggggtcatagcctccag

SEQ ID NO: 8780577 - DNA, 22 bp, Homo sapiens
gcactggggtcatagcctccag

SEQ ID NO: 8780578 - DNA, 22 bp, Homo sapiens
gcactgggtgggagatctgaat

SEQ ID NO: 8780579 - DNA, 22 bp, Homo sapiens
gcactgggggcagcagtgaggg

SEQ ID NO: 8780580 - DNA, 22 bp, Homo sapiens
gcactgggggcagcagtgaggg

SEQ ID NO: 8780581 - DNA, 22 bp, Homo sapiens
gcactgggggcagcagtgaggg

SEQ ID NO: 8780582 - DNA, 22 bp, Homo sapiens
gcactgggggcagcagtgaggg

SEQ ID NO: 8780583 - DNA, 22 bp, Homo sapiens
gcactgggggcagcagtgaggg

SEQ ID NO: 8780584 - DNA, 22 bp, Homo sapiens
gcacaggctgttggccttcaga

SEQ ID NO: 8780585 - DNA, 22 bp, Homo sapiens
gcacaggctgttggccttcaga

SEQ ID NO: 8780586 - DNA, 22 bp, Homo sapiens
gcacaggctctcttggggacac

SEQ ID NO: 8780587 - DNA, 22 bp, Homo sapiens
gcacaggctctcttggggacac

SEQ ID NO: 8780588 - DNA, 22 bp, Homo sapiens
gcacagaggatgaggcagctct

SEQ ID NO: 8780589 - DNA, 22 bp, Homo sapiens
gcacagaggatgaggcagctct

SEQ ID NO: 8780590 - DNA, 22 bp, Homo sapiens
gcacagaggatgaggcagctct

SEQ ID NO: 8780591 - DNA, 22 bp, Homo sapiens
gcacagaggatgaggcagctct

SEQ ID NO: 8780592 - DNA, 21 bp, Homo sapiens
gcacagggacagatcatcaca

SEQ ID NO: 8780593 - DNA, 22 bp, Homo sapiens
gcacagggagacagccgtggcc

SEQ ID NO: 8780594 - DNA, 22 bp, Homo sapiens
gcacagggagcaggtctctggt

SEQ ID NO: 8780595 - DNA, 22 bp, Homo sapiens
gcacagggagcaggtctctggt

SEQ ID NO: 8780596 - DNA, 22 bp, Homo sapiens
gcacagggagacagccgtggcc

SEQ ID NO: 8780597 - DNA, 22 bp, Homo sapiens
gcacagggagacagccgtggcc

SEQ ID NO: 8780598 - DNA, 22 bp, Homo sapiens
gcacagggagacagccgtggcc

SEQ ID NO: 8780599 - DNA, 22 bp, Homo sapiens
gcacagggagacagccgtggcc

SEQ ID NO: 8780600 - DNA, 22 bp, Homo sapiens
gcacagagctggccctccaggc

SEQ ID NO: 8780601 - DNA, 22 bp, Homo sapiens
gcacagaggaagcacagactct

SEQ ID NO: 8780602 - DNA, 22 bp, Homo sapiens
gcacagaggaagcacagactct

SEQ ID NO: 8780603 - DNA, 22 bp, Homo sapiens
gcacagagcttgtttacatttg

SEQ ID NO: 8780604 - DNA, 22 bp, Homo sapiens
gcacagagcctggtaccgagaa

SEQ ID NO: 8780605 - DNA, 22 bp, Homo sapiens
gcacagagctggccctccaggc

SEQ ID NO: 8780606 - DNA, 22 bp, Homo sapiens
gcacagagcctggtaccgagaa

SEQ ID NO: 8780607 - DNA, 22 bp, Homo sapiens
gcacagagcctggtaccgagaa

SEQ ID NO: 8780608 - DNA, 23 bp, Homo sapiens
gcacagagcagttaggggaagat

SEQ ID NO: 8780609 - DNA, 18 bp, Homo sapiens
gcacagagcccaggctct

SEQ ID NO: 8780610 - DNA, 18 bp, Homo sapiens
gcacagagcccaggctct

SEQ ID NO: 8780611 - DNA, 18 bp, Homo sapiens
gcacagagcccaggctct

SEQ ID NO: 8780612 - DNA, 20 bp, Homo sapiens
gcacagagatgagcaaagta

SEQ ID NO: 8780613 - DNA, 20 bp, Homo sapiens
gcacagagatgagcaaagta

SEQ ID NO: 8780614 - DNA, 23 bp, Homo sapiens
gcacagagcagttaggggaagat

SEQ ID NO: 8780615 - DNA, 22 bp, Homo sapiens
gcagaagggaataaggagcttt

SEQ ID NO: 8780616 - DNA, 22 bp, Homo sapiens
gcactgtgacccagagcaggtg

SEQ ID NO: 8780617 - DNA, 22 bp, Homo sapiens
gcactgtgatcaaggctaagca

SEQ ID NO: 8780618 - DNA, 22 bp, Homo sapiens
gcagaaggtcaaagcaagatgt

SEQ ID NO: 8780619 - DNA, 22 bp, Homo sapiens
gcagaaggttgtttgggaaagg

SEQ ID NO: 8780620 - DNA, 22 bp, Homo sapiens
gcagaaggtctggcacttcagg

SEQ ID NO: 8780621 - DNA, 16 bp, Homo sapiens
gcagaggaaaggggag

SEQ ID NO: 8780622 - DNA, 22 bp, Homo sapiens
gcagaggcctaggtggaaggcc

SEQ ID NO: 8780623 - DNA, 22 bp, Homo sapiens
gcagaggcctaggtggaaggcc

SEQ ID NO: 8780624 - DNA, 22 bp, Homo sapiens
gcagaggcctaggtggaaggcc

SEQ ID NO: 8780625 - DNA, 22 bp, Homo sapiens
gcagaggccatcaactttgcca

SEQ ID NO: 8780626 - DNA, 22 bp, Homo sapiens
gcagaatgtaggccttcagtgt

SEQ ID NO: 8780627 - DNA, 22 bp, Homo sapiens
gcagaatatattactgagcctc

SEQ ID NO: 8780628 - DNA, 22 bp, Homo sapiens
gcagaatagtgactttccttaa

SEQ ID NO: 8780629 - DNA, 22 bp, Homo sapiens
gcagaatactgagagctgattg

SEQ ID NO: 8780630 - DNA, 21 bp, Homo sapiens
gcagaatagtctctgtcttca

SEQ ID NO: 8780631 - DNA, 22 bp, Homo sapiens
gcagaatacattttgttttcct

SEQ ID NO: 8780632 - DNA, 22 bp, Homo sapiens
gcagaatacatttgggattact

SEQ ID NO: 8780633 - DNA, 19 bp, Homo sapiens
gcagatccaaaagtcacat

SEQ ID NO: 8780634 - DNA, 22 bp, Homo sapiens
gcagatgaagtttacaggaaac

SEQ ID NO: 8780635 - DNA, 22 bp, Homo sapiens
gcagatgagtgagatagacttc

SEQ ID NO: 8780636 - DNA, 22 bp, Homo sapiens
gcagatgagtgagatagacttc

SEQ ID NO: 8780637 - DNA, 20 bp, Homo sapiens
gcagatgagactcacagagg

SEQ ID NO: 8780638 - DNA, 20 bp, Homo sapiens
gcagatgagactcacagagg

SEQ ID NO: 8780639 - DNA, 22 bp, Homo sapiens
gcagatgaagtttacaggaaac

SEQ ID NO: 8780640 - DNA, 22 bp, Homo sapiens
gcagaggggaagctgaggaatt

SEQ ID NO: 8780641 - DNA, 22 bp, Homo sapiens
gcagaggggaagctgaggaatt

SEQ ID NO: 8780642 - DNA, 22 bp, Homo sapiens
gcagaggggaagctgaggaatt

SEQ ID NO: 8780643 - DNA, 22 bp, Homo sapiens
gcagagtttctggcacattgga

SEQ ID NO: 8780644 - DNA, 22 bp, Homo sapiens
gcagagtttgaagtcaagatgt

SEQ ID NO: 8780645 - DNA, 22 bp, Homo sapiens
gcagaggctgggtgtcccagtc

SEQ ID NO: 8780646 - DNA, 22 bp, Homo sapiens
gcagaggctgggtgtcccagtc

SEQ ID NO: 8780647 - DNA, 22 bp, Homo sapiens
gcagaggctctttaatgcttag

SEQ ID NO: 8780648 - DNA, 22 bp, Homo sapiens
gcagaggctctttaatgcttag

SEQ ID NO: 8780649 - DNA, 22 bp, Homo sapiens
gcagaggctgtagggaaggttg

SEQ ID NO: 8780650 - DNA, 22 bp, Homo sapiens
gcagaggctgtagggaaggttg

SEQ ID NO: 8780651 - DNA, 22 bp, Homo sapiens
gcagaggctgtagggaaggttg

SEQ ID NO: 8780652 - DNA, 22 bp, Homo sapiens
gcagaggctgtagggaaggttg

SEQ ID NO: 8780653 - DNA, 22 bp, Homo sapiens
gcagaggcctgaaggtggcggg

SEQ ID NO: 8780654 - DNA, 22 bp, Homo sapiens
gcagaggcctgaaggtggcggg

SEQ ID NO: 8780655 - DNA, 22 bp, Homo sapiens
gcagaggcctgaaggtggcggg

SEQ ID NO: 8780656 - DNA, 22 bp, Homo sapiens
gcagaggcctgaaggtggcggg

SEQ ID NO: 8780657 - DNA, 22 bp, Homo sapiens
gcagaggcctgaaggtggcggg

SEQ ID NO: 8780658 - DNA, 18 bp, Homo sapiens
gcaggagatgggtggggt

SEQ ID NO: 8780659 - DNA, 22 bp, Homo sapiens
gcaggagagtctgtgccaggtt

SEQ ID NO: 8780660 - DNA, 22 bp, Homo sapiens
gcaggagagtctgtgccaggtt

SEQ ID NO: 8780661 - DNA, 22 bp, Homo sapiens
gcagcctgttgtaccagcctgt

SEQ ID NO: 8780662 - DNA, 22 bp, Homo sapiens
gcagcctgttgtaccagcctgt

SEQ ID NO: 8780663 - DNA, 22 bp, Homo sapiens
gcagccttggtgactgagtctg

SEQ ID NO: 8780664 - DNA, 22 bp, Homo sapiens
gcagctttctaagctttattgc

SEQ ID NO: 8780665 - DNA, 22 bp, Homo sapiens
gcagcctgaggccctttctggc

SEQ ID NO: 8780666 - DNA, 22 bp, Homo sapiens
gcagccaggtttgaggaccact

SEQ ID NO: 8780667 - DNA, 17 bp, Homo sapiens
gcagcctcttggtagtg

SEQ ID NO: 8780668 - DNA, 22 bp, Homo sapiens
gcagccaggtttgaggaccact

SEQ ID NO: 8780669 - DNA, 22 bp, Homo sapiens
gcagccaggtttgaggaccact

SEQ ID NO: 8780670 - DNA, 22 bp, Homo sapiens
gcagccaggtttgaggaccact

SEQ ID NO: 8780671 - DNA, 22 bp, Homo sapiens
gcagcctgggcaacagagtgag

SEQ ID NO: 8780672 - DNA, 22 bp, Homo sapiens
gcagcctgttgtaccagcctgt

SEQ ID NO: 8780673 - DNA, 22 bp, Homo sapiens
gcagcctgggcaacagagtgag

SEQ ID NO: 8780674 - DNA, 22 bp, Homo sapiens
gcagcctgggcaacagagtgag

SEQ ID NO: 8780675 - DNA, 19 bp, Homo sapiens
gcagccaggtgctctacct

SEQ ID NO: 8780676 - DNA, 19 bp, Homo sapiens
gcagccaggtgctctacct

SEQ ID NO: 8780677 - DNA, 22 bp, Homo sapiens
gcagccaggggctgtgacctgt

SEQ ID NO: 8780678 - DNA, 22 bp, Homo sapiens
gcagccagggctaagctgggga

SEQ ID NO: 8780679 - DNA, 22 bp, Homo sapiens
gcagccaggggctgtgacctgt

SEQ ID NO: 8780680 - DNA, 22 bp, Homo sapiens
gcagccaggctacagcgggctt

SEQ ID NO: 8780681 - DNA, 22 bp, Homo sapiens
gcagccaggctacagcgggctt

SEQ ID NO: 8780682 - DNA, 21 bp, Homo sapiens
gcagccaggactttgggctgg

SEQ ID NO: 8780683 - DNA, 22 bp, Homo sapiens
gcagccagggagagaaccaggg

SEQ ID NO: 8780684 - DNA, 22 bp, Homo sapiens
gcagccagggagagaaccaggg

SEQ ID NO: 8780685 - DNA, 22 bp, Homo sapiens
gcagccagggctaagctgggga

SEQ ID NO: 8780686 - DNA, 22 bp, Homo sapiens
gcagccagggagagaaccaggg

SEQ ID NO: 8780687 - DNA, 22 bp, Homo sapiens
gcagcaggtctgtcaatgtcat

SEQ ID NO: 8780688 - DNA, 22 bp, Homo sapiens
gcagatgcctgaaggagctggg

SEQ ID NO: 8780689 - DNA, 22 bp, Homo sapiens
gcagcaggtccgcatcatcatc

SEQ ID NO: 8780690 - DNA, 22 bp, Homo sapiens
gcagatgcaagggtactggggc

SEQ ID NO: 8780691 - DNA, 22 bp, Homo sapiens
gcagatgatgtagacagacagt

SEQ ID NO: 8780692 - DNA, 22 bp, Homo sapiens
gcagatgatgtagacagacagt

SEQ ID NO: 8780693 - DNA, 22 bp, Homo sapiens
gcagatgatgtagacagacagt

SEQ ID NO: 8780694 - DNA, 22 bp, Homo sapiens
gcagatgccagatcatgcaggg

SEQ ID NO: 8780695 - DNA, 22 bp, Homo sapiens
gcattcagcctaaagagaaaag

SEQ ID NO: 8780696 - DNA, 22 bp, Homo sapiens
gcattcatacatcaataagctt

SEQ ID NO: 8780697 - DNA, 22 bp, Homo sapiens
gcattcatcttcctccatgcag

SEQ ID NO: 8780698 - DNA, 22 bp, Homo sapiens
gcattcatcttcatgaaagcac

SEQ ID NO: 8780699 - DNA, 22 bp, Homo sapiens
gcattcctgagaatgcagagtg

SEQ ID NO: 8780700 - DNA, 22 bp, Homo sapiens
gcattcctgagaatgcagagtg

SEQ ID NO: 8780701 - DNA, 22 bp, Homo sapiens
gcattcctgtacctctctgcta

SEQ ID NO: 8780702 - DNA, 22 bp, Homo sapiens
gcattcatgtccttcctgaacg

SEQ ID NO: 8780703 - DNA, 22 bp, Homo sapiens
gcattcccaaaagacacttacc

SEQ ID NO: 8780704 - DNA, 22 bp, Homo sapiens
gcattcctacaggctgctatga

SEQ ID NO: 8780705 - DNA, 22 bp, Homo sapiens
gccactggacccagaaagggaa

SEQ ID NO: 8780706 - DNA, 21 bp, Homo sapiens
gccactgcactccagcctggg

SEQ ID NO: 8780707 - DNA, 22 bp, Homo sapiens
gccactcaaatccagctttaga

SEQ ID NO: 8780708 - DNA, 22 bp, Homo sapiens
gccacgtagaagtgccgcgaga

SEQ ID NO: 8780709 - DNA, 22 bp, Homo sapiens
gcattccttgttagcatttgat

SEQ ID NO: 8780710 - DNA, 22 bp, Homo sapiens
gccactcacatgtaccagatgc

SEQ ID NO: 8780711 - DNA, 22 bp, Homo sapiens
gccactcatgggaggtgtgcaa

SEQ ID NO: 8780712 - DNA, 19 bp, Homo sapiens
gccactcctgatgctgccc

SEQ ID NO: 8780713 - DNA, 23 bp, Homo sapiens
attgtttttggctctcagggaat

SEQ ID NO: 8780714 - DNA, 23 bp, Homo sapiens
attgtttttggctctcagggaat

SEQ ID NO: 8780715 - DNA, 22 bp, Homo sapiens
attgttttgtttcccagtgact

SEQ ID NO: 8780716 - DNA, 22 bp, Homo sapiens
atttaaatgcttaagagggttt

SEQ ID NO: 8780717 - DNA, 22 bp, Homo sapiens
gccactgtcctgtgcctgtgct

SEQ ID NO: 8780718 - DNA, 22 bp, Homo sapiens
attgttttccaaagatgctgct

SEQ ID NO: 8780719 - DNA, 22 bp, Homo sapiens
attgttttccaaagatgctgct

SEQ ID NO: 8780720 - DNA, 22 bp, Homo sapiens
attgttttgtagaatgaccctt

SEQ ID NO: 8780721 - DNA, 22 bp, Homo sapiens
attgttttccaaagatgctgct

SEQ ID NO: 8780722 - DNA, 16 bp, Homo sapiens
attgttttcaattaga

SEQ ID NO: 8780723 - DNA, 22 bp, Homo sapiens
atttaaattttctgatggagag

SEQ ID NO: 8780724 - DNA, 22 bp, Homo sapiens
atttaaattttctgatggagag

SEQ ID NO: 8780725 - DNA, 22 bp, Homo sapiens
atttacagaagcatgtaatagc

SEQ ID NO: 8780726 - DNA, 22 bp, Homo sapiens
atttaaatgcttaagagggttt

SEQ ID NO: 8780727 - DNA, 22 bp, Homo sapiens
atttaaatgcttaagagggttt

SEQ ID NO: 8780728 - DNA, 22 bp, Homo sapiens
atttaaatgcttaagagggttt

SEQ ID NO: 8780729 - DNA, 22 bp, Homo sapiens
atttaaatgcttaagagggttt

SEQ ID NO: 8780730 - DNA, 20 bp, Homo sapiens
attgtttcatttaatgtaca

SEQ ID NO: 8780731 - DNA, 22 bp, Homo sapiens
attgtttccccggaattattca

SEQ ID NO: 8780732 - DNA, 22 bp, Homo sapiens
attgttttaattccattgtgaa

SEQ ID NO: 8780733 - DNA, 22 bp, Homo sapiens
attgtttctgctttatttaggg

SEQ ID NO: 8780734 - DNA, 22 bp, Homo sapiens
attgttttaattccattgtgaa

SEQ ID NO: 8780735 - DNA, 22 bp, Homo sapiens
attgttttattaaatgagccct

SEQ ID NO: 8780736 - DNA, 22 bp, Homo sapiens
gccactgtcataccctggcaat

SEQ ID NO: 8780737 - DNA, 22 bp, Homo sapiens
gccactgtcataccctggcaat

SEQ ID NO: 8780738 - DNA, 22 bp, Homo sapiens
gccactgtactccagcctgcga

SEQ ID NO: 8780739 - DNA, 22 bp, Homo sapiens
gccactgtactccagcctgcga

SEQ ID NO: 8780740 - DNA, 20 bp, Homo sapiens
gccactgggcaccagcaggg

SEQ ID NO: 8780741 - DNA, 22 bp, Homo sapiens
attgttatgaaaataagatgtt

SEQ ID NO: 8780742 - DNA, 22 bp, Homo sapiens
attgttcactgtgaatcttgat

SEQ ID NO: 8780743 - DNA, 22 bp, Homo sapiens
attgttcagagtagggctctgt

SEQ ID NO: 8780744 - DNA, 18 bp, Homo sapiens
attgttaatagagtactt

SEQ ID NO: 8780745 - DNA, 22 bp, Homo sapiens
attgttaatgttgcactaaggt

SEQ ID NO: 8780746 - DNA, 22 bp, Homo sapiens
attgttaatgttgcactaaggt

SEQ ID NO: 8780747 - DNA, 22 bp, Homo sapiens
attgttaatgttgcactaaggt

SEQ ID NO: 8780748 - DNA, 22 bp, Homo sapiens
attgttatgaaaataagatgtt

SEQ ID NO: 8780749 - DNA, 22 bp, Homo sapiens
attgtgcagctctgctcttatt

SEQ ID NO: 8780750 - DNA, 22 bp, Homo sapiens
attgttctggatatttacattg

SEQ ID NO: 8780751 - DNA, 22 bp, Homo sapiens
attgttctaagggtttaattaa

SEQ ID NO: 8780752 - DNA, 22 bp, Homo sapiens
attgttctaagggtttaattaa

SEQ ID NO: 8780753 - DNA, 22 bp, Homo sapiens
attgttccacttccttgtttgc

SEQ ID NO: 8780754 - DNA, 18 bp, Homo sapiens
attgttctgtgacatgtc

SEQ ID NO: 8780755 - DNA, 22 bp, Homo sapiens
attgttctgtagtgacatgtag

SEQ ID NO: 8780756 - DNA, 22 bp, Homo sapiens
attgttctgtagtgacatgtag

SEQ ID NO: 8780757 - DNA, 22 bp, Homo sapiens
attgtttaaagatacatccctg

SEQ ID NO: 8780758 - DNA, 22 bp, Homo sapiens
attgttgggtctcactcctaga

SEQ ID NO: 8780759 - DNA, 22 bp, Homo sapiens
attgttgggtctcactcctaga

SEQ ID NO: 8780760 - DNA, 22 bp, Homo sapiens
attgtttacactaacttcataa

SEQ ID NO: 8780761 - DNA, 22 bp, Homo sapiens
attgttgccacaaggcaattct

SEQ ID NO: 8780762 - DNA, 20 bp, Homo sapiens
attgttgctgctgctgttga

SEQ ID NO: 8780763 - DNA, 20 bp, Homo sapiens
attgttgctgctgctgttga

SEQ ID NO: 8780764 - DNA, 22 bp, Homo sapiens
gcattagacccaaggtattttg

SEQ ID NO: 8780765 - DNA, 22 bp, Homo sapiens
attgtttacactaacttcataa

SEQ ID NO: 8780766 - DNA, 22 bp, Homo sapiens
gcattagagcccatcacctgta

SEQ ID NO: 8780767 - DNA, 22 bp, Homo sapiens
gcattagatttgcctttgaagc

SEQ ID NO: 8780768 - DNA, 22 bp, Homo sapiens
gcattagatatccttgaagtta

SEQ ID NO: 8780769 - DNA, 20 bp, Homo sapiens
gcattagagtactatatgct

SEQ ID NO: 8780770 - DNA, 22 bp, Homo sapiens
gcattattaactggaggaaaag

SEQ ID NO: 8780771 - DNA, 22 bp, Homo sapiens
gcattattaatagctgcatgag

SEQ ID NO: 8780772 - DNA, 22 bp, Homo sapiens
gcagtgcaggacaaatcagtgc

SEQ ID NO: 8780773 - DNA, 22 bp, Homo sapiens
gcagtgcagtgggacagggcgc

SEQ ID NO: 8780774 - DNA, 18 bp, Homo sapiens
gcagtgcaggaagaagag

SEQ ID NO: 8780775 - DNA, 22 bp, Homo sapiens
gcagtgcaggaacatagcttct

SEQ ID NO: 8780776 - DNA, 22 bp, Homo sapiens
gcagtgcattactcacatgttt

SEQ ID NO: 8780777 - DNA, 22 bp, Homo sapiens
gcagtgcatgtcggaactcatt

SEQ ID NO: 8780778 - DNA, 22 bp, Homo sapiens
gcagtgccacaagatgggagga

SEQ ID NO: 8780779 - DNA, 22 bp, Homo sapiens
gcagtgccacaagatgggagga

SEQ ID NO: 8780780 - DNA, 22 bp, Homo sapiens
gcagtgcattactcacatgttt

SEQ ID NO: 8780781 - DNA, 22 bp, Homo sapiens
gcagtgccgaaggtagtggttg

SEQ ID NO: 8780782 - DNA, 18 bp, Homo sapiens
gcagtgccagcctctcct

SEQ ID NO: 8780783 - DNA, 22 bp, Homo sapiens
gcagtgccttgcttctctgtct

SEQ ID NO: 8780784 - DNA, 22 bp, Homo sapiens
gcagtgccgaccatccttccca

SEQ ID NO: 8780785 - DNA, 20 bp, Homo sapiens
gcagtgctggtgcctctgct

SEQ ID NO: 8780786 - DNA, 22 bp, Homo sapiens
attgtaattttagagaaagtgg

SEQ ID NO: 8780787 - DNA, 22 bp, Homo sapiens
attgtaacaggatccctgtggc

SEQ ID NO: 8780788 - DNA, 22 bp, Homo sapiens
attgtacaaaaaagtagacctt

SEQ ID NO: 8780789 - DNA, 22 bp, Homo sapiens
attgtacaatgcctggaacatt

SEQ ID NO: 8780790 - DNA, 22 bp, Homo sapiens
attgtacaatgcctggaacatt

SEQ ID NO: 8780791 - DNA, 22 bp, Homo sapiens
attgtacaatgcctggaacatt

SEQ ID NO: 8780792 - DNA, 22 bp, Homo sapiens
attgtacaatgcctggaacatt

SEQ ID NO: 8780793 - DNA, 22 bp, Homo sapiens
attgtacaatgctgaggtttgg

SEQ ID NO: 8780794 - DNA, 22 bp, Homo sapiens
gcagtgattggatcagagatgg

SEQ ID NO: 8780795 - DNA, 22 bp, Homo sapiens
gcagtgattggatcagagatgg

SEQ ID NO: 8780796 - DNA, 22 bp, Homo sapiens
gcagtgattggctttcacaaaa

SEQ ID NO: 8780797 - DNA, 20 bp, Homo sapiens
gcagtgatttgtctatgttt

SEQ ID NO: 8780798 - DNA, 20 bp, Homo sapiens
gcagtgatttgtctatgttt

SEQ ID NO: 8780799 - DNA, 21 bp, Homo sapiens
gcagtgcagcttggagggtag

SEQ ID NO: 8780800 - DNA, 21 bp, Homo sapiens
gcagtgcagcttggagggtag

SEQ ID NO: 8780801 - DNA, 22 bp, Homo sapiens
gcaggctgtggtatgttgggca

SEQ ID NO: 8780802 - DNA, 22 bp, Homo sapiens
gcaggctgtggtatgttgggca

SEQ ID NO: 8780803 - DNA, 22 bp, Homo sapiens
gcaggctgtggtatgttgggca

SEQ ID NO: 8780804 - DNA, 22 bp, Homo sapiens
gcagggactttggcaacaggtg

SEQ ID NO: 8780805 - DNA, 22 bp, Homo sapiens
gcagggactttggcaacaggtg

SEQ ID NO: 8780806 - DNA, 22 bp, Homo sapiens
gcagggactgtgatctcacaga

SEQ ID NO: 8780807 - DNA, 22 bp, Homo sapiens
gcagggactgtgatctcacaga

SEQ ID NO: 8780808 - DNA, 22 bp, Homo sapiens
gcagggactgtgatctcacaga

SEQ ID NO: 8780809 - DNA, 22 bp, Homo sapiens
gcagggacgccagggacagcaa

SEQ ID NO: 8780810 - DNA, 22 bp, Homo sapiens
gcagggaggaagagatgcttcc

SEQ ID NO: 8780811 - DNA, 22 bp, Homo sapiens
gcagggaggaagagatgcttcc

SEQ ID NO: 8780812 - DNA, 22 bp, Homo sapiens
gcagggagggcctttcatgaca

SEQ ID NO: 8780813 - DNA, 22 bp, Homo sapiens
gcagggagggcctttcatgaca

SEQ ID NO: 8780814 - DNA, 22 bp, Homo sapiens
gcagggaggaagagatgcttcc

SEQ ID NO: 8780815 - DNA, 22 bp, Homo sapiens
gcaggctgtgaggctcagatgg

SEQ ID NO: 8780816 - DNA, 22 bp, Homo sapiens
gcaggctgtgaggctcagatgg

SEQ ID NO: 8780817 - DNA, 22 bp, Homo sapiens
gcaggctgtgaggctcagatgg

SEQ ID NO: 8780818 - DNA, 22 bp, Homo sapiens
gcaggctgtgaggctcagatgg

SEQ ID NO: 8780819 - DNA, 22 bp, Homo sapiens
gcaggctgtgaggctcagatgg

SEQ ID NO: 8780820 - DNA, 22 bp, Homo sapiens
gcaggctgtctaaagttagagt

SEQ ID NO: 8780821 - DNA, 22 bp, Homo sapiens
gcaggctgtctaaagttagagt

SEQ ID NO: 8780822 - DNA, 22 bp, Homo sapiens
gcaggctgtagacaccaaacta

SEQ ID NO: 8780823 - DNA, 22 bp, Homo sapiens
gcaggctagggagctgcagtcc

SEQ ID NO: 8780824 - DNA, 22 bp, Homo sapiens
gcaggatgggtgtagcccagca

SEQ ID NO: 8780825 - DNA, 22 bp, Homo sapiens
gcaggatggtggaaggcctgct

SEQ ID NO: 8780826 - DNA, 22 bp, Homo sapiens
gcaggatggtggaaggcctgct

SEQ ID NO: 8780827 - DNA, 22 bp, Homo sapiens
gcaggcgtgtttcacgtgccag

SEQ ID NO: 8780828 - DNA, 22 bp, Homo sapiens
gcaggctaactcataggctgtg

SEQ ID NO: 8780829 - DNA, 22 bp, Homo sapiens
gcaggcggatcactggaagtca

SEQ ID NO: 8780830 - DNA, 14 bp, Homo sapiens
gcaggcggatcact

SEQ ID NO: 8780831 - DNA, 22 bp, Homo sapiens
gcaggcggaggttgcagtgagc

SEQ ID NO: 8780832 - DNA, 22 bp, Homo sapiens
gcaggatgagtgagtacattta

SEQ ID NO: 8780833 - DNA, 22 bp, Homo sapiens
gcaggatgccagggcagcagcg

SEQ ID NO: 8780834 - DNA, 22 bp, Homo sapiens
gcaggatgccagggcagcagcg

SEQ ID NO: 8780835 - DNA, 22 bp, Homo sapiens
gcaggatgaactaacacctgca

SEQ ID NO: 8780836 - DNA, 22 bp, Homo sapiens
gcaggatgaactaacacctgca

SEQ ID NO: 8780837 - DNA, 22 bp, Homo sapiens
gcaggagcagtcaggggcagct

SEQ ID NO: 8780838 - DNA, 22 bp, Homo sapiens
gcaggagcagtcaggggcagct

SEQ ID NO: 8780839 - DNA, 22 bp, Homo sapiens
gcaggagcaaactgcagtgtgg

SEQ ID NO: 8780840 - DNA, 22 bp, Homo sapiens
gcaggagcaaactgcagtgtgg

SEQ ID NO: 8780841 - DNA, 18 bp, Homo sapiens
gcaggagatgggtggggt

SEQ ID NO: 8780842 - DNA, 18 bp, Homo sapiens
gcaggagatgggtggggt

SEQ ID NO: 8780843 - DNA, 22 bp, Homo sapiens
gcaggagcagtcaggggcagct

SEQ ID NO: 8780844 - DNA, 22 bp, Homo sapiens
gcagggattgtgcagggggcta

SEQ ID NO: 8780845 - DNA, 22 bp, Homo sapiens
gcagggaggtttgctgacctgg

SEQ ID NO: 8780846 - DNA, 22 bp, Homo sapiens
gcagggaggtttgctgacctgg

SEQ ID NO: 8780847 - DNA, 22 bp, Homo sapiens
gcagggaggtttgctgacctgg

SEQ ID NO: 8780848 - DNA, 22 bp, Homo sapiens
gcagggctggggctgctcctga

SEQ ID NO: 8780849 - DNA, 22 bp, Homo sapiens
gcaggggtagagattgctggtg

SEQ ID NO: 8780850 - DNA, 22 bp, Homo sapiens
gcaggggtagtgtcttcctgag

SEQ ID NO: 8780851 - DNA, 22 bp, Homo sapiens
gcaggggtagtgtcttcctgag

SEQ ID NO: 8780852 - DNA, 16 bp, Homo sapiens
gcaggggtgggtggag

SEQ ID NO: 8780853 - DNA, 22 bp, Homo sapiens
gcaggggttttctgacttgagt

SEQ ID NO: 8780854 - DNA, 22 bp, Homo sapiens
gcagggtaggtgacaggtagtc

SEQ ID NO: 8780855 - DNA, 22 bp, Homo sapiens
gcagggtgaaggtcacatagaa

SEQ ID NO: 8780856 - DNA, 22 bp, Homo sapiens
gcaggtggatattgctacttga

SEQ ID NO: 8780857 - DNA, 22 bp, Homo sapiens
gcaggtggatattgctacttga

SEQ ID NO: 8780858 - DNA, 22 bp, Homo sapiens
gcaggtggatcaccacgtcagg

SEQ ID NO: 8780859 - DNA, 22 bp, Homo sapiens
gcaggtggatattgctacttga

SEQ ID NO: 8780860 - DNA, 14 bp, Homo sapiens
gcaggtggatcacc

SEQ ID NO: 8780861 - DNA, 22 bp, Homo sapiens
gcaggtggatcaccacgtcagg

SEQ ID NO: 8780862 - DNA, 22 bp, Homo sapiens
gcaggtggatcaccacgtcagg

SEQ ID NO: 8780863 - DNA, 22 bp, Homo sapiens
gcaggtggatcacctgaggtca

SEQ ID NO: 8780864 - DNA, 16 bp, Homo sapiens
gcaggtggatcacctg

SEQ ID NO: 8780865 - DNA, 22 bp, Homo sapiens
gcaggtggatcacctgaggtca

SEQ ID NO: 8780866 - DNA, 22 bp, Homo sapiens
gcaggtggatcacctgaggtca

SEQ ID NO: 8780867 - DNA, 22 bp, Homo sapiens
gcaggtggatcacctgaggtca

SEQ ID NO: 8780868 - DNA, 22 bp, Homo sapiens
attggcagttagtgacgaggct

SEQ ID NO: 8780869 - DNA, 22 bp, Homo sapiens
attggcagggccagcatctccc

SEQ ID NO: 8780870 - DNA, 15 bp, Homo sapiens
gcaggtggatcactt

SEQ ID NO: 8780871 - DNA, 14 bp, Homo sapiens
gcaggtggatcact

SEQ ID NO: 8780872 - DNA, 22 bp, Homo sapiens
attggtggtgaggacatgccag

SEQ ID NO: 8780873 - DNA, 22 bp, Homo sapiens
attggtggtgaggacatgccag

SEQ ID NO: 8780874 - DNA, 22 bp, Homo sapiens
attggttaccactttaaatctt

SEQ ID NO: 8780875 - DNA, 22 bp, Homo sapiens
attgtaaaagtattctaagatt

SEQ ID NO: 8780876 - DNA, 22 bp, Homo sapiens
attgtaaaagtattctaagatt

SEQ ID NO: 8780877 - DNA, 22 bp, Homo sapiens
attgtaaaagtattctaagatt

SEQ ID NO: 8780878 - DNA, 22 bp, Homo sapiens
attgtaaaagtattctaagatt

SEQ ID NO: 8780879 - DNA, 22 bp, Homo sapiens
attgtaaaagtattctaagatt

SEQ ID NO: 8780880 - DNA, 22 bp, Homo sapiens
attggttttgttatctccattc

SEQ ID NO: 8780881 - DNA, 22 bp, Homo sapiens
attgtaaaagtattctaagatt

SEQ ID NO: 8780882 - DNA, 22 bp, Homo sapiens
attgtaaaagtattctaagatt

SEQ ID NO: 8780883 - DNA, 22 bp, Homo sapiens
attgtaaaagtattctaagatt

SEQ ID NO: 8780884 - DNA, 22 bp, Homo sapiens
attgtaaagtactgtgtacaat

SEQ ID NO: 8780885 - DNA, 22 bp, Homo sapiens
attgtaaagtactgtgtacaat

SEQ ID NO: 8780886 - DNA, 22 bp, Homo sapiens
gcccaggaggtcaagtagctat

SEQ ID NO: 8780887 - DNA, 22 bp, Homo sapiens
gcccagcccctgggtggacgtg

SEQ ID NO: 8780888 - DNA, 22 bp, Homo sapiens
gcccaggaggtggaggtgcagt

SEQ ID NO: 8780889 - DNA, 22 bp, Homo sapiens
gcccaggaggtggaggtgcagt

SEQ ID NO: 8780890 - DNA, 22 bp, Homo sapiens
gcccaggaggttgggctgtgca

SEQ ID NO: 8780891 - DNA, 22 bp, Homo sapiens
gcccaggagttcaaggctgcag

SEQ ID NO: 8780892 - DNA, 22 bp, Homo sapiens
gcccaggagttcaaggctgcag

SEQ ID NO: 8780893 - DNA, 22 bp, Homo sapiens
gccctccagctgttgcgcgtcg

SEQ ID NO: 8780894 - DNA, 22 bp, Homo sapiens
gccctccagctgttgcgcgtcg

SEQ ID NO: 8780895 - DNA, 20 bp, Homo sapiens
gccctcatgtacaggctgga

SEQ ID NO: 8780896 - DNA, 22 bp, Homo sapiens
gccctccaccagagcccttctc

SEQ ID NO: 8780897 - DNA, 19 bp, Homo sapiens
gccctcatgatattcagat

SEQ ID NO: 8780898 - DNA, 22 bp, Homo sapiens
gcccaggagttcaagtctagtg

SEQ ID NO: 8780899 - DNA, 22 bp, Homo sapiens
gcccaggagttcaagtctagtg

SEQ ID NO: 8780900 - DNA, 22 bp, Homo sapiens
gcccaggagttgaagggctgac

SEQ ID NO: 8780901 - DNA, 21 bp, Homo sapiens
gccccctggactcctcatcca

SEQ ID NO: 8780902 - DNA, 21 bp, Homo sapiens
gccccctggactcctcatcca

SEQ ID NO: 8780903 - DNA, 21 bp, Homo sapiens
gccccctggactcctcatcca

SEQ ID NO: 8780904 - DNA, 21 bp, Homo sapiens
gccccctggactcctcatcca

SEQ ID NO: 8780905 - DNA, 22 bp, Homo sapiens
gccctgcagtgcggaggtggca

SEQ ID NO: 8780906 - DNA, 22 bp, Homo sapiens
gccctgcagtgcggaggtggca

SEQ ID NO: 8780907 - DNA, 19 bp, Homo sapiens
gccctgcaggaggtggggc

SEQ ID NO: 8780908 - DNA, 22 bp, Homo sapiens
gccctgccctctcggcactcgc

SEQ ID NO: 8780909 - DNA, 22 bp, Homo sapiens
gccctgccctctcggcactcgc

SEQ ID NO: 8780910 - DNA, 22 bp, Homo sapiens
gccctgccctgagccgtagacc

SEQ ID NO: 8780911 - DNA, 22 bp, Homo sapiens
gccctgcctgccggtgtgggtc

SEQ ID NO: 8780912 - DNA, 23 bp, Homo sapiens
gccctgcccttagcacactcaca

SEQ ID NO: 8780913 - DNA, 23 bp, Homo sapiens
gccctgcccttagcacactcaca

SEQ ID NO: 8780914 - DNA, 22 bp, Homo sapiens
gccctgccctgttgaaactaga

SEQ ID NO: 8780915 - DNA, 22 bp, Homo sapiens
gccctcctggcaggcagtgatg

SEQ ID NO: 8780916 - DNA, 22 bp, Homo sapiens
gccctcctggcaggcagtgatg

SEQ ID NO: 8780917 - DNA, 22 bp, Homo sapiens
gccctcctgcaggggcttctgg

SEQ ID NO: 8780918 - DNA, 22 bp, Homo sapiens
gccctcctgcaggggcttctgg

SEQ ID NO: 8780919 - DNA, 22 bp, Homo sapiens
gccctcctgcaggggcttctgg

SEQ ID NO: 8780920 - DNA, 22 bp, Homo sapiens
gccctcctgagctagcacgtgt

SEQ ID NO: 8780921 - DNA, 19 bp, Homo sapiens
gccctcctcactgagctct

SEQ ID NO: 8780922 - DNA, 19 bp, Homo sapiens
gccctcctcactgagctct

SEQ ID NO: 8780923 - DNA, 19 bp, Homo sapiens
gccctcctcactgagctct

SEQ ID NO: 8780924 - DNA, 23 bp, Homo sapiens
gccctccctcccaggtgggtgtt

SEQ ID NO: 8780925 - DNA, 23 bp, Homo sapiens
gccctccctcccaggtgggtgtt

SEQ ID NO: 8780926 - DNA, 22 bp, Homo sapiens
gccctccctacagcctatttct

SEQ ID NO: 8780927 - DNA, 22 bp, Homo sapiens
gccctccctacagcctatttct

SEQ ID NO: 8780928 - DNA, 22 bp, Homo sapiens
gccctccctacagcctatttct

SEQ ID NO: 8780929 - DNA, 22 bp, Homo sapiens
gccctccatggtgatccaggcc

SEQ ID NO: 8780930 - DNA, 22 bp, Homo sapiens
gccctcccctctgggtggtgag

SEQ ID NO: 8780931 - DNA, 22 bp, Homo sapiens
gccctcccctctgggtggtgag

SEQ ID NO: 8780932 - DNA, 22 bp, Homo sapiens
atttacagtttagcatttcaag

SEQ ID NO: 8780933 - DNA, 22 bp, Homo sapiens
atttacagtttagcatttcaag

SEQ ID NO: 8780934 - DNA, 22 bp, Homo sapiens
atttacataatagactttaggt

SEQ ID NO: 8780935 - DNA, 22 bp, Homo sapiens
atttacataatagactttaggt

SEQ ID NO: 8780936 - DNA, 22 bp, Homo sapiens
atttacataatagactttaggt

SEQ ID NO: 8780937 - DNA, 22 bp, Homo sapiens
atttacataatagactttaggt

SEQ ID NO: 8780938 - DNA, 22 bp, Homo sapiens
atttacataatagactttaggt

SEQ ID NO: 8780939 - DNA, 22 bp, Homo sapiens
atttacagacgtggattagtgc

SEQ ID NO: 8780940 - DNA, 22 bp, Homo sapiens
atttacagaccctcccactaag

SEQ ID NO: 8780941 - DNA, 22 bp, Homo sapiens
atttacagtgtgcctactatat

SEQ ID NO: 8780942 - DNA, 23 bp, Homo sapiens
atttacaggttaaatgaaatcag

SEQ ID NO: 8780943 - DNA, 22 bp, Homo sapiens
atttacagtttagcatttcaag

SEQ ID NO: 8780944 - DNA, 22 bp, Homo sapiens
atttacagtgtgcctactatat

SEQ ID NO: 8780945 - DNA, 22 bp, Homo sapiens
atttacagtgtgcctactatat

SEQ ID NO: 8780946 - DNA, 22 bp, Homo sapiens
atttacagtgtgcctactatat

SEQ ID NO: 8780947 - DNA, 22 bp, Homo sapiens
atttacatttatttgagaaggt

SEQ ID NO: 8780948 - DNA, 22 bp, Homo sapiens
atttacatttatttgagaaggt

SEQ ID NO: 8780949 - DNA, 22 bp, Homo sapiens
atttacatttatttgagaaggt

SEQ ID NO: 8780950 - DNA, 22 bp, Homo sapiens
atttacatttatttgagaaggt

SEQ ID NO: 8780951 - DNA, 17 bp, Homo sapiens
atttacattgtcaccga

SEQ ID NO: 8780952 - DNA, 22 bp, Homo sapiens
atttaccagctgtgcactgata

SEQ ID NO: 8780953 - DNA, 22 bp, Homo sapiens
atttaccatatgtactgagtat

SEQ ID NO: 8780954 - DNA, 22 bp, Homo sapiens
atttaccagctgtgcactgata

SEQ ID NO: 8780955 - DNA, 22 bp, Homo sapiens
atttaccagtgctgacatttga

SEQ ID NO: 8780956 - DNA, 18 bp, Homo sapiens
gccagagggaagcaggtg

SEQ ID NO: 8780957 - DNA, 22 bp, Homo sapiens
atttaccatcctgtgaatggcc

SEQ ID NO: 8780958 - DNA, 22 bp, Homo sapiens
atttactaatgtcatatcgcgt

SEQ ID NO: 8780959 - DNA, 18 bp, Homo sapiens
gccagagggaagcaggtg

SEQ ID NO: 8780960 - DNA, 22 bp, Homo sapiens
atttactaatgtcatatcgcgt

SEQ ID NO: 8780961 - DNA, 18 bp, Homo sapiens
gccagagggaagcaggtg

SEQ ID NO: 8780962 - DNA, 22 bp, Homo sapiens
gccagagggattcctggtgtgt

SEQ ID NO: 8780963 - DNA, 18 bp, Homo sapiens
gccagagggaagcaggtg

SEQ ID NO: 8780964 - DNA, 19 bp, Homo sapiens
gcccacggccctgctctgc

SEQ ID NO: 8780965 - DNA, 22 bp, Homo sapiens
gccagaggttcaacaactgtct

SEQ ID NO: 8780966 - DNA, 22 bp, Homo sapiens
gccagaggtatcaaagatagta

SEQ ID NO: 8780967 - DNA, 22 bp, Homo sapiens
gccagaggttcaacaactgtct

SEQ ID NO: 8780968 - DNA, 22 bp, Homo sapiens
gccagaggtatcaaagatagta

SEQ ID NO: 8780969 - DNA, 18 bp, Homo sapiens
gccagaggtactactgat

SEQ ID NO: 8780970 - DNA, 22 bp, Homo sapiens
gccagaggggctcgaaggcgcg

SEQ ID NO: 8780971 - DNA, 18 bp, Homo sapiens
gccagaggtactactgat

SEQ ID NO: 8780972 - DNA, 18 bp, Homo sapiens
gccagaggtactactgat

SEQ ID NO: 8780973 - DNA, 18 bp, Homo sapiens
gccagagggcccaaggtc

SEQ ID NO: 8780974 - DNA, 22 bp, Homo sapiens
gccagaggggctcgaaggcgcg

SEQ ID NO: 8780975 - DNA, 18 bp, Homo sapiens
gccagagggcccaaggtc

SEQ ID NO: 8780976 - DNA, 22 bp, Homo sapiens
gccagagggattcctggtgtgt

SEQ ID NO: 8780977 - DNA, 18 bp, Homo sapiens
gccagaggtactactgat

SEQ ID NO: 8780978 - DNA, 18 bp, Homo sapiens
gccagaggtactactgat

SEQ ID NO: 8780979 - DNA, 22 bp, Homo sapiens
gcccagcaggggatggcagctc

SEQ ID NO: 8780980 - DNA, 22 bp, Homo sapiens
gcccagcaggggatggcagctc

SEQ ID NO: 8780981 - DNA, 22 bp, Homo sapiens
gcccagcaggggatggcagctc

SEQ ID NO: 8780982 - DNA, 22 bp, Homo sapiens
gcccagcaggacagagtggttt

SEQ ID NO: 8780983 - DNA, 22 bp, Homo sapiens
gcccagccacagtcactttcat

SEQ ID NO: 8780984 - DNA, 22 bp, Homo sapiens
gcccagccagagctgtgtgatg

SEQ ID NO: 8780985 - DNA, 22 bp, Homo sapiens
gcccagcccagaaaggttcgga

SEQ ID NO: 8780986 - DNA, 22 bp, Homo sapiens
gcccagccagagctgtgtgatg

SEQ ID NO: 8780987 - DNA, 22 bp, Homo sapiens
atttgcagctaggatccaaagt

SEQ ID NO: 8780988 - DNA, 18 bp, Homo sapiens
atttgcaggcatgcaggc

SEQ ID NO: 8780989 - DNA, 22 bp, Homo sapiens
atttgcagggaagggcagaagg

SEQ ID NO: 8780990 - DNA, 22 bp, Homo sapiens
atttgcaattttactttgcagt

SEQ ID NO: 8780991 - DNA, 22 bp, Homo sapiens
atttgcagagctctgaattttg

SEQ ID NO: 8780992 - DNA, 22 bp, Homo sapiens
atttgcagagctctgaattttg

SEQ ID NO: 8780993 - DNA, 22 bp, Homo sapiens
atttgcataaggatgctactgt

SEQ ID NO: 8780994 - DNA, 22 bp, Homo sapiens
atttgcaggtgtcgattagtct

SEQ ID NO: 8780995 - DNA, 22 bp, Homo sapiens
atttgcatatctgatagactaa

SEQ ID NO: 8780996 - DNA, 22 bp, Homo sapiens
atttgcaaaggttaacagcagt

SEQ ID NO: 8780997 - DNA, 22 bp, Homo sapiens
atttgcaaagtcgtatctgtga

SEQ ID NO: 8780998 - DNA, 22 bp, Homo sapiens
atttgcaaagtcgtatctgtga

SEQ ID NO: 8780999 - DNA, 22 bp, Homo sapiens
atttgcaagagtaagaatttct

SEQ ID NO: 8781000 - DNA, 22 bp, Homo sapiens
atttgcaagcatgcacaaaagc

SEQ ID NO: 8781001 - DNA, 22 bp, Homo sapiens
atttgcaatgatttcagtgctt

SEQ ID NO: 8781002 - DNA, 22 bp, Homo sapiens
atttgcaatgatttcagtgctt

SEQ ID NO: 8781003 - DNA, 22 bp, Homo sapiens
atttgcaatgatttcagtgctt

SEQ ID NO: 8781004 - DNA, 22 bp, Homo sapiens
atttgcaattactcatgtcatt

SEQ ID NO: 8781005 - DNA, 22 bp, Homo sapiens
atttgcaattttactttgcagt

SEQ ID NO: 8781006 - DNA, 22 bp, Homo sapiens
atttgcaattttactttgcagt

SEQ ID NO: 8781007 - DNA, 22 bp, Homo sapiens
atttgacagtgagttgtggatg

SEQ ID NO: 8781008 - DNA, 22 bp, Homo sapiens
atttgattagctgtgtaatttt

SEQ ID NO: 8781009 - DNA, 22 bp, Homo sapiens
atttgattagctgtgtaatttt

SEQ ID NO: 8781010 - DNA, 22 bp, Homo sapiens
atttgattagctgtgtaatttt

SEQ ID NO: 8781011 - DNA, 23 bp, Homo sapiens
atttgacagagcatagcatttct

SEQ ID NO: 8781012 - DNA, 22 bp, Homo sapiens
atttgacagtgagttgtggatg

SEQ ID NO: 8781013 - DNA, 22 bp, Homo sapiens
atttgacattgacacacctatg

SEQ ID NO: 8781014 - DNA, 22 bp, Homo sapiens
atttgagaaaggagggaacttt

SEQ ID NO: 8781015 - DNA, 23 bp, Homo sapiens
atttgacagagcatagcatttct

SEQ ID NO: 8781016 - DNA, 22 bp, Homo sapiens
atttgacaacttctggtggcat

SEQ ID NO: 8781017 - DNA, 22 bp, Homo sapiens
atttcttccttctcctagaaga

SEQ ID NO: 8781018 - DNA, 22 bp, Homo sapiens
atttcttgattccaccagtgaa

SEQ ID NO: 8781019 - DNA, 22 bp, Homo sapiens
atttcttgattccaccagtgaa

SEQ ID NO: 8781020 - DNA, 20 bp, Homo sapiens
atttgcatctgaataactta

SEQ ID NO: 8781021 - DNA, 20 bp, Homo sapiens
atttgcatctgaataactta

SEQ ID NO: 8781022 - DNA, 23 bp, Homo sapiens
atttgcatggccggattatggat

SEQ ID NO: 8781023 - DNA, 22 bp, Homo sapiens
atttgcatgcttctattgtgaa

SEQ ID NO: 8781024 - DNA, 22 bp, Homo sapiens
atttgcctgtaagacaaggcct

SEQ ID NO: 8781025 - DNA, 22 bp, Homo sapiens
atttgcatttagaaagatcact

SEQ ID NO: 8781026 - DNA, 22 bp, Homo sapiens
atttgcctctgctttcaaggat

SEQ ID NO: 8781027 - DNA, 22 bp, Homo sapiens
atttgccttgtgatttgtaagt

SEQ ID NO: 8781028 - DNA, 22 bp, Homo sapiens
atttgccttggtgatttgtaaa

SEQ ID NO: 8781029 - DNA, 22 bp, Homo sapiens
atttgccttactgaagaaggag

SEQ ID NO: 8781030 - DNA, 22 bp, Homo sapiens
atttgccttgtgaattggatat

SEQ ID NO: 8781031 - DNA, 22 bp, Homo sapiens
attttaaggcttatttaaaggc

SEQ ID NO: 8781032 - DNA, 22 bp, Homo sapiens
attttaaggcttatttaaaggc

SEQ ID NO: 8781033 - DNA, 22 bp, Homo sapiens
attttaataagattcccaagta

SEQ ID NO: 8781034 - DNA, 22 bp, Homo sapiens
attttaataagatccatttggt

SEQ ID NO: 8781035 - DNA, 22 bp, Homo sapiens
attttaataagatccatttggt

SEQ ID NO: 8781036 - DNA, 23 bp, Homo sapiens
attttaaccttgactaacatgca

SEQ ID NO: 8781037 - DNA, 23 bp, Homo sapiens
attttaaccttgactaacatgca

SEQ ID NO: 8781038 - DNA, 22 bp, Homo sapiens
atttgtctttgagtgccctgct

SEQ ID NO: 8781039 - DNA, 22 bp, Homo sapiens
atttgtctgcttgctgccttcc

SEQ ID NO: 8781040 - DNA, 22 bp, Homo sapiens
atttgtctgcttgctgccttcc

SEQ ID NO: 8781041 - DNA, 22 bp, Homo sapiens
atttgcctttcgaatcaacagg

SEQ ID NO: 8781042 - DNA, 22 bp, Homo sapiens
attttacataaggaaggtttaa

SEQ ID NO: 8781043 - DNA, 23 bp, Homo sapiens
attttacaggtcagttccttgaa

SEQ ID NO: 8781044 - DNA, 22 bp, Homo sapiens
attttaataagattcccaagta

SEQ ID NO: 8781045 - DNA, 18 bp, Homo sapiens
gcctgccatccccacagc

SEQ ID NO: 8781046 - DNA, 22 bp, Homo sapiens
gcctgcccacggggctggcata

SEQ ID NO: 8781047 - DNA, 22 bp, Homo sapiens
gcctgcccacggggctggcata

SEQ ID NO: 8781048 - DNA, 22 bp, Homo sapiens
gcctgcccacggggctggcata

SEQ ID NO: 8781049 - DNA, 22 bp, Homo sapiens
gcctgcccacggggctggcata

SEQ ID NO: 8781050 - DNA, 22 bp, Homo sapiens
gcctgcctagaattgcagcttt

SEQ ID NO: 8781051 - DNA, 23 bp, Homo sapiens
gcctgccgcctggctgagaactg

SEQ ID NO: 8781052 - DNA, 23 bp, Homo sapiens
gcctgccgcctggctgagaactg

SEQ ID NO: 8781053 - DNA, 23 bp, Homo sapiens
gcctgccgcctggctgagaactg

SEQ ID NO: 8781054 - DNA, 22 bp, Homo sapiens
gcctgcctagaattgcagcttt

SEQ ID NO: 8781055 - DNA, 18 bp, Homo sapiens
gcctgcctagagcttgcc

SEQ ID NO: 8781056 - DNA, 22 bp, Homo sapiens
gcctgcctagaattgcagcttt

SEQ ID NO: 8781057 - DNA, 22 bp, Homo sapiens
gcctgcctagaattgcagcttt

SEQ ID NO: 8781058 - DNA, 21 bp, Homo sapiens
gcctgccctctgtgatggcca

SEQ ID NO: 8781059 - DNA, 21 bp, Homo sapiens
gcctgccctctgtgatggcca

SEQ ID NO: 8781060 - DNA, 22 bp, Homo sapiens
gcctgccctgaaagaggtgaag

SEQ ID NO: 8781061 - DNA, 22 bp, Homo sapiens
gcctgccctgaaagaggtgaag

SEQ ID NO: 8781062 - DNA, 22 bp, Homo sapiens
gcctgccccttcctgggcaggg

SEQ ID NO: 8781063 - DNA, 21 bp, Homo sapiens
gcctgccccatgtttctgttg

SEQ ID NO: 8781064 - DNA, 22 bp, Homo sapiens
gcctgccccttcctgggcaggg

SEQ ID NO: 8781065 - DNA, 22 bp, Homo sapiens
gcctgccccttcctgggcaggg

SEQ ID NO: 8781066 - DNA, 22 bp, Homo sapiens
gcctggctcacagagcagcctt

SEQ ID NO: 8781067 - DNA, 22 bp, Homo sapiens
gcctggctcacagagcagcctt

SEQ ID NO: 8781068 - DNA, 22 bp, Homo sapiens
gcctggctccctctgcagctcc

SEQ ID NO: 8781069 - DNA, 22 bp, Homo sapiens
attttgaaatacttgaaggaaa

SEQ ID NO: 8781070 - DNA, 22 bp, Homo sapiens
attttgaaatacttgaaggaaa

SEQ ID NO: 8781071 - DNA, 18 bp, Homo sapiens
attttgaacaatgctgta

SEQ ID NO: 8781072 - DNA, 18 bp, Homo sapiens
attttgaacaatgctgta

SEQ ID NO: 8781073 - DNA, 18 bp, Homo sapiens
attttgaacaatgctgta

SEQ ID NO: 8781074 - DNA, 18 bp, Homo sapiens
attttgaacaatgctgta

SEQ ID NO: 8781075 - DNA, 18 bp, Homo sapiens
attttgaactgggaatat

SEQ ID NO: 8781076 - DNA, 18 bp, Homo sapiens
attttgaactgggaatat

SEQ ID NO: 8781077 - DNA, 22 bp, Homo sapiens
attttgaagggaattgaagttc

SEQ ID NO: 8781078 - DNA, 22 bp, Homo sapiens
attttgaagggaattgaagttc

SEQ ID NO: 8781079 - DNA, 22 bp, Homo sapiens
attttgaagggaattgaagttc

SEQ ID NO: 8781080 - DNA, 22 bp, Homo sapiens
attttgaagggaattgaagttc

SEQ ID NO: 8781081 - DNA, 22 bp, Homo sapiens
attttgaaaagcatttgagtaa

SEQ ID NO: 8781082 - DNA, 22 bp, Homo sapiens
attttgaaaagcatttgagtaa

SEQ ID NO: 8781083 - DNA, 22 bp, Homo sapiens
attttgaaaagcatttgagtaa

SEQ ID NO: 8781084 - DNA, 22 bp, Homo sapiens
attttgaaaccaagttatttcc

SEQ ID NO: 8781085 - DNA, 22 bp, Homo sapiens
attttgaaaagcatttgagtaa

SEQ ID NO: 8781086 - DNA, 22 bp, Homo sapiens
attttgaaaccaagttatttcc

SEQ ID NO: 8781087 - DNA, 22 bp, Homo sapiens
attttgaaaccaagttatttcc

SEQ ID NO: 8781088 - DNA, 22 bp, Homo sapiens
attttgaaaccaagttatttcc

SEQ ID NO: 8781089 - DNA, 22 bp, Homo sapiens
attttgaaaccaagttatttcc

SEQ ID NO: 8781090 - DNA, 22 bp, Homo sapiens
attttctgtgtgcagataaata

SEQ ID NO: 8781091 - DNA, 22 bp, Homo sapiens
attttctgtgtgcagataaata

SEQ ID NO: 8781092 - DNA, 22 bp, Homo sapiens
attttcttctctccctggctgc

SEQ ID NO: 8781093 - DNA, 22 bp, Homo sapiens
attttcttctctccctggctgc

SEQ ID NO: 8781094 - DNA, 22 bp, Homo sapiens
gcctggctcctaaggactggct

SEQ ID NO: 8781095 - DNA, 21 bp, Homo sapiens
gcctggctctcactggcctgg

SEQ ID NO: 8781096 - DNA, 22 bp, Homo sapiens
gcctggctcgggcactcgccag

SEQ ID NO: 8781097 - DNA, 21 bp, Homo sapiens
gcctggctctcactggcctgg

SEQ ID NO: 8781098 - DNA, 22 bp, Homo sapiens
gcctggctcctaagagcacaac

SEQ ID NO: 8781099 - DNA, 22 bp, Homo sapiens
gcctggctcctaagagcacaac

SEQ ID NO: 8781100 - DNA, 22 bp, Homo sapiens
gcctggctcctaaggactggct

SEQ ID NO: 8781101 - DNA, 22 bp, Homo sapiens
gcctggctctgagggagctcct

SEQ ID NO: 8781102 - DNA, 22 bp, Homo sapiens
gcctggctctgagtttctctcc

SEQ ID NO: 8781103 - DNA, 22 bp, Homo sapiens
gcgcaggagccgcggagggccg

SEQ ID NO: 8781104 - DNA, 22 bp, Homo sapiens
gcgcaggagccgcggagggccg

SEQ ID NO: 8781105 - DNA, 22 bp, Homo sapiens
gcgcaggcccgggtcagggccg

SEQ ID NO: 8781106 - DNA, 22 bp, Homo sapiens
gcgcaggcccgggtcagggccg

SEQ ID NO: 8781107 - DNA, 22 bp, Homo sapiens
gcgcaggcccgggtcagggccg

SEQ ID NO: 8781108 - DNA, 23 bp, Homo sapiens
gctaaattgaagtctcaggggaa

SEQ ID NO: 8781109 - DNA, 22 bp, Homo sapiens
gctaaatttaagcctttctcct

SEQ ID NO: 8781110 - DNA, 22 bp, Homo sapiens
gctaaggcacaaatagctttgc

SEQ ID NO: 8781111 - DNA, 15 bp, Homo sapiens
gctaaggcattggta

SEQ ID NO: 8781112 - DNA, 22 bp, Homo sapiens
gctaagggataggctgcctcct

SEQ ID NO: 8781113 - DNA, 22 bp, Homo sapiens
gctaagggaccctttctaatgt

SEQ ID NO: 8781114 - DNA, 22 bp, Homo sapiens
gctaaggccttaactcatggag

SEQ ID NO: 8781115 - DNA, 22 bp, Homo sapiens
gctaaggctcaggttctaagga

SEQ ID NO: 8781116 - DNA, 22 bp, Homo sapiens
gcgtgggtccaagaatctgtga

SEQ ID NO: 8781117 - DNA, 22 bp, Homo sapiens
gcgtgtatgcaggtctgtgcag

SEQ ID NO: 8781118 - DNA, 22 bp, Homo sapiens
gcgtgtgtgatatgcctctgca

SEQ ID NO: 8781119 - DNA, 22 bp, Homo sapiens
gcgttggggaccccgaagctgg

SEQ ID NO: 8781120 - DNA, 22 bp, Homo sapiens
gctacaaagtggtaggaggtca

SEQ ID NO: 8781121 - DNA, 22 bp, Homo sapiens
gctacacaatagcgttcactta

SEQ ID NO: 8781122 - DNA, 22 bp, Homo sapiens
gctacacaaaaggagagtgagt

SEQ ID NO: 8781123 - DNA, 22 bp, Homo sapiens
gctaagtaaatcgtgggaggtt

SEQ ID NO: 8781124 - DNA, 22 bp, Homo sapiens
gctaagggaggcatgccgtggt

SEQ ID NO: 8781125 - DNA, 22 bp, Homo sapiens
gctaatcaatgttaaggctgtg

SEQ ID NO: 8781126 - DNA, 22 bp, Homo sapiens
gctaatgactgagtttttagca

SEQ ID NO: 8781127 - DNA, 22 bp, Homo sapiens
gctaatgaggtaatgaatacgt

SEQ ID NO: 8781128 - DNA, 22 bp, Homo sapiens
gctaatgaaaaatagattatag

SEQ ID NO: 8781129 - DNA, 22 bp, Homo sapiens
gctatgttcccttttgctataa

SEQ ID NO: 8781130 - DNA, 22 bp, Homo sapiens
gctatgtgtgttttgctgcagc

SEQ ID NO: 8781131 - DNA, 22 bp, Homo sapiens
gctacagactgagcatggctct

SEQ ID NO: 8781132 - DNA, 22 bp, Homo sapiens
gctcaaaggttgatagctgtgc

SEQ ID NO: 8781133 - DNA, 22 bp, Homo sapiens
gctcaaaggttgatagctgtgc

SEQ ID NO: 8781134 - DNA, 22 bp, Homo sapiens
gctcaaaggccaggtagcagca

SEQ ID NO: 8781135 - DNA, 22 bp, Homo sapiens
gctcaaaggctatcaatagtgt

SEQ ID NO: 8781136 - DNA, 23 bp, Homo sapiens
gctcaggcatcattcttcctggc

SEQ ID NO: 8781137 - DNA, 22 bp, Homo sapiens
gctcagggctaaggctgagggg

SEQ ID NO: 8781138 - DNA, 22 bp, Homo sapiens
gctcagggctaaggctgagggg

SEQ ID NO: 8781139 - DNA, 22 bp, Homo sapiens
gctcaaagaccagacagaggag

SEQ ID NO: 8781140 - DNA, 22 bp, Homo sapiens
gctatttattaaaatggtgaag

SEQ ID NO: 8781141 - DNA, 23 bp, Homo sapiens
gctcaggtggctcagggactgat

SEQ ID NO: 8781142 - DNA, 18 bp, Homo sapiens
gctcaggtatagacaggg

SEQ ID NO: 8781143 - DNA, 22 bp, Homo sapiens
gctcagggctaaggctgagggg

SEQ ID NO: 8781144 - DNA, 22 bp, Homo sapiens
gctcaggggaatgggctgccgt

SEQ ID NO: 8781145 - DNA, 22 bp, Homo sapiens
gctcagggtcccttggtgctgg

SEQ ID NO: 8781146 - DNA, 22 bp, Homo sapiens
gctccaggccccagcgttccgc

SEQ ID NO: 8781147 - DNA, 22 bp, Homo sapiens
gctccaggcgagctggaccaga

SEQ ID NO: 8781148 - DNA, 22 bp, Homo sapiens
gctccaggcgagctggaccaga

SEQ ID NO: 8781149 - DNA, 22 bp, Homo sapiens
gctccaggcgagctggaccaga

SEQ ID NO: 8781150 - DNA, 22 bp, Homo sapiens
gctccaggcgagctggaccaga

SEQ ID NO: 8781151 - DNA, 17 bp, Homo sapiens
gctccaggcgtgagtga

SEQ ID NO: 8781152 - DNA, 22 bp, Homo sapiens
gctccaggccacggcttcttgg

SEQ ID NO: 8781153 - DNA, 22 bp, Homo sapiens
gctccaggcagcatagtggatg

SEQ ID NO: 8781154 - DNA, 22 bp, Homo sapiens
gctccaggcagcatagtggatg

SEQ ID NO: 8781155 - DNA, 22 bp, Homo sapiens
gctcctggatgttcaagtcggc

SEQ ID NO: 8781156 - DNA, 22 bp, Homo sapiens
gctcctggatgttcaagtcggc

SEQ ID NO: 8781157 - DNA, 22 bp, Homo sapiens
gctccaggctgctctgtcccat

SEQ ID NO: 8781158 - DNA, 22 bp, Homo sapiens
gctccaggctgctctgtcccat

SEQ ID NO: 8781159 - DNA, 22 bp, Homo sapiens
gctcggtggccagcctgaggcc

SEQ ID NO: 8781160 - DNA, 22 bp, Homo sapiens
gctcggtggccagcctgaggcc

SEQ ID NO: 8781161 - DNA, 22 bp, Homo sapiens
gctcggccccgacggccggcgg

SEQ ID NO: 8781162 - DNA, 22 bp, Homo sapiens
gctccttctggctcccttttgg

SEQ ID NO: 8781163 - DNA, 22 bp, Homo sapiens
gctcctggatgttcaagtcggc

SEQ ID NO: 8781164 - DNA, 22 bp, Homo sapiens
gctcgttgaacctgtccccgag

SEQ ID NO: 8781165 - DNA, 19 bp, Homo sapiens
gctctaaaagattttgaag

SEQ ID NO: 8781166 - DNA, 22 bp, Homo sapiens
gctctaaagagaatctatgcgg

SEQ ID NO: 8781167 - DNA, 20 bp, Homo sapiens
gctctaaagccacagattga

SEQ ID NO: 8781168 - DNA, 22 bp, Homo sapiens
gctctaactattaagaggtcat

SEQ ID NO: 8781169 - DNA, 21 bp, Homo sapiens
gctctaagctttgggaagaat

SEQ ID NO: 8781170 - DNA, 22 bp, Homo sapiens
gctctagacagaaagaccagtg

SEQ ID NO: 8781171 - DNA, 22 bp, Homo sapiens
gctctagaaagaaggatgtggg

SEQ ID NO: 8781172 - DNA, 22 bp, Homo sapiens
gctctagatcataggtcattat

SEQ ID NO: 8781173 - DNA, 22 bp, Homo sapiens
gctctagaaagaaggatgtggg

SEQ ID NO: 8781174 - DNA, 22 bp, Homo sapiens
gctctagtaggaatgtccctct

SEQ ID NO: 8781175 - DNA, 22 bp, Homo sapiens
caaattcaaatttcatcagtgt

SEQ ID NO: 8781176 - DNA, 22 bp, Homo sapiens
caaattcaaatttcatcagtgt

SEQ ID NO: 8781177 - DNA, 22 bp, Homo sapiens
caaattcacatgattgcttctg

SEQ ID NO: 8781178 - DNA, 22 bp, Homo sapiens
caaattcacatgattgcttctg

SEQ ID NO: 8781179 - DNA, 22 bp, Homo sapiens
caaattcacatgattgcttctg

SEQ ID NO: 8781180 - DNA, 22 bp, Homo sapiens
caaattcaatgaacatgtttaa

SEQ ID NO: 8781181 - DNA, 22 bp, Homo sapiens
caaattcaaatttcatcagtgt

SEQ ID NO: 8781182 - DNA, 22 bp, Homo sapiens
caaatgtgttttttcttctaca

SEQ ID NO: 8781183 - DNA, 22 bp, Homo sapiens
caaattaccctcaacatctaga

SEQ ID NO: 8781184 - DNA, 22 bp, Homo sapiens
caaatgaatagggagtgtgatg

SEQ ID NO: 8781185 - DNA, 22 bp, Homo sapiens
caaatgaatttccctgcaaatg

SEQ ID NO: 8781186 - DNA, 22 bp, Homo sapiens
caaatgtgtagagcttttgggg

SEQ ID NO: 8781187 - DNA, 22 bp, Homo sapiens
caaatgaatatttccatgggtt

SEQ ID NO: 8781188 - DNA, 22 bp, Homo sapiens
caaatgaagagggcaacttctg

SEQ ID NO: 8781189 - DNA, 22 bp, Homo sapiens
gctgaggaggtgtggttaggtg

SEQ ID NO: 8781190 - DNA, 22 bp, Homo sapiens
gctgaggagcgagaactctgct

SEQ ID NO: 8781191 - DNA, 22 bp, Homo sapiens
caaatgaaggtggtgggtcatt

SEQ ID NO: 8781192 - DNA, 22 bp, Homo sapiens
caaatgaagggagctgaagtct

SEQ ID NO: 8781193 - DNA, 22 bp, Homo sapiens
caaatgaatagggagtgtgatg

SEQ ID NO: 8781194 - DNA, 22 bp, Homo sapiens
gctgagctgaggcagggctggg

SEQ ID NO: 8781195 - DNA, 22 bp, Homo sapiens
gctgagctgaggcagggctggg

SEQ ID NO: 8781196 - DNA, 22 bp, Homo sapiens
gctgagaacagagctctgagct

SEQ ID NO: 8781197 - DNA, 22 bp, Homo sapiens
gctgagctgggacagtcctggg

SEQ ID NO: 8781198 - DNA, 22 bp, Homo sapiens
gctgagctgggacagtcctggg

SEQ ID NO: 8781199 - DNA, 22 bp, Homo sapiens
gctgagctgggacagtcctggg

SEQ ID NO: 8781200 - DNA, 22 bp, Homo sapiens
gctgagctgaggcagggctggg

SEQ ID NO: 8781201 - DNA, 22 bp, Homo sapiens
gctctggtggtgatcagacgct

SEQ ID NO: 8781202 - DNA, 22 bp, Homo sapiens
gctctggtagatcctcaggctc

SEQ ID NO: 8781203 - DNA, 22 bp, Homo sapiens
gctctggtagatcctcaggctc

SEQ ID NO: 8781204 - DNA, 22 bp, Homo sapiens
gctctgggttctgatttatgag

SEQ ID NO: 8781205 - DNA, 22 bp, Homo sapiens
gctgaggacatcatggaaggaa

SEQ ID NO: 8781206 - DNA, 22 bp, Homo sapiens
gctgaggacatcatggaaggaa

SEQ ID NO: 8781207 - DNA, 22 bp, Homo sapiens
gctgaggacatcatggaaggaa

SEQ ID NO: 8781208 - DNA, 22 bp, Homo sapiens
gctgaggacatcatggaaggaa

SEQ ID NO: 8781209 - DNA, 20 bp, Homo sapiens
gctgaggagcagtgtggttg

SEQ ID NO: 8781210 - DNA, 22 bp, Homo sapiens
gctgaggacatacacattgtgc

SEQ ID NO: 8781211 - DNA, 22 bp, Homo sapiens
gctgaggacatacacattgtgc

SEQ ID NO: 8781212 - DNA, 22 bp, Homo sapiens
gctgaggaagtcaggtggccca

SEQ ID NO: 8781213 - DNA, 22 bp, Homo sapiens
gctgaggaaaggctggaaggga

SEQ ID NO: 8781214 - DNA, 22 bp, Homo sapiens
gctgaggaaaggctggaaggga

SEQ ID NO: 8781215 - DNA, 22 bp, Homo sapiens
gctgaggaaaggctggaaggga

SEQ ID NO: 8781216 - DNA, 22 bp, Homo sapiens
gctgaggaagtcaggtggccca

SEQ ID NO: 8781217 - DNA, 22 bp, Homo sapiens
gctgaggaaaggctggaaggga

SEQ ID NO: 8781218 - DNA, 22 bp, Homo sapiens
gctgaggaaggtttcttatcaa

SEQ ID NO: 8781219 - DNA, 22 bp, Homo sapiens
gctgaggaagtcaggtggccca

SEQ ID NO: 8781220 - DNA, 22 bp, Homo sapiens
gctgagctgggacagtcctggg

SEQ ID NO: 8781221 - DNA, 22 bp, Homo sapiens
gctgagctgggacagtcctggg

SEQ ID NO: 8781222 - DNA, 22 bp, Homo sapiens
gctgaggaaaccaatgctcaga

SEQ ID NO: 8781223 - DNA, 19 bp, Homo sapiens
gctctgagaggggcatggg

SEQ ID NO: 8781224 - DNA, 19 bp, Homo sapiens
gctctgagaggggcatggg

SEQ ID NO: 8781225 - DNA, 19 bp, Homo sapiens
gctctgagaggggcatggg

SEQ ID NO: 8781226 - DNA, 22 bp, Homo sapiens
gctctgagaggatgctgagcag

SEQ ID NO: 8781227 - DNA, 22 bp, Homo sapiens
caaatagactctagaatttatt

SEQ ID NO: 8781228 - DNA, 22 bp, Homo sapiens
gctctgagagtgcatgatagca

SEQ ID NO: 8781229 - DNA, 22 bp, Homo sapiens
gctctgagaggtgcagcagtaa

SEQ ID NO: 8781230 - DNA, 22 bp, Homo sapiens
gctctgagaggtgcagcagtaa

SEQ ID NO: 8781231 - DNA, 22 bp, Homo sapiens
gctctgagaggtgcagcagtaa

SEQ ID NO: 8781232 - DNA, 22 bp, Homo sapiens
gctctgagagtgcatgatagca

SEQ ID NO: 8781233 - DNA, 22 bp, Homo sapiens
caaatattccaggtacatccct

SEQ ID NO: 8781234 - DNA, 20 bp, Homo sapiens
caaatcacaggtaattgcaa

SEQ ID NO: 8781235 - DNA, 22 bp, Homo sapiens
caaatattccaggtacatccct

SEQ ID NO: 8781236 - DNA, 22 bp, Homo sapiens
caaatcacaatgtgagactgag

SEQ ID NO: 8781237 - DNA, 20 bp, Homo sapiens
caaatcacaggtaattgcaa

SEQ ID NO: 8781238 - DNA, 22 bp, Homo sapiens
caaatcaccacttaatgggtta

SEQ ID NO: 8781239 - DNA, 22 bp, Homo sapiens
caaatattccaggtacatccct

SEQ ID NO: 8781240 - DNA, 22 bp, Homo sapiens
gctctgaagggtgagctgttcg

SEQ ID NO: 8781241 - DNA, 20 bp, Homo sapiens
gctctgaccatatcaagaca

SEQ ID NO: 8781242 - DNA, 22 bp, Homo sapiens
gctctgactgagcttcctgcct

SEQ ID NO: 8781243 - DNA, 22 bp, Homo sapiens
gctctgactggtgggccacagt

SEQ ID NO: 8781244 - DNA, 22 bp, Homo sapiens
gctctgagaaccaggaacacag

SEQ ID NO: 8781245 - DNA, 22 bp, Homo sapiens
gctctgagaggatgctgagcag

SEQ ID NO: 8781246 - DNA, 22 bp, Homo sapiens
gctctgagaggatgctgagcag

SEQ ID NO: 8781247 - DNA, 22 bp, Homo sapiens
gctctgagaggatgctgagcag

SEQ ID NO: 8781248 - DNA, 22 bp, Homo sapiens
gctctgagagctacacagggta

SEQ ID NO: 8781249 - DNA, 22 bp, Homo sapiens
gctctgagacagtagagatggc

SEQ ID NO: 8781250 - DNA, 22 bp, Homo sapiens
gctctgagagctacacagggta

SEQ ID NO: 8781251 - DNA, 22 bp, Homo sapiens
gctctgagacacaaagggtgca

SEQ ID NO: 8781252 - DNA, 22 bp, Homo sapiens
gctctgagacacaaagggtgca

SEQ ID NO: 8781253 - DNA, 22 bp, Homo sapiens
gctctgagagagcaaagtcacc

SEQ ID NO: 8781254 - DNA, 22 bp, Homo sapiens
gctctgagacagtagagatggc

SEQ ID NO: 8781255 - DNA, 22 bp, Homo sapiens
caaatcatggaataactagaga

SEQ ID NO: 8781256 - DNA, 22 bp, Homo sapiens
caaatcatggaataactagaga

SEQ ID NO: 8781257 - DNA, 22 bp, Homo sapiens
caaatcatggaataactagaga

SEQ ID NO: 8781258 - DNA, 22 bp, Homo sapiens
caaatcatggctctagcttaca

SEQ ID NO: 8781259 - DNA, 22 bp, Homo sapiens
caaatcatggctctagcttaca

SEQ ID NO: 8781260 - DNA, 22 bp, Homo sapiens
caaatccagatcccagtcgtag

SEQ ID NO: 8781261 - DNA, 20 bp, Homo sapiens
caaatccctgctctgtgctg

SEQ ID NO: 8781262 - DNA, 22 bp, Homo sapiens
caaatcctgcagggcttagatg

SEQ ID NO: 8781263 - DNA, 22 bp, Homo sapiens
caaatcctgcagggcttagatg

SEQ ID NO: 8781264 - DNA, 17 bp, Homo sapiens
caaatcctaggatgtct

SEQ ID NO: 8781265 - DNA, 22 bp, Homo sapiens
caaatcctcacctcatcatgaa

SEQ ID NO: 8781266 - DNA, 17 bp, Homo sapiens
caaatcctaggatgtct

SEQ ID NO: 8781267 - DNA, 22 bp, Homo sapiens
caaatctacatgaacccaaaga

SEQ ID NO: 8781268 - DNA, 22 bp, Homo sapiens
caaatcctggagccatggtaac

SEQ ID NO: 8781269 - DNA, 22 bp, Homo sapiens
gctctgggtgaacttggagcaa

SEQ ID NO: 8781270 - DNA, 15 bp, Homo sapiens
gctctgggtatttga

SEQ ID NO: 8781271 - DNA, 22 bp, Homo sapiens
gctctgggtgaacttggagcaa

SEQ ID NO: 8781272 - DNA, 22 bp, Homo sapiens
gctctgggtgaacttggagcaa

SEQ ID NO: 8781273 - DNA, 15 bp, Homo sapiens
gctctgggtatttga

SEQ ID NO: 8781274 - DNA, 22 bp, Homo sapiens
caaatctccttaaaggtaaaat

SEQ ID NO: 8781275 - DNA, 22 bp, Homo sapiens
gctctgggtgaatggcagattg

SEQ ID NO: 8781276 - DNA, 22 bp, Homo sapiens
gctctgggtgaatggcagattg

SEQ ID NO: 8781277 - DNA, 20 bp, Homo sapiens
gctctgggtggtaaatgact

SEQ ID NO: 8781278 - DNA, 22 bp, Homo sapiens
gctctgggttctgatttatgag

SEQ ID NO: 8781279 - DNA, 20 bp, Homo sapiens
gctctgggtggtaaatgact

SEQ ID NO: 8781280 - DNA, 22 bp, Homo sapiens
gctctgggtgaagggtaccatt

SEQ ID NO: 8781281 - DNA, 22 bp, Homo sapiens
gctctgggtgaagggtaccatt

SEQ ID NO: 8781282 - DNA, 22 bp, Homo sapiens
gctctgggtgaagggtaccatt

SEQ ID NO: 8781283 - DNA, 22 bp, Homo sapiens
gctctgggtgaagggtaccatt

SEQ ID NO: 8781284 - DNA, 22 bp, Homo sapiens
gctctgggtgaatggcagattg

SEQ ID NO: 8781285 - DNA, 22 bp, Homo sapiens
gctctgggtgaatggcagattg

SEQ ID NO: 8781286 - DNA, 22 bp, Homo sapiens
gctctgggtgaatggcagattg

SEQ ID NO: 8781287 - DNA, 22 bp, Homo sapiens
agtgtttattagatttcccttt

SEQ ID NO: 8781288 - DNA, 22 bp, Homo sapiens
agtgtttcaagaagcaggaagt

SEQ ID NO: 8781289 - DNA, 22 bp, Homo sapiens
agtgtttatggaatcttagtta

SEQ ID NO: 8781290 - DNA, 17 bp, Homo sapiens
agtgttctgggttgccc

SEQ ID NO: 8781291 - DNA, 22 bp, Homo sapiens
agtgtggcaggaatgactagaa

SEQ ID NO: 8781292 - DNA, 22 bp, Homo sapiens
agtgtggcaggaatgactagaa

SEQ ID NO: 8781293 - DNA, 22 bp, Homo sapiens
agtgtggccaatgaggatgggc

SEQ ID NO: 8781294 - DNA, 17 bp, Homo sapiens
agtgtggccctggttaa

SEQ ID NO: 8781295 - DNA, 17 bp, Homo sapiens
agtgtggccctggttaa

SEQ ID NO: 8781296 - DNA, 17 bp, Homo sapiens
agtgtggccctggttaa

SEQ ID NO: 8781297 - DNA, 22 bp, Homo sapiens
agtgtggctgcgtagggctctc

SEQ ID NO: 8781298 - DNA, 22 bp, Homo sapiens
agtgtggctgcgtagggctctc

SEQ ID NO: 8781299 - DNA, 22 bp, Homo sapiens
agtgtgggccacgcagctgagc

SEQ ID NO: 8781300 - DNA, 22 bp, Homo sapiens
agtgtgggccacgcagctgagc

SEQ ID NO: 8781301 - DNA, 22 bp, Homo sapiens
agtgtggattggctggagctat

SEQ ID NO: 8781302 - DNA, 22 bp, Homo sapiens
agtgtggagccactgagtggct

SEQ ID NO: 8781303 - DNA, 22 bp, Homo sapiens
agtgtggaccttcacacagaga

SEQ ID NO: 8781304 - DNA, 22 bp, Homo sapiens
agtgtgcttaagtttatcagga

SEQ ID NO: 8781305 - DNA, 22 bp, Homo sapiens
agtgtgctgtttccagaagggc

SEQ ID NO: 8781306 - DNA, 22 bp, Homo sapiens
agtgtgctctggttgccatgct

SEQ ID NO: 8781307 - DNA, 22 bp, Homo sapiens
agtgtgctcaattcaagtcttt

SEQ ID NO: 8781308 - DNA, 19 bp, Homo sapiens
agtgtgagtaattggagtt

SEQ ID NO: 8781309 - DNA, 22 bp, Homo sapiens
agtgtgagttacaaagtgtgaa

SEQ ID NO: 8781310 - DNA, 22 bp, Homo sapiens
agtgtgcattcctctcctcagg

SEQ ID NO: 8781311 - DNA, 22 bp, Homo sapiens
agtgtgctagcaagaactgggg

SEQ ID NO: 8781312 - DNA, 22 bp, Homo sapiens
agtgtgctattgcaccatcata

SEQ ID NO: 8781313 - DNA, 22 bp, Homo sapiens
agtgtgcccagtaattggctga

SEQ ID NO: 8781314 - DNA, 22 bp, Homo sapiens
agttaacacaagtaagattcca

SEQ ID NO: 8781315 - DNA, 22 bp, Homo sapiens
agttaaatgtgttagccagggt

SEQ ID NO: 8781316 - DNA, 22 bp, Homo sapiens
agttaacaagttggcaatcaac

SEQ ID NO: 8781317 - DNA, 22 bp, Homo sapiens
agttaacacaagtaagattcca

SEQ ID NO: 8781318 - DNA, 22 bp, Homo sapiens
agttaaatcattactgacagag

SEQ ID NO: 8781319 - DNA, 22 bp, Homo sapiens
agttaaacttgcctttattcct

SEQ ID NO: 8781320 - DNA, 22 bp, Homo sapiens
agtgtttttcaggagcagaaca

SEQ ID NO: 8781321 - DNA, 22 bp, Homo sapiens
agtgttttatttcagcactttg

SEQ ID NO: 8781322 - DNA, 22 bp, Homo sapiens
agtgtttgcatctcattgattt

SEQ ID NO: 8781323 - DNA, 22 bp, Homo sapiens
agtgttttattagaacacagcc

SEQ ID NO: 8781324 - DNA, 22 bp, Homo sapiens
agtgttttattagaacacagcc

SEQ ID NO: 8781325 - DNA, 22 bp, Homo sapiens
agtgttttattagaacacagcc

SEQ ID NO: 8781326 - DNA, 22 bp, Homo sapiens
agtgttttatttcagcactttg

SEQ ID NO: 8781327 - DNA, 17 bp, Homo sapiens
agtgtttccttatcatt

SEQ ID NO: 8781328 - DNA, 17 bp, Homo sapiens
agtgtttccttatcatt

SEQ ID NO: 8781329 - DNA, 22 bp, Homo sapiens
agtgtttcctgagtgttatcat

SEQ ID NO: 8781330 - DNA, 22 bp, Homo sapiens
agtgtttcccagtaggatgaaa

SEQ ID NO: 8781331 - DNA, 22 bp, Homo sapiens
agtgtttcaccgtatgttctca

SEQ ID NO: 8781332 - DNA, 22 bp, Homo sapiens
agtgtttcaagtgatgctttgg

SEQ ID NO: 8781333 - DNA, 22 bp, Homo sapiens
agtgtttcacagcactttttct

SEQ ID NO: 8781334 - DNA, 22 bp, Homo sapiens
agtgtttcaccgtatgttctca

SEQ ID NO: 8781335 - DNA, 19 bp, Homo sapiens
agtgtttcatgtgctttta

SEQ ID NO: 8781336 - DNA, 22 bp, Homo sapiens
agtgtttctggaatcagtgttt

SEQ ID NO: 8781337 - DNA, 22 bp, Homo sapiens
agtgtttctgtgccccagtgtt

SEQ ID NO: 8781338 - DNA, 22 bp, Homo sapiens
agtgtttctgtgccccagtgtt

SEQ ID NO: 8781339 - DNA, 22 bp, Homo sapiens
agtgtttctggcaaatgaaagt

SEQ ID NO: 8781340 - DNA, 22 bp, Homo sapiens
agtgtttggggtgattgtaacc

SEQ ID NO: 8781341 - DNA, 22 bp, Homo sapiens
agtgtttgggggccttgtaaca

SEQ ID NO: 8781342 - DNA, 22 bp, Homo sapiens
agtgtttgggggccttgtaaca

SEQ ID NO: 8781343 - DNA, 22 bp, Homo sapiens
agtgtttgcatctcattgattt

SEQ ID NO: 8781344 - DNA, 22 bp, Homo sapiens
ctgagctgctcccgctgcagcg

SEQ ID NO: 8781345 - DNA, 22 bp, Homo sapiens
ctgagctgctttgcttttgggg

SEQ ID NO: 8781346 - DNA, 22 bp, Homo sapiens
agttatttcagtaacataatag

SEQ ID NO: 8781347 - DNA, 22 bp, Homo sapiens
agttatttcagtaacataatag

SEQ ID NO: 8781348 - DNA, 22 bp, Homo sapiens
agttatttcagtaacataatag

SEQ ID NO: 8781349 - DNA, 22 bp, Homo sapiens
ctgagctgcagtcctggctctg

SEQ ID NO: 8781350 - DNA, 22 bp, Homo sapiens
ctgagctgcggcaggcacctgg

SEQ ID NO: 8781351 - DNA, 22 bp, Homo sapiens
ctgagctgcggcaggcacctgg

SEQ ID NO: 8781352 - DNA, 22 bp, Homo sapiens
ctgagctgctcccgctgcagcg

SEQ ID NO: 8781353 - DNA, 22 bp, Homo sapiens
ctgagctgcagtcctggctctg

SEQ ID NO: 8781354 - DNA, 22 bp, Homo sapiens
ctgagctgagccaaatctgtct

SEQ ID NO: 8781355 - DNA, 20 bp, Homo sapiens
ctgagctgagctccatgggt

SEQ ID NO: 8781356 - DNA, 22 bp, Homo sapiens
agttcatattgaaagcaggtga

SEQ ID NO: 8781357 - DNA, 22 bp, Homo sapiens
agttcatcttacttagagtaca

SEQ ID NO: 8781358 - DNA, 22 bp, Homo sapiens
agttccaaagcctgtattctta

SEQ ID NO: 8781359 - DNA, 22 bp, Homo sapiens
agttccaaagcctgtattctta

SEQ ID NO: 8781360 - DNA, 18 bp, Homo sapiens
agttccttaaattggtgt

SEQ ID NO: 8781361 - DNA, 22 bp, Homo sapiens
agttcccaggtgatgctgatgt

SEQ ID NO: 8781362 - DNA, 22 bp, Homo sapiens
agttccctccacaacttctcac

SEQ ID NO: 8781363 - DNA, 22 bp, Homo sapiens
agttcctatactgggtcagtcc

SEQ ID NO: 8781364 - DNA, 22 bp, Homo sapiens
agttccatgtctgggtttgtga

SEQ ID NO: 8781365 - DNA, 22 bp, Homo sapiens
agttccatccttccactgccct

SEQ ID NO: 8781366 - DNA, 22 bp, Homo sapiens
agttccagtgtgagagaacatg

SEQ ID NO: 8781367 - DNA, 22 bp, Homo sapiens
agttccagtgtgagagaacatg

SEQ ID NO: 8781368 - DNA, 22 bp, Homo sapiens
agttaacacatccagaatagag

SEQ ID NO: 8781369 - DNA, 22 bp, Homo sapiens
ctgagcagccccaccagccatt

SEQ ID NO: 8781370 - DNA, 22 bp, Homo sapiens
ctgagcagccccaccagccatt

SEQ ID NO: 8781371 - DNA, 22 bp, Homo sapiens
ctgagccactgcttgttcagtg

SEQ ID NO: 8781372 - DNA, 22 bp, Homo sapiens
ctgagccactgcttgttcagtg

SEQ ID NO: 8781373 - DNA, 22 bp, Homo sapiens
ctgagccagagggagtcgggtc

SEQ ID NO: 8781374 - DNA, 22 bp, Homo sapiens
ctgagccagagggagtcgggtc

SEQ ID NO: 8781375 - DNA, 22 bp, Homo sapiens
ctgagccagcgggctcactttt

SEQ ID NO: 8781376 - DNA, 22 bp, Homo sapiens
ctgagccaaggggacagtgaca

SEQ ID NO: 8781377 - DNA, 22 bp, Homo sapiens
ctgagccaccggcagggacatc

SEQ ID NO: 8781378 - DNA, 22 bp, Homo sapiens
ctgagccaccggcagggacatc

SEQ ID NO: 8781379 - DNA, 22 bp, Homo sapiens
ctgagccaccggcagggacatc

SEQ ID NO: 8781380 - DNA, 22 bp, Homo sapiens
ctgagccagctggcatgtgcta

SEQ ID NO: 8781381 - DNA, 22 bp, Homo sapiens
ctgagccagctggcatgtgcta

SEQ ID NO: 8781382 - DNA, 22 bp, Homo sapiens
ctgagccagctggcatgtgcta

SEQ ID NO: 8781383 - DNA, 22 bp, Homo sapiens
ctgagccagcgggctcactttt

SEQ ID NO: 8781384 - DNA, 22 bp, Homo sapiens
ctgagctcaagtgatctgccca

SEQ ID NO: 8781385 - DNA, 22 bp, Homo sapiens
ctgagctcagtcccagctctac

SEQ ID NO: 8781386 - DNA, 22 bp, Homo sapiens
ctgagctatgaactgcagccta

SEQ ID NO: 8781387 - DNA, 22 bp, Homo sapiens
ctgagctatggaggcaagacat

SEQ ID NO: 8781388 - DNA, 22 bp, Homo sapiens
ctgagccagggccacacatgga

SEQ ID NO: 8781389 - DNA, 22 bp, Homo sapiens
agtgtctttggctaagtgctgt

SEQ ID NO: 8781390 - DNA, 22 bp, Homo sapiens
agtgtctttgacacattcaaag

SEQ ID NO: 8781391 - DNA, 22 bp, Homo sapiens
agtgtctggtctctgaactaaa

SEQ ID NO: 8781392 - DNA, 22 bp, Homo sapiens
agtgtcctcctctgggagccag

SEQ ID NO: 8781393 - DNA, 22 bp, Homo sapiens
agtgtctgggctcccttggagc

SEQ ID NO: 8781394 - DNA, 20 bp, Homo sapiens
agtgtctgggcctcaggccc

SEQ ID NO: 8781395 - DNA, 22 bp, Homo sapiens
agtgtcccctccaagggcctgg

SEQ ID NO: 8781396 - DNA, 22 bp, Homo sapiens
agtgtcccctccaagggcctgg

SEQ ID NO: 8781397 - DNA, 21 bp, Homo sapiens
agtgtcatttgatcattgtta

SEQ ID NO: 8781398 - DNA, 22 bp, Homo sapiens
agtgtgagtaattcagggaggg

SEQ ID NO: 8781399 - DNA, 22 bp, Homo sapiens
agtgtgagtaattcagggaggg

SEQ ID NO: 8781400 - DNA, 22 bp, Homo sapiens
agtgtgagtaattcagggaggg

SEQ ID NO: 8781401 - DNA, 22 bp, Homo sapiens
agtgtgagctaatagcagagcc

SEQ ID NO: 8781402 - DNA, 22 bp, Homo sapiens
agtgtgagatgattgaggagca

SEQ ID NO: 8781403 - DNA, 22 bp, Homo sapiens
agtgtgagatgattgaggagca

SEQ ID NO: 8781404 - DNA, 22 bp, Homo sapiens
agtgtgacaaatctatggctca

SEQ ID NO: 8781405 - DNA, 22 bp, Homo sapiens
agtgtcacagacccaatcagga

SEQ ID NO: 8781406 - DNA, 22 bp, Homo sapiens
agtgtcacaaacctgccttgta

SEQ ID NO: 8781407 - DNA, 22 bp, Homo sapiens
agtgtcaattctcaaatctcgg

SEQ ID NO: 8781408 - DNA, 22 bp, Homo sapiens
agtgtcacagacccaatcagga

SEQ ID NO: 8781409 - DNA, 22 bp, Homo sapiens
agtgtcacagacccaatcagga

SEQ ID NO: 8781410 - DNA, 22 bp, Homo sapiens
agtgtcaatgccaacagtatat

SEQ ID NO: 8781411 - DNA, 22 bp, Homo sapiens
agtgtcaatgctctgttaaaaa

SEQ ID NO: 8781412 - DNA, 22 bp, Homo sapiens
agtgtcaaggttgagaaaccct

SEQ ID NO: 8781413 - DNA, 18 bp, Homo sapiens
agtgtcagctgcagctca

SEQ ID NO: 8781414 - DNA, 22 bp, Homo sapiens
agtgtcagcctgggcaaggaac

SEQ ID NO: 8781415 - DNA, 22 bp, Homo sapiens
agtgtcatatgccactgcatcc

SEQ ID NO: 8781416 - DNA, 21 bp, Homo sapiens
agtgtcattcccaagctgtga

SEQ ID NO: 8781417 - DNA, 19 bp, Homo sapiens
agtgtatttttttctgtag

SEQ ID NO: 8781418 - DNA, 22 bp, Homo sapiens
agtgtcaaatgtgtgccaagct

SEQ ID NO: 8781419 - DNA, 22 bp, Homo sapiens
agtgtcaactgtctacagggag

SEQ ID NO: 8781420 - DNA, 22 bp, Homo sapiens
agtgtcaaattaaataatctgg

SEQ ID NO: 8781421 - DNA, 20 bp, Homo sapiens
agtgtatttgggtagagtgt

SEQ ID NO: 8781422 - DNA, 22 bp, Homo sapiens
agtgtatttgagcatctcctta

SEQ ID NO: 8781423 - DNA, 22 bp, Homo sapiens
agtgtattgctttcatcatttt

SEQ ID NO: 8781424 - DNA, 22 bp, Homo sapiens
agtgtattgtctcacagttctt

SEQ ID NO: 8781425 - DNA, 22 bp, Homo sapiens
ctctggatatgcactgggtgag

SEQ ID NO: 8781426 - DNA, 22 bp, Homo sapiens
agtgtattcagaatgtagcaaa

SEQ ID NO: 8781427 - DNA, 22 bp, Homo sapiens
agtggtccttaagctgctgggt

SEQ ID NO: 8781428 - DNA, 22 bp, Homo sapiens
agtggtcctcagcctcggctca

SEQ ID NO: 8781429 - DNA, 22 bp, Homo sapiens
agtgggtggcgcagaggaggaa

SEQ ID NO: 8781430 - DNA, 22 bp, Homo sapiens
agtgggtgcaaccatggctagg

SEQ ID NO: 8781431 - DNA, 22 bp, Homo sapiens
agtgggtggcgcagaggaggaa

SEQ ID NO: 8781432 - DNA, 22 bp, Homo sapiens
agtgggtggcgcagaggaggaa

SEQ ID NO: 8781433 - DNA, 22 bp, Homo sapiens
agtgggtggcgcagaggaggaa

SEQ ID NO: 8781434 - DNA, 20 bp, Homo sapiens
agtgggtgtaagttattgcc

SEQ ID NO: 8781435 - DNA, 22 bp, Homo sapiens
agtgggtgggtgtctgacagtt

SEQ ID NO: 8781436 - DNA, 22 bp, Homo sapiens
agtgggtgggtgtctgacagtt

SEQ ID NO: 8781437 - DNA, 22 bp, Homo sapiens
ctctggagttctcatgaggaac

SEQ ID NO: 8781438 - DNA, 22 bp, Homo sapiens
ctctggagttctcatgaggaac

SEQ ID NO: 8781439 - DNA, 22 bp, Homo sapiens
ctctggagttctcatgaggaac

SEQ ID NO: 8781440 - DNA, 21 bp, Homo sapiens
ctctggagtttgaaggctggg

SEQ ID NO: 8781441 - DNA, 20 bp, Homo sapiens
ctctggagttggggaacatt

SEQ ID NO: 8781442 - DNA, 22 bp, Homo sapiens
ctctggagtgtctggccagggt

SEQ ID NO: 8781443 - DNA, 22 bp, Homo sapiens
ctctggagtgtctggccagggt

SEQ ID NO: 8781444 - DNA, 22 bp, Homo sapiens
ctctggagtgtctggccagggt

SEQ ID NO: 8781445 - DNA, 22 bp, Homo sapiens
ctctggagtgtctggccagggt

SEQ ID NO: 8781446 - DNA, 22 bp, Homo sapiens
ctctggagttcccttgatctga

SEQ ID NO: 8781447 - DNA, 22 bp, Homo sapiens
agtgggtgataagaccaaggag

SEQ ID NO: 8781448 - DNA, 22 bp, Homo sapiens
agtgggtgagcttggtctagat

SEQ ID NO: 8781449 - DNA, 22 bp, Homo sapiens
agtggctctccaagaagtcaca

SEQ ID NO: 8781450 - DNA, 22 bp, Homo sapiens
agtggggagtttccagatgtgt

SEQ ID NO: 8781451 - DNA, 22 bp, Homo sapiens
agtggctgaagcatcaaaggca

SEQ ID NO: 8781452 - DNA, 22 bp, Homo sapiens
agtggctgaagcatcaaaggca

SEQ ID NO: 8781453 - DNA, 20 bp, Homo sapiens
agtggggagtcaggagtgcc

SEQ ID NO: 8781454 - DNA, 22 bp, Homo sapiens
agtggcccttagtggcaaagtc

SEQ ID NO: 8781455 - DNA, 22 bp, Homo sapiens
agtggcctggagccccgcctgg

SEQ ID NO: 8781456 - DNA, 22 bp, Homo sapiens
agtggcctggagccccgcctgg

SEQ ID NO: 8781457 - DNA, 22 bp, Homo sapiens
agtggcccctagggaacagcct

SEQ ID NO: 8781458 - DNA, 22 bp, Homo sapiens
agtggccccacagtagggctta

SEQ ID NO: 8781459 - DNA, 22 bp, Homo sapiens
agtggccatggcaggtgagcat

SEQ ID NO: 8781460 - DNA, 22 bp, Homo sapiens
agtggccatccctcaggtaggc

SEQ ID NO: 8781461 - DNA, 22 bp, Homo sapiens
agtgatcagcttgaagtagttt

SEQ ID NO: 8781462 - DNA, 22 bp, Homo sapiens
agtgatcagctagatctacttg

SEQ ID NO: 8781463 - DNA, 22 bp, Homo sapiens
agtgatcaatgcttgtcattgt

SEQ ID NO: 8781464 - DNA, 22 bp, Homo sapiens
agtgatcagtgagtgaagcagg

SEQ ID NO: 8781465 - DNA, 22 bp, Homo sapiens
agtgataggacatatggatttt

SEQ ID NO: 8781466 - DNA, 22 bp, Homo sapiens
agtgataatgtggtaattattt

SEQ ID NO: 8781467 - DNA, 22 bp, Homo sapiens
agtgatagcaaataaaatgtaa

SEQ ID NO: 8781468 - DNA, 20 bp, Homo sapiens
agtgagttatcagctacagt

SEQ ID NO: 8781469 - DNA, 22 bp, Homo sapiens
agtgatggggccctgcactgat

SEQ ID NO: 8781470 - DNA, 22 bp, Homo sapiens
agtgatggcatcgggtccagca

SEQ ID NO: 8781471 - DNA, 22 bp, Homo sapiens
agtgatggagcttcctctgcta

SEQ ID NO: 8781472 - DNA, 22 bp, Homo sapiens
agtgatggtttccagtcactga

SEQ ID NO: 8781473 - DNA, 22 bp, Homo sapiens
agtgatggtttccagtcactga

SEQ ID NO: 8781474 - DNA, 22 bp, Homo sapiens
agtgatgtaggtggattctggc

SEQ ID NO: 8781475 - DNA, 22 bp, Homo sapiens
agtgaggggattcaggcaaggt

SEQ ID NO: 8781476 - DNA, 22 bp, Homo sapiens
agtgaggggattcaggcaaggt

SEQ ID NO: 8781477 - DNA, 22 bp, Homo sapiens
agtgaggggcagctgagtgggc

SEQ ID NO: 8781478 - DNA, 22 bp, Homo sapiens
agtgagggactccatgactcct

SEQ ID NO: 8781479 - DNA, 22 bp, Homo sapiens
agtgaggggattcaggcaaggt

SEQ ID NO: 8781480 - DNA, 22 bp, Homo sapiens
agtgagggactagtgctgggga

SEQ ID NO: 8781481 - DNA, 22 bp, Homo sapiens
agtgagggactagtgctgggga

SEQ ID NO: 8781482 - DNA, 22 bp, Homo sapiens
agtgaggggcagctgagtgggc

SEQ ID NO: 8781483 - DNA, 22 bp, Homo sapiens
agtgaggggcagctgagtgggc

SEQ ID NO: 8781484 - DNA, 22 bp, Homo sapiens
agtgagtcaaaaaacttagata

SEQ ID NO: 8781485 - DNA, 22 bp, Homo sapiens
agtgacttctcctaatgtcata

SEQ ID NO: 8781486 - DNA, 22 bp, Homo sapiens
agtgacttaattcattatattt

SEQ ID NO: 8781487 - DNA, 22 bp, Homo sapiens
agtgagggactagtgctgggga

SEQ ID NO: 8781488 - DNA, 19 bp, Homo sapiens
agtgagaacatgtgcacac

SEQ ID NO: 8781489 - DNA, 19 bp, Homo sapiens
agtgagaacatgtgcacac

SEQ ID NO: 8781490 - DNA, 22 bp, Homo sapiens
agtgaaatgattctgagcaaga

SEQ ID NO: 8781491 - DNA, 22 bp, Homo sapiens
agtgaaaacactagttcttgcc

SEQ ID NO: 8781492 - DNA, 22 bp, Homo sapiens
agtgaaaacctaatcatgcagt

SEQ ID NO: 8781493 - DNA, 22 bp, Homo sapiens
agtgaaaacctaatcatgcagt

SEQ ID NO: 8781494 - DNA, 22 bp, Homo sapiens
agtgaaaacctaatcatgcagt

SEQ ID NO: 8781495 - DNA, 22 bp, Homo sapiens
agtgaaaagatgcatttctctg

SEQ ID NO: 8781496 - DNA, 22 bp, Homo sapiens
agtgaaacagagcacagcatgc

SEQ ID NO: 8781497 - DNA, 22 bp, Homo sapiens
agtgaaacagagcacagcatgc

SEQ ID NO: 8781498 - DNA, 22 bp, Homo sapiens
agtgaaaggttgagaatattct

SEQ ID NO: 8781499 - DNA, 22 bp, Homo sapiens
agtgaaaggttgagaatattct

SEQ ID NO: 8781500 - DNA, 22 bp, Homo sapiens
agtctttgaagttctgacagag

SEQ ID NO: 8781501 - DNA, 21 bp, Homo sapiens
agtctttgataaagacaaagt

SEQ ID NO: 8781502 - DNA, 22 bp, Homo sapiens
agtctttatacagaaatatatg

SEQ ID NO: 8781503 - DNA, 22 bp, Homo sapiens
agtctttatacagaaatatatg

SEQ ID NO: 8781504 - DNA, 18 bp, Homo sapiens
agtcttctgatccatttt

SEQ ID NO: 8781505 - DNA, 22 bp, Homo sapiens
ctcaccagacatggaacctgtc

SEQ ID NO: 8781506 - DNA, 22 bp, Homo sapiens
ctcaccacagagcctgtccagc

SEQ ID NO: 8781507 - DNA, 22 bp, Homo sapiens
ctcacattccacttgtgccaac

SEQ ID NO: 8781508 - DNA, 22 bp, Homo sapiens
ctcacattccacttgtgccaac

SEQ ID NO: 8781509 - DNA, 22 bp, Homo sapiens
ctcacattcacaggacagaagg

SEQ ID NO: 8781510 - DNA, 23 bp, Homo sapiens
ctcaccaagcgccgccgctgtgt

SEQ ID NO: 8781511 - DNA, 22 bp, Homo sapiens
ctcacagttggctcattaatga

SEQ ID NO: 8781512 - DNA, 22 bp, Homo sapiens
ctcacagtgtcaacattaacta

SEQ ID NO: 8781513 - DNA, 22 bp, Homo sapiens
ctcacagttggagaatttagat

SEQ ID NO: 8781514 - DNA, 22 bp, Homo sapiens
ctcacagtgtaatattgaaccc

SEQ ID NO: 8781515 - DNA, 22 bp, Homo sapiens
ctcacatgagatctgtacatcc

SEQ ID NO: 8781516 - DNA, 22 bp, Homo sapiens
ctcacatgagatctgtacatcc

SEQ ID NO: 8781517 - DNA, 22 bp, Homo sapiens
ctcacagtgatgtcttatgaca

SEQ ID NO: 8781518 - DNA, 22 bp, Homo sapiens
ctcacagtctctccctaatttt

SEQ ID NO: 8781519 - DNA, 20 bp, Homo sapiens
ctcacagtcaatgcagaggt

SEQ ID NO: 8781520 - DNA, 22 bp, Homo sapiens
agtctcacttcttgagctatgc

SEQ ID NO: 8781521 - DNA, 22 bp, Homo sapiens
agtctcagaaaatatgcttttt

SEQ ID NO: 8781522 - DNA, 22 bp, Homo sapiens
agtctcagaaaatatgcttttt

SEQ ID NO: 8781523 - DNA, 22 bp, Homo sapiens
agtctcaaagtcagtgtcatgg

SEQ ID NO: 8781524 - DNA, 22 bp, Homo sapiens
agtctatttttggttcttcggg

SEQ ID NO: 8781525 - DNA, 22 bp, Homo sapiens
agtctcaagggatgtctctata

SEQ ID NO: 8781526 - DNA, 22 bp, Homo sapiens
agtctatttccccttctcttga

SEQ ID NO: 8781527 - DNA, 22 bp, Homo sapiens
agtctattgcctaacagagagg

SEQ ID NO: 8781528 - DNA, 22 bp, Homo sapiens
agtctattttagctgcatatgt

SEQ ID NO: 8781529 - DNA, 22 bp, Homo sapiens
agtctagatgtgtactaggtta

SEQ ID NO: 8781530 - DNA, 22 bp, Homo sapiens
agtctagggtggggtccacagg

SEQ ID NO: 8781531 - DNA, 22 bp, Homo sapiens
agtctatattgtgaaagtaaaa

SEQ ID NO: 8781532 - DNA, 22 bp, Homo sapiens
agtctacaatcttaaatgaact

SEQ ID NO: 8781533 - DNA, 22 bp, Homo sapiens
agtctacagttccctcaggtcc

SEQ ID NO: 8781534 - DNA, 22 bp, Homo sapiens
agtcctgggtctggagaatgga

SEQ ID NO: 8781535 - DNA, 22 bp, Homo sapiens
agtctacaagaactccagtgca

SEQ ID NO: 8781536 - DNA, 22 bp, Homo sapiens
agtctagaatgtgcaccaagct

SEQ ID NO: 8781537 - DNA, 22 bp, Homo sapiens
agtctagaaacaaggtagagct

SEQ ID NO: 8781538 - DNA, 22 bp, Homo sapiens
agtctagaggatgggtccagat

SEQ ID NO: 8781539 - DNA, 22 bp, Homo sapiens
agtcctgggtctggagaatgga

SEQ ID NO: 8781540 - DNA, 22 bp, Homo sapiens
agtctagaggatgggtccagat

SEQ ID NO: 8781541 - DNA, 22 bp, Homo sapiens
agtctagatccccagtgctgtc

SEQ ID NO: 8781542 - DNA, 22 bp, Homo sapiens
agtctagatgatcctaggaata

SEQ ID NO: 8781543 - DNA, 22 bp, Homo sapiens
agtggcatcaactttatctgta

SEQ ID NO: 8781544 - DNA, 22 bp, Homo sapiens
agtggcatctaagttttagaaa

SEQ ID NO: 8781545 - DNA, 22 bp, Homo sapiens
agtggcatcaaatcaaggtttg

SEQ ID NO: 8781546 - DNA, 22 bp, Homo sapiens
agtggccaatatgtcatgctct

SEQ ID NO: 8781547 - DNA, 22 bp, Homo sapiens
agtggcagtggggcagggccct

SEQ ID NO: 8781548 - DNA, 22 bp, Homo sapiens
agtggcagtggggcagggccct

SEQ ID NO: 8781549 - DNA, 22 bp, Homo sapiens
agtggcagtttgggagctacag

SEQ ID NO: 8781550 - DNA, 22 bp, Homo sapiens
agtggcagtttgggagctacag

SEQ ID NO: 8781551 - DNA, 20 bp, Homo sapiens
agtggccactgcagagatgc

SEQ ID NO: 8781552 - DNA, 22 bp, Homo sapiens
agtggccactgacttggaaatc

SEQ ID NO: 8781553 - DNA, 22 bp, Homo sapiens
agtggagttgagttgatggatt

SEQ ID NO: 8781554 - DNA, 22 bp, Homo sapiens
agtggagtgagtggcagaagga

SEQ ID NO: 8781555 - DNA, 22 bp, Homo sapiens
agtggcaagagggtctattgtt

SEQ ID NO: 8781556 - DNA, 22 bp, Homo sapiens
agtggcaaaagcaggcttaggc

SEQ ID NO: 8781557 - DNA, 20 bp, Homo sapiens
agtggcagggaaatggaaag

SEQ ID NO: 8781558 - DNA, 22 bp, Homo sapiens
agtggcaattgacaacaaagga

SEQ ID NO: 8781559 - DNA, 22 bp, Homo sapiens
agtggaaagaaccctggactca

SEQ ID NO: 8781560 - DNA, 18 bp, Homo sapiens
agtggaaaacaaatacac

SEQ ID NO: 8781561 - DNA, 21 bp, Homo sapiens
agtggaacccttagggtcagg

SEQ ID NO: 8781562 - DNA, 22 bp, Homo sapiens
agtggaacactacattgttgtt

SEQ ID NO: 8781563 - DNA, 22 bp, Homo sapiens
agtggaaggtcaggggacagtg

SEQ ID NO: 8781564 - DNA, 22 bp, Homo sapiens
agtggaatgtagaaaaaagatg

SEQ ID NO: 8781565 - DNA, 22 bp, Homo sapiens
agtggaattgctgattgaaata

SEQ ID NO: 8781566 - DNA, 22 bp, Homo sapiens
agtggaattgctgattgaaata

SEQ ID NO: 8781567 - DNA, 22 bp, Homo sapiens
agtggacaaccatgctgagatt

SEQ ID NO: 8781568 - DNA, 22 bp, Homo sapiens
agtggaatttcatgaagatcca

SEQ ID NO: 8781569 - DNA, 22 bp, Homo sapiens
agtgcttttgtcattgaatctt

SEQ ID NO: 8781570 - DNA, 22 bp, Homo sapiens
agtgcttttgtcattgaatctt

SEQ ID NO: 8781571 - DNA, 18 bp, Homo sapiens
agtggaaaacaaatacac

SEQ ID NO: 8781572 - DNA, 22 bp, Homo sapiens
agtgcttttattatatacagga

SEQ ID NO: 8781573 - DNA, 22 bp, Homo sapiens
agtgcttttatatcattaatcc

SEQ ID NO: 8781574 - DNA, 22 bp, Homo sapiens
agtgctttgtagtttcattgtg

SEQ ID NO: 8781575 - DNA, 22 bp, Homo sapiens
agtgctgggtactgttcccatt

SEQ ID NO: 8781576 - DNA, 22 bp, Homo sapiens
agtgctttgtgctctcactgca

SEQ ID NO: 8781577 - DNA, 22 bp, Homo sapiens
agtggaggttacagctgtacat

SEQ ID NO: 8781578 - DNA, 22 bp, Homo sapiens
agtggaggttattgagttaagg

SEQ ID NO: 8781579 - DNA, 22 bp, Homo sapiens
agtggaggttacagctgtacat

SEQ ID NO: 8781580 - DNA, 22 bp, Homo sapiens
agtggaggcactaattggattt

SEQ ID NO: 8781581 - DNA, 22 bp, Homo sapiens
agtggacattctgcacttggag

SEQ ID NO: 8781582 - DNA, 22 bp, Homo sapiens
agtggaccagaagactgaagct

SEQ ID NO: 8781583 - DNA, 22 bp, Homo sapiens
agtggacccggaacagaggccc

SEQ ID NO: 8781584 - DNA, 22 bp, Homo sapiens
agtggagaatatgcagaaagcc

SEQ ID NO: 8781585 - DNA, 22 bp, Homo sapiens
agtggagaatatgcagaaagcc

SEQ ID NO: 8781586 - DNA, 18 bp, Homo sapiens
agtgccagctctgctttc

SEQ ID NO: 8781587 - DNA, 23 bp, Homo sapiens
agtgccagggagatcaggacgga

SEQ ID NO: 8781588 - DNA, 22 bp, Homo sapiens
agtgccaggagcaaggagctcc

SEQ ID NO: 8781589 - DNA, 20 bp, Homo sapiens
agtgccagggcaggtgagag

SEQ ID NO: 8781590 - DNA, 21 bp, Homo sapiens
agtgccagtaggtatggagga

SEQ ID NO: 8781591 - DNA, 22 bp, Homo sapiens
agtgccagttaataagaaatgg

SEQ ID NO: 8781592 - DNA, 22 bp, Homo sapiens
agtgccctgctggggcaggaga

SEQ ID NO: 8781593 - DNA, 22 bp, Homo sapiens
agtgccctcgtgcccagggcct

SEQ ID NO: 8781594 - DNA, 22 bp, Homo sapiens
agtgccccatgggtgcctgggg

SEQ ID NO: 8781595 - DNA, 22 bp, Homo sapiens
agtgccttacaagagtgagggg

SEQ ID NO: 8781596 - DNA, 22 bp, Homo sapiens
agtgcctctgcaggtccgagtt

SEQ ID NO: 8781597 - DNA, 22 bp, Homo sapiens
agtgcgtggtttacagctagtt

SEQ ID NO: 8781598 - DNA, 22 bp, Homo sapiens
agtgctaatgtgcaatatagag

SEQ ID NO: 8781599 - DNA, 22 bp, Homo sapiens
agtgctgggtactgttcccatt

SEQ ID NO: 8781600 - DNA, 22 bp, Homo sapiens
agtgcgtggacccctggctgct

SEQ ID NO: 8781601 - DNA, 22 bp, Homo sapiens
agtgcgcaaaaatagaagctgt

SEQ ID NO: 8781602 - DNA, 22 bp, Homo sapiens
agtgcattgcatctctgcttca

SEQ ID NO: 8781603 - DNA, 22 bp, Homo sapiens
agtgcatttggggtagtggaag

SEQ ID NO: 8781604 - DNA, 22 bp, Homo sapiens
agtgcattctgtcatcttggtt

SEQ ID NO: 8781605 - DNA, 22 bp, Homo sapiens
agtgcattctgtcatcttggtt

SEQ ID NO: 8781606 - DNA, 22 bp, Homo sapiens
agtgcattctggcagaacaggt

SEQ ID NO: 8781607 - DNA, 22 bp, Homo sapiens
agtgcattctctaattacaggt

SEQ ID NO: 8781608 - DNA, 22 bp, Homo sapiens
agtgcattctccatcatctagg

SEQ ID NO: 8781609 - DNA, 22 bp, Homo sapiens
agtgcattcagtattcataggc

SEQ ID NO: 8781610 - DNA, 22 bp, Homo sapiens
agtgcattcctggggaagaagc

SEQ ID NO: 8781611 - DNA, 22 bp, Homo sapiens
agtgcattatatgtttcaatgg

SEQ ID NO: 8781612 - DNA, 22 bp, Homo sapiens
agtgccaagagtgagccatgag

SEQ ID NO: 8781613 - DNA, 22 bp, Homo sapiens
agtgccaaggtattaatttata

SEQ ID NO: 8781614 - DNA, 22 bp, Homo sapiens
agtgcatttggggtagtggaag

SEQ ID NO: 8781615 - DNA, 19 bp, Homo sapiens
agtgcattttatgtttcaa

SEQ ID NO: 8781616 - DNA, 23 bp, Homo sapiens
agtgatgtcacccacagacaagg

SEQ ID NO: 8781617 - DNA, 22 bp, Homo sapiens
agtgatgtcacaaactatggtg

SEQ ID NO: 8781618 - DNA, 22 bp, Homo sapiens
agtgatgtgggagagtatagct

SEQ ID NO: 8781619 - DNA, 22 bp, Homo sapiens
agtgatgtcttttaaattacat

SEQ ID NO: 8781620 - DNA, 22 bp, Homo sapiens
agtgatttactaccatattggg

SEQ ID NO: 8781621 - DNA, 20 bp, Homo sapiens
agtgatttatctttttccac

SEQ ID NO: 8781622 - DNA, 22 bp, Homo sapiens
agtgattagaaagtacacttgg

SEQ ID NO: 8781623 - DNA, 22 bp, Homo sapiens
agtgattgtgtagaaccatccc

SEQ ID NO: 8781624 - DNA, 22 bp, Homo sapiens
agtgcagggggaaagggtgtct

SEQ ID NO: 8781625 - DNA, 22 bp, Homo sapiens
agtgcagggcctgcccagcagg

SEQ ID NO: 8781626 - DNA, 22 bp, Homo sapiens
agtgatttcctggcaccctaca

SEQ ID NO: 8781627 - DNA, 19 bp, Homo sapiens
agggtttcttgactttgct

SEQ ID NO: 8781628 - DNA, 22 bp, Homo sapiens
agggttaggtcacgctgcctgg

SEQ ID NO: 8781629 - DNA, 19 bp, Homo sapiens
agggttacccgctgccacc

SEQ ID NO: 8781630 - DNA, 22 bp, Homo sapiens
agggtgggctagactcttcccc

SEQ ID NO: 8781631 - DNA, 22 bp, Homo sapiens
agggttagtctttgcagctagg

SEQ ID NO: 8781632 - DNA, 20 bp, Homo sapiens
agggttcccttgttcagcag

SEQ ID NO: 8781633 - DNA, 22 bp, Homo sapiens
agggttctgccagtgtcttgag

SEQ ID NO: 8781634 - DNA, 22 bp, Homo sapiens
cctgaggttatccatctacctg

SEQ ID NO: 8781635 - DNA, 19 bp, Homo sapiens
cctgaggtggggtggaagg

SEQ ID NO: 8781636 - DNA, 22 bp, Homo sapiens
cctgagtaacatggtgagaacc

SEQ ID NO: 8781637 - DNA, 22 bp, Homo sapiens
cctgagtagctggaattaaagg

SEQ ID NO: 8781638 - DNA, 22 bp, Homo sapiens
cctgagtagctggaattaaagg

SEQ ID NO: 8781639 - DNA, 22 bp, Homo sapiens
agggtgggctagactcttcccc

SEQ ID NO: 8781640 - DNA, 22 bp, Homo sapiens
aggtaattttgtgttaatgatt

SEQ ID NO: 8781641 - DNA, 22 bp, Homo sapiens
aggtaatttctccaaacatgct

SEQ ID NO: 8781642 - DNA, 22 bp, Homo sapiens
aggtaattgtatgttccaagca

SEQ ID NO: 8781643 - DNA, 22 bp, Homo sapiens
aggtacagatgaaagtctagtt

SEQ ID NO: 8781644 - DNA, 22 bp, Homo sapiens
aggtacagatgaaagtctagtt

SEQ ID NO: 8781645 - DNA, 22 bp, Homo sapiens
aggtaaggtttggaggcagtgg

SEQ ID NO: 8781646 - DNA, 22 bp, Homo sapiens
aggtaatttctccaaacatgct

SEQ ID NO: 8781647 - DNA, 22 bp, Homo sapiens
aggtaatgcaactactttgcta

SEQ ID NO: 8781648 - DNA, 22 bp, Homo sapiens
aggtaatgcatataaagtgctt

SEQ ID NO: 8781649 - DNA, 22 bp, Homo sapiens
aggtacagcaatataagaggtc

SEQ ID NO: 8781650 - DNA, 22 bp, Homo sapiens
aggtcacacttggatcatagaa

SEQ ID NO: 8781651 - DNA, 22 bp, Homo sapiens
aggtcacacaactgtcagaggc

SEQ ID NO: 8781652 - DNA, 22 bp, Homo sapiens
aggtcacacttggatcatagaa

SEQ ID NO: 8781653 - DNA, 22 bp, Homo sapiens
aggtaagccttgcctgagaaaa

SEQ ID NO: 8781654 - DNA, 22 bp, Homo sapiens
aggtaacattgcctccatctga

SEQ ID NO: 8781655 - DNA, 22 bp, Homo sapiens
aggtaactggctaactgaacga

SEQ ID NO: 8781656 - DNA, 22 bp, Homo sapiens
aggtaactgtggctaggtaact

SEQ ID NO: 8781657 - DNA, 22 bp, Homo sapiens
aggtaaggaaattgaggcaatt

SEQ ID NO: 8781658 - DNA, 22 bp, Homo sapiens
aggtaaatgaatgtttagtctt

SEQ ID NO: 8781659 - DNA, 22 bp, Homo sapiens
aggtaaatgtcagagcctttaa

SEQ ID NO: 8781660 - DNA, 22 bp, Homo sapiens
aggtaaagacagtgaaagaggg

SEQ ID NO: 8781661 - DNA, 22 bp, Homo sapiens
aggtaacagcttcagcttcaga

SEQ ID NO: 8781662 - DNA, 22 bp, Homo sapiens
aggtaacactacttagtatact

SEQ ID NO: 8781663 - DNA, 22 bp, Homo sapiens
aggtaacactacttagtatact

SEQ ID NO: 8781664 - DNA, 22 bp, Homo sapiens
cctgggaggctgaggctgcagt

SEQ ID NO: 8781665 - DNA, 22 bp, Homo sapiens
cctgggaggctgtgggtctgct

SEQ ID NO: 8781666 - DNA, 22 bp, Homo sapiens
cctgggaggctgtttccagcct

SEQ ID NO: 8781667 - DNA, 22 bp, Homo sapiens
cctgggaggctgtgggtctgct

SEQ ID NO: 8781668 - DNA, 22 bp, Homo sapiens
cctgggagggcaagtgctgatg

SEQ ID NO: 8781669 - DNA, 22 bp, Homo sapiens
cctgggagggcaagtgctgatg

SEQ ID NO: 8781670 - DNA, 22 bp, Homo sapiens
cctgggaggtggaggttgcagc

SEQ ID NO: 8781671 - DNA, 22 bp, Homo sapiens
cctgggaggtggaggttgcagc

SEQ ID NO: 8781672 - DNA, 22 bp, Homo sapiens
cctgggaggtggaggttgcagt

SEQ ID NO: 8781673 - DNA, 22 bp, Homo sapiens
cctgggaggtggaggttgcagt

SEQ ID NO: 8781674 - DNA, 19 bp, Homo sapiens
aggtcagtggctcaggcat

SEQ ID NO: 8781675 - DNA, 22 bp, Homo sapiens
aggtcaggtatcagcaggtatt

SEQ ID NO: 8781676 - DNA, 22 bp, Homo sapiens
aggtcaggtatcagcaggtatt

SEQ ID NO: 8781677 - DNA, 22 bp, Homo sapiens
aggtcaggtatcagcaggtatt

SEQ ID NO: 8781678 - DNA, 22 bp, Homo sapiens
cctgggaggctgaggctgcagt

SEQ ID NO: 8781679 - DNA, 21 bp, Homo sapiens
cctgggagaattgggtgtggc

SEQ ID NO: 8781680 - DNA, 22 bp, Homo sapiens
cctgggaggctgaggctgcagt

SEQ ID NO: 8781681 - DNA, 22 bp, Homo sapiens
aggtcagacacagtgctgggtg

SEQ ID NO: 8781682 - DNA, 22 bp, Homo sapiens
aggtcagaaaaggagagcattg

SEQ ID NO: 8781683 - DNA, 22 bp, Homo sapiens
aggtcagaaaaggagagcattg

SEQ ID NO: 8781684 - DNA, 22 bp, Homo sapiens
aggtcacaggctttgaaatcaa

SEQ ID NO: 8781685 - DNA, 22 bp, Homo sapiens
aggtcacaggctttgaaatcaa

SEQ ID NO: 8781686 - DNA, 22 bp, Homo sapiens
aggtcacagctttctcgtgagg

SEQ ID NO: 8781687 - DNA, 22 bp, Homo sapiens
aggtcacacaactgtcagaggc

SEQ ID NO: 8781688 - DNA, 22 bp, Homo sapiens
aggtcacagggttgaagtactt

SEQ ID NO: 8781689 - DNA, 22 bp, Homo sapiens
aggtcaccatggcatgctccac

SEQ ID NO: 8781690 - DNA, 22 bp, Homo sapiens
aggtcaccatggcatgctccac

SEQ ID NO: 8781691 - DNA, 22 bp, Homo sapiens
aggtcacccgtttgactatcca

SEQ ID NO: 8781692 - DNA, 22 bp, Homo sapiens
aggtcaccatggcatgctccac

SEQ ID NO: 8781693 - DNA, 22 bp, Homo sapiens
aggtcagctgtgtgtgcatgag

SEQ ID NO: 8781694 - DNA, 22 bp, Homo sapiens
aggtcagctgtgtgtgcatgag

SEQ ID NO: 8781695 - DNA, 22 bp, Homo sapiens
aggtcagctgtgtgtgcatgag

SEQ ID NO: 8781696 - DNA, 18 bp, Homo sapiens
aggtcaggaaagcagagt

SEQ ID NO: 8781697 - DNA, 18 bp, Homo sapiens
aggtcaggaaagcagagt

SEQ ID NO: 8781698 - DNA, 22 bp, Homo sapiens
aggtcaggaggcctctgccatt

SEQ ID NO: 8781699 - DNA, 22 bp, Homo sapiens
aggtcaggaggttaagagtctt

SEQ ID NO: 8781700 - DNA, 22 bp, Homo sapiens
aggtcagcatgagtagaaggta

SEQ ID NO: 8781701 - DNA, 22 bp, Homo sapiens
aggtcagccctctctgggcagg

SEQ ID NO: 8781702 - DNA, 21 bp, Homo sapiens
aggtcagcccagctctggaag

SEQ ID NO: 8781703 - DNA, 22 bp, Homo sapiens
aggtcagcatgctcctctctgt

SEQ ID NO: 8781704 - DNA, 22 bp, Homo sapiens
cctgtgggccctggacagagac

SEQ ID NO: 8781705 - DNA, 22 bp, Homo sapiens
cctgtgggccctggacagagac

SEQ ID NO: 8781706 - DNA, 22 bp, Homo sapiens
cctgtgggccaaggacctgcca

SEQ ID NO: 8781707 - DNA, 22 bp, Homo sapiens
cctgtgggccaaggacctgcca

SEQ ID NO: 8781708 - DNA, 22 bp, Homo sapiens
cctgtgggcgcagctggagtca

SEQ ID NO: 8781709 - DNA, 22 bp, Homo sapiens
cctgtgggagcccaggcagata

SEQ ID NO: 8781710 - DNA, 22 bp, Homo sapiens
cctgtgggagggagcggctgga

SEQ ID NO: 8781711 - DNA, 22 bp, Homo sapiens
cctgtgggagggagcggctgga

SEQ ID NO: 8781712 - DNA, 22 bp, Homo sapiens
cctgtgggaggggcctggcgcg

SEQ ID NO: 8781713 - DNA, 22 bp, Homo sapiens
cctgtgggaggttctgtgagtc

SEQ ID NO: 8781714 - DNA, 22 bp, Homo sapiens
cctgtgggcttgagtgtagggt

SEQ ID NO: 8781715 - DNA, 22 bp, Homo sapiens
cctgtgggctgagaacaagggc

SEQ ID NO: 8781716 - DNA, 22 bp, Homo sapiens
cctgtggggccatctcagtcac

SEQ ID NO: 8781717 - DNA, 22 bp, Homo sapiens
cctgtgggtacaacagggtcac

SEQ ID NO: 8781718 - DNA, 22 bp, Homo sapiens
cctgtgggtcacatgggtgact

SEQ ID NO: 8781719 - DNA, 22 bp, Homo sapiens
cctgtgggtacaacagggtcac

SEQ ID NO: 8781720 - DNA, 22 bp, Homo sapiens
aggtggcagactaacagaagga

SEQ ID NO: 8781721 - DNA, 22 bp, Homo sapiens
aggtggcagactaacagaagga

SEQ ID NO: 8781722 - DNA, 22 bp, Homo sapiens
aggtggcagagctggcccagcg

SEQ ID NO: 8781723 - DNA, 22 bp, Homo sapiens
aggtggcagaggactcctcctg

SEQ ID NO: 8781724 - DNA, 22 bp, Homo sapiens
aggtggcagagtgacaggctga

SEQ ID NO: 8781725 - DNA, 22 bp, Homo sapiens
ccttccagaggcgtgacaccct

SEQ ID NO: 8781726 - DNA, 22 bp, Homo sapiens
ccttccagaaagcacttagtta

SEQ ID NO: 8781727 - DNA, 19 bp, Homo sapiens
ccttccagaactaaattaa

SEQ ID NO: 8781728 - DNA, 22 bp, Homo sapiens
ccttccagaaagcacttagtta

SEQ ID NO: 8781729 - DNA, 21 bp, Homo sapiens
ccttccaccttctgccatgtg

SEQ ID NO: 8781730 - DNA, 22 bp, Homo sapiens
ccttccagagttcagtctgccc

SEQ ID NO: 8781731 - DNA, 22 bp, Homo sapiens
ccttccagagttcagtctgccc

SEQ ID NO: 8781732 - DNA, 22 bp, Homo sapiens
ccttccagaggcgtgacaccct

SEQ ID NO: 8781733 - DNA, 22 bp, Homo sapiens
ccttccagagttcagtctgccc

SEQ ID NO: 8781734 - DNA, 22 bp, Homo sapiens
ccttccagaggcgtgacaccct

SEQ ID NO: 8781735 - DNA, 19 bp, Homo sapiens
ccttccagaactaaattaa

SEQ ID NO: 8781736 - DNA, 19 bp, Homo sapiens
ccttccagctccttttcag

SEQ ID NO: 8781737 - DNA, 22 bp, Homo sapiens
ccttccagccccatctcatcgt

SEQ ID NO: 8781738 - DNA, 22 bp, Homo sapiens
ccttccagatgtaagagctgat

SEQ ID NO: 8781739 - DNA, 19 bp, Homo sapiens
ccttccagctccttttcag

SEQ ID NO: 8781740 - DNA, 22 bp, Homo sapiens
ccttccagatgtaagagctgat

SEQ ID NO: 8781741 - DNA, 22 bp, Homo sapiens
ccttccagccccatctcatcgt

SEQ ID NO: 8781742 - DNA, 22 bp, Homo sapiens
ccttccagccccatctcatcgt

SEQ ID NO: 8781743 - DNA, 22 bp, Homo sapiens
ccttccagggagcaggcagtgt

SEQ ID NO: 8781744 - DNA, 22 bp, Homo sapiens
ccttccagggagcaggcagtgt

SEQ ID NO: 8781745 - DNA, 22 bp, Homo sapiens
ccttccaggctggaggcttggg

SEQ ID NO: 8781746 - DNA, 22 bp, Homo sapiens
ccttccaggagtctctgcaggt

SEQ ID NO: 8781747 - DNA, 22 bp, Homo sapiens
ccttccaggagtctctgcaggt

SEQ ID NO: 8781748 - DNA, 22 bp, Homo sapiens
ccttccaggagtctctgcaggt

SEQ ID NO: 8781749 - DNA, 22 bp, Homo sapiens
ccttccaggctggaggcttggg

SEQ ID NO: 8781750 - DNA, 22 bp, Homo sapiens
ccttccaggagtctctgcaggt

SEQ ID NO: 8781751 - DNA, 22 bp, Homo sapiens
aggtggcagcaggagatgtgga

SEQ ID NO: 8781752 - DNA, 22 bp, Homo sapiens
aggtggcagcagcctggtgaaa

SEQ ID NO: 8781753 - DNA, 22 bp, Homo sapiens
aggtggcagcagaatcagggag

SEQ ID NO: 8781754 - DNA, 22 bp, Homo sapiens
aggtggcagatgggggtgctcg

SEQ ID NO: 8781755 - DNA, 22 bp, Homo sapiens
aggtggcagcagaatcagggag

SEQ ID NO: 8781756 - DNA, 22 bp, Homo sapiens
aggtggcagatgggggtgctcg

SEQ ID NO: 8781757 - DNA, 22 bp, Homo sapiens
aggtggcagatgggggtgctcg

SEQ ID NO: 8781758 - DNA, 22 bp, Homo sapiens
cctgtttattgtgaagaaccca

SEQ ID NO: 8781759 - DNA, 22 bp, Homo sapiens
cctgtttggtacaatctgccaa

SEQ ID NO: 8781760 - DNA, 22 bp, Homo sapiens
cctgtttatccatgccaatcct

SEQ ID NO: 8781761 - DNA, 22 bp, Homo sapiens
ccttcattcagctatagcatcc

SEQ ID NO: 8781762 - DNA, 22 bp, Homo sapiens
ccttccaaaggagccacatctg

SEQ ID NO: 8781763 - DNA, 22 bp, Homo sapiens
cctgttgtttagcacttagaac

SEQ ID NO: 8781764 - DNA, 22 bp, Homo sapiens
cctgggtagactttgaagcatt

SEQ ID NO: 8781765 - DNA, 22 bp, Homo sapiens
cctgggtcaccaggcccaggca

SEQ ID NO: 8781766 - DNA, 22 bp, Homo sapiens
cctgggtagactttgaagcatt

SEQ ID NO: 8781767 - DNA, 22 bp, Homo sapiens
cctgggtcaccaggcccaggca

SEQ ID NO: 8781768 - DNA, 22 bp, Homo sapiens
cctgggtcactcaggcaggcgg

SEQ ID NO: 8781769 - DNA, 22 bp, Homo sapiens
cctgggtccaccctgtgaagta

SEQ ID NO: 8781770 - DNA, 22 bp, Homo sapiens
cctgggtccaccctgtgaagta

SEQ ID NO: 8781771 - DNA, 22 bp, Homo sapiens
cctgggtccaattctggcttgt

SEQ ID NO: 8781772 - DNA, 22 bp, Homo sapiens
cctgggtcactcaggcaggcgg

SEQ ID NO: 8781773 - DNA, 22 bp, Homo sapiens
cctgggtccaattctggcttgt

SEQ ID NO: 8781774 - DNA, 17 bp, Homo sapiens
aggtgcagaggcagagc

SEQ ID NO: 8781775 - DNA, 17 bp, Homo sapiens
aggtgcagaggcagagc

SEQ ID NO: 8781776 - DNA, 22 bp, Homo sapiens
aggtgcagcatgagtccaacgg

SEQ ID NO: 8781777 - DNA, 23 bp, Homo sapiens
aggtgcagccctggacctgcccc

SEQ ID NO: 8781778 - DNA, 22 bp, Homo sapiens
aggtgcagctgacaccatgtgg

SEQ ID NO: 8781779 - DNA, 22 bp, Homo sapiens
aggtgcagctggtggagtctgg

SEQ ID NO: 8781780 - DNA, 22 bp, Homo sapiens
aggtgcagctggtggagtctgg

SEQ ID NO: 8781781 - DNA, 22 bp, Homo sapiens
cctgtgccagccccttctgctg

SEQ ID NO: 8781782 - DNA, 22 bp, Homo sapiens
cctgtgggagcccaggcagata

SEQ ID NO: 8781783 - DNA, 22 bp, Homo sapiens
cctgtgccagctgggccctgcc

SEQ ID NO: 8781784 - DNA, 22 bp, Homo sapiens
cctgtgccagctgggccctgcc

SEQ ID NO: 8781785 - DNA, 22 bp, Homo sapiens
cctgtgccagctgggccctgcc

SEQ ID NO: 8781786 - DNA, 20 bp, Homo sapiens
cctggggtacactggcatgt

SEQ ID NO: 8781787 - DNA, 22 bp, Homo sapiens
cctggggctctgcacagagcag

SEQ ID NO: 8781788 - DNA, 22 bp, Homo sapiens
cctggggctctgcacagagcag

SEQ ID NO: 8781789 - DNA, 22 bp, Homo sapiens
cctggggctctgcacagagcag

SEQ ID NO: 8781790 - DNA, 22 bp, Homo sapiens
cctggggctctgcacagagcag

SEQ ID NO: 8781791 - DNA, 22 bp, Homo sapiens
cctggggctttctttgtatcat

SEQ ID NO: 8781792 - DNA, 22 bp, Homo sapiens
cctggggctctgcacagagcag

SEQ ID NO: 8781793 - DNA, 22 bp, Homo sapiens
cctgggctttgagggcaggatg

SEQ ID NO: 8781794 - DNA, 22 bp, Homo sapiens
cctgggctttgagggcaggatg

SEQ ID NO: 8781795 - DNA, 20 bp, Homo sapiens
aggtcctggttctctgggat

SEQ ID NO: 8781796 - DNA, 20 bp, Homo sapiens
aggtcctggttctctgggat

SEQ ID NO: 8781797 - DNA, 22 bp, Homo sapiens
cctgggctttgagggcaggatg

SEQ ID NO: 8781798 - DNA, 22 bp, Homo sapiens
cctggggctccagagcagcgga

SEQ ID NO: 8781799 - DNA, 22 bp, Homo sapiens
cctggggctctgcacagagcag

SEQ ID NO: 8781800 - DNA, 22 bp, Homo sapiens
cctggggctctgcacagagcag

SEQ ID NO: 8781801 - DNA, 22 bp, Homo sapiens
aggtcctggtgaccatggagtt

SEQ ID NO: 8781802 - DNA, 22 bp, Homo sapiens
aggtcctggtgaccatggagtt

SEQ ID NO: 8781803 - DNA, 20 bp, Homo sapiens
aggtcctggttctctgggat

SEQ ID NO: 8781804 - DNA, 22 bp, Homo sapiens
aggtcctggtgaccatggagtt

SEQ ID NO: 8781805 - DNA, 20 bp, Homo sapiens
aggtcctgggactggcagag

SEQ ID NO: 8781806 - DNA, 22 bp, Homo sapiens
aggtcctgggagttctagtgtg

SEQ ID NO: 8781807 - DNA, 20 bp, Homo sapiens
aggtcctgggactggcagag

SEQ ID NO: 8781808 - DNA, 22 bp, Homo sapiens
aggtcctgggagttctagtgtg

SEQ ID NO: 8781809 - DNA, 22 bp, Homo sapiens
aggtcctggtcttgagtcttaa

SEQ ID NO: 8781810 - DNA, 22 bp, Homo sapiens
aggtcctgggagttctagtgtg

SEQ ID NO: 8781811 - DNA, 22 bp, Homo sapiens
aggtcctggactgctcttgtta

SEQ ID NO: 8781812 - DNA, 22 bp, Homo sapiens
aggtcctggactgctcttgtta

SEQ ID NO: 8781813 - DNA, 23 bp, Homo sapiens
aggtcctggacatatgtgcatca

SEQ ID NO: 8781814 - DNA, 23 bp, Homo sapiens
aggtcctggacatatgtgcatca

SEQ ID NO: 8781815 - DNA, 23 bp, Homo sapiens
aggtcctggacatatgtgcatca

SEQ ID NO: 8781816 - DNA, 22 bp, Homo sapiens
aggtcctgatgatctctgagag

SEQ ID NO: 8781817 - DNA, 19 bp, Homo sapiens
aggtcctgatcagcaagga

SEQ ID NO: 8781818 - DNA, 19 bp, Homo sapiens
aggtcctgatcagcaagga

SEQ ID NO: 8781819 - DNA, 22 bp, Homo sapiens
ctattctgtgtatttactggct

SEQ ID NO: 8781820 - DNA, 22 bp, Homo sapiens
ctatgaccccagcatgaataag

SEQ ID NO: 8781821 - DNA, 22 bp, Homo sapiens
ctatgaccccagcatgaataag

SEQ ID NO: 8781822 - DNA, 22 bp, Homo sapiens
ctatctcagataacctgcacca

SEQ ID NO: 8781823 - DNA, 22 bp, Homo sapiens
ctatctcagataacctgcacca

SEQ ID NO: 8781824 - DNA, 22 bp, Homo sapiens
ctatcttttgttcattttgagt

SEQ ID NO: 8781825 - DNA, 22 bp, Homo sapiens
ctatctttcgattctagcttaa

SEQ ID NO: 8781826 - DNA, 22 bp, Homo sapiens
ctatctcatgcatcaactcttc

SEQ ID NO: 8781827 - DNA, 22 bp, Homo sapiens
ctatcttttgttcattttgagt

SEQ ID NO: 8781828 - DNA, 22 bp, Homo sapiens
ctatctgtaaatttgaggttct

SEQ ID NO: 8781829 - DNA, 22 bp, Homo sapiens
ctatttatctatttctgaatga

SEQ ID NO: 8781830 - DNA, 22 bp, Homo sapiens
ctatttatctatttctgaatga

SEQ ID NO: 8781831 - DNA, 22 bp, Homo sapiens
agtcctgggtctggagaatgga

SEQ ID NO: 8781832 - DNA, 22 bp, Homo sapiens
ctatttaagaataaaaggggca

SEQ ID NO: 8781833 - DNA, 21 bp, Homo sapiens
ctattggaaaagaaaatattt

SEQ ID NO: 8781834 - DNA, 22 bp, Homo sapiens
ctattgtttctatgctctgagg

SEQ ID NO: 8781835 - DNA, 19 bp, Homo sapiens
ctattgcacatagctgaag

SEQ ID NO: 8781836 - DNA, 19 bp, Homo sapiens
ctattgcacatagctgaag

SEQ ID NO: 8781837 - DNA, 22 bp, Homo sapiens
ctattgcatttgcatcttcatc

SEQ ID NO: 8781838 - DNA, 22 bp, Homo sapiens
ctattgcatttgcatcttcatc

SEQ ID NO: 8781839 - DNA, 21 bp, Homo sapiens
ctattggaaaagaaaatattt

SEQ ID NO: 8781840 - DNA, 22 bp, Homo sapiens
ctagtgaaatttgcaagtaatt

SEQ ID NO: 8781841 - DNA, 22 bp, Homo sapiens
ctatatctacatttgctgtttg

SEQ ID NO: 8781842 - DNA, 22 bp, Homo sapiens
ctatattctggaatgtccattt

SEQ ID NO: 8781843 - DNA, 22 bp, Homo sapiens
ctatatatatcatcttccagtt

SEQ ID NO: 8781844 - DNA, 22 bp, Homo sapiens
agtcaggatatgccttgtgggc

SEQ ID NO: 8781845 - DNA, 22 bp, Homo sapiens
ctatatttcttggctttaaaca

SEQ ID NO: 8781846 - DNA, 22 bp, Homo sapiens
ctatattggtaatatttgctca

SEQ ID NO: 8781847 - DNA, 22 bp, Homo sapiens
ctatatttcttggctttaaaca

SEQ ID NO: 8781848 - DNA, 22 bp, Homo sapiens
ctatatttggtgagggatgtct

SEQ ID NO: 8781849 - DNA, 22 bp, Homo sapiens
ctatcaaacagccattaatata

SEQ ID NO: 8781850 - DNA, 22 bp, Homo sapiens
agtcaggagctgctgcattgta

SEQ ID NO: 8781851 - DNA, 22 bp, Homo sapiens
agtcaggacacagcatgaacat

SEQ ID NO: 8781852 - DNA, 22 bp, Homo sapiens
agtcaggacacagcatgaacat

SEQ ID NO: 8781853 - DNA, 22 bp, Homo sapiens
agtcaggaacctcagcaagtct

SEQ ID NO: 8781854 - DNA, 22 bp, Homo sapiens
agtcaggaagctggagctgggg

SEQ ID NO: 8781855 - DNA, 22 bp, Homo sapiens
ctaggcagactgagctctaggg

SEQ ID NO: 8781856 - DNA, 22 bp, Homo sapiens
agtcagcagtgaaagcacagcc

SEQ ID NO: 8781857 - DNA, 22 bp, Homo sapiens
agtcagcatctgcactgtgctg

SEQ ID NO: 8781858 - DNA, 23 bp, Homo sapiens
ctagacttggaggtcttgaggac

SEQ ID NO: 8781859 - DNA, 22 bp, Homo sapiens
ctagctttttatgacaatcttg

SEQ ID NO: 8781860 - DNA, 22 bp, Homo sapiens
ctagcttcaagtcctggctgtg

SEQ ID NO: 8781861 - DNA, 22 bp, Homo sapiens
ctagctttgtccattgtcttgc

SEQ ID NO: 8781862 - DNA, 22 bp, Homo sapiens
ctagctgtgtaaaccgagctgc

SEQ ID NO: 8781863 - DNA, 22 bp, Homo sapiens
ctagctgtgtaaaccgagctgc

SEQ ID NO: 8781864 - DNA, 22 bp, Homo sapiens
ctagcttcaagtcctggctgtg

SEQ ID NO: 8781865 - DNA, 22 bp, Homo sapiens
ctagctgtaagagggatgtggc

SEQ ID NO: 8781866 - DNA, 22 bp, Homo sapiens
agtcacatgggattagaaccca

SEQ ID NO: 8781867 - DNA, 22 bp, Homo sapiens
agtcacatggactcaggatgac

SEQ ID NO: 8781868 - DNA, 22 bp, Homo sapiens
agtcacatggcagagagaagtt

SEQ ID NO: 8781869 - DNA, 22 bp, Homo sapiens
agtcacatggactcaggatgac

SEQ ID NO: 8781870 - DNA, 20 bp, Homo sapiens
agtcacattgagcttttgga

SEQ ID NO: 8781871 - DNA, 21 bp, Homo sapiens
agtcacattgggggtttaggg

SEQ ID NO: 8781872 - DNA, 23 bp, Homo sapiens
ctagaattttgctaaaagactag

SEQ ID NO: 8781873 - DNA, 22 bp, Homo sapiens
ctagacttcagctttgtgatct

SEQ ID NO: 8781874 - DNA, 22 bp, Homo sapiens
ctagacagaggcaagcgcatta

SEQ ID NO: 8781875 - DNA, 22 bp, Homo sapiens
ctaggaaagacacagagagttt

SEQ ID NO: 8781876 - DNA, 22 bp, Homo sapiens
ctaggaaagacacagagagttt

SEQ ID NO: 8781877 - DNA, 22 bp, Homo sapiens
ctaggaaagacacagagagttt

SEQ ID NO: 8781878 - DNA, 22 bp, Homo sapiens
ctaggaaatgaatacagtacac

SEQ ID NO: 8781879 - DNA, 22 bp, Homo sapiens
ctaggaaatttaaaatatgatt

SEQ ID NO: 8781880 - DNA, 20 bp, Homo sapiens
ctaggaactatggtctggct

SEQ ID NO: 8781881 - DNA, 22 bp, Homo sapiens
ctaggaagagaaggaattcccc

SEQ ID NO: 8781882 - DNA, 22 bp, Homo sapiens
ctaggaccactgtaacaaagta

SEQ ID NO: 8781883 - DNA, 22 bp, Homo sapiens
ctaggaccactgtaacaaagta

SEQ ID NO: 8781884 - DNA, 22 bp, Homo sapiens
ctaggaatggtacctcttacaa

SEQ ID NO: 8781885 - DNA, 22 bp, Homo sapiens
ctaggaccactgtaacaaagta

SEQ ID NO: 8781886 - DNA, 22 bp, Homo sapiens
ctaggaatccttttagagttgg

SEQ ID NO: 8781887 - DNA, 22 bp, Homo sapiens
ctaggaatcaccaagattctag

SEQ ID NO: 8781888 - DNA, 21 bp, Homo sapiens
ctaggaggcccagaagacctc

SEQ ID NO: 8781889 - DNA, 22 bp, Homo sapiens
ctaggcacttgtaaggccgctc

SEQ ID NO: 8781890 - DNA, 22 bp, Homo sapiens
ctaggcactcacgtggctttag

SEQ ID NO: 8781891 - DNA, 18 bp, Homo sapiens
ctaggcaccaggcacccc

SEQ ID NO: 8781892 - DNA, 22 bp, Homo sapiens
agtcacagaatgatggctccag

SEQ ID NO: 8781893 - DNA, 22 bp, Homo sapiens
agtcacagaatgatggctccag

SEQ ID NO: 8781894 - DNA, 22 bp, Homo sapiens
agtcacagaatgatggctccag

SEQ ID NO: 8781895 - DNA, 22 bp, Homo sapiens
agtcacagaaacccaggtgtgg

SEQ ID NO: 8781896 - DNA, 22 bp, Homo sapiens
agtcacactggttgtttacagt

SEQ ID NO: 8781897 - DNA, 22 bp, Homo sapiens
agtcacacactgtcagttctgc

SEQ ID NO: 8781898 - DNA, 22 bp, Homo sapiens
agtcacaataccgtgtgtcagt

SEQ ID NO: 8781899 - DNA, 19 bp, Homo sapiens
agtcacagaccttgtctcc

SEQ ID NO: 8781900 - DNA, 19 bp, Homo sapiens
agtcacagaccttgtctcc

SEQ ID NO: 8781901 - DNA, 22 bp, Homo sapiens
agtcacaggcaagagggctcca

SEQ ID NO: 8781902 - DNA, 22 bp, Homo sapiens
agtcacagggggcccctgcaac

SEQ ID NO: 8781903 - DNA, 19 bp, Homo sapiens
agtcacagggaagaggaac

SEQ ID NO: 8781904 - DNA, 22 bp, Homo sapiens
agtcacagggtacacaaggatt

SEQ ID NO: 8781905 - DNA, 22 bp, Homo sapiens
agtcacagttctgctgtctgag

SEQ ID NO: 8781906 - DNA, 22 bp, Homo sapiens
agtcacatagaagtgggtttaa

SEQ ID NO: 8781907 - DNA, 22 bp, Homo sapiens
agtcacagttctgctgtctgag

SEQ ID NO: 8781908 - DNA, 22 bp, Homo sapiens
agtcacagtttccctgagagag

SEQ ID NO: 8781909 - DNA, 22 bp, Homo sapiens
agtcacagtttccctgagagag

SEQ ID NO: 8781910 - DNA, 22 bp, Homo sapiens
agtcacagtttccctgagagag

SEQ ID NO: 8781911 - DNA, 22 bp, Homo sapiens
agtcacagttcctacccagtaa

SEQ ID NO: 8781912 - DNA, 22 bp, Homo sapiens
agtcacagttagactacccaag

SEQ ID NO: 8781913 - DNA, 22 bp, Homo sapiens
agtcacatcgattataaaattt

SEQ ID NO: 8781914 - DNA, 22 bp, Homo sapiens
agtcacatagtgttttggaatc

SEQ ID NO: 8781915 - DNA, 20 bp, Homo sapiens
agtcacatgcatacacaagt

SEQ ID NO: 8781916 - DNA, 22 bp, Homo sapiens
agtcacatgcattttcttcaat

SEQ ID NO: 8781917 - DNA, 22 bp, Homo sapiens
agtcacatgagtttctctttat

SEQ ID NO: 8781918 - DNA, 22 bp, Homo sapiens
agtcacatgagcactaattagg

SEQ ID NO: 8781919 - DNA, 22 bp, Homo sapiens
ccttctcccctctgcagggtgt

SEQ ID NO: 8781920 - DNA, 22 bp, Homo sapiens
ccttccagtgactaaggaggaa

SEQ ID NO: 8781921 - DNA, 20 bp, Homo sapiens
ccttctccagcttgttcttg

SEQ ID NO: 8781922 - DNA, 21 bp, Homo sapiens
ccttctccattacagtaagct

SEQ ID NO: 8781923 - DNA, 22 bp, Homo sapiens
ccttccagtatgttaagatggt

SEQ ID NO: 8781924 - DNA, 22 bp, Homo sapiens
ccttccagtatgttaagatggt

SEQ ID NO: 8781925 - DNA, 22 bp, Homo sapiens
ccttccagtatgttaagatggt

SEQ ID NO: 8781926 - DNA, 22 bp, Homo sapiens
ccttccagtgactaaggaggaa

SEQ ID NO: 8781927 - DNA, 16 bp, Homo sapiens
ccttccagtccagcag

SEQ ID NO: 8781928 - DNA, 16 bp, Homo sapiens
ccttccagtccagcag

SEQ ID NO: 8781929 - DNA, 22 bp, Homo sapiens
ccttccaggttttggctccatt

SEQ ID NO: 8781930 - DNA, 22 bp, Homo sapiens
ccttccaggttttggctccatt

SEQ ID NO: 8781931 - DNA, 22 bp, Homo sapiens
ccttccaggttttggctccatt

SEQ ID NO: 8781932 - DNA, 22 bp, Homo sapiens
ccttccaggttttggctccatt

SEQ ID NO: 8781933 - DNA, 22 bp, Homo sapiens
ccttccaggtgcaggcaagcct

SEQ ID NO: 8781934 - DNA, 22 bp, Homo sapiens
ccttccaggtgcaggcaagcct

SEQ ID NO: 8781935 - DNA, 22 bp, Homo sapiens
ccttccagggctctccagaacc

SEQ ID NO: 8781936 - DNA, 22 bp, Homo sapiens
ccttccagggctctccagaacc

SEQ ID NO: 8781937 - DNA, 22 bp, Homo sapiens
ccttccagggctctccagaacc

SEQ ID NO: 8781938 - DNA, 22 bp, Homo sapiens
ccttccagggtttttgccaatc

SEQ ID NO: 8781939 - DNA, 22 bp, Homo sapiens
ccttccagggtttttgccaatc

SEQ ID NO: 8781940 - DNA, 22 bp, Homo sapiens
ccttctccctctgagaggaacc

SEQ ID NO: 8781941 - DNA, 22 bp, Homo sapiens
ccttctcctgccttgggttcat

SEQ ID NO: 8781942 - DNA, 22 bp, Homo sapiens
ccttctctactcctgatgcatg

SEQ ID NO: 8781943 - DNA, 22 bp, Homo sapiens
ccttctctaccatgtgaggaaa

SEQ ID NO: 8781944 - DNA, 22 bp, Homo sapiens
ccttctctaccatgtgaggaaa

SEQ ID NO: 8781945 - DNA, 22 bp, Homo sapiens
ccttctctactcctgatgcatg

SEQ ID NO: 8781946 - DNA, 22 bp, Homo sapiens
ccttctctctgaagaccccaaa

SEQ ID NO: 8781947 - DNA, 22 bp, Homo sapiens
ccttctctctgaagaccccaaa

SEQ ID NO: 8781948 - DNA, 22 bp, Homo sapiens
agtaaacagtatctttagtgtc

SEQ ID NO: 8781949 - DNA, 22 bp, Homo sapiens
agtaaacagtatctttagtgtc

SEQ ID NO: 8781950 - DNA, 22 bp, Homo sapiens
agtaaaaattgaggtgcaaaat

SEQ ID NO: 8781951 - DNA, 22 bp, Homo sapiens
agtaaacagtaggaactgagaa

SEQ ID NO: 8781952 - DNA, 22 bp, Homo sapiens
agtaacaaagaaagcctttgga

SEQ ID NO: 8781953 - DNA, 22 bp, Homo sapiens
agtaaatttctgcatgtgtact

SEQ ID NO: 8781954 - DNA, 22 bp, Homo sapiens
agtaaatttctgcatgtgtact

SEQ ID NO: 8781955 - DNA, 18 bp, Homo sapiens
agtaaatgttaaatattg

SEQ ID NO: 8781956 - DNA, 22 bp, Homo sapiens
agtaaatgtttatcacacagat

SEQ ID NO: 8781957 - DNA, 18 bp, Homo sapiens
agtaaatggtttattttc

SEQ ID NO: 8781958 - DNA, 22 bp, Homo sapiens
agtaaatggtggtttttatcat

SEQ ID NO: 8781959 - DNA, 22 bp, Homo sapiens
agtaaatgattattttgccaac

SEQ ID NO: 8781960 - DNA, 22 bp, Homo sapiens
agtaaatgaaagcaattttaga

SEQ ID NO: 8781961 - DNA, 22 bp, Homo sapiens
agtaaatgaaagcaattttaga

SEQ ID NO: 8781962 - DNA, 22 bp, Homo sapiens
agtaaataacagagaaaatggg

SEQ ID NO: 8781963 - DNA, 22 bp, Homo sapiens
agtaaataacagagaaaatggg

SEQ ID NO: 8781964 - DNA, 22 bp, Homo sapiens
agtaaacagtttcttagaagaa

SEQ ID NO: 8781965 - DNA, 22 bp, Homo sapiens
agtaaacatagaatgttcttcc

SEQ ID NO: 8781966 - DNA, 22 bp, Homo sapiens
agtaaacataatttacctgtag

SEQ ID NO: 8781967 - DNA, 22 bp, Homo sapiens
agtaaacatagaatgttcttcc

SEQ ID NO: 8781968 - DNA, 22 bp, Homo sapiens
agtaaacatagaatgttcttcc

SEQ ID NO: 8781969 - DNA, 22 bp, Homo sapiens
agtaaacatgtaattgttcatt

SEQ ID NO: 8781970 - DNA, 22 bp, Homo sapiens
agtaaactgtgtgcctttgact

SEQ ID NO: 8781971 - DNA, 22 bp, Homo sapiens
agtaaacatttcagatttattt

SEQ ID NO: 8781972 - DNA, 22 bp, Homo sapiens
agtagacattttgcaacatctg

SEQ ID NO: 8781973 - DNA, 19 bp, Homo sapiens
agtagacattttcatgttt

SEQ ID NO: 8781974 - DNA, 22 bp, Homo sapiens
agtagacagccttgctcctgag

SEQ ID NO: 8781975 - DNA, 22 bp, Homo sapiens
agtagacatgagcaatgataat

SEQ ID NO: 8781976 - DNA, 22 bp, Homo sapiens
agtagacatgagcaatgataat

SEQ ID NO: 8781977 - DNA, 22 bp, Homo sapiens
agtagacaatatggatttaatg

SEQ ID NO: 8781978 - DNA, 22 bp, Homo sapiens
agtagacagccttgctcctgag

SEQ ID NO: 8781979 - DNA, 22 bp, Homo sapiens
agtagaaatgtagtgtagagaa

SEQ ID NO: 8781980 - DNA, 22 bp, Homo sapiens
agtagaatgttctatgtcaatg

SEQ ID NO: 8781981 - DNA, 22 bp, Homo sapiens
agtagaatcccttgcaatgtcc

SEQ ID NO: 8781982 - DNA, 22 bp, Homo sapiens
agtagacaataattcaactccc

SEQ ID NO: 8781983 - DNA, 20 bp, Homo sapiens
agtagacaactgcaggtgtg

SEQ ID NO: 8781984 - DNA, 22 bp, Homo sapiens
agtagacaataattcaactccc

SEQ ID NO: 8781985 - DNA, 22 bp, Homo sapiens
agtagcaatggctctgagctat

SEQ ID NO: 8781986 - DNA, 23 bp, Homo sapiens
agtagcacatacagtacttgttc

SEQ ID NO: 8781987 - DNA, 22 bp, Homo sapiens
agtagattctcattgatctggt

SEQ ID NO: 8781988 - DNA, 22 bp, Homo sapiens
agtagattctcattgatctggt

SEQ ID NO: 8781989 - DNA, 22 bp, Homo sapiens
agtaacaaatagctgcctttaa

SEQ ID NO: 8781990 - DNA, 22 bp, Homo sapiens
agtaacaagtgccaacgttaga

SEQ ID NO: 8781991 - DNA, 22 bp, Homo sapiens
agtaacactattttcatatgta

SEQ ID NO: 8781992 - DNA, 22 bp, Homo sapiens
agtaacagaaggcctgacttaa

SEQ ID NO: 8781993 - DNA, 22 bp, Homo sapiens
agtaacagaaggcctgacttaa

SEQ ID NO: 8781994 - DNA, 22 bp, Homo sapiens
agtaacagagcatgggttcaga

SEQ ID NO: 8781995 - DNA, 22 bp, Homo sapiens
agtaacagaaggcctgacttaa

SEQ ID NO: 8781996 - DNA, 22 bp, Homo sapiens
agtaacagagcatgggttcaga

SEQ ID NO: 8781997 - DNA, 22 bp, Homo sapiens
agtagaaatgtaagaaggatta

SEQ ID NO: 8781998 - DNA, 22 bp, Homo sapiens
agtagaaatgtaagaaggatta

SEQ ID NO: 8781999 - DNA, 22 bp, Homo sapiens
agtagaaatgtaagaaggatta

SEQ ID NO: 8782000 - DNA, 22 bp, Homo sapiens
agtagaaagttgcaggaggaat

SEQ ID NO: 8782001 - DNA, 22 bp, Homo sapiens
agtagaaagttgcaggaggaat

SEQ ID NO: 8782002 - DNA, 22 bp, Homo sapiens
agtaggaggcgggagcatgaag

SEQ ID NO: 8782003 - DNA, 22 bp, Homo sapiens
agtagcataaatagtggtagta

SEQ ID NO: 8782004 - DNA, 22 bp, Homo sapiens
agtagcatgtgcacagtaattt

SEQ ID NO: 8782005 - DNA, 22 bp, Homo sapiens
agtagcattctccctctacact

SEQ ID NO: 8782006 - DNA, 20 bp, Homo sapiens
agtagcagtaatatggaaga

SEQ ID NO: 8782007 - DNA, 22 bp, Homo sapiens
agtagcagtttggctgaattta

SEQ ID NO: 8782008 - DNA, 22 bp, Homo sapiens
agtagcagtgacagctgaggta

SEQ ID NO: 8782009 - DNA, 22 bp, Homo sapiens
agtagcagaaggtcttgaaggg

SEQ ID NO: 8782010 - DNA, 22 bp, Homo sapiens
agtagcagaaggtcttgaaggg

SEQ ID NO: 8782011 - DNA, 19 bp, Homo sapiens
agtagcagaaagtgcagtg

SEQ ID NO: 8782012 - DNA, 22 bp, Homo sapiens
agtagggagaccggaggccgcc

SEQ ID NO: 8782013 - DNA, 22 bp, Homo sapiens
agtagggagaccggaggccgcc

SEQ ID NO: 8782014 - DNA, 22 bp, Homo sapiens
agtagggagaccggaggccgcc

SEQ ID NO: 8782015 - DNA, 22 bp, Homo sapiens
agtaggcatagaaagaagcacc

SEQ ID NO: 8782016 - DNA, 22 bp, Homo sapiens
agtcaaggtggaccagaaaaat

SEQ ID NO: 8782017 - DNA, 22 bp, Homo sapiens
agtcaaggctattatgtgggaa

SEQ ID NO: 8782018 - DNA, 22 bp, Homo sapiens
agtcaagattctggcactagca

SEQ ID NO: 8782019 - DNA, 22 bp, Homo sapiens
agtcaaggctattatgtgggaa

SEQ ID NO: 8782020 - DNA, 22 bp, Homo sapiens
agtatttcttcatatgattact

SEQ ID NO: 8782021 - DNA, 22 bp, Homo sapiens
agtatttcttcatatgattact

SEQ ID NO: 8782022 - DNA, 22 bp, Homo sapiens
agtcaagagacttaaaatattt

SEQ ID NO: 8782023 - DNA, 18 bp, Homo sapiens
agtatttctgcatgtctt

SEQ ID NO: 8782024 - DNA, 22 bp, Homo sapiens
agtatttctgaatattatcata

SEQ ID NO: 8782025 - DNA, 22 bp, Homo sapiens
ataaactcatgctgaaaaccca

SEQ ID NO: 8782026 - DNA, 22 bp, Homo sapiens
ataaactcatgccaagaaatga

SEQ ID NO: 8782027 - DNA, 22 bp, Homo sapiens
ataaactcatgccaagaaatga

SEQ ID NO: 8782028 - DNA, 22 bp, Homo sapiens
ataaactgaagggaacactgag

SEQ ID NO: 8782029 - DNA, 22 bp, Homo sapiens
ataaactctgcctcagaagagc

SEQ ID NO: 8782030 - DNA, 21 bp, Homo sapiens
ataaactgcatcaagttggtg

SEQ ID NO: 8782031 - DNA, 22 bp, Homo sapiens
ataaactgggtatcaagaggcc

SEQ ID NO: 8782032 - DNA, 22 bp, Homo sapiens
ataaactgaagggaacactgag

SEQ ID NO: 8782033 - DNA, 22 bp, Homo sapiens
ataaacatctgtttctcttctg

SEQ ID NO: 8782034 - DNA, 22 bp, Homo sapiens
ataaactctattttgaggagat

SEQ ID NO: 8782035 - DNA, 22 bp, Homo sapiens
ataaactctgcctcagaagagc

SEQ ID NO: 8782036 - DNA, 22 bp, Homo sapiens
ataaacatctgtttctcttctg

SEQ ID NO: 8782037 - DNA, 22 bp, Homo sapiens
ataaaatcaactggctccagtt

SEQ ID NO: 8782038 - DNA, 22 bp, Homo sapiens
ataaaatcagagttggattgga

SEQ ID NO: 8782039 - DNA, 22 bp, Homo sapiens
ataaaatctttatgtgctctgc

SEQ ID NO: 8782040 - DNA, 22 bp, Homo sapiens
ataaaatctttatgtgctctgc

SEQ ID NO: 8782041 - DNA, 22 bp, Homo sapiens
ctgcagggaccacaagcaggtt

SEQ ID NO: 8782042 - DNA, 22 bp, Homo sapiens
ctgcagggacccaagtctttgg

SEQ ID NO: 8782043 - DNA, 22 bp, Homo sapiens
ctgcagggaactgaggcccaga

SEQ ID NO: 8782044 - DNA, 22 bp, Homo sapiens
ctgcagggaccacaagcaggtt

SEQ ID NO: 8782045 - DNA, 22 bp, Homo sapiens
ctgcaggctgagcgcctgccgg

SEQ ID NO: 8782046 - DNA, 22 bp, Homo sapiens
ctgcaggctgagcgcctgccgg

SEQ ID NO: 8782047 - DNA, 22 bp, Homo sapiens
ctgcaggcttccagggctgtgg

SEQ ID NO: 8782048 - DNA, 22 bp, Homo sapiens
ctgcaggcttccagggctgtgg

SEQ ID NO: 8782049 - DNA, 22 bp, Homo sapiens
ataaagaggatgtatttacagc

SEQ ID NO: 8782050 - DNA, 22 bp, Homo sapiens
ataaagaggatgtatttacagc

SEQ ID NO: 8782051 - DNA, 22 bp, Homo sapiens
ataaagaggatgtatttacagc

SEQ ID NO: 8782052 - DNA, 22 bp, Homo sapiens
ataaagatagaatgctttcctg

SEQ ID NO: 8782053 - DNA, 22 bp, Homo sapiens
ataaagatagaatgctttcctg

SEQ ID NO: 8782054 - DNA, 22 bp, Homo sapiens
ataaagatagaatgctttcctg

SEQ ID NO: 8782055 - DNA, 22 bp, Homo sapiens
ataaagatttctttttctctac

SEQ ID NO: 8782056 - DNA, 22 bp, Homo sapiens
ataaagatttctttttctctac

SEQ ID NO: 8782057 - DNA, 22 bp, Homo sapiens
ataaagatttttaggcatttct

SEQ ID NO: 8782058 - DNA, 22 bp, Homo sapiens
ataaagatttttaggcatttct

SEQ ID NO: 8782059 - DNA, 22 bp, Homo sapiens
ataaagatttttaggcatttct

SEQ ID NO: 8782060 - DNA, 22 bp, Homo sapiens
ataaactggtaggaaaacagta

SEQ ID NO: 8782061 - DNA, 23 bp, Homo sapiens
ataaactgtcaaaagccagccct

SEQ ID NO: 8782062 - DNA, 22 bp, Homo sapiens
ataaactgtgctggatgatgag

SEQ ID NO: 8782063 - DNA, 22 bp, Homo sapiens
ataaactgtgctggatgatgag

SEQ ID NO: 8782064 - DNA, 22 bp, Homo sapiens
ataaactggtaggaaaacagta

SEQ ID NO: 8782065 - DNA, 23 bp, Homo sapiens
ataaactgtcaaaagccagccct

SEQ ID NO: 8782066 - DNA, 22 bp, Homo sapiens
ataaactggtaggaaaacagta

SEQ ID NO: 8782067 - DNA, 22 bp, Homo sapiens
ataaactgggtatcaagaggcc

SEQ ID NO: 8782068 - DNA, 21 bp, Homo sapiens
ataaactgcatcaagttggtg

SEQ ID NO: 8782069 - DNA, 22 bp, Homo sapiens
ataaacttgagtctcagagtat

SEQ ID NO: 8782070 - DNA, 22 bp, Homo sapiens
ataaagcaagcataccattaag

SEQ ID NO: 8782071 - DNA, 22 bp, Homo sapiens
ataaagcaaataggactattgc

SEQ ID NO: 8782072 - DNA, 22 bp, Homo sapiens
ataaagcatactttgtatgact

SEQ ID NO: 8782073 - DNA, 22 bp, Homo sapiens
ataaagcaggtccccagacact

SEQ ID NO: 8782074 - DNA, 22 bp, Homo sapiens
ataaagcaatagattgtgtaat

SEQ ID NO: 8782075 - DNA, 22 bp, Homo sapiens
ataaagcaatagattgtgtaat

SEQ ID NO: 8782076 - DNA, 22 bp, Homo sapiens
ataaagcatctagtctgtcact

SEQ ID NO: 8782077 - DNA, 22 bp, Homo sapiens
ataaagcatttcccctgtgtgg

SEQ ID NO: 8782078 - DNA, 22 bp, Homo sapiens
ataaagcatttcccctgtgtgg

SEQ ID NO: 8782079 - DNA, 22 bp, Homo sapiens
ataaagctaagacttacatgaa

SEQ ID NO: 8782080 - DNA, 22 bp, Homo sapiens
ataaagcatactttgtatgact

SEQ ID NO: 8782081 - DNA, 22 bp, Homo sapiens
ataaagcatactttgtatgact

SEQ ID NO: 8782082 - DNA, 22 bp, Homo sapiens
ataaaaaggacagatgtggtct

SEQ ID NO: 8782083 - DNA, 22 bp, Homo sapiens
ataaaaaggacagatgtggtct

SEQ ID NO: 8782084 - DNA, 22 bp, Homo sapiens
ataaaaaggacagatgtggtct

SEQ ID NO: 8782085 - DNA, 22 bp, Homo sapiens
ataaaaatgagggcggtagcta

SEQ ID NO: 8782086 - DNA, 22 bp, Homo sapiens
ataaaaatgagggcggtagcta

SEQ ID NO: 8782087 - DNA, 22 bp, Homo sapiens
agttttgtaattctcaaaaata

SEQ ID NO: 8782088 - DNA, 22 bp, Homo sapiens
agttcttcataaccttactgtg

SEQ ID NO: 8782089 - DNA, 22 bp, Homo sapiens
ctgcaggctcgaagacacggat

SEQ ID NO: 8782090 - DNA, 22 bp, Homo sapiens
ctgcaggctcgaagacacggat

SEQ ID NO: 8782091 - DNA, 22 bp, Homo sapiens
ataaaagatcccttctgagctc

SEQ ID NO: 8782092 - DNA, 22 bp, Homo sapiens
ataaaagatcccttctgagctc

SEQ ID NO: 8782093 - DNA, 22 bp, Homo sapiens
ataaaagaagttttggtacttg

SEQ ID NO: 8782094 - DNA, 22 bp, Homo sapiens
ataaaagaagttttggtacttg

SEQ ID NO: 8782095 - DNA, 22 bp, Homo sapiens
ataaaagaagttttggtacttg

SEQ ID NO: 8782096 - DNA, 22 bp, Homo sapiens
ataaaagaagttttggtacttg

SEQ ID NO: 8782097 - DNA, 22 bp, Homo sapiens
ataaaagaagttttggtacttg

SEQ ID NO: 8782098 - DNA, 22 bp, Homo sapiens
ataaaagaagttttggtacttg

SEQ ID NO: 8782099 - DNA, 22 bp, Homo sapiens
ataaaacttgggtatgatccct

SEQ ID NO: 8782100 - DNA, 22 bp, Homo sapiens
ataaaacttattagaattgtgt

SEQ ID NO: 8782101 - DNA, 22 bp, Homo sapiens
ataaaacttattagaattgtgt

SEQ ID NO: 8782102 - DNA, 22 bp, Homo sapiens
agttctgtggctgtgccctgta

SEQ ID NO: 8782103 - DNA, 22 bp, Homo sapiens
agttctggttaacctgcaacct

SEQ ID NO: 8782104 - DNA, 22 bp, Homo sapiens
agttctgctgctgcctagggtg

SEQ ID NO: 8782105 - DNA, 22 bp, Homo sapiens
agttctggaactctacagcaac

SEQ ID NO: 8782106 - DNA, 22 bp, Homo sapiens
agttctggtggtttggagatct

SEQ ID NO: 8782107 - DNA, 22 bp, Homo sapiens
agttctgggaaaaacatggcca

SEQ ID NO: 8782108 - DNA, 22 bp, Homo sapiens
agttctggcggctgtcggcact

SEQ ID NO: 8782109 - DNA, 22 bp, Homo sapiens
agttctcttctcatcacccagg

SEQ ID NO: 8782110 - DNA, 22 bp, Homo sapiens
agttctcttggaagttatgtga

SEQ ID NO: 8782111 - DNA, 20 bp, Homo sapiens
agttctcttccttgggcctg

SEQ ID NO: 8782112 - DNA, 22 bp, Homo sapiens
agttctcttccacagcctcctc

SEQ ID NO: 8782113 - DNA, 22 bp, Homo sapiens
agttctctcccctgctgttcag

SEQ ID NO: 8782114 - DNA, 22 bp, Homo sapiens
agttctctcccctgctgttcag

SEQ ID NO: 8782115 - DNA, 22 bp, Homo sapiens
agttctctggctcctttccaga

SEQ ID NO: 8782116 - DNA, 22 bp, Homo sapiens
agttctgctatcttgtcttctt

SEQ ID NO: 8782117 - DNA, 22 bp, Homo sapiens
agttctgctatcttgtcttctt

SEQ ID NO: 8782118 - DNA, 22 bp, Homo sapiens
agttctgcctatatagaaactc

SEQ ID NO: 8782119 - DNA, 22 bp, Homo sapiens
agttctctttagctcatatggt

SEQ ID NO: 8782120 - DNA, 22 bp, Homo sapiens
agttctataattaaaatgaagg

SEQ ID NO: 8782121 - DNA, 22 bp, Homo sapiens
agttctcaagacaattacctgt

SEQ ID NO: 8782122 - DNA, 23 bp, Homo sapiens
agttctcaaaaccagcttgacaa

SEQ ID NO: 8782123 - DNA, 22 bp, Homo sapiens
agttctatttctaacatgttat

SEQ ID NO: 8782124 - DNA, 22 bp, Homo sapiens
agttctaagatgctccacagag

SEQ ID NO: 8782125 - DNA, 22 bp, Homo sapiens
agttcgagatctgctgatgaga

SEQ ID NO: 8782126 - DNA, 22 bp, Homo sapiens
agttctaattgcgttttcttgc

SEQ ID NO: 8782127 - DNA, 22 bp, Homo sapiens
agttctaagatgctccacagag

SEQ ID NO: 8782128 - DNA, 22 bp, Homo sapiens
agttctaaacacttgaggaacc

SEQ ID NO: 8782129 - DNA, 22 bp, Homo sapiens
agttctaaggtgagtagagagg

SEQ ID NO: 8782130 - DNA, 22 bp, Homo sapiens
agttctaagtaaatattttata

SEQ ID NO: 8782131 - DNA, 22 bp, Homo sapiens
agttctaagatgctccacagag

SEQ ID NO: 8782132 - DNA, 22 bp, Homo sapiens
agttctaagtaaatattttata

SEQ ID NO: 8782133 - DNA, 23 bp, Homo sapiens
agttctcattcatcacggcctat

SEQ ID NO: 8782134 - DNA, 22 bp, Homo sapiens
agttctcattgcatgagacaga

SEQ ID NO: 8782135 - DNA, 22 bp, Homo sapiens
agttctcatttcacaggcagtg

SEQ ID NO: 8782136 - DNA, 22 bp, Homo sapiens
agttctctatgaagtctattgt

SEQ ID NO: 8782137 - DNA, 22 bp, Homo sapiens
agttctcacttcagagctgccc

SEQ ID NO: 8782138 - DNA, 22 bp, Homo sapiens
agttctcaagacaattacctgt

SEQ ID NO: 8782139 - DNA, 22 bp, Homo sapiens
agttctcaaggttaggaaaagt

SEQ ID NO: 8782140 - DNA, 22 bp, Homo sapiens
agttctcaagacaattacctgt

SEQ ID NO: 8782141 - DNA, 22 bp, Homo sapiens
agttctcaggtcagctgagtct

SEQ ID NO: 8782142 - DNA, 22 bp, Homo sapiens
agttctcagcttagtatgctgt

SEQ ID NO: 8782143 - DNA, 22 bp, Homo sapiens
agttctcagcttagtatgctgt

SEQ ID NO: 8782144 - DNA, 22 bp, Homo sapiens
ctgcctgggttcaagtcctgtt

SEQ ID NO: 8782145 - DNA, 22 bp, Homo sapiens
ctgcctgggttcaagtcctgtt

SEQ ID NO: 8782146 - DNA, 22 bp, Homo sapiens
ctgcctggtactttaggcactt

SEQ ID NO: 8782147 - DNA, 22 bp, Homo sapiens
ctgcctgggttcaagtcctgtt

SEQ ID NO: 8782148 - DNA, 22 bp, Homo sapiens
ctgcctggtctcaggcatgggg

SEQ ID NO: 8782149 - DNA, 22 bp, Homo sapiens
ctgcctggtctcaggcatgggg

SEQ ID NO: 8782150 - DNA, 22 bp, Homo sapiens
ctgcctggtactttaggcactt

SEQ ID NO: 8782151 - DNA, 22 bp, Homo sapiens
ctgcctggggcatcagtcaagg

SEQ ID NO: 8782152 - DNA, 22 bp, Homo sapiens
ctgcctgggttcaagtcctgtt

SEQ ID NO: 8782153 - DNA, 22 bp, Homo sapiens
ataaaggaaattccatgtctaa

SEQ ID NO: 8782154 - DNA, 22 bp, Homo sapiens
ctgcctgtgcatgcagtcagaa

SEQ ID NO: 8782155 - DNA, 22 bp, Homo sapiens
ctgcctgtgcatgcagtcagaa

SEQ ID NO: 8782156 - DNA, 22 bp, Homo sapiens
ctgcctgtgaacatactggggg

SEQ ID NO: 8782157 - DNA, 22 bp, Homo sapiens
ctgcctgtattgtctgcttggg

SEQ ID NO: 8782158 - DNA, 22 bp, Homo sapiens
ctgcctggtgcggtgcccaccc

SEQ ID NO: 8782159 - DNA, 22 bp, Homo sapiens
ctgcctggtgcggtgcccaccc

SEQ ID NO: 8782160 - DNA, 22 bp, Homo sapiens
ctgcctggtgcggtgcccaccc

SEQ ID NO: 8782161 - DNA, 22 bp, Homo sapiens
ctgctacaccggaatagtgaca

SEQ ID NO: 8782162 - DNA, 22 bp, Homo sapiens
ctgctacacgattctgattcca

SEQ ID NO: 8782163 - DNA, 22 bp, Homo sapiens
ctgctaaacctctctgagagct

SEQ ID NO: 8782164 - DNA, 22 bp, Homo sapiens
ctgctcagcggaaggaagagcg

SEQ ID NO: 8782165 - DNA, 22 bp, Homo sapiens
ctgctcagaggaaggaatgtct

SEQ ID NO: 8782166 - DNA, 22 bp, Homo sapiens
ctgctcagcggaaggaagagcg

SEQ ID NO: 8782167 - DNA, 19 bp, Homo sapiens
ctgctcagagcagctccag

SEQ ID NO: 8782168 - DNA, 19 bp, Homo sapiens
ctgctcagagcagctccag

SEQ ID NO: 8782169 - DNA, 22 bp, Homo sapiens
ctgctcaagtgcgcacccaggg

SEQ ID NO: 8782170 - DNA, 22 bp, Homo sapiens
ctgctgggggacacaggtccgg

SEQ ID NO: 8782171 - DNA, 22 bp, Homo sapiens
ctgctggggaggcgcctcgacg

SEQ ID NO: 8782172 - DNA, 22 bp, Homo sapiens
ctgctggggaggcgcctcgacg

SEQ ID NO: 8782173 - DNA, 22 bp, Homo sapiens
ctgctgggctcctcatgtgact

SEQ ID NO: 8782174 - DNA, 22 bp, Homo sapiens
ctgctgggctcctcatgtgact

SEQ ID NO: 8782175 - DNA, 22 bp, Homo sapiens
ctgctgggcctggtctctgagg

SEQ ID NO: 8782176 - DNA, 22 bp, Homo sapiens
ctgctgggcagaggctgcatga

SEQ ID NO: 8782177 - DNA, 22 bp, Homo sapiens
ctgctgggcagaggctgcatga

SEQ ID NO: 8782178 - DNA, 22 bp, Homo sapiens
ctgctgggcagaggctgcatga

SEQ ID NO: 8782179 - DNA, 22 bp, Homo sapiens
ctgctgggcctggtctctgagg

SEQ ID NO: 8782180 - DNA, 22 bp, Homo sapiens
ctgctgcccagtgtgcattggg

SEQ ID NO: 8782181 - DNA, 22 bp, Homo sapiens
atacacatatgtgtgtatatgt

SEQ ID NO: 8782182 - DNA, 22 bp, Homo sapiens
atacacatatgtgtgtatatgt

SEQ ID NO: 8782183 - DNA, 22 bp, Homo sapiens
atacacatatgtgtgtatatgt

SEQ ID NO: 8782184 - DNA, 20 bp, Homo sapiens
atacacatattcttgcaact

SEQ ID NO: 8782185 - DNA, 20 bp, Homo sapiens
atacacatattcttgcaact

SEQ ID NO: 8782186 - DNA, 22 bp, Homo sapiens
atacacatatgtgtgtatatgt

SEQ ID NO: 8782187 - DNA, 22 bp, Homo sapiens
atacacatgcacacatgtgtgt

SEQ ID NO: 8782188 - DNA, 22 bp, Homo sapiens
atacacatgcacacatgtgtgt

SEQ ID NO: 8782189 - DNA, 22 bp, Homo sapiens
atacacatgcacacatgtgtgt

SEQ ID NO: 8782190 - DNA, 22 bp, Homo sapiens
atacacatgcacacatgtgtgt

SEQ ID NO: 8782191 - DNA, 22 bp, Homo sapiens
atacacatctatttaagagaca

SEQ ID NO: 8782192 - DNA, 22 bp, Homo sapiens
atacacatctatttaagagaca

SEQ ID NO: 8782193 - DNA, 22 bp, Homo sapiens
atacacatctatttaagagaca

SEQ ID NO: 8782194 - DNA, 21 bp, Homo sapiens
atacacatacacataaatgtg

SEQ ID NO: 8782195 - DNA, 21 bp, Homo sapiens
atacacatacacataaatgtg

SEQ ID NO: 8782196 - DNA, 21 bp, Homo sapiens
atacacatacacataaatgtg

SEQ ID NO: 8782197 - DNA, 19 bp, Homo sapiens
atacacatacgtaaactga

SEQ ID NO: 8782198 - DNA, 19 bp, Homo sapiens
atacacatacgtaaactga

SEQ ID NO: 8782199 - DNA, 19 bp, Homo sapiens
atacacatacgtaaactga

SEQ ID NO: 8782200 - DNA, 19 bp, Homo sapiens
atacacatacgtaaactga

SEQ ID NO: 8782201 - DNA, 22 bp, Homo sapiens
atacacatatatacacgtttaa

SEQ ID NO: 8782202 - DNA, 22 bp, Homo sapiens
atacacatatatacacgtttaa

SEQ ID NO: 8782203 - DNA, 22 bp, Homo sapiens
atacacatatcaggtgtataca

SEQ ID NO: 8782204 - DNA, 22 bp, Homo sapiens
atacacaggcatgcttctgatt

SEQ ID NO: 8782205 - DNA, 22 bp, Homo sapiens
atacaagttgcccaaatgatta

SEQ ID NO: 8782206 - DNA, 22 bp, Homo sapiens
atacaagttgcccaaatgatta

SEQ ID NO: 8782207 - DNA, 22 bp, Homo sapiens
atacaagttctcatgtgtatct

SEQ ID NO: 8782208 - DNA, 22 bp, Homo sapiens
atacacaggcatgcttctgatt

SEQ ID NO: 8782209 - DNA, 22 bp, Homo sapiens
atacacaggtgctaggtcaata

SEQ ID NO: 8782210 - DNA, 21 bp, Homo sapiens
atacacatacacataaatgtg

SEQ ID NO: 8782211 - DNA, 22 bp, Homo sapiens
ctgctggggtcagagcactggg

SEQ ID NO: 8782212 - DNA, 22 bp, Homo sapiens
ctgctgggggacacaggtccgg

SEQ ID NO: 8782213 - DNA, 22 bp, Homo sapiens
ctgctgggggacacaggtccgg

SEQ ID NO: 8782214 - DNA, 22 bp, Homo sapiens
ctgctgggggacacaggtccgg

SEQ ID NO: 8782215 - DNA, 22 bp, Homo sapiens
ctgctggggtcagagcactggg

SEQ ID NO: 8782216 - DNA, 22 bp, Homo sapiens
ctgctggggtcagagcactggg

SEQ ID NO: 8782217 - DNA, 22 bp, Homo sapiens
ctgctgtgccttaaaatgcaag

SEQ ID NO: 8782218 - DNA, 22 bp, Homo sapiens
ctgctgtggatgcaggacctca

SEQ ID NO: 8782219 - DNA, 22 bp, Homo sapiens
ctgctgtgcaggtgcctatgat

SEQ ID NO: 8782220 - DNA, 22 bp, Homo sapiens
ctgctgtgcagacagactctct

SEQ ID NO: 8782221 - DNA, 22 bp, Homo sapiens
ctgctgtgcagacagactctct

SEQ ID NO: 8782222 - DNA, 22 bp, Homo sapiens
ctgctggggtcagagcactggg

SEQ ID NO: 8782223 - DNA, 22 bp, Homo sapiens
ctgctgtgcaggtgcctatgat

SEQ ID NO: 8782224 - DNA, 22 bp, Homo sapiens
ctgctgtgcaggtgcctatgat

SEQ ID NO: 8782225 - DNA, 22 bp, Homo sapiens
ctgctgtggtgtcaagcatctc

SEQ ID NO: 8782226 - DNA, 22 bp, Homo sapiens
atacaagttctcatgtgtatct

SEQ ID NO: 8782227 - DNA, 18 bp, Homo sapiens
ctgctgtgtcgtctgggc

SEQ ID NO: 8782228 - DNA, 21 bp, Homo sapiens
ctgctgtggcccccgacatgc

SEQ ID NO: 8782229 - DNA, 22 bp, Homo sapiens
ctgctgtgggttaagacactgt

SEQ ID NO: 8782230 - DNA, 22 bp, Homo sapiens
ctgctgtgggcagggtagctgg

SEQ ID NO: 8782231 - DNA, 22 bp, Homo sapiens
ctgctgtgggcagggtagctgg

SEQ ID NO: 8782232 - DNA, 22 bp, Homo sapiens
ctggcctaggaatggttttccg

SEQ ID NO: 8782233 - DNA, 22 bp, Homo sapiens
ctggcctaggaatggttttccg

SEQ ID NO: 8782234 - DNA, 22 bp, Homo sapiens
ctggcctaaaattgcttctgca

SEQ ID NO: 8782235 - DNA, 22 bp, Homo sapiens
ctggccggtatttgcctctggg

SEQ ID NO: 8782236 - DNA, 22 bp, Homo sapiens
ctggcctaaaaatacagaacaa

SEQ ID NO: 8782237 - DNA, 22 bp, Homo sapiens
ctggcccttgacttacagcagg

SEQ ID NO: 8782238 - DNA, 22 bp, Homo sapiens
ctggccgccgtcccaacctcga

SEQ ID NO: 8782239 - DNA, 22 bp, Homo sapiens
ctggccgcagtgtggagttgtg

SEQ ID NO: 8782240 - DNA, 22 bp, Homo sapiens
ctggccgcctggggccgggtga

SEQ ID NO: 8782241 - DNA, 22 bp, Homo sapiens
ctggcctcagagggtcatggtg

SEQ ID NO: 8782242 - DNA, 22 bp, Homo sapiens
ctggcctcagagggtcatggtg

SEQ ID NO: 8782243 - DNA, 22 bp, Homo sapiens
ctggcctcatagccaagctgtg

SEQ ID NO: 8782244 - DNA, 22 bp, Homo sapiens
ctggcctcatagccaagctgtg

SEQ ID NO: 8782245 - DNA, 23 bp, Homo sapiens
ctggcctccgacactggccaaga

SEQ ID NO: 8782246 - DNA, 20 bp, Homo sapiens
ctggccagaacgcctacaca

SEQ ID NO: 8782247 - DNA, 20 bp, Homo sapiens
ctggccagaacgcctacaca

SEQ ID NO: 8782248 - DNA, 22 bp, Homo sapiens
ctggccagaagcacctttggcg

SEQ ID NO: 8782249 - DNA, 22 bp, Homo sapiens
ctggccagactacacatgtgtg

SEQ ID NO: 8782250 - DNA, 22 bp, Homo sapiens
ctggccagaagcacctttggcg

SEQ ID NO: 8782251 - DNA, 22 bp, Homo sapiens
ctggcccttctcttgcttcctg

SEQ ID NO: 8782252 - DNA, 22 bp, Homo sapiens
ctggcccttctcttgcttcctg

SEQ ID NO: 8782253 - DNA, 22 bp, Homo sapiens
ctggcccttctcttgcttcctg

SEQ ID NO: 8782254 - DNA, 22 bp, Homo sapiens
ctggccctatgagcctcctgat

SEQ ID NO: 8782255 - DNA, 22 bp, Homo sapiens
ctggccctatgagcctcctgat

SEQ ID NO: 8782256 - DNA, 22 bp, Homo sapiens
ctggccagaggttcctctgccc

SEQ ID NO: 8782257 - DNA, 22 bp, Homo sapiens
ctggccagaagcacctttggcg

SEQ ID NO: 8782258 - DNA, 22 bp, Homo sapiens
ctggccagactacacatgtgtg

SEQ ID NO: 8782259 - DNA, 22 bp, Homo sapiens
ctggccagactacacatgtgtg

SEQ ID NO: 8782260 - DNA, 22 bp, Homo sapiens
ctggcaggtctcgctgacgtgt

SEQ ID NO: 8782261 - DNA, 22 bp, Homo sapiens
ctggcaggtccagctggactca

SEQ ID NO: 8782262 - DNA, 22 bp, Homo sapiens
ctggcaggtggaggttgcagtg

SEQ ID NO: 8782263 - DNA, 22 bp, Homo sapiens
ctggcaggtggatggggactcc

SEQ ID NO: 8782264 - DNA, 22 bp, Homo sapiens
ctggcaggttatagagctgccc

SEQ ID NO: 8782265 - DNA, 22 bp, Homo sapiens
ctggcaggttatagagctgccc

SEQ ID NO: 8782266 - DNA, 22 bp, Homo sapiens
ctggcaggtggaggttgcagtg

SEQ ID NO: 8782267 - DNA, 22 bp, Homo sapiens
ctggcaggtggaggttgcagtg

SEQ ID NO: 8782268 - DNA, 22 bp, Homo sapiens
ctggcaggtttggtgtctggtg

SEQ ID NO: 8782269 - DNA, 22 bp, Homo sapiens
ctggcagtattaagagaagtga

SEQ ID NO: 8782270 - DNA, 22 bp, Homo sapiens
ctggcaggttatagagctgccc

SEQ ID NO: 8782271 - DNA, 22 bp, Homo sapiens
ctggcaggttatagagctgccc

SEQ ID NO: 8782272 - DNA, 22 bp, Homo sapiens
ctggcaggttatagagctgccc

SEQ ID NO: 8782273 - DNA, 22 bp, Homo sapiens
ctggcaggttatagagctgccc

SEQ ID NO: 8782274 - DNA, 22 bp, Homo sapiens
ctggccactgcgggcctctgcc

SEQ ID NO: 8782275 - DNA, 22 bp, Homo sapiens
ctggcaggtttggtgtctggtg

SEQ ID NO: 8782276 - DNA, 22 bp, Homo sapiens
ctggccactgcgggcctctgcc

SEQ ID NO: 8782277 - DNA, 22 bp, Homo sapiens
ctggccactgcgggcctctgcc

SEQ ID NO: 8782278 - DNA, 22 bp, Homo sapiens
ctggccactggaggtggcaccc

SEQ ID NO: 8782279 - DNA, 22 bp, Homo sapiens
ctggccactggtggtcataggc

SEQ ID NO: 8782280 - DNA, 20 bp, Homo sapiens
ctggccagaacgcctacaca

SEQ ID NO: 8782281 - DNA, 20 bp, Homo sapiens
ctggccagaacgcctacaca

SEQ ID NO: 8782282 - DNA, 22 bp, Homo sapiens
ctggccactggtggtcataggc

SEQ ID NO: 8782283 - DNA, 22 bp, Homo sapiens
ctggcaagtggttgggatggat

SEQ ID NO: 8782284 - DNA, 22 bp, Homo sapiens
ctggcaagtactgggccagctc

SEQ ID NO: 8782285 - DNA, 22 bp, Homo sapiens
ctggcaagtggttgggatggat

SEQ ID NO: 8782286 - DNA, 22 bp, Homo sapiens
ctggcaagtggttgggatggat

SEQ ID NO: 8782287 - DNA, 22 bp, Homo sapiens
ctggcacacagaggccctcggg

SEQ ID NO: 8782288 - DNA, 22 bp, Homo sapiens
ctggcaagtactgggccagctc

SEQ ID NO: 8782289 - DNA, 22 bp, Homo sapiens
ctggcacacagcaggctctcag

SEQ ID NO: 8782290 - DNA, 22 bp, Homo sapiens
ctggcacacagaggccctcggg

SEQ ID NO: 8782291 - DNA, 22 bp, Homo sapiens
ctggcacagagtgagcattcaa

SEQ ID NO: 8782292 - DNA, 22 bp, Homo sapiens
ctggcacagagacagaaggatt

SEQ ID NO: 8782293 - DNA, 22 bp, Homo sapiens
ctggcacacagcaggctctcag

SEQ ID NO: 8782294 - DNA, 22 bp, Homo sapiens
ctggcacacagcaggctctcag

SEQ ID NO: 8782295 - DNA, 22 bp, Homo sapiens
ctggcacacagtaggcaccaat

SEQ ID NO: 8782296 - DNA, 22 bp, Homo sapiens
atacacatgttattgtggaagc

SEQ ID NO: 8782297 - DNA, 22 bp, Homo sapiens
atacacatgttattgtggaagc

SEQ ID NO: 8782298 - DNA, 22 bp, Homo sapiens
atacacatgttattgtggaagc

SEQ ID NO: 8782299 - DNA, 22 bp, Homo sapiens
atacacatgtgtatgtgcatgc

SEQ ID NO: 8782300 - DNA, 22 bp, Homo sapiens
atacacatgtgtatgtgcatgc

SEQ ID NO: 8782301 - DNA, 22 bp, Homo sapiens
atacacatgtgtatgtgcatgc

SEQ ID NO: 8782302 - DNA, 22 bp, Homo sapiens
atacacatgtgtatgtgcatgc

SEQ ID NO: 8782303 - DNA, 20 bp, Homo sapiens
atacacatgcagacagatgc

SEQ ID NO: 8782304 - DNA, 20 bp, Homo sapiens
atacacatgcagacagatgc

SEQ ID NO: 8782305 - DNA, 22 bp, Homo sapiens
ctggagtggccggtgctgtggc

SEQ ID NO: 8782306 - DNA, 20 bp, Homo sapiens
atacacattcatagaaaaat

SEQ ID NO: 8782307 - DNA, 22 bp, Homo sapiens
atacacattactttctgtctga

SEQ ID NO: 8782308 - DNA, 22 bp, Homo sapiens
atacacattactttctgtctga

SEQ ID NO: 8782309 - DNA, 22 bp, Homo sapiens
atacacattactttctgtctga

SEQ ID NO: 8782310 - DNA, 20 bp, Homo sapiens
atacacattcatagaaaaat

SEQ ID NO: 8782311 - DNA, 22 bp, Homo sapiens
atacatgtaactgcattgtaat

SEQ ID NO: 8782312 - DNA, 22 bp, Homo sapiens
atacatgtacataaatgtagca

SEQ ID NO: 8782313 - DNA, 22 bp, Homo sapiens
atacatgtcatcatatgtttgt

SEQ ID NO: 8782314 - DNA, 22 bp, Homo sapiens
atacatgtcatcatatgtttgt

SEQ ID NO: 8782315 - DNA, 22 bp, Homo sapiens
atacatgtgtccctgatttatt

SEQ ID NO: 8782316 - DNA, 22 bp, Homo sapiens
atacatgtgtccctgatttatt

SEQ ID NO: 8782317 - DNA, 22 bp, Homo sapiens
atacatgtgggtctaaacatat

SEQ ID NO: 8782318 - DNA, 22 bp, Homo sapiens
atacatgtgggtctaaacatat

SEQ ID NO: 8782319 - DNA, 22 bp, Homo sapiens
atacatgtgggtctaaacatat

SEQ ID NO: 8782320 - DNA, 22 bp, Homo sapiens
ctggcagcttagcactctggtt

SEQ ID NO: 8782321 - DNA, 22 bp, Homo sapiens
ctggcagcttattagaaatgca

SEQ ID NO: 8782322 - DNA, 22 bp, Homo sapiens
ctggcagcttagcactctggtt

SEQ ID NO: 8782323 - DNA, 22 bp, Homo sapiens
atacatgtgtgagcgaagatgt

SEQ ID NO: 8782324 - DNA, 17 bp, Homo sapiens
atacatgtaaagtgctt

SEQ ID NO: 8782325 - DNA, 22 bp, Homo sapiens
atacatgtaactgcattgtaat

SEQ ID NO: 8782326 - DNA, 17 bp, Homo sapiens
atacatgtaaagtgctt

SEQ ID NO: 8782327 - DNA, 19 bp, Homo sapiens
atacatgcatttacatgct

SEQ ID NO: 8782328 - DNA, 22 bp, Homo sapiens
atacatgcgccatgttggtgtg

SEQ ID NO: 8782329 - DNA, 22 bp, Homo sapiens
atacatgatgggtgtatagttt

SEQ ID NO: 8782330 - DNA, 22 bp, Homo sapiens
ctggcacatagcaaatctcaac

SEQ ID NO: 8782331 - DNA, 22 bp, Homo sapiens
ctggcacagttaacatatgcta

SEQ ID NO: 8782332 - DNA, 20 bp, Homo sapiens
ctggcacagggtccgtcctt

SEQ ID NO: 8782333 - DNA, 20 bp, Homo sapiens
ctggcacagggtccgtcctt

SEQ ID NO: 8782334 - DNA, 22 bp, Homo sapiens
ctggcacagcttgggccccatc

SEQ ID NO: 8782335 - DNA, 22 bp, Homo sapiens
ctggcacagcttgggccccatc

SEQ ID NO: 8782336 - DNA, 22 bp, Homo sapiens
ctggcacagccactgcaggcag

SEQ ID NO: 8782337 - DNA, 22 bp, Homo sapiens
ctggcacagccactgcaggcag

SEQ ID NO: 8782338 - DNA, 22 bp, Homo sapiens
ctggcacagccactgcaggcag

SEQ ID NO: 8782339 - DNA, 22 bp, Homo sapiens
atatacagttttacagggtttc

SEQ ID NO: 8782340 - DNA, 19 bp, Homo sapiens
atatacatactgtgtgcat

SEQ ID NO: 8782341 - DNA, 19 bp, Homo sapiens
atatacatactgtgtgcat

SEQ ID NO: 8782342 - DNA, 19 bp, Homo sapiens
atatacatactgtgtgcat

SEQ ID NO: 8782343 - DNA, 22 bp, Homo sapiens
atatacaggtggtatgtgtaaa

SEQ ID NO: 8782344 - DNA, 22 bp, Homo sapiens
atatacatgggaatatgtggag

SEQ ID NO: 8782345 - DNA, 20 bp, Homo sapiens
atataccatcccacaacagg

SEQ ID NO: 8782346 - DNA, 20 bp, Homo sapiens
atataccatcccacaacagg

SEQ ID NO: 8782347 - DNA, 22 bp, Homo sapiens
atatacttggagactatcattg

SEQ ID NO: 8782348 - DNA, 22 bp, Homo sapiens
atatactgtaggccactataag

SEQ ID NO: 8782349 - DNA, 22 bp, Homo sapiens
ctgggagctggaatgggagaag

SEQ ID NO: 8782350 - DNA, 22 bp, Homo sapiens
ctgggagctggatgccctgccc

SEQ ID NO: 8782351 - DNA, 22 bp, Homo sapiens
ctgggagctggatgccctgccc

SEQ ID NO: 8782352 - DNA, 22 bp, Homo sapiens
ctgggagctgtcaggagcgtgt

SEQ ID NO: 8782353 - DNA, 22 bp, Homo sapiens
atatacttggagactatcattg

SEQ ID NO: 8782354 - DNA, 22 bp, Homo sapiens
atatacttggagactatcattg

SEQ ID NO: 8782355 - DNA, 22 bp, Homo sapiens
ctgggagctggaatgggagaag

SEQ ID NO: 8782356 - DNA, 22 bp, Homo sapiens
ctgggagaggaacctcgagggt

SEQ ID NO: 8782357 - DNA, 22 bp, Homo sapiens
atatacaggtggtatgtgtaaa

SEQ ID NO: 8782358 - DNA, 22 bp, Homo sapiens
atatacaggtggtatgtgtaaa

SEQ ID NO: 8782359 - DNA, 22 bp, Homo sapiens
atatacagtatgtactgtggtt

SEQ ID NO: 8782360 - DNA, 22 bp, Homo sapiens
atatacagttttacagggtttc

SEQ ID NO: 8782361 - DNA, 22 bp, Homo sapiens
atatacagtatgtactgtggtt

SEQ ID NO: 8782362 - DNA, 22 bp, Homo sapiens
atatacagtatgtactgtggtt

SEQ ID NO: 8782363 - DNA, 22 bp, Homo sapiens
atatacagggagaaacagctta

SEQ ID NO: 8782364 - DNA, 22 bp, Homo sapiens
atatacaggtggtatgtgtaaa

SEQ ID NO: 8782365 - DNA, 22 bp, Homo sapiens
atatacactgtttcagttgaag

SEQ ID NO: 8782366 - DNA, 22 bp, Homo sapiens
atatacagggagaaacagctta

SEQ ID NO: 8782367 - DNA, 22 bp, Homo sapiens
atatacactgtttcagttgaag

SEQ ID NO: 8782368 - DNA, 22 bp, Homo sapiens
atatacactccactgatacagg

SEQ ID NO: 8782369 - DNA, 22 bp, Homo sapiens
atatacactccactgatacagg

SEQ ID NO: 8782370 - DNA, 22 bp, Homo sapiens
atatacactccactgatacagg

SEQ ID NO: 8782371 - DNA, 22 bp, Homo sapiens
atatacactccactgatacagg

SEQ ID NO: 8782372 - DNA, 22 bp, Homo sapiens
atatacactcaccatggtattt

SEQ ID NO: 8782373 - DNA, 22 bp, Homo sapiens
atatacactcaccatggtattt

SEQ ID NO: 8782374 - DNA, 22 bp, Homo sapiens
atatacacatgtgtatacattt

SEQ ID NO: 8782375 - DNA, 22 bp, Homo sapiens
atatacacatgtgtatacattt

SEQ ID NO: 8782376 - DNA, 22 bp, Homo sapiens
atatacacatgtgtatacattt

SEQ ID NO: 8782377 - DNA, 22 bp, Homo sapiens
atatacacatgtgtatacattt

SEQ ID NO: 8782378 - DNA, 22 bp, Homo sapiens
atatacacatgtgtatacattt

SEQ ID NO: 8782379 - DNA, 22 bp, Homo sapiens
atatacacatttgcttatgtgt

SEQ ID NO: 8782380 - DNA, 19 bp, Homo sapiens
ctggctgcaatgccagggt

SEQ ID NO: 8782381 - DNA, 22 bp, Homo sapiens
ctggctgaggtcaccagtagct

SEQ ID NO: 8782382 - DNA, 22 bp, Homo sapiens
ctggctgatctcctgaatgtct

SEQ ID NO: 8782383 - DNA, 22 bp, Homo sapiens
ctggctgcaaaatctattcact

SEQ ID NO: 8782384 - DNA, 19 bp, Homo sapiens
ctggctgcaatgccagggt

SEQ ID NO: 8782385 - DNA, 22 bp, Homo sapiens
ctggctgattttctcacttctc

SEQ ID NO: 8782386 - DNA, 22 bp, Homo sapiens
ctggctgatctcctgaatgtct

SEQ ID NO: 8782387 - DNA, 22 bp, Homo sapiens
ctggctgatctcaatcatggct

SEQ ID NO: 8782388 - DNA, 22 bp, Homo sapiens
ctggctgaggcagagcctgggg

SEQ ID NO: 8782389 - DNA, 22 bp, Homo sapiens
ctggctgacaccttgatagcag

SEQ ID NO: 8782390 - DNA, 22 bp, Homo sapiens
ctggctgagctagagtccatgg

SEQ ID NO: 8782391 - DNA, 22 bp, Homo sapiens
ctggcctttcgtgagagctggg

SEQ ID NO: 8782392 - DNA, 19 bp, Homo sapiens
ctggcctgtgtcctgtgct

SEQ ID NO: 8782393 - DNA, 19 bp, Homo sapiens
ctggcctgtgtcctgtgct

SEQ ID NO: 8782394 - DNA, 19 bp, Homo sapiens
ctggcctgtgtcctgtgct

SEQ ID NO: 8782395 - DNA, 22 bp, Homo sapiens
ctggccttgaggaggccaccaa

SEQ ID NO: 8782396 - DNA, 22 bp, Homo sapiens
ctggccttggtgcttgcagaca

SEQ ID NO: 8782397 - DNA, 22 bp, Homo sapiens
ctggcctcggcagcaggaacag

SEQ ID NO: 8782398 - DNA, 22 bp, Homo sapiens
ctggcctcggcagcaggaacag

SEQ ID NO: 8782399 - DNA, 22 bp, Homo sapiens
ctggcctctctgagcagggagc

SEQ ID NO: 8782400 - DNA, 22 bp, Homo sapiens
ctggcctgtgggctgtctccgg

SEQ ID NO: 8782401 - DNA, 22 bp, Homo sapiens
ctggcctgtgggctgtctccgg

SEQ ID NO: 8782402 - DNA, 22 bp, Homo sapiens
ctggcctgtgggctgtctccgg

SEQ ID NO: 8782403 - DNA, 19 bp, Homo sapiens
ctggcctgtgtcctgtgct

SEQ ID NO: 8782404 - DNA, 19 bp, Homo sapiens
ctggcctgtgtcctgtgct

SEQ ID NO: 8782405 - DNA, 22 bp, Homo sapiens
atagtttgaaggctgttctact

SEQ ID NO: 8782406 - DNA, 22 bp, Homo sapiens
atagtttgctttaatacaactg

SEQ ID NO: 8782407 - DNA, 22 bp, Homo sapiens
ctggctcaatttgtactgctgt

SEQ ID NO: 8782408 - DNA, 22 bp, Homo sapiens
ctggctagcacctcagctcaga

SEQ ID NO: 8782409 - DNA, 22 bp, Homo sapiens
ctggcgagggtcgctggggact

SEQ ID NO: 8782410 - DNA, 22 bp, Homo sapiens
ctggcgagcaggaggcgacggc

SEQ ID NO: 8782411 - DNA, 22 bp, Homo sapiens
ctggctaaagagcaagaagatg

SEQ ID NO: 8782412 - DNA, 22 bp, Homo sapiens
atagttttatagatattgtgta

SEQ ID NO: 8782413 - DNA, 22 bp, Homo sapiens
atagttttatagatattgtgta

SEQ ID NO: 8782414 - DNA, 22 bp, Homo sapiens
atagttttatagatattgtgta

SEQ ID NO: 8782415 - DNA, 22 bp, Homo sapiens
atagttttaaaacctcaggaag

SEQ ID NO: 8782416 - DNA, 22 bp, Homo sapiens
atagttttctatgcactgttat

SEQ ID NO: 8782417 - DNA, 23 bp, Homo sapiens
atataaacaccagatagattgta

SEQ ID NO: 8782418 - DNA, 23 bp, Homo sapiens
atataaacaccagatagattgta

SEQ ID NO: 8782419 - DNA, 22 bp, Homo sapiens
atataaagaagtggaaaatgag

SEQ ID NO: 8782420 - DNA, 23 bp, Homo sapiens
atataaacaccagatagattgta

SEQ ID NO: 8782421 - DNA, 22 bp, Homo sapiens
atataaagaagtggaaaatgag

SEQ ID NO: 8782422 - DNA, 22 bp, Homo sapiens
atataaagagcttagtatagtg

SEQ ID NO: 8782423 - DNA, 22 bp, Homo sapiens
atataaagagcttagtatagtg

SEQ ID NO: 8782424 - DNA, 22 bp, Homo sapiens
ctggctctttcctagctaggct

SEQ ID NO: 8782425 - DNA, 22 bp, Homo sapiens
ctggctctttcctagctaggct

SEQ ID NO: 8782426 - DNA, 22 bp, Homo sapiens
ctggctctttcctagctaggct

SEQ ID NO: 8782427 - DNA, 22 bp, Homo sapiens
ctggctctttcctagctaggct

SEQ ID NO: 8782428 - DNA, 22 bp, Homo sapiens
ctggctctttcagccgctggag

SEQ ID NO: 8782429 - DNA, 19 bp, Homo sapiens
ctggctcttgggtggagga

SEQ ID NO: 8782430 - DNA, 22 bp, Homo sapiens
ctggctgaagctgggctctcct

SEQ ID NO: 8782431 - DNA, 22 bp, Homo sapiens
ctggctgaatcctagtctcata

SEQ ID NO: 8782432 - DNA, 22 bp, Homo sapiens
ctggctgacaaaataaatttta

SEQ ID NO: 8782433 - DNA, 22 bp, Homo sapiens
ctggctgacacaaaggtatcga

SEQ ID NO: 8782434 - DNA, 22 bp, Homo sapiens
ctggctgacaccttgatagcag

SEQ ID NO: 8782435 - DNA, 22 bp, Homo sapiens
atataaagtgtttagaaagctg

SEQ ID NO: 8782436 - DNA, 22 bp, Homo sapiens
atataaagtgtttagaaagctg

SEQ ID NO: 8782437 - DNA, 22 bp, Homo sapiens
atataaagtgtttagaaagctg

SEQ ID NO: 8782438 - DNA, 22 bp, Homo sapiens
ctggctcttggctagggagagt

SEQ ID NO: 8782439 - DNA, 19 bp, Homo sapiens
ctggctcttgggtggagga

SEQ ID NO: 8782440 - DNA, 22 bp, Homo sapiens
ctggctcttggctagggagagt

SEQ ID NO: 8782441 - DNA, 22 bp, Homo sapiens
ctggctcttggctagggagagt

SEQ ID NO: 8782442 - DNA, 22 bp, Homo sapiens
cttcaaatgtgattttaataac

SEQ ID NO: 8782443 - DNA, 22 bp, Homo sapiens
cttcaaatgtgattttaataac

SEQ ID NO: 8782444 - DNA, 22 bp, Homo sapiens
cttattcatatattctcggtag

SEQ ID NO: 8782445 - DNA, 22 bp, Homo sapiens
cttattcataagtcagacacac

SEQ ID NO: 8782446 - DNA, 22 bp, Homo sapiens
cttcaacatacacagagagagg

SEQ ID NO: 8782447 - DNA, 22 bp, Homo sapiens
cttcaacagttttagaacactg

SEQ ID NO: 8782448 - DNA, 22 bp, Homo sapiens
cttattcagcaagtttgggtac

SEQ ID NO: 8782449 - DNA, 22 bp, Homo sapiens
cttattcagatacagactcttg

SEQ ID NO: 8782450 - DNA, 22 bp, Homo sapiens
cttattcagcacttgctctgta

SEQ ID NO: 8782451 - DNA, 22 bp, Homo sapiens
cttattcagaaggagaaatgga

SEQ ID NO: 8782452 - DNA, 22 bp, Homo sapiens
cttattcagaaggagaaatgga

SEQ ID NO: 8782453 - DNA, 22 bp, Homo sapiens
cttattcagaaggagaaatgga

SEQ ID NO: 8782454 - DNA, 22 bp, Homo sapiens
cttattcagaccttggattctt

SEQ ID NO: 8782455 - DNA, 21 bp, Homo sapiens
cttattcactgttatttatca

SEQ ID NO: 8782456 - DNA, 22 bp, Homo sapiens
cttattcagaaggagaaatgga

SEQ ID NO: 8782457 - DNA, 22 bp, Homo sapiens
cttatgctgagaatgaaagaat

SEQ ID NO: 8782458 - DNA, 22 bp, Homo sapiens
cttatcttacttccccttcatg

SEQ ID NO: 8782459 - DNA, 19 bp, Homo sapiens
cttatgcagctgagcttgg

SEQ ID NO: 8782460 - DNA, 22 bp, Homo sapiens
cttagcaagcattcaagtgcct

SEQ ID NO: 8782461 - DNA, 22 bp, Homo sapiens
cttatgtataatgttccacata

SEQ ID NO: 8782462 - DNA, 22 bp, Homo sapiens
cttatgtacacacatatattgt

SEQ ID NO: 8782463 - DNA, 22 bp, Homo sapiens
cttattaatggaatcctaatga

SEQ ID NO: 8782464 - DNA, 22 bp, Homo sapiens
cttattcaatgctggaaatgtt

SEQ ID NO: 8782465 - DNA, 22 bp, Homo sapiens
cttattcaatgctggaaatgtt

SEQ ID NO: 8782466 - DNA, 22 bp, Homo sapiens
cttattatggcatgtaagtggg

SEQ ID NO: 8782467 - DNA, 22 bp, Homo sapiens
cttattataaaatcctgtttga

SEQ ID NO: 8782468 - DNA, 22 bp, Homo sapiens
cttattatggcatgtaagtggg

SEQ ID NO: 8782469 - DNA, 22 bp, Homo sapiens
cttcaagagaatgcagggatgt

SEQ ID NO: 8782470 - DNA, 22 bp, Homo sapiens
cttcaagagaatgcagggatgt

SEQ ID NO: 8782471 - DNA, 22 bp, Homo sapiens
cttcaagaagacagcagagcat

SEQ ID NO: 8782472 - DNA, 22 bp, Homo sapiens
cttcaagagaatgcagggatgt

SEQ ID NO: 8782473 - DNA, 22 bp, Homo sapiens
cttcaagatatttctagaatca

SEQ ID NO: 8782474 - DNA, 22 bp, Homo sapiens
cttcaagatatttctagaatca

SEQ ID NO: 8782475 - DNA, 22 bp, Homo sapiens
cttcaagtaattctgatggcta

SEQ ID NO: 8782476 - DNA, 22 bp, Homo sapiens
cttcaaggcttattccagttgt

SEQ ID NO: 8782477 - DNA, 22 bp, Homo sapiens
cttcaagtccagctcatgctct

SEQ ID NO: 8782478 - DNA, 22 bp, Homo sapiens
cttcaagttgggcggcgggcag

SEQ ID NO: 8782479 - DNA, 22 bp, Homo sapiens
cttcaagttgtctgagggtggg

SEQ ID NO: 8782480 - DNA, 22 bp, Homo sapiens
cttcacaaagctctctttatgt

SEQ ID NO: 8782481 - DNA, 22 bp, Homo sapiens
cttcacaaatggcctagagttc

SEQ ID NO: 8782482 - DNA, 22 bp, Homo sapiens
cttcacaaaatatttcattata

SEQ ID NO: 8782483 - DNA, 22 bp, Homo sapiens
cttcaattgccaccagctagca

SEQ ID NO: 8782484 - DNA, 22 bp, Homo sapiens
cttcaataggaactgcatggca

SEQ ID NO: 8782485 - DNA, 22 bp, Homo sapiens
cttcaatacctgcgttgctagt

SEQ ID NO: 8782486 - DNA, 22 bp, Homo sapiens
cttccttctgaagcatagaagc

SEQ ID NO: 8782487 - DNA, 22 bp, Homo sapiens
cttccttctgaagcatagaagc

SEQ ID NO: 8782488 - DNA, 22 bp, Homo sapiens
cttccttctgtaagaccagttg

SEQ ID NO: 8782489 - DNA, 22 bp, Homo sapiens
cttccttgcggcccctgcctag

SEQ ID NO: 8782490 - DNA, 22 bp, Homo sapiens
cttccttgcggcccctgcctag

SEQ ID NO: 8782491 - DNA, 22 bp, Homo sapiens
cttccttgctgtctgctccagg

SEQ ID NO: 8782492 - DNA, 19 bp, Homo sapiens
cttccttgctccccatgtg

SEQ ID NO: 8782493 - DNA, 22 bp, Homo sapiens
cttccttccttccccgaaatgc

SEQ ID NO: 8782494 - DNA, 22 bp, Homo sapiens
cttccttctcactagcagcgcc

SEQ ID NO: 8782495 - DNA, 22 bp, Homo sapiens
cttcctctcttgcccataagag

SEQ ID NO: 8782496 - DNA, 22 bp, Homo sapiens
cttcctctcttgcccataagag

SEQ ID NO: 8782497 - DNA, 22 bp, Homo sapiens
cttcctctcaataagatgagaa

SEQ ID NO: 8782498 - DNA, 22 bp, Homo sapiens
cttcctctcttgcccataagag

SEQ ID NO: 8782499 - DNA, 22 bp, Homo sapiens
cttcctctcttgcccataagag

SEQ ID NO: 8782500 - DNA, 22 bp, Homo sapiens
cttcctctcaataagatgagaa

SEQ ID NO: 8782501 - DNA, 22 bp, Homo sapiens
cttcctctcaataagatgagaa

SEQ ID NO: 8782502 - DNA, 22 bp, Homo sapiens
cttcctctcaataagatgagaa

SEQ ID NO: 8782503 - DNA, 22 bp, Homo sapiens
cttcctctatgttcaggtagaa

SEQ ID NO: 8782504 - DNA, 22 bp, Homo sapiens
cttcctctatgttcaggtagaa

SEQ ID NO: 8782505 - DNA, 22 bp, Homo sapiens
cttcctctatgttcaggtagaa

SEQ ID NO: 8782506 - DNA, 22 bp, Homo sapiens
cttatctcatttaatcatcaca

SEQ ID NO: 8782507 - DNA, 22 bp, Homo sapiens
cttatctgtaaaatggatacaa

SEQ ID NO: 8782508 - DNA, 22 bp, Homo sapiens
cttagatgaagtcacagaaccc

SEQ ID NO: 8782509 - DNA, 22 bp, Homo sapiens
atccatttgacataatttcagc

SEQ ID NO: 8782510 - DNA, 22 bp, Homo sapiens
atccatttcctccactataaag

SEQ ID NO: 8782511 - DNA, 22 bp, Homo sapiens
atccatgattgcccagaggtgt

SEQ ID NO: 8782512 - DNA, 23 bp, Homo sapiens
atccatgtgagaatagactagca

SEQ ID NO: 8782513 - DNA, 22 bp, Homo sapiens
atccatgttcataagaattgta

SEQ ID NO: 8782514 - DNA, 18 bp, Homo sapiens
atccatttaatgcctgga

SEQ ID NO: 8782515 - DNA, 22 bp, Homo sapiens
cttaataaatggtagctgttat

SEQ ID NO: 8782516 - DNA, 22 bp, Homo sapiens
cttaatctcacctgcaaagtcc

SEQ ID NO: 8782517 - DNA, 22 bp, Homo sapiens
cttaatctcacctgcaaagtcc

SEQ ID NO: 8782518 - DNA, 22 bp, Homo sapiens
cttaatctcacctgcaaagtcc

SEQ ID NO: 8782519 - DNA, 22 bp, Homo sapiens
cttaatctcacctgcaaagtcc

SEQ ID NO: 8782520 - DNA, 22 bp, Homo sapiens
cttaatcatggcttgtgggagg

SEQ ID NO: 8782521 - DNA, 22 bp, Homo sapiens
cttaatgtcctctttctgagct

SEQ ID NO: 8782522 - DNA, 20 bp, Homo sapiens
atccatcagagaaaataaag

SEQ ID NO: 8782523 - DNA, 22 bp, Homo sapiens
cttaagaatattgaagttgtgg

SEQ ID NO: 8782524 - DNA, 22 bp, Homo sapiens
cttaagaagcaagtctcagcaa

SEQ ID NO: 8782525 - DNA, 22 bp, Homo sapiens
cttaagaagcaagtctcagcaa

SEQ ID NO: 8782526 - DNA, 22 bp, Homo sapiens
cttaagaaattgcattctaatc

SEQ ID NO: 8782527 - DNA, 22 bp, Homo sapiens
cttaagcaaaatattctttcac

SEQ ID NO: 8782528 - DNA, 22 bp, Homo sapiens
cttaagattgtcagcttcagcc

SEQ ID NO: 8782529 - DNA, 21 bp, Homo sapiens
cttaagatggcatagtacgaa

SEQ ID NO: 8782530 - DNA, 22 bp, Homo sapiens
cttaagattgtcagcttcagcc

SEQ ID NO: 8782531 - DNA, 22 bp, Homo sapiens
cttaacagcaagatctgtgtca

SEQ ID NO: 8782532 - DNA, 22 bp, Homo sapiens
cttaacagatacatctgtggtt

SEQ ID NO: 8782533 - DNA, 20 bp, Homo sapiens
cttaacaatggctctgatga

SEQ ID NO: 8782534 - DNA, 22 bp, Homo sapiens
cttaagaaattgcattctaatc

SEQ ID NO: 8782535 - DNA, 22 bp, Homo sapiens
cttaagaaattgcattctaatc

SEQ ID NO: 8782536 - DNA, 22 bp, Homo sapiens
cttaacttgatgtctctctgct

SEQ ID NO: 8782537 - DNA, 22 bp, Homo sapiens
atcatacatgtaactaagtaaa

SEQ ID NO: 8782538 - DNA, 19 bp, Homo sapiens
atcatcactcatggtcctg

SEQ ID NO: 8782539 - DNA, 22 bp, Homo sapiens
atcatagaggaaaatccacgtt

SEQ ID NO: 8782540 - DNA, 22 bp, Homo sapiens
atcataggatttaggtccatct

SEQ ID NO: 8782541 - DNA, 23 bp, Homo sapiens
atcataggccctagagagaaggc

SEQ ID NO: 8782542 - DNA, 22 bp, Homo sapiens
atcatcatcaacaagaaacatt

SEQ ID NO: 8782543 - DNA, 22 bp, Homo sapiens
ctgtttctccacactcttccca

SEQ ID NO: 8782544 - DNA, 22 bp, Homo sapiens
ctgtttctccacactcttccca

SEQ ID NO: 8782545 - DNA, 22 bp, Homo sapiens
cttaacaagcccaactttcatt

SEQ ID NO: 8782546 - DNA, 22 bp, Homo sapiens
atctctccttatgaagcattat

SEQ ID NO: 8782547 - DNA, 22 bp, Homo sapiens
atctctagctaaccctctggca

SEQ ID NO: 8782548 - DNA, 17 bp, Homo sapiens
atctctctaaggcaggc

SEQ ID NO: 8782549 - DNA, 22 bp, Homo sapiens
atctctctatgcactgaggact

SEQ ID NO: 8782550 - DNA, 22 bp, Homo sapiens
atctctctgcccaggggctgtg

SEQ ID NO: 8782551 - DNA, 15 bp, Homo sapiens
atctctctagctgct

SEQ ID NO: 8782552 - DNA, 23 bp, Homo sapiens
atctctctggtggtcacagtcag

SEQ ID NO: 8782553 - DNA, 22 bp, Homo sapiens
cttctgagatgttgttttacag

SEQ ID NO: 8782554 - DNA, 22 bp, Homo sapiens
cttctgacccctggtctacagc

SEQ ID NO: 8782555 - DNA, 23 bp, Homo sapiens
atctctctttattcttggggata

SEQ ID NO: 8782556 - DNA, 22 bp, Homo sapiens
cttctccttatatgtcccgttc

SEQ ID NO: 8782557 - DNA, 22 bp, Homo sapiens
cttctccttatatgtcccgttc

SEQ ID NO: 8782558 - DNA, 22 bp, Homo sapiens
cttctccttatatgtcccgttc

SEQ ID NO: 8782559 - DNA, 22 bp, Homo sapiens
cttctcggccgtgtggatgcgc

SEQ ID NO: 8782560 - DNA, 22 bp, Homo sapiens
cttctcggccgtgtggatgcgc

SEQ ID NO: 8782561 - DNA, 21 bp, Homo sapiens
atctcgggcttctcgcccagc

SEQ ID NO: 8782562 - DNA, 22 bp, Homo sapiens
atctccttggatcacgtttagt

SEQ ID NO: 8782563 - DNA, 22 bp, Homo sapiens
atctctaatttaaaaagtaaca

SEQ ID NO: 8782564 - DNA, 22 bp, Homo sapiens
atctctaaagtctgttcagctc

SEQ ID NO: 8782565 - DNA, 22 bp, Homo sapiens
cttccttgtggtccttctcatt

SEQ ID NO: 8782566 - DNA, 22 bp, Homo sapiens
cttccttggcttctggggtgtg

SEQ ID NO: 8782567 - DNA, 22 bp, Homo sapiens
cttccttggcttctggggtgtg

SEQ ID NO: 8782568 - DNA, 22 bp, Homo sapiens
cttctgcccctgtagcctgagt

SEQ ID NO: 8782569 - DNA, 22 bp, Homo sapiens
cttctgtgcgcctctattccct

SEQ ID NO: 8782570 - DNA, 22 bp, Homo sapiens
cttctgtgcgcctctattccct

SEQ ID NO: 8782571 - DNA, 22 bp, Homo sapiens
cttctgtgcaattgtggaggag

SEQ ID NO: 8782572 - DNA, 22 bp, Homo sapiens
cttctgtgctaaatgcaaaacc

SEQ ID NO: 8782573 - DNA, 22 bp, Homo sapiens
cttctgtgcgcctctattccct

SEQ ID NO: 8782574 - DNA, 22 bp, Homo sapiens
cttctgtgttttactatatgta

SEQ ID NO: 8782575 - DNA, 22 bp, Homo sapiens
cttctgtgttaaatgagtcttt

SEQ ID NO: 8782576 - DNA, 22 bp, Homo sapiens
cttctgtgttaaatgagtcttt

SEQ ID NO: 8782577 - DNA, 22 bp, Homo sapiens
cttctgtggatgttggatgcat

SEQ ID NO: 8782578 - DNA, 22 bp, Homo sapiens
cttctgtggtaaactttgttgt

SEQ ID NO: 8782579 - DNA, 22 bp, Homo sapiens
cttctgtggtaaactttgttgt

SEQ ID NO: 8782580 - DNA, 22 bp, Homo sapiens
cttctgtggatatgttctctct

SEQ ID NO: 8782581 - DNA, 22 bp, Homo sapiens
cttctgtgcaattgtggaggag

SEQ ID NO: 8782582 - DNA, 19 bp, Homo sapiens
cttctgatggaaagccaac

SEQ ID NO: 8782583 - DNA, 22 bp, Homo sapiens
cttctgcaagagcatcagttgt

SEQ ID NO: 8782584 - DNA, 22 bp, Homo sapiens
cttctgcactgaccttttgtcc

SEQ ID NO: 8782585 - DNA, 19 bp, Homo sapiens
cttctgcagggtgacagtg

SEQ ID NO: 8782586 - DNA, 22 bp, Homo sapiens
cttctgcaggccttattttagt

SEQ ID NO: 8782587 - DNA, 22 bp, Homo sapiens
cttctgcaggccttattttagt

SEQ ID NO: 8782588 - DNA, 22 bp, Homo sapiens
cttctgcaggagtcaactctgg

SEQ ID NO: 8782589 - DNA, 22 bp, Homo sapiens
cttctgcaggccctgtctgacc

SEQ ID NO: 8782590 - DNA, 22 bp, Homo sapiens
cttctgcaggccctgtctgacc

SEQ ID NO: 8782591 - DNA, 22 bp, Homo sapiens
cttctgcagaattaattcacta

SEQ ID NO: 8782592 - DNA, 22 bp, Homo sapiens
cttctgagcagacctcctgggg

SEQ ID NO: 8782593 - DNA, 22 bp, Homo sapiens
cttctgagatgttgttttacag

SEQ ID NO: 8782594 - DNA, 22 bp, Homo sapiens
cttctgagcagacctcctgggg

SEQ ID NO: 8782595 - DNA, 22 bp, Homo sapiens
cttctgagggcctttgcttcca

SEQ ID NO: 8782596 - DNA, 22 bp, Homo sapiens
cttctgagggcctttgcttcca

SEQ ID NO: 8782597 - DNA, 22 bp, Homo sapiens
atctgtggctggtgagaggcag

SEQ ID NO: 8782598 - DNA, 22 bp, Homo sapiens
atctgtgtatgaaagtataact

SEQ ID NO: 8782599 - DNA, 22 bp, Homo sapiens
atctgtgtatgaaagtataact

SEQ ID NO: 8782600 - DNA, 22 bp, Homo sapiens
atctgtggcgcaaacaaaggct

SEQ ID NO: 8782601 - DNA, 22 bp, Homo sapiens
atctgtgtgttattgtttatca

SEQ ID NO: 8782602 - DNA, 23 bp, Homo sapiens
atctgtgtgtgggtagggatgat

SEQ ID NO: 8782603 - DNA, 22 bp, Homo sapiens
atctgtgtgttcaggaagtcct

SEQ ID NO: 8782604 - DNA, 22 bp, Homo sapiens
atctgtgtgttcaggaagtcct

SEQ ID NO: 8782605 - DNA, 22 bp, Homo sapiens
atctgtgtccttataagagaca

SEQ ID NO: 8782606 - DNA, 22 bp, Homo sapiens
atctgtgtccttataagagaca

SEQ ID NO: 8782607 - DNA, 22 bp, Homo sapiens
atctgtgtatgtgaccttatct

SEQ ID NO: 8782608 - DNA, 22 bp, Homo sapiens
atctgtgtatgtgaccttatct

SEQ ID NO: 8782609 - DNA, 22 bp, Homo sapiens
atctgtgtatgtgaccttatct

SEQ ID NO: 8782610 - DNA, 23 bp, Homo sapiens
atctgttcatctgacacagattc

SEQ ID NO: 8782611 - DNA, 22 bp, Homo sapiens
atctgttattgaataggtgcta

SEQ ID NO: 8782612 - DNA, 22 bp, Homo sapiens
atctgttatttacccatctctg

SEQ ID NO: 8782613 - DNA, 22 bp, Homo sapiens
atctgtgtgttgagttctcagc

SEQ ID NO: 8782614 - DNA, 22 bp, Homo sapiens
atctgttaacaaagaagacagc

SEQ ID NO: 8782615 - DNA, 22 bp, Homo sapiens
atctgttaacaaagaagacagc

SEQ ID NO: 8782616 - DNA, 22 bp, Homo sapiens
atctgtgtgttcaggaagtcct

SEQ ID NO: 8782617 - DNA, 22 bp, Homo sapiens
atctgtgtgttcaggaagtcct

SEQ ID NO: 8782618 - DNA, 22 bp, Homo sapiens
atcttcaaagaatttcttgtcc

SEQ ID NO: 8782619 - DNA, 22 bp, Homo sapiens
atctgttcttgtgtcagtaatt

SEQ ID NO: 8782620 - DNA, 22 bp, Homo sapiens
atctgtggatatgaccttcctg

SEQ ID NO: 8782621 - DNA, 22 bp, Homo sapiens
atctgtgatcaagacagacagt

SEQ ID NO: 8782622 - DNA, 22 bp, Homo sapiens
atctgtgagaaaggcttgtgct

SEQ ID NO: 8782623 - DNA, 22 bp, Homo sapiens
atctgtctatgatatagtctgt

SEQ ID NO: 8782624 - DNA, 22 bp, Homo sapiens
atctgtctatgatatagtctgt

SEQ ID NO: 8782625 - DNA, 22 bp, Homo sapiens
atctgtctatgtggctatgtat

SEQ ID NO: 8782626 - DNA, 22 bp, Homo sapiens
atctgtctgggtgcagcagtcc

SEQ ID NO: 8782627 - DNA, 22 bp, Homo sapiens
atctgtcctccagcatctccat

SEQ ID NO: 8782628 - DNA, 22 bp, Homo sapiens
atctggtgctaacaaatgtgga

SEQ ID NO: 8782629 - DNA, 22 bp, Homo sapiens
atctggtatgaggttttgcttt

SEQ ID NO: 8782630 - DNA, 22 bp, Homo sapiens
atctggtgacacgaggagctgg

SEQ ID NO: 8782631 - DNA, 22 bp, Homo sapiens
atctggtgctaacaaatgtgga

SEQ ID NO: 8782632 - DNA, 22 bp, Homo sapiens
atctggttcttcttaggcatca

SEQ ID NO: 8782633 - DNA, 22 bp, Homo sapiens
atctggctctctcatttacaaa

SEQ ID NO: 8782634 - DNA, 22 bp, Homo sapiens
atctggctcctacacttgaaga

SEQ ID NO: 8782635 - DNA, 22 bp, Homo sapiens
cttcttaaagattacacaatga

SEQ ID NO: 8782636 - DNA, 22 bp, Homo sapiens
cttctgtgttttactatatgta

SEQ ID NO: 8782637 - DNA, 22 bp, Homo sapiens
cttctgtgttttactatatgta

SEQ ID NO: 8782638 - DNA, 22 bp, Homo sapiens
cttcttaaagttgtcacagctg

SEQ ID NO: 8782639 - DNA, 22 bp, Homo sapiens
cttcttaaatatttggctgact

SEQ ID NO: 8782640 - DNA, 22 bp, Homo sapiens
cttcttaaattggattgctatt

SEQ ID NO: 8782641 - DNA, 22 bp, Homo sapiens
cttcttaaattggattgctatt

SEQ ID NO: 8782642 - DNA, 22 bp, Homo sapiens
cttcttaactgtatatactatg

SEQ ID NO: 8782643 - DNA, 22 bp, Homo sapiens
atctggttcttcttaggcatca

SEQ ID NO: 8782644 - DNA, 22 bp, Homo sapiens
atctggttctttgtatttcctt

SEQ ID NO: 8782645 - DNA, 22 bp, Homo sapiens
atctggttttggctgtgtccct

SEQ ID NO: 8782646 - DNA, 22 bp, Homo sapiens
atctggttttggctgtgtccct

SEQ ID NO: 8782647 - DNA, 22 bp, Homo sapiens
atctgtaacatcagtagcagaa

SEQ ID NO: 8782648 - DNA, 22 bp, Homo sapiens
atctgtaaatgcaaatgtagct

SEQ ID NO: 8782649 - DNA, 22 bp, Homo sapiens
atctgtcaggagcaaggactac

SEQ ID NO: 8782650 - DNA, 22 bp, Homo sapiens
atctgtcaggagcaaggactac

SEQ ID NO: 8782651 - DNA, 22 bp, Homo sapiens
atctgtcaagatagactctgca

SEQ ID NO: 8782652 - DNA, 22 bp, Homo sapiens
atctgtatgttgacctcctaga

SEQ ID NO: 8782653 - DNA, 22 bp, Homo sapiens
atctgtagaagatactctgaga

SEQ ID NO: 8782654 - DNA, 22 bp, Homo sapiens
atctgtaattttgaatgcaaat

SEQ ID NO: 8782655 - DNA, 22 bp, Homo sapiens
atctgtaattttgaatgcaaat

SEQ ID NO: 8782656 - DNA, 22 bp, Homo sapiens
atattcaaattacatttactaa

SEQ ID NO: 8782657 - DNA, 22 bp, Homo sapiens
atattcaaattacatttactaa

SEQ ID NO: 8782658 - DNA, 22 bp, Homo sapiens
atattcaaattacatttactaa

SEQ ID NO: 8782659 - DNA, 22 bp, Homo sapiens
atattattttccctggagttgt

SEQ ID NO: 8782660 - DNA, 22 bp, Homo sapiens
atattattttccctggagttgt

SEQ ID NO: 8782661 - DNA, 22 bp, Homo sapiens
atattattttccctggagttgt

SEQ ID NO: 8782662 - DNA, 22 bp, Homo sapiens
atattcactcctggtgagacta

SEQ ID NO: 8782663 - DNA, 23 bp, Homo sapiens
atattcacgccgccagaggtccc

SEQ ID NO: 8782664 - DNA, 22 bp, Homo sapiens
atattcacagatagaaggttct

SEQ ID NO: 8782665 - DNA, 18 bp, Homo sapiens
ctgggtctccaggctgcc

SEQ ID NO: 8782666 - DNA, 18 bp, Homo sapiens
ctgggtctccaggctgcc

SEQ ID NO: 8782667 - DNA, 22 bp, Homo sapiens
atattcaagtgaggatggctaa

SEQ ID NO: 8782668 - DNA, 22 bp, Homo sapiens
atattcacactgtttagttaca

SEQ ID NO: 8782669 - DNA, 22 bp, Homo sapiens
atattcacactgtttagttaca

SEQ ID NO: 8782670 - DNA, 18 bp, Homo sapiens
atattcaagaagacagag

SEQ ID NO: 8782671 - DNA, 18 bp, Homo sapiens
atattcaagaagacagag

SEQ ID NO: 8782672 - DNA, 18 bp, Homo sapiens
atattcaagaagacagag

SEQ ID NO: 8782673 - DNA, 18 bp, Homo sapiens
atattcaagaagacagag

SEQ ID NO: 8782674 - DNA, 18 bp, Homo sapiens
atattcaagaagacagag

SEQ ID NO: 8782675 - DNA, 22 bp, Homo sapiens
ctgggtggatcgcagccccagg

SEQ ID NO: 8782676 - DNA, 20 bp, Homo sapiens
ctgggtggcaagcaaggggg

SEQ ID NO: 8782677 - DNA, 22 bp, Homo sapiens
ctgggtggcagagcctgcagtg

SEQ ID NO: 8782678 - DNA, 22 bp, Homo sapiens
ctgggtggcgtctggggccagt

SEQ ID NO: 8782679 - DNA, 22 bp, Homo sapiens
ctgggtggcagagcctgcagtg

SEQ ID NO: 8782680 - DNA, 22 bp, Homo sapiens
ctgggtggcagagcctgcagtg

SEQ ID NO: 8782681 - DNA, 20 bp, Homo sapiens
ctgggtggcaagcaaggggg

SEQ ID NO: 8782682 - DNA, 20 bp, Homo sapiens
ctgggtggcaagcaaggggg

SEQ ID NO: 8782683 - DNA, 20 bp, Homo sapiens
ctgggtggcaagcaaggggg

SEQ ID NO: 8782684 - DNA, 22 bp, Homo sapiens
ctggtccctgcagtgtgctggg

SEQ ID NO: 8782685 - DNA, 22 bp, Homo sapiens
ctggtccctgcagtgtgctggg

SEQ ID NO: 8782686 - DNA, 22 bp, Homo sapiens
ctggtccccagactgggcttag

SEQ ID NO: 8782687 - DNA, 22 bp, Homo sapiens
ctggtccctgagtagttatgca

SEQ ID NO: 8782688 - DNA, 22 bp, Homo sapiens
ctggtcctccttgccttcagat

SEQ ID NO: 8782689 - DNA, 22 bp, Homo sapiens
ctggtcctccttgccttcagat

SEQ ID NO: 8782690 - DNA, 22 bp, Homo sapiens
ctggtcctaaagccctactcca

SEQ ID NO: 8782691 - DNA, 22 bp, Homo sapiens
atcaagaatgttcattcttcta

SEQ ID NO: 8782692 - DNA, 22 bp, Homo sapiens
atcaagaacttattttggaaat

SEQ ID NO: 8782693 - DNA, 22 bp, Homo sapiens
ctggtccagttgtctcctaagc

SEQ ID NO: 8782694 - DNA, 17 bp, Homo sapiens
ctggtcccaccaagccc

SEQ ID NO: 8782695 - DNA, 22 bp, Homo sapiens
ctggtcccagaggcaagagatg

SEQ ID NO: 8782696 - DNA, 22 bp, Homo sapiens
ctggtcccagctctgccaccaa

SEQ ID NO: 8782697 - DNA, 22 bp, Homo sapiens
ctggtcccatcctggcttcatg

SEQ ID NO: 8782698 - DNA, 22 bp, Homo sapiens
ctggtcccatcctggcttcatg

SEQ ID NO: 8782699 - DNA, 22 bp, Homo sapiens
ctggtcccagctctgccaccaa

SEQ ID NO: 8782700 - DNA, 22 bp, Homo sapiens
ctggtcccagcagagctctgag

SEQ ID NO: 8782701 - DNA, 22 bp, Homo sapiens
ctggtcatcactctaacagact

SEQ ID NO: 8782702 - DNA, 22 bp, Homo sapiens
ctggtccagaatttatgattct

SEQ ID NO: 8782703 - DNA, 22 bp, Homo sapiens
ctggtcagggtagtgttgcaga

SEQ ID NO: 8782704 - DNA, 22 bp, Homo sapiens
ctggtcagggtagtgttgcaga

SEQ ID NO: 8782705 - DNA, 22 bp, Homo sapiens
ctggtcaggggatggggctcag

SEQ ID NO: 8782706 - DNA, 22 bp, Homo sapiens
ctggtcaggctgaactgccaca

SEQ ID NO: 8782707 - DNA, 18 bp, Homo sapiens
ctggtcagggcaatgggc

SEQ ID NO: 8782708 - DNA, 22 bp, Homo sapiens
ctgggtggctgtccagccagcc

SEQ ID NO: 8782709 - DNA, 22 bp, Homo sapiens
ctgggtggcgtctggggccagt

SEQ ID NO: 8782710 - DNA, 22 bp, Homo sapiens
ctggtcaggaaggtggggacag

SEQ ID NO: 8782711 - DNA, 22 bp, Homo sapiens
ctgggtggctgtccagccagcc

SEQ ID NO: 8782712 - DNA, 22 bp, Homo sapiens
ctgggtggctgtccagccagcc

SEQ ID NO: 8782713 - DNA, 22 bp, Homo sapiens
ctgggtggcgtctggggccagt

SEQ ID NO: 8782714 - DNA, 22 bp, Homo sapiens
ctgggaggcggaggttgtagtg

SEQ ID NO: 8782715 - DNA, 20 bp, Homo sapiens
ctgggaggtcttccaaatca

SEQ ID NO: 8782716 - DNA, 20 bp, Homo sapiens
ctgggaggtcttccaaatca

SEQ ID NO: 8782717 - DNA, 22 bp, Homo sapiens
ctgggaggggtagccaatccta

SEQ ID NO: 8782718 - DNA, 22 bp, Homo sapiens
ctgggaggggtagccaatccta

SEQ ID NO: 8782719 - DNA, 22 bp, Homo sapiens
ctgggaggggtagccaatccta

SEQ ID NO: 8782720 - DNA, 22 bp, Homo sapiens
ctgggaggggtagccaatccta

SEQ ID NO: 8782721 - DNA, 22 bp, Homo sapiens
ctgggaggggtagccaatccta

SEQ ID NO: 8782722 - DNA, 22 bp, Homo sapiens
ctgggaggtgaacagaaaaact

SEQ ID NO: 8782723 - DNA, 22 bp, Homo sapiens
ctgggaggtgcagcaaaaatca

SEQ ID NO: 8782724 - DNA, 22 bp, Homo sapiens
ctgggaggtggaggttgcattg

SEQ ID NO: 8782725 - DNA, 22 bp, Homo sapiens
ctgggaggtggaggttgcattg

SEQ ID NO: 8782726 - DNA, 22 bp, Homo sapiens
ctgggaggatacacaagatcag

SEQ ID NO: 8782727 - DNA, 22 bp, Homo sapiens
ctgggaggacaacttggagctc

SEQ ID NO: 8782728 - DNA, 22 bp, Homo sapiens
ctgggaggattcattgaggtga

SEQ ID NO: 8782729 - DNA, 22 bp, Homo sapiens
ctgggaggcggaggttgcagtg

SEQ ID NO: 8782730 - DNA, 22 bp, Homo sapiens
ctgggaggcggaggttgcagtg

SEQ ID NO: 8782731 - DNA, 22 bp, Homo sapiens
ctgggaggcggaggttgcagtg

SEQ ID NO: 8782732 - DNA, 22 bp, Homo sapiens
ctgggagcttttagaaatgcag

SEQ ID NO: 8782733 - DNA, 22 bp, Homo sapiens
ctgggaggacaacttggagctc

SEQ ID NO: 8782734 - DNA, 22 bp, Homo sapiens
ctgggagcttgttaggaatgca

SEQ ID NO: 8782735 - DNA, 22 bp, Homo sapiens
atattattctagtaacagtgat

SEQ ID NO: 8782736 - DNA, 22 bp, Homo sapiens
atattattctagtaacagtgat

SEQ ID NO: 8782737 - DNA, 22 bp, Homo sapiens
atattattctagctcttgtgtg

SEQ ID NO: 8782738 - DNA, 22 bp, Homo sapiens
atattattctagctcttgtgtg

SEQ ID NO: 8782739 - DNA, 22 bp, Homo sapiens
atattattctagctcttgtgtg

SEQ ID NO: 8782740 - DNA, 22 bp, Homo sapiens
atattattctagctcttgtgtg

SEQ ID NO: 8782741 - DNA, 22 bp, Homo sapiens
atattattctagctcttgtgtg

SEQ ID NO: 8782742 - DNA, 22 bp, Homo sapiens
ctgggggcaatggtcagagtgt

SEQ ID NO: 8782743 - DNA, 19 bp, Homo sapiens
ctggggctttggtactgcc

SEQ ID NO: 8782744 - DNA, 22 bp, Homo sapiens
ctgggggcaagcagacagctgt

SEQ ID NO: 8782745 - DNA, 22 bp, Homo sapiens
ctgggggcaagcagacagctgt

SEQ ID NO: 8782746 - DNA, 22 bp, Homo sapiens
ctgggggcaagcagacagctgt

SEQ ID NO: 8782747 - DNA, 22 bp, Homo sapiens
ctgggggcaagcagacagctgt

SEQ ID NO: 8782748 - DNA, 22 bp, Homo sapiens
ctggggctgtgggagacaaggc

SEQ ID NO: 8782749 - DNA, 22 bp, Homo sapiens
ctggggcttcaatgcttcggtg

SEQ ID NO: 8782750 - DNA, 22 bp, Homo sapiens
ctggggcttcaatgcttcggtg

SEQ ID NO: 8782751 - DNA, 19 bp, Homo sapiens
ctgggaggtgttcagagaa

SEQ ID NO: 8782752 - DNA, 22 bp, Homo sapiens
ctggggcatctgacagataaat

SEQ ID NO: 8782753 - DNA, 22 bp, Homo sapiens
ctggggctgtaggaggacttat

SEQ ID NO: 8782754 - DNA, 22 bp, Homo sapiens
ctggggctgtgggagacaaggc

SEQ ID NO: 8782755 - DNA, 22 bp, Homo sapiens
atcagtttctaccatgtggaat

SEQ ID NO: 8782756 - DNA, 22 bp, Homo sapiens
atcagtttcacttgcttgcaaa

SEQ ID NO: 8782757 - DNA, 22 bp, Homo sapiens
atcagtttggtgctttcagtga

SEQ ID NO: 8782758 - DNA, 22 bp, Homo sapiens
atcagtttggaacattcaggcc

SEQ ID NO: 8782759 - DNA, 22 bp, Homo sapiens
atcagtttgataataaggcttg

SEQ ID NO: 8782760 - DNA, 22 bp, Homo sapiens
atcagttttgttcactactata

SEQ ID NO: 8782761 - DNA, 22 bp, Homo sapiens
atcagtttgtatatgaaacact

SEQ ID NO: 8782762 - DNA, 22 bp, Homo sapiens
atcagtttgtatatgaaacact

SEQ ID NO: 8782763 - DNA, 22 bp, Homo sapiens
atcataaaattgcaccatttct

SEQ ID NO: 8782764 - DNA, 22 bp, Homo sapiens
atcataaaattgcaccatttct

SEQ ID NO: 8782765 - DNA, 22 bp, Homo sapiens
atcataaaattgcaccatttct

SEQ ID NO: 8782766 - DNA, 22 bp, Homo sapiens
atcagtttttattaatgtagct

SEQ ID NO: 8782767 - DNA, 22 bp, Homo sapiens
atcagtttttattaatgtagct

SEQ ID NO: 8782768 - DNA, 22 bp, Homo sapiens
atcataaagtgctatctgattg

SEQ ID NO: 8782769 - DNA, 22 bp, Homo sapiens
atcataaagtgctatctgattg

SEQ ID NO: 8782770 - DNA, 22 bp, Homo sapiens
atcataagacccagccagtatt

SEQ ID NO: 8782771 - DNA, 22 bp, Homo sapiens
atcatacactcacataaacaga

SEQ ID NO: 8782772 - DNA, 22 bp, Homo sapiens
atcatacactcacataaacaga

SEQ ID NO: 8782773 - DNA, 22 bp, Homo sapiens
atcataaagtgctatctgattg

SEQ ID NO: 8782774 - DNA, 22 bp, Homo sapiens
atcataaagtgctatctgattg

SEQ ID NO: 8782775 - DNA, 22 bp, Homo sapiens
atcataaaccactttgtaatct

SEQ ID NO: 8782776 - DNA, 22 bp, Homo sapiens
ctgtctccgccctcttggtagg

SEQ ID NO: 8782777 - DNA, 22 bp, Homo sapiens
ctgtctcctccactgcatggga

SEQ ID NO: 8782778 - DNA, 22 bp, Homo sapiens
atcaggtgatgctctggttccc

SEQ ID NO: 8782779 - DNA, 22 bp, Homo sapiens
atcaggtgaagtcactgagtgg

SEQ ID NO: 8782780 - DNA, 22 bp, Homo sapiens
ctgtctctgataagctcgaggg

SEQ ID NO: 8782781 - DNA, 22 bp, Homo sapiens
ctgtctctgataagctcgaggg

SEQ ID NO: 8782782 - DNA, 22 bp, Homo sapiens
ctgtcgtgttcactgtggccta

SEQ ID NO: 8782783 - DNA, 22 bp, Homo sapiens
ctgtcgtgttcactgtggccta

SEQ ID NO: 8782784 - DNA, 20 bp, Homo sapiens
ctgtccttttgttggaagac

SEQ ID NO: 8782785 - DNA, 23 bp, Homo sapiens
ctgtccttggtcttggctgagtg

SEQ ID NO: 8782786 - DNA, 22 bp, Homo sapiens
atcagcttaattctcaacaggt

SEQ ID NO: 8782787 - DNA, 19 bp, Homo sapiens
ctgtccttggctgcactgt

SEQ ID NO: 8782788 - DNA, 22 bp, Homo sapiens
atcaggaaagagtggaactctg

SEQ ID NO: 8782789 - DNA, 22 bp, Homo sapiens
atcagcttggaccaataagatg

SEQ ID NO: 8782790 - DNA, 22 bp, Homo sapiens
atcagcttggaccaataagatg

SEQ ID NO: 8782791 - DNA, 22 bp, Homo sapiens
ctgtaacagctgtcagagcagg

SEQ ID NO: 8782792 - DNA, 22 bp, Homo sapiens
ctgtaacttaatgagaggcaga

SEQ ID NO: 8782793 - DNA, 22 bp, Homo sapiens
ctgtaactctgccaagaaggct

SEQ ID NO: 8782794 - DNA, 22 bp, Homo sapiens
ctgtaactctgccaagaaggct

SEQ ID NO: 8782795 - DNA, 22 bp, Homo sapiens
ctgtaatcccagctacctggga

SEQ ID NO: 8782796 - DNA, 22 bp, Homo sapiens
ctgtaatcccagctacctggga

SEQ ID NO: 8782797 - DNA, 22 bp, Homo sapiens
ctgtaacttaatgagaggcaga

SEQ ID NO: 8782798 - DNA, 20 bp, Homo sapiens
ctgtaactgtcccttttgcc

SEQ ID NO: 8782799 - DNA, 22 bp, Homo sapiens
ctgtaacttagcatggttacta

SEQ ID NO: 8782800 - DNA, 21 bp, Homo sapiens
ctgtaagaaatcagttttatc

SEQ ID NO: 8782801 - DNA, 22 bp, Homo sapiens
ctgtaagggcctgactaccctg

SEQ ID NO: 8782802 - DNA, 22 bp, Homo sapiens
ctgtaatcccagctacctggga

SEQ ID NO: 8782803 - DNA, 22 bp, Homo sapiens
ctgtaatcccagctactcggga

SEQ ID NO: 8782804 - DNA, 22 bp, Homo sapiens
ctgtaatcccagctactcggga

SEQ ID NO: 8782805 - DNA, 22 bp, Homo sapiens
ctgtaatcccagctactcggga

SEQ ID NO: 8782806 - DNA, 22 bp, Homo sapiens
ctgtaatcccagctactcggga

SEQ ID NO: 8782807 - DNA, 22 bp, Homo sapiens
ctgtaatcccagctactcggga

SEQ ID NO: 8782808 - DNA, 22 bp, Homo sapiens
ctgtaatcccagctactcggga

SEQ ID NO: 8782809 - DNA, 22 bp, Homo sapiens
ctgtaatcccagctactcggga

SEQ ID NO: 8782810 - DNA, 22 bp, Homo sapiens
ctgtaatcccagctacctggga

SEQ ID NO: 8782811 - DNA, 22 bp, Homo sapiens
ctgtaatcccagctacctggga

SEQ ID NO: 8782812 - DNA, 22 bp, Homo sapiens
ctgtaatcccagctacctggga

SEQ ID NO: 8782813 - DNA, 22 bp, Homo sapiens
ctgtaatcccagctacctggga

SEQ ID NO: 8782814 - DNA, 22 bp, Homo sapiens
atcagcattcccaaatgatgtg

SEQ ID NO: 8782815 - DNA, 22 bp, Homo sapiens
atcagctcattttgatggaaat

SEQ ID NO: 8782816 - DNA, 22 bp, Homo sapiens
atcagctgaaaaacaggcagca

SEQ ID NO: 8782817 - DNA, 22 bp, Homo sapiens
atcagagctagtacttgcaggt

SEQ ID NO: 8782818 - DNA, 22 bp, Homo sapiens
atcagcaggtgctggtggagac

SEQ ID NO: 8782819 - DNA, 22 bp, Homo sapiens
atcagcaggaagggcaccttta

SEQ ID NO: 8782820 - DNA, 22 bp, Homo sapiens
ctgtaaatatgaagaatatatg

SEQ ID NO: 8782821 - DNA, 22 bp, Homo sapiens
ctgtaaatatgaagaatatatg

SEQ ID NO: 8782822 - DNA, 22 bp, Homo sapiens
atcacagatttgatacttttgt

SEQ ID NO: 8782823 - DNA, 22 bp, Homo sapiens
atcacagattgtgaataactat

SEQ ID NO: 8782824 - DNA, 22 bp, Homo sapiens
atcacagattgtgaataactat

SEQ ID NO: 8782825 - DNA, 22 bp, Homo sapiens
atcacagattgtgaataactat

SEQ ID NO: 8782826 - DNA, 22 bp, Homo sapiens
atcacagagattgcttttaaaa

SEQ ID NO: 8782827 - DNA, 22 bp, Homo sapiens
atcacagagattgcttttaaaa

SEQ ID NO: 8782828 - DNA, 18 bp, Homo sapiens
atcacagagggggagtct

SEQ ID NO: 8782829 - DNA, 19 bp, Homo sapiens
atcacagacgtgcctcatc

SEQ ID NO: 8782830 - DNA, 22 bp, Homo sapiens
atcacagacaattgtcagacca

SEQ ID NO: 8782831 - DNA, 22 bp, Homo sapiens
atcacagacaattgtcagacca

SEQ ID NO: 8782832 - DNA, 22 bp, Homo sapiens
atcacagacaattgtcagacca

SEQ ID NO: 8782833 - DNA, 22 bp, Homo sapiens
atcacactgttattttagttaa

SEQ ID NO: 8782834 - DNA, 22 bp, Homo sapiens
atcacacttttgtaaccatcag

SEQ ID NO: 8782835 - DNA, 22 bp, Homo sapiens
atcacacttttgtaaccatcag

SEQ ID NO: 8782836 - DNA, 22 bp, Homo sapiens
atcacactgttattttagttaa

SEQ ID NO: 8782837 - DNA, 22 bp, Homo sapiens
atcacaatgtacgttaaaatgt

SEQ ID NO: 8782838 - DNA, 22 bp, Homo sapiens
atcacaatgtacgttaaaatgt

SEQ ID NO: 8782839 - DNA, 22 bp, Homo sapiens
atcacactggacattggatact

SEQ ID NO: 8782840 - DNA, 22 bp, Homo sapiens
atcacaaaggtctcagagcaca

SEQ ID NO: 8782841 - DNA, 22 bp, Homo sapiens
atcacaatcttcaaatcgattc

SEQ ID NO: 8782842 - DNA, 22 bp, Homo sapiens
atcacaatgtacgttaaaatgt

SEQ ID NO: 8782843 - DNA, 22 bp, Homo sapiens
atcacaatcttcaaatcgattc

SEQ ID NO: 8782844 - DNA, 22 bp, Homo sapiens
atcacaatccctctctctgata

SEQ ID NO: 8782845 - DNA, 22 bp, Homo sapiens
atcacaaagggttttctctgag

SEQ ID NO: 8782846 - DNA, 22 bp, Homo sapiens
atcacaaaggtctcagagcaca

SEQ ID NO: 8782847 - DNA, 22 bp, Homo sapiens
atcacaaaggtctcagagcaca

SEQ ID NO: 8782848 - DNA, 22 bp, Homo sapiens
atcacaaaggtctcagagcaca

SEQ ID NO: 8782849 - DNA, 22 bp, Homo sapiens
atcaagaattgggagctattga

SEQ ID NO: 8782850 - DNA, 22 bp, Homo sapiens
atcaagaattgggagctattga

SEQ ID NO: 8782851 - DNA, 22 bp, Homo sapiens
atcacaaagggttttctctgag

SEQ ID NO: 8782852 - DNA, 22 bp, Homo sapiens
cagggaccctactagctcacac

SEQ ID NO: 8782853 - DNA, 22 bp, Homo sapiens
cagggactacagccagccctcc

SEQ ID NO: 8782854 - DNA, 22 bp, Homo sapiens
agctttggggacagccaaggtt

SEQ ID NO: 8782855 - DNA, 22 bp, Homo sapiens
agctttgggccactggctggat

SEQ ID NO: 8782856 - DNA, 22 bp, Homo sapiens
agctttgggggaggtagtctgt

SEQ ID NO: 8782857 - DNA, 22 bp, Homo sapiens
agctttgggggtaggtatagag

SEQ ID NO: 8782858 - DNA, 22 bp, Homo sapiens
agctttgggggaggtagtctgt

SEQ ID NO: 8782859 - DNA, 22 bp, Homo sapiens
cagggacattggtggccaggtt

SEQ ID NO: 8782860 - DNA, 22 bp, Homo sapiens
cagggacattggtggccaggtt

SEQ ID NO: 8782861 - DNA, 22 bp, Homo sapiens
cagggacatgactggtctctgt

SEQ ID NO: 8782862 - DNA, 20 bp, Homo sapiens
cagggacagtggcagattca

SEQ ID NO: 8782863 - DNA, 22 bp, Homo sapiens
cagggacatttccaagagaatt

SEQ ID NO: 8782864 - DNA, 22 bp, Homo sapiens
cagggacattggtggccaggtt

SEQ ID NO: 8782865 - DNA, 22 bp, Homo sapiens
cagggacccgcacaggtagcat

SEQ ID NO: 8782866 - DNA, 22 bp, Homo sapiens
cagggacccgcacaggtagcat

SEQ ID NO: 8782867 - DNA, 22 bp, Homo sapiens
cagggacccgcacaggtagcat

SEQ ID NO: 8782868 - DNA, 22 bp, Homo sapiens
cagggacatttccaagagaatt

SEQ ID NO: 8782869 - DNA, 22 bp, Homo sapiens
agctttctagtttagccatctt

SEQ ID NO: 8782870 - DNA, 22 bp, Homo sapiens
agctttctagtttagccatctt

SEQ ID NO: 8782871 - DNA, 22 bp, Homo sapiens
agctttctggttacagtcttca

SEQ ID NO: 8782872 - DNA, 22 bp, Homo sapiens
cagggacataagaggaacatgg

SEQ ID NO: 8782873 - DNA, 22 bp, Homo sapiens
cagggacaggggagaaaagatg

SEQ ID NO: 8782874 - DNA, 22 bp, Homo sapiens
cagggacagggatcatttgctt

SEQ ID NO: 8782875 - DNA, 22 bp, Homo sapiens
aggaaaacacagtattgatgga

SEQ ID NO: 8782876 - DNA, 22 bp, Homo sapiens
aggaaaacacagtattgatgga

SEQ ID NO: 8782877 - DNA, 22 bp, Homo sapiens
aggaaaacacagtattgatgga

SEQ ID NO: 8782878 - DNA, 22 bp, Homo sapiens
aggaaaaataaggcagcagggc

SEQ ID NO: 8782879 - DNA, 22 bp, Homo sapiens
aggaaaaataaggcagcagggc

SEQ ID NO: 8782880 - DNA, 22 bp, Homo sapiens
aggaaaaataaggcagcagggc

SEQ ID NO: 8782881 - DNA, 23 bp, Homo sapiens
agctttggtgatgtgacagataa

SEQ ID NO: 8782882 - DNA, 23 bp, Homo sapiens
agctttggtgatgtgacagataa

SEQ ID NO: 8782883 - DNA, 20 bp, Homo sapiens
aggaaaaatggaaactggag

SEQ ID NO: 8782884 - DNA, 20 bp, Homo sapiens
aggaaaaatggaaactggag

SEQ ID NO: 8782885 - DNA, 22 bp, Homo sapiens
aggaaaagtgtgaagtatggag

SEQ ID NO: 8782886 - DNA, 22 bp, Homo sapiens
aggaaaagtgtgaagtatggag

SEQ ID NO: 8782887 - DNA, 22 bp, Homo sapiens
aggaaaatcaatgtctttttaa

SEQ ID NO: 8782888 - DNA, 22 bp, Homo sapiens
aggaaaatgaaacagcaactgt

SEQ ID NO: 8782889 - DNA, 22 bp, Homo sapiens
aggaaaatgaaacagcaactgt

SEQ ID NO: 8782890 - DNA, 22 bp, Homo sapiens
aggaaaatgatattctgctgtt

SEQ ID NO: 8782891 - DNA, 22 bp, Homo sapiens
aggaaaatcaatgtctttttaa

SEQ ID NO: 8782892 - DNA, 22 bp, Homo sapiens
aggaaaatggaccagagttgtt

SEQ ID NO: 8782893 - DNA, 22 bp, Homo sapiens
aggaaaatggaccagagttgtt

SEQ ID NO: 8782894 - DNA, 22 bp, Homo sapiens
aggaaaatggaccagagttgtt

SEQ ID NO: 8782895 - DNA, 21 bp, Homo sapiens
aggaaaattgagggttgttgt

SEQ ID NO: 8782896 - DNA, 21 bp, Homo sapiens
aggaaaattgagggttgttgt

SEQ ID NO: 8782897 - DNA, 22 bp, Homo sapiens
aggaaacaacttggcatgagcc

SEQ ID NO: 8782898 - DNA, 22 bp, Homo sapiens
aggaaacaacttggcatgagcc

SEQ ID NO: 8782899 - DNA, 22 bp, Homo sapiens
aggaaacaacttggcatgagcc

SEQ ID NO: 8782900 - DNA, 22 bp, Homo sapiens
aggaaacaacttggcatgagcc

SEQ ID NO: 8782901 - DNA, 22 bp, Homo sapiens
aggaaacagaggtgccacaata

SEQ ID NO: 8782902 - DNA, 22 bp, Homo sapiens
aggaaacagaggtgccacaata

SEQ ID NO: 8782903 - DNA, 22 bp, Homo sapiens
caggcttcgctctgtgggcagg

SEQ ID NO: 8782904 - DNA, 22 bp, Homo sapiens
caggcttcgctctgtgggcagg

SEQ ID NO: 8782905 - DNA, 22 bp, Homo sapiens
caggcttccgccaggtttccag

SEQ ID NO: 8782906 - DNA, 22 bp, Homo sapiens
caggcttcatgaattatgcacc

SEQ ID NO: 8782907 - DNA, 22 bp, Homo sapiens
caggcttcagggaacgcagtct

SEQ ID NO: 8782908 - DNA, 22 bp, Homo sapiens
caggcttgaagcttcagagtat

SEQ ID NO: 8782909 - DNA, 22 bp, Homo sapiens
caggcttcttttctttccagac

SEQ ID NO: 8782910 - DNA, 22 bp, Homo sapiens
caggcttcttttctttccagac

SEQ ID NO: 8782911 - DNA, 22 bp, Homo sapiens
caggcttgagggcaggcccagt

SEQ ID NO: 8782912 - DNA, 22 bp, Homo sapiens
caggcttgattattcagacaat

SEQ ID NO: 8782913 - DNA, 22 bp, Homo sapiens
agcttctccatctgcccagaga

SEQ ID NO: 8782914 - DNA, 22 bp, Homo sapiens
agcttctcaggagtctgaggca

SEQ ID NO: 8782915 - DNA, 22 bp, Homo sapiens
agcttctcaggagtctgaggca

SEQ ID NO: 8782916 - DNA, 22 bp, Homo sapiens
caggcttgctgctagagcactt

SEQ ID NO: 8782917 - DNA, 22 bp, Homo sapiens
caggctgtctgctgaggaaagg

SEQ ID NO: 8782918 - DNA, 22 bp, Homo sapiens
caggctggagttacctttaggg

SEQ ID NO: 8782919 - DNA, 22 bp, Homo sapiens
agctggtgctgaagctcttgag

SEQ ID NO: 8782920 - DNA, 22 bp, Homo sapiens
caggctggagttacctttaggg

SEQ ID NO: 8782921 - DNA, 22 bp, Homo sapiens
agctggtgctcggggagctggc

SEQ ID NO: 8782922 - DNA, 22 bp, Homo sapiens
agctggtgctcggggagctggc

SEQ ID NO: 8782923 - DNA, 22 bp, Homo sapiens
caggctgtggatcaggagcctt

SEQ ID NO: 8782924 - DNA, 22 bp, Homo sapiens
caggctgtggatcaggagcctt

SEQ ID NO: 8782925 - DNA, 22 bp, Homo sapiens
caggctgtgggagtcaggaccc

SEQ ID NO: 8782926 - DNA, 22 bp, Homo sapiens
caggcttcagcatccacttagt

SEQ ID NO: 8782927 - DNA, 22 bp, Homo sapiens
caggcttcagcatccacttagt

SEQ ID NO: 8782928 - DNA, 22 bp, Homo sapiens
caggcttaggagtcagcctgct

SEQ ID NO: 8782929 - DNA, 22 bp, Homo sapiens
caggcttaggagtcagcctgct

SEQ ID NO: 8782930 - DNA, 22 bp, Homo sapiens
caggctgtggatcaggagcctt

SEQ ID NO: 8782931 - DNA, 22 bp, Homo sapiens
caggctgtggatcaggagcctt

SEQ ID NO: 8782932 - DNA, 22 bp, Homo sapiens
caggctgtgaaactgagatgcg

SEQ ID NO: 8782933 - DNA, 22 bp, Homo sapiens
agctttatttgtcattcacggc

SEQ ID NO: 8782934 - DNA, 22 bp, Homo sapiens
agctttccactatcttaggggt

SEQ ID NO: 8782935 - DNA, 22 bp, Homo sapiens
agctttctaccaggtcctgtct

SEQ ID NO: 8782936 - DNA, 22 bp, Homo sapiens
agctttctagactctgtggtca

SEQ ID NO: 8782937 - DNA, 22 bp, Homo sapiens
agcttctgttcatcttccaggc

SEQ ID NO: 8782938 - DNA, 23 bp, Homo sapiens
agcttctggttcaggtcaagcag

SEQ ID NO: 8782939 - DNA, 23 bp, Homo sapiens
agcttctggttcaggtcaagcag

SEQ ID NO: 8782940 - DNA, 22 bp, Homo sapiens
agcttctggaaggcaaggcttg

SEQ ID NO: 8782941 - DNA, 23 bp, Homo sapiens
agcttctggttcaggtcaagcag

SEQ ID NO: 8782942 - DNA, 22 bp, Homo sapiens
agcttctggaaggcaaggcttg

SEQ ID NO: 8782943 - DNA, 22 bp, Homo sapiens
agcttctctggtcttctgccaa

SEQ ID NO: 8782944 - DNA, 22 bp, Homo sapiens
agcttctccctttcctattggt

SEQ ID NO: 8782945 - DNA, 22 bp, Homo sapiens
agcttctcggctgggagtattt

SEQ ID NO: 8782946 - DNA, 22 bp, Homo sapiens
agcttctctcagggtatctttc

SEQ ID NO: 8782947 - DNA, 22 bp, Homo sapiens
agcttctctctttgcactcaca

SEQ ID NO: 8782948 - DNA, 22 bp, Homo sapiens
agcttctctctttgcactcaca

SEQ ID NO: 8782949 - DNA, 22 bp, Homo sapiens
cagggtgtggtctgcattcgga

SEQ ID NO: 8782950 - DNA, 22 bp, Homo sapiens
cagggtgtggtctgcattcgga

SEQ ID NO: 8782951 - DNA, 22 bp, Homo sapiens
cagggtggtgaatagctatagt

SEQ ID NO: 8782952 - DNA, 22 bp, Homo sapiens
cagggttaatttaatgtgagag

SEQ ID NO: 8782953 - DNA, 22 bp, Homo sapiens
cagggtggtgaatagctatagt

SEQ ID NO: 8782954 - DNA, 22 bp, Homo sapiens
cagggtggtaccagcatctagt

SEQ ID NO: 8782955 - DNA, 22 bp, Homo sapiens
cagggtggtaccagcatctagt

SEQ ID NO: 8782956 - DNA, 22 bp, Homo sapiens
cagggtggtaccagcatctagt

SEQ ID NO: 8782957 - DNA, 22 bp, Homo sapiens
cagggtggggctggctatcaaa

SEQ ID NO: 8782958 - DNA, 22 bp, Homo sapiens
cagggtggggctggctatcaaa

SEQ ID NO: 8782959 - DNA, 22 bp, Homo sapiens
cagggtggggctggctatcaaa

SEQ ID NO: 8782960 - DNA, 22 bp, Homo sapiens
cagggtggggctggctatcaaa

SEQ ID NO: 8782961 - DNA, 22 bp, Homo sapiens
cagggtgctgcaccatccctca

SEQ ID NO: 8782962 - DNA, 22 bp, Homo sapiens
aggaaacattgatattgggaaa

SEQ ID NO: 8782963 - DNA, 22 bp, Homo sapiens
aggaaacatccttatctattct

SEQ ID NO: 8782964 - DNA, 22 bp, Homo sapiens
aggaaacagttggtaatgcata

SEQ ID NO: 8782965 - DNA, 22 bp, Homo sapiens
aggaaacagtgaacttggcagg

SEQ ID NO: 8782966 - DNA, 22 bp, Homo sapiens
aggaaacagttggtaatgcata

SEQ ID NO: 8782967 - DNA, 22 bp, Homo sapiens
aggaaacagagtgaagcttggg

SEQ ID NO: 8782968 - DNA, 22 bp, Homo sapiens
aggaaacaggcagcctttgaac

SEQ ID NO: 8782969 - DNA, 22 bp, Homo sapiens
aggaaacagagtgaagcttggg

SEQ ID NO: 8782970 - DNA, 22 bp, Homo sapiens
aggaaacagagtgaagcttggg

SEQ ID NO: 8782971 - DNA, 22 bp, Homo sapiens
aggaaacagtgaacttggcagg

SEQ ID NO: 8782972 - DNA, 22 bp, Homo sapiens
aggaaacagtgaacttggcagg

SEQ ID NO: 8782973 - DNA, 22 bp, Homo sapiens
aggaaacattgatattgggaaa

SEQ ID NO: 8782974 - DNA, 22 bp, Homo sapiens
aggaaacattgatattgggaaa

SEQ ID NO: 8782975 - DNA, 22 bp, Homo sapiens
aggaaacattgatattgggaaa

SEQ ID NO: 8782976 - DNA, 22 bp, Homo sapiens
aggaaacatgaatctgccttga

SEQ ID NO: 8782977 - DNA, 22 bp, Homo sapiens
aggaaacatccttatctattct

SEQ ID NO: 8782978 - DNA, 22 bp, Homo sapiens
aggaaacatccttatctattct

SEQ ID NO: 8782979 - DNA, 22 bp, Homo sapiens
aggaagaggtagctgtcaaggg

SEQ ID NO: 8782980 - DNA, 22 bp, Homo sapiens
aggaagaggtagctgtcaaggg

SEQ ID NO: 8782981 - DNA, 22 bp, Homo sapiens
aggaagagggtggcagataatc

SEQ ID NO: 8782982 - DNA, 22 bp, Homo sapiens
aggaagagggtggcagataatc

SEQ ID NO: 8782983 - DNA, 22 bp, Homo sapiens
aggaagagggtggcagataatc

SEQ ID NO: 8782984 - DNA, 22 bp, Homo sapiens
cagggtttcaccatgttagcag

SEQ ID NO: 8782985 - DNA, 22 bp, Homo sapiens
cagggtttcaccatgttagcag

SEQ ID NO: 8782986 - DNA, 22 bp, Homo sapiens
cagggtttcaccatgttagcag

SEQ ID NO: 8782987 - DNA, 22 bp, Homo sapiens
cagggtttcaccatgttagcag

SEQ ID NO: 8782988 - DNA, 22 bp, Homo sapiens
cagggtttcaccatgttagcag

SEQ ID NO: 8782989 - DNA, 22 bp, Homo sapiens
aggaagagtgttacctatgggt

SEQ ID NO: 8782990 - DNA, 22 bp, Homo sapiens
aggaagaggtgtgcaatggtgt

SEQ ID NO: 8782991 - DNA, 22 bp, Homo sapiens
aggaagaggtgtgcaatggtgt

SEQ ID NO: 8782992 - DNA, 20 bp, Homo sapiens
aggaagatcctttcttttaa

SEQ ID NO: 8782993 - DNA, 22 bp, Homo sapiens
aggaagcaaaaggcagggtcta

SEQ ID NO: 8782994 - DNA, 22 bp, Homo sapiens
aggaagcaaaaggcagggtcta

SEQ ID NO: 8782995 - DNA, 20 bp, Homo sapiens
aggaaggagaatctgagcaa

SEQ ID NO: 8782996 - DNA, 22 bp, Homo sapiens
aggaagcactggaaggggttgg

SEQ ID NO: 8782997 - DNA, 22 bp, Homo sapiens
aggaatgtgtttctaggctgtt

SEQ ID NO: 8782998 - DNA, 23 bp, Homo sapiens
aggaatgtgcccacccatctcct

SEQ ID NO: 8782999 - DNA, 22 bp, Homo sapiens
aggaatgacagatgtccgcacc

SEQ ID NO: 8783000 - DNA, 22 bp, Homo sapiens
aggaatgaactcgagtgatctg

SEQ ID NO: 8783001 - DNA, 22 bp, Homo sapiens
caggtcctggcatcaggcaggt

SEQ ID NO: 8783002 - DNA, 22 bp, Homo sapiens
caggtccctgcgccccggcctc

SEQ ID NO: 8783003 - DNA, 22 bp, Homo sapiens
caggtccctgcgccccggcctc

SEQ ID NO: 8783004 - DNA, 22 bp, Homo sapiens
caggtcctcgggggaggccggc

SEQ ID NO: 8783005 - DNA, 22 bp, Homo sapiens
caggtcctgccttggttaccct

SEQ ID NO: 8783006 - DNA, 22 bp, Homo sapiens
caggtcctgcagggagagtaaa

SEQ ID NO: 8783007 - DNA, 22 bp, Homo sapiens
aggaagggtggatagtaacgtg

SEQ ID NO: 8783008 - DNA, 22 bp, Homo sapiens
aggaagggctgtttctccaaga

SEQ ID NO: 8783009 - DNA, 20 bp, Homo sapiens
aggaaggagaatctgagcaa

SEQ ID NO: 8783010 - DNA, 22 bp, Homo sapiens
aggaagggtgtcatgagccctt

SEQ ID NO: 8783011 - DNA, 22 bp, Homo sapiens
aggaagggtgtcatgagccctt

SEQ ID NO: 8783012 - DNA, 22 bp, Homo sapiens
aggaagggtgtcatgagccctt

SEQ ID NO: 8783013 - DNA, 22 bp, Homo sapiens
aggaagggtgtcatgagccctt

SEQ ID NO: 8783014 - DNA, 20 bp, Homo sapiens
caggtccagcacgtgcacgg

SEQ ID NO: 8783015 - DNA, 22 bp, Homo sapiens
aggaagtgaaagggaaggagtt

SEQ ID NO: 8783016 - DNA, 22 bp, Homo sapiens
aggaaggtgcagtagggtgtgc

SEQ ID NO: 8783017 - DNA, 22 bp, Homo sapiens
aggaagtcagctgccatgctgt

SEQ ID NO: 8783018 - DNA, 22 bp, Homo sapiens
aggaagtcagctgccatgctgt

SEQ ID NO: 8783019 - DNA, 22 bp, Homo sapiens
aggaagtcagaatgctggggag

SEQ ID NO: 8783020 - DNA, 22 bp, Homo sapiens
agctgggcagactgcagtggtt

SEQ ID NO: 8783021 - DNA, 22 bp, Homo sapiens
agctgggactcaactgtctggg

SEQ ID NO: 8783022 - DNA, 22 bp, Homo sapiens
agctggaggagtttctcctagc

SEQ ID NO: 8783023 - DNA, 22 bp, Homo sapiens
agctgggactcaactgtctggg

SEQ ID NO: 8783024 - DNA, 22 bp, Homo sapiens
agctgggactcaactgtctggg

SEQ ID NO: 8783025 - DNA, 22 bp, Homo sapiens
agctggaggagtttctcctagc

SEQ ID NO: 8783026 - DNA, 21 bp, Homo sapiens
agctgggcctcagcctgcagt

SEQ ID NO: 8783027 - DNA, 23 bp, Homo sapiens
agctgggccaggtggtcagacct

SEQ ID NO: 8783028 - DNA, 23 bp, Homo sapiens
agctgggccaggtggtcagacct

SEQ ID NO: 8783029 - DNA, 22 bp, Homo sapiens
agctgggcagtgcttggattca

SEQ ID NO: 8783030 - DNA, 22 bp, Homo sapiens
agctgggcagactgcagtggtt

SEQ ID NO: 8783031 - DNA, 22 bp, Homo sapiens
agctgggcagactgcagtggtt

SEQ ID NO: 8783032 - DNA, 22 bp, Homo sapiens
agctgggcagactgcagtggtt

SEQ ID NO: 8783033 - DNA, 22 bp, Homo sapiens
agctgggctgatgactcatgtt

SEQ ID NO: 8783034 - DNA, 22 bp, Homo sapiens
agctgggctgatgactcatgtt

SEQ ID NO: 8783035 - DNA, 22 bp, Homo sapiens
agctgggctgatgactcatgtt

SEQ ID NO: 8783036 - DNA, 22 bp, Homo sapiens
agctgggctccaagagggatct

SEQ ID NO: 8783037 - DNA, 22 bp, Homo sapiens
agctgggcgcagtggctggtga

SEQ ID NO: 8783038 - DNA, 22 bp, Homo sapiens
agctgggcgcagtggctggtga

SEQ ID NO: 8783039 - DNA, 22 bp, Homo sapiens
agctgggcgcagtggctggtga

SEQ ID NO: 8783040 - DNA, 22 bp, Homo sapiens
agctgggcctgagctggaagct

SEQ ID NO: 8783041 - DNA, 22 bp, Homo sapiens
agctgggcctgagctggaagct

SEQ ID NO: 8783042 - DNA, 21 bp, Homo sapiens
agctgggcctcagcctgcagt

SEQ ID NO: 8783043 - DNA, 21 bp, Homo sapiens
agctgggcctcagcctgcagt

SEQ ID NO: 8783044 - DNA, 21 bp, Homo sapiens
agctgggcctcagcctgcagt

SEQ ID NO: 8783045 - DNA, 22 bp, Homo sapiens
agctgggcgcagtggctggtga

SEQ ID NO: 8783046 - DNA, 22 bp, Homo sapiens
agctgggcctgatttgcagggg

SEQ ID NO: 8783047 - DNA, 22 bp, Homo sapiens
agctgggcctgagctggaagct

SEQ ID NO: 8783048 - DNA, 22 bp, Homo sapiens
agctgggcctgatttgcagggg

SEQ ID NO: 8783049 - DNA, 22 bp, Homo sapiens
agctggagatcatgctgatact

SEQ ID NO: 8783050 - DNA, 22 bp, Homo sapiens
agctggagatcatgctgatact

SEQ ID NO: 8783051 - DNA, 22 bp, Homo sapiens
agctggagagtttccaggaagg

SEQ ID NO: 8783052 - DNA, 22 bp, Homo sapiens
agctggagatgcccagcaccgg

SEQ ID NO: 8783053 - DNA, 22 bp, Homo sapiens
agctggagatgagtgacgtgcc

SEQ ID NO: 8783054 - DNA, 22 bp, Homo sapiens
agctggagagtttccaggaagg

SEQ ID NO: 8783055 - DNA, 22 bp, Homo sapiens
agctggagatcatgctgatact

SEQ ID NO: 8783056 - DNA, 22 bp, Homo sapiens
agctggagaatgtggatgatcc

SEQ ID NO: 8783057 - DNA, 22 bp, Homo sapiens
agctggagaatgtggatgatcc

SEQ ID NO: 8783058 - DNA, 20 bp, Homo sapiens
agctggagaagggcccttcc

SEQ ID NO: 8783059 - DNA, 20 bp, Homo sapiens
agctggagaagggcccttcc

SEQ ID NO: 8783060 - DNA, 20 bp, Homo sapiens
agctggagaagggcccttcc

SEQ ID NO: 8783061 - DNA, 22 bp, Homo sapiens
agctggagaataggaattagtg

SEQ ID NO: 8783062 - DNA, 22 bp, Homo sapiens
agctggagaataggaattagtg

SEQ ID NO: 8783063 - DNA, 20 bp, Homo sapiens
agctggagaagggcccttcc

SEQ ID NO: 8783064 - DNA, 22 bp, Homo sapiens
agctggagaaacctgggagggt

SEQ ID NO: 8783065 - DNA, 22 bp, Homo sapiens
agctggagaaacctgggagggt

SEQ ID NO: 8783066 - DNA, 22 bp, Homo sapiens
agctggagaaacctgggagggt

SEQ ID NO: 8783067 - DNA, 22 bp, Homo sapiens
agctggaattacaggcacgcac

SEQ ID NO: 8783068 - DNA, 21 bp, Homo sapiens
agctggaatctggctgtgctt

SEQ ID NO: 8783069 - DNA, 22 bp, Homo sapiens
agctggagcttcaagcaggtaa

SEQ ID NO: 8783070 - DNA, 22 bp, Homo sapiens
agctggagcttcaagcaggtaa

SEQ ID NO: 8783071 - DNA, 22 bp, Homo sapiens
agctggagcttcaagcaggtaa

SEQ ID NO: 8783072 - DNA, 22 bp, Homo sapiens
agctggagccagtgtgaggctt

SEQ ID NO: 8783073 - DNA, 22 bp, Homo sapiens
agctggagccagtgtgaggctt

SEQ ID NO: 8783074 - DNA, 22 bp, Homo sapiens
agctggagccagtgtgaggctt

SEQ ID NO: 8783075 - DNA, 22 bp, Homo sapiens
agctggagccagtgtgaggctt

SEQ ID NO: 8783076 - DNA, 22 bp, Homo sapiens
agctggagccagtgtgaggctt

SEQ ID NO: 8783077 - DNA, 19 bp, Homo sapiens
agctggagattggagggca

SEQ ID NO: 8783078 - DNA, 19 bp, Homo sapiens
agctggagattggagggca

SEQ ID NO: 8783079 - DNA, 22 bp, Homo sapiens
agctggagattctggggacagt

SEQ ID NO: 8783080 - DNA, 22 bp, Homo sapiens
agctggagattctggggacagt

SEQ ID NO: 8783081 - DNA, 22 bp, Homo sapiens
agctggagatgcccagcaccgg

SEQ ID NO: 8783082 - DNA, 22 bp, Homo sapiens
agctggagattctggggacagt

SEQ ID NO: 8783083 - DNA, 22 bp, Homo sapiens
agctggagatgcccagcaccgg

SEQ ID NO: 8783084 - DNA, 22 bp, Homo sapiens
agctggagatgcccagcaccgg

SEQ ID NO: 8783085 - DNA, 22 bp, Homo sapiens
caggcagaggaagtctgggtct

SEQ ID NO: 8783086 - DNA, 22 bp, Homo sapiens
caggcagaggaagtctgggtct

SEQ ID NO: 8783087 - DNA, 22 bp, Homo sapiens
agctgggctgatgactcatgtt

SEQ ID NO: 8783088 - DNA, 20 bp, Homo sapiens
caggcagaggatgctgacca

SEQ ID NO: 8783089 - DNA, 20 bp, Homo sapiens
caggcagaggatgctgacca

SEQ ID NO: 8783090 - DNA, 20 bp, Homo sapiens
caggcagaggatgctgacca

SEQ ID NO: 8783091 - DNA, 20 bp, Homo sapiens
caggcagaggatgctgacca

SEQ ID NO: 8783092 - DNA, 22 bp, Homo sapiens
caggcagaggaggccttctcct

SEQ ID NO: 8783093 - DNA, 22 bp, Homo sapiens
caggcagaggaggccttctcct

SEQ ID NO: 8783094 - DNA, 22 bp, Homo sapiens
caggcagaggaagtctgggtct

SEQ ID NO: 8783095 - DNA, 22 bp, Homo sapiens
caggcagaggaggccttctcct

SEQ ID NO: 8783096 - DNA, 22 bp, Homo sapiens
caggcagaggaggccttctcct

SEQ ID NO: 8783097 - DNA, 22 bp, Homo sapiens
caggcagaggcttttcatggct

SEQ ID NO: 8783098 - DNA, 22 bp, Homo sapiens
caggcagaggcttttcatggct

SEQ ID NO: 8783099 - DNA, 22 bp, Homo sapiens
caggcagaggcttttcatggct

SEQ ID NO: 8783100 - DNA, 22 bp, Homo sapiens
caggcagaggtaccaagattga

SEQ ID NO: 8783101 - DNA, 22 bp, Homo sapiens
caggcagagtcagattagactt

SEQ ID NO: 8783102 - DNA, 22 bp, Homo sapiens
caggcagagtgagaagcccttg

SEQ ID NO: 8783103 - DNA, 22 bp, Homo sapiens
caggcagagtgagaagcccttg

SEQ ID NO: 8783104 - DNA, 22 bp, Homo sapiens
caggcagagtgagaagcccttg

SEQ ID NO: 8783105 - DNA, 22 bp, Homo sapiens
caggcagagtgaggtggtctaa

SEQ ID NO: 8783106 - DNA, 19 bp, Homo sapiens
agctggggcggtgtgtgtt

SEQ ID NO: 8783107 - DNA, 22 bp, Homo sapiens
agctgggtgcggtggctcatgc

SEQ ID NO: 8783108 - DNA, 21 bp, Homo sapiens
agctgggtgggctgagtgaca

SEQ ID NO: 8783109 - DNA, 23 bp, Homo sapiens
agctgggtggcctgcgtgaagct

SEQ ID NO: 8783110 - DNA, 23 bp, Homo sapiens
agctgggtggcctgcgtgaagct

SEQ ID NO: 8783111 - DNA, 22 bp, Homo sapiens
agctgggtggcctctcctcggg

SEQ ID NO: 8783112 - DNA, 21 bp, Homo sapiens
agctgggtgctaatgacaact

SEQ ID NO: 8783113 - DNA, 22 bp, Homo sapiens
agctgggtggagggcccacggt

SEQ ID NO: 8783114 - DNA, 22 bp, Homo sapiens
agctgggtgtagggctggacaa

SEQ ID NO: 8783115 - DNA, 22 bp, Homo sapiens
agctgggtgttcttgggcctaa

SEQ ID NO: 8783116 - DNA, 22 bp, Homo sapiens
agctgggttcagaggcacatgg

SEQ ID NO: 8783117 - DNA, 22 bp, Homo sapiens
agctgggttgacaagatggaaa

SEQ ID NO: 8783118 - DNA, 22 bp, Homo sapiens
agctgggttgacaagatggaaa

SEQ ID NO: 8783119 - DNA, 17 bp, Homo sapiens
agctgggttctcaggaa

SEQ ID NO: 8783120 - DNA, 22 bp, Homo sapiens
agctgggtttctggcaggctta

SEQ ID NO: 8783121 - DNA, 22 bp, Homo sapiens
agctggtaaaggggaaagcaga

SEQ ID NO: 8783122 - DNA, 22 bp, Homo sapiens
agctggtaacattagtcagtat

SEQ ID NO: 8783123 - DNA, 22 bp, Homo sapiens
agctggtaagtggcagagattc

SEQ ID NO: 8783124 - DNA, 22 bp, Homo sapiens
agctggtatttgttagggagtt

SEQ ID NO: 8783125 - DNA, 22 bp, Homo sapiens
agctggtaagtggcagagattc

SEQ ID NO: 8783126 - DNA, 22 bp, Homo sapiens
agctggtgctcaggggcatgga

SEQ ID NO: 8783127 - DNA, 22 bp, Homo sapiens
agctggtgctcaggggcatgga

SEQ ID NO: 8783128 - DNA, 22 bp, Homo sapiens
agctggtgatgtggtccctcac

SEQ ID NO: 8783129 - DNA, 22 bp, Homo sapiens
agctggtgcctgcttttgtgtg

SEQ ID NO: 8783130 - DNA, 20 bp, Homo sapiens
agctggtgaattaaagactg

SEQ ID NO: 8783131 - DNA, 22 bp, Homo sapiens
agctggtgagggttgaggggta

SEQ ID NO: 8783132 - DNA, 22 bp, Homo sapiens
agctggtgatggcctaagaagg

SEQ ID NO: 8783133 - DNA, 22 bp, Homo sapiens
agctggtgagggttgaggggta

SEQ ID NO: 8783134 - DNA, 22 bp, Homo sapiens
agctggtgagggttgaggggta

SEQ ID NO: 8783135 - DNA, 22 bp, Homo sapiens
agctggtgaacctgaggcacag

SEQ ID NO: 8783136 - DNA, 18 bp, Homo sapiens
agctggtgaaatccagta

SEQ ID NO: 8783137 - DNA, 22 bp, Homo sapiens
agctggtccttggcagttctca

SEQ ID NO: 8783138 - DNA, 22 bp, Homo sapiens
agctgaaagggtgttggagtgt

SEQ ID NO: 8783139 - DNA, 23 bp, Homo sapiens
agctgaaagcttgcaacgaggca

SEQ ID NO: 8783140 - DNA, 22 bp, Homo sapiens
agctgaaagtgctttgaggact

SEQ ID NO: 8783141 - DNA, 22 bp, Homo sapiens
agctgaaattcacaaggatcca

SEQ ID NO: 8783142 - DNA, 17 bp, Homo sapiens
agctgaaattgctgaag

SEQ ID NO: 8783143 - DNA, 22 bp, Homo sapiens
agctgaaattttactgagtata

SEQ ID NO: 8783144 - DNA, 22 bp, Homo sapiens
agctgaagaaatgggaagcatt

SEQ ID NO: 8783145 - DNA, 22 bp, Homo sapiens
agctcttttatcatgaggagag

SEQ ID NO: 8783146 - DNA, 21 bp, Homo sapiens
agctgaaaagttgtttacaag

SEQ ID NO: 8783147 - DNA, 20 bp, Homo sapiens
agctctttttagctaaggta

SEQ ID NO: 8783148 - DNA, 22 bp, Homo sapiens
agctgaaacttcccattaattg

SEQ ID NO: 8783149 - DNA, 22 bp, Homo sapiens
agctgaaacccaggcctcagct

SEQ ID NO: 8783150 - DNA, 22 bp, Homo sapiens
agctgaaaattagtgatagttt

SEQ ID NO: 8783151 - DNA, 22 bp, Homo sapiens
caggaaatatctcaacacttta

SEQ ID NO: 8783152 - DNA, 22 bp, Homo sapiens
caggaaatataggaaaaggaac

SEQ ID NO: 8783153 - DNA, 22 bp, Homo sapiens
caggaaatatctcaacacttta

SEQ ID NO: 8783154 - DNA, 22 bp, Homo sapiens
caggaaatcagaactcaagtgg

SEQ ID NO: 8783155 - DNA, 22 bp, Homo sapiens
caggaaatcactctgattttgg

SEQ ID NO: 8783156 - DNA, 23 bp, Homo sapiens
caggaaatcaattcttccagcat

SEQ ID NO: 8783157 - DNA, 22 bp, Homo sapiens
caggaaatatctcctggcagag

SEQ ID NO: 8783158 - DNA, 22 bp, Homo sapiens
caggaagaagggtggtgagtcc

SEQ ID NO: 8783159 - DNA, 22 bp, Homo sapiens
caggaagaaagaggtgaggtgt

SEQ ID NO: 8783160 - DNA, 22 bp, Homo sapiens
caggaagaaagaggtgaggtgt

SEQ ID NO: 8783161 - DNA, 22 bp, Homo sapiens
caggaagaccagggctgtggct

SEQ ID NO: 8783162 - DNA, 22 bp, Homo sapiens
caggaagaccagggctgtggct

SEQ ID NO: 8783163 - DNA, 22 bp, Homo sapiens
caggaagaccagggctgtggct

SEQ ID NO: 8783164 - DNA, 22 bp, Homo sapiens
caggaagaagggtggtgagtcc

SEQ ID NO: 8783165 - DNA, 22 bp, Homo sapiens
caggaaatgaaagctagctaat

SEQ ID NO: 8783166 - DNA, 22 bp, Homo sapiens
caggaaatgcgtagttgaactt

SEQ ID NO: 8783167 - DNA, 20 bp, Homo sapiens
caggaaccaaagaggactcc

SEQ ID NO: 8783168 - DNA, 22 bp, Homo sapiens
caggaacatttaaccacagggt

SEQ ID NO: 8783169 - DNA, 22 bp, Homo sapiens
caggaacccaatgggccaggcc

SEQ ID NO: 8783170 - DNA, 22 bp, Homo sapiens
caggaacccaatgggccaggcc

SEQ ID NO: 8783171 - DNA, 22 bp, Homo sapiens
agctgccactgagggtgcacag

SEQ ID NO: 8783172 - DNA, 22 bp, Homo sapiens
agctgccagatgacagtgctat

SEQ ID NO: 8783173 - DNA, 22 bp, Homo sapiens
agctgccctggcggagctgctc

SEQ ID NO: 8783174 - DNA, 18 bp, Homo sapiens
agctgccctgggctggag

SEQ ID NO: 8783175 - DNA, 22 bp, Homo sapiens
agctgcccttaataggcattca

SEQ ID NO: 8783176 - DNA, 22 bp, Homo sapiens
agctgccctttatgatgctgaa

SEQ ID NO: 8783177 - DNA, 22 bp, Homo sapiens
agctgccgatgcccagctgcat

SEQ ID NO: 8783178 - DNA, 22 bp, Homo sapiens
agctgcctcagtcactcatggc

SEQ ID NO: 8783179 - DNA, 22 bp, Homo sapiens
agctgcctcagcaacacagacc

SEQ ID NO: 8783180 - DNA, 21 bp, Homo sapiens
agctgcctccacttctgaggc

SEQ ID NO: 8783181 - DNA, 22 bp, Homo sapiens
agctgcctccatggtcaaagat

SEQ ID NO: 8783182 - DNA, 22 bp, Homo sapiens
agctgcctccatggtcaaagat

SEQ ID NO: 8783183 - DNA, 22 bp, Homo sapiens
agctggaagctgatgagcacag

SEQ ID NO: 8783184 - DNA, 22 bp, Homo sapiens
agctggaagatcctggttttgt

SEQ ID NO: 8783185 - DNA, 21 bp, Homo sapiens
agctggaatctggctgtgctt

SEQ ID NO: 8783186 - DNA, 22 bp, Homo sapiens
agctggaactgggtttgttgga

SEQ ID NO: 8783187 - DNA, 22 bp, Homo sapiens
agctgcttttagggccgggctc

SEQ ID NO: 8783188 - DNA, 22 bp, Homo sapiens
agctgcttttattaggacaatg

SEQ ID NO: 8783189 - DNA, 18 bp, Homo sapiens
agctgcttttggcttaaa

SEQ ID NO: 8783190 - DNA, 18 bp, Homo sapiens
agctgcttttggcttaaa

SEQ ID NO: 8783191 - DNA, 18 bp, Homo sapiens
agctgcttttggcttaaa

SEQ ID NO: 8783192 - DNA, 22 bp, Homo sapiens
agctggaacccgggtgggcagc

SEQ ID NO: 8783193 - DNA, 22 bp, Homo sapiens
agctggaaagaaggtggcagcc

SEQ ID NO: 8783194 - DNA, 22 bp, Homo sapiens
agctgcctggagtcatttcctg

SEQ ID NO: 8783195 - DNA, 22 bp, Homo sapiens
agctgctgggagaagtgagcca

SEQ ID NO: 8783196 - DNA, 22 bp, Homo sapiens
agctgctgggatacagtagtga

SEQ ID NO: 8783197 - DNA, 22 bp, Homo sapiens
agctgctttgctgggcaggccc

SEQ ID NO: 8783198 - DNA, 22 bp, Homo sapiens
agctgctttgccaatgcgttcc

SEQ ID NO: 8783199 - DNA, 22 bp, Homo sapiens
agctgctttgccaatgcgttcc

SEQ ID NO: 8783200 - DNA, 22 bp, Homo sapiens
agctgctttgccaatgcgttcc

SEQ ID NO: 8783201 - DNA, 21 bp, Homo sapiens
agctgctttcagctcctagag

SEQ ID NO: 8783202 - DNA, 22 bp, Homo sapiens
catcactgtcaccatctttcct

SEQ ID NO: 8783203 - DNA, 22 bp, Homo sapiens
catcactgcttctaaaatggtg

SEQ ID NO: 8783204 - DNA, 22 bp, Homo sapiens
catcagaaagagtcctggactt

SEQ ID NO: 8783205 - DNA, 20 bp, Homo sapiens
catcagaaatcctgacccac

SEQ ID NO: 8783206 - DNA, 22 bp, Homo sapiens
catcagaagatggctctggaaa

SEQ ID NO: 8783207 - DNA, 22 bp, Homo sapiens
catcagaagaaagacaaatgat

SEQ ID NO: 8783208 - DNA, 22 bp, Homo sapiens
catcagaagaaagacaaatgat

SEQ ID NO: 8783209 - DNA, 22 bp, Homo sapiens
catcagaagaaagacaaatgat

SEQ ID NO: 8783210 - DNA, 22 bp, Homo sapiens
catcagaagaaagacaaatgat

SEQ ID NO: 8783211 - DNA, 22 bp, Homo sapiens
catcagaaggccagagggtagc

SEQ ID NO: 8783212 - DNA, 22 bp, Homo sapiens
catcagaatctgagtctctgcc

SEQ ID NO: 8783213 - DNA, 22 bp, Homo sapiens
catcagaatgaatgttctggag

SEQ ID NO: 8783214 - DNA, 22 bp, Homo sapiens
catcagaatagctctgtggata

SEQ ID NO: 8783215 - DNA, 22 bp, Homo sapiens
aggaggctgggcacagtggcct

SEQ ID NO: 8783216 - DNA, 22 bp, Homo sapiens
aggaggctgggcacagtggcct

SEQ ID NO: 8783217 - DNA, 22 bp, Homo sapiens
aggaggctgggcacagtggcct

SEQ ID NO: 8783218 - DNA, 22 bp, Homo sapiens
aggaggctgggcacagtggcct

SEQ ID NO: 8783219 - DNA, 22 bp, Homo sapiens
aggaggctgcaaccctgaggcc

SEQ ID NO: 8783220 - DNA, 22 bp, Homo sapiens
aggaggctgggcacagtggcct

SEQ ID NO: 8783221 - DNA, 22 bp, Homo sapiens
catcagaatgttagagaaggga

SEQ ID NO: 8783222 - DNA, 22 bp, Homo sapiens
cagttcaagagaaatactactg

SEQ ID NO: 8783223 - DNA, 22 bp, Homo sapiens
cagttcaaagttaagcagcagt

SEQ ID NO: 8783224 - DNA, 22 bp, Homo sapiens
cagttcagctagaagaaacaaa

SEQ ID NO: 8783225 - DNA, 22 bp, Homo sapiens
cagttcacactgtgctatctgc

SEQ ID NO: 8783226 - DNA, 22 bp, Homo sapiens
cagttcacactgtgctatctgc

SEQ ID NO: 8783227 - DNA, 22 bp, Homo sapiens
cagttcatagtcttcatgtctc

SEQ ID NO: 8783228 - DNA, 22 bp, Homo sapiens
cagttcatccccatgttttcaa

SEQ ID NO: 8783229 - DNA, 22 bp, Homo sapiens
cagttcaaaattttgaagaagg

SEQ ID NO: 8783230 - DNA, 22 bp, Homo sapiens
cagttatttcaacagagaggat

SEQ ID NO: 8783231 - DNA, 22 bp, Homo sapiens
cagttattttgaggattaaatg

SEQ ID NO: 8783232 - DNA, 22 bp, Homo sapiens
cagttattatgaggtcattagg

SEQ ID NO: 8783233 - DNA, 22 bp, Homo sapiens
cagttattatcttagagagaca

SEQ ID NO: 8783234 - DNA, 22 bp, Homo sapiens
cagttattatgaggtcattagg

SEQ ID NO: 8783235 - DNA, 22 bp, Homo sapiens
cagttattatgaggtcattagg

SEQ ID NO: 8783236 - DNA, 22 bp, Homo sapiens
cagttattctagttccacatct

SEQ ID NO: 8783237 - DNA, 21 bp, Homo sapiens
cagttattcttgatgtgtgtg

SEQ ID NO: 8783238 - DNA, 21 bp, Homo sapiens
cagttattcttgatgtgtgtg

SEQ ID NO: 8783239 - DNA, 21 bp, Homo sapiens
cagttattcttgatgtgtgtg

SEQ ID NO: 8783240 - DNA, 22 bp, Homo sapiens
cagttatcaaatactatgaagg

SEQ ID NO: 8783241 - DNA, 22 bp, Homo sapiens
cagttctctgtgcctcgctggg

SEQ ID NO: 8783242 - DNA, 22 bp, Homo sapiens
cagttcccttcttctggcccct

SEQ ID NO: 8783243 - DNA, 22 bp, Homo sapiens
cagttcctatgggcaaaacaca

SEQ ID NO: 8783244 - DNA, 19 bp, Homo sapiens
catatttttgggctggcat

SEQ ID NO: 8783245 - DNA, 22 bp, Homo sapiens
catattttagttgctgaacagc

SEQ ID NO: 8783246 - DNA, 22 bp, Homo sapiens
catattttagttgctgaacagc

SEQ ID NO: 8783247 - DNA, 22 bp, Homo sapiens
catattttagttgctgaacagc

SEQ ID NO: 8783248 - DNA, 22 bp, Homo sapiens
catattttagttgctgaacagc

SEQ ID NO: 8783249 - DNA, 19 bp, Homo sapiens
catatttttgggctggcat

SEQ ID NO: 8783250 - DNA, 19 bp, Homo sapiens
catatttttgggctggcat

SEQ ID NO: 8783251 - DNA, 22 bp, Homo sapiens
catcactacaaatttaagaaat

SEQ ID NO: 8783252 - DNA, 22 bp, Homo sapiens
aggagggtggggtctgcctgtc

SEQ ID NO: 8783253 - DNA, 22 bp, Homo sapiens
aggaggctggttcaggccatat

SEQ ID NO: 8783254 - DNA, 22 bp, Homo sapiens
aggaggggcaatgatagtctgg

SEQ ID NO: 8783255 - DNA, 22 bp, Homo sapiens
aggaggctggttcaggccatat

SEQ ID NO: 8783256 - DNA, 22 bp, Homo sapiens
aggaggtagtcttataaatgtt

SEQ ID NO: 8783257 - DNA, 20 bp, Homo sapiens
aggaggtcaaatggaatctg

SEQ ID NO: 8783258 - DNA, 22 bp, Homo sapiens
aggagggtttcaatgggatgag

SEQ ID NO: 8783259 - DNA, 22 bp, Homo sapiens
aggagggttctctggacagagg

SEQ ID NO: 8783260 - DNA, 22 bp, Homo sapiens
aggaggtgacagcctgcatctg

SEQ ID NO: 8783261 - DNA, 22 bp, Homo sapiens
aggaggtgagcggtcatgtggt

SEQ ID NO: 8783262 - DNA, 22 bp, Homo sapiens
catcatgccccgctacagtgca

SEQ ID NO: 8783263 - DNA, 22 bp, Homo sapiens
aggaggtgagcggtcatgtggt

SEQ ID NO: 8783264 - DNA, 22 bp, Homo sapiens
aggaggtgagcggtcatgtggt

SEQ ID NO: 8783265 - DNA, 20 bp, Homo sapiens
catcattttaaaatctctcc

SEQ ID NO: 8783266 - DNA, 22 bp, Homo sapiens
catcattttattaaccaagaaa

SEQ ID NO: 8783267 - DNA, 22 bp, Homo sapiens
catcattttattaaccaagaaa

SEQ ID NO: 8783268 - DNA, 22 bp, Homo sapiens
catcatttgtttgcatgcagga

SEQ ID NO: 8783269 - DNA, 22 bp, Homo sapiens
catcatttgtttgcatgcagga

SEQ ID NO: 8783270 - DNA, 22 bp, Homo sapiens
catcatttgttcacttgattcc

SEQ ID NO: 8783271 - DNA, 22 bp, Homo sapiens
catcatttgttcacttgattcc

SEQ ID NO: 8783272 - DNA, 22 bp, Homo sapiens
catcatttaattataggggctg

SEQ ID NO: 8783273 - DNA, 22 bp, Homo sapiens
catcatttcacttagatgaagt

SEQ ID NO: 8783274 - DNA, 21 bp, Homo sapiens
catcatgcttgtgttggagaa

SEQ ID NO: 8783275 - DNA, 23 bp, Homo sapiens
catcattgttatgggtgctacta

SEQ ID NO: 8783276 - DNA, 22 bp, Homo sapiens
catcattgttagggactctaac

SEQ ID NO: 8783277 - DNA, 19 bp, Homo sapiens
catcattatcagttcactg

SEQ ID NO: 8783278 - DNA, 22 bp, Homo sapiens
catcattaccatcattagtagt

SEQ ID NO: 8783279 - DNA, 22 bp, Homo sapiens
catcattaccatcattagtagt

SEQ ID NO: 8783280 - DNA, 22 bp, Homo sapiens
aggaggttgccagtctgggggt

SEQ ID NO: 8783281 - DNA, 22 bp, Homo sapiens
aggagtcacctgcccaaagtca

SEQ ID NO: 8783282 - DNA, 22 bp, Homo sapiens
aggaggtgttgatagaaggttt

SEQ ID NO: 8783283 - DNA, 22 bp, Homo sapiens
catcattttattaaccaagaaa

SEQ ID NO: 8783284 - DNA, 22 bp, Homo sapiens
aggagtggtgcaggacctgcca

SEQ ID NO: 8783285 - DNA, 22 bp, Homo sapiens
aggagtggtgcaggacctgcca

SEQ ID NO: 8783286 - DNA, 22 bp, Homo sapiens
aggagtgggggcgagaagttaa

SEQ ID NO: 8783287 - DNA, 22 bp, Homo sapiens
aggagtgggggcgagaagttaa

SEQ ID NO: 8783288 - DNA, 22 bp, Homo sapiens
aggacaaaggaccagatctgga

SEQ ID NO: 8783289 - DNA, 22 bp, Homo sapiens
aggacaaaggaccagatctgga

SEQ ID NO: 8783290 - DNA, 22 bp, Homo sapiens
aggacaagacaaggaccagaga

SEQ ID NO: 8783291 - DNA, 22 bp, Homo sapiens
aggacaagacaaggaccagaga

SEQ ID NO: 8783292 - DNA, 22 bp, Homo sapiens
cagtgaggagtccagggcagag

SEQ ID NO: 8783293 - DNA, 22 bp, Homo sapiens
cagtctgatgttcgcaggtgaa

SEQ ID NO: 8783294 - DNA, 22 bp, Homo sapiens
cagtgaggagtccagggcagag

SEQ ID NO: 8783295 - DNA, 22 bp, Homo sapiens
aggaattcaagaccagctgggc

SEQ ID NO: 8783296 - DNA, 22 bp, Homo sapiens
aggaattcaagaccagctgggc

SEQ ID NO: 8783297 - DNA, 22 bp, Homo sapiens
aggaattactcatctgtggtat

SEQ ID NO: 8783298 - DNA, 22 bp, Homo sapiens
aggaattcaagaccagctgggc

SEQ ID NO: 8783299 - DNA, 22 bp, Homo sapiens
aggaattcaagaccagctgggc

SEQ ID NO: 8783300 - DNA, 22 bp, Homo sapiens
aggaatttggggttacatgatg

SEQ ID NO: 8783301 - DNA, 22 bp, Homo sapiens
aggaattttgtatggatactgt

SEQ ID NO: 8783302 - DNA, 22 bp, Homo sapiens
aggaattggttcaaggtttatc

SEQ ID NO: 8783303 - DNA, 22 bp, Homo sapiens
aggaattgtgttgtagtggaga

SEQ ID NO: 8783304 - DNA, 22 bp, Homo sapiens
aggaatttagacagggcataaa

SEQ ID NO: 8783305 - DNA, 22 bp, Homo sapiens
cagtgagggaagatctcagcac

SEQ ID NO: 8783306 - DNA, 22 bp, Homo sapiens
cagtgaggctctgctgagcggt

SEQ ID NO: 8783307 - DNA, 22 bp, Homo sapiens
cagtgagggcattcagtgctgg

SEQ ID NO: 8783308 - DNA, 22 bp, Homo sapiens
cagtgagggcattcagtgctgg

SEQ ID NO: 8783309 - DNA, 22 bp, Homo sapiens
cagtgcagccaaggacaggcac

SEQ ID NO: 8783310 - DNA, 22 bp, Homo sapiens
cagtgcaggcttgtggccgcag

SEQ ID NO: 8783311 - DNA, 22 bp, Homo sapiens
cagtgcaggctgggggccctgc

SEQ ID NO: 8783312 - DNA, 22 bp, Homo sapiens
cagtgcaggctgggggccctgc

SEQ ID NO: 8783313 - DNA, 23 bp, Homo sapiens
cagtgcagggcaactcagactcc

SEQ ID NO: 8783314 - DNA, 23 bp, Homo sapiens
cagtgcagggcaactcagactcc

SEQ ID NO: 8783315 - DNA, 20 bp, Homo sapiens
aggagatgatccagagtcag

SEQ ID NO: 8783316 - DNA, 22 bp, Homo sapiens
cagtgcagccaaggacaggcac

SEQ ID NO: 8783317 - DNA, 22 bp, Homo sapiens
cagtgcagctgccccgctggta

SEQ ID NO: 8783318 - DNA, 22 bp, Homo sapiens
cagtgcaggaagtgagatgcct

SEQ ID NO: 8783319 - DNA, 22 bp, Homo sapiens
cagtgcaggaagtgagatgcct

SEQ ID NO: 8783320 - DNA, 22 bp, Homo sapiens
aggagccaaattactagctctg

SEQ ID NO: 8783321 - DNA, 22 bp, Homo sapiens
aggagccaaattactagctctg

SEQ ID NO: 8783322 - DNA, 22 bp, Homo sapiens
aggagcagcttctgaaccatgt

SEQ ID NO: 8783323 - DNA, 22 bp, Homo sapiens
aggagcagcttctgaaccatgt

SEQ ID NO: 8783324 - DNA, 22 bp, Homo sapiens
aggagcagcttctgaaccatgt

SEQ ID NO: 8783325 - DNA, 22 bp, Homo sapiens
aggagcagcccactcctgtcct

SEQ ID NO: 8783326 - DNA, 22 bp, Homo sapiens
aggagcagcccactcctgtcct

SEQ ID NO: 8783327 - DNA, 22 bp, Homo sapiens
aggagcagcccactcctgtcct

SEQ ID NO: 8783328 - DNA, 22 bp, Homo sapiens
aggagatggagctcagtgggca

SEQ ID NO: 8783329 - DNA, 22 bp, Homo sapiens
aggagatggagctcagtgggca

SEQ ID NO: 8783330 - DNA, 22 bp, Homo sapiens
cagtgctttgggaggctgagga

SEQ ID NO: 8783331 - DNA, 22 bp, Homo sapiens
cagtgcttttaaaacaacatca

SEQ ID NO: 8783332 - DNA, 20 bp, Homo sapiens
cagtgcttcctcctttcttt

SEQ ID NO: 8783333 - DNA, 22 bp, Homo sapiens
cagtgcttttttaccttccaac

SEQ ID NO: 8783334 - DNA, 22 bp, Homo sapiens
cagtggaaactatgctgctgga

SEQ ID NO: 8783335 - DNA, 22 bp, Homo sapiens
aggagccaaattttagactctg

SEQ ID NO: 8783336 - DNA, 22 bp, Homo sapiens
aggagccaagatggggcaagta

SEQ ID NO: 8783337 - DNA, 22 bp, Homo sapiens
aggagccaagatggggcaagta

SEQ ID NO: 8783338 - DNA, 22 bp, Homo sapiens
cagtggaagactcagctctccc

SEQ ID NO: 8783339 - DNA, 22 bp, Homo sapiens
cagtggaaatcagagtgagagt

SEQ ID NO: 8783340 - DNA, 22 bp, Homo sapiens
aggagctgatagtctatggaga

SEQ ID NO: 8783341 - DNA, 22 bp, Homo sapiens
aggagctggccactaggatgca

SEQ ID NO: 8783342 - DNA, 22 bp, Homo sapiens
aggagctgatagtctatggaga

SEQ ID NO: 8783343 - DNA, 22 bp, Homo sapiens
aggagctggcctagaaaggaga

SEQ ID NO: 8783344 - DNA, 22 bp, Homo sapiens
aggagctggcctagaaaggaga

SEQ ID NO: 8783345 - DNA, 22 bp, Homo sapiens
aggagctggcctagaaaggaga

SEQ ID NO: 8783346 - DNA, 22 bp, Homo sapiens
aggagctggcctagaaaggaga

SEQ ID NO: 8783347 - DNA, 22 bp, Homo sapiens
aggagctggcctagaaaggaga

SEQ ID NO: 8783348 - DNA, 22 bp, Homo sapiens
aggagctgggctgctgctggga

SEQ ID NO: 8783349 - DNA, 22 bp, Homo sapiens
aggagctgggctgctgctggga

SEQ ID NO: 8783350 - DNA, 22 bp, Homo sapiens
aggagctgggagaaggactaaa

SEQ ID NO: 8783351 - DNA, 22 bp, Homo sapiens
aggagctgggagaaggactaaa

SEQ ID NO: 8783352 - DNA, 22 bp, Homo sapiens
aggagctgggcccaaggatgct

SEQ ID NO: 8783353 - DNA, 22 bp, Homo sapiens
aggagctgggcccaaggatgct

SEQ ID NO: 8783354 - DNA, 22 bp, Homo sapiens
aggagctgggcccaaggatgct

SEQ ID NO: 8783355 - DNA, 22 bp, Homo sapiens
aggcagaggaagggtggatttg

SEQ ID NO: 8783356 - DNA, 22 bp, Homo sapiens
aggcagaggaagggtggatttg

SEQ ID NO: 8783357 - DNA, 22 bp, Homo sapiens
aggcagagctgggttttgaaat

SEQ ID NO: 8783358 - DNA, 22 bp, Homo sapiens
aggcagaggaagggtggatttg

SEQ ID NO: 8783359 - DNA, 22 bp, Homo sapiens
aggcagaggaagggtggatttg

SEQ ID NO: 8783360 - DNA, 22 bp, Homo sapiens
aggcagaggaagggtggatttg

SEQ ID NO: 8783361 - DNA, 22 bp, Homo sapiens
aggcagagctgggttttgaaat

SEQ ID NO: 8783362 - DNA, 22 bp, Homo sapiens
aggcagagctgggttttgaaat

SEQ ID NO: 8783363 - DNA, 22 bp, Homo sapiens
aggcagagctgggttttgaaat

SEQ ID NO: 8783364 - DNA, 22 bp, Homo sapiens
aggcagaggaagggtggatttg

SEQ ID NO: 8783365 - DNA, 22 bp, Homo sapiens
aggcagaggagaatgatcttcc

SEQ ID NO: 8783366 - DNA, 19 bp, Homo sapiens
aggcagaggcttggctagc

SEQ ID NO: 8783367 - DNA, 22 bp, Homo sapiens
aggcagaggagaatgatcttcc

SEQ ID NO: 8783368 - DNA, 19 bp, Homo sapiens
aggcagaggcttggctagc

SEQ ID NO: 8783369 - DNA, 22 bp, Homo sapiens
aggcagaggagaatgatcttcc

SEQ ID NO: 8783370 - DNA, 22 bp, Homo sapiens
aggcagaggagaatgatcttcc

SEQ ID NO: 8783371 - DNA, 22 bp, Homo sapiens
aggcagaggagaatgatcttcc

SEQ ID NO: 8783372 - DNA, 23 bp, Homo sapiens
aggcagagccaaggtcaaaaccc

SEQ ID NO: 8783373 - DNA, 22 bp, Homo sapiens
aggcagagagcagtggccgtct

SEQ ID NO: 8783374 - DNA, 23 bp, Homo sapiens
aggcagagccaaggtcaaaaccc

SEQ ID NO: 8783375 - DNA, 20 bp, Homo sapiens
aggcagagcgcacttttaga

SEQ ID NO: 8783376 - DNA, 20 bp, Homo sapiens
aggcagagcgcacttttaga

SEQ ID NO: 8783377 - DNA, 22 bp, Homo sapiens
aggcagagctaggaagaattgt

SEQ ID NO: 8783378 - DNA, 20 bp, Homo sapiens
aggcagagcgcacttttaga

SEQ ID NO: 8783379 - DNA, 20 bp, Homo sapiens
aggcagagcgcacttttaga

SEQ ID NO: 8783380 - DNA, 22 bp, Homo sapiens
aggcagagctgatgttctgtga

SEQ ID NO: 8783381 - DNA, 22 bp, Homo sapiens
aggcagagctgatgttctgtga

SEQ ID NO: 8783382 - DNA, 22 bp, Homo sapiens
aggcagagctgatgttctgtga

SEQ ID NO: 8783383 - DNA, 22 bp, Homo sapiens
aggcagagctgatgttctgtga

SEQ ID NO: 8783384 - DNA, 22 bp, Homo sapiens
aggcagagctgatgttctgtga

SEQ ID NO: 8783385 - DNA, 22 bp, Homo sapiens
aggcagagctaggaagaattgt

SEQ ID NO: 8783386 - DNA, 22 bp, Homo sapiens
aggcagagctaggaagaattgt

SEQ ID NO: 8783387 - DNA, 22 bp, Homo sapiens
aggcagagctgatgttctgtga

SEQ ID NO: 8783388 - DNA, 20 bp, Homo sapiens
aggcagctgggaaatgaggg

SEQ ID NO: 8783389 - DNA, 20 bp, Homo sapiens
aggcagctgggaaatgaggg

SEQ ID NO: 8783390 - DNA, 23 bp, Homo sapiens
aggcagctgggtagcatctttct

SEQ ID NO: 8783391 - DNA, 22 bp, Homo sapiens
aggcagctgtgaggactggatt

SEQ ID NO: 8783392 - DNA, 22 bp, Homo sapiens
aggcagctgtgaggactggatt

SEQ ID NO: 8783393 - DNA, 22 bp, Homo sapiens
aggcagctgtgaggactggatt

SEQ ID NO: 8783394 - DNA, 20 bp, Homo sapiens
aggcagctggccaggcaggt

SEQ ID NO: 8783395 - DNA, 20 bp, Homo sapiens
aggcagctggccaggcaggt

SEQ ID NO: 8783396 - DNA, 20 bp, Homo sapiens
aggcagctggccaggcaggt

SEQ ID NO: 8783397 - DNA, 20 bp, Homo sapiens
aggcagctggccaggcaggt

SEQ ID NO: 8783398 - DNA, 20 bp, Homo sapiens
aggcagctgggaaatgaggg

SEQ ID NO: 8783399 - DNA, 20 bp, Homo sapiens
aggcagctggccaggcaggt

SEQ ID NO: 8783400 - DNA, 20 bp, Homo sapiens
aggcagctggccaggcaggt

SEQ ID NO: 8783401 - DNA, 20 bp, Homo sapiens
aggcagctggccaggcaggt

SEQ ID NO: 8783402 - DNA, 20 bp, Homo sapiens
aggcagctggccaggcaggt

SEQ ID NO: 8783403 - DNA, 22 bp, Homo sapiens
aggcagcgtagcaaggctagta

SEQ ID NO: 8783404 - DNA, 22 bp, Homo sapiens
aggcagcgtagcaaggctagta

SEQ ID NO: 8783405 - DNA, 22 bp, Homo sapiens
aggcagcgtagcaaggctagta

SEQ ID NO: 8783406 - DNA, 19 bp, Homo sapiens
aggcagaggcttggctagc

SEQ ID NO: 8783407 - DNA, 22 bp, Homo sapiens
aggcagcgtagcaaggctagta

SEQ ID NO: 8783408 - DNA, 19 bp, Homo sapiens
aggcagaggcttggctagc

SEQ ID NO: 8783409 - DNA, 19 bp, Homo sapiens
aggcagaggcttggctagc

SEQ ID NO: 8783410 - DNA, 21 bp, Homo sapiens
aggcagcgtgagggccactca

SEQ ID NO: 8783411 - DNA, 21 bp, Homo sapiens
aggcagcgtgagggccactca

SEQ ID NO: 8783412 - DNA, 22 bp, Homo sapiens
aggcagctggcaaattctagag

SEQ ID NO: 8783413 - DNA, 22 bp, Homo sapiens
aggcagctggcagcacccaggg

SEQ ID NO: 8783414 - DNA, 22 bp, Homo sapiens
aggcagctggcagcacccaggg

SEQ ID NO: 8783415 - DNA, 22 bp, Homo sapiens
aggcagctggcagcacccaggg

SEQ ID NO: 8783416 - DNA, 22 bp, Homo sapiens
aggcagctggcagcacccaggg

SEQ ID NO: 8783417 - DNA, 22 bp, Homo sapiens
aggcagctgtgaggactggatt

SEQ ID NO: 8783418 - DNA, 22 bp, Homo sapiens
aggcagcttaagccctggccca

SEQ ID NO: 8783419 - DNA, 22 bp, Homo sapiens
aggcagcttaagccctggccca

SEQ ID NO: 8783420 - DNA, 22 bp, Homo sapiens
aggcagcttaagccctggccca

SEQ ID NO: 8783421 - DNA, 22 bp, Homo sapiens
aggcagcttaagccctggccca

SEQ ID NO: 8783422 - DNA, 22 bp, Homo sapiens
aggcagcttctgattagcagcg

SEQ ID NO: 8783423 - DNA, 22 bp, Homo sapiens
aggcagcttctgattagcagcg

SEQ ID NO: 8783424 - DNA, 22 bp, Homo sapiens
aggcagcttctgattagcagcg

SEQ ID NO: 8783425 - DNA, 22 bp, Homo sapiens
aggcagctttaactggtagtag

SEQ ID NO: 8783426 - DNA, 22 bp, Homo sapiens
aggcagctttaactggtagtag

SEQ ID NO: 8783427 - DNA, 22 bp, Homo sapiens
aggcagctttcagtgtctctca

SEQ ID NO: 8783428 - DNA, 22 bp, Homo sapiens
aggcagctttaactggtagtag

SEQ ID NO: 8783429 - DNA, 22 bp, Homo sapiens
aggcagcttctgattagcagcg

SEQ ID NO: 8783430 - DNA, 22 bp, Homo sapiens
aggcagctttctggtgcaccat

SEQ ID NO: 8783431 - DNA, 22 bp, Homo sapiens
aggcagctttcagtgtctctca

SEQ ID NO: 8783432 - DNA, 22 bp, Homo sapiens
aggcagctttcagtgtctctca

SEQ ID NO: 8783433 - DNA, 22 bp, Homo sapiens
aggcagctttctggtgcaccat

SEQ ID NO: 8783434 - DNA, 22 bp, Homo sapiens
aggcagctttctggtgcaccat

SEQ ID NO: 8783435 - DNA, 22 bp, Homo sapiens
aggcagctttctggtgcaccat

SEQ ID NO: 8783436 - DNA, 22 bp, Homo sapiens
aggcagctttctgtaggggtgt

SEQ ID NO: 8783437 - DNA, 22 bp, Homo sapiens
aggcagctttctggtgcaccat

SEQ ID NO: 8783438 - DNA, 22 bp, Homo sapiens
aggcagctttctggtgcaccat

SEQ ID NO: 8783439 - DNA, 22 bp, Homo sapiens
aggcagctttctgtaggggtgt

SEQ ID NO: 8783440 - DNA, 22 bp, Homo sapiens
aggcagctttctgtaggggtgt

SEQ ID NO: 8783441 - DNA, 22 bp, Homo sapiens
ccaaaataacagcccaattcac

SEQ ID NO: 8783442 - DNA, 22 bp, Homo sapiens
ccaaaataacagcccaattcac

SEQ ID NO: 8783443 - DNA, 22 bp, Homo sapiens
ccaaaaggaactttttgaaggt

SEQ ID NO: 8783444 - DNA, 22 bp, Homo sapiens
aggcagctttgtagtaaagcta

SEQ ID NO: 8783445 - DNA, 22 bp, Homo sapiens
aggcagctttgtagtaaagcta

SEQ ID NO: 8783446 - DNA, 23 bp, Homo sapiens
aggcaggcagttcagctgttgtt

SEQ ID NO: 8783447 - DNA, 23 bp, Homo sapiens
aggcaggcagttcagctgttgtt

SEQ ID NO: 8783448 - DNA, 22 bp, Homo sapiens
aggcaggcccctgagaatagac

SEQ ID NO: 8783449 - DNA, 22 bp, Homo sapiens
aggcaggcccctgagaatagac

SEQ ID NO: 8783450 - DNA, 22 bp, Homo sapiens
aggcaggcccctgagaatagac

SEQ ID NO: 8783451 - DNA, 22 bp, Homo sapiens
aggcaggcccctgagaatagac

SEQ ID NO: 8783452 - DNA, 22 bp, Homo sapiens
aggcaggcccctgagaatagac

SEQ ID NO: 8783453 - DNA, 22 bp, Homo sapiens
aggcaggcccctgagaatagac

SEQ ID NO: 8783454 - DNA, 22 bp, Homo sapiens
ccaaaggatgtccctgtgtttt

SEQ ID NO: 8783455 - DNA, 19 bp, Homo sapiens
ccaaaggaagtttccctcc

SEQ ID NO: 8783456 - DNA, 22 bp, Homo sapiens
ccaaagcaagtcacatgatcaa

SEQ ID NO: 8783457 - DNA, 22 bp, Homo sapiens
ccaaagcaagtcacatgatcaa

SEQ ID NO: 8783458 - DNA, 20 bp, Homo sapiens
ccaaagactgccccttccag

SEQ ID NO: 8783459 - DNA, 22 bp, Homo sapiens
ccaaagcaagtcacatgatcaa

SEQ ID NO: 8783460 - DNA, 22 bp, Homo sapiens
ccaaagagctagaattataggc

SEQ ID NO: 8783461 - DNA, 22 bp, Homo sapiens
ccaaagagctagaattataggc

SEQ ID NO: 8783462 - DNA, 21 bp, Homo sapiens
ccaaagaactgccatttgtca

SEQ ID NO: 8783463 - DNA, 22 bp, Homo sapiens
ccaaagacagacttgactagag

SEQ ID NO: 8783464 - DNA, 22 bp, Homo sapiens
ccaaacttaacgatgtttttgt

SEQ ID NO: 8783465 - DNA, 22 bp, Homo sapiens
ccaaacttaacgatgtttttgt

SEQ ID NO: 8783466 - DNA, 22 bp, Homo sapiens
ccaaactgtttcgtatttatgc

SEQ ID NO: 8783467 - DNA, 22 bp, Homo sapiens
ccaaagaaacccaagctcaggg

SEQ ID NO: 8783468 - DNA, 22 bp, Homo sapiens
ccaaagaaacccaagctcaggg

SEQ ID NO: 8783469 - DNA, 22 bp, Homo sapiens
ccaaactgtgtcgtctgcatag

SEQ ID NO: 8783470 - DNA, 22 bp, Homo sapiens
ccaaactgtgtcgtctgcatag

SEQ ID NO: 8783471 - DNA, 22 bp, Homo sapiens
ccaaacaaatccccattcttag

SEQ ID NO: 8783472 - DNA, 22 bp, Homo sapiens
ccaaacaaatccccattcttag

SEQ ID NO: 8783473 - DNA, 22 bp, Homo sapiens
ccaaacaaatccccattcttag

SEQ ID NO: 8783474 - DNA, 22 bp, Homo sapiens
ccaaacatttcaaatttagaga

SEQ ID NO: 8783475 - DNA, 22 bp, Homo sapiens
ccaaaattattacatttgtagg

SEQ ID NO: 8783476 - DNA, 22 bp, Homo sapiens
ccaaaatattagtgcttaagta

SEQ ID NO: 8783477 - DNA, 22 bp, Homo sapiens
ccaaaattattacatttgtagg

SEQ ID NO: 8783478 - DNA, 22 bp, Homo sapiens
ccaaaattaagcctcttatgtt

SEQ ID NO: 8783479 - DNA, 22 bp, Homo sapiens
ccaaaatgtttgaatgcatgtg

SEQ ID NO: 8783480 - DNA, 22 bp, Homo sapiens
ccaaaattaagcctcttatgtt

SEQ ID NO: 8783481 - DNA, 22 bp, Homo sapiens
ccaaaatgtttgaatgcatgtg

SEQ ID NO: 8783482 - DNA, 22 bp, Homo sapiens
aggcaggctagtcgcttgagcc

SEQ ID NO: 8783483 - DNA, 22 bp, Homo sapiens
aggcaggctagtcgcttgagcc

SEQ ID NO: 8783484 - DNA, 22 bp, Homo sapiens
aggcaggctagtcgcttgagcc

SEQ ID NO: 8783485 - DNA, 22 bp, Homo sapiens
aggcaggctagtcgcttgagcc

SEQ ID NO: 8783486 - DNA, 22 bp, Homo sapiens
aggcaggctcaatgcccagtct

SEQ ID NO: 8783487 - DNA, 22 bp, Homo sapiens
aggcaggctcaggcccatgctt

SEQ ID NO: 8783488 - DNA, 22 bp, Homo sapiens
aggcaggctcaatgcccagtct

SEQ ID NO: 8783489 - DNA, 22 bp, Homo sapiens
aggcaggctgctatggagtaga

SEQ ID NO: 8783490 - DNA, 22 bp, Homo sapiens
aggcaggctgctatggagtaga

SEQ ID NO: 8783491 - DNA, 22 bp, Homo sapiens
aggcaggctgctatggagtaga

SEQ ID NO: 8783492 - DNA, 22 bp, Homo sapiens
aggcaggctgctatggagtaga

SEQ ID NO: 8783493 - DNA, 22 bp, Homo sapiens
aggcaggctgctatggagtaga

SEQ ID NO: 8783494 - DNA, 22 bp, Homo sapiens
aggcaggctctgggtatgtgca

SEQ ID NO: 8783495 - DNA, 22 bp, Homo sapiens
aggcaggctgctatggagtaga

SEQ ID NO: 8783496 - DNA, 22 bp, Homo sapiens
aggcaggctcaggcccatgctt

SEQ ID NO: 8783497 - DNA, 22 bp, Homo sapiens
aggcaggctcaggcccatgctt

SEQ ID NO: 8783498 - DNA, 22 bp, Homo sapiens
aggcaggctctgggtatgtgca

SEQ ID NO: 8783499 - DNA, 22 bp, Homo sapiens
aggcaggccctgggccatcccg

SEQ ID NO: 8783500 - DNA, 22 bp, Homo sapiens
aggcaggccctgggccatcccg

SEQ ID NO: 8783501 - DNA, 22 bp, Homo sapiens
aggcaggccctgggccatcccg

SEQ ID NO: 8783502 - DNA, 22 bp, Homo sapiens
aggcaggccctgggccatcccg

SEQ ID NO: 8783503 - DNA, 22 bp, Homo sapiens
aggcaggccgtgtccctcctca

SEQ ID NO: 8783504 - DNA, 22 bp, Homo sapiens
aggcaggccctctggaaaggta

SEQ ID NO: 8783505 - DNA, 22 bp, Homo sapiens
aggcaggccctctggaaaggta

SEQ ID NO: 8783506 - DNA, 22 bp, Homo sapiens
aggcaggccctctggaaaggta

SEQ ID NO: 8783507 - DNA, 22 bp, Homo sapiens
aggcaggccctctggaaaggta

SEQ ID NO: 8783508 - DNA, 22 bp, Homo sapiens
aggcaggccctctggaaaggta

SEQ ID NO: 8783509 - DNA, 18 bp, Homo sapiens
aggcaggcggatcacaag

SEQ ID NO: 8783510 - DNA, 18 bp, Homo sapiens
aggcaggcggatcacaag

SEQ ID NO: 8783511 - DNA, 18 bp, Homo sapiens
aggcaggcggatcacaag

SEQ ID NO: 8783512 - DNA, 18 bp, Homo sapiens
aggcaggcggatcacaag

SEQ ID NO: 8783513 - DNA, 22 bp, Homo sapiens
aggcaggcctacacaatgggag

SEQ ID NO: 8783514 - DNA, 22 bp, Homo sapiens
aggcaggcctacacaatgggag

SEQ ID NO: 8783515 - DNA, 22 bp, Homo sapiens
aggcaggcctacacaatgggag

SEQ ID NO: 8783516 - DNA, 22 bp, Homo sapiens
aggcaggccgtgtccctcctca

SEQ ID NO: 8783517 - DNA, 22 bp, Homo sapiens
aggcactttgaaatttggagct

SEQ ID NO: 8783518 - DNA, 22 bp, Homo sapiens
aggcagagagcagtggccgtct

SEQ ID NO: 8783519 - DNA, 22 bp, Homo sapiens
aggcactttccttgaggagttt

SEQ ID NO: 8783520 - DNA, 22 bp, Homo sapiens
aggcactttccttgaggagttt

SEQ ID NO: 8783521 - DNA, 22 bp, Homo sapiens
aggcactgcagattacaggcgc

SEQ ID NO: 8783522 - DNA, 22 bp, Homo sapiens
aggcactgattctcagagttac

SEQ ID NO: 8783523 - DNA, 22 bp, Homo sapiens
aggcactgattctgttttccat

SEQ ID NO: 8783524 - DNA, 22 bp, Homo sapiens
aggcagagagcagtggccgtct

SEQ ID NO: 8783525 - DNA, 22 bp, Homo sapiens
aggcagagagcagtggccgtct

SEQ ID NO: 8783526 - DNA, 22 bp, Homo sapiens
aggcagagagcagtggccgtct

SEQ ID NO: 8783527 - DNA, 16 bp, Homo sapiens
aggcagagatttaccc

SEQ ID NO: 8783528 - DNA, 22 bp, Homo sapiens
aggcagagagcagtggccgtct

SEQ ID NO: 8783529 - DNA, 16 bp, Homo sapiens
aggcagagatttaccc

SEQ ID NO: 8783530 - DNA, 16 bp, Homo sapiens
aggcagagatttaccc

SEQ ID NO: 8783531 - DNA, 22 bp, Homo sapiens
aggcactgagaggctgtgttgc

SEQ ID NO: 8783532 - DNA, 22 bp, Homo sapiens
aggcactgactcaagggagcca

SEQ ID NO: 8783533 - DNA, 22 bp, Homo sapiens
aggcactgattctcagagttac

SEQ ID NO: 8783534 - DNA, 22 bp, Homo sapiens
aggcactgactcaagggagcca

SEQ ID NO: 8783535 - DNA, 22 bp, Homo sapiens
aggcactgacctgcttccttga

SEQ ID NO: 8783536 - DNA, 22 bp, Homo sapiens
aggcactgactcaagggagcca

SEQ ID NO: 8783537 - DNA, 22 bp, Homo sapiens
aggcactgacagattctgtgtc

SEQ ID NO: 8783538 - DNA, 22 bp, Homo sapiens
aggcactgactcaagggagcca

SEQ ID NO: 8783539 - DNA, 22 bp, Homo sapiens
aggcactgactcaagggagcca

SEQ ID NO: 8783540 - DNA, 22 bp, Homo sapiens
aggcactgacctgcttccttga

SEQ ID NO: 8783541 - DNA, 22 bp, Homo sapiens
aggcactgacagattctgtgtc

SEQ ID NO: 8783542 - DNA, 23 bp, Homo sapiens
aggcactgaatgtgtcagtgagt

SEQ ID NO: 8783543 - DNA, 23 bp, Homo sapiens
aggcactgaatgtgtcagtgagt

SEQ ID NO: 8783544 - DNA, 22 bp, Homo sapiens
aggcactgacaattctggactg

SEQ ID NO: 8783545 - DNA, 22 bp, Homo sapiens
aggcactgacaattctggactg

SEQ ID NO: 8783546 - DNA, 22 bp, Homo sapiens
aggcactgaaggaagcttgcgc

SEQ ID NO: 8783547 - DNA, 22 bp, Homo sapiens
aggcactgaaggaagcttgcgc

SEQ ID NO: 8783548 - DNA, 22 bp, Homo sapiens
aggcactgaagtggtaaatgta

SEQ ID NO: 8783549 - DNA, 22 bp, Homo sapiens
aggcactgaagtggtaaatgta

SEQ ID NO: 8783550 - DNA, 22 bp, Homo sapiens
aggcactgaatatccagtaaaa

SEQ ID NO: 8783551 - DNA, 22 bp, Homo sapiens
aggcactgaatatccagtaaaa

SEQ ID NO: 8783552 - DNA, 23 bp, Homo sapiens
aggcactgaatgtgtcagtgagt

SEQ ID NO: 8783553 - DNA, 22 bp, Homo sapiens
aggcactgaatatccagtaaaa

SEQ ID NO: 8783554 - DNA, 22 bp, Homo sapiens
aggcactgaatatccagtaaaa

SEQ ID NO: 8783555 - DNA, 22 bp, Homo sapiens
aggcactgaagaactctttttg

SEQ ID NO: 8783556 - DNA, 22 bp, Homo sapiens
aggcactgaaaggtggccagag

SEQ ID NO: 8783557 - DNA, 22 bp, Homo sapiens
aggcacagtttcatccccgggc

SEQ ID NO: 8783558 - DNA, 20 bp, Homo sapiens
aggcacagttcctagttggg

SEQ ID NO: 8783559 - DNA, 22 bp, Homo sapiens
aggcacagtgcctggaatcaaa

SEQ ID NO: 8783560 - DNA, 19 bp, Homo sapiens
aggcacaggttgtctggac

SEQ ID NO: 8783561 - DNA, 22 bp, Homo sapiens
aggcacagtgcctggaatcaaa

SEQ ID NO: 8783562 - DNA, 22 bp, Homo sapiens
aggcacagtgcctggaatcaaa

SEQ ID NO: 8783563 - DNA, 19 bp, Homo sapiens
aggcacaggttgtctggac

SEQ ID NO: 8783564 - DNA, 19 bp, Homo sapiens
aggcacaggttgtctggac

SEQ ID NO: 8783565 - DNA, 19 bp, Homo sapiens
aggcacaggttgtctggac

SEQ ID NO: 8783566 - DNA, 19 bp, Homo sapiens
aggcacaggttgtctggac

SEQ ID NO: 8783567 - DNA, 19 bp, Homo sapiens
aggcacaggttgtctggac

SEQ ID NO: 8783568 - DNA, 22 bp, Homo sapiens
aggcacaggtggacttcacagt

SEQ ID NO: 8783569 - DNA, 22 bp, Homo sapiens
aggcacagtgcctggaatcaaa

SEQ ID NO: 8783570 - DNA, 20 bp, Homo sapiens
aggcacagttcctagttggg

SEQ ID NO: 8783571 - DNA, 22 bp, Homo sapiens
aggcacagtggctcacacctgt

SEQ ID NO: 8783572 - DNA, 22 bp, Homo sapiens
aggcacagtggctcacacctgt

SEQ ID NO: 8783573 - DNA, 22 bp, Homo sapiens
aggcacagtggctcacacctgt

SEQ ID NO: 8783574 - DNA, 22 bp, Homo sapiens
aggcacagtggctcacacctgt

SEQ ID NO: 8783575 - DNA, 22 bp, Homo sapiens
aggcacagtggctcacacctgt

SEQ ID NO: 8783576 - DNA, 22 bp, Homo sapiens
aggcacagtggctcacacctgt

SEQ ID NO: 8783577 - DNA, 22 bp, Homo sapiens
aggatagttgtgaagataggct

SEQ ID NO: 8783578 - DNA, 22 bp, Homo sapiens
aggatacagcgtttttcccaca

SEQ ID NO: 8783579 - DNA, 22 bp, Homo sapiens
aggatacacggggatttatgta

SEQ ID NO: 8783580 - DNA, 22 bp, Homo sapiens
aggatacaagtctcagaatgct

SEQ ID NO: 8783581 - DNA, 22 bp, Homo sapiens
aggatacatgttttttatcaat

SEQ ID NO: 8783582 - DNA, 21 bp, Homo sapiens
aggatattaggtgatttgggt

SEQ ID NO: 8783583 - DNA, 23 bp, Homo sapiens
aggatcctggtacaggagcagag

SEQ ID NO: 8783584 - DNA, 22 bp, Homo sapiens
aggatcctttggccacttctta

SEQ ID NO: 8783585 - DNA, 22 bp, Homo sapiens
aggatacaaaacgtcttgcaga

SEQ ID NO: 8783586 - DNA, 22 bp, Homo sapiens
aggataactttgaaagtaaatt

SEQ ID NO: 8783587 - DNA, 22 bp, Homo sapiens
aggataagtttgattcttgcca

SEQ ID NO: 8783588 - DNA, 22 bp, Homo sapiens
aggataactataggataatgct

SEQ ID NO: 8783589 - DNA, 22 bp, Homo sapiens
aggataacgacagtgacgacga

SEQ ID NO: 8783590 - DNA, 22 bp, Homo sapiens
aggagtttcctttagtttctgg

SEQ ID NO: 8783591 - DNA, 22 bp, Homo sapiens
aggagtttatccgagggcataa

SEQ ID NO: 8783592 - DNA, 22 bp, Homo sapiens
aggagtttggcacatgtatgca

SEQ ID NO: 8783593 - DNA, 22 bp, Homo sapiens
aggagttgattacgtttatttt

SEQ ID NO: 8783594 - DNA, 21 bp, Homo sapiens
aggagttgagtgcacagttgg

SEQ ID NO: 8783595 - DNA, 21 bp, Homo sapiens
aggagttgctgtggcctggtt

SEQ ID NO: 8783596 - DNA, 23 bp, Homo sapiens
aggagttgcatgatttttagagc

SEQ ID NO: 8783597 - DNA, 22 bp, Homo sapiens
aggagttggtcaccgtggccca

SEQ ID NO: 8783598 - DNA, 22 bp, Homo sapiens
aggagttgtatgtccaagggac

SEQ ID NO: 8783599 - DNA, 22 bp, Homo sapiens
aggagttggtgctctccaaata

SEQ ID NO: 8783600 - DNA, 16 bp, Homo sapiens
aggagttgaggctatt

SEQ ID NO: 8783601 - DNA, 23 bp, Homo sapiens
aggagttgagggttgggttggca

SEQ ID NO: 8783602 - DNA, 22 bp, Homo sapiens
aggagtgttgcttcagggaagc

SEQ ID NO: 8783603 - DNA, 22 bp, Homo sapiens
aggagttatggcagaatcaaat

SEQ ID NO: 8783604 - DNA, 22 bp, Homo sapiens
aggagtgttcagcgtggggatg

SEQ ID NO: 8783605 - DNA, 22 bp, Homo sapiens
aggatgaatatttagtgggata

SEQ ID NO: 8783606 - DNA, 22 bp, Homo sapiens
aggatcttgctgtagaggatag

SEQ ID NO: 8783607 - DNA, 22 bp, Homo sapiens
aggatcttatgtaataattatg

SEQ ID NO: 8783608 - DNA, 22 bp, Homo sapiens
catgtctactgaggctttatgg

SEQ ID NO: 8783609 - DNA, 22 bp, Homo sapiens
catgtctgagtagagtgtgatt

SEQ ID NO: 8783610 - DNA, 22 bp, Homo sapiens
catgtctgagtagagtgtgatt

SEQ ID NO: 8783611 - DNA, 22 bp, Homo sapiens
catgtgtgaagactgcgggcca

SEQ ID NO: 8783612 - DNA, 22 bp, Homo sapiens
catgtgtgaatcttgtgatcat

SEQ ID NO: 8783613 - DNA, 22 bp, Homo sapiens
catgtgtgaatcttgtgatcat

SEQ ID NO: 8783614 - DNA, 22 bp, Homo sapiens
catgtgtgaagactgcgggcca

SEQ ID NO: 8783615 - DNA, 22 bp, Homo sapiens
catgtgtctttatggagccaca

SEQ ID NO: 8783616 - DNA, 23 bp, Homo sapiens
catgtgtgacagtatcactgttt

SEQ ID NO: 8783617 - DNA, 22 bp, Homo sapiens
catgtgtgagtatatcttatcc

SEQ ID NO: 8783618 - DNA, 22 bp, Homo sapiens
catgtgtgagtgagcagtcttc

SEQ ID NO: 8783619 - DNA, 22 bp, Homo sapiens
catgtgtgagtgagcagtcttc

SEQ ID NO: 8783620 - DNA, 22 bp, Homo sapiens
catgtgtgcaccaaccctatgt

SEQ ID NO: 8783621 - DNA, 22 bp, Homo sapiens
catgtgtggagggcatgcatgg

SEQ ID NO: 8783622 - DNA, 22 bp, Homo sapiens
catgtgtgggacccttaggttg

SEQ ID NO: 8783623 - DNA, 22 bp, Homo sapiens
catgtgtggagggcatgcatgg

SEQ ID NO: 8783624 - DNA, 23 bp, Homo sapiens
catgtgtgacagtatcactgttt

SEQ ID NO: 8783625 - DNA, 22 bp, Homo sapiens
catgtgtgagtatatcttatcc

SEQ ID NO: 8783626 - DNA, 23 bp, Homo sapiens
catgtgtgacagtatcactgttt

SEQ ID NO: 8783627 - DNA, 22 bp, Homo sapiens
catgtgtgaatcttgtgatcat

SEQ ID NO: 8783628 - DNA, 22 bp, Homo sapiens
catgtgtgacaaactgcctgca

SEQ ID NO: 8783629 - DNA, 22 bp, Homo sapiens
catgtgtgaatcttgtgatcat

SEQ ID NO: 8783630 - DNA, 22 bp, Homo sapiens
catgtgtgacaaactgcctgca

SEQ ID NO: 8783631 - DNA, 22 bp, Homo sapiens
catgtgtgggacccttaggttg

SEQ ID NO: 8783632 - DNA, 22 bp, Homo sapiens
catgtgtggtctgtggctatct

SEQ ID NO: 8783633 - DNA, 22 bp, Homo sapiens
aggcacagggatgcggagccag

SEQ ID NO: 8783634 - DNA, 22 bp, Homo sapiens
catgtgtggtctgtggctatct

SEQ ID NO: 8783635 - DNA, 22 bp, Homo sapiens
aggcacaggtggacttcacagt

SEQ ID NO: 8783636 - DNA, 22 bp, Homo sapiens
aggcacaggtggacttcacagt

SEQ ID NO: 8783637 - DNA, 22 bp, Homo sapiens
aggcacagggatgcggagccag

SEQ ID NO: 8783638 - DNA, 22 bp, Homo sapiens
aggcacagggatgcggagccag

SEQ ID NO: 8783639 - DNA, 22 bp, Homo sapiens
aggcacagggatgcggagccag

SEQ ID NO: 8783640 - DNA, 22 bp, Homo sapiens
ccagaaccaaaagcatggagta

SEQ ID NO: 8783641 - DNA, 22 bp, Homo sapiens
ccagaacacagtggaagaatat

SEQ ID NO: 8783642 - DNA, 22 bp, Homo sapiens
ccagaacagacctgcctgacct

SEQ ID NO: 8783643 - DNA, 22 bp, Homo sapiens
ccagaacacagtggaagaatat

SEQ ID NO: 8783644 - DNA, 22 bp, Homo sapiens
ccagaaagataggaaatcaagt

SEQ ID NO: 8783645 - DNA, 22 bp, Homo sapiens
ccagaaagaatgaactgaaccc

SEQ ID NO: 8783646 - DNA, 22 bp, Homo sapiens
ccagaaaatatggctaaggtga

SEQ ID NO: 8783647 - DNA, 22 bp, Homo sapiens
ccagaaaatatggctaaggtga

SEQ ID NO: 8783648 - DNA, 22 bp, Homo sapiens
ccagaaaatatggctaaggtga

SEQ ID NO: 8783649 - DNA, 22 bp, Homo sapiens
ccagaaaatgcagaacatagaa

SEQ ID NO: 8783650 - DNA, 22 bp, Homo sapiens
ccagaaaatgcagaacatagaa

SEQ ID NO: 8783651 - DNA, 18 bp, Homo sapiens
aggcaggctggagtgact

SEQ ID NO: 8783652 - DNA, 22 bp, Homo sapiens
aggcaggctgctatggagtaga

SEQ ID NO: 8783653 - DNA, 22 bp, Homo sapiens
aggcaggctgctatggagtaga

SEQ ID NO: 8783654 - DNA, 18 bp, Homo sapiens
aggcaggctggagtgact

SEQ ID NO: 8783655 - DNA, 18 bp, Homo sapiens
aggcaggctggagtgact

SEQ ID NO: 8783656 - DNA, 22 bp, Homo sapiens
ccactgggggctgctcccaggt

SEQ ID NO: 8783657 - DNA, 22 bp, Homo sapiens
ccactgggggctgctcccaggt

SEQ ID NO: 8783658 - DNA, 21 bp, Homo sapiens
ccagacttgagtgtatgttgt

SEQ ID NO: 8783659 - DNA, 22 bp, Homo sapiens
ccagactgtggagttcctggtg

SEQ ID NO: 8783660 - DNA, 22 bp, Homo sapiens
ccagactgtggagttcctggtg

SEQ ID NO: 8783661 - DNA, 22 bp, Homo sapiens
ccagactggggctccttgaggg

SEQ ID NO: 8783662 - DNA, 22 bp, Homo sapiens
ccagactgtcagcaacttcaag

SEQ ID NO: 8783663 - DNA, 22 bp, Homo sapiens
ccagagaaagctcacaggcagt

SEQ ID NO: 8783664 - DNA, 22 bp, Homo sapiens
aggccacaagaactaccccatc

SEQ ID NO: 8783665 - DNA, 22 bp, Homo sapiens
aggccacaagaactaccccatc

SEQ ID NO: 8783666 - DNA, 22 bp, Homo sapiens
aggccacagtactttgcagacc

SEQ ID NO: 8783667 - DNA, 22 bp, Homo sapiens
aggccacagtcagtgggtgctg

SEQ ID NO: 8783668 - DNA, 22 bp, Homo sapiens
aggccacagttgaggccagcaa

SEQ ID NO: 8783669 - DNA, 22 bp, Homo sapiens
ccagaccagactgacttgagcc

SEQ ID NO: 8783670 - DNA, 22 bp, Homo sapiens
ccagaccagactgacttgagcc

SEQ ID NO: 8783671 - DNA, 22 bp, Homo sapiens
ccagaccagactgacttgagcc

SEQ ID NO: 8783672 - DNA, 22 bp, Homo sapiens
ccagacatattgacatttgatc

SEQ ID NO: 8783673 - DNA, 22 bp, Homo sapiens
ccagacagttccttgaggttca

SEQ ID NO: 8783674 - DNA, 22 bp, Homo sapiens
ccagaagaccggggagtcaggg

SEQ ID NO: 8783675 - DNA, 22 bp, Homo sapiens
ccagaagaccggggagtcaggg

SEQ ID NO: 8783676 - DNA, 21 bp, Homo sapiens
ccagactggcctatgtggtag

SEQ ID NO: 8783677 - DNA, 22 bp, Homo sapiens
ccagactggggctccttgaggg

SEQ ID NO: 8783678 - DNA, 22 bp, Homo sapiens
ccagactggggctccttgaggg

SEQ ID NO: 8783679 - DNA, 22 bp, Homo sapiens
ccagactgagggtccctgagct

SEQ ID NO: 8783680 - DNA, 22 bp, Homo sapiens
ccagactgcttgcttcccagcc

SEQ ID NO: 8783681 - DNA, 22 bp, Homo sapiens
ccagactattgtgtgtcttggg

SEQ ID NO: 8783682 - DNA, 21 bp, Homo sapiens
ccagactcagaagtttaacca

SEQ ID NO: 8783683 - DNA, 22 bp, Homo sapiens
ccagactcatctgccattgctg

SEQ ID NO: 8783684 - DNA, 22 bp, Homo sapiens
ccagacctaagcatcagtgcat

SEQ ID NO: 8783685 - DNA, 22 bp, Homo sapiens
ccagaccctgctctggggctct

SEQ ID NO: 8783686 - DNA, 22 bp, Homo sapiens
ccagagctgaggagatgggctt

SEQ ID NO: 8783687 - DNA, 22 bp, Homo sapiens
aggccaggttcctcaatcttga

SEQ ID NO: 8783688 - DNA, 22 bp, Homo sapiens
aggccaggtggtcatgcttgct

SEQ ID NO: 8783689 - DNA, 22 bp, Homo sapiens
aggccagtgcagctggaacaga

SEQ ID NO: 8783690 - DNA, 22 bp, Homo sapiens
aggccagtgcagctggaacaga

SEQ ID NO: 8783691 - DNA, 22 bp, Homo sapiens
aggccagtgcagctggaacaga

SEQ ID NO: 8783692 - DNA, 22 bp, Homo sapiens
aggccagtggttctctgtgtcc

SEQ ID NO: 8783693 - DNA, 22 bp, Homo sapiens
ccagcagctttgcatacactaa

SEQ ID NO: 8783694 - DNA, 19 bp, Homo sapiens
ccagcagctttgattctct

SEQ ID NO: 8783695 - DNA, 22 bp, Homo sapiens
aggcccagactcagcggggcgg

SEQ ID NO: 8783696 - DNA, 19 bp, Homo sapiens
ccagcagctttgattctct

SEQ ID NO: 8783697 - DNA, 22 bp, Homo sapiens
ccagcagctttgcatacactaa

SEQ ID NO: 8783698 - DNA, 22 bp, Homo sapiens
aggccatgaggtcatgggagat

SEQ ID NO: 8783699 - DNA, 22 bp, Homo sapiens
aggcccagactcagcggggcgg

SEQ ID NO: 8783700 - DNA, 22 bp, Homo sapiens
aggcccagactcagcggggcgg

SEQ ID NO: 8783701 - DNA, 22 bp, Homo sapiens
aggcccaaaagaaaccactggg

SEQ ID NO: 8783702 - DNA, 22 bp, Homo sapiens
ccagagctaaacacacaggctg

SEQ ID NO: 8783703 - DNA, 22 bp, Homo sapiens
ccagagctaaacacacaggctg

SEQ ID NO: 8783704 - DNA, 22 bp, Homo sapiens
ccagagctaaacacacaggctg

SEQ ID NO: 8783705 - DNA, 17 bp, Homo sapiens
ccagagctactgagact

SEQ ID NO: 8783706 - DNA, 22 bp, Homo sapiens
ccagagctccagggctacagaa

SEQ ID NO: 8783707 - DNA, 22 bp, Homo sapiens
ccagagctgaggagatgggctt

SEQ ID NO: 8783708 - DNA, 22 bp, Homo sapiens
ccagagctccagggctacagaa

SEQ ID NO: 8783709 - DNA, 22 bp, Homo sapiens
aggccacgctaatggggccaag

SEQ ID NO: 8783710 - DNA, 22 bp, Homo sapiens
aggccacatagcttgcatgtag

SEQ ID NO: 8783711 - DNA, 22 bp, Homo sapiens
aggccaccaccctatctcctgg

SEQ ID NO: 8783712 - DNA, 22 bp, Homo sapiens
aggccacatagcttgcatgtag

SEQ ID NO: 8783713 - DNA, 22 bp, Homo sapiens
aggccacatagcttgcatgtag

SEQ ID NO: 8783714 - DNA, 22 bp, Homo sapiens
ccagagcctggcatctgcataa

SEQ ID NO: 8783715 - DNA, 22 bp, Homo sapiens
aggccagaaatgtcagggagtg

SEQ ID NO: 8783716 - DNA, 22 bp, Homo sapiens
aggccagaaatgtcagggagtg

SEQ ID NO: 8783717 - DNA, 22 bp, Homo sapiens
aggccagaaatgtcagggagtg

SEQ ID NO: 8783718 - DNA, 22 bp, Homo sapiens
aggcggtgtgctttgcagagca

SEQ ID NO: 8783719 - DNA, 22 bp, Homo sapiens
aggcgtgggaggatctgaggcc

SEQ ID NO: 8783720 - DNA, 22 bp, Homo sapiens
aggcggtggccaaggagcggga

SEQ ID NO: 8783721 - DNA, 22 bp, Homo sapiens
aggcggcttctgaggaggctgc

SEQ ID NO: 8783722 - DNA, 22 bp, Homo sapiens
aggcgctgtgcttggggctgga

SEQ ID NO: 8783723 - DNA, 22 bp, Homo sapiens
aggcgctgcgctggggccagaa

SEQ ID NO: 8783724 - DNA, 22 bp, Homo sapiens
aggcgctgcgctggggccagaa

SEQ ID NO: 8783725 - DNA, 22 bp, Homo sapiens
aggcgctgcatgtgaaggagtt

SEQ ID NO: 8783726 - DNA, 22 bp, Homo sapiens
aggcggctccgggagtgtgggc

SEQ ID NO: 8783727 - DNA, 19 bp, Homo sapiens
aggcggctcgcgcgcctcc

SEQ ID NO: 8783728 - DNA, 22 bp, Homo sapiens
aggcggctccgggagtgtgggc

SEQ ID NO: 8783729 - DNA, 22 bp, Homo sapiens
aggcggctccgggagtgtgggc

SEQ ID NO: 8783730 - DNA, 22 bp, Homo sapiens
aggcggctggtgtcctgcaggt

SEQ ID NO: 8783731 - DNA, 22 bp, Homo sapiens
aggcggaagatggccccataga

SEQ ID NO: 8783732 - DNA, 22 bp, Homo sapiens
ccaggaaggtgtttaactagag

SEQ ID NO: 8783733 - DNA, 22 bp, Homo sapiens
ccaggaaggtatgggaagaaaa

SEQ ID NO: 8783734 - DNA, 22 bp, Homo sapiens
ccaggaaggtgtttaactagag

SEQ ID NO: 8783735 - DNA, 22 bp, Homo sapiens
ccaggaagtatgacccaacaga

SEQ ID NO: 8783736 - DNA, 22 bp, Homo sapiens
aggcctggtgtgccggatgcag

SEQ ID NO: 8783737 - DNA, 22 bp, Homo sapiens
ccaggacaagccagagggacag

SEQ ID NO: 8783738 - DNA, 22 bp, Homo sapiens
ccaggacaagccagagggacag

SEQ ID NO: 8783739 - DNA, 22 bp, Homo sapiens
aggcgctgcatgtgaaggagtt

SEQ ID NO: 8783740 - DNA, 22 bp, Homo sapiens
aggcctgtctgaggtccccact

SEQ ID NO: 8783741 - DNA, 22 bp, Homo sapiens
aggcctgtaatcccagcacttt

SEQ ID NO: 8783742 - DNA, 22 bp, Homo sapiens
ccaggaaggtatgggaagaaaa

SEQ ID NO: 8783743 - DNA, 22 bp, Homo sapiens
ccaggaaggtatgggaagaaaa

SEQ ID NO: 8783744 - DNA, 22 bp, Homo sapiens
ccaggaaggcgttgttcctctc

SEQ ID NO: 8783745 - DNA, 22 bp, Homo sapiens
ccaggaaggcgttgttcctctc

SEQ ID NO: 8783746 - DNA, 22 bp, Homo sapiens
ccaggaagggctctttaaagac

SEQ ID NO: 8783747 - DNA, 22 bp, Homo sapiens
ccaggaaggcgttgttcctctc

SEQ ID NO: 8783748 - DNA, 22 bp, Homo sapiens
ccaggaaggcaggcctccccgc

SEQ ID NO: 8783749 - DNA, 22 bp, Homo sapiens
ccaggaaggcctggatgccccc

SEQ ID NO: 8783750 - DNA, 22 bp, Homo sapiens
ccaggaaggcctggatgccccc

SEQ ID NO: 8783751 - DNA, 22 bp, Homo sapiens
ccaggaaggatcgtttgggagt

SEQ ID NO: 8783752 - DNA, 22 bp, Homo sapiens
ccaggaaggcaggcctccccgc

SEQ ID NO: 8783753 - DNA, 18 bp, Homo sapiens
aggcctgggaagctgagg

SEQ ID NO: 8783754 - DNA, 18 bp, Homo sapiens
aggcctgggaagctgagg

SEQ ID NO: 8783755 - DNA, 22 bp, Homo sapiens
aggcctgggacgggagccgtga

SEQ ID NO: 8783756 - DNA, 18 bp, Homo sapiens
aggcctgggaagctgagg

SEQ ID NO: 8783757 - DNA, 18 bp, Homo sapiens
aggcctgggaagctgagg

SEQ ID NO: 8783758 - DNA, 22 bp, Homo sapiens
aggcctggcatgagacctgaga

SEQ ID NO: 8783759 - DNA, 22 bp, Homo sapiens
aggcctggccccagttgctagg

SEQ ID NO: 8783760 - DNA, 22 bp, Homo sapiens
aggcctgctgtgtagcctgttg

SEQ ID NO: 8783761 - DNA, 22 bp, Homo sapiens
aggcctgctgtgtagcctgttg

SEQ ID NO: 8783762 - DNA, 22 bp, Homo sapiens
aggcctgctgtgtagcctgttg

SEQ ID NO: 8783763 - DNA, 22 bp, Homo sapiens
aggcctggcctgggcggcattg

SEQ ID NO: 8783764 - DNA, 22 bp, Homo sapiens
aggcctggcctgggcggcattg

SEQ ID NO: 8783765 - DNA, 22 bp, Homo sapiens
aggcctggcctgggcggcattg

SEQ ID NO: 8783766 - DNA, 22 bp, Homo sapiens
aggcctggcctgggcggcattg

SEQ ID NO: 8783767 - DNA, 22 bp, Homo sapiens
aggcctggcctgggcggcattg

SEQ ID NO: 8783768 - DNA, 22 bp, Homo sapiens
aggcctggctttggtttgctga

SEQ ID NO: 8783769 - DNA, 22 bp, Homo sapiens
aggcctggctttggtttgctga

SEQ ID NO: 8783770 - DNA, 22 bp, Homo sapiens
aggcctggcctttatgttcaag

SEQ ID NO: 8783771 - DNA, 22 bp, Homo sapiens
aggcctggcctgggcggcattg

SEQ ID NO: 8783772 - DNA, 22 bp, Homo sapiens
aggcctggcctttatgttcaag

SEQ ID NO: 8783773 - DNA, 22 bp, Homo sapiens
aggcctggcctttatgttcaag

SEQ ID NO: 8783774 - DNA, 22 bp, Homo sapiens
ccagctctggcttcttgctggg

SEQ ID NO: 8783775 - DNA, 22 bp, Homo sapiens
ccagctctggcttcttgctggg

SEQ ID NO: 8783776 - DNA, 22 bp, Homo sapiens
ccagctctggcttcttgctggg

SEQ ID NO: 8783777 - DNA, 22 bp, Homo sapiens
ccagctctgcttgcccagtcag

SEQ ID NO: 8783778 - DNA, 21 bp, Homo sapiens
ccagctctgcctccagttggt

SEQ ID NO: 8783779 - DNA, 22 bp, Homo sapiens
ccagctctgcttgcccagtcag

SEQ ID NO: 8783780 - DNA, 22 bp, Homo sapiens
ccagctctgcttgcccagtcag

SEQ ID NO: 8783781 - DNA, 22 bp, Homo sapiens
ccagctctgcttgcccagtcag

SEQ ID NO: 8783782 - DNA, 22 bp, Homo sapiens
ccagctctgcttgcccagtcag

SEQ ID NO: 8783783 - DNA, 22 bp, Homo sapiens
ccagctctgtaagctgtgaaat

SEQ ID NO: 8783784 - DNA, 22 bp, Homo sapiens
ccagctctgtaagctgtgaaat

SEQ ID NO: 8783785 - DNA, 22 bp, Homo sapiens
ccagctctgtaagctgtgaaat

SEQ ID NO: 8783786 - DNA, 22 bp, Homo sapiens
ccagctcttttggctgagtgag

SEQ ID NO: 8783787 - DNA, 22 bp, Homo sapiens
ccagctcttttggctgagtgag

SEQ ID NO: 8783788 - DNA, 22 bp, Homo sapiens
ccagctcttttggctgagtgag

SEQ ID NO: 8783789 - DNA, 22 bp, Homo sapiens
ccagcaggagactagcaacata

SEQ ID NO: 8783790 - DNA, 22 bp, Homo sapiens
ccagcaggagactagcaacata

SEQ ID NO: 8783791 - DNA, 22 bp, Homo sapiens
ccagcaggagatgcctgtgtct

SEQ ID NO: 8783792 - DNA, 23 bp, Homo sapiens
ccagctccgtgagcctcgggctc

SEQ ID NO: 8783793 - DNA, 21 bp, Homo sapiens
ccagctctgcctccagttggt

SEQ ID NO: 8783794 - DNA, 22 bp, Homo sapiens
ccagctccggtgtgcttatttc

SEQ ID NO: 8783795 - DNA, 22 bp, Homo sapiens
ccagctccggtgtgcttatttc

SEQ ID NO: 8783796 - DNA, 22 bp, Homo sapiens
ccagctggagctcgcagatagg

SEQ ID NO: 8783797 - DNA, 22 bp, Homo sapiens
ccagctggagctcgcagatagg

SEQ ID NO: 8783798 - DNA, 22 bp, Homo sapiens
ccagctggcaggagagtcaggg

SEQ ID NO: 8783799 - DNA, 22 bp, Homo sapiens
ccagctggcactgtggctgccc

SEQ ID NO: 8783800 - DNA, 22 bp, Homo sapiens
ccagctggcaggagagtcaggg

SEQ ID NO: 8783801 - DNA, 22 bp, Homo sapiens
ccagctggcaggagagtcaggg

SEQ ID NO: 8783802 - DNA, 22 bp, Homo sapiens
ccagctggcaggagagtcaggg

SEQ ID NO: 8783803 - DNA, 22 bp, Homo sapiens
aggcctgctgtcttgaggccaa

SEQ ID NO: 8783804 - DNA, 22 bp, Homo sapiens
aggcctgctgtcttgaggccaa

SEQ ID NO: 8783805 - DNA, 22 bp, Homo sapiens
aggcctgccttgagcaaccagc

SEQ ID NO: 8783806 - DNA, 22 bp, Homo sapiens
aggcctgctgtcttgaggccaa

SEQ ID NO: 8783807 - DNA, 22 bp, Homo sapiens
aggcctgctgtcttgaggccaa

SEQ ID NO: 8783808 - DNA, 22 bp, Homo sapiens
ccagctggcccagctgtgctcc

SEQ ID NO: 8783809 - DNA, 22 bp, Homo sapiens
aggcctctgctggaaagagttg

SEQ ID NO: 8783810 - DNA, 22 bp, Homo sapiens
ccagctcttttggctgagtgag

SEQ ID NO: 8783811 - DNA, 22 bp, Homo sapiens
ccagctgagaagtgtaaagtga

SEQ ID NO: 8783812 - DNA, 22 bp, Homo sapiens
ccagctgacgatgcctggtctc

SEQ ID NO: 8783813 - DNA, 22 bp, Homo sapiens
ccagctgacgatgcctggtctc

SEQ ID NO: 8783814 - DNA, 22 bp, Homo sapiens
ccagctggaacggcagcccagc

SEQ ID NO: 8783815 - DNA, 20 bp, Homo sapiens
ccagctgagccaaggggaga

SEQ ID NO: 8783816 - DNA, 22 bp, Homo sapiens
ccagctggaaacaaatagagtg

SEQ ID NO: 8783817 - DNA, 22 bp, Homo sapiens
ccagctggaagagtgcagaact

SEQ ID NO: 8783818 - DNA, 22 bp, Homo sapiens
ccagctggaagagtgcagaact

SEQ ID NO: 8783819 - DNA, 22 bp, Homo sapiens
ccagctggaagagtgcagaact

SEQ ID NO: 8783820 - DNA, 22 bp, Homo sapiens
ccagctggaagagtgcagaact

SEQ ID NO: 8783821 - DNA, 22 bp, Homo sapiens
ccagctggaagagtgcagaact

SEQ ID NO: 8783822 - DNA, 22 bp, Homo sapiens
ccagctggagctcgcagatagg

SEQ ID NO: 8783823 - DNA, 22 bp, Homo sapiens
ccagctggagccaaggtggact

SEQ ID NO: 8783824 - DNA, 22 bp, Homo sapiens
ccagctggagccaaggtggact

SEQ ID NO: 8783825 - DNA, 22 bp, Homo sapiens
ccagctggagccaaggtggact

SEQ ID NO: 8783826 - DNA, 22 bp, Homo sapiens
ccaggctggtctgaatttctag

SEQ ID NO: 8783827 - DNA, 22 bp, Homo sapiens
ccaggctgtaaacaccttcaaa

SEQ ID NO: 8783828 - DNA, 22 bp, Homo sapiens
ccagggcagcgcccctccacgc

SEQ ID NO: 8783829 - DNA, 22 bp, Homo sapiens
ccagggcaggagaaagactcac

SEQ ID NO: 8783830 - DNA, 22 bp, Homo sapiens
ccagggcctcgtgttctgagtg

SEQ ID NO: 8783831 - DNA, 22 bp, Homo sapiens
ccagggcctgagggcgacgccc

SEQ ID NO: 8783832 - DNA, 22 bp, Homo sapiens
ccagggcctgagggcgacgccc

SEQ ID NO: 8783833 - DNA, 22 bp, Homo sapiens
ccagggcctgagggcgacgccc

SEQ ID NO: 8783834 - DNA, 22 bp, Homo sapiens
ccagggcctgccacttagcaag

SEQ ID NO: 8783835 - DNA, 22 bp, Homo sapiens
ccagggcctgccacttagcaag

SEQ ID NO: 8783836 - DNA, 22 bp, Homo sapiens
ccagggcctcgtgttctgagtg

SEQ ID NO: 8783837 - DNA, 22 bp, Homo sapiens
ccagggcctgccacttagcaag

SEQ ID NO: 8783838 - DNA, 22 bp, Homo sapiens
ccagggcctgccacttagcaag

SEQ ID NO: 8783839 - DNA, 23 bp, Homo sapiens
ccagggctacgggcaccgtcctg

SEQ ID NO: 8783840 - DNA, 23 bp, Homo sapiens
ccagggctacgggcaccgtcctg

SEQ ID NO: 8783841 - DNA, 20 bp, Homo sapiens
ccagggctggctcctgggat

SEQ ID NO: 8783842 - DNA, 22 bp, Homo sapiens
ccagggctccattgctcatcct

SEQ ID NO: 8783843 - DNA, 20 bp, Homo sapiens
ccagggctggctcctgggat

SEQ ID NO: 8783844 - DNA, 20 bp, Homo sapiens
ccagggctggctcctgggat

SEQ ID NO: 8783845 - DNA, 22 bp, Homo sapiens
ccagggctcaggctcccagtgg

SEQ ID NO: 8783846 - DNA, 22 bp, Homo sapiens
ccagggctccattgctcatcct

SEQ ID NO: 8783847 - DNA, 19 bp, Homo sapiens
ccagggctccaagctgagt

SEQ ID NO: 8783848 - DNA, 19 bp, Homo sapiens
ccagggctccaagctgagt

SEQ ID NO: 8783849 - DNA, 22 bp, Homo sapiens
ccaggtctgcgggcggcaggca

SEQ ID NO: 8783850 - DNA, 22 bp, Homo sapiens
ccaggtctcgggtctgctcgtg

SEQ ID NO: 8783851 - DNA, 22 bp, Homo sapiens
ccaggtctggaaccaccagggc

SEQ ID NO: 8783852 - DNA, 22 bp, Homo sapiens
aggctgaggcaggtggatcacc

SEQ ID NO: 8783853 - DNA, 22 bp, Homo sapiens
aggctgaggcaggtggatcacc

SEQ ID NO: 8783854 - DNA, 22 bp, Homo sapiens
aggctgaggcaggtggatcacc

SEQ ID NO: 8783855 - DNA, 22 bp, Homo sapiens
aggctgaggcaagaggatcact

SEQ ID NO: 8783856 - DNA, 22 bp, Homo sapiens
aggctgaggcaagaggatcact

SEQ ID NO: 8783857 - DNA, 22 bp, Homo sapiens
aggctgaggcaagaggatcact

SEQ ID NO: 8783858 - DNA, 22 bp, Homo sapiens
aggctgaggatccctgtgttct

SEQ ID NO: 8783859 - DNA, 22 bp, Homo sapiens
aggctgaggcaagaggatcact

SEQ ID NO: 8783860 - DNA, 22 bp, Homo sapiens
aggctgaggatcgtactttcca

SEQ ID NO: 8783861 - DNA, 22 bp, Homo sapiens
aggctgaggatccctgtgttct

SEQ ID NO: 8783862 - DNA, 22 bp, Homo sapiens
aggctgagctgacctggtttgg

SEQ ID NO: 8783863 - DNA, 22 bp, Homo sapiens
aggctgagctgacctggtttgg

SEQ ID NO: 8783864 - DNA, 22 bp, Homo sapiens
aggctgagctgacctggtttgg

SEQ ID NO: 8783865 - DNA, 22 bp, Homo sapiens
ccagggctggtgggagatgctg

SEQ ID NO: 8783866 - DNA, 22 bp, Homo sapiens
ccagggctgggtttgtcggtgt

SEQ ID NO: 8783867 - DNA, 22 bp, Homo sapiens
ccagggctggtggctgcagagg

SEQ ID NO: 8783868 - DNA, 22 bp, Homo sapiens
ccaggctggaatcaatattctg

SEQ ID NO: 8783869 - DNA, 22 bp, Homo sapiens
ccaggctggaatcaatattctg

SEQ ID NO: 8783870 - DNA, 22 bp, Homo sapiens
ccaggctgctttattactctgt

SEQ ID NO: 8783871 - DNA, 22 bp, Homo sapiens
ccaggctgctttattactctgt

SEQ ID NO: 8783872 - DNA, 22 bp, Homo sapiens
ccaggctgcttagccttatctt

SEQ ID NO: 8783873 - DNA, 22 bp, Homo sapiens
ccaggctgctttattactctgt

SEQ ID NO: 8783874 - DNA, 22 bp, Homo sapiens
ccaggctggagtatagtggcgc

SEQ ID NO: 8783875 - DNA, 22 bp, Homo sapiens
ccaggctggagtatagtggcgc

SEQ ID NO: 8783876 - DNA, 22 bp, Homo sapiens
ccaggctggagtgcaatggcat

SEQ ID NO: 8783877 - DNA, 22 bp, Homo sapiens
ccaggctggagtatagtggcgc

SEQ ID NO: 8783878 - DNA, 22 bp, Homo sapiens
ccaggctggagtatagtggcgc

SEQ ID NO: 8783879 - DNA, 22 bp, Homo sapiens
ccaggctgggctacaagttgag

SEQ ID NO: 8783880 - DNA, 22 bp, Homo sapiens
ccaggctgggctacaagttgag

SEQ ID NO: 8783881 - DNA, 22 bp, Homo sapiens
ccaggctgggctacaagttgag

SEQ ID NO: 8783882 - DNA, 22 bp, Homo sapiens
ccaggctgggcggggaacctgg

SEQ ID NO: 8783883 - DNA, 22 bp, Homo sapiens
ccaggctgggcggggaacctgg

SEQ ID NO: 8783884 - DNA, 22 bp, Homo sapiens
ccaggctgggcggggaacctgg

SEQ ID NO: 8783885 - DNA, 22 bp, Homo sapiens
ccaggctgggcggggaacctgg

SEQ ID NO: 8783886 - DNA, 21 bp, Homo sapiens
ccaggctgggagggcagttcc

SEQ ID NO: 8783887 - DNA, 21 bp, Homo sapiens
ccaggctgggagggcagttcc

SEQ ID NO: 8783888 - DNA, 22 bp, Homo sapiens
ccaggctgctgttggtgtccgc

SEQ ID NO: 8783889 - DNA, 22 bp, Homo sapiens
ccaggctctgcgctggacatgg

SEQ ID NO: 8783890 - DNA, 22 bp, Homo sapiens
ccaggctgctgttggtgtccgc

SEQ ID NO: 8783891 - DNA, 22 bp, Homo sapiens
ccaggctgctgttggtgtccgc

SEQ ID NO: 8783892 - DNA, 22 bp, Homo sapiens
ccaggctgctgttggtgtccgc

SEQ ID NO: 8783893 - DNA, 22 bp, Homo sapiens
aggctacttctagagggacaat

SEQ ID NO: 8783894 - DNA, 22 bp, Homo sapiens
aggctacttctagagggacaat

SEQ ID NO: 8783895 - DNA, 22 bp, Homo sapiens
aggctacatgttggggtggaag

SEQ ID NO: 8783896 - DNA, 22 bp, Homo sapiens
aggctacaggagacgccaggag

SEQ ID NO: 8783897 - DNA, 22 bp, Homo sapiens
aggctacagatacagaggctac

SEQ ID NO: 8783898 - DNA, 22 bp, Homo sapiens
aggctaagtgattagtgacata

SEQ ID NO: 8783899 - DNA, 22 bp, Homo sapiens
aggctaagtgagtaaaatgtgg

SEQ ID NO: 8783900 - DNA, 22 bp, Homo sapiens
aggctaagtgggtgtcagggcc

SEQ ID NO: 8783901 - DNA, 22 bp, Homo sapiens
aggctaagtgggtgtcagggcc

SEQ ID NO: 8783902 - DNA, 22 bp, Homo sapiens
aggctaagttgattaaattgtt

SEQ ID NO: 8783903 - DNA, 22 bp, Homo sapiens
aggctaagttgattaaattgtt

SEQ ID NO: 8783904 - DNA, 22 bp, Homo sapiens
aggctaaggtgggaggatcgct

SEQ ID NO: 8783905 - DNA, 22 bp, Homo sapiens
aggctaagggatgactggagtg

SEQ ID NO: 8783906 - DNA, 22 bp, Homo sapiens
aggctaagggatgactggagtg

SEQ ID NO: 8783907 - DNA, 22 bp, Homo sapiens
aggctaaggtgggaggatcgct

SEQ ID NO: 8783908 - DNA, 22 bp, Homo sapiens
aggctaagatgtggtctgagca

SEQ ID NO: 8783909 - DNA, 22 bp, Homo sapiens
aggctaaggaccaggagggcca

SEQ ID NO: 8783910 - DNA, 22 bp, Homo sapiens
aggctaaggaccaggagggcca

SEQ ID NO: 8783911 - DNA, 22 bp, Homo sapiens
aggctaaggagtgtgatgctca

SEQ ID NO: 8783912 - DNA, 22 bp, Homo sapiens
aggctaagatgactccaccccc

SEQ ID NO: 8783913 - DNA, 22 bp, Homo sapiens
aggctaagaggccttcagatac

SEQ ID NO: 8783914 - DNA, 22 bp, Homo sapiens
aggctaagagcatttgctgaag

SEQ ID NO: 8783915 - DNA, 22 bp, Homo sapiens
aggctaagaccctcctggggcc

SEQ ID NO: 8783916 - DNA, 22 bp, Homo sapiens
aggctaagaaggctttgttcct

SEQ ID NO: 8783917 - DNA, 22 bp, Homo sapiens
aggctaagaaagattcattgca

SEQ ID NO: 8783918 - DNA, 19 bp, Homo sapiens
aggctaaagagtcttgcgt

SEQ ID NO: 8783919 - DNA, 22 bp, Homo sapiens
aggctggctggcaggggacaca

SEQ ID NO: 8783920 - DNA, 22 bp, Homo sapiens
ccatttgttgtgtattaatatt

SEQ ID NO: 8783921 - DNA, 22 bp, Homo sapiens
aggctggctggggatgcgtctt

SEQ ID NO: 8783922 - DNA, 22 bp, Homo sapiens
aggctggctggcaggggacaca

SEQ ID NO: 8783923 - DNA, 22 bp, Homo sapiens
ccatttgtgcttcttcaaagca

SEQ ID NO: 8783924 - DNA, 22 bp, Homo sapiens
ccatttgtgatgtggcagcatc

SEQ ID NO: 8783925 - DNA, 22 bp, Homo sapiens
ccatttgttgtgtattaatatt

SEQ ID NO: 8783926 - DNA, 22 bp, Homo sapiens
ccatttgtggtttatttgctct

SEQ ID NO: 8783927 - DNA, 22 bp, Homo sapiens
ccatttgtggtttatttgctct

SEQ ID NO: 8783928 - DNA, 17 bp, Homo sapiens
aggctggccttcacagt

SEQ ID NO: 8783929 - DNA, 22 bp, Homo sapiens
aggctggcgacatctggcgggc

SEQ ID NO: 8783930 - DNA, 22 bp, Homo sapiens
aggctggcgacatctggcgggc

SEQ ID NO: 8783931 - DNA, 22 bp, Homo sapiens
aggctggcgacatctggcgggc

SEQ ID NO: 8783932 - DNA, 22 bp, Homo sapiens
aggctggcgacatctggcgggc

SEQ ID NO: 8783933 - DNA, 17 bp, Homo sapiens
aggctggccttcacagt

SEQ ID NO: 8783934 - DNA, 22 bp, Homo sapiens
aggctggcctatttctttatcg

SEQ ID NO: 8783935 - DNA, 22 bp, Homo sapiens
aggctggccctactggctgcct

SEQ ID NO: 8783936 - DNA, 22 bp, Homo sapiens
aggctggccctactggctgcct

SEQ ID NO: 8783937 - DNA, 22 bp, Homo sapiens
aggctggccctactggctgcct

SEQ ID NO: 8783938 - DNA, 22 bp, Homo sapiens
aggctggcgtcaggggctgtac

SEQ ID NO: 8783939 - DNA, 22 bp, Homo sapiens
aggctggcggtgactgctctga

SEQ ID NO: 8783940 - DNA, 22 bp, Homo sapiens
aggctggcggtgactgctctga

SEQ ID NO: 8783941 - DNA, 22 bp, Homo sapiens
ccatttatagatgtatttggct

SEQ ID NO: 8783942 - DNA, 22 bp, Homo sapiens
ccatttacattgtactctgtga

SEQ ID NO: 8783943 - DNA, 22 bp, Homo sapiens
ccatttatagatgtatttggct

SEQ ID NO: 8783944 - DNA, 22 bp, Homo sapiens
ccatttcattgcctgtaaagtg

SEQ ID NO: 8783945 - DNA, 22 bp, Homo sapiens
ccatttgggaatcttccatgga

SEQ ID NO: 8783946 - DNA, 22 bp, Homo sapiens
aggctggagtgctggagtgctg

SEQ ID NO: 8783947 - DNA, 22 bp, Homo sapiens
aggctggagtgcaatggcgtga

SEQ ID NO: 8783948 - DNA, 22 bp, Homo sapiens
aggctggagtgcaatggcgtga

SEQ ID NO: 8783949 - DNA, 22 bp, Homo sapiens
aggctggcccacctcttgtctt

SEQ ID NO: 8783950 - DNA, 22 bp, Homo sapiens
aggctggagtgtagcagtgcag

SEQ ID NO: 8783951 - DNA, 22 bp, Homo sapiens
aggctggagtgtagcagtgcag

SEQ ID NO: 8783952 - DNA, 22 bp, Homo sapiens
aggctggagtgtagcagtgcag

SEQ ID NO: 8783953 - DNA, 22 bp, Homo sapiens
aggctggagcaagggggcatat

SEQ ID NO: 8783954 - DNA, 22 bp, Homo sapiens
aggctggagacccgccaagaaa

SEQ ID NO: 8783955 - DNA, 22 bp, Homo sapiens
aggctggagacccgccaagaaa

SEQ ID NO: 8783956 - DNA, 22 bp, Homo sapiens
aggctggagagtgcagtggcgt

SEQ ID NO: 8783957 - DNA, 22 bp, Homo sapiens
aggctggagagtgcagtggcgt

SEQ ID NO: 8783958 - DNA, 22 bp, Homo sapiens
aggctggagagtgcagtggcgt

SEQ ID NO: 8783959 - DNA, 22 bp, Homo sapiens
aggctggagagtgcagtggcgt

SEQ ID NO: 8783960 - DNA, 19 bp, Homo sapiens
aggctggagacaccaggcc

SEQ ID NO: 8783961 - DNA, 22 bp, Homo sapiens
aggctggaaatcactagattcc

SEQ ID NO: 8783962 - DNA, 22 bp, Homo sapiens
aggctggaaatcactagattcc

SEQ ID NO: 8783963 - DNA, 22 bp, Homo sapiens
aggctggacccgacacctgccc

SEQ ID NO: 8783964 - DNA, 22 bp, Homo sapiens
aggctggaaagggaccagagtg

SEQ ID NO: 8783965 - DNA, 22 bp, Homo sapiens
aggctggaaagggaccagagtg

SEQ ID NO: 8783966 - DNA, 22 bp, Homo sapiens
aggctgcttcagctgcagggag

SEQ ID NO: 8783967 - DNA, 22 bp, Homo sapiens
aggctgcttccttacgtggctg

SEQ ID NO: 8783968 - DNA, 22 bp, Homo sapiens
ccaggtgaaatcttcatggttc

SEQ ID NO: 8783969 - DNA, 22 bp, Homo sapiens
ccaggtctttggccttggcact

SEQ ID NO: 8783970 - DNA, 22 bp, Homo sapiens
ccaggtctttggccttggcact

SEQ ID NO: 8783971 - DNA, 21 bp, Homo sapiens
ccaggtcttggtccttggact

SEQ ID NO: 8783972 - DNA, 21 bp, Homo sapiens
ccaggtcttggtccttggact

SEQ ID NO: 8783973 - DNA, 21 bp, Homo sapiens
ccaggtcttggtccttggact

SEQ ID NO: 8783974 - DNA, 22 bp, Homo sapiens
ccaggtcttggcccccggacct

SEQ ID NO: 8783975 - DNA, 22 bp, Homo sapiens
ccaggtcttgtttgacatcaat

SEQ ID NO: 8783976 - DNA, 22 bp, Homo sapiens
ccaggtcttgtttgacatcaat

SEQ ID NO: 8783977 - DNA, 22 bp, Homo sapiens
ccaggtctttgactaatatgct

SEQ ID NO: 8783978 - DNA, 19 bp, Homo sapiens
ccaggtctggggccagatt

SEQ ID NO: 8783979 - DNA, 22 bp, Homo sapiens
ccaggtctggaaccaccagggc

SEQ ID NO: 8783980 - DNA, 22 bp, Homo sapiens
ccaggtctggcactggccagtc

SEQ ID NO: 8783981 - DNA, 22 bp, Homo sapiens
ccaggtctggcactggccagtc

SEQ ID NO: 8783982 - DNA, 22 bp, Homo sapiens
ccaggtctgtcttcttagctca

SEQ ID NO: 8783983 - DNA, 22 bp, Homo sapiens
ccaggtctgtcttcttagctca

SEQ ID NO: 8783984 - DNA, 22 bp, Homo sapiens
ccaggtcttcactttactgaag

SEQ ID NO: 8783985 - DNA, 22 bp, Homo sapiens
agggctggagccacagctggga

SEQ ID NO: 8783986 - DNA, 22 bp, Homo sapiens
agggctggagggtactagttta

SEQ ID NO: 8783987 - DNA, 22 bp, Homo sapiens
agggctggagggtactagttta

SEQ ID NO: 8783988 - DNA, 22 bp, Homo sapiens
agggctggcatctctaatgctg

SEQ ID NO: 8783989 - DNA, 22 bp, Homo sapiens
agggctggcaagggattgaaat

SEQ ID NO: 8783990 - DNA, 22 bp, Homo sapiens
agggctggcaagggattgaaat

SEQ ID NO: 8783991 - DNA, 22 bp, Homo sapiens
agggctaccaccaagctgcaca

SEQ ID NO: 8783992 - DNA, 22 bp, Homo sapiens
agggctaggaatggaactggag

SEQ ID NO: 8783993 - DNA, 22 bp, Homo sapiens
agggctgctgctccgggcccag

SEQ ID NO: 8783994 - DNA, 22 bp, Homo sapiens
agggctgcatctgcctggtgaa

SEQ ID NO: 8783995 - DNA, 22 bp, Homo sapiens
agggctggagccacagctggga

SEQ ID NO: 8783996 - DNA, 22 bp, Homo sapiens
agggctgcttacctggaatggc

SEQ ID NO: 8783997 - DNA, 22 bp, Homo sapiens
agggctggagccacagctggga

SEQ ID NO: 8783998 - DNA, 22 bp, Homo sapiens
agggctggagccacagctggga

SEQ ID NO: 8783999 - DNA, 22 bp, Homo sapiens
cctcaggccctgtccctgcgcc

SEQ ID NO: 8784000 - DNA, 22 bp, Homo sapiens
cctcaggccctgtccctgcgcc

SEQ ID NO: 8784001 - DNA, 22 bp, Homo sapiens
cctcaggccagggggcggccag

SEQ ID NO: 8784002 - DNA, 22 bp, Homo sapiens
cctcaggccagggggcggccag

SEQ ID NO: 8784003 - DNA, 22 bp, Homo sapiens
cctcaggcaagtcacttaacat

SEQ ID NO: 8784004 - DNA, 22 bp, Homo sapiens
cctcaggatacaggagccacag

SEQ ID NO: 8784005 - DNA, 22 bp, Homo sapiens
agggcgaggagacggaggcaca

SEQ ID NO: 8784006 - DNA, 22 bp, Homo sapiens
agggcgacaatggagagcgttt

SEQ ID NO: 8784007 - DNA, 22 bp, Homo sapiens
agggcgaggagacggaggcaca

SEQ ID NO: 8784008 - DNA, 22 bp, Homo sapiens
agggcgaggagacggaggcaca

SEQ ID NO: 8784009 - DNA, 22 bp, Homo sapiens
agggcgaggagacggaggcaca

SEQ ID NO: 8784010 - DNA, 22 bp, Homo sapiens
agggcgctgaaatactaacatg

SEQ ID NO: 8784011 - DNA, 22 bp, Homo sapiens
agggcgcatctctggggtgaat

SEQ ID NO: 8784012 - DNA, 22 bp, Homo sapiens
agggcgtggtggtgctggagca

SEQ ID NO: 8784013 - DNA, 22 bp, Homo sapiens
agggcgctgaaatactaacatg

SEQ ID NO: 8784014 - DNA, 22 bp, Homo sapiens
agggcgggctcatcacatgctc

SEQ ID NO: 8784015 - DNA, 22 bp, Homo sapiens
agggcgggctcatcacatgctc

SEQ ID NO: 8784016 - DNA, 22 bp, Homo sapiens
ccctggaactcctaggcaagca

SEQ ID NO: 8784017 - DNA, 22 bp, Homo sapiens
agggcctgagctggctgacctc

SEQ ID NO: 8784018 - DNA, 22 bp, Homo sapiens
agggcctccagggcagcagtgg

SEQ ID NO: 8784019 - DNA, 22 bp, Homo sapiens
agggcctccagggcagcagtgg

SEQ ID NO: 8784020 - DNA, 22 bp, Homo sapiens
ccctgctttgcacccaggctgg

SEQ ID NO: 8784021 - DNA, 22 bp, Homo sapiens
ccctgcttccgctgttttctca

SEQ ID NO: 8784022 - DNA, 22 bp, Homo sapiens
ccctgcttccctgggagaggcg

SEQ ID NO: 8784023 - DNA, 22 bp, Homo sapiens
ccctgcttagcacccttgcacc

SEQ ID NO: 8784024 - DNA, 22 bp, Homo sapiens
ccctgctttcaaccttctagct

SEQ ID NO: 8784025 - DNA, 22 bp, Homo sapiens
ccctgcttgtcacccctgggtc

SEQ ID NO: 8784026 - DNA, 22 bp, Homo sapiens
ccctgctttcaaccttctagct

SEQ ID NO: 8784027 - DNA, 22 bp, Homo sapiens
ccctgctttcaaccttctagct

SEQ ID NO: 8784028 - DNA, 19 bp, Homo sapiens
agggcctgcagctcaagct

SEQ ID NO: 8784029 - DNA, 23 bp, Homo sapiens
agggcctgatggctcccgctggc

SEQ ID NO: 8784030 - DNA, 23 bp, Homo sapiens
agggcctgatggctcccgctggc

SEQ ID NO: 8784031 - DNA, 23 bp, Homo sapiens
agggcctgatggctcccgctggc

SEQ ID NO: 8784032 - DNA, 23 bp, Homo sapiens
agggcctgatggctcccgctggc

SEQ ID NO: 8784033 - DNA, 22 bp, Homo sapiens
agggcctgaggctgacggggag

SEQ ID NO: 8784034 - DNA, 22 bp, Homo sapiens
agggcctgagctggctgacctc

SEQ ID NO: 8784035 - DNA, 22 bp, Homo sapiens
agggcctgaggctgacggggag

SEQ ID NO: 8784036 - DNA, 22 bp, Homo sapiens
agggcctgcatcaggagcttgg

SEQ ID NO: 8784037 - DNA, 22 bp, Homo sapiens
agggcctgcatcaggagcttgg

SEQ ID NO: 8784038 - DNA, 22 bp, Homo sapiens
agggcctgcatcaggagcttgg

SEQ ID NO: 8784039 - DNA, 19 bp, Homo sapiens
agggcctgcagctcaagct

SEQ ID NO: 8784040 - DNA, 19 bp, Homo sapiens
agggcctgcagctcaagct

SEQ ID NO: 8784041 - DNA, 23 bp, Homo sapiens
agggcctggcgtggagtgtgtgc

SEQ ID NO: 8784042 - DNA, 19 bp, Homo sapiens
cctcagagctagtgaacat

SEQ ID NO: 8784043 - DNA, 19 bp, Homo sapiens
cctcagagctagtgaacat

SEQ ID NO: 8784044 - DNA, 18 bp, Homo sapiens
cctcagaggcaaattgtt

SEQ ID NO: 8784045 - DNA, 22 bp, Homo sapiens
cctcagcttgatttctgcagag

SEQ ID NO: 8784046 - DNA, 23 bp, Homo sapiens
agggcctggcgtggagtgtgtgc

SEQ ID NO: 8784047 - DNA, 23 bp, Homo sapiens
agggcctggcgtggagtgtgtgc

SEQ ID NO: 8784048 - DNA, 23 bp, Homo sapiens
agggcctggcgtggagtgtgtgc

SEQ ID NO: 8784049 - DNA, 22 bp, Homo sapiens
agggcctggcgcgtggccgccg

SEQ ID NO: 8784050 - DNA, 22 bp, Homo sapiens
agggcctggcgcgtggccgccg

SEQ ID NO: 8784051 - DNA, 20 bp, Homo sapiens
agggcctggagtacagcagg

SEQ ID NO: 8784052 - DNA, 20 bp, Homo sapiens
agggcctggagtacagcagg

SEQ ID NO: 8784053 - DNA, 20 bp, Homo sapiens
agggcctggagtacagcagg

SEQ ID NO: 8784054 - DNA, 22 bp, Homo sapiens
agggcctggactaattggatcc

SEQ ID NO: 8784055 - DNA, 22 bp, Homo sapiens
agggcctggaactgtgggcagg

SEQ ID NO: 8784056 - DNA, 22 bp, Homo sapiens
agggcctggaactgtgggcagg

SEQ ID NO: 8784057 - DNA, 22 bp, Homo sapiens
agggcctggaactgtgggcagg

SEQ ID NO: 8784058 - DNA, 22 bp, Homo sapiens
agggcctggactaattggatcc

SEQ ID NO: 8784059 - DNA, 22 bp, Homo sapiens
agggcctggaactgtgggcagg

SEQ ID NO: 8784060 - DNA, 22 bp, Homo sapiens
agggcctggaactggagaccac

SEQ ID NO: 8784061 - DNA, 22 bp, Homo sapiens
agggcctggaactggagaccac

SEQ ID NO: 8784062 - DNA, 22 bp, Homo sapiens
agggcctggaactggagaccac

SEQ ID NO: 8784063 - DNA, 22 bp, Homo sapiens
agggcctggaactggagaccac

SEQ ID NO: 8784064 - DNA, 20 bp, Homo sapiens
agggcctgctctgtggtgtc

SEQ ID NO: 8784065 - DNA, 20 bp, Homo sapiens
agggcctgctctgtggtgtc

SEQ ID NO: 8784066 - DNA, 20 bp, Homo sapiens
agggcctgctctgtggtgtc

SEQ ID NO: 8784067 - DNA, 20 bp, Homo sapiens
agggcctgctctgtggtgtc

SEQ ID NO: 8784068 - DNA, 22 bp, Homo sapiens
agggcctgctctatcactctca

SEQ ID NO: 8784069 - DNA, 22 bp, Homo sapiens
agggcctgctctatcactctca

SEQ ID NO: 8784070 - DNA, 22 bp, Homo sapiens
agggcctgctctatcactctca

SEQ ID NO: 8784071 - DNA, 22 bp, Homo sapiens
cctgaaatccatagtttacact

SEQ ID NO: 8784072 - DNA, 22 bp, Homo sapiens
cctgaaatgagttctgctcact

SEQ ID NO: 8784073 - DNA, 22 bp, Homo sapiens
cctgaaatgactccagctgagt

SEQ ID NO: 8784074 - DNA, 22 bp, Homo sapiens
cctgaacaaatggcatagccaa

SEQ ID NO: 8784075 - DNA, 22 bp, Homo sapiens
cctgaaatttgaagacctgaat

SEQ ID NO: 8784076 - DNA, 22 bp, Homo sapiens
cctgaaatttgaagacctgaat

SEQ ID NO: 8784077 - DNA, 22 bp, Homo sapiens
cctgaactctaaatagagcagt

SEQ ID NO: 8784078 - DNA, 22 bp, Homo sapiens
cctgaacagtctgaaaggagac

SEQ ID NO: 8784079 - DNA, 22 bp, Homo sapiens
cctgaagaaaattccacgagaa

SEQ ID NO: 8784080 - DNA, 22 bp, Homo sapiens
cctgaagagtgaatgtggcagt

SEQ ID NO: 8784081 - DNA, 22 bp, Homo sapiens
cctgaagatccattatagacac

SEQ ID NO: 8784082 - DNA, 22 bp, Homo sapiens
cctgaagagcactctagagttg

SEQ ID NO: 8784083 - DNA, 22 bp, Homo sapiens
cctgaagaattcaaatccagat

SEQ ID NO: 8784084 - DNA, 22 bp, Homo sapiens
cctgaagacaacttttatcacc

SEQ ID NO: 8784085 - DNA, 22 bp, Homo sapiens
cctgagagagtgagccctgaca

SEQ ID NO: 8784086 - DNA, 22 bp, Homo sapiens
cctgagagagtgagccctgaca

SEQ ID NO: 8784087 - DNA, 22 bp, Homo sapiens
cctgagagcagcttcctgctta

SEQ ID NO: 8784088 - DNA, 22 bp, Homo sapiens
cctgagagcagcttcctgctta

SEQ ID NO: 8784089 - DNA, 22 bp, Homo sapiens
cctgaagatgctgtggcctggt

SEQ ID NO: 8784090 - DNA, 22 bp, Homo sapiens
cctgagagagaagcgacctggt

SEQ ID NO: 8784091 - DNA, 22 bp, Homo sapiens
cctgagagccagtgcctgccca

SEQ ID NO: 8784092 - DNA, 22 bp, Homo sapiens
cctgagagccagtgcctgccca

SEQ ID NO: 8784093 - DNA, 22 bp, Homo sapiens
cctgagagccctagccaggcgc

SEQ ID NO: 8784094 - DNA, 22 bp, Homo sapiens
cctgagagccctagccaggcgc

SEQ ID NO: 8784095 - DNA, 22 bp, Homo sapiens
cctgagagcgagtggcctcatg

SEQ ID NO: 8784096 - DNA, 22 bp, Homo sapiens
cctgagagggggccctagaaat

SEQ ID NO: 8784097 - DNA, 22 bp, Homo sapiens
cctgagagggggccctagaaat

SEQ ID NO: 8784098 - DNA, 22 bp, Homo sapiens
cctgagaggttggcctgtccag

SEQ ID NO: 8784099 - DNA, 22 bp, Homo sapiens
cctgagaggccctctcactgtc

SEQ ID NO: 8784100 - DNA, 22 bp, Homo sapiens
cctgagaggccctctcactgtc

SEQ ID NO: 8784101 - DNA, 22 bp, Homo sapiens
cctgaggtggctgcagcactgc

SEQ ID NO: 8784102 - DNA, 22 bp, Homo sapiens
agggtagggtaaatgatgcatc

SEQ ID NO: 8784103 - DNA, 22 bp, Homo sapiens
agggtagggccgtagggccatg

SEQ ID NO: 8784104 - DNA, 22 bp, Homo sapiens
agggtagggccgtagggccatg

SEQ ID NO: 8784105 - DNA, 22 bp, Homo sapiens
agggtagggccgtagggccatg

SEQ ID NO: 8784106 - DNA, 22 bp, Homo sapiens
agggtaggaactgagtggaagg

SEQ ID NO: 8784107 - DNA, 22 bp, Homo sapiens
agggtaggaactgagtggaagg

SEQ ID NO: 8784108 - DNA, 22 bp, Homo sapiens
aggggtgaaggcccgataggag

SEQ ID NO: 8784109 - DNA, 22 bp, Homo sapiens
cctgagagtgagtgcctcctta

SEQ ID NO: 8784110 - DNA, 22 bp, Homo sapiens
cctgagagtgagggcctcctta

SEQ ID NO: 8784111 - DNA, 22 bp, Homo sapiens
cctgagagtgagggcctcctta

SEQ ID NO: 8784112 - DNA, 22 bp, Homo sapiens
cctgagagtgagtgccacctta

SEQ ID NO: 8784113 - DNA, 22 bp, Homo sapiens
cctgagagtgagtgccacctta

SEQ ID NO: 8784114 - DNA, 22 bp, Homo sapiens
cctgagagtgagtgccacctta

SEQ ID NO: 8784115 - DNA, 22 bp, Homo sapiens
cctgagagtgagtgccacctta

SEQ ID NO: 8784116 - DNA, 22 bp, Homo sapiens
agggtagggcccggagacagac

SEQ ID NO: 8784117 - DNA, 22 bp, Homo sapiens
agggtagggcccggagacagac

SEQ ID NO: 8784118 - DNA, 22 bp, Homo sapiens
agggtagggccgtagggccatg

SEQ ID NO: 8784119 - DNA, 22 bp, Homo sapiens
agggtaggaactgagtggaagg

SEQ ID NO: 8784120 - DNA, 22 bp, Homo sapiens
agggtagggcccggagacagac

SEQ ID NO: 8784121 - DNA, 22 bp, Homo sapiens
agggtagggcccggagacagac

SEQ ID NO: 8784122 - DNA, 22 bp, Homo sapiens
aggggatggagctggaaggcag

SEQ ID NO: 8784123 - DNA, 22 bp, Homo sapiens
aggggatggagctggaaggcag

SEQ ID NO: 8784124 - DNA, 22 bp, Homo sapiens
aggggatggagctggaaggcag

SEQ ID NO: 8784125 - DNA, 22 bp, Homo sapiens
aggggatgcctgaggatctgta

SEQ ID NO: 8784126 - DNA, 22 bp, Homo sapiens
aggggatgcctgaggatctgta

SEQ ID NO: 8784127 - DNA, 22 bp, Homo sapiens
aggggatggagctggaaggcag

SEQ ID NO: 8784128 - DNA, 20 bp, Homo sapiens
aggggcacctgcgacggggc

SEQ ID NO: 8784129 - DNA, 22 bp, Homo sapiens
aggggatggagctggaaggcag

SEQ ID NO: 8784130 - DNA, 22 bp, Homo sapiens
aggggcactagaatgggagact

SEQ ID NO: 8784131 - DNA, 22 bp, Homo sapiens
aggggcacgagtagagctctag

SEQ ID NO: 8784132 - DNA, 18 bp, Homo sapiens
aggggcagcttgtgtgga

SEQ ID NO: 8784133 - DNA, 22 bp, Homo sapiens
aggggcagcctcacaatcctct

SEQ ID NO: 8784134 - DNA, 22 bp, Homo sapiens
aggggcagcctcacaatcctct

SEQ ID NO: 8784135 - DNA, 23 bp, Homo sapiens
aggggcagcaagttttggtgtta

SEQ ID NO: 8784136 - DNA, 23 bp, Homo sapiens
aggggcagcaagttttggtgtta

SEQ ID NO: 8784137 - DNA, 22 bp, Homo sapiens
aggggagcaacatagtcactct

SEQ ID NO: 8784138 - DNA, 22 bp, Homo sapiens
aggggagcaacatagtcactct

SEQ ID NO: 8784139 - DNA, 22 bp, Homo sapiens
agggctggctccgttaccttga

SEQ ID NO: 8784140 - DNA, 22 bp, Homo sapiens
agggctggccacatgatttggt

SEQ ID NO: 8784141 - DNA, 22 bp, Homo sapiens
agggctggccacatgatttggt

SEQ ID NO: 8784142 - DNA, 22 bp, Homo sapiens
agggctggccacatgatttggt

SEQ ID NO: 8784143 - DNA, 22 bp, Homo sapiens
agggctggctaggtgcgttccc

SEQ ID NO: 8784144 - DNA, 22 bp, Homo sapiens
aggggaggagcttttcttgcct

SEQ ID NO: 8784145 - DNA, 22 bp, Homo sapiens
aggggaggagcttttcttgcct

SEQ ID NO: 8784146 - DNA, 22 bp, Homo sapiens
aggggaggcagcgataaacctg

SEQ ID NO: 8784147 - DNA, 22 bp, Homo sapiens
aggggaggcagcgataaacctg

SEQ ID NO: 8784148 - DNA, 22 bp, Homo sapiens
aggggaggcagcgataaacctg

SEQ ID NO: 8784149 - DNA, 22 bp, Homo sapiens
aggggaggtgtccccaaatctc

SEQ ID NO: 8784150 - DNA, 22 bp, Homo sapiens
aggggatgatcctcccgcagcg

SEQ ID NO: 8784151 - DNA, 22 bp, Homo sapiens
aggggatgatcctcccgcagcg

SEQ ID NO: 8784152 - DNA, 22 bp, Homo sapiens
aggggaggtgtccccaaatctc

SEQ ID NO: 8784153 - DNA, 22 bp, Homo sapiens
cccaggcttttaagttagacag

SEQ ID NO: 8784154 - DNA, 18 bp, Homo sapiens
cccaggctttgtgggtct

SEQ ID NO: 8784155 - DNA, 18 bp, Homo sapiens
cccaggctttgtgggtct

SEQ ID NO: 8784156 - DNA, 22 bp, Homo sapiens
cccaggcttcccaatcagaagg

SEQ ID NO: 8784157 - DNA, 22 bp, Homo sapiens
cccaggctgtgcaaacttcaaa

SEQ ID NO: 8784158 - DNA, 22 bp, Homo sapiens
cccaggctgtgcaaacttcaaa

SEQ ID NO: 8784159 - DNA, 22 bp, Homo sapiens
cccaggcttttaagttagacag

SEQ ID NO: 8784160 - DNA, 22 bp, Homo sapiens
cccaggcttttaagttagacag

SEQ ID NO: 8784161 - DNA, 22 bp, Homo sapiens
cccaggcttttaagttagacag

SEQ ID NO: 8784162 - DNA, 22 bp, Homo sapiens
cccaggcttttctcttgcccca

SEQ ID NO: 8784163 - DNA, 22 bp, Homo sapiens
cccatcaggaacccaggagccc

SEQ ID NO: 8784164 - DNA, 22 bp, Homo sapiens
cccagtcatcctgcaggtgaaa

SEQ ID NO: 8784165 - DNA, 22 bp, Homo sapiens
cccagtcatcctgcaggtgaaa

SEQ ID NO: 8784166 - DNA, 22 bp, Homo sapiens
cccagtcatcctgcaggtgaaa

SEQ ID NO: 8784167 - DNA, 22 bp, Homo sapiens
cccagtttcaactttccagtgg

SEQ ID NO: 8784168 - DNA, 22 bp, Homo sapiens
cccaggctgcatgagtccatgg

SEQ ID NO: 8784169 - DNA, 22 bp, Homo sapiens
cccaggctgatgggatgggcca

SEQ ID NO: 8784170 - DNA, 22 bp, Homo sapiens
cccaggctgatgttcagcgggt

SEQ ID NO: 8784171 - DNA, 22 bp, Homo sapiens
cccaggctgatgttcagcgggt

SEQ ID NO: 8784172 - DNA, 22 bp, Homo sapiens
cccaggctgatgttcagcgggt

SEQ ID NO: 8784173 - DNA, 22 bp, Homo sapiens
cccaggaggtcgaagctgcagt

SEQ ID NO: 8784174 - DNA, 22 bp, Homo sapiens
cccaggcctggtctgggccagt

SEQ ID NO: 8784175 - DNA, 23 bp, Homo sapiens
cccaggctacaaattatgctctg

SEQ ID NO: 8784176 - DNA, 22 bp, Homo sapiens
cccaggaggtggagcttgcagt

SEQ ID NO: 8784177 - DNA, 22 bp, Homo sapiens
cccaggaggtcgaagctgcagt

SEQ ID NO: 8784178 - DNA, 22 bp, Homo sapiens
cccaggaggtcgaagctgcagt

SEQ ID NO: 8784179 - DNA, 22 bp, Homo sapiens
cccaggaggtcgaagctgcagt

SEQ ID NO: 8784180 - DNA, 22 bp, Homo sapiens
cccaggaggtcaaggctgcagt

SEQ ID NO: 8784181 - DNA, 22 bp, Homo sapiens
cccaggaggtcaaggctgcagt

SEQ ID NO: 8784182 - DNA, 22 bp, Homo sapiens
aggctgtgacagggtcatggag

SEQ ID NO: 8784183 - DNA, 22 bp, Homo sapiens
aggctgtgacagggtcatggag

SEQ ID NO: 8784184 - DNA, 22 bp, Homo sapiens
aggctgtgaaatgtggcaagga

SEQ ID NO: 8784185 - DNA, 22 bp, Homo sapiens
aggctgtgaaatgtggcaagga

SEQ ID NO: 8784186 - DNA, 22 bp, Homo sapiens
aggctgtgaaggttaaagacga

SEQ ID NO: 8784187 - DNA, 22 bp, Homo sapiens
aggctgtgaactctatgctgaa

SEQ ID NO: 8784188 - DNA, 22 bp, Homo sapiens
aggctgtctgaccccagagccc

SEQ ID NO: 8784189 - DNA, 22 bp, Homo sapiens
aggctgtctcagcctgcttgca

SEQ ID NO: 8784190 - DNA, 22 bp, Homo sapiens
aggctgtctcagcctgcttgca

SEQ ID NO: 8784191 - DNA, 22 bp, Homo sapiens
aggctgtctcagcctgcttgca

SEQ ID NO: 8784192 - DNA, 22 bp, Homo sapiens
aggctgtctcacctcaggaggg

SEQ ID NO: 8784193 - DNA, 22 bp, Homo sapiens
aggctgtctcacctcaggaggg

SEQ ID NO: 8784194 - DNA, 20 bp, Homo sapiens
aggctgtcatttctggcagg

SEQ ID NO: 8784195 - DNA, 22 bp, Homo sapiens
aggctgtcatctttgcaggcag

SEQ ID NO: 8784196 - DNA, 22 bp, Homo sapiens
aggctgtcatctttgcaggcag

SEQ ID NO: 8784197 - DNA, 22 bp, Homo sapiens
aggctgtcatggctataggccc

SEQ ID NO: 8784198 - DNA, 22 bp, Homo sapiens
aggctggtgcctgcagtgaatc

SEQ ID NO: 8784199 - DNA, 22 bp, Homo sapiens
aggctggtgcttcctagggcag

SEQ ID NO: 8784200 - DNA, 22 bp, Homo sapiens
aggctggtgcctgcagtgaatc

SEQ ID NO: 8784201 - DNA, 22 bp, Homo sapiens
aggctggtctgttggcattttt

SEQ ID NO: 8784202 - DNA, 22 bp, Homo sapiens
aggctggtagtatttagtcaca

SEQ ID NO: 8784203 - DNA, 22 bp, Homo sapiens
aggctggtagtatttagtcaca

SEQ ID NO: 8784204 - DNA, 22 bp, Homo sapiens
cccaggagatgcactccattgg

SEQ ID NO: 8784205 - DNA, 22 bp, Homo sapiens
cccaggagatgcactccattgg

SEQ ID NO: 8784206 - DNA, 22 bp, Homo sapiens
cccaggagatggaggttgcagt

SEQ ID NO: 8784207 - DNA, 22 bp, Homo sapiens
cccaggagatgcactccattgg

SEQ ID NO: 8784208 - DNA, 22 bp, Homo sapiens
cccaggagccatctgtcttggc

SEQ ID NO: 8784209 - DNA, 23 bp, Homo sapiens
cccaggagcctgagtcctctctg

SEQ ID NO: 8784210 - DNA, 22 bp, Homo sapiens
cccaggagatggtgcgtggtct

SEQ ID NO: 8784211 - DNA, 19 bp, Homo sapiens
cccaggagcagtattgatg

SEQ ID NO: 8784212 - DNA, 22 bp, Homo sapiens
cccaggagatggaggttgcagt

SEQ ID NO: 8784213 - DNA, 22 bp, Homo sapiens
cccaggagatggtgcgtggtct

SEQ ID NO: 8784214 - DNA, 20 bp, Homo sapiens
cccaggagctgtgccccatc

SEQ ID NO: 8784215 - DNA, 20 bp, Homo sapiens
cccaggagctgtgccccatc

SEQ ID NO: 8784216 - DNA, 22 bp, Homo sapiens
cccaggagcttctctctgcctc

SEQ ID NO: 8784217 - DNA, 23 bp, Homo sapiens
cccaggagcctgagtcctctctg

SEQ ID NO: 8784218 - DNA, 23 bp, Homo sapiens
cccaggagcctgagtcctctctg

SEQ ID NO: 8784219 - DNA, 23 bp, Homo sapiens
cccaggagcctgagtcctctctg

SEQ ID NO: 8784220 - DNA, 20 bp, Homo sapiens
cccaggagctgtgccccatc

SEQ ID NO: 8784221 - DNA, 22 bp, Homo sapiens
cccaggagggtggcctctgccc

SEQ ID NO: 8784222 - DNA, 22 bp, Homo sapiens
cccaggagggtggcctctgccc

SEQ ID NO: 8784223 - DNA, 22 bp, Homo sapiens
cccaggaggtagaggttgcagt

SEQ ID NO: 8784224 - DNA, 22 bp, Homo sapiens
cccaggagcttctctctgcctc

SEQ ID NO: 8784225 - DNA, 20 bp, Homo sapiens
cccaggagctgtgccccatc

SEQ ID NO: 8784226 - DNA, 22 bp, Homo sapiens
cccaggagcttctctctgcctc

SEQ ID NO: 8784227 - DNA, 22 bp, Homo sapiens
cccaggaggtcaaggctgcagt

SEQ ID NO: 8784228 - DNA, 22 bp, Homo sapiens
cccaggaggtcaaggctgcagt

SEQ ID NO: 8784229 - DNA, 22 bp, Homo sapiens
cccaggaggtagaggttgcagt

SEQ ID NO: 8784230 - DNA, 22 bp, Homo sapiens
ccctgctgtgtcccacctggaa

SEQ ID NO: 8784231 - DNA, 22 bp, Homo sapiens
ccctgctgtgtagcggaggaac

SEQ ID NO: 8784232 - DNA, 22 bp, Homo sapiens
ccctgctgtgcctgactgccat

SEQ ID NO: 8784233 - DNA, 22 bp, Homo sapiens
ccctgctgtccctcagtcctgc

SEQ ID NO: 8784234 - DNA, 22 bp, Homo sapiens
ccctgctgtcaggtgctgggag

SEQ ID NO: 8784235 - DNA, 22 bp, Homo sapiens
ccctgctgtcaggtgctgggag

SEQ ID NO: 8784236 - DNA, 22 bp, Homo sapiens
ccctgctgtcaggtgctgggag

SEQ ID NO: 8784237 - DNA, 22 bp, Homo sapiens
ccctgccctggagacacttaaa

SEQ ID NO: 8784238 - DNA, 22 bp, Homo sapiens
ccctgccctgggcagaagtggg

SEQ ID NO: 8784239 - DNA, 22 bp, Homo sapiens
ccctgccctgggcagaagtggg

SEQ ID NO: 8784240 - DNA, 22 bp, Homo sapiens
ccctgccctgggcagaagtggg

SEQ ID NO: 8784241 - DNA, 22 bp, Homo sapiens
ccctgctgcatggcctccacga

SEQ ID NO: 8784242 - DNA, 22 bp, Homo sapiens
ccctgcccaccacatgctggga

SEQ ID NO: 8784243 - DNA, 22 bp, Homo sapiens
ccctgcccaccacatgctggga

SEQ ID NO: 8784244 - DNA, 22 bp, Homo sapiens
ccctgcccaccacatgctggga

SEQ ID NO: 8784245 - DNA, 22 bp, Homo sapiens
ccctgcccatcggggcggcctg

SEQ ID NO: 8784246 - DNA, 22 bp, Homo sapiens
ccctgcccatcggggcggcctg

SEQ ID NO: 8784247 - DNA, 22 bp, Homo sapiens
ccctgcccatcggggcggcctg

SEQ ID NO: 8784248 - DNA, 22 bp, Homo sapiens
ccctgcccaccacatgctggga

SEQ ID NO: 8784249 - DNA, 22 bp, Homo sapiens
ccctgcccaccacatgctggga

SEQ ID NO: 8784250 - DNA, 22 bp, Homo sapiens
ccctgccagggtcctgacagac

SEQ ID NO: 8784251 - DNA, 22 bp, Homo sapiens
ccctgccagggtcctgacagac

SEQ ID NO: 8784252 - DNA, 21 bp, Homo sapiens
ccctgccctcaaggacagtgc

SEQ ID NO: 8784253 - DNA, 21 bp, Homo sapiens
ccctgccctcaaggacagtgc

SEQ ID NO: 8784254 - DNA, 21 bp, Homo sapiens
ccctgccctcaaggacagtgc

SEQ ID NO: 8784255 - DNA, 22 bp, Homo sapiens
ccctgccctggagacacttaaa

SEQ ID NO: 8784256 - DNA, 22 bp, Homo sapiens
ccctgccctggagacacttaaa

SEQ ID NO: 8784257 - DNA, 22 bp, Homo sapiens
ccctgccccaggcggcttcact

SEQ ID NO: 8784258 - DNA, 23 bp, Homo sapiens
ccctgcccattgagcaggacgtc

SEQ ID NO: 8784259 - DNA, 23 bp, Homo sapiens
ccctgcccattgagcaggacgtc

SEQ ID NO: 8784260 - DNA, 23 bp, Homo sapiens
ccctgcccattgagcaggacgtc

SEQ ID NO: 8784261 - DNA, 22 bp, Homo sapiens
ccctgccccaggcggcttcact

SEQ ID NO: 8784262 - DNA, 22 bp, Homo sapiens
ccctgccccaggcggcttcact

SEQ ID NO: 8784263 - DNA, 23 bp, Homo sapiens
ccctgcccattgagcaggacgtc

SEQ ID NO: 8784264 - DNA, 22 bp, Homo sapiens
ccctgatggcctatctggcagt

SEQ ID NO: 8784265 - DNA, 20 bp, Homo sapiens
ccctgcaatgggaagctggt

SEQ ID NO: 8784266 - DNA, 22 bp, Homo sapiens
ccctgatgttttctctgccttt

SEQ ID NO: 8784267 - DNA, 22 bp, Homo sapiens
ccctgcacactcgtgtcttgac

SEQ ID NO: 8784268 - DNA, 22 bp, Homo sapiens
ccctcccagatgggcttgaggt

SEQ ID NO: 8784269 - DNA, 23 bp, Homo sapiens
ccctgcatctgtccctcaccagt

SEQ ID NO: 8784270 - DNA, 22 bp, Homo sapiens
ccctgccaatcccgtctctctg

SEQ ID NO: 8784271 - DNA, 22 bp, Homo sapiens
ccctgccaatcccgtctctctg

SEQ ID NO: 8784272 - DNA, 22 bp, Homo sapiens
ccctgccaatcccgtctctctg

SEQ ID NO: 8784273 - DNA, 20 bp, Homo sapiens
ccctcccagatgcttcccaa

SEQ ID NO: 8784274 - DNA, 20 bp, Homo sapiens
ccctcccagatgcttcccaa

SEQ ID NO: 8784275 - DNA, 22 bp, Homo sapiens
ccctcccaagcactctgacata

SEQ ID NO: 8784276 - DNA, 22 bp, Homo sapiens
ccctcccaagcactctgacata

SEQ ID NO: 8784277 - DNA, 22 bp, Homo sapiens
ccctcccaagcactctgacata

SEQ ID NO: 8784278 - DNA, 22 bp, Homo sapiens
ccctcccaagcactctgacata

SEQ ID NO: 8784279 - DNA, 22 bp, Homo sapiens
ccctcccaagcactctgacata

SEQ ID NO: 8784280 - DNA, 22 bp, Homo sapiens
ccctccattaaaacagacctat

SEQ ID NO: 8784281 - DNA, 22 bp, Homo sapiens
ccctcagctccaccctcagcag

SEQ ID NO: 8784282 - DNA, 22 bp, Homo sapiens
ccctcagctccaccctcagcag

SEQ ID NO: 8784283 - DNA, 22 bp, Homo sapiens
ccctcagctcaagcccctgtgc

SEQ ID NO: 8784284 - DNA, 22 bp, Homo sapiens
ccctcacttcacgctctgcaga

SEQ ID NO: 8784285 - DNA, 22 bp, Homo sapiens
ccctcaccaggctccaggcatg

SEQ ID NO: 8784286 - DNA, 22 bp, Homo sapiens
ccctcagcagatatttgtgttt

SEQ ID NO: 8784287 - DNA, 22 bp, Homo sapiens
ccctcagcagatatttgtgttt

SEQ ID NO: 8784288 - DNA, 22 bp, Homo sapiens
ccctccatgagtgtgctgctgg

SEQ ID NO: 8784289 - DNA, 22 bp, Homo sapiens
ccctccatgagtgtgctgctgg

SEQ ID NO: 8784290 - DNA, 22 bp, Homo sapiens
ccctccatgagtgtgctgctgg

SEQ ID NO: 8784291 - DNA, 22 bp, Homo sapiens
ccctcagctccaccctcagcag

SEQ ID NO: 8784292 - DNA, 22 bp, Homo sapiens
ccctccatgacgtcttcagccg

SEQ ID NO: 8784293 - DNA, 22 bp, Homo sapiens
ccccttccaggaagcagaatcg

SEQ ID NO: 8784294 - DNA, 22 bp, Homo sapiens
ccccttccacagtgcttcctaa

SEQ ID NO: 8784295 - DNA, 22 bp, Homo sapiens
ccccttccacagtgcttcctaa

SEQ ID NO: 8784296 - DNA, 22 bp, Homo sapiens
ccccttccacagtgcttcctaa

SEQ ID NO: 8784297 - DNA, 20 bp, Homo sapiens
ccccttcatctacagcctga

SEQ ID NO: 8784298 - DNA, 22 bp, Homo sapiens
ccccagcacttggagtggggag

SEQ ID NO: 8784299 - DNA, 22 bp, Homo sapiens
ccccttccacagtgcttcctaa

SEQ ID NO: 8784300 - DNA, 22 bp, Homo sapiens
ccccagcactctgactcttacc

SEQ ID NO: 8784301 - DNA, 22 bp, Homo sapiens
ccccagcactaccagaagccag

SEQ ID NO: 8784302 - DNA, 22 bp, Homo sapiens
ccccagcactaccagaagccag

SEQ ID NO: 8784303 - DNA, 22 bp, Homo sapiens
ccccagcactctgactcttacc

SEQ ID NO: 8784304 - DNA, 21 bp, Homo sapiens
ccccagcaccttgccagcctg

SEQ ID NO: 8784305 - DNA, 22 bp, Homo sapiens
ccccagcacaggctcctcagat

SEQ ID NO: 8784306 - DNA, 22 bp, Homo sapiens
ccccagcacaggctcctcagat

SEQ ID NO: 8784307 - DNA, 22 bp, Homo sapiens
ccctcacttcacgctctgcaga

SEQ ID NO: 8784308 - DNA, 22 bp, Homo sapiens
ccctcacttcacgctctgcaga

SEQ ID NO: 8784309 - DNA, 22 bp, Homo sapiens
ccctcacttcacgctctgcaga

SEQ ID NO: 8784310 - DNA, 22 bp, Homo sapiens
ccctcactctgcctcctggggt

SEQ ID NO: 8784311 - DNA, 22 bp, Homo sapiens
ccctcactgtccttgggccctt

SEQ ID NO: 8784312 - DNA, 22 bp, Homo sapiens
ccctcaccaggctccaggcatg

SEQ ID NO: 8784313 - DNA, 22 bp, Homo sapiens
ccctcaccaggctccaggcatg

SEQ ID NO: 8784314 - DNA, 22 bp, Homo sapiens
ccctagggctaagcaggactgc

SEQ ID NO: 8784315 - DNA, 22 bp, Homo sapiens
ccctaggggcaatgatggtgct

SEQ ID NO: 8784316 - DNA, 22 bp, Homo sapiens
ccctaggggcaatgatggtgct

SEQ ID NO: 8784317 - DNA, 19 bp, Homo sapiens
ccctaggggctcctgaggg

SEQ ID NO: 8784318 - DNA, 19 bp, Homo sapiens
ccctaggggctcctgaggg

SEQ ID NO: 8784319 - DNA, 22 bp, Homo sapiens
ccctagggtttggccagagccc

SEQ ID NO: 8784320 - DNA, 22 bp, Homo sapiens
ccctagggtttggccagagccc

SEQ ID NO: 8784321 - DNA, 22 bp, Homo sapiens
ccctagggtttggccagagccc

SEQ ID NO: 8784322 - DNA, 17 bp, Homo sapiens
cccatgagcccactccc

SEQ ID NO: 8784323 - DNA, 22 bp, Homo sapiens
cccatgagtgctgctcagaggc

SEQ ID NO: 8784324 - DNA, 22 bp, Homo sapiens
cccatgcaccctctaagaagga

SEQ ID NO: 8784325 - DNA, 22 bp, Homo sapiens
cccatgcaccctctaagaagga

SEQ ID NO: 8784326 - DNA, 22 bp, Homo sapiens
cccatgcaccctctaagaagga

SEQ ID NO: 8784327 - DNA, 22 bp, Homo sapiens
cccatgcaccctctaagaagga

SEQ ID NO: 8784328 - DNA, 22 bp, Homo sapiens
cccatggggacaccatgaagga

SEQ ID NO: 8784329 - DNA, 22 bp, Homo sapiens
cccatggggacaccatgaagga

SEQ ID NO: 8784330 - DNA, 22 bp, Homo sapiens
cccatgggttttcctccctgcc

SEQ ID NO: 8784331 - DNA, 23 bp, Homo sapiens
cccatgctgggcgcagtgaatgg

SEQ ID NO: 8784332 - DNA, 22 bp, Homo sapiens
cccatgctgagtggcctgagat

SEQ ID NO: 8784333 - DNA, 22 bp, Homo sapiens
cccatggagtgcctgagggcca

SEQ ID NO: 8784334 - DNA, 22 bp, Homo sapiens
cccatgccttctgactcacagg

SEQ ID NO: 8784335 - DNA, 22 bp, Homo sapiens
cccatgccttctgactcacagg

SEQ ID NO: 8784336 - DNA, 22 bp, Homo sapiens
cccatgccttctgactcacagg

SEQ ID NO: 8784337 - DNA, 22 bp, Homo sapiens
ccccagagtgagggattgagtg

SEQ ID NO: 8784338 - DNA, 22 bp, Homo sapiens
ccccagagtgagggattgagtg

SEQ ID NO: 8784339 - DNA, 22 bp, Homo sapiens
ccccagagagcaccatgaagcc

SEQ ID NO: 8784340 - DNA, 22 bp, Homo sapiens
ccccagagagcaccatgaagcc

SEQ ID NO: 8784341 - DNA, 22 bp, Homo sapiens
ccccagaaggggacagagggta

SEQ ID NO: 8784342 - DNA, 22 bp, Homo sapiens
ccccagagaaagtcagcagcat

SEQ ID NO: 8784343 - DNA, 22 bp, Homo sapiens
ccccagaagtttgcacaagaga

SEQ ID NO: 8784344 - DNA, 22 bp, Homo sapiens
ccccagagaaagtcagcagcat

SEQ ID NO: 8784345 - DNA, 22 bp, Homo sapiens
ccccacttgctcagcatgtcca

SEQ ID NO: 8784346 - DNA, 22 bp, Homo sapiens
cccattcatcctcgcttccttc

SEQ ID NO: 8784347 - DNA, 22 bp, Homo sapiens
ccccactttgagtagcacttga

SEQ ID NO: 8784348 - DNA, 22 bp, Homo sapiens
ccccagaaagcctggcactagg

SEQ ID NO: 8784349 - DNA, 22 bp, Homo sapiens
ccccagaaagcctggcactagg

SEQ ID NO: 8784350 - DNA, 22 bp, Homo sapiens
ccccagaagtttgcacaagaga

SEQ ID NO: 8784351 - DNA, 22 bp, Homo sapiens
acattctacagttaaccattag

SEQ ID NO: 8784352 - DNA, 22 bp, Homo sapiens
acattctacagttaaccattag

SEQ ID NO: 8784353 - DNA, 22 bp, Homo sapiens
acattctaacattgtacagata

SEQ ID NO: 8784354 - DNA, 22 bp, Homo sapiens
acattcctttcttgagcacagt

SEQ ID NO: 8784355 - DNA, 22 bp, Homo sapiens
acattcctgccataaatttttt

SEQ ID NO: 8784356 - DNA, 22 bp, Homo sapiens
acattcctgaggaaatacattc

SEQ ID NO: 8784357 - DNA, 22 bp, Homo sapiens
acattcccttggcttgaagcag

SEQ ID NO: 8784358 - DNA, 22 bp, Homo sapiens
acattcattgccagggtggaag

SEQ ID NO: 8784359 - DNA, 22 bp, Homo sapiens
acattcattgagcaacaacaat

SEQ ID NO: 8784360 - DNA, 22 bp, Homo sapiens
acattcattccaggtcagtcag

SEQ ID NO: 8784361 - DNA, 22 bp, Homo sapiens
acattcattgagcaacaacaat

SEQ ID NO: 8784362 - DNA, 22 bp, Homo sapiens
acattcctcagtgccagttgag

SEQ ID NO: 8784363 - DNA, 22 bp, Homo sapiens
acattctttcgatgtctgattt

SEQ ID NO: 8784364 - DNA, 22 bp, Homo sapiens
acattctttctcttcaggaaac

SEQ ID NO: 8784365 - DNA, 22 bp, Homo sapiens
acattctttgagttttgttaaa

SEQ ID NO: 8784366 - DNA, 22 bp, Homo sapiens
acattctttgagttttgttaaa

SEQ ID NO: 8784367 - DNA, 22 bp, Homo sapiens
acattgaaagcatattatctcc

SEQ ID NO: 8784368 - DNA, 22 bp, Homo sapiens
acattctttcaccttgtgtcca

SEQ ID NO: 8784369 - DNA, 22 bp, Homo sapiens
acattctttcaccttgtgtcca

SEQ ID NO: 8784370 - DNA, 22 bp, Homo sapiens
acattctttcaccttgtgtcca

SEQ ID NO: 8784371 - DNA, 22 bp, Homo sapiens
acattcttggactccactctag

SEQ ID NO: 8784372 - DNA, 22 bp, Homo sapiens
acattcttggactccactctag

SEQ ID NO: 8784373 - DNA, 22 bp, Homo sapiens
acattcttggactccactctag

SEQ ID NO: 8784374 - DNA, 23 bp, Homo sapiens
acattcttgattcaggccttagc

SEQ ID NO: 8784375 - DNA, 22 bp, Homo sapiens
acattcttgaagtgaagtttat

SEQ ID NO: 8784376 - DNA, 22 bp, Homo sapiens
acattctatggttgatgagttg

SEQ ID NO: 8784377 - DNA, 22 bp, Homo sapiens
acattctatggttgatgagttg

SEQ ID NO: 8784378 - DNA, 22 bp, Homo sapiens
acattctagaagagcttcactt

SEQ ID NO: 8784379 - DNA, 22 bp, Homo sapiens
acattctatagcaagctgatct

SEQ ID NO: 8784380 - DNA, 22 bp, Homo sapiens
acattctatagcaagctgatct

SEQ ID NO: 8784381 - DNA, 22 bp, Homo sapiens
acattctatagcaagctgatct

SEQ ID NO: 8784382 - DNA, 22 bp, Homo sapiens
acattctatgaagataatttta

SEQ ID NO: 8784383 - DNA, 22 bp, Homo sapiens
acattctatggttgatgagttg

SEQ ID NO: 8784384 - DNA, 22 bp, Homo sapiens
acattctatgaagataatttta

SEQ ID NO: 8784385 - DNA, 22 bp, Homo sapiens
aggccctgcaggagtggggaca

SEQ ID NO: 8784386 - DNA, 22 bp, Homo sapiens
aggccctgcaggaagcaggatg

SEQ ID NO: 8784387 - DNA, 22 bp, Homo sapiens
aggccctgcaggagtggggaca

SEQ ID NO: 8784388 - DNA, 22 bp, Homo sapiens
aggccctgcaggaagcaggatg

SEQ ID NO: 8784389 - DNA, 22 bp, Homo sapiens
aggccctgcaggaagcaggatg

SEQ ID NO: 8784390 - DNA, 22 bp, Homo sapiens
aggccctgcaggagtggggaca

SEQ ID NO: 8784391 - DNA, 22 bp, Homo sapiens
aggccctgcaggaagcaggatg

SEQ ID NO: 8784392 - DNA, 22 bp, Homo sapiens
aggccctgcaggaagcaggatg

SEQ ID NO: 8784393 - DNA, 22 bp, Homo sapiens
acattcaagatgcattcactta

SEQ ID NO: 8784394 - DNA, 22 bp, Homo sapiens
acattcaagatgcattcactta

SEQ ID NO: 8784395 - DNA, 22 bp, Homo sapiens
acattcaagatgcattcactta

SEQ ID NO: 8784396 - DNA, 23 bp, Homo sapiens
acattacacgcagtaattgcccc

SEQ ID NO: 8784397 - DNA, 22 bp, Homo sapiens
acattacactgtggtcctgttc

SEQ ID NO: 8784398 - DNA, 23 bp, Homo sapiens
acattacacgcagtaattgcccc

SEQ ID NO: 8784399 - DNA, 22 bp, Homo sapiens
aggccctgcattgtactgaggg

SEQ ID NO: 8784400 - DNA, 20 bp, Homo sapiens
aggccctgccagggacggag

SEQ ID NO: 8784401 - DNA, 22 bp, Homo sapiens
acattaagaaacgagagagcaa

SEQ ID NO: 8784402 - DNA, 22 bp, Homo sapiens
acattcatgtcccacttctagc

SEQ ID NO: 8784403 - DNA, 22 bp, Homo sapiens
acattcatgtcccacttctagc

SEQ ID NO: 8784404 - DNA, 22 bp, Homo sapiens
acattcatgggttttacattat

SEQ ID NO: 8784405 - DNA, 22 bp, Homo sapiens
acattcagaatcttgtagcagt

SEQ ID NO: 8784406 - DNA, 22 bp, Homo sapiens
acattcatgcaccttcctatcc

SEQ ID NO: 8784407 - DNA, 22 bp, Homo sapiens
acattcaaggcagcactgagtg

SEQ ID NO: 8784408 - DNA, 22 bp, Homo sapiens
aggctgtgcaattagggtaaga

SEQ ID NO: 8784409 - DNA, 22 bp, Homo sapiens
aggcttcagcctagagctggag

SEQ ID NO: 8784410 - DNA, 22 bp, Homo sapiens
aggcttcagatgaccttagcat

SEQ ID NO: 8784411 - DNA, 22 bp, Homo sapiens
aggcttcaggaaatatacattt

SEQ ID NO: 8784412 - DNA, 22 bp, Homo sapiens
aggctccaggcccttcaccagc

SEQ ID NO: 8784413 - DNA, 22 bp, Homo sapiens
aggctccaggcaaaatttcgga

SEQ ID NO: 8784414 - DNA, 22 bp, Homo sapiens
aggctccaggcctccctgcatg

SEQ ID NO: 8784415 - DNA, 22 bp, Homo sapiens
aggctgtgattccaccactctc

SEQ ID NO: 8784416 - DNA, 22 bp, Homo sapiens
aggctgtgattccaccactctc

SEQ ID NO: 8784417 - DNA, 22 bp, Homo sapiens
aggctgtgattccaccactctc

SEQ ID NO: 8784418 - DNA, 22 bp, Homo sapiens
aggcttcccttcctctgggggt

SEQ ID NO: 8784419 - DNA, 23 bp, Homo sapiens
aggcttcctatcttagagctggg

SEQ ID NO: 8784420 - DNA, 18 bp, Homo sapiens
aggcttcccaggcaggcc

SEQ ID NO: 8784421 - DNA, 22 bp, Homo sapiens
aggcttcaggtttgctttgcag

SEQ ID NO: 8784422 - DNA, 22 bp, Homo sapiens
aggcttcagtagggagcatgtc

SEQ ID NO: 8784423 - DNA, 22 bp, Homo sapiens
aggcttcatatttaggcatatg

SEQ ID NO: 8784424 - DNA, 19 bp, Homo sapiens
aggcttcatcctgggcagc

SEQ ID NO: 8784425 - DNA, 22 bp, Homo sapiens
acattgatactgagatacaaag

SEQ ID NO: 8784426 - DNA, 22 bp, Homo sapiens
acattgatactgagatacaaag

SEQ ID NO: 8784427 - DNA, 22 bp, Homo sapiens
acattgatatttcaaatacagg

SEQ ID NO: 8784428 - DNA, 22 bp, Homo sapiens
acattgagtgctccataaatca

SEQ ID NO: 8784429 - DNA, 22 bp, Homo sapiens
aggctccacggtcactggctct

SEQ ID NO: 8784430 - DNA, 22 bp, Homo sapiens
acattgagagttttgaagagta

SEQ ID NO: 8784431 - DNA, 22 bp, Homo sapiens
acattgagcctcacctagatgc

SEQ ID NO: 8784432 - DNA, 22 bp, Homo sapiens
acattgagagttttgaagagta

SEQ ID NO: 8784433 - DNA, 22 bp, Homo sapiens
acattgaacatggcaggacatt

SEQ ID NO: 8784434 - DNA, 22 bp, Homo sapiens
acattgaacagtacaaatgatc

SEQ ID NO: 8784435 - DNA, 22 bp, Homo sapiens
acattgaaagcatattatctcc

SEQ ID NO: 8784436 - DNA, 22 bp, Homo sapiens
acattgaacagtacaaatgatc

SEQ ID NO: 8784437 - DNA, 22 bp, Homo sapiens
acattgaaccagtagacacaaa

SEQ ID NO: 8784438 - DNA, 22 bp, Homo sapiens
acattgaactacttgtaatgag

SEQ ID NO: 8784439 - DNA, 22 bp, Homo sapiens
acattgaactacttgtaatgag

SEQ ID NO: 8784440 - DNA, 22 bp, Homo sapiens
acattgaactacttgtaatgag

SEQ ID NO: 8784441 - DNA, 22 bp, Homo sapiens
acattgaagctgtgaaatcaaa

SEQ ID NO: 8784442 - DNA, 22 bp, Homo sapiens
acattgaagctgtgaaatcaaa

SEQ ID NO: 8784443 - DNA, 22 bp, Homo sapiens
acattgaagggctatccaatag

SEQ ID NO: 8784444 - DNA, 22 bp, Homo sapiens
acattgaagggaatgcaaagat

SEQ ID NO: 8784445 - DNA, 22 bp, Homo sapiens
acattgaagggaatgcaaagat

SEQ ID NO: 8784446 - DNA, 22 bp, Homo sapiens
acattgaatgtatgtgatgaaa

SEQ ID NO: 8784447 - DNA, 22 bp, Homo sapiens
acattgaattcaaaattactga

SEQ ID NO: 8784448 - DNA, 18 bp, Homo sapiens
aggcatggtggtgcgcac

SEQ ID NO: 8784449 - DNA, 18 bp, Homo sapiens
aggcatggtggtgcgcac

SEQ ID NO: 8784450 - DNA, 18 bp, Homo sapiens
aggcatggtggtgcgcac

SEQ ID NO: 8784451 - DNA, 22 bp, Homo sapiens
aggcatgggtagaagagaagcc

SEQ ID NO: 8784452 - DNA, 22 bp, Homo sapiens
aggcatgggtagaagagaagcc

SEQ ID NO: 8784453 - DNA, 22 bp, Homo sapiens
aggcatgggtagaagagaagcc

SEQ ID NO: 8784454 - DNA, 22 bp, Homo sapiens
aggcatgggtagaagagaagcc

SEQ ID NO: 8784455 - DNA, 18 bp, Homo sapiens
aggccacactccagaaca

SEQ ID NO: 8784456 - DNA, 22 bp, Homo sapiens
aggccacacaactcttagagat

SEQ ID NO: 8784457 - DNA, 22 bp, Homo sapiens
aggccacagagagtgcatgtgc

SEQ ID NO: 8784458 - DNA, 22 bp, Homo sapiens
aggccacagagagtgcatgtgc

SEQ ID NO: 8784459 - DNA, 22 bp, Homo sapiens
aggccacagagagtgcatgtgc

SEQ ID NO: 8784460 - DNA, 22 bp, Homo sapiens
aggccacagcctgggaggtgac

SEQ ID NO: 8784461 - DNA, 22 bp, Homo sapiens
aggccacagcctgggaggtgac

SEQ ID NO: 8784462 - DNA, 22 bp, Homo sapiens
aggccacagatactgtgaagta

SEQ ID NO: 8784463 - DNA, 22 bp, Homo sapiens
aggccacagatactgtgaagta

SEQ ID NO: 8784464 - DNA, 22 bp, Homo sapiens
aggccacaggagtactgtcggt

SEQ ID NO: 8784465 - DNA, 22 bp, Homo sapiens
aggccacaggcaccctgtgttc

SEQ ID NO: 8784466 - DNA, 22 bp, Homo sapiens
aggccacaggcaccctgtgttc

SEQ ID NO: 8784467 - DNA, 22 bp, Homo sapiens
aggccagcaccagagtcaagaa

SEQ ID NO: 8784468 - DNA, 22 bp, Homo sapiens
aggccagcacgacagccgcagg

SEQ ID NO: 8784469 - DNA, 22 bp, Homo sapiens
acatacatgtaaaggaaattat

SEQ ID NO: 8784470 - DNA, 22 bp, Homo sapiens
acatacatggtgctttcttggt

SEQ ID NO: 8784471 - DNA, 22 bp, Homo sapiens
aggcagtgttcttctaagggca

SEQ ID NO: 8784472 - DNA, 22 bp, Homo sapiens
aggcatggctttaggcaggcgt

SEQ ID NO: 8784473 - DNA, 20 bp, Homo sapiens
aggcagttagaaggagatga

SEQ ID NO: 8784474 - DNA, 22 bp, Homo sapiens
acatacatggattcatggattc

SEQ ID NO: 8784475 - DNA, 22 bp, Homo sapiens
acatacatgggattaaaaaatt

SEQ ID NO: 8784476 - DNA, 22 bp, Homo sapiens
acatacatgggattaaaaaatt

SEQ ID NO: 8784477 - DNA, 22 bp, Homo sapiens
acatacatgggattaaaaaatt

SEQ ID NO: 8784478 - DNA, 20 bp, Homo sapiens
aggcatgggatgcccagatt

SEQ ID NO: 8784479 - DNA, 20 bp, Homo sapiens
aggcatgggatgcccagatt

SEQ ID NO: 8784480 - DNA, 19 bp, Homo sapiens
aggcatgggaagagaagtc

SEQ ID NO: 8784481 - DNA, 22 bp, Homo sapiens
aggcatggggctgcagtcaggt

SEQ ID NO: 8784482 - DNA, 22 bp, Homo sapiens
aggcatggggctgcagtcaggt

SEQ ID NO: 8784483 - DNA, 22 bp, Homo sapiens
aggcatggggctgcagtcaggt

SEQ ID NO: 8784484 - DNA, 22 bp, Homo sapiens
aggcatggctttaggcaggcgt

SEQ ID NO: 8784485 - DNA, 22 bp, Homo sapiens
aggcatggctttaggcaggcgt

SEQ ID NO: 8784486 - DNA, 22 bp, Homo sapiens
aggcatggctttaggcaggcgt

SEQ ID NO: 8784487 - DNA, 19 bp, Homo sapiens
aggcatgggaagagaagtc

SEQ ID NO: 8784488 - DNA, 19 bp, Homo sapiens
aggcatgggaagagaagtc

SEQ ID NO: 8784489 - DNA, 19 bp, Homo sapiens
aggcatgggaagagaagtc

SEQ ID NO: 8784490 - DNA, 22 bp, Homo sapiens
aggcatggctttaggcaggcgt

SEQ ID NO: 8784491 - DNA, 22 bp, Homo sapiens
aggccaggtggtcatgcttgct

SEQ ID NO: 8784492 - DNA, 22 bp, Homo sapiens
aggcccagctgggccaggaaca

SEQ ID NO: 8784493 - DNA, 22 bp, Homo sapiens
aggcccagctgggccaggaaca

SEQ ID NO: 8784494 - DNA, 22 bp, Homo sapiens
aggcccagctgggccaggaaca

SEQ ID NO: 8784495 - DNA, 22 bp, Homo sapiens
aggcccagcttgaagtgggaag

SEQ ID NO: 8784496 - DNA, 22 bp, Homo sapiens
aggcccagcttgaagtgggaag

SEQ ID NO: 8784497 - DNA, 22 bp, Homo sapiens
aggcccagcttgaagtgggaag

SEQ ID NO: 8784498 - DNA, 22 bp, Homo sapiens
acatgaaacccagccgtggtcc

SEQ ID NO: 8784499 - DNA, 22 bp, Homo sapiens
acatgaaacctgagtctaactc

SEQ ID NO: 8784500 - DNA, 20 bp, Homo sapiens
acatgaaaggaaacaggaaa

SEQ ID NO: 8784501 - DNA, 22 bp, Homo sapiens
aggcccagggctgctctctgaa

SEQ ID NO: 8784502 - DNA, 22 bp, Homo sapiens
aggcccagggctgctctctgaa

SEQ ID NO: 8784503 - DNA, 21 bp, Homo sapiens
aggcccagctttcctcttgct

SEQ ID NO: 8784504 - DNA, 21 bp, Homo sapiens
aggcccagctttcctcttgct

SEQ ID NO: 8784505 - DNA, 22 bp, Homo sapiens
aggcccagggctgctctctgaa

SEQ ID NO: 8784506 - DNA, 21 bp, Homo sapiens
aggcccaggaatatgcatttt

SEQ ID NO: 8784507 - DNA, 22 bp, Homo sapiens
aggccctgagcatccgagggca

SEQ ID NO: 8784508 - DNA, 22 bp, Homo sapiens
aggccctgagaaaatccctgca

SEQ ID NO: 8784509 - DNA, 22 bp, Homo sapiens
aggccctgagcatccgagggca

SEQ ID NO: 8784510 - DNA, 22 bp, Homo sapiens
aggccctgatccgaatccagat

SEQ ID NO: 8784511 - DNA, 22 bp, Homo sapiens
aggccctgatccgaatccagat

SEQ ID NO: 8784512 - DNA, 22 bp, Homo sapiens
aggccctgatccgaatccagat

SEQ ID NO: 8784513 - DNA, 22 bp, Homo sapiens
aggccctgagaaaatccctgca

SEQ ID NO: 8784514 - DNA, 23 bp, Homo sapiens
aggcccaggtatgtttgttttgg

SEQ ID NO: 8784515 - DNA, 23 bp, Homo sapiens
aggcccaggtatgtttgttttgg

SEQ ID NO: 8784516 - DNA, 22 bp, Homo sapiens
aggccagccctgggctgagaga

SEQ ID NO: 8784517 - DNA, 18 bp, Homo sapiens
aggccagccctgctactg

SEQ ID NO: 8784518 - DNA, 18 bp, Homo sapiens
aggccagccctgctactg

SEQ ID NO: 8784519 - DNA, 22 bp, Homo sapiens
aggccagccctcacctgtgttc

SEQ ID NO: 8784520 - DNA, 22 bp, Homo sapiens
aggccagccctcacctgtgttc

SEQ ID NO: 8784521 - DNA, 22 bp, Homo sapiens
aggccagccctcacctgtgttc

SEQ ID NO: 8784522 - DNA, 22 bp, Homo sapiens
aggccagcattctctctccagg

SEQ ID NO: 8784523 - DNA, 22 bp, Homo sapiens
aggccagcattctctctccagg

SEQ ID NO: 8784524 - DNA, 22 bp, Homo sapiens
aggccagcattctctctccagg

SEQ ID NO: 8784525 - DNA, 22 bp, Homo sapiens
aggccagcattctctctccagg

SEQ ID NO: 8784526 - DNA, 22 bp, Homo sapiens
aggccagcattctctctccagg

SEQ ID NO: 8784527 - DNA, 22 bp, Homo sapiens
aggccagcatgcagttctaagg

SEQ ID NO: 8784528 - DNA, 22 bp, Homo sapiens
aggccagcatgcagttctaagg

SEQ ID NO: 8784529 - DNA, 22 bp, Homo sapiens
aggccagcagcatgacggcatc

SEQ ID NO: 8784530 - DNA, 22 bp, Homo sapiens
aggccagcagacgtgggactga

SEQ ID NO: 8784531 - DNA, 22 bp, Homo sapiens
aggccagcagacgtgggactga

SEQ ID NO: 8784532 - DNA, 22 bp, Homo sapiens
aggccagccctgggctgagaga

SEQ ID NO: 8784533 - DNA, 22 bp, Homo sapiens
acatctttttggaaacggctga

SEQ ID NO: 8784534 - DNA, 22 bp, Homo sapiens
acatctttgctcttatagagct

SEQ ID NO: 8784535 - DNA, 22 bp, Homo sapiens
acatgaaacccagccgtggtcc

SEQ ID NO: 8784536 - DNA, 22 bp, Homo sapiens
acatgaaaagactatctgatta

SEQ ID NO: 8784537 - DNA, 22 bp, Homo sapiens
acatgaaaagactatctgatta

SEQ ID NO: 8784538 - DNA, 22 bp, Homo sapiens
acatgaaaactggttccttcag

SEQ ID NO: 8784539 - DNA, 22 bp, Homo sapiens
acatgaaaactggttccttcag

SEQ ID NO: 8784540 - DNA, 22 bp, Homo sapiens
accaggagccacaggaggagcc

SEQ ID NO: 8784541 - DNA, 23 bp, Homo sapiens
accaggagccaagatctccctgg

SEQ ID NO: 8784542 - DNA, 23 bp, Homo sapiens
accaggagccaagatctccctgg

SEQ ID NO: 8784543 - DNA, 22 bp, Homo sapiens
accaggagaggcacttgcaatg

SEQ ID NO: 8784544 - DNA, 20 bp, Homo sapiens
accaggagatggaggcaggg

SEQ ID NO: 8784545 - DNA, 20 bp, Homo sapiens
accaggagatggaggcaggg

SEQ ID NO: 8784546 - DNA, 20 bp, Homo sapiens
accaggagatggaggcaggg

SEQ ID NO: 8784547 - DNA, 22 bp, Homo sapiens
accaggagcattttttattagt

SEQ ID NO: 8784548 - DNA, 22 bp, Homo sapiens
accaggaggcctggagcacaaa

SEQ ID NO: 8784549 - DNA, 22 bp, Homo sapiens
accaggaggcctggagcacaaa

SEQ ID NO: 8784550 - DNA, 22 bp, Homo sapiens
accaggaggcctggagcacaaa

SEQ ID NO: 8784551 - DNA, 22 bp, Homo sapiens
accaggaggccttggttctgag

SEQ ID NO: 8784552 - DNA, 22 bp, Homo sapiens
accaggaggaagtgttaatgat

SEQ ID NO: 8784553 - DNA, 22 bp, Homo sapiens
accaggagccatagagtcaggc

SEQ ID NO: 8784554 - DNA, 22 bp, Homo sapiens
accaggagccatagagtcaggc

SEQ ID NO: 8784555 - DNA, 22 bp, Homo sapiens
accaggagccatagagtcaggc

SEQ ID NO: 8784556 - DNA, 19 bp, Homo sapiens
accaggagacagtgagctt

SEQ ID NO: 8784557 - DNA, 19 bp, Homo sapiens
accaggagacagtgagctt

SEQ ID NO: 8784558 - DNA, 19 bp, Homo sapiens
accaggagacagtgagctt

SEQ ID NO: 8784559 - DNA, 23 bp, Homo sapiens
accaggagaaaagctttgcggga

SEQ ID NO: 8784560 - DNA, 22 bp, Homo sapiens
accaggagacatgaccaatgag

SEQ ID NO: 8784561 - DNA, 22 bp, Homo sapiens
accaggagagattttattgaga

SEQ ID NO: 8784562 - DNA, 22 bp, Homo sapiens
accaggagaggcacttgcaatg

SEQ ID NO: 8784563 - DNA, 22 bp, Homo sapiens
accaggaacaagccatggagga

SEQ ID NO: 8784564 - DNA, 22 bp, Homo sapiens
accaggaagaacaggcaaggca

SEQ ID NO: 8784565 - DNA, 22 bp, Homo sapiens
accaaaggcagagctgaacact

SEQ ID NO: 8784566 - DNA, 22 bp, Homo sapiens
accaaaggctcctgaagaactg

SEQ ID NO: 8784567 - DNA, 22 bp, Homo sapiens
accaaaggcagagctgaacact

SEQ ID NO: 8784568 - DNA, 23 bp, Homo sapiens
aggcttcctatcttagagctggg

SEQ ID NO: 8784569 - DNA, 22 bp, Homo sapiens
accaaagggcagaacatgagca

SEQ ID NO: 8784570 - DNA, 22 bp, Homo sapiens
accaaaggtgatcaggatcacc

SEQ ID NO: 8784571 - DNA, 22 bp, Homo sapiens
accaaagggcagaacatgagca

SEQ ID NO: 8784572 - DNA, 22 bp, Homo sapiens
accaaataggcttcctgggttg

SEQ ID NO: 8784573 - DNA, 22 bp, Homo sapiens
accaaatatatcttttgacctg

SEQ ID NO: 8784574 - DNA, 22 bp, Homo sapiens
accaaatgctgacagcatgact

SEQ ID NO: 8784575 - DNA, 22 bp, Homo sapiens
accaaggagacaaaggtgtatt

SEQ ID NO: 8784576 - DNA, 22 bp, Homo sapiens
accaagcacaaagatgagtaaa

SEQ ID NO: 8784577 - DNA, 22 bp, Homo sapiens
accaagctagaacattacaggc

SEQ ID NO: 8784578 - DNA, 22 bp, Homo sapiens
accaagctctcttcccggctct

SEQ ID NO: 8784579 - DNA, 22 bp, Homo sapiens
accaagctgtatattattggtt

SEQ ID NO: 8784580 - DNA, 22 bp, Homo sapiens
accaagctctcttcccggctct

SEQ ID NO: 8784581 - DNA, 22 bp, Homo sapiens
accaagcttcgtggaggaagtt

SEQ ID NO: 8784582 - DNA, 22 bp, Homo sapiens
accaagatctgttaggggctag

SEQ ID NO: 8784583 - DNA, 22 bp, Homo sapiens
accagctctttcttttcactat

SEQ ID NO: 8784584 - DNA, 22 bp, Homo sapiens
accagctgagtaggggagggcc

SEQ ID NO: 8784585 - DNA, 22 bp, Homo sapiens
accagctgaactgcagcccagg

SEQ ID NO: 8784586 - DNA, 22 bp, Homo sapiens
accacaggaattgctctgtggt

SEQ ID NO: 8784587 - DNA, 22 bp, Homo sapiens
accacagaggaatttgaagagg

SEQ ID NO: 8784588 - DNA, 22 bp, Homo sapiens
accacagaggaatttgaagagg

SEQ ID NO: 8784589 - DNA, 17 bp, Homo sapiens
accaatgtcagacaaag

SEQ ID NO: 8784590 - DNA, 22 bp, Homo sapiens
accaatgtcccgcccacgctgc

SEQ ID NO: 8784591 - DNA, 22 bp, Homo sapiens
accacactggctagtgaagaag

SEQ ID NO: 8784592 - DNA, 22 bp, Homo sapiens
accacaaacttagtggtgcaaa

SEQ ID NO: 8784593 - DNA, 22 bp, Homo sapiens
accacactggctagtgaagaag

SEQ ID NO: 8784594 - DNA, 22 bp, Homo sapiens
accaaggctaaaataacatgtt

SEQ ID NO: 8784595 - DNA, 22 bp, Homo sapiens
accaatctgcttaaatgctgac

SEQ ID NO: 8784596 - DNA, 22 bp, Homo sapiens
accagggcttacagcagtagct

SEQ ID NO: 8784597 - DNA, 22 bp, Homo sapiens
accagggcttacagcagtagct

SEQ ID NO: 8784598 - DNA, 22 bp, Homo sapiens
accagggctgggataggtcagg

SEQ ID NO: 8784599 - DNA, 22 bp, Homo sapiens
accagggcggcttgaggaggca

SEQ ID NO: 8784600 - DNA, 22 bp, Homo sapiens
accagggcggcttgaggaggca

SEQ ID NO: 8784601 - DNA, 22 bp, Homo sapiens
accagggcggcttgaggaggca

SEQ ID NO: 8784602 - DNA, 22 bp, Homo sapiens
accagggcagccgaggtgtgtc

SEQ ID NO: 8784603 - DNA, 22 bp, Homo sapiens
accaggctgtgaagtgagacta

SEQ ID NO: 8784604 - DNA, 22 bp, Homo sapiens
accaggagttgggggtgggacc

SEQ ID NO: 8784605 - DNA, 22 bp, Homo sapiens
accaggagtctagcctagtcaa

SEQ ID NO: 8784606 - DNA, 22 bp, Homo sapiens
accaggagggaccctggtggcc

SEQ ID NO: 8784607 - DNA, 22 bp, Homo sapiens
accaggctgttgggcccagtgt

SEQ ID NO: 8784608 - DNA, 22 bp, Homo sapiens
accagggcacattccggccaga

SEQ ID NO: 8784609 - DNA, 22 bp, Homo sapiens
accagggcagccgaggtgtgtc

SEQ ID NO: 8784610 - DNA, 22 bp, Homo sapiens
accaggagtaacagtgagtggt

SEQ ID NO: 8784611 - DNA, 22 bp, Homo sapiens
accaggaggtgtttgctcaagt

SEQ ID NO: 8784612 - DNA, 22 bp, Homo sapiens
accaggaggtgtttgctcaagt

SEQ ID NO: 8784613 - DNA, 22 bp, Homo sapiens
accaggagggaccctggtggcc

SEQ ID NO: 8784614 - DNA, 22 bp, Homo sapiens
accaggaggctacactgtccca

SEQ ID NO: 8784615 - DNA, 22 bp, Homo sapiens
accaggaggctacactgtccca

SEQ ID NO: 8784616 - DNA, 22 bp, Homo sapiens
accaggagtagaatatctgtga

SEQ ID NO: 8784617 - DNA, 22 bp, Homo sapiens
accaggagtaacagtgagtggt

SEQ ID NO: 8784618 - DNA, 19 bp, Homo sapiens
accaggagtatcagagctg

SEQ ID NO: 8784619 - DNA, 19 bp, Homo sapiens
accaggagtatcagagctg

SEQ ID NO: 8784620 - DNA, 19 bp, Homo sapiens
accaggagtatcagagctg

SEQ ID NO: 8784621 - DNA, 22 bp, Homo sapiens
agggcctcgaaggcagagggat

SEQ ID NO: 8784622 - DNA, 22 bp, Homo sapiens
agggcctcgggctcagtgggtc

SEQ ID NO: 8784623 - DNA, 22 bp, Homo sapiens
agggcctcctaatttcctcata

SEQ ID NO: 8784624 - DNA, 22 bp, Homo sapiens
accatacacaatttgcaacggt

SEQ ID NO: 8784625 - DNA, 22 bp, Homo sapiens
accatacttgaaatggatagga

SEQ ID NO: 8784626 - DNA, 22 bp, Homo sapiens
accatacttgaaatggatagga

SEQ ID NO: 8784627 - DNA, 22 bp, Homo sapiens
accatagactggaggatctcct

SEQ ID NO: 8784628 - DNA, 22 bp, Homo sapiens
accagttttttatacatcttct

SEQ ID NO: 8784629 - DNA, 22 bp, Homo sapiens
accagttttttatacatcttct

SEQ ID NO: 8784630 - DNA, 22 bp, Homo sapiens
accagttttttatacatcttct

SEQ ID NO: 8784631 - DNA, 22 bp, Homo sapiens
accagtttgtaacctgttttca

SEQ ID NO: 8784632 - DNA, 22 bp, Homo sapiens
accagtttgtaacctgttttca

SEQ ID NO: 8784633 - DNA, 21 bp, Homo sapiens
accagtttggggggcttcctg

SEQ ID NO: 8784634 - DNA, 22 bp, Homo sapiens
accagtttgtaacctgttttca

SEQ ID NO: 8784635 - DNA, 22 bp, Homo sapiens
accagttacatcttagcaagca

SEQ ID NO: 8784636 - DNA, 22 bp, Homo sapiens
accagtttctgggggaggttgg

SEQ ID NO: 8784637 - DNA, 22 bp, Homo sapiens
accagtttatagcgatctgtca

SEQ ID NO: 8784638 - DNA, 22 bp, Homo sapiens
accagtttaataactgctcaag

SEQ ID NO: 8784639 - DNA, 22 bp, Homo sapiens
accagtttaataactgctcaag

SEQ ID NO: 8784640 - DNA, 22 bp, Homo sapiens
accagtaagatcctgtacatac

SEQ ID NO: 8784641 - DNA, 22 bp, Homo sapiens
accaggtggccccagcgtggtt

SEQ ID NO: 8784642 - DNA, 20 bp, Homo sapiens
accaggtggctgatgacacc

SEQ ID NO: 8784643 - DNA, 22 bp, Homo sapiens
accagggttgagtcagctgcgt

SEQ ID NO: 8784644 - DNA, 22 bp, Homo sapiens
accaggtaatgtaaagcagggt

SEQ ID NO: 8784645 - DNA, 22 bp, Homo sapiens
accaggtaccttacacttggct

SEQ ID NO: 8784646 - DNA, 22 bp, Homo sapiens
accagtatgtgccttcagtgtc

SEQ ID NO: 8784647 - DNA, 22 bp, Homo sapiens
accagtcatagaaagcagtggt

SEQ ID NO: 8784648 - DNA, 22 bp, Homo sapiens
accagtctgttgttgcagagtg

SEQ ID NO: 8784649 - DNA, 22 bp, Homo sapiens
accagtctgttgttgcagagtg

SEQ ID NO: 8784650 - DNA, 22 bp, Homo sapiens
accagtcttgttgccatgtctg

SEQ ID NO: 8784651 - DNA, 22 bp, Homo sapiens
accagtgagtatttgtaacaga

SEQ ID NO: 8784652 - DNA, 22 bp, Homo sapiens
accagtctaggcaatgggggct

SEQ ID NO: 8784653 - DNA, 22 bp, Homo sapiens
accagtgcttcctgctggagct

SEQ ID NO: 8784654 - DNA, 22 bp, Homo sapiens
accagtgcttcctgctggagct

SEQ ID NO: 8784655 - DNA, 22 bp, Homo sapiens
accagtgggaagtggaaaatga

SEQ ID NO: 8784656 - DNA, 22 bp, Homo sapiens
accagttaaagggaaattgaaa

SEQ ID NO: 8784657 - DNA, 22 bp, Homo sapiens
accagtgtcttattgaccatct

SEQ ID NO: 8784658 - DNA, 22 bp, Homo sapiens
acccagagcactgggtgtgggc

SEQ ID NO: 8784659 - DNA, 22 bp, Homo sapiens
acccagagatggacctggctgc

SEQ ID NO: 8784660 - DNA, 17 bp, Homo sapiens
acccagagaaggaggtc

SEQ ID NO: 8784661 - DNA, 22 bp, Homo sapiens
acccagagactagcacggtaca

SEQ ID NO: 8784662 - DNA, 22 bp, Homo sapiens
acccagggtcaccccgtagggt

SEQ ID NO: 8784663 - DNA, 22 bp, Homo sapiens
acccagggtagagtgcagtggc

SEQ ID NO: 8784664 - DNA, 22 bp, Homo sapiens
acccagggtagagtgcagtggc

SEQ ID NO: 8784665 - DNA, 22 bp, Homo sapiens
acccagggagtgctcctgttct

SEQ ID NO: 8784666 - DNA, 22 bp, Homo sapiens
acccagggtagaacctcagagc

SEQ ID NO: 8784667 - DNA, 22 bp, Homo sapiens
acccagggtagaacctcagagc

SEQ ID NO: 8784668 - DNA, 22 bp, Homo sapiens
acccaggctggcgtgcagtggc

SEQ ID NO: 8784669 - DNA, 22 bp, Homo sapiens
acccaggctggcgtgcagtggc

SEQ ID NO: 8784670 - DNA, 22 bp, Homo sapiens
acccagggaccccgctgacgcc

SEQ ID NO: 8784671 - DNA, 22 bp, Homo sapiens
acccagggtttgagctctgcag

SEQ ID NO: 8784672 - DNA, 19 bp, Homo sapiens
acccagggttgatgtccag

SEQ ID NO: 8784673 - DNA, 22 bp, Homo sapiens
acccagggttcctgggtcccag

SEQ ID NO: 8784674 - DNA, 22 bp, Homo sapiens
acccagggtcaccccgtagggt

SEQ ID NO: 8784675 - DNA, 22 bp, Homo sapiens
acccagggtcaccccgtagggt

SEQ ID NO: 8784676 - DNA, 22 bp, Homo sapiens
acccagggttcctgggtcccag

SEQ ID NO: 8784677 - DNA, 22 bp, Homo sapiens
acccagggttcctgggtcccag

SEQ ID NO: 8784678 - DNA, 22 bp, Homo sapiens
acccagggtcaccccgtagggt

SEQ ID NO: 8784679 - DNA, 22 bp, Homo sapiens
acccagggtttgagctctgcag

SEQ ID NO: 8784680 - DNA, 22 bp, Homo sapiens
acccagggtttgagctctgcag

SEQ ID NO: 8784681 - DNA, 22 bp, Homo sapiens
acccaggtggctctgacggggg

SEQ ID NO: 8784682 - DNA, 22 bp, Homo sapiens
acccaccacagtggctggcaca

SEQ ID NO: 8784683 - DNA, 22 bp, Homo sapiens
acccaccctactagcagtgtcc

SEQ ID NO: 8784684 - DNA, 22 bp, Homo sapiens
agggcctgagctctcctccagt

SEQ ID NO: 8784685 - DNA, 19 bp, Homo sapiens
agggcctgagcagatgttg

SEQ ID NO: 8784686 - DNA, 22 bp, Homo sapiens
agggcctgagctctcctccagt

SEQ ID NO: 8784687 - DNA, 19 bp, Homo sapiens
agggcctgagcagatgttg

SEQ ID NO: 8784688 - DNA, 22 bp, Homo sapiens
acccagagaactgaggcatgaa

SEQ ID NO: 8784689 - DNA, 22 bp, Homo sapiens
acccactgtcatctctgaccac

SEQ ID NO: 8784690 - DNA, 22 bp, Homo sapiens
acccaccctactagcagtgtcc

SEQ ID NO: 8784691 - DNA, 22 bp, Homo sapiens
acccaccctactagcagtgtcc

SEQ ID NO: 8784692 - DNA, 22 bp, Homo sapiens
acccacgaagatgagcggcatg

SEQ ID NO: 8784693 - DNA, 22 bp, Homo sapiens
agggcctgagaccgtggcttga

SEQ ID NO: 8784694 - DNA, 22 bp, Homo sapiens
agggcctgacacccttgccagc

SEQ ID NO: 8784695 - DNA, 22 bp, Homo sapiens
agggcctgagaccgtggcttga

SEQ ID NO: 8784696 - DNA, 19 bp, Homo sapiens
agggcctgagcagatgttg

SEQ ID NO: 8784697 - DNA, 19 bp, Homo sapiens
agggcctgagcagatgttg

SEQ ID NO: 8784698 - DNA, 22 bp, Homo sapiens
agggcctgagaccgtggcttga

SEQ ID NO: 8784699 - DNA, 22 bp, Homo sapiens
agggcctgagaccgtggcttga

SEQ ID NO: 8784700 - DNA, 23 bp, Homo sapiens
agggcctctgtcccccagcactc

SEQ ID NO: 8784701 - DNA, 23 bp, Homo sapiens
agggcctctgtcccccagcactc

SEQ ID NO: 8784702 - DNA, 22 bp, Homo sapiens
agggcctctggaacactgaggg

SEQ ID NO: 8784703 - DNA, 22 bp, Homo sapiens
agggcctctgagccagttctgg

SEQ ID NO: 8784704 - DNA, 22 bp, Homo sapiens
agggcctctctgggcctttcct

SEQ ID NO: 8784705 - DNA, 21 bp, Homo sapiens
agggcctctcatttgtgccag

SEQ ID NO: 8784706 - DNA, 22 bp, Homo sapiens
accccacagcatacaaaggcac

SEQ ID NO: 8784707 - DNA, 22 bp, Homo sapiens
accccagaatctatgctttaca

SEQ ID NO: 8784708 - DNA, 22 bp, Homo sapiens
accccagaagcagcagtggcag

SEQ ID NO: 8784709 - DNA, 22 bp, Homo sapiens
accccaaaagagtaatagaatt

SEQ ID NO: 8784710 - DNA, 22 bp, Homo sapiens
accccaaaagagtaatagaatt

SEQ ID NO: 8784711 - DNA, 19 bp, Homo sapiens
acccattttcagtattggc

SEQ ID NO: 8784712 - DNA, 22 bp, Homo sapiens
acccatttcataaacatgcttt

SEQ ID NO: 8784713 - DNA, 22 bp, Homo sapiens
acccatccagtgtccctgctag

SEQ ID NO: 8784714 - DNA, 22 bp, Homo sapiens
acccatcagcggctggagctgg

SEQ ID NO: 8784715 - DNA, 17 bp, Homo sapiens
acccatccccagggcag

SEQ ID NO: 8784716 - DNA, 22 bp, Homo sapiens
acccatgagtgtatctttaaaa

SEQ ID NO: 8784717 - DNA, 22 bp, Homo sapiens
accctctgccttgagcagtgcc

SEQ ID NO: 8784718 - DNA, 18 bp, Homo sapiens
accctctggcttctgagc

SEQ ID NO: 8784719 - DNA, 22 bp, Homo sapiens
accccagcgcatatggtctgcg

SEQ ID NO: 8784720 - DNA, 22 bp, Homo sapiens
accccagcgcatatggtctgcg

SEQ ID NO: 8784721 - DNA, 22 bp, Homo sapiens
accccagcgcatatggtctgcg

SEQ ID NO: 8784722 - DNA, 22 bp, Homo sapiens
accccagccctgcttctgggag

SEQ ID NO: 8784723 - DNA, 22 bp, Homo sapiens
accccagccctgcttctgggag

SEQ ID NO: 8784724 - DNA, 20 bp, Homo sapiens
accccagcccctctatctga

SEQ ID NO: 8784725 - DNA, 22 bp, Homo sapiens
accccagaggcggaggctgcag

SEQ ID NO: 8784726 - DNA, 22 bp, Homo sapiens
accctgcttctggattaatcca

SEQ ID NO: 8784727 - DNA, 18 bp, Homo sapiens
accctctggcttctgagc

SEQ ID NO: 8784728 - DNA, 18 bp, Homo sapiens
accctctggcttctgagc

SEQ ID NO: 8784729 - DNA, 22 bp, Homo sapiens
accctgcctgacaacagaggat

SEQ ID NO: 8784730 - DNA, 22 bp, Homo sapiens
accctggactggggctgaggct

SEQ ID NO: 8784731 - DNA, 21 bp, Homo sapiens
accctgggttctccataccct

SEQ ID NO: 8784732 - DNA, 22 bp, Homo sapiens
accctgggttcccgcagcacca

SEQ ID NO: 8784733 - DNA, 22 bp, Homo sapiens
accctgtatacgctacattttt

SEQ ID NO: 8784734 - DNA, 22 bp, Homo sapiens
accctggtttgaataatctgtg

SEQ ID NO: 8784735 - DNA, 22 bp, Homo sapiens
accctggtctctacttcacaga

SEQ ID NO: 8784736 - DNA, 22 bp, Homo sapiens
accctgggtcatatacagtgtg

SEQ ID NO: 8784737 - DNA, 22 bp, Homo sapiens
accctgggtatttcccaaactt

SEQ ID NO: 8784738 - DNA, 22 bp, Homo sapiens
accctgggggtggccagtgcca

SEQ ID NO: 8784739 - DNA, 22 bp, Homo sapiens
accctgggcttggcctgctcag

SEQ ID NO: 8784740 - DNA, 22 bp, Homo sapiens
accctgggggtggccagtgcca

SEQ ID NO: 8784741 - DNA, 22 bp, Homo sapiens
accctgggcacaccatttcccc

SEQ ID NO: 8784742 - DNA, 22 bp, Homo sapiens
accctggctctctggccaccgc

SEQ ID NO: 8784743 - DNA, 22 bp, Homo sapiens
accctgggaactggaaactgga

SEQ ID NO: 8784744 - DNA, 22 bp, Homo sapiens
accctggcagccttctgtcctg

SEQ ID NO: 8784745 - DNA, 22 bp, Homo sapiens
accctggcccattgctgtgcct

SEQ ID NO: 8784746 - DNA, 22 bp, Homo sapiens
accctggcccattgctgtgcct

SEQ ID NO: 8784747 - DNA, 22 bp, Homo sapiens
accctggaggtggaggtgcagt

SEQ ID NO: 8784748 - DNA, 17 bp, Homo sapiens
aggaagcgagctggcct

SEQ ID NO: 8784749 - DNA, 22 bp, Homo sapiens
aggaagcgtgggtctggctgga

SEQ ID NO: 8784750 - DNA, 22 bp, Homo sapiens
aggaagctagaaggtcttcttt

SEQ ID NO: 8784751 - DNA, 23 bp, Homo sapiens
aggaagctaccaattttgtaggc

SEQ ID NO: 8784752 - DNA, 22 bp, Homo sapiens
aggaagctagagccaccggact

SEQ ID NO: 8784753 - DNA, 23 bp, Homo sapiens
aggaagctaagtgtggctgcgga

SEQ ID NO: 8784754 - DNA, 23 bp, Homo sapiens
aggaagctaagtgtggctgcgga

SEQ ID NO: 8784755 - DNA, 22 bp, Homo sapiens
aggaagctaaccagggagtgag

SEQ ID NO: 8784756 - DNA, 22 bp, Homo sapiens
aggaagctaaccagggagtgag

SEQ ID NO: 8784757 - DNA, 22 bp, Homo sapiens
aggaagcgtgggtctggctgga

SEQ ID NO: 8784758 - DNA, 22 bp, Homo sapiens
aggaaggctgatcactgcttgt

SEQ ID NO: 8784759 - DNA, 22 bp, Homo sapiens
aggaaggcttctttggtcttct

SEQ ID NO: 8784760 - DNA, 22 bp, Homo sapiens
aggaagggatacataggatagt

SEQ ID NO: 8784761 - DNA, 22 bp, Homo sapiens
aggaaggcatgaggtgttcaca

SEQ ID NO: 8784762 - DNA, 23 bp, Homo sapiens
aggaaggaggtcctaacagtatc

SEQ ID NO: 8784763 - DNA, 23 bp, Homo sapiens
aggaaggaggtcctaacagtatc

SEQ ID NO: 8784764 - DNA, 20 bp, Homo sapiens
aggaaggagaatctgagcaa

SEQ ID NO: 8784765 - DNA, 22 bp, Homo sapiens
aggaaggagggcagatattaag

SEQ ID NO: 8784766 - DNA, 23 bp, Homo sapiens
aggaaggaggtcctaacagtatc

SEQ ID NO: 8784767 - DNA, 22 bp, Homo sapiens
aggacttcttagatgccttccg

SEQ ID NO: 8784768 - DNA, 19 bp, Homo sapiens
aggacttctgaacccgtcc

SEQ ID NO: 8784769 - DNA, 19 bp, Homo sapiens
aggacttctgaacccgtcc

SEQ ID NO: 8784770 - DNA, 22 bp, Homo sapiens
aggacttctgagctgctttaaa

SEQ ID NO: 8784771 - DNA, 22 bp, Homo sapiens
aggacttctgagctgctttaaa

SEQ ID NO: 8784772 - DNA, 22 bp, Homo sapiens
aggacttctgaggtcaagtcgc

SEQ ID NO: 8784773 - DNA, 22 bp, Homo sapiens
aggacttctgaggtcaagtcgc

SEQ ID NO: 8784774 - DNA, 22 bp, Homo sapiens
aggacttcttagatgccttccg

SEQ ID NO: 8784775 - DNA, 22 bp, Homo sapiens
aggacttcttagatgccttccg

SEQ ID NO: 8784776 - DNA, 22 bp, Homo sapiens
aggacttctccgataagtcaga

SEQ ID NO: 8784777 - DNA, 22 bp, Homo sapiens
aggacttctccgataagtcaga

SEQ ID NO: 8784778 - DNA, 22 bp, Homo sapiens
aggacttctaagctaagaagtt

SEQ ID NO: 8784779 - DNA, 22 bp, Homo sapiens
aggacttctaagctaagaagtt

SEQ ID NO: 8784780 - DNA, 22 bp, Homo sapiens
aggacttctagtggtactgtga

SEQ ID NO: 8784781 - DNA, 22 bp, Homo sapiens
aggacttctagtggtactgtga

SEQ ID NO: 8784782 - DNA, 23 bp, Homo sapiens
aggagacagggaagtgcctggct

SEQ ID NO: 8784783 - DNA, 23 bp, Homo sapiens
aggagacagggaagtgcctggct

SEQ ID NO: 8784784 - DNA, 22 bp, Homo sapiens
aggagacagtttggacgtgtag

SEQ ID NO: 8784785 - DNA, 22 bp, Homo sapiens
aggagacagtttggacgtgtag

SEQ ID NO: 8784786 - DNA, 22 bp, Homo sapiens
aggagacagtttggacgtgtag

SEQ ID NO: 8784787 - DNA, 22 bp, Homo sapiens
aggactttaacatattaactgt

SEQ ID NO: 8784788 - DNA, 22 bp, Homo sapiens
aggagacagccaggggcctgag

SEQ ID NO: 8784789 - DNA, 22 bp, Homo sapiens
aggagacataactatgatgaga

SEQ ID NO: 8784790 - DNA, 22 bp, Homo sapiens
aggagacataactatgatgaga

SEQ ID NO: 8784791 - DNA, 22 bp, Homo sapiens
aggagacatactataggaatat

SEQ ID NO: 8784792 - DNA, 22 bp, Homo sapiens
aggagacatggaatagtgaggc

SEQ ID NO: 8784793 - DNA, 22 bp, Homo sapiens
aggagacatggaatagtgaggc

SEQ ID NO: 8784794 - DNA, 22 bp, Homo sapiens
aggagacatggaatagtgaggc

SEQ ID NO: 8784795 - DNA, 20 bp, Homo sapiens
aggagccattgactgcagca

SEQ ID NO: 8784796 - DNA, 20 bp, Homo sapiens
aggagccattgactgcagca

SEQ ID NO: 8784797 - DNA, 22 bp, Homo sapiens
aggagccattttccaagggcga

SEQ ID NO: 8784798 - DNA, 22 bp, Homo sapiens
aggagccattttccaagggcga

SEQ ID NO: 8784799 - DNA, 22 bp, Homo sapiens
aggagccattgcaggatggcag

SEQ ID NO: 8784800 - DNA, 22 bp, Homo sapiens
aggagccattgcaggatggcag

SEQ ID NO: 8784801 - DNA, 22 bp, Homo sapiens
aggagcagaccgtagtcctgca

SEQ ID NO: 8784802 - DNA, 22 bp, Homo sapiens
aggagcagaccgtagtcctgca

SEQ ID NO: 8784803 - DNA, 22 bp, Homo sapiens
aggagccatggaggtgaggcgg

SEQ ID NO: 8784804 - DNA, 22 bp, Homo sapiens
aggagccatggaggtgaggcgg

SEQ ID NO: 8784805 - DNA, 23 bp, Homo sapiens
aggagccatgagttggatatgtt

SEQ ID NO: 8784806 - DNA, 22 bp, Homo sapiens
acaggggtgcatggtgcatggt

SEQ ID NO: 8784807 - DNA, 22 bp, Homo sapiens
acagggtcttagagatcacctg

SEQ ID NO: 8784808 - DNA, 22 bp, Homo sapiens
acaggggctccgaaggtgaggg

SEQ ID NO: 8784809 - DNA, 22 bp, Homo sapiens
acaggggctccgaaggtgaggg

SEQ ID NO: 8784810 - DNA, 22 bp, Homo sapiens
acaggggctccgaaggtgaggg

SEQ ID NO: 8784811 - DNA, 22 bp, Homo sapiens
acaggggctccgaaggtgaggg

SEQ ID NO: 8784812 - DNA, 22 bp, Homo sapiens
acaggggtgcatggtgcatggt

SEQ ID NO: 8784813 - DNA, 22 bp, Homo sapiens
acagggtggggatggtgagctt

SEQ ID NO: 8784814 - DNA, 22 bp, Homo sapiens
acagggtgactttgtgacagat

SEQ ID NO: 8784815 - DNA, 22 bp, Homo sapiens
acagggtgactttgtgacagat

SEQ ID NO: 8784816 - DNA, 22 bp, Homo sapiens
acagggtcttagagatcacctg

SEQ ID NO: 8784817 - DNA, 22 bp, Homo sapiens
acagggtgaatgtgacattatc

SEQ ID NO: 8784818 - DNA, 23 bp, Homo sapiens
aggagcccctaattctgggcagc

SEQ ID NO: 8784819 - DNA, 22 bp, Homo sapiens
aggagcccctcttcagtcctgg

SEQ ID NO: 8784820 - DNA, 23 bp, Homo sapiens
aggagcccctaattctgggcagc

SEQ ID NO: 8784821 - DNA, 22 bp, Homo sapiens
aggagcccagcctgggctcgga

SEQ ID NO: 8784822 - DNA, 22 bp, Homo sapiens
aggagcccctcttcagtcctgg

SEQ ID NO: 8784823 - DNA, 22 bp, Homo sapiens
aggagccctgcgggaggcagag

SEQ ID NO: 8784824 - DNA, 22 bp, Homo sapiens
aggagccctgcgggaggcagag

SEQ ID NO: 8784825 - DNA, 22 bp, Homo sapiens
aggagccctgcgggaggcagag

SEQ ID NO: 8784826 - DNA, 22 bp, Homo sapiens
aggagcctccatggtcacattc

SEQ ID NO: 8784827 - DNA, 22 bp, Homo sapiens
aggagcctccatggtcacattc

SEQ ID NO: 8784828 - DNA, 22 bp, Homo sapiens
aggagctgcaaatattagtaat

SEQ ID NO: 8784829 - DNA, 22 bp, Homo sapiens
aggagctgcagattctgccttg

SEQ ID NO: 8784830 - DNA, 22 bp, Homo sapiens
aggagctgcttaaatggttggt

SEQ ID NO: 8784831 - DNA, 22 bp, Homo sapiens
aggagctgctttggtgcggttt

SEQ ID NO: 8784832 - DNA, 22 bp, Homo sapiens
aggagctggagtccaggcaagt

SEQ ID NO: 8784833 - DNA, 21 bp, Homo sapiens
aggagctggagaaaactttcc

SEQ ID NO: 8784834 - DNA, 20 bp, Homo sapiens
aggagggacctggattggcg

SEQ ID NO: 8784835 - DNA, 20 bp, Homo sapiens
aggagggacctggattggcg

SEQ ID NO: 8784836 - DNA, 20 bp, Homo sapiens
aggagggacctggattggcg

SEQ ID NO: 8784837 - DNA, 20 bp, Homo sapiens
aggagggacctggattggcg

SEQ ID NO: 8784838 - DNA, 22 bp, Homo sapiens
aggagggagatgcccatcctgg

SEQ ID NO: 8784839 - DNA, 22 bp, Homo sapiens
aggagggagatgcccatcctgg

SEQ ID NO: 8784840 - DNA, 20 bp, Homo sapiens
aggagggacctggattggcg

SEQ ID NO: 8784841 - DNA, 20 bp, Homo sapiens
aggagggacctggattggcg

SEQ ID NO: 8784842 - DNA, 22 bp, Homo sapiens
aggagggacaccaatatatgtt

SEQ ID NO: 8784843 - DNA, 22 bp, Homo sapiens
aggagggacctaggaatattgc

SEQ ID NO: 8784844 - DNA, 22 bp, Homo sapiens
aggaggggcatagaaatgtaat

SEQ ID NO: 8784845 - DNA, 22 bp, Homo sapiens
aggaggggcatagaaatgtaat

SEQ ID NO: 8784846 - DNA, 22 bp, Homo sapiens
aggaggggcatagaaatgtaat

SEQ ID NO: 8784847 - DNA, 21 bp, Homo sapiens
aggaggggtctttcccactga

SEQ ID NO: 8784848 - DNA, 21 bp, Homo sapiens
aggaggggtctttcccactga

SEQ ID NO: 8784849 - DNA, 22 bp, Homo sapiens
aggaggggcatagaaatgtaat

SEQ ID NO: 8784850 - DNA, 22 bp, Homo sapiens
aggagggagatgcccatcctgg

SEQ ID NO: 8784851 - DNA, 22 bp, Homo sapiens
aggaggctgtggagcactccat

SEQ ID NO: 8784852 - DNA, 22 bp, Homo sapiens
aggaggcttttgcaggtgccac

SEQ ID NO: 8784853 - DNA, 22 bp, Homo sapiens
aggaggccgatttcagaggtcg

SEQ ID NO: 8784854 - DNA, 22 bp, Homo sapiens
aggaggccgatttcagaggtcg

SEQ ID NO: 8784855 - DNA, 22 bp, Homo sapiens
aggagggaataagaaagagtca

SEQ ID NO: 8784856 - DNA, 22 bp, Homo sapiens
aggagggaataagaaagagtca

SEQ ID NO: 8784857 - DNA, 22 bp, Homo sapiens
aggagggacaccaatatatgtt

SEQ ID NO: 8784858 - DNA, 17 bp, Homo sapiens
aggagggaaatagcttg

SEQ ID NO: 8784859 - DNA, 17 bp, Homo sapiens
aggagggaaatagcttg

SEQ ID NO: 8784860 - DNA, 17 bp, Homo sapiens
aggagggaaatagcttg

SEQ ID NO: 8784861 - DNA, 22 bp, Homo sapiens
aggagggaataagaaagagtca

SEQ ID NO: 8784862 - DNA, 17 bp, Homo sapiens
aggagggaaatagcttg

SEQ ID NO: 8784863 - DNA, 22 bp, Homo sapiens
aggaggggttctcgggtgctga

SEQ ID NO: 8784864 - DNA, 22 bp, Homo sapiens
aggaggggttctcgggtgctga

SEQ ID NO: 8784865 - DNA, 22 bp, Homo sapiens
aggaggggttctcgggtgctga

SEQ ID NO: 8784866 - DNA, 22 bp, Homo sapiens
aggaggggttctcgggtgctga

SEQ ID NO: 8784867 - DNA, 21 bp, Homo sapiens
aggaggggtctttcccactga

SEQ ID NO: 8784868 - DNA, 21 bp, Homo sapiens
aggaggggtctttcccactga

SEQ ID NO: 8784869 - DNA, 21 bp, Homo sapiens
aggaggggtctttcccactga

SEQ ID NO: 8784870 - DNA, 21 bp, Homo sapiens
aggaggggtctttcccactga

SEQ ID NO: 8784871 - DNA, 22 bp, Homo sapiens
aggaggggttctcgggtgctga

SEQ ID NO: 8784872 - DNA, 22 bp, Homo sapiens
aggaggggttctcgggtgctga

SEQ ID NO: 8784873 - DNA, 22 bp, Homo sapiens
aggaggggttctcgggtgctga

SEQ ID NO: 8784874 - DNA, 22 bp, Homo sapiens
aggagggtacaatgggtggaaa

SEQ ID NO: 8784875 - DNA, 22 bp, Homo sapiens
aggcaaaagaatgtcataaatg

SEQ ID NO: 8784876 - DNA, 21 bp, Homo sapiens
aggattttgttgaagtttctg

SEQ ID NO: 8784877 - DNA, 22 bp, Homo sapiens
aggattttgctttataaaagcc

SEQ ID NO: 8784878 - DNA, 22 bp, Homo sapiens
aggcaaagaagttggtcaggag

SEQ ID NO: 8784879 - DNA, 22 bp, Homo sapiens
aggcaaaataagcctctcctgt

SEQ ID NO: 8784880 - DNA, 22 bp, Homo sapiens
aggcaaaagaatgtcataaatg

SEQ ID NO: 8784881 - DNA, 22 bp, Homo sapiens
aggcaaaattacaaagttatta

SEQ ID NO: 8784882 - DNA, 22 bp, Homo sapiens
aggcaaaattacaaagttatta

SEQ ID NO: 8784883 - DNA, 22 bp, Homo sapiens
aggcaaatagatagtccataca

SEQ ID NO: 8784884 - DNA, 22 bp, Homo sapiens
aggcaaatctcagttggcctct

SEQ ID NO: 8784885 - DNA, 22 bp, Homo sapiens
aggcaaagagccagcaaatctg

SEQ ID NO: 8784886 - DNA, 22 bp, Homo sapiens
aggcaaagaggatattttgggg

SEQ ID NO: 8784887 - DNA, 22 bp, Homo sapiens
aggcaaagcgataccagagcta

SEQ ID NO: 8784888 - DNA, 22 bp, Homo sapiens
aggcacagatttggggaaagca

SEQ ID NO: 8784889 - DNA, 22 bp, Homo sapiens
aggcacagatttggggaaagca

SEQ ID NO: 8784890 - DNA, 22 bp, Homo sapiens
aggcacagatttggggaaagca

SEQ ID NO: 8784891 - DNA, 18 bp, Homo sapiens
aggcacagagcatacata

SEQ ID NO: 8784892 - DNA, 18 bp, Homo sapiens
aggcacagagcatacata

SEQ ID NO: 8784893 - DNA, 18 bp, Homo sapiens
aggcacagagcatacata

SEQ ID NO: 8784894 - DNA, 18 bp, Homo sapiens
aggcacagagcatacata

SEQ ID NO: 8784895 - DNA, 22 bp, Homo sapiens
aggcacagagaggttaaatgca

SEQ ID NO: 8784896 - DNA, 22 bp, Homo sapiens
aggcacagagaatgccctccat

SEQ ID NO: 8784897 - DNA, 22 bp, Homo sapiens
aggcacagagaatgccctccat

SEQ ID NO: 8784898 - DNA, 22 bp, Homo sapiens
aggcacagaatggcattcagtg

SEQ ID NO: 8784899 - DNA, 22 bp, Homo sapiens
aggcacagagaatgccctccat

SEQ ID NO: 8784900 - DNA, 22 bp, Homo sapiens
aggcacagagaatgccctccat

SEQ ID NO: 8784901 - DNA, 22 bp, Homo sapiens
aggcacagagaatgccctccat

SEQ ID NO: 8784902 - DNA, 22 bp, Homo sapiens
aggcacagagaatgccctccat

SEQ ID NO: 8784903 - DNA, 22 bp, Homo sapiens
aggcacagaatggcattcagtg

SEQ ID NO: 8784904 - DNA, 22 bp, Homo sapiens
aggcacagagaagtaaagtatc

SEQ ID NO: 8784905 - DNA, 22 bp, Homo sapiens
aggcacagaatggcattcagtg

SEQ ID NO: 8784906 - DNA, 22 bp, Homo sapiens
aggcacagagaagtaaagtatc

SEQ ID NO: 8784907 - DNA, 22 bp, Homo sapiens
aggcacagaatggcattcagtg

SEQ ID NO: 8784908 - DNA, 22 bp, Homo sapiens
aggcacagaatggcattcagtg

SEQ ID NO: 8784909 - DNA, 22 bp, Homo sapiens
aggcacagaatggcattcagtg

SEQ ID NO: 8784910 - DNA, 22 bp, Homo sapiens
aggcaacaggaaaccacatgat

SEQ ID NO: 8784911 - DNA, 22 bp, Homo sapiens
aggcaacaggaaaccacatgat

SEQ ID NO: 8784912 - DNA, 22 bp, Homo sapiens
aggcaacacttgcattttttag

SEQ ID NO: 8784913 - DNA, 22 bp, Homo sapiens
aggcaacaagggtagtcagtga

SEQ ID NO: 8784914 - DNA, 22 bp, Homo sapiens
aggcaacatgactcacttgcac

SEQ ID NO: 8784915 - DNA, 22 bp, Homo sapiens
aggcaacatgactcacttgcac

SEQ ID NO: 8784916 - DNA, 22 bp, Homo sapiens
aggcaacaggaaaccacatgat

SEQ ID NO: 8784917 - DNA, 22 bp, Homo sapiens
aggcaacataacacgaaagtct

SEQ ID NO: 8784918 - DNA, 22 bp, Homo sapiens
aggcaacatgggccaggcagaa

SEQ ID NO: 8784919 - DNA, 22 bp, Homo sapiens
aggcaacaagggtagtcagtga

SEQ ID NO: 8784920 - DNA, 22 bp, Homo sapiens
aggcaacatgactcacttgcac

SEQ ID NO: 8784921 - DNA, 22 bp, Homo sapiens
aggcacagaatggcattcagtg

SEQ ID NO: 8784922 - DNA, 22 bp, Homo sapiens
aggcacacccagtgacctcccg

SEQ ID NO: 8784923 - DNA, 22 bp, Homo sapiens
aggcacacagcttgcataaatc

SEQ ID NO: 8784924 - DNA, 19 bp, Homo sapiens
aggcacaattctgagaagc

SEQ ID NO: 8784925 - DNA, 22 bp, Homo sapiens
aggcacacagaccccagcaagt

SEQ ID NO: 8784926 - DNA, 22 bp, Homo sapiens
aggcacaagaaactgctcccca

SEQ ID NO: 8784927 - DNA, 22 bp, Homo sapiens
aggcaactaggcctctgcctca

SEQ ID NO: 8784928 - DNA, 22 bp, Homo sapiens
aggcaaccctggtgagcagatg

SEQ ID NO: 8784929 - DNA, 22 bp, Homo sapiens
aggcaacatgggccaggcagaa

SEQ ID NO: 8784930 - DNA, 19 bp, Homo sapiens
aggcaaccaatgaggcaaa

SEQ ID NO: 8784931 - DNA, 22 bp, Homo sapiens
acatacatatgtttaaatgcat

SEQ ID NO: 8784932 - DNA, 22 bp, Homo sapiens
acatacatatgtttaaatgcat

SEQ ID NO: 8784933 - DNA, 23 bp, Homo sapiens
acatacatggagataaagtgatg

SEQ ID NO: 8784934 - DNA, 22 bp, Homo sapiens
acatacatcaagtatcacaaga

SEQ ID NO: 8784935 - DNA, 22 bp, Homo sapiens
acatacatcaagtatcacaaga

SEQ ID NO: 8784936 - DNA, 22 bp, Homo sapiens
acatacatcaagtatcacaaga

SEQ ID NO: 8784937 - DNA, 23 bp, Homo sapiens
acatacataagcaccacattttg

SEQ ID NO: 8784938 - DNA, 17 bp, Homo sapiens
acatacactggtgaaca

SEQ ID NO: 8784939 - DNA, 22 bp, Homo sapiens
acatacacgggaaacctctttt

SEQ ID NO: 8784940 - DNA, 22 bp, Homo sapiens
acatacacacatactttctcct

SEQ ID NO: 8784941 - DNA, 22 bp, Homo sapiens
acatacacaagcgtacatgaac

SEQ ID NO: 8784942 - DNA, 22 bp, Homo sapiens
acatacacaagcgtacatgaac

SEQ ID NO: 8784943 - DNA, 22 bp, Homo sapiens
acataacaatcataggacatag

SEQ ID NO: 8784944 - DNA, 22 bp, Homo sapiens
acataaatttcactgttccgtg

SEQ ID NO: 8784945 - DNA, 21 bp, Homo sapiens
agctggctctctctggagaga

SEQ ID NO: 8784946 - DNA, 21 bp, Homo sapiens
agctggctctctctggagaga

SEQ ID NO: 8784947 - DNA, 21 bp, Homo sapiens
agctggctctctctggagaga

SEQ ID NO: 8784948 - DNA, 22 bp, Homo sapiens
agctggctatgccctgtgaacc

SEQ ID NO: 8784949 - DNA, 22 bp, Homo sapiens
agctggctatgccctgtgaacc

SEQ ID NO: 8784950 - DNA, 22 bp, Homo sapiens
agctggctatgccctgtgaacc

SEQ ID NO: 8784951 - DNA, 22 bp, Homo sapiens
agctggctatacttgaaaagtc

SEQ ID NO: 8784952 - DNA, 22 bp, Homo sapiens
agctggccttcggtgtcactgg

SEQ ID NO: 8784953 - DNA, 22 bp, Homo sapiens
agctggcctgttagagctgagt

SEQ ID NO: 8784954 - DNA, 22 bp, Homo sapiens
agctggccttagtgagcacctg

SEQ ID NO: 8784955 - DNA, 22 bp, Homo sapiens
acagcctgagagtggagctggc

SEQ ID NO: 8784956 - DNA, 22 bp, Homo sapiens
acagcctgcagccccaggtcgc

SEQ ID NO: 8784957 - DNA, 22 bp, Homo sapiens
acagcctgcagccccaggtcgc

SEQ ID NO: 8784958 - DNA, 20 bp, Homo sapiens
agctggcctgtcctaggcct

SEQ ID NO: 8784959 - DNA, 22 bp, Homo sapiens
agctggcaggggttcacactgc

SEQ ID NO: 8784960 - DNA, 19 bp, Homo sapiens
agctggcagcttccacttc

SEQ ID NO: 8784961 - DNA, 22 bp, Homo sapiens
agctggcaggggttcacactgc

SEQ ID NO: 8784962 - DNA, 19 bp, Homo sapiens
agctggcagcttccacttc

SEQ ID NO: 8784963 - DNA, 22 bp, Homo sapiens
agctgctggggagggcagacac

SEQ ID NO: 8784964 - DNA, 23 bp, Homo sapiens
agctgctgggcctgccgtggcct

SEQ ID NO: 8784965 - DNA, 22 bp, Homo sapiens
agctgctgtcctaggcactgta

SEQ ID NO: 8784966 - DNA, 22 bp, Homo sapiens
agctgctggtttaagggatggg

SEQ ID NO: 8784967 - DNA, 22 bp, Homo sapiens
agctgctgtcctaggcactgta

SEQ ID NO: 8784968 - DNA, 22 bp, Homo sapiens
agctgctgtcctaggcactgta

SEQ ID NO: 8784969 - DNA, 22 bp, Homo sapiens
agctgctgtcctaggcactgta

SEQ ID NO: 8784970 - DNA, 22 bp, Homo sapiens
agctgctgtggccacatctggc

SEQ ID NO: 8784971 - DNA, 22 bp, Homo sapiens
agctgctgtttggtgagtcttg

SEQ ID NO: 8784972 - DNA, 22 bp, Homo sapiens
agctgcttagagtcctcaggat

SEQ ID NO: 8784973 - DNA, 22 bp, Homo sapiens
agctgctgtttcttgcacgtat

SEQ ID NO: 8784974 - DNA, 22 bp, Homo sapiens
agctgctgtttggtgagtcttg

SEQ ID NO: 8784975 - DNA, 22 bp, Homo sapiens
agctgctgtgtgctcaggcagg

SEQ ID NO: 8784976 - DNA, 22 bp, Homo sapiens
agctgctgtttcttgcacgtat

SEQ ID NO: 8784977 - DNA, 22 bp, Homo sapiens
agctgctgtggggctcggcctg

SEQ ID NO: 8784978 - DNA, 22 bp, Homo sapiens
agctgctgtggggctcggcctg

SEQ ID NO: 8784979 - DNA, 22 bp, Homo sapiens
agctgcttataagatttgggag

SEQ ID NO: 8784980 - DNA, 22 bp, Homo sapiens
agctgcttcaaaatgggctcct

SEQ ID NO: 8784981 - DNA, 22 bp, Homo sapiens
agctgcttcctctttgatgtca

SEQ ID NO: 8784982 - DNA, 21 bp, Homo sapiens
agctgcttcacctggacaaca

SEQ ID NO: 8784983 - DNA, 22 bp, Homo sapiens
agctgcttcctctttgatgtca

SEQ ID NO: 8784984 - DNA, 22 bp, Homo sapiens
agctgcttataagatttgggag

SEQ ID NO: 8784985 - DNA, 22 bp, Homo sapiens
agctgcttagagtctcttctta

SEQ ID NO: 8784986 - DNA, 22 bp, Homo sapiens
agctgcttattcattgatcgat

SEQ ID NO: 8784987 - DNA, 22 bp, Homo sapiens
agctgcttagagtcctcaggat

SEQ ID NO: 8784988 - DNA, 18 bp, Homo sapiens
agctgcttgcaggccttc

SEQ ID NO: 8784989 - DNA, 22 bp, Homo sapiens
agctgcttgggaaccatcaatt

SEQ ID NO: 8784990 - DNA, 22 bp, Homo sapiens
agctgcttgttgaaatccaaac

SEQ ID NO: 8784991 - DNA, 22 bp, Homo sapiens
agctgcttgtacatgaccacat

SEQ ID NO: 8784992 - DNA, 22 bp, Homo sapiens
acagcccagaaagcctaagggg

SEQ ID NO: 8784993 - DNA, 22 bp, Homo sapiens
acagccccccgctcagtttcca

SEQ ID NO: 8784994 - DNA, 23 bp, Homo sapiens
acagccccatgcaggtgtgtttg

SEQ ID NO: 8784995 - DNA, 22 bp, Homo sapiens
acagccccccgctcagtttcca

SEQ ID NO: 8784996 - DNA, 22 bp, Homo sapiens
acagccccccgctcagtttcca

SEQ ID NO: 8784997 - DNA, 23 bp, Homo sapiens
acagccccatgcaggtgtgtttg

SEQ ID NO: 8784998 - DNA, 22 bp, Homo sapiens
acagccccagcgcggcggggtc

SEQ ID NO: 8784999 - DNA, 22 bp, Homo sapiens
acagcccaggactccagtgggc

SEQ ID NO: 8785000 - DNA, 22 bp, Homo sapiens
acagcccaggactccagtgggc

SEQ ID NO: 8785001 - DNA, 22 bp, Homo sapiens
acagcccaggactccagtgggc

SEQ ID NO: 8785002 - DNA, 22 bp, Homo sapiens
agctgctgggatacagtagtga

SEQ ID NO: 8785003 - DNA, 22 bp, Homo sapiens
agctgctgggatacagtagtga

SEQ ID NO: 8785004 - DNA, 22 bp, Homo sapiens
agctgcaggagtcgcctaggat

SEQ ID NO: 8785005 - DNA, 22 bp, Homo sapiens
agctgcaggattatggaatgga

SEQ ID NO: 8785006 - DNA, 22 bp, Homo sapiens
agctgcaggaagtagaagcgga

SEQ ID NO: 8785007 - DNA, 22 bp, Homo sapiens
agctgcaggaagtagaagcgga

SEQ ID NO: 8785008 - DNA, 22 bp, Homo sapiens
agctgcaggagtcgcctaggat

SEQ ID NO: 8785009 - DNA, 22 bp, Homo sapiens
agctgcagcttcctagtccagc

SEQ ID NO: 8785010 - DNA, 22 bp, Homo sapiens
agctgcaggaagtagaagcgga

SEQ ID NO: 8785011 - DNA, 22 bp, Homo sapiens
agctgcagctacagtgttggtt

SEQ ID NO: 8785012 - DNA, 22 bp, Homo sapiens
agctgcagctgttttctgagtg

SEQ ID NO: 8785013 - DNA, 22 bp, Homo sapiens
agctgcagctacagtgttggtt

SEQ ID NO: 8785014 - DNA, 22 bp, Homo sapiens
agctgcagctacagtgttggtt

SEQ ID NO: 8785015 - DNA, 22 bp, Homo sapiens
agctgcagcgttcatttttcca

SEQ ID NO: 8785016 - DNA, 22 bp, Homo sapiens
acagccagtgactggacaagct

SEQ ID NO: 8785017 - DNA, 22 bp, Homo sapiens
acagccagtgactggacaagct

SEQ ID NO: 8785018 - DNA, 22 bp, Homo sapiens
acagccagtgctccgtgaggac

SEQ ID NO: 8785019 - DNA, 22 bp, Homo sapiens
acagccagtgctccgtgaggac

SEQ ID NO: 8785020 - DNA, 22 bp, Homo sapiens
acagccagtgactggacaagct

SEQ ID NO: 8785021 - DNA, 22 bp, Homo sapiens
acagccagtgctccgtgaggac

SEQ ID NO: 8785022 - DNA, 22 bp, Homo sapiens
agctgcagccgcagctgtggcc

SEQ ID NO: 8785023 - DNA, 22 bp, Homo sapiens
agctgcagccgcagctgtggcc

SEQ ID NO: 8785024 - DNA, 22 bp, Homo sapiens
agctgcagccgcagctgtggcc

SEQ ID NO: 8785025 - DNA, 22 bp, Homo sapiens
agctgcagcctcatgattcggt

SEQ ID NO: 8785026 - DNA, 22 bp, Homo sapiens
acagcccaagtcacctgcagga

SEQ ID NO: 8785027 - DNA, 22 bp, Homo sapiens
agctgcagccctcctgcatggc

SEQ ID NO: 8785028 - DNA, 20 bp, Homo sapiens
agctccagtgctgacgcttc

SEQ ID NO: 8785029 - DNA, 22 bp, Homo sapiens
agctccagttacttacctagag

SEQ ID NO: 8785030 - DNA, 22 bp, Homo sapiens
agctccaggtgcaagtcatggt

SEQ ID NO: 8785031 - DNA, 22 bp, Homo sapiens
agctccaggtgcaagtcatggt

SEQ ID NO: 8785032 - DNA, 22 bp, Homo sapiens
agctccaggtgcaagtcatggt

SEQ ID NO: 8785033 - DNA, 22 bp, Homo sapiens
agctccaggtgcaagtcatggt

SEQ ID NO: 8785034 - DNA, 20 bp, Homo sapiens
acagccagaggaggcagaca

SEQ ID NO: 8785035 - DNA, 20 bp, Homo sapiens
agctccatgaagtagtcact

SEQ ID NO: 8785036 - DNA, 18 bp, Homo sapiens
agctccatctgtcagcat

SEQ ID NO: 8785037 - DNA, 22 bp, Homo sapiens
agctccagtttcctgactgagc

SEQ ID NO: 8785038 - DNA, 22 bp, Homo sapiens
agctccagtttcctgactgagc

SEQ ID NO: 8785039 - DNA, 22 bp, Homo sapiens
acagccagaggtggtcctgggt

SEQ ID NO: 8785040 - DNA, 22 bp, Homo sapiens
acagccagggtctcaggaggcg

SEQ ID NO: 8785041 - DNA, 22 bp, Homo sapiens
acagccagggtctcaggaggcg

SEQ ID NO: 8785042 - DNA, 22 bp, Homo sapiens
acagccagggtctcaggaggcg

SEQ ID NO: 8785043 - DNA, 22 bp, Homo sapiens
acagccaggtaaaggcatggca

SEQ ID NO: 8785044 - DNA, 22 bp, Homo sapiens
acagccagtaaggaaagaccca

SEQ ID NO: 8785045 - DNA, 22 bp, Homo sapiens
acagccaggtaaaggcatggca

SEQ ID NO: 8785046 - DNA, 22 bp, Homo sapiens
acagccaggtaaaggcatggca

SEQ ID NO: 8785047 - DNA, 22 bp, Homo sapiens
acagccagggtctcaggaggcg

SEQ ID NO: 8785048 - DNA, 22 bp, Homo sapiens
acagccaggtaaaggcatggca

SEQ ID NO: 8785049 - DNA, 22 bp, Homo sapiens
acagccagtcatctcagcaggg

SEQ ID NO: 8785050 - DNA, 22 bp, Homo sapiens
acagccagtgactgcagaccct

SEQ ID NO: 8785051 - DNA, 22 bp, Homo sapiens
acagccagtcctcccacagggt

SEQ ID NO: 8785052 - DNA, 22 bp, Homo sapiens
acagccagtcatctcagcaggg

SEQ ID NO: 8785053 - DNA, 22 bp, Homo sapiens
aggaaactgatgttttttacaa

SEQ ID NO: 8785054 - DNA, 22 bp, Homo sapiens
aggaaacttcagagttttggtc

SEQ ID NO: 8785055 - DNA, 22 bp, Homo sapiens
aggaaactgaagcccagagagg

SEQ ID NO: 8785056 - DNA, 22 bp, Homo sapiens
aggaaactaacttatctttata

SEQ ID NO: 8785057 - DNA, 18 bp, Homo sapiens
aggaaagaaaggcaggtg

SEQ ID NO: 8785058 - DNA, 18 bp, Homo sapiens
aggaaagaaaggcaggtg

SEQ ID NO: 8785059 - DNA, 22 bp, Homo sapiens
aggaagagcattcacatggtag

SEQ ID NO: 8785060 - DNA, 22 bp, Homo sapiens
aggaagagcattcacatggtag

SEQ ID NO: 8785061 - DNA, 18 bp, Homo sapiens
aggaaagaaaggcaggtg

SEQ ID NO: 8785062 - DNA, 18 bp, Homo sapiens
aggaagcaggaggaaggc

SEQ ID NO: 8785063 - DNA, 22 bp, Homo sapiens
aggaagcatgttggatccactt

SEQ ID NO: 8785064 - DNA, 22 bp, Homo sapiens
aggaagcagtttataatgcatt

SEQ ID NO: 8785065 - DNA, 22 bp, Homo sapiens
agctttgtcttctcacatatcc

SEQ ID NO: 8785066 - DNA, 22 bp, Homo sapiens
agctttggttgccatgatctga

SEQ ID NO: 8785067 - DNA, 20 bp, Homo sapiens
agctttggttaagccagtgg

SEQ ID NO: 8785068 - DNA, 20 bp, Homo sapiens
agctttggttaagccagtgg

SEQ ID NO: 8785069 - DNA, 22 bp, Homo sapiens
agctttggttgaggggagtgtg

SEQ ID NO: 8785070 - DNA, 22 bp, Homo sapiens
agcttcatctttatgtacagga

SEQ ID NO: 8785071 - DNA, 23 bp, Homo sapiens
agcttcatcttgctgtgtctcag

SEQ ID NO: 8785072 - DNA, 22 bp, Homo sapiens
agcttcagttttctattgttaa

SEQ ID NO: 8785073 - DNA, 22 bp, Homo sapiens
agcttcaggtggtcttgtttct

SEQ ID NO: 8785074 - DNA, 23 bp, Homo sapiens
agcttcattattttccatgatct

SEQ ID NO: 8785075 - DNA, 22 bp, Homo sapiens
agcttcattccagccactgtga

SEQ ID NO: 8785076 - DNA, 22 bp, Homo sapiens
agcttttacataatgatcttga

SEQ ID NO: 8785077 - DNA, 22 bp, Homo sapiens
aggaaaaaagtctgtgattata

SEQ ID NO: 8785078 - DNA, 22 bp, Homo sapiens
aggaaaaaagtctgtgattata

SEQ ID NO: 8785079 - DNA, 22 bp, Homo sapiens
aggaaaaaagtctgtgattata

SEQ ID NO: 8785080 - DNA, 22 bp, Homo sapiens
aggaaaaaagtctgtgattata

SEQ ID NO: 8785081 - DNA, 22 bp, Homo sapiens
aggaaaaagagttgctgccttc

SEQ ID NO: 8785082 - DNA, 22 bp, Homo sapiens
aggaaaaacctgttaatggtag

SEQ ID NO: 8785083 - DNA, 22 bp, Homo sapiens
agctgggatgaggagcatcctt

SEQ ID NO: 8785084 - DNA, 22 bp, Homo sapiens
agctgggatgataacctcagtc

SEQ ID NO: 8785085 - DNA, 22 bp, Homo sapiens
agctgggatgataacctcagtc

SEQ ID NO: 8785086 - DNA, 22 bp, Homo sapiens
agctgggcaaaatgtgaggttg

SEQ ID NO: 8785087 - DNA, 22 bp, Homo sapiens
agctggtgtggatttttgaatg

SEQ ID NO: 8785088 - DNA, 22 bp, Homo sapiens
agctgggcaaaatgtgaggttg

SEQ ID NO: 8785089 - DNA, 22 bp, Homo sapiens
agctgtgggatttgggtgtgcc

SEQ ID NO: 8785090 - DNA, 22 bp, Homo sapiens
agctgtgggcctgggagagctg

SEQ ID NO: 8785091 - DNA, 22 bp, Homo sapiens
agctgtgggagaatctctgggt

SEQ ID NO: 8785092 - DNA, 22 bp, Homo sapiens
agctgtgggatttgggtgtgcc

SEQ ID NO: 8785093 - DNA, 22 bp, Homo sapiens
agctgtgggatttgggtgtgcc

SEQ ID NO: 8785094 - DNA, 22 bp, Homo sapiens
agctgtggccagatgtgagcgg

SEQ ID NO: 8785095 - DNA, 21 bp, Homo sapiens
agctgtggcgaggggaacatg

SEQ ID NO: 8785096 - DNA, 21 bp, Homo sapiens
agctggctctctctggagaga

SEQ ID NO: 8785097 - DNA, 22 bp, Homo sapiens
agctgggagcagagccacagcc

SEQ ID NO: 8785098 - DNA, 22 bp, Homo sapiens
agctgggagctgaaggctgatt

SEQ ID NO: 8785099 - DNA, 22 bp, Homo sapiens
agctgggagctgaaggctgatt

SEQ ID NO: 8785100 - DNA, 22 bp, Homo sapiens
agctgggagctgaaggctgatt

SEQ ID NO: 8785101 - DNA, 22 bp, Homo sapiens
agctgggaggtgggcagtgaga

SEQ ID NO: 8785102 - DNA, 22 bp, Homo sapiens
agctgggaggtgggcagtgaga

SEQ ID NO: 8785103 - DNA, 22 bp, Homo sapiens
agctgggaggtgggcagtgaga

SEQ ID NO: 8785104 - DNA, 22 bp, Homo sapiens
agctgggaggtgggcagtgaga

SEQ ID NO: 8785105 - DNA, 22 bp, Homo sapiens
agctgggaggctcctctgtgac

SEQ ID NO: 8785106 - DNA, 22 bp, Homo sapiens
agctgggaggctcctctgtgac

SEQ ID NO: 8785107 - DNA, 22 bp, Homo sapiens
agctgggaggctcctctgtgac

SEQ ID NO: 8785108 - DNA, 22 bp, Homo sapiens
agctgtggggaggaggctagca

SEQ ID NO: 8785109 - DNA, 22 bp, Homo sapiens
agctgtggggaggaggctagca

SEQ ID NO: 8785110 - DNA, 22 bp, Homo sapiens
agctgtgggcctgggagagctg

SEQ ID NO: 8785111 - DNA, 22 bp, Homo sapiens
agctgtgggcctgggagagctg

SEQ ID NO: 8785112 - DNA, 22 bp, Homo sapiens
agctgtgggcctgggagagctg

SEQ ID NO: 8785113 - DNA, 19 bp, Homo sapiens
agctgtggggcctagcacc

SEQ ID NO: 8785114 - DNA, 22 bp, Homo sapiens
agctgtggggcaggcagcgagg

SEQ ID NO: 8785115 - DNA, 22 bp, Homo sapiens
agctgtggggcaggcagcgagg

SEQ ID NO: 8785116 - DNA, 22 bp, Homo sapiens
agctgtggggcaggcagcgagg

SEQ ID NO: 8785117 - DNA, 22 bp, Homo sapiens
agctgtggggcaggcagcgagg

SEQ ID NO: 8785118 - DNA, 22 bp, Homo sapiens
agctgtggtcttcaagttgcct

SEQ ID NO: 8785119 - DNA, 22 bp, Homo sapiens
agctgtggtacttgattcacaa

SEQ ID NO: 8785120 - DNA, 22 bp, Homo sapiens
agctgtggtacttgattcacaa

SEQ ID NO: 8785121 - DNA, 22 bp, Homo sapiens
agctgtggtgttttcaagccct

SEQ ID NO: 8785122 - DNA, 22 bp, Homo sapiens
agctgtggtgttttcaagccct

SEQ ID NO: 8785123 - DNA, 22 bp, Homo sapiens
agctgtggttctgggcagcgac

SEQ ID NO: 8785124 - DNA, 19 bp, Homo sapiens
agctgtggggcctagcacc

SEQ ID NO: 8785125 - DNA, 22 bp, Homo sapiens
agctgtggttctgggcagcgac

SEQ ID NO: 8785126 - DNA, 21 bp, Homo sapiens
agctgtggttttacatctttt

SEQ ID NO: 8785127 - DNA, 22 bp, Homo sapiens
agctgtgtaggatcataacacg

SEQ ID NO: 8785128 - DNA, 22 bp, Homo sapiens
agctgtgtaagtcatgtaggtg

SEQ ID NO: 8785129 - DNA, 22 bp, Homo sapiens
agctgtgtaagtcatgtaggtg

SEQ ID NO: 8785130 - DNA, 22 bp, Homo sapiens
agcttattaatttttctgcatg

SEQ ID NO: 8785131 - DNA, 22 bp, Homo sapiens
agcttattaaaaacggattgct

SEQ ID NO: 8785132 - DNA, 22 bp, Homo sapiens
agcttagtggttgtatgagtta

SEQ ID NO: 8785133 - DNA, 22 bp, Homo sapiens
agcttagtgaggtgcaagacac

SEQ ID NO: 8785134 - DNA, 21 bp, Homo sapiens
agctgtggttttacatctttt

SEQ ID NO: 8785135 - DNA, 22 bp, Homo sapiens
agcttcaaagctaggaagatct

SEQ ID NO: 8785136 - DNA, 22 bp, Homo sapiens
agcttcactttgtactttgtca

SEQ ID NO: 8785137 - DNA, 22 bp, Homo sapiens
agcttcaaggttcaaggatgct

SEQ ID NO: 8785138 - DNA, 20 bp, Homo sapiens
agcttcaggctcaagagaac

SEQ ID NO: 8785139 - DNA, 20 bp, Homo sapiens
agcttcaggctcaagagaac

SEQ ID NO: 8785140 - DNA, 22 bp, Homo sapiens
agcttcagcttgcagctgtgat

SEQ ID NO: 8785141 - DNA, 22 bp, Homo sapiens
agtagaaagaaggcactgggcc

SEQ ID NO: 8785142 - DNA, 22 bp, Homo sapiens
agtacttttttgatatctgagt

SEQ ID NO: 8785143 - DNA, 22 bp, Homo sapiens
agtacttttttgatatctgagt

SEQ ID NO: 8785144 - DNA, 22 bp, Homo sapiens
agtacttttttgatatctgagt

SEQ ID NO: 8785145 - DNA, 22 bp, Homo sapiens
agtactttttgttcaattgtgc

SEQ ID NO: 8785146 - DNA, 22 bp, Homo sapiens
agtagtcagcagataatatagg

SEQ ID NO: 8785147 - DNA, 22 bp, Homo sapiens
agtagtgtacatctgttgattt

SEQ ID NO: 8785148 - DNA, 22 bp, Homo sapiens
agtactttcttccgagagagaa

SEQ ID NO: 8785149 - DNA, 22 bp, Homo sapiens
agtactttagcataaagcagtt

SEQ ID NO: 8785150 - DNA, 22 bp, Homo sapiens
agtactttagcataaagcagtt

SEQ ID NO: 8785151 - DNA, 22 bp, Homo sapiens
agtactttacttcttacagttt

SEQ ID NO: 8785152 - DNA, 22 bp, Homo sapiens
agtactttagcataaagcagtt

SEQ ID NO: 8785153 - DNA, 22 bp, Homo sapiens
agtactttcttccgagagagaa

SEQ ID NO: 8785154 - DNA, 22 bp, Homo sapiens
agtactttgcactttgctcaga

SEQ ID NO: 8785155 - DNA, 22 bp, Homo sapiens
agtactgtcagcagggtgttga

SEQ ID NO: 8785156 - DNA, 22 bp, Homo sapiens
agtataatgaaatgtgtcagta

SEQ ID NO: 8785157 - DNA, 22 bp, Homo sapiens
agtataattagatatcaaaagt

SEQ ID NO: 8785158 - DNA, 22 bp, Homo sapiens
agtataaagtggttttcagcac

SEQ ID NO: 8785159 - DNA, 21 bp, Homo sapiens
agtagtttagcacagggtttg

SEQ ID NO: 8785160 - DNA, 21 bp, Homo sapiens
agtagtttagcacagggtttg

SEQ ID NO: 8785161 - DNA, 21 bp, Homo sapiens
agtagtttagcacagggtttg

SEQ ID NO: 8785162 - DNA, 21 bp, Homo sapiens
agtagtttagcacagggtttg

SEQ ID NO: 8785163 - DNA, 22 bp, Homo sapiens
agtagtttttaagaggtataaa

SEQ ID NO: 8785164 - DNA, 22 bp, Homo sapiens
agtagtttccatttctgagttt

SEQ ID NO: 8785165 - DNA, 22 bp, Homo sapiens
aggtggggaaaccagcgatccc

SEQ ID NO: 8785166 - DNA, 22 bp, Homo sapiens
aggtggggaaaccagcgatccc

SEQ ID NO: 8785167 - DNA, 22 bp, Homo sapiens
aggtggggaaaccagcgatccc

SEQ ID NO: 8785168 - DNA, 22 bp, Homo sapiens
agtaataatagctgtaaagtgc

SEQ ID NO: 8785169 - DNA, 22 bp, Homo sapiens
aggtgggcggattcatgaggtc

SEQ ID NO: 8785170 - DNA, 22 bp, Homo sapiens
aggtgggcttggtgccaacatg

SEQ ID NO: 8785171 - DNA, 22 bp, Homo sapiens
aggtgggcggattcatgaggtc

SEQ ID NO: 8785172 - DNA, 22 bp, Homo sapiens
aggtgggcttggtgccaacatg

SEQ ID NO: 8785173 - DNA, 22 bp, Homo sapiens
aggtggggaaaccagcgatccc

SEQ ID NO: 8785174 - DNA, 22 bp, Homo sapiens
aggtgggcggattcatgaggtc

SEQ ID NO: 8785175 - DNA, 22 bp, Homo sapiens
aggtgggcggatcacaaggtca

SEQ ID NO: 8785176 - DNA, 22 bp, Homo sapiens
aggtgggcgctgctcccgctgg

SEQ ID NO: 8785177 - DNA, 22 bp, Homo sapiens
aggtgggcggatcacaaggtca

SEQ ID NO: 8785178 - DNA, 22 bp, Homo sapiens
aggtgggcgctgctcccgctgg

SEQ ID NO: 8785179 - DNA, 22 bp, Homo sapiens
aggtgggcccagtgggctccag

SEQ ID NO: 8785180 - DNA, 22 bp, Homo sapiens
aggtgggcgctgctcccgctgg

SEQ ID NO: 8785181 - DNA, 21 bp, Homo sapiens
aggtgggcaggtggagtggcc

SEQ ID NO: 8785182 - DNA, 21 bp, Homo sapiens
aggtgggcaggtggagtggcc

SEQ ID NO: 8785183 - DNA, 21 bp, Homo sapiens
aggtgggcaggtggagtggcc

SEQ ID NO: 8785184 - DNA, 22 bp, Homo sapiens
aggtgggcccagtgggctccag

SEQ ID NO: 8785185 - DNA, 22 bp, Homo sapiens
aggtgggcccagtgggctccag

SEQ ID NO: 8785186 - DNA, 22 bp, Homo sapiens
aggtgggcccagtgggctccag

SEQ ID NO: 8785187 - DNA, 22 bp, Homo sapiens
aggtgggcatagctagaatatt

SEQ ID NO: 8785188 - DNA, 21 bp, Homo sapiens
aggtgggcaggtggagtggcc

SEQ ID NO: 8785189 - DNA, 22 bp, Homo sapiens
agtacatttagtttatgaacat

SEQ ID NO: 8785190 - DNA, 23 bp, Homo sapiens
agtacattcgaaaaattctgtga

SEQ ID NO: 8785191 - DNA, 23 bp, Homo sapiens
agtacattcgaaaaattctgtga

SEQ ID NO: 8785192 - DNA, 22 bp, Homo sapiens
agtaataatagctgtaaagtgc

SEQ ID NO: 8785193 - DNA, 22 bp, Homo sapiens
agtaataatagtagccggcatt

SEQ ID NO: 8785194 - DNA, 23 bp, Homo sapiens
agtacatttgacccaaataagct

SEQ ID NO: 8785195 - DNA, 23 bp, Homo sapiens
agtacatttgacccaaataagct

SEQ ID NO: 8785196 - DNA, 22 bp, Homo sapiens
agtacatttttcagtggggagt

SEQ ID NO: 8785197 - DNA, 22 bp, Homo sapiens
agtaccattactcacttatttt

SEQ ID NO: 8785198 - DNA, 22 bp, Homo sapiens
agtacccttttcactgtcacaa

SEQ ID NO: 8785199 - DNA, 22 bp, Homo sapiens
agtaccattatccagtaaagga

SEQ ID NO: 8785200 - DNA, 22 bp, Homo sapiens
actcctgggtgctgaccagcgt

SEQ ID NO: 8785201 - DNA, 22 bp, Homo sapiens
agtcaccaggttttagagacct

SEQ ID NO: 8785202 - DNA, 22 bp, Homo sapiens
agtcaccagggtttgctgggtt

SEQ ID NO: 8785203 - DNA, 22 bp, Homo sapiens
agtcaccagggtttgctgggtt

SEQ ID NO: 8785204 - DNA, 22 bp, Homo sapiens
actcctgggtgctgaccagcgt

SEQ ID NO: 8785205 - DNA, 22 bp, Homo sapiens
agtcaccattttcacctgcctc

SEQ ID NO: 8785206 - DNA, 22 bp, Homo sapiens
agtcaccatctgtggcagcctg

SEQ ID NO: 8785207 - DNA, 22 bp, Homo sapiens
actccagggtgactctgtctga

SEQ ID NO: 8785208 - DNA, 22 bp, Homo sapiens
actccagggttttgcacctgga

SEQ ID NO: 8785209 - DNA, 22 bp, Homo sapiens
actccctccaaatctgcacagt

SEQ ID NO: 8785210 - DNA, 22 bp, Homo sapiens
actccctctctagtccttgcaa

SEQ ID NO: 8785211 - DNA, 22 bp, Homo sapiens
actccctctctagtccttgcaa

SEQ ID NO: 8785212 - DNA, 22 bp, Homo sapiens
actcctcagttgcttcttagtt

SEQ ID NO: 8785213 - DNA, 22 bp, Homo sapiens
actcctgccacacagatgctgt

SEQ ID NO: 8785214 - DNA, 22 bp, Homo sapiens
actcctgcttcttccctgagga

SEQ ID NO: 8785215 - DNA, 22 bp, Homo sapiens
actcctgctgtcactgcagttc

SEQ ID NO: 8785216 - DNA, 22 bp, Homo sapiens
actcctgctgtcactgcagttc

SEQ ID NO: 8785217 - DNA, 22 bp, Homo sapiens
actcccttttctacttctaccc

SEQ ID NO: 8785218 - DNA, 22 bp, Homo sapiens
actccctttccaggaaacacaa

SEQ ID NO: 8785219 - DNA, 22 bp, Homo sapiens
actcccttgtgaactcattctt

SEQ ID NO: 8785220 - DNA, 22 bp, Homo sapiens
actcccttggtggagaatgcaa

SEQ ID NO: 8785221 - DNA, 22 bp, Homo sapiens
actcccttttcccgtaatctat

SEQ ID NO: 8785222 - DNA, 22 bp, Homo sapiens
actctcccttggagcctcaggc

SEQ ID NO: 8785223 - DNA, 22 bp, Homo sapiens
actctcccttggagcctcaggc

SEQ ID NO: 8785224 - DNA, 22 bp, Homo sapiens
actctaaatagcctcttaaaca

SEQ ID NO: 8785225 - DNA, 22 bp, Homo sapiens
actctcccttggagcctcaggc

SEQ ID NO: 8785226 - DNA, 22 bp, Homo sapiens
actctctgtggttctactttgc

SEQ ID NO: 8785227 - DNA, 22 bp, Homo sapiens
actctctgtgatggaggccagc

SEQ ID NO: 8785228 - DNA, 22 bp, Homo sapiens
actctctgtgatggaggccagc

SEQ ID NO: 8785229 - DNA, 22 bp, Homo sapiens
actctctgtctaaatgcagttt

SEQ ID NO: 8785230 - DNA, 22 bp, Homo sapiens
actctctggtgtagaaagacct

SEQ ID NO: 8785231 - DNA, 22 bp, Homo sapiens
actctctgtctaaatgcagttt

SEQ ID NO: 8785232 - DNA, 22 bp, Homo sapiens
agtcacttaatctaagtctcag

SEQ ID NO: 8785233 - DNA, 22 bp, Homo sapiens
agtcactgtttaatctagctaa

SEQ ID NO: 8785234 - DNA, 22 bp, Homo sapiens
agtcactgttctgtcatgtcaa

SEQ ID NO: 8785235 - DNA, 22 bp, Homo sapiens
agtcacttccagacacctgcct

SEQ ID NO: 8785236 - DNA, 22 bp, Homo sapiens
actctaaatagataaccatgca

SEQ ID NO: 8785237 - DNA, 22 bp, Homo sapiens
agtcactgggctgcttcctata

SEQ ID NO: 8785238 - DNA, 22 bp, Homo sapiens
agtcactgagatggtgaggcta

SEQ ID NO: 8785239 - DNA, 22 bp, Homo sapiens
agtcactgtcttgcaaaggtca

SEQ ID NO: 8785240 - DNA, 22 bp, Homo sapiens
aggtcttggctcctgtgtgcag

SEQ ID NO: 8785241 - DNA, 19 bp, Homo sapiens
aggtcttgactctgttctt

SEQ ID NO: 8785242 - DNA, 22 bp, Homo sapiens
aggtcttggctcctgtgtgcag

SEQ ID NO: 8785243 - DNA, 19 bp, Homo sapiens
aggtcttgactctgttctt

SEQ ID NO: 8785244 - DNA, 22 bp, Homo sapiens
aggtcttgatgtgataagagga

SEQ ID NO: 8785245 - DNA, 22 bp, Homo sapiens
aggtgaagttaaaaaccagtct

SEQ ID NO: 8785246 - DNA, 22 bp, Homo sapiens
aggtcttggtaggccagagtct

SEQ ID NO: 8785247 - DNA, 22 bp, Homo sapiens
aggtcttgtgaaggactgtgcc

SEQ ID NO: 8785248 - DNA, 22 bp, Homo sapiens
aggtcttgtgaaggactgtgcc

SEQ ID NO: 8785249 - DNA, 22 bp, Homo sapiens
aggtgaagttaaaaaccagtct

SEQ ID NO: 8785250 - DNA, 22 bp, Homo sapiens
aggtgaagttgaggaggcagaa

SEQ ID NO: 8785251 - DNA, 22 bp, Homo sapiens
aggtgaagttgaggaggcagaa

SEQ ID NO: 8785252 - DNA, 22 bp, Homo sapiens
aggtgaagttgaggaggcagaa

SEQ ID NO: 8785253 - DNA, 22 bp, Homo sapiens
aggtgacaggacaggagctggt

SEQ ID NO: 8785254 - DNA, 22 bp, Homo sapiens
aggtgaatgctcacattctaat

SEQ ID NO: 8785255 - DNA, 22 bp, Homo sapiens
aggtgacatcccggcagcagag

SEQ ID NO: 8785256 - DNA, 19 bp, Homo sapiens
aggtgacatgtgacagcct

SEQ ID NO: 8785257 - DNA, 22 bp, Homo sapiens
aggtgacatgaaaaatgttgag

SEQ ID NO: 8785258 - DNA, 22 bp, Homo sapiens
aggtgacatcccggcagcagag

SEQ ID NO: 8785259 - DNA, 22 bp, Homo sapiens
aggtgactactattttaaaata

SEQ ID NO: 8785260 - DNA, 19 bp, Homo sapiens
aggtgacatgtgacagcct

SEQ ID NO: 8785261 - DNA, 19 bp, Homo sapiens
aggtgacatgtgacagcct

SEQ ID NO: 8785262 - DNA, 22 bp, Homo sapiens
aggtcttaggagcatggtgctg

SEQ ID NO: 8785263 - DNA, 22 bp, Homo sapiens
acgatgatgaaagagaacattc

SEQ ID NO: 8785264 - DNA, 22 bp, Homo sapiens
acgagtatgtttgtattttctt

SEQ ID NO: 8785265 - DNA, 22 bp, Homo sapiens
acgaggagcctgtggcctggta

SEQ ID NO: 8785266 - DNA, 22 bp, Homo sapiens
acgaaatactttgcacagtttt

SEQ ID NO: 8785267 - DNA, 22 bp, Homo sapiens
acgaatcattcacggacaacac

SEQ ID NO: 8785268 - DNA, 22 bp, Homo sapiens
accttttttcagaactctaaag

SEQ ID NO: 8785269 - DNA, 22 bp, Homo sapiens
acctttttgttctgttctcagc

SEQ ID NO: 8785270 - DNA, 22 bp, Homo sapiens
accttttatgtaaatatatgtt

SEQ ID NO: 8785271 - DNA, 22 bp, Homo sapiens
acctttggtcatttacttttca

SEQ ID NO: 8785272 - DNA, 22 bp, Homo sapiens
accttttacggtgtgactagca

SEQ ID NO: 8785273 - DNA, 22 bp, Homo sapiens
acctttggtaagtttccaaaac

SEQ ID NO: 8785274 - DNA, 22 bp, Homo sapiens
acctttttccaaagcttcttac

SEQ ID NO: 8785275 - DNA, 22 bp, Homo sapiens
acctttttccaaagcttcttac

SEQ ID NO: 8785276 - DNA, 22 bp, Homo sapiens
accttttcatctgaaactttta

SEQ ID NO: 8785277 - DNA, 22 bp, Homo sapiens
actactgatgtaaaggagcaat

SEQ ID NO: 8785278 - DNA, 22 bp, Homo sapiens
actactgaatattagttctgaa

SEQ ID NO: 8785279 - DNA, 22 bp, Homo sapiens
actactgaatattagttctgaa

SEQ ID NO: 8785280 - DNA, 22 bp, Homo sapiens
actactagtggctacaataatg

SEQ ID NO: 8785281 - DNA, 23 bp, Homo sapiens
actagaaaatgactttctccctg

SEQ ID NO: 8785282 - DNA, 22 bp, Homo sapiens
actacagtccctcatatgttgg

SEQ ID NO: 8785283 - DNA, 22 bp, Homo sapiens
actacatcttgcatatctataa

SEQ ID NO: 8785284 - DNA, 22 bp, Homo sapiens
actacagtgtgataagaggggc

SEQ ID NO: 8785285 - DNA, 22 bp, Homo sapiens
aggtgactggtttatctggcag

SEQ ID NO: 8785286 - DNA, 22 bp, Homo sapiens
aggtgactggtttatctggcag

SEQ ID NO: 8785287 - DNA, 22 bp, Homo sapiens
aggtgactggtttatctggcag

SEQ ID NO: 8785288 - DNA, 22 bp, Homo sapiens
actacagaagtcttattagaga

SEQ ID NO: 8785289 - DNA, 22 bp, Homo sapiens
actacagaagtcttattagaga

SEQ ID NO: 8785290 - DNA, 23 bp, Homo sapiens
actacagatactcctgctgtttg

SEQ ID NO: 8785291 - DNA, 22 bp, Homo sapiens
actacagtaagggaggcagcat

SEQ ID NO: 8785292 - DNA, 22 bp, Homo sapiens
actacagtactatatctatagg

SEQ ID NO: 8785293 - DNA, 22 bp, Homo sapiens
aggtgggcactccgctcgaggt

SEQ ID NO: 8785294 - DNA, 22 bp, Homo sapiens
aggtgggcaccaggcttgtggt

SEQ ID NO: 8785295 - DNA, 21 bp, Homo sapiens
aggtgggcaggtggagtggcc

SEQ ID NO: 8785296 - DNA, 22 bp, Homo sapiens
aggtgggcaccaggcttgtggt

SEQ ID NO: 8785297 - DNA, 22 bp, Homo sapiens
aggtgggcactccgctcgaggt

SEQ ID NO: 8785298 - DNA, 22 bp, Homo sapiens
actagaaattactcagaataaa

SEQ ID NO: 8785299 - DNA, 22 bp, Homo sapiens
actagaaattactcagaataaa

SEQ ID NO: 8785300 - DNA, 22 bp, Homo sapiens
actagaaagtttccagagttat

SEQ ID NO: 8785301 - DNA, 22 bp, Homo sapiens
aggtgggcaccaggcttgtggt

SEQ ID NO: 8785302 - DNA, 22 bp, Homo sapiens
actagaaagtttccagagttat

SEQ ID NO: 8785303 - DNA, 22 bp, Homo sapiens
actagaaatgtattggtagctg

SEQ ID NO: 8785304 - DNA, 22 bp, Homo sapiens
actagaaatgtattggtagctg

SEQ ID NO: 8785305 - DNA, 22 bp, Homo sapiens
actagaaaattcctagaaacta

SEQ ID NO: 8785306 - DNA, 23 bp, Homo sapiens
actagaaaatgactttctccctg

SEQ ID NO: 8785307 - DNA, 22 bp, Homo sapiens
actagaaaattcctagaaacta

SEQ ID NO: 8785308 - DNA, 22 bp, Homo sapiens
actagaaaattcctagaaacta

SEQ ID NO: 8785309 - DNA, 22 bp, Homo sapiens
actagaaaattcctagaaacta

SEQ ID NO: 8785310 - DNA, 22 bp, Homo sapiens
actagaaactaatggattatta

SEQ ID NO: 8785311 - DNA, 22 bp, Homo sapiens
actagaaagcaaaagccatttc

SEQ ID NO: 8785312 - DNA, 22 bp, Homo sapiens
actagaaaattcctagaaacta

SEQ ID NO: 8785313 - DNA, 22 bp, Homo sapiens
actagaaagcaaaagccatttc

SEQ ID NO: 8785314 - DNA, 22 bp, Homo sapiens
actagaaagaagttttttgaga

SEQ ID NO: 8785315 - DNA, 20 bp, Homo sapiens
actagaaagtcactgggggg

SEQ ID NO: 8785316 - DNA, 22 bp, Homo sapiens
actagaaagcactaagctaggc

SEQ ID NO: 8785317 - DNA, 22 bp, Homo sapiens
actagaaagcactaagctaggc

SEQ ID NO: 8785318 - DNA, 22 bp, Homo sapiens
actagaaagcactaagctaggc

SEQ ID NO: 8785319 - DNA, 22 bp, Homo sapiens
actagaaagcactaagctaggc

SEQ ID NO: 8785320 - DNA, 22 bp, Homo sapiens
aggtcaagagtaaatttgggta

SEQ ID NO: 8785321 - DNA, 22 bp, Homo sapiens
aggtcaagattctacatttgta

SEQ ID NO: 8785322 - DNA, 22 bp, Homo sapiens
aggtcaaagaacctagctatag

SEQ ID NO: 8785323 - DNA, 23 bp, Homo sapiens
aggtcaaccacaagctgacaaac

SEQ ID NO: 8785324 - DNA, 20 bp, Homo sapiens
aggtcaacacctagtaagtg

SEQ ID NO: 8785325 - DNA, 22 bp, Homo sapiens
aggtcaaaatgcttttcaggtc

SEQ ID NO: 8785326 - DNA, 22 bp, Homo sapiens
aggtcaaggttcacaggggatc

SEQ ID NO: 8785327 - DNA, 22 bp, Homo sapiens
aggtcaaggttcacaggggatc

SEQ ID NO: 8785328 - DNA, 22 bp, Homo sapiens
aggtatttgttatttgagagtg

SEQ ID NO: 8785329 - DNA, 22 bp, Homo sapiens
aggtatttgtctcagattgggt

SEQ ID NO: 8785330 - DNA, 22 bp, Homo sapiens
aggtatttcatggagcaagcag

SEQ ID NO: 8785331 - DNA, 22 bp, Homo sapiens
aggtatttcccaaagtggcatg

SEQ ID NO: 8785332 - DNA, 22 bp, Homo sapiens
aggtatttcctttaaagaaact

SEQ ID NO: 8785333 - DNA, 22 bp, Homo sapiens
acccttctgtgacctgcctgtc

SEQ ID NO: 8785334 - DNA, 22 bp, Homo sapiens
acccttccaaatgagcttatta

SEQ ID NO: 8785335 - DNA, 22 bp, Homo sapiens
acccttccaaatgagcttatta

SEQ ID NO: 8785336 - DNA, 22 bp, Homo sapiens
acccttcatagaggagaagctg

SEQ ID NO: 8785337 - DNA, 22 bp, Homo sapiens
accctgtgtcacagtggcctgt

SEQ ID NO: 8785338 - DNA, 22 bp, Homo sapiens
accctgttatggtgtaacattt

SEQ ID NO: 8785339 - DNA, 22 bp, Homo sapiens
accctgttggtggatcagattg

SEQ ID NO: 8785340 - DNA, 22 bp, Homo sapiens
acccttcatagaggagaagctg

SEQ ID NO: 8785341 - DNA, 22 bp, Homo sapiens
aggtaggaaagtctccttgtat

SEQ ID NO: 8785342 - DNA, 22 bp, Homo sapiens
accctttagaaggcatctcagt

SEQ ID NO: 8785343 - DNA, 22 bp, Homo sapiens
aggtagctatccagacgctgaa

SEQ ID NO: 8785344 - DNA, 22 bp, Homo sapiens
accttcctctaagacatttagc

SEQ ID NO: 8785345 - DNA, 21 bp, Homo sapiens
accttctgaattacctaccaa

SEQ ID NO: 8785346 - DNA, 22 bp, Homo sapiens
accttcctctaagacatttagc

SEQ ID NO: 8785347 - DNA, 21 bp, Homo sapiens
aggtccagttctgtcttggac

SEQ ID NO: 8785348 - DNA, 22 bp, Homo sapiens
aggtccagttgccagaatggcc

SEQ ID NO: 8785349 - DNA, 22 bp, Homo sapiens
acctttcattaaagtctgtagt

SEQ ID NO: 8785350 - DNA, 22 bp, Homo sapiens
acctttctgcaagttctgggac

SEQ ID NO: 8785351 - DNA, 22 bp, Homo sapiens
acctttgctaggtaggtattgg

SEQ ID NO: 8785352 - DNA, 22 bp, Homo sapiens
aggtccagaacgtgcctactct

SEQ ID NO: 8785353 - DNA, 22 bp, Homo sapiens
aggtccaggcctcatgatggcc

SEQ ID NO: 8785354 - DNA, 22 bp, Homo sapiens
aggtccagctgttgcagcctcc

SEQ ID NO: 8785355 - DNA, 22 bp, Homo sapiens
aggtccagctgttgcagcctcc

SEQ ID NO: 8785356 - DNA, 22 bp, Homo sapiens
aggtccagctgttgcagcctcc

SEQ ID NO: 8785357 - DNA, 22 bp, Homo sapiens
aggtccagctgttgcagcctcc

SEQ ID NO: 8785358 - DNA, 22 bp, Homo sapiens
aggtccaggatttgtggggtct

SEQ ID NO: 8785359 - DNA, 22 bp, Homo sapiens
actgcattggagagcatgaatt

SEQ ID NO: 8785360 - DNA, 22 bp, Homo sapiens
actgcatttggtaaagtcaaga

SEQ ID NO: 8785361 - DNA, 22 bp, Homo sapiens
actgcattggagagcatgaatt

SEQ ID NO: 8785362 - DNA, 22 bp, Homo sapiens
actgcattctttatcccacaac

SEQ ID NO: 8785363 - DNA, 22 bp, Homo sapiens
actgcattgaggtttcatactt

SEQ ID NO: 8785364 - DNA, 23 bp, Homo sapiens
actgcagcctccgcctgccgggt

SEQ ID NO: 8785365 - DNA, 22 bp, Homo sapiens
actgcagcctagggaccacagt

SEQ ID NO: 8785366 - DNA, 22 bp, Homo sapiens
actgcagccccctattaggact

SEQ ID NO: 8785367 - DNA, 22 bp, Homo sapiens
actgcagcaaagcccgtgtctt

SEQ ID NO: 8785368 - DNA, 22 bp, Homo sapiens
actgcagcaggtaagagcattt

SEQ ID NO: 8785369 - DNA, 22 bp, Homo sapiens
agtgctctgtcattggtgggat

SEQ ID NO: 8785370 - DNA, 22 bp, Homo sapiens
agtgctcctttcattgctgccc

SEQ ID NO: 8785371 - DNA, 22 bp, Homo sapiens
agtgctcctgccagctttctgg

SEQ ID NO: 8785372 - DNA, 22 bp, Homo sapiens
agtgctatcgagttctaatgct

SEQ ID NO: 8785373 - DNA, 22 bp, Homo sapiens
agtgctcacctgtcaggtcaag

SEQ ID NO: 8785374 - DNA, 22 bp, Homo sapiens
actgcacttcagcctgggtgac

SEQ ID NO: 8785375 - DNA, 22 bp, Homo sapiens
agtgctcagtagctgcatgtgg

SEQ ID NO: 8785376 - DNA, 22 bp, Homo sapiens
actgcacttcaccctgggtgac

SEQ ID NO: 8785377 - DNA, 22 bp, Homo sapiens
actgcacttcaccctgggtgac

SEQ ID NO: 8785378 - DNA, 22 bp, Homo sapiens
actgcacttcagcctgggtgac

SEQ ID NO: 8785379 - DNA, 22 bp, Homo sapiens
actgcacttcagcctgggtgac

SEQ ID NO: 8785380 - DNA, 22 bp, Homo sapiens
actgcacttcaccctgggtgac

SEQ ID NO: 8785381 - DNA, 22 bp, Homo sapiens
actgcacttcaccctgggtgac

SEQ ID NO: 8785382 - DNA, 22 bp, Homo sapiens
actgcacttcaccctgggtgac

SEQ ID NO: 8785383 - DNA, 22 bp, Homo sapiens
actgcacttcaccctgggtgac

SEQ ID NO: 8785384 - DNA, 22 bp, Homo sapiens
actgcacttcaccctgggtgac

SEQ ID NO: 8785385 - DNA, 22 bp, Homo sapiens
actgcacttcaccctgggtgac

SEQ ID NO: 8785386 - DNA, 22 bp, Homo sapiens
actgcacttcaccctgggtgac

SEQ ID NO: 8785387 - DNA, 22 bp, Homo sapiens
actgcacttcaccctgggtgac

SEQ ID NO: 8785388 - DNA, 22 bp, Homo sapiens
actgcactcctgcctgggtaac

SEQ ID NO: 8785389 - DNA, 22 bp, Homo sapiens
actgcactcctgcctgggtaac

SEQ ID NO: 8785390 - DNA, 22 bp, Homo sapiens
actgcactcctgcctgggtaac

SEQ ID NO: 8785391 - DNA, 22 bp, Homo sapiens
actgcacttacatagaggaggc

SEQ ID NO: 8785392 - DNA, 22 bp, Homo sapiens
actgcacttacatagaggaggc

SEQ ID NO: 8785393 - DNA, 22 bp, Homo sapiens
actgcactcctgcctgggtaac

SEQ ID NO: 8785394 - DNA, 22 bp, Homo sapiens
actgcactcctgcctgggtaac

SEQ ID NO: 8785395 - DNA, 22 bp, Homo sapiens
actgcactcctgcctgggtaac

SEQ ID NO: 8785396 - DNA, 22 bp, Homo sapiens
actgcactcctgcctgggtaac

SEQ ID NO: 8785397 - DNA, 22 bp, Homo sapiens
actgcactcctgcctgggtaac

SEQ ID NO: 8785398 - DNA, 22 bp, Homo sapiens
actgcactcctgcctgggtaac

SEQ ID NO: 8785399 - DNA, 22 bp, Homo sapiens
actgcactccagcctgggtgat

SEQ ID NO: 8785400 - DNA, 22 bp, Homo sapiens
actgcactccagcctgggtgat

SEQ ID NO: 8785401 - DNA, 22 bp, Homo sapiens
actgcactccagcctgggtgat

SEQ ID NO: 8785402 - DNA, 22 bp, Homo sapiens
actgcactccagcctgggtgat

SEQ ID NO: 8785403 - DNA, 22 bp, Homo sapiens
actgcactccagcctgggtgat

SEQ ID NO: 8785404 - DNA, 22 bp, Homo sapiens
actgcactccagcctgggtgat

SEQ ID NO: 8785405 - DNA, 22 bp, Homo sapiens
actgcactccagcctgggtgat

SEQ ID NO: 8785406 - DNA, 22 bp, Homo sapiens
actgcactccagcctgggtgat

SEQ ID NO: 8785407 - DNA, 22 bp, Homo sapiens
actgcactccagcctgggtgat

SEQ ID NO: 8785408 - DNA, 22 bp, Homo sapiens
actgcactccagcctgggtgat

SEQ ID NO: 8785409 - DNA, 22 bp, Homo sapiens
actgcactccagcctgggtgat

SEQ ID NO: 8785410 - DNA, 22 bp, Homo sapiens
actgcacagatgaagctgtaaa

SEQ ID NO: 8785411 - DNA, 22 bp, Homo sapiens
actgcacagatgaagctgtaaa

SEQ ID NO: 8785412 - DNA, 22 bp, Homo sapiens
agtgaatatgcagcaagaagtt

SEQ ID NO: 8785413 - DNA, 22 bp, Homo sapiens
actgcacagtcccagaggatgc

SEQ ID NO: 8785414 - DNA, 22 bp, Homo sapiens
actgcacatagtgggctggcct

SEQ ID NO: 8785415 - DNA, 22 bp, Homo sapiens
actgcactccagcctgggtgac

SEQ ID NO: 8785416 - DNA, 20 bp, Homo sapiens
agtgaatagagacattgccc

SEQ ID NO: 8785417 - DNA, 22 bp, Homo sapiens
agtgaatacatgtcactcagca

SEQ ID NO: 8785418 - DNA, 22 bp, Homo sapiens
agtgaatatttttagacaccca

SEQ ID NO: 8785419 - DNA, 22 bp, Homo sapiens
agtgaagctggagaaaggcagt

SEQ ID NO: 8785420 - DNA, 23 bp, Homo sapiens
agtgaagctggttagtgatgacc

SEQ ID NO: 8785421 - DNA, 22 bp, Homo sapiens
agtgaagtaaaagatgtgcatc

SEQ ID NO: 8785422 - DNA, 22 bp, Homo sapiens
agtgaaggaagtttgtcttggg

SEQ ID NO: 8785423 - DNA, 22 bp, Homo sapiens
agtgaaggaagtttgtcttggg

SEQ ID NO: 8785424 - DNA, 22 bp, Homo sapiens
agtgaaggtttacagggcccct

SEQ ID NO: 8785425 - DNA, 22 bp, Homo sapiens
actctgcctgaacctcctgcaa

SEQ ID NO: 8785426 - DNA, 22 bp, Homo sapiens
actctgcctgaacctcctgcaa

SEQ ID NO: 8785427 - DNA, 22 bp, Homo sapiens
actgaatttattagtatagtct

SEQ ID NO: 8785428 - DNA, 18 bp, Homo sapiens
actctgcggaggccccag

SEQ ID NO: 8785429 - DNA, 22 bp, Homo sapiens
actctgcaatgtggcaagaaca

SEQ ID NO: 8785430 - DNA, 21 bp, Homo sapiens
actctgccagtctcctgcact

SEQ ID NO: 8785431 - DNA, 21 bp, Homo sapiens
actctgccagtctcctgcact

SEQ ID NO: 8785432 - DNA, 22 bp, Homo sapiens
actctgccctaggcctctgggg

SEQ ID NO: 8785433 - DNA, 22 bp, Homo sapiens
actctgccctaggcctctgggg

SEQ ID NO: 8785434 - DNA, 22 bp, Homo sapiens
actctgcctgaacctcctgcaa

SEQ ID NO: 8785435 - DNA, 22 bp, Homo sapiens
actctgccatcccaggtgctgt

SEQ ID NO: 8785436 - DNA, 22 bp, Homo sapiens
actctgaagaagacttccagac

SEQ ID NO: 8785437 - DNA, 22 bp, Homo sapiens
actctgaatgtgcatgtaaatc

SEQ ID NO: 8785438 - DNA, 22 bp, Homo sapiens
actctgaatgtgcatgtaaatc

SEQ ID NO: 8785439 - DNA, 22 bp, Homo sapiens
actctgaattaattgctctcaa

SEQ ID NO: 8785440 - DNA, 22 bp, Homo sapiens
actctgaattaattgctctcaa

SEQ ID NO: 8785441 - DNA, 22 bp, Homo sapiens
actctgaactccaggaggctca

SEQ ID NO: 8785442 - DNA, 22 bp, Homo sapiens
actctgaaccaattcgcaatga

SEQ ID NO: 8785443 - DNA, 22 bp, Homo sapiens
actctgaaccagagatcatacc

SEQ ID NO: 8785444 - DNA, 21 bp, Homo sapiens
actctgaaaattaatagttat

SEQ ID NO: 8785445 - DNA, 21 bp, Homo sapiens
actctgaaaattaatagttat

SEQ ID NO: 8785446 - DNA, 22 bp, Homo sapiens
actctcttgggggagagcagag

SEQ ID NO: 8785447 - DNA, 22 bp, Homo sapiens
actctcttgggggagagcagag

SEQ ID NO: 8785448 - DNA, 22 bp, Homo sapiens
actctgaaacttgcaacacatt

SEQ ID NO: 8785449 - DNA, 21 bp, Homo sapiens
actctgaaaattaatagttat

SEQ ID NO: 8785450 - DNA, 22 bp, Homo sapiens
actctgaaatagaggctggtgg

SEQ ID NO: 8785451 - DNA, 22 bp, Homo sapiens
actctgaaacttgcaacacatt

SEQ ID NO: 8785452 - DNA, 22 bp, Homo sapiens
actctgaggagtgactagaggt

SEQ ID NO: 8785453 - DNA, 22 bp, Homo sapiens
actctgagcatcccaagtctta

SEQ ID NO: 8785454 - DNA, 21 bp, Homo sapiens
actgagagatgttggatcata

SEQ ID NO: 8785455 - DNA, 22 bp, Homo sapiens
actgacaaatatagcttcgtct

SEQ ID NO: 8785456 - DNA, 22 bp, Homo sapiens
actgagagggaggctgtccggt

SEQ ID NO: 8785457 - DNA, 22 bp, Homo sapiens
actgagagtcaagatagcatgg

SEQ ID NO: 8785458 - DNA, 22 bp, Homo sapiens
actgagcaggagaatcacttta

SEQ ID NO: 8785459 - DNA, 22 bp, Homo sapiens
actgagcagtagattttctgtt

SEQ ID NO: 8785460 - DNA, 22 bp, Homo sapiens
actgagcagggttccgcatgga

SEQ ID NO: 8785461 - DNA, 22 bp, Homo sapiens
actgagcagggttccgcatgga

SEQ ID NO: 8785462 - DNA, 22 bp, Homo sapiens
actgagcacttggtatatttcc

SEQ ID NO: 8785463 - DNA, 22 bp, Homo sapiens
actgagcagaacaatgggagcc

SEQ ID NO: 8785464 - DNA, 22 bp, Homo sapiens
actgagcagaacaatgggagcc

SEQ ID NO: 8785465 - DNA, 22 bp, Homo sapiens
actgagcagaagagatctgtga

SEQ ID NO: 8785466 - DNA, 22 bp, Homo sapiens
actgagcactcacttttgttat

SEQ ID NO: 8785467 - DNA, 23 bp, Homo sapiens
actgagcaatgtttacatacttg

SEQ ID NO: 8785468 - DNA, 22 bp, Homo sapiens
actgagatttacatgttctagt

SEQ ID NO: 8785469 - DNA, 22 bp, Homo sapiens
actgagcaatgcagtgggagcg

SEQ ID NO: 8785470 - DNA, 22 bp, Homo sapiens
actgagcaatgcagtgggagcg

SEQ ID NO: 8785471 - DNA, 22 bp, Homo sapiens
actgagctctaggttttgaacc

SEQ ID NO: 8785472 - DNA, 22 bp, Homo sapiens
actgagcatttgctggtggacc

SEQ ID NO: 8785473 - DNA, 22 bp, Homo sapiens
actgagctccctgagggcaggc

SEQ ID NO: 8785474 - DNA, 23 bp, Homo sapiens
actgagcattagtatttttataa

SEQ ID NO: 8785475 - DNA, 22 bp, Homo sapiens
actgagcatggctcacagagag

SEQ ID NO: 8785476 - DNA, 22 bp, Homo sapiens
actgagcatcagggctgggaac

SEQ ID NO: 8785477 - DNA, 22 bp, Homo sapiens
actgagcatcagggctgggaac

SEQ ID NO: 8785478 - DNA, 22 bp, Homo sapiens
actgagcataaatatgtgtcca

SEQ ID NO: 8785479 - DNA, 22 bp, Homo sapiens
actgagcagtagattttctgtt

SEQ ID NO: 8785480 - DNA, 19 bp, Homo sapiens
agtgaacacaaagagaagg

SEQ ID NO: 8785481 - DNA, 22 bp, Homo sapiens
agtgaacagtttggaacacatg

SEQ ID NO: 8785482 - DNA, 22 bp, Homo sapiens
agtgaacagtttggaacacatg

SEQ ID NO: 8785483 - DNA, 22 bp, Homo sapiens
agtgaaccaggctgcgtccctg

SEQ ID NO: 8785484 - DNA, 22 bp, Homo sapiens
agtgaaatttgtttagataggt

SEQ ID NO: 8785485 - DNA, 22 bp, Homo sapiens
agtgaacaaaggtagtgagcat

SEQ ID NO: 8785486 - DNA, 19 bp, Homo sapiens
agtgaacacaaagagaagg

SEQ ID NO: 8785487 - DNA, 19 bp, Homo sapiens
agtgaacacaaagagaagg

SEQ ID NO: 8785488 - DNA, 22 bp, Homo sapiens
agtgaacaagttaagaacacta

SEQ ID NO: 8785489 - DNA, 22 bp, Homo sapiens
agtgaacaaggatgccacctct

SEQ ID NO: 8785490 - DNA, 22 bp, Homo sapiens
agtgaacaaggatgccacctct

SEQ ID NO: 8785491 - DNA, 22 bp, Homo sapiens
actgggcatgatgagtcaccta

SEQ ID NO: 8785492 - DNA, 22 bp, Homo sapiens
actgggcattttgaacgttctt

SEQ ID NO: 8785493 - DNA, 20 bp, Homo sapiens
actgggcatacctgtcctgt

SEQ ID NO: 8785494 - DNA, 22 bp, Homo sapiens
actgggcatcccatggcagagc

SEQ ID NO: 8785495 - DNA, 22 bp, Homo sapiens
actgggccagacactgattccc

SEQ ID NO: 8785496 - DNA, 22 bp, Homo sapiens
actgggccaactatttgttcta

SEQ ID NO: 8785497 - DNA, 22 bp, Homo sapiens
actgggccacatagacctgctg

SEQ ID NO: 8785498 - DNA, 18 bp, Homo sapiens
actgggccagcaggcagg

SEQ ID NO: 8785499 - DNA, 23 bp, Homo sapiens
actgggccagctacttagcactg

SEQ ID NO: 8785500 - DNA, 22 bp, Homo sapiens
actgggccagatcagagcaact

SEQ ID NO: 8785501 - DNA, 22 bp, Homo sapiens
actgggccagatcagagcaact

SEQ ID NO: 8785502 - DNA, 22 bp, Homo sapiens
actgggccagacactgattccc

SEQ ID NO: 8785503 - DNA, 22 bp, Homo sapiens
actgggccagatcagagcaact

SEQ ID NO: 8785504 - DNA, 22 bp, Homo sapiens
actgggccaggtgtgggtgagt

SEQ ID NO: 8785505 - DNA, 23 bp, Homo sapiens
actgggccagctacttagcactg

SEQ ID NO: 8785506 - DNA, 22 bp, Homo sapiens
actgggccaggggctttggagc

SEQ ID NO: 8785507 - DNA, 22 bp, Homo sapiens
actgggccgcgctgcagagggc

SEQ ID NO: 8785508 - DNA, 22 bp, Homo sapiens
actgggcctacccagattggca

SEQ ID NO: 8785509 - DNA, 22 bp, Homo sapiens
actgggccggtgcagagtagtt

SEQ ID NO: 8785510 - DNA, 22 bp, Homo sapiens
actgggccgcgctgcagagggc

SEQ ID NO: 8785511 - DNA, 22 bp, Homo sapiens
actgggccgaaatggacagaat

SEQ ID NO: 8785512 - DNA, 22 bp, Homo sapiens
actgggcccatatactcagtct

SEQ ID NO: 8785513 - DNA, 22 bp, Homo sapiens
actgggcccatatactcagtct

SEQ ID NO: 8785514 - DNA, 22 bp, Homo sapiens
actgggcccagtggtgtggctg

SEQ ID NO: 8785515 - DNA, 22 bp, Homo sapiens
actgggcctgattgggtcggag

SEQ ID NO: 8785516 - DNA, 20 bp, Homo sapiens
actgggcctaggggaggcat

SEQ ID NO: 8785517 - DNA, 20 bp, Homo sapiens
actgggcctaggggaggcat

SEQ ID NO: 8785518 - DNA, 22 bp, Homo sapiens
actgggcctgtacagagaaaac

SEQ ID NO: 8785519 - DNA, 22 bp, Homo sapiens
actgggcctgtacagagaaaac

SEQ ID NO: 8785520 - DNA, 22 bp, Homo sapiens
actgggcctgtacagagaaaac

SEQ ID NO: 8785521 - DNA, 22 bp, Homo sapiens
actgggcctgtacagagaaaac

SEQ ID NO: 8785522 - DNA, 22 bp, Homo sapiens
actgggcctggattggcgtgtc

SEQ ID NO: 8785523 - DNA, 22 bp, Homo sapiens
actgggcctggattggcgtgtc

SEQ ID NO: 8785524 - DNA, 22 bp, Homo sapiens
actggctgtgcagagggcagta

SEQ ID NO: 8785525 - DNA, 22 bp, Homo sapiens
actggctgtgcccatagagctc

SEQ ID NO: 8785526 - DNA, 22 bp, Homo sapiens
actggctgtgcagagggcagta

SEQ ID NO: 8785527 - DNA, 21 bp, Homo sapiens
actggctgtcttcctactggt

SEQ ID NO: 8785528 - DNA, 22 bp, Homo sapiens
actggctggccacaccctggta

SEQ ID NO: 8785529 - DNA, 21 bp, Homo sapiens
actggctgtcttcctactggt

SEQ ID NO: 8785530 - DNA, 21 bp, Homo sapiens
actggctgtcttcctactggt

SEQ ID NO: 8785531 - DNA, 21 bp, Homo sapiens
actggctggtggctaagaatc

SEQ ID NO: 8785532 - DNA, 21 bp, Homo sapiens
actggctggtggctaagaatc

SEQ ID NO: 8785533 - DNA, 21 bp, Homo sapiens
actggctggctgagtttcctg

SEQ ID NO: 8785534 - DNA, 21 bp, Homo sapiens
actggctggctgagtttcctg

SEQ ID NO: 8785535 - DNA, 22 bp, Homo sapiens
actggctggccgcgctcttcgc

SEQ ID NO: 8785536 - DNA, 22 bp, Homo sapiens
actggctggccgcgctcttcgc

SEQ ID NO: 8785537 - DNA, 22 bp, Homo sapiens
actggctggccgcgctcttcgc

SEQ ID NO: 8785538 - DNA, 22 bp, Homo sapiens
actggctggccacaccctggta

SEQ ID NO: 8785539 - DNA, 22 bp, Homo sapiens
actggctggccacaccctggta

SEQ ID NO: 8785540 - DNA, 22 bp, Homo sapiens
actggcttgaagtagattcaaa

SEQ ID NO: 8785541 - DNA, 22 bp, Homo sapiens
actggcttgaagtagattcaaa

SEQ ID NO: 8785542 - DNA, 22 bp, Homo sapiens
actggctgtgcccatagagctc

SEQ ID NO: 8785543 - DNA, 22 bp, Homo sapiens
actggctgtggccacggctgct

SEQ ID NO: 8785544 - DNA, 22 bp, Homo sapiens
actggctgtggccacggctgct

SEQ ID NO: 8785545 - DNA, 22 bp, Homo sapiens
actggctgtggccacggctgct

SEQ ID NO: 8785546 - DNA, 22 bp, Homo sapiens
actggctgtgtaacctcaggca

SEQ ID NO: 8785547 - DNA, 22 bp, Homo sapiens
actggctgtgcagagggcagta

SEQ ID NO: 8785548 - DNA, 22 bp, Homo sapiens
actggctgtgtaacctcaggca

SEQ ID NO: 8785549 - DNA, 22 bp, Homo sapiens
agtgtccttgattcctgttgtt

SEQ ID NO: 8785550 - DNA, 21 bp, Homo sapiens
agtgtctctggaagcacgtgt

SEQ ID NO: 8785551 - DNA, 22 bp, Homo sapiens
agtgtctaaactggcttcctgg

SEQ ID NO: 8785552 - DNA, 22 bp, Homo sapiens
agtgtctcagccccaactagag

SEQ ID NO: 8785553 - DNA, 21 bp, Homo sapiens
agtgtccttttactgtgaata

SEQ ID NO: 8785554 - DNA, 22 bp, Homo sapiens
actgggcagcagctcgagccgc

SEQ ID NO: 8785555 - DNA, 22 bp, Homo sapiens
actgggcagggaaggagaccga

SEQ ID NO: 8785556 - DNA, 20 bp, Homo sapiens
actgggcatacctgtcctgt

SEQ ID NO: 8785557 - DNA, 22 bp, Homo sapiens
actgggcagggaaggagaccga

SEQ ID NO: 8785558 - DNA, 20 bp, Homo sapiens
actggctgcctggaatgcgc

SEQ ID NO: 8785559 - DNA, 22 bp, Homo sapiens
actggctgcgatcttggcgctt

SEQ ID NO: 8785560 - DNA, 20 bp, Homo sapiens
actggctgcctggaatgcgc

SEQ ID NO: 8785561 - DNA, 22 bp, Homo sapiens
actggctgcggggtggaagaag

SEQ ID NO: 8785562 - DNA, 20 bp, Homo sapiens
actggctgcctggaatgcgc

SEQ ID NO: 8785563 - DNA, 22 bp, Homo sapiens
actggctgcgatcttggcgctt

SEQ ID NO: 8785564 - DNA, 22 bp, Homo sapiens
actggctgcggggtggaagaag

SEQ ID NO: 8785565 - DNA, 22 bp, Homo sapiens
actggctgcgttcctgtgagac

SEQ ID NO: 8785566 - DNA, 22 bp, Homo sapiens
actggctgcgttcctgtgagac

SEQ ID NO: 8785567 - DNA, 22 bp, Homo sapiens
actggctgcgttcctgtgagac

SEQ ID NO: 8785568 - DNA, 22 bp, Homo sapiens
actggctggactctgacctctt

SEQ ID NO: 8785569 - DNA, 22 bp, Homo sapiens
actggctggactctgacctctt

SEQ ID NO: 8785570 - DNA, 22 bp, Homo sapiens
actggctggactctgacctctt

SEQ ID NO: 8785571 - DNA, 22 bp, Homo sapiens
actggctggagttgccaaggct

SEQ ID NO: 8785572 - DNA, 22 bp, Homo sapiens
actggctggagttgccaaggct

SEQ ID NO: 8785573 - DNA, 22 bp, Homo sapiens
actggctggagttgccaaggct

SEQ ID NO: 8785574 - DNA, 22 bp, Homo sapiens
actggctgatcacctgcctcag

SEQ ID NO: 8785575 - DNA, 21 bp, Homo sapiens
actggctgccatgatccaggg

SEQ ID NO: 8785576 - DNA, 21 bp, Homo sapiens
actggctgccatgatccaggg

SEQ ID NO: 8785577 - DNA, 21 bp, Homo sapiens
actggctgccatgatccaggg

SEQ ID NO: 8785578 - DNA, 22 bp, Homo sapiens
actggctgcctccaaagtgtgc

SEQ ID NO: 8785579 - DNA, 22 bp, Homo sapiens
actggctgcctccaaagtgtgc

SEQ ID NO: 8785580 - DNA, 22 bp, Homo sapiens
actggctgatatggctaggaag

SEQ ID NO: 8785581 - DNA, 22 bp, Homo sapiens
actggctgatcacctgcctcag

SEQ ID NO: 8785582 - DNA, 21 bp, Homo sapiens
actggccaccactggcagggg

SEQ ID NO: 8785583 - DNA, 22 bp, Homo sapiens
actggcagtttgagaatgcatt

SEQ ID NO: 8785584 - DNA, 22 bp, Homo sapiens
actgcctgctcataacattgct

SEQ ID NO: 8785585 - DNA, 22 bp, Homo sapiens
actgcctgctcctggctccaca

SEQ ID NO: 8785586 - DNA, 22 bp, Homo sapiens
actgcctgctcctggctccaca

SEQ ID NO: 8785587 - DNA, 22 bp, Homo sapiens
actgcctggcagaggtttgcaa

SEQ ID NO: 8785588 - DNA, 22 bp, Homo sapiens
actgcctggcctggcctcactg

SEQ ID NO: 8785589 - DNA, 22 bp, Homo sapiens
actgcctggcagaggtttgcaa

SEQ ID NO: 8785590 - DNA, 22 bp, Homo sapiens
actgcctggcctggcctcactg

SEQ ID NO: 8785591 - DNA, 18 bp, Homo sapiens
actgcctggcgaagatag

SEQ ID NO: 8785592 - DNA, 21 bp, Homo sapiens
actgcctggggtgctggccaa

SEQ ID NO: 8785593 - DNA, 21 bp, Homo sapiens
actgcctggggtgctggccaa

SEQ ID NO: 8785594 - DNA, 22 bp, Homo sapiens
actgcctgtagccctgagatgt

SEQ ID NO: 8785595 - DNA, 21 bp, Homo sapiens
actgcctggggtgctggccaa

SEQ ID NO: 8785596 - DNA, 19 bp, Homo sapiens
actgcctgaggctcacagg

SEQ ID NO: 8785597 - DNA, 19 bp, Homo sapiens
actgcctgcaggtgttggg

SEQ ID NO: 8785598 - DNA, 22 bp, Homo sapiens
actgcctgatgtggttctaaat

SEQ ID NO: 8785599 - DNA, 22 bp, Homo sapiens
actgcctgagctattggaaaag

SEQ ID NO: 8785600 - DNA, 22 bp, Homo sapiens
actgcctgcatccttagggtag

SEQ ID NO: 8785601 - DNA, 22 bp, Homo sapiens
actgcctgcatccttagggtag

SEQ ID NO: 8785602 - DNA, 22 bp, Homo sapiens
actgcctgcctctgattctgca

SEQ ID NO: 8785603 - DNA, 22 bp, Homo sapiens
actgcctgcctctgattctgca

SEQ ID NO: 8785604 - DNA, 22 bp, Homo sapiens
actgcctgcctctgattctgca

SEQ ID NO: 8785605 - DNA, 19 bp, Homo sapiens
actgcctgcaggtgttggg

SEQ ID NO: 8785606 - DNA, 22 bp, Homo sapiens
actgcctgcctctgattctgca

SEQ ID NO: 8785607 - DNA, 23 bp, Homo sapiens
actgcctgctactatgcccacgg

SEQ ID NO: 8785608 - DNA, 22 bp, Homo sapiens
actgcctgccttccaggtactg

SEQ ID NO: 8785609 - DNA, 22 bp, Homo sapiens
actgcctcttggtgctgagaga

SEQ ID NO: 8785610 - DNA, 19 bp, Homo sapiens
actgcctgaggctcacagg

SEQ ID NO: 8785611 - DNA, 22 bp, Homo sapiens
actgccctggagacagcagagt

SEQ ID NO: 8785612 - DNA, 22 bp, Homo sapiens
actgccctggcaccacacatgc

SEQ ID NO: 8785613 - DNA, 22 bp, Homo sapiens
actgcccttgtcctggcacacc

SEQ ID NO: 8785614 - DNA, 22 bp, Homo sapiens
actgcccatgtgcatcaagtag

SEQ ID NO: 8785615 - DNA, 22 bp, Homo sapiens
actgcccatgtgcatcaagtag

SEQ ID NO: 8785616 - DNA, 22 bp, Homo sapiens
actgcccaggaatctcaaagaa

SEQ ID NO: 8785617 - DNA, 22 bp, Homo sapiens
actgcccaggaatctcaaagaa

SEQ ID NO: 8785618 - DNA, 22 bp, Homo sapiens
actgcccagaagagatgaaagt

SEQ ID NO: 8785619 - DNA, 22 bp, Homo sapiens
actgccaggtaagtgctcctgc

SEQ ID NO: 8785620 - DNA, 22 bp, Homo sapiens
actgccaggtaagtgctcctgc

SEQ ID NO: 8785621 - DNA, 22 bp, Homo sapiens
actgccaggtgctccatctgaa

SEQ ID NO: 8785622 - DNA, 22 bp, Homo sapiens
actgccaggtgctccatctgaa

SEQ ID NO: 8785623 - DNA, 21 bp, Homo sapiens
actgccaggagagtaggggga

SEQ ID NO: 8785624 - DNA, 23 bp, Homo sapiens
actgccagttttaccacagacgg

SEQ ID NO: 8785625 - DNA, 22 bp, Homo sapiens
actgccattggttctggaaaat

SEQ ID NO: 8785626 - DNA, 22 bp, Homo sapiens
actgcatttgtctgtctcaatt

SEQ ID NO: 8785627 - DNA, 22 bp, Homo sapiens
actgccaatggtagtttgatgg

SEQ ID NO: 8785628 - DNA, 22 bp, Homo sapiens
actgccacctggtggtcctgga

SEQ ID NO: 8785629 - DNA, 22 bp, Homo sapiens
actgccagaagacagcttttca

SEQ ID NO: 8785630 - DNA, 22 bp, Homo sapiens
actgccagaatcattcaaggaa

SEQ ID NO: 8785631 - DNA, 20 bp, Homo sapiens
actgccagccttgtctactg

SEQ ID NO: 8785632 - DNA, 22 bp, Homo sapiens
actgccagcctcagtgaaggca

SEQ ID NO: 8785633 - DNA, 22 bp, Homo sapiens
actgccagcctcagtgaaggca

SEQ ID NO: 8785634 - DNA, 23 bp, Homo sapiens
actgccagattgaaggtttctta

SEQ ID NO: 8785635 - DNA, 22 bp, Homo sapiens
actgccagagacaaggatgagt

SEQ ID NO: 8785636 - DNA, 22 bp, Homo sapiens
atacaaaatatatactggagac

SEQ ID NO: 8785637 - DNA, 22 bp, Homo sapiens
atacaaaatatatactggagac

SEQ ID NO: 8785638 - DNA, 22 bp, Homo sapiens
atacaaaatatatactggagac

SEQ ID NO: 8785639 - DNA, 22 bp, Homo sapiens
atacaaaatatatactggagac

SEQ ID NO: 8785640 - DNA, 22 bp, Homo sapiens
atacaaaatatatactggagac

SEQ ID NO: 8785641 - DNA, 22 bp, Homo sapiens
atacaaaatatatactggagac

SEQ ID NO: 8785642 - DNA, 22 bp, Homo sapiens
atacaaaatatatactggagac

SEQ ID NO: 8785643 - DNA, 22 bp, Homo sapiens
atacaaaatatatactggagac

SEQ ID NO: 8785644 - DNA, 22 bp, Homo sapiens
atacaaagacaaatctcaatct

SEQ ID NO: 8785645 - DNA, 22 bp, Homo sapiens
acttggttgcaaatgaattatt

SEQ ID NO: 8785646 - DNA, 22 bp, Homo sapiens
acttggttgcaaatgaattatt

SEQ ID NO: 8785647 - DNA, 23 bp, Homo sapiens
atacaaaccttgcaggacatgtt

SEQ ID NO: 8785648 - DNA, 22 bp, Homo sapiens
actttaaaactgatcatcagag

SEQ ID NO: 8785649 - DNA, 22 bp, Homo sapiens
acttggttgcttctgaaatgac

SEQ ID NO: 8785650 - DNA, 22 bp, Homo sapiens
acttggttgcttctgaaatgac

SEQ ID NO: 8785651 - DNA, 22 bp, Homo sapiens
acttggttgcttctgaaatgac

SEQ ID NO: 8785652 - DNA, 22 bp, Homo sapiens
atacaaaatatatactggagac

SEQ ID NO: 8785653 - DNA, 22 bp, Homo sapiens
atacaaaaattagccgggagta

SEQ ID NO: 8785654 - DNA, 22 bp, Homo sapiens
atacaaaaattagccgggagta

SEQ ID NO: 8785655 - DNA, 22 bp, Homo sapiens
atacaaaaattagccgggagta

SEQ ID NO: 8785656 - DNA, 22 bp, Homo sapiens
atacaaaaattagccgggagta

SEQ ID NO: 8785657 - DNA, 22 bp, Homo sapiens
acttctctcattcagacatagc

SEQ ID NO: 8785658 - DNA, 22 bp, Homo sapiens
acttctctccacccaagtccct

SEQ ID NO: 8785659 - DNA, 22 bp, Homo sapiens
acttctctgctacctgcaaaga

SEQ ID NO: 8785660 - DNA, 22 bp, Homo sapiens
ataatttttgtttgatgtccaa

SEQ ID NO: 8785661 - DNA, 22 bp, Homo sapiens
acttctcttcataggtggcaat

SEQ ID NO: 8785662 - DNA, 22 bp, Homo sapiens
acttctctgctacctgcaaaga

SEQ ID NO: 8785663 - DNA, 22 bp, Homo sapiens
acttctctggttgaggtccaat

SEQ ID NO: 8785664 - DNA, 21 bp, Homo sapiens
actttaatatacatgaggagg

SEQ ID NO: 8785665 - DNA, 22 bp, Homo sapiens
actttaattaatgaactgtggc

SEQ ID NO: 8785666 - DNA, 21 bp, Homo sapiens
actttaatatacatgaggagg

SEQ ID NO: 8785667 - DNA, 22 bp, Homo sapiens
actttaaagcagaatggctatg

SEQ ID NO: 8785668 - DNA, 22 bp, Homo sapiens
acttggttgatgtcataaggtt

SEQ ID NO: 8785669 - DNA, 22 bp, Homo sapiens
actttaaagcagaatggctatg

SEQ ID NO: 8785670 - DNA, 22 bp, Homo sapiens
actttacaaactcctcactgtt

SEQ ID NO: 8785671 - DNA, 22 bp, Homo sapiens
actttacaaactcctcactgtt

SEQ ID NO: 8785672 - DNA, 22 bp, Homo sapiens
actttacaaactcctcactgtt

SEQ ID NO: 8785673 - DNA, 22 bp, Homo sapiens
actttacaagcttatagcctag

SEQ ID NO: 8785674 - DNA, 22 bp, Homo sapiens
actttacaagcttatagcctag

SEQ ID NO: 8785675 - DNA, 22 bp, Homo sapiens
actttacaagcttatagcctag

SEQ ID NO: 8785676 - DNA, 22 bp, Homo sapiens
actttacaagcttatagcctag

SEQ ID NO: 8785677 - DNA, 22 bp, Homo sapiens
actttacaatatcctgtgactt

SEQ ID NO: 8785678 - DNA, 22 bp, Homo sapiens
actttacaatatcctgtgactt

SEQ ID NO: 8785679 - DNA, 22 bp, Homo sapiens
actttacaatatcctgtgactt

SEQ ID NO: 8785680 - DNA, 21 bp, Homo sapiens
actttacaatttacatagtga

SEQ ID NO: 8785681 - DNA, 21 bp, Homo sapiens
actttacaatttacatagtga

SEQ ID NO: 8785682 - DNA, 21 bp, Homo sapiens
actttacaatttacatagtga

SEQ ID NO: 8785683 - DNA, 21 bp, Homo sapiens
actttacaatttacatagtga

SEQ ID NO: 8785684 - DNA, 22 bp, Homo sapiens
actttacacatcttttctcatt

SEQ ID NO: 8785685 - DNA, 22 bp, Homo sapiens
actttacacatcttttctcatt

SEQ ID NO: 8785686 - DNA, 20 bp, Homo sapiens
actttacagagaagactgac

SEQ ID NO: 8785687 - DNA, 20 bp, Homo sapiens
actttacagagaagactgac

SEQ ID NO: 8785688 - DNA, 22 bp, Homo sapiens
atacatatccacaggagataaa

SEQ ID NO: 8785689 - DNA, 22 bp, Homo sapiens
atacatatgaatgatttggctc

SEQ ID NO: 8785690 - DNA, 20 bp, Homo sapiens
actttacagagaagactgac

SEQ ID NO: 8785691 - DNA, 22 bp, Homo sapiens
atacatcaaggatgatggtgta

SEQ ID NO: 8785692 - DNA, 22 bp, Homo sapiens
atacatcacctatatattcaca

SEQ ID NO: 8785693 - DNA, 22 bp, Homo sapiens
atacatcaatttcttagttatc

SEQ ID NO: 8785694 - DNA, 22 bp, Homo sapiens
atacatcacctatatattcaca

SEQ ID NO: 8785695 - DNA, 22 bp, Homo sapiens
atacatcacctatatattcaca

SEQ ID NO: 8785696 - DNA, 22 bp, Homo sapiens
atacatcacctatatattcaca

SEQ ID NO: 8785697 - DNA, 22 bp, Homo sapiens
atacatcatgctccatatattt

SEQ ID NO: 8785698 - DNA, 22 bp, Homo sapiens
atagagtccaaagtatgaatat

SEQ ID NO: 8785699 - DNA, 22 bp, Homo sapiens
atagagtgatgtaaggtatgtg

SEQ ID NO: 8785700 - DNA, 22 bp, Homo sapiens
atagagtgatgtaaggtatgtg

SEQ ID NO: 8785701 - DNA, 22 bp, Homo sapiens
atagagttgagttcaaatatgt

SEQ ID NO: 8785702 - DNA, 22 bp, Homo sapiens
atagatacattaggtaacttgt

SEQ ID NO: 8785703 - DNA, 22 bp, Homo sapiens
actttggagggtgttgtagatg

SEQ ID NO: 8785704 - DNA, 22 bp, Homo sapiens
actttggagggtgttgtagatg

SEQ ID NO: 8785705 - DNA, 22 bp, Homo sapiens
actttggacaatttattactgt

SEQ ID NO: 8785706 - DNA, 22 bp, Homo sapiens
actttggacgccatgctgtttg

SEQ ID NO: 8785707 - DNA, 22 bp, Homo sapiens
atagatacttataacaattgtg

SEQ ID NO: 8785708 - DNA, 22 bp, Homo sapiens
atagatacttaactgaaatctt

SEQ ID NO: 8785709 - DNA, 22 bp, Homo sapiens
atagatactgggtatggagatg

SEQ ID NO: 8785710 - DNA, 20 bp, Homo sapiens
atagatatcatctttagaag

SEQ ID NO: 8785711 - DNA, 22 bp, Homo sapiens
actttgtataagacaataaaga

SEQ ID NO: 8785712 - DNA, 22 bp, Homo sapiens
actttgtataagacaataaaga

SEQ ID NO: 8785713 - DNA, 22 bp, Homo sapiens
actttgttcctttcacaaagaa

SEQ ID NO: 8785714 - DNA, 22 bp, Homo sapiens
actttgttcctttcacaaagaa

SEQ ID NO: 8785715 - DNA, 22 bp, Homo sapiens
actttgttcctttcacaaagaa

SEQ ID NO: 8785716 - DNA, 22 bp, Homo sapiens
acttttcaaatgggaaactcag

SEQ ID NO: 8785717 - DNA, 20 bp, Homo sapiens
actttctcggtttctcacct

SEQ ID NO: 8785718 - DNA, 22 bp, Homo sapiens
actttctgtcatctagacaagt

SEQ ID NO: 8785719 - DNA, 20 bp, Homo sapiens
actttctcggtttctcacct

SEQ ID NO: 8785720 - DNA, 22 bp, Homo sapiens
actttctgccttacaggagtcc

SEQ ID NO: 8785721 - DNA, 22 bp, Homo sapiens
actttctgcagtgttggaaatg

SEQ ID NO: 8785722 - DNA, 22 bp, Homo sapiens
actttctgccttacaggagtcc

SEQ ID NO: 8785723 - DNA, 22 bp, Homo sapiens
actttgcaatacttaatacaaa

SEQ ID NO: 8785724 - DNA, 22 bp, Homo sapiens
actttgcaatacttaatacaaa

SEQ ID NO: 8785725 - DNA, 22 bp, Homo sapiens
actttgcaaataaactctctaa

SEQ ID NO: 8785726 - DNA, 22 bp, Homo sapiens
actttgcaaataaactctctaa

SEQ ID NO: 8785727 - DNA, 22 bp, Homo sapiens
actttgcaaggtactaactgta

SEQ ID NO: 8785728 - DNA, 22 bp, Homo sapiens
actttgcaaggtactaactgta

SEQ ID NO: 8785729 - DNA, 22 bp, Homo sapiens
actttgcacttcaatataactt

SEQ ID NO: 8785730 - DNA, 22 bp, Homo sapiens
actttgcacttcaatataactt

SEQ ID NO: 8785731 - DNA, 22 bp, Homo sapiens
actttgcactaagttactcatt

SEQ ID NO: 8785732 - DNA, 22 bp, Homo sapiens
actttgcacttcaatataactt

SEQ ID NO: 8785733 - DNA, 22 bp, Homo sapiens
actttgcaatgggcagaaccca

SEQ ID NO: 8785734 - DNA, 22 bp, Homo sapiens
actttgcaatgggcagaaccca

SEQ ID NO: 8785735 - DNA, 22 bp, Homo sapiens
actttgcactaagttactcatt

SEQ ID NO: 8785736 - DNA, 22 bp, Homo sapiens
atacatcatgctccatatattt

SEQ ID NO: 8785737 - DNA, 22 bp, Homo sapiens
atacatcatgctccatatattt

SEQ ID NO: 8785738 - DNA, 22 bp, Homo sapiens
atacatcatttatgatgtgtgt

SEQ ID NO: 8785739 - DNA, 22 bp, Homo sapiens
atacatcatttatggaataagg

SEQ ID NO: 8785740 - DNA, 22 bp, Homo sapiens
actttggaagatggctgtattt

SEQ ID NO: 8785741 - DNA, 22 bp, Homo sapiens
actttggaataagctatataac

SEQ ID NO: 8785742 - DNA, 22 bp, Homo sapiens
actttggaataagctatataac

SEQ ID NO: 8785743 - DNA, 22 bp, Homo sapiens
actttggacaatttattactgt

SEQ ID NO: 8785744 - DNA, 22 bp, Homo sapiens
actttggaaattgtctataaga

SEQ ID NO: 8785745 - DNA, 22 bp, Homo sapiens
actttggaaattgtctataaga

SEQ ID NO: 8785746 - DNA, 20 bp, Homo sapiens
actttgcatttcctgatttt

SEQ ID NO: 8785747 - DNA, 19 bp, Homo sapiens
actttgcatgtgtgtctaa

SEQ ID NO: 8785748 - DNA, 23 bp, Homo sapiens
actttgcatacccaaattgtttt

SEQ ID NO: 8785749 - DNA, 22 bp, Homo sapiens
actttgcatggaaaatggtcat

SEQ ID NO: 8785750 - DNA, 22 bp, Homo sapiens
actttgcatggaaaatggtcat

SEQ ID NO: 8785751 - DNA, 21 bp, Homo sapiens
actttgcatctaccttgggtt

SEQ ID NO: 8785752 - DNA, 22 bp, Homo sapiens
actttgccccaaagaagttggt

SEQ ID NO: 8785753 - DNA, 18 bp, Homo sapiens
actttgcaggctcccatt

SEQ ID NO: 8785754 - DNA, 18 bp, Homo sapiens
actttgcaggctcccatt

SEQ ID NO: 8785755 - DNA, 22 bp, Homo sapiens
actttgcagctgaggacatttc

SEQ ID NO: 8785756 - DNA, 22 bp, Homo sapiens
actttgcagctgaggacatttc

SEQ ID NO: 8785757 - DNA, 23 bp, Homo sapiens
actttgcagagccccttgaaaca

SEQ ID NO: 8785758 - DNA, 23 bp, Homo sapiens
actttgcagagccccttgaaaca

SEQ ID NO: 8785759 - DNA, 22 bp, Homo sapiens
actttgcagagccagaagagaa

SEQ ID NO: 8785760 - DNA, 22 bp, Homo sapiens
actttgcagagccagaagagaa

SEQ ID NO: 8785761 - DNA, 22 bp, Homo sapiens
actttgcaggccttttcttgtg

SEQ ID NO: 8785762 - DNA, 22 bp, Homo sapiens
actttgcagggcttgatatcca

SEQ ID NO: 8785763 - DNA, 22 bp, Homo sapiens
actttgcagggcttgatatcca

SEQ ID NO: 8785764 - DNA, 22 bp, Homo sapiens
actttgcaggtacatgagcatc

SEQ ID NO: 8785765 - DNA, 22 bp, Homo sapiens
actttgcaggtacatgagcatc

SEQ ID NO: 8785766 - DNA, 22 bp, Homo sapiens
actttgcagggcttgatatcca

SEQ ID NO: 8785767 - DNA, 22 bp, Homo sapiens
actttgcaggtacatgagcatc

SEQ ID NO: 8785768 - DNA, 22 bp, Homo sapiens
actgggctaccccaccattacc

SEQ ID NO: 8785769 - DNA, 22 bp, Homo sapiens
actgggccttgtgtgtctcatc

SEQ ID NO: 8785770 - DNA, 22 bp, Homo sapiens
actgggccttgtgtgtctcatc

SEQ ID NO: 8785771 - DNA, 22 bp, Homo sapiens
actgggccttgtgtgtctcatc

SEQ ID NO: 8785772 - DNA, 22 bp, Homo sapiens
actgggccttgccatggcagcc

SEQ ID NO: 8785773 - DNA, 22 bp, Homo sapiens
actgggccttgccatggcagcc

SEQ ID NO: 8785774 - DNA, 22 bp, Homo sapiens
actgggctagagtggaagctgg

SEQ ID NO: 8785775 - DNA, 22 bp, Homo sapiens
actgggctcaagtgattgtcct

SEQ ID NO: 8785776 - DNA, 21 bp, Homo sapiens
actgggctagcctgacttctg

SEQ ID NO: 8785777 - DNA, 22 bp, Homo sapiens
actgggctcataatgtcataga

SEQ ID NO: 8785778 - DNA, 22 bp, Homo sapiens
actgggctcataatgtcataga

SEQ ID NO: 8785779 - DNA, 22 bp, Homo sapiens
actgggctccagatgtgatacg

SEQ ID NO: 8785780 - DNA, 22 bp, Homo sapiens
actgggctccaaggacctggag

SEQ ID NO: 8785781 - DNA, 22 bp, Homo sapiens
actgggctcccaggcttgtcat

SEQ ID NO: 8785782 - DNA, 22 bp, Homo sapiens
agtttctaccggtacattcagg

SEQ ID NO: 8785783 - DNA, 22 bp, Homo sapiens
actgggctccagatgtgatacg

SEQ ID NO: 8785784 - DNA, 22 bp, Homo sapiens
agtttctaccggtacattcagg

SEQ ID NO: 8785785 - DNA, 22 bp, Homo sapiens
agtttctagcaaggattgttga

SEQ ID NO: 8785786 - DNA, 22 bp, Homo sapiens
agtttctagcaaggattgttga

SEQ ID NO: 8785787 - DNA, 21 bp, Homo sapiens
agttttatattataagctaaa

SEQ ID NO: 8785788 - DNA, 21 bp, Homo sapiens
agttttatattataagctaaa

SEQ ID NO: 8785789 - DNA, 22 bp, Homo sapiens
agttttaagatgcgcttctgtt

SEQ ID NO: 8785790 - DNA, 22 bp, Homo sapiens
agttttaaatgatggtggtggt

SEQ ID NO: 8785791 - DNA, 22 bp, Homo sapiens
agttttatctgtaagctgttca

SEQ ID NO: 8785792 - DNA, 21 bp, Homo sapiens
agttttatattataagctaaa

SEQ ID NO: 8785793 - DNA, 18 bp, Homo sapiens
agtttttaggaagaaatg

SEQ ID NO: 8785794 - DNA, 18 bp, Homo sapiens
agtttttaggaagaaatg

SEQ ID NO: 8785795 - DNA, 18 bp, Homo sapiens
agtttttaggaagaaatg

SEQ ID NO: 8785796 - DNA, 22 bp, Homo sapiens
agtttttcctgattttacagaa

SEQ ID NO: 8785797 - DNA, 22 bp, Homo sapiens
agttttatgtagacaattcatt

SEQ ID NO: 8785798 - DNA, 22 bp, Homo sapiens
agttttatggctcaacctaata

SEQ ID NO: 8785799 - DNA, 22 bp, Homo sapiens
agttttatggctcaacctaata

SEQ ID NO: 8785800 - DNA, 23 bp, Homo sapiens
agtttttaatggtcatagctgag

SEQ ID NO: 8785801 - DNA, 22 bp, Homo sapiens
actgttatttgtaatccattat

SEQ ID NO: 8785802 - DNA, 21 bp, Homo sapiens
actgttattcccattttcacc

SEQ ID NO: 8785803 - DNA, 22 bp, Homo sapiens
ataaaaactgacccatcctttg

SEQ ID NO: 8785804 - DNA, 22 bp, Homo sapiens
ataaaaactgacccatcctttg

SEQ ID NO: 8785805 - DNA, 22 bp, Homo sapiens
actgtttagtaaattgaaatgg

SEQ ID NO: 8785806 - DNA, 22 bp, Homo sapiens
actgtttaggaggcttatatgc

SEQ ID NO: 8785807 - DNA, 22 bp, Homo sapiens
actgtttaaaggcttcctttct

SEQ ID NO: 8785808 - DNA, 22 bp, Homo sapiens
actgtttaaaggcttcctttct

SEQ ID NO: 8785809 - DNA, 22 bp, Homo sapiens
agtttttgacaaactgtagttg

SEQ ID NO: 8785810 - DNA, 22 bp, Homo sapiens
agtttttctcccctggcttcat

SEQ ID NO: 8785811 - DNA, 17 bp, Homo sapiens
agtttttggacctgtgt

SEQ ID NO: 8785812 - DNA, 22 bp, Homo sapiens
agtttttgctgatagcatgctt

SEQ ID NO: 8785813 - DNA, 19 bp, Homo sapiens
agtttttggaaatcctgct

SEQ ID NO: 8785814 - DNA, 19 bp, Homo sapiens
agtttttggaaatcctgct

SEQ ID NO: 8785815 - DNA, 22 bp, Homo sapiens
agtttttgagaatttactatgt

SEQ ID NO: 8785816 - DNA, 22 bp, Homo sapiens
agtttttgagaatttactatgt

SEQ ID NO: 8785817 - DNA, 22 bp, Homo sapiens
agtttttgagaatttactatgt

SEQ ID NO: 8785818 - DNA, 22 bp, Homo sapiens
agtttttgagaatttactatgt

SEQ ID NO: 8785819 - DNA, 22 bp, Homo sapiens
acttaaaaagaatcttttcacg

SEQ ID NO: 8785820 - DNA, 22 bp, Homo sapiens
acttaaaaagaatcttttcacg

SEQ ID NO: 8785821 - DNA, 22 bp, Homo sapiens
acttaaaaccagacagcgtcat

SEQ ID NO: 8785822 - DNA, 22 bp, Homo sapiens
acttaaaaccagacagcgtcat

SEQ ID NO: 8785823 - DNA, 22 bp, Homo sapiens
acttaaagaggctacttttggt

SEQ ID NO: 8785824 - DNA, 22 bp, Homo sapiens
acttaaagtagttttactgtgg

SEQ ID NO: 8785825 - DNA, 22 bp, Homo sapiens
ataaagtagccactggaaagct

SEQ ID NO: 8785826 - DNA, 19 bp, Homo sapiens
acttaaacctagaaaatgc

SEQ ID NO: 8785827 - DNA, 22 bp, Homo sapiens
acttaaaggttagctattctac

SEQ ID NO: 8785828 - DNA, 22 bp, Homo sapiens
acttaaagtagttttactgtgg

SEQ ID NO: 8785829 - DNA, 22 bp, Homo sapiens
ataaagtcaaggcattttatga

SEQ ID NO: 8785830 - DNA, 22 bp, Homo sapiens
ataaagtcatttcaaaagttga

SEQ ID NO: 8785831 - DNA, 22 bp, Homo sapiens
ataaagtggaagtgttaaaggg

SEQ ID NO: 8785832 - DNA, 22 bp, Homo sapiens
ataaagtctaccgtattaaaga

SEQ ID NO: 8785833 - DNA, 18 bp, Homo sapiens
ataaagtgctaataatgg

SEQ ID NO: 8785834 - DNA, 22 bp, Homo sapiens
ataaagtcatggcagctagaat

SEQ ID NO: 8785835 - DNA, 22 bp, Homo sapiens
actgtttctcaaattatgtggt

SEQ ID NO: 8785836 - DNA, 22 bp, Homo sapiens
actgtttctgccacaatagccc

SEQ ID NO: 8785837 - DNA, 22 bp, Homo sapiens
actgtttatgatgatagagggg

SEQ ID NO: 8785838 - DNA, 22 bp, Homo sapiens
actgttttcctaatgagcaaga

SEQ ID NO: 8785839 - DNA, 22 bp, Homo sapiens
actgttttctaaagaacagatg

SEQ ID NO: 8785840 - DNA, 22 bp, Homo sapiens
actgttttctgtaaagggccag

SEQ ID NO: 8785841 - DNA, 22 bp, Homo sapiens
actgttttcttagctccctgct

SEQ ID NO: 8785842 - DNA, 22 bp, Homo sapiens
acttaaaaagaatcttttcacg

SEQ ID NO: 8785843 - DNA, 22 bp, Homo sapiens
acttaaaaacagatccagcagg

SEQ ID NO: 8785844 - DNA, 22 bp, Homo sapiens
acttaaaaacagatccagcagg

SEQ ID NO: 8785845 - DNA, 22 bp, Homo sapiens
acttaaaaacagatccagcagg

SEQ ID NO: 8785846 - DNA, 22 bp, Homo sapiens
acttctatgccttcctctgttt

SEQ ID NO: 8785847 - DNA, 22 bp, Homo sapiens
acttctattggtcatgataaaa

SEQ ID NO: 8785848 - DNA, 22 bp, Homo sapiens
acttctaagctcaaattggtat

SEQ ID NO: 8785849 - DNA, 22 bp, Homo sapiens
acttccttttcaaccatacagc

SEQ ID NO: 8785850 - DNA, 22 bp, Homo sapiens
acttccttgtcaggtgcatcat

SEQ ID NO: 8785851 - DNA, 22 bp, Homo sapiens
acttccttgtcaggtgcatcat

SEQ ID NO: 8785852 - DNA, 22 bp, Homo sapiens
acttcctgtatttatccatagc

SEQ ID NO: 8785853 - DNA, 22 bp, Homo sapiens
acttcctgtgttggtcttgctg

SEQ ID NO: 8785854 - DNA, 22 bp, Homo sapiens
acttcctgtgttggtcttgctg

SEQ ID NO: 8785855 - DNA, 22 bp, Homo sapiens
acttcctgttatgtgtgcctct

SEQ ID NO: 8785856 - DNA, 22 bp, Homo sapiens
acttccttccaaacattcattt

SEQ ID NO: 8785857 - DNA, 22 bp, Homo sapiens
acttcctgggcatgcagagtcc

SEQ ID NO: 8785858 - DNA, 22 bp, Homo sapiens
acttcctgggcatgcagagtcc

SEQ ID NO: 8785859 - DNA, 22 bp, Homo sapiens
acttcctgggtgttgtaaggtc

SEQ ID NO: 8785860 - DNA, 22 bp, Homo sapiens
acttcctgtaaatagaattcca

SEQ ID NO: 8785861 - DNA, 19 bp, Homo sapiens
ataaataaaaagtgggaga

SEQ ID NO: 8785862 - DNA, 19 bp, Homo sapiens
ataaataaaaagtgggaga

SEQ ID NO: 8785863 - DNA, 22 bp, Homo sapiens
acttccagcaacttggtgctat

SEQ ID NO: 8785864 - DNA, 22 bp, Homo sapiens
acttccagcaacttggtgctat

SEQ ID NO: 8785865 - DNA, 22 bp, Homo sapiens
acttcctggcgtagctgacatt

SEQ ID NO: 8785866 - DNA, 22 bp, Homo sapiens
acttccagctaggttctgctaa

SEQ ID NO: 8785867 - DNA, 22 bp, Homo sapiens
acttccagctaggttctgctaa

SEQ ID NO: 8785868 - DNA, 22 bp, Homo sapiens
acttccagcacctcaagcggaa

SEQ ID NO: 8785869 - DNA, 22 bp, Homo sapiens
acttccagcacctcaagcggaa

SEQ ID NO: 8785870 - DNA, 22 bp, Homo sapiens
acttccagcccctgtcagcaaa

SEQ ID NO: 8785871 - DNA, 22 bp, Homo sapiens
acttccagcccctgtcagcaaa

SEQ ID NO: 8785872 - DNA, 22 bp, Homo sapiens
ataaagtggaggtagtattcat

SEQ ID NO: 8785873 - DNA, 22 bp, Homo sapiens
ataaagtggaggtagtattcat

SEQ ID NO: 8785874 - DNA, 22 bp, Homo sapiens
ataaagtttaaaagtcaatagt

SEQ ID NO: 8785875 - DNA, 19 bp, Homo sapiens
ataaataaaaagtgggaga

SEQ ID NO: 8785876 - DNA, 21 bp, Homo sapiens
ataaagttttacaggaatgca

SEQ ID NO: 8785877 - DNA, 22 bp, Homo sapiens
acttttcccttggtagagttgc

SEQ ID NO: 8785878 - DNA, 23 bp, Homo sapiens
acttttcaattagctatgcttaa

SEQ ID NO: 8785879 - DNA, 23 bp, Homo sapiens
acttttcaattagctatgcttaa

SEQ ID NO: 8785880 - DNA, 23 bp, Homo sapiens
acttttcaattagctatgcttaa

SEQ ID NO: 8785881 - DNA, 22 bp, Homo sapiens
acttttctaagcaatggtcttg

SEQ ID NO: 8785882 - DNA, 22 bp, Homo sapiens
acttttctccctcctgccttca

SEQ ID NO: 8785883 - DNA, 22 bp, Homo sapiens
acttttctccctcctgccttca

SEQ ID NO: 8785884 - DNA, 22 bp, Homo sapiens
actttttacagggtgtatacca

SEQ ID NO: 8785885 - DNA, 22 bp, Homo sapiens
actttttacagggtgtatacca

SEQ ID NO: 8785886 - DNA, 22 bp, Homo sapiens
acttttgtgcaggtctctccca

SEQ ID NO: 8785887 - DNA, 22 bp, Homo sapiens
acttttgaggactttattgtat

SEQ ID NO: 8785888 - DNA, 22 bp, Homo sapiens
acttttggctatgtccaatacc

SEQ ID NO: 8785889 - DNA, 22 bp, Homo sapiens
acttttctgcagatgatctctt

SEQ ID NO: 8785890 - DNA, 22 bp, Homo sapiens
acttttgaagaattatgcaaaa

SEQ ID NO: 8785891 - DNA, 22 bp, Homo sapiens
acttttgaacaaactcctctgt

SEQ ID NO: 8785892 - DNA, 22 bp, Homo sapiens
acttttgaagaattatgcaaaa

SEQ ID NO: 8785893 - DNA, 21 bp, Homo sapiens
agaaaaacacgatataagccc

SEQ ID NO: 8785894 - DNA, 21 bp, Homo sapiens
agaaaaacacgatataagccc

SEQ ID NO: 8785895 - DNA, 21 bp, Homo sapiens
agaaaaacacgatataagccc

SEQ ID NO: 8785896 - DNA, 22 bp, Homo sapiens
agaaaaacacaatcgggcctcc

SEQ ID NO: 8785897 - DNA, 23 bp, Homo sapiens
agaaaaacaggattgtgttccta

SEQ ID NO: 8785898 - DNA, 22 bp, Homo sapiens
actttttctcagaaggattggt

SEQ ID NO: 8785899 - DNA, 22 bp, Homo sapiens
actttttgcatagtaagtgtct

SEQ ID NO: 8785900 - DNA, 22 bp, Homo sapiens
actttttgcatagtaagtgtct

SEQ ID NO: 8785901 - DNA, 22 bp, Homo sapiens
actttttctcagaaggattggt

SEQ ID NO: 8785902 - DNA, 22 bp, Homo sapiens
actttttagtttcctcaaacat

SEQ ID NO: 8785903 - DNA, 22 bp, Homo sapiens
actttttacagggtgtatacca

SEQ ID NO: 8785904 - DNA, 22 bp, Homo sapiens
actttttgctggtctcttccat

SEQ ID NO: 8785905 - DNA, 22 bp, Homo sapiens
acttttttataaggaagaagat

SEQ ID NO: 8785906 - DNA, 22 bp, Homo sapiens
acttttttataaggaagaagat

SEQ ID NO: 8785907 - DNA, 22 bp, Homo sapiens
acttttttataaggaagaagat

SEQ ID NO: 8785908 - DNA, 21 bp, Homo sapiens
atatttttgtttggactgtca

SEQ ID NO: 8785909 - DNA, 21 bp, Homo sapiens
atatttttgtttggactgtca

SEQ ID NO: 8785910 - DNA, 21 bp, Homo sapiens
atatttttgtttggactgtca

SEQ ID NO: 8785911 - DNA, 21 bp, Homo sapiens
atatttttgtttggactgtca

SEQ ID NO: 8785912 - DNA, 21 bp, Homo sapiens
atatttttgtttggactgtca

SEQ ID NO: 8785913 - DNA, 22 bp, Homo sapiens
atattttgtaacttggaatagg

SEQ ID NO: 8785914 - DNA, 22 bp, Homo sapiens
atattttgtaacttggaatagg

SEQ ID NO: 8785915 - DNA, 22 bp, Homo sapiens
atattttggtagctctcaatga

SEQ ID NO: 8785916 - DNA, 22 bp, Homo sapiens
atattttggtagctctcaatga

SEQ ID NO: 8785917 - DNA, 22 bp, Homo sapiens
atattttggtagctctcaatga

SEQ ID NO: 8785918 - DNA, 22 bp, Homo sapiens
atatttttccatgtgggactct

SEQ ID NO: 8785919 - DNA, 22 bp, Homo sapiens
atatttttccatgtgggactct

SEQ ID NO: 8785920 - DNA, 22 bp, Homo sapiens
atatttttccatgtgggactct

SEQ ID NO: 8785921 - DNA, 22 bp, Homo sapiens
atatttttccatgtgggactct

SEQ ID NO: 8785922 - DNA, 22 bp, Homo sapiens
atatttttccatgtgggactct

SEQ ID NO: 8785923 - DNA, 22 bp, Homo sapiens
atatttttccatgtgggactct

SEQ ID NO: 8785924 - DNA, 22 bp, Homo sapiens
atatttttccatgtgggactct

SEQ ID NO: 8785925 - DNA, 21 bp, Homo sapiens
agaaaaaccagcatgttttca

SEQ ID NO: 8785926 - DNA, 22 bp, Homo sapiens
agaaaaagaaagtggatttgtc

SEQ ID NO: 8785927 - DNA, 22 bp, Homo sapiens
agaaaaagtcaaggaattggac

SEQ ID NO: 8785928 - DNA, 22 bp, Homo sapiens
agaaaaagtcaaggaattggac

SEQ ID NO: 8785929 - DNA, 22 bp, Homo sapiens
agaaaaagtcaaggaattggac

SEQ ID NO: 8785930 - DNA, 22 bp, Homo sapiens
atatttctccaaatgttttcaa

SEQ ID NO: 8785931 - DNA, 22 bp, Homo sapiens
atatttctccaaatgttttcaa

SEQ ID NO: 8785932 - DNA, 22 bp, Homo sapiens
atattttggggtgatgtgcatc

SEQ ID NO: 8785933 - DNA, 22 bp, Homo sapiens
agaaagaggatgcagatctcat

SEQ ID NO: 8785934 - DNA, 22 bp, Homo sapiens
atcaaaatgctccagtgatggt

SEQ ID NO: 8785935 - DNA, 22 bp, Homo sapiens
atcaaaatgctccagtgatggt

SEQ ID NO: 8785936 - DNA, 22 bp, Homo sapiens
atcaaaatgctccagtgatggt

SEQ ID NO: 8785937 - DNA, 22 bp, Homo sapiens
atcaaaatgctccagtgatggt

SEQ ID NO: 8785938 - DNA, 22 bp, Homo sapiens
agaaagattttcaacaggaggt

SEQ ID NO: 8785939 - DNA, 22 bp, Homo sapiens
agaaagattttcaacaggaggt

SEQ ID NO: 8785940 - DNA, 22 bp, Homo sapiens
agaaagattttcaacaggaggt

SEQ ID NO: 8785941 - DNA, 20 bp, Homo sapiens
atcaaaatcctattgaggtt

SEQ ID NO: 8785942 - DNA, 22 bp, Homo sapiens
agaaagcacgggccccaggctc

SEQ ID NO: 8785943 - DNA, 22 bp, Homo sapiens
agaaagcacgggccccaggctc

SEQ ID NO: 8785944 - DNA, 22 bp, Homo sapiens
agaaagcactctgtcttttacc

SEQ ID NO: 8785945 - DNA, 22 bp, Homo sapiens
agaaagcaccctgcactttctg

SEQ ID NO: 8785946 - DNA, 22 bp, Homo sapiens
agaaagcaccctgcactttctg

SEQ ID NO: 8785947 - DNA, 22 bp, Homo sapiens
agaaagcacagcgggtccattt

SEQ ID NO: 8785948 - DNA, 22 bp, Homo sapiens
agaaagcacagcgggtccattt

SEQ ID NO: 8785949 - DNA, 22 bp, Homo sapiens
agaaagattttcaacaggaggt

SEQ ID NO: 8785950 - DNA, 22 bp, Homo sapiens
agaaagccttatgtacagaggc

SEQ ID NO: 8785951 - DNA, 22 bp, Homo sapiens
agaaagcctcaatcttcaggcc

SEQ ID NO: 8785952 - DNA, 22 bp, Homo sapiens
agaaagcctcaatcttcaggcc

SEQ ID NO: 8785953 - DNA, 22 bp, Homo sapiens
agaaagcccaggagaacagatt

SEQ ID NO: 8785954 - DNA, 22 bp, Homo sapiens
agaaagcatctccattgtaggt

SEQ ID NO: 8785955 - DNA, 22 bp, Homo sapiens
agaaagcagcatttatgatctc

SEQ ID NO: 8785956 - DNA, 22 bp, Homo sapiens
agaaagcagtcccttccgaccg

SEQ ID NO: 8785957 - DNA, 22 bp, Homo sapiens
agaaagcatctccattgtaggt

SEQ ID NO: 8785958 - DNA, 22 bp, Homo sapiens
agaaagcactctgtcttttacc

SEQ ID NO: 8785959 - DNA, 22 bp, Homo sapiens
agaaagcactctgtcttttacc

SEQ ID NO: 8785960 - DNA, 22 bp, Homo sapiens
agaaagcagtcccttccgaccg

SEQ ID NO: 8785961 - DNA, 22 bp, Homo sapiens
agaaagcagcatttatgatctc

SEQ ID NO: 8785962 - DNA, 22 bp, Homo sapiens
agaaagcactctgtcttttacc

SEQ ID NO: 8785963 - DNA, 22 bp, Homo sapiens
agaaatcatgactaagagcagt

SEQ ID NO: 8785964 - DNA, 22 bp, Homo sapiens
agaaatcatgactaagagcagt

SEQ ID NO: 8785965 - DNA, 22 bp, Homo sapiens
agaaatcatgactaagagcagt

SEQ ID NO: 8785966 - DNA, 22 bp, Homo sapiens
agaaatcattcccaaacccata

SEQ ID NO: 8785967 - DNA, 22 bp, Homo sapiens
agaaatcattgaattatttgct

SEQ ID NO: 8785968 - DNA, 22 bp, Homo sapiens
agaaatcatgtcttatttctat

SEQ ID NO: 8785969 - DNA, 22 bp, Homo sapiens
agaaatcatgtcttatttctat

SEQ ID NO: 8785970 - DNA, 22 bp, Homo sapiens
agaaatcatgtcttatttctat

SEQ ID NO: 8785971 - DNA, 22 bp, Homo sapiens
atcagtgtttcaaatgtaatct

SEQ ID NO: 8785972 - DNA, 22 bp, Homo sapiens
atcagttagttactgctaagat

SEQ ID NO: 8785973 - DNA, 22 bp, Homo sapiens
atcagttatttttaagctataa

SEQ ID NO: 8785974 - DNA, 22 bp, Homo sapiens
atcagtgttgttgattggatag

SEQ ID NO: 8785975 - DNA, 22 bp, Homo sapiens
atcagtttaaatgggctgttgg

SEQ ID NO: 8785976 - DNA, 23 bp, Homo sapiens
agaaatcatctccaccccatgtc

SEQ ID NO: 8785977 - DNA, 22 bp, Homo sapiens
agaaatcatgactaagagcagt

SEQ ID NO: 8785978 - DNA, 22 bp, Homo sapiens
agaaatcaggaacagtaaggag

SEQ ID NO: 8785979 - DNA, 22 bp, Homo sapiens
agaaatcaggaacagtaaggag

SEQ ID NO: 8785980 - DNA, 22 bp, Homo sapiens
agaaatcaggaacagtaaggag

SEQ ID NO: 8785981 - DNA, 22 bp, Homo sapiens
atcagtatattccttggtcttt

SEQ ID NO: 8785982 - DNA, 22 bp, Homo sapiens
atcagtaaatattcattgtgca

SEQ ID NO: 8785983 - DNA, 17 bp, Homo sapiens
atcagtagcatatcaga

SEQ ID NO: 8785984 - DNA, 21 bp, Homo sapiens
atcagtaaggttggaggaaga

SEQ ID NO: 8785985 - DNA, 22 bp, Homo sapiens
atcagtatcctgcagtttctat

SEQ ID NO: 8785986 - DNA, 19 bp, Homo sapiens
atcagtgcatgagtgctgt

SEQ ID NO: 8785987 - DNA, 22 bp, Homo sapiens
atcagtgtaccttatggatttt

SEQ ID NO: 8785988 - DNA, 22 bp, Homo sapiens
atccaggaaggatggcattgag

SEQ ID NO: 8785989 - DNA, 22 bp, Homo sapiens
agaaatcttatcaagaaatgcc

SEQ ID NO: 8785990 - DNA, 22 bp, Homo sapiens
agaaatcttatcaagaaatgcc

SEQ ID NO: 8785991 - DNA, 22 bp, Homo sapiens
agaaatctgactgctgtgcaca

SEQ ID NO: 8785992 - DNA, 22 bp, Homo sapiens
atccaggagtcgtggcgctcag

SEQ ID NO: 8785993 - DNA, 22 bp, Homo sapiens
atccaggagggctgactcctta

SEQ ID NO: 8785994 - DNA, 22 bp, Homo sapiens
agaaatcccaaggcatcaacca

SEQ ID NO: 8785995 - DNA, 22 bp, Homo sapiens
agaaatctatgttttggttaga

SEQ ID NO: 8785996 - DNA, 22 bp, Homo sapiens
agaaatctatgttttggttaga

SEQ ID NO: 8785997 - DNA, 22 bp, Homo sapiens
agaaatcattttaggcttgatg

SEQ ID NO: 8785998 - DNA, 22 bp, Homo sapiens
agaaatctctagcacatcgaat

SEQ ID NO: 8785999 - DNA, 22 bp, Homo sapiens
agaaatctgactgctgtgcaca

SEQ ID NO: 8786000 - DNA, 22 bp, Homo sapiens
agaaatctctagcacatcgaat

SEQ ID NO: 8786001 - DNA, 22 bp, Homo sapiens
agaaatctctagcacatcgaat

SEQ ID NO: 8786002 - DNA, 22 bp, Homo sapiens
agaaatctcagtatctcaggga

SEQ ID NO: 8786003 - DNA, 22 bp, Homo sapiens
agaaatctattatttcagagtt

SEQ ID NO: 8786004 - DNA, 22 bp, Homo sapiens
atcccatttcctagtacatcat

SEQ ID NO: 8786005 - DNA, 22 bp, Homo sapiens
atcccaggcggcacaggttgca

SEQ ID NO: 8786006 - DNA, 22 bp, Homo sapiens
atcccaggcggcacaggttgca

SEQ ID NO: 8786007 - DNA, 22 bp, Homo sapiens
atcccaggaggctgcgcagtta

SEQ ID NO: 8786008 - DNA, 21 bp, Homo sapiens
atcccagcacccaggagtgca

SEQ ID NO: 8786009 - DNA, 18 bp, Homo sapiens
atcccaaaagacaaggaa

SEQ ID NO: 8786010 - DNA, 18 bp, Homo sapiens
atcccaaaagacaaggaa

SEQ ID NO: 8786011 - DNA, 22 bp, Homo sapiens
atcccaagtagcaatcctggta

SEQ ID NO: 8786012 - DNA, 22 bp, Homo sapiens
atccatttttgcaaagttgttc

SEQ ID NO: 8786013 - DNA, 22 bp, Homo sapiens
atcccacacccctacaacatat

SEQ ID NO: 8786014 - DNA, 22 bp, Homo sapiens
atcccacacccctacaacatat

SEQ ID NO: 8786015 - DNA, 22 bp, Homo sapiens
atcccacctcaatctgaagctc

SEQ ID NO: 8786016 - DNA, 22 bp, Homo sapiens
atcccattttataccataagag

SEQ ID NO: 8786017 - DNA, 22 bp, Homo sapiens
atcccatttcctgttttgtcaa

SEQ ID NO: 8786018 - DNA, 22 bp, Homo sapiens
agaacagtcgtggtgagagaaa

SEQ ID NO: 8786019 - DNA, 22 bp, Homo sapiens
agaacagtcgtggtgagagaaa

SEQ ID NO: 8786020 - DNA, 22 bp, Homo sapiens
agaacaggttcagggtataaaa

SEQ ID NO: 8786021 - DNA, 22 bp, Homo sapiens
atccccagactttagatttctc

SEQ ID NO: 8786022 - DNA, 22 bp, Homo sapiens
atcccattttataccataagag

SEQ ID NO: 8786023 - DNA, 22 bp, Homo sapiens
agaacagggactggaggcttca

SEQ ID NO: 8786024 - DNA, 22 bp, Homo sapiens
agaacatatctgttttctaact

SEQ ID NO: 8786025 - DNA, 22 bp, Homo sapiens
agaacatatctgttttctaact

SEQ ID NO: 8786026 - DNA, 22 bp, Homo sapiens
agaacatctaaatatctgagac

SEQ ID NO: 8786027 - DNA, 22 bp, Homo sapiens
agaacatagatacctaagacag

SEQ ID NO: 8786028 - DNA, 22 bp, Homo sapiens
agaacataattatcataaactg

SEQ ID NO: 8786029 - DNA, 22 bp, Homo sapiens
agaacataattatcataaactg

SEQ ID NO: 8786030 - DNA, 22 bp, Homo sapiens
agaacataattatcataaactg

SEQ ID NO: 8786031 - DNA, 22 bp, Homo sapiens
agaacctcacgagattccttca

SEQ ID NO: 8786032 - DNA, 22 bp, Homo sapiens
agaaccttcagattaggaggtg

SEQ ID NO: 8786033 - DNA, 20 bp, Homo sapiens
agaacctaagttaaaacaca

SEQ ID NO: 8786034 - DNA, 22 bp, Homo sapiens
atctctggcaatgcagcatcgt

SEQ ID NO: 8786035 - DNA, 22 bp, Homo sapiens
atctctggcccctggggtccga

SEQ ID NO: 8786036 - DNA, 22 bp, Homo sapiens
atctctggcaatgcagcatcgt

SEQ ID NO: 8786037 - DNA, 22 bp, Homo sapiens
atctctgctagccttcttcagg

SEQ ID NO: 8786038 - DNA, 22 bp, Homo sapiens
agaaccctaatacaatggacat

SEQ ID NO: 8786039 - DNA, 22 bp, Homo sapiens
agaaccagctagtcttgctttt

SEQ ID NO: 8786040 - DNA, 22 bp, Homo sapiens
agaaccatgagtttgagtatct

SEQ ID NO: 8786041 - DNA, 22 bp, Homo sapiens
agaaccattttgacagatatac

SEQ ID NO: 8786042 - DNA, 22 bp, Homo sapiens
agaacatttgtcgatcaatttg

SEQ ID NO: 8786043 - DNA, 22 bp, Homo sapiens
agaacatttgtcgatcaatttg

SEQ ID NO: 8786044 - DNA, 22 bp, Homo sapiens
agaacattaatgcgaggtatta

SEQ ID NO: 8786045 - DNA, 22 bp, Homo sapiens
agaacatggattgtcaaaggta

SEQ ID NO: 8786046 - DNA, 22 bp, Homo sapiens
agaaggagtgtacaggtcatgc

SEQ ID NO: 8786047 - DNA, 22 bp, Homo sapiens
agaaggagtgtacaggtcatgc

SEQ ID NO: 8786048 - DNA, 22 bp, Homo sapiens
agaagctgtggtatgaaatgtg

SEQ ID NO: 8786049 - DNA, 22 bp, Homo sapiens
agaagctgtggtatgaaatgtg

SEQ ID NO: 8786050 - DNA, 19 bp, Homo sapiens
agaagctgtgaaatgaagg

SEQ ID NO: 8786051 - DNA, 19 bp, Homo sapiens
agaagctgtgaaatgaagg

SEQ ID NO: 8786052 - DNA, 23 bp, Homo sapiens
agaagctgggagcctggggatgg

SEQ ID NO: 8786053 - DNA, 22 bp, Homo sapiens
agaagccacaggcctcgtctgg

SEQ ID NO: 8786054 - DNA, 21 bp, Homo sapiens
agaaggcaccagcaaggactg

SEQ ID NO: 8786055 - DNA, 22 bp, Homo sapiens
agaaggcaccgtggccaatatt

SEQ ID NO: 8786056 - DNA, 21 bp, Homo sapiens
agaaggcaccagcaaggactg

SEQ ID NO: 8786057 - DNA, 22 bp, Homo sapiens
agaaggcacagtgctgctaaga

SEQ ID NO: 8786058 - DNA, 21 bp, Homo sapiens
agaaggcaaaagcagacatct

SEQ ID NO: 8786059 - DNA, 21 bp, Homo sapiens
agaaggcaaaagcagacatct

SEQ ID NO: 8786060 - DNA, 22 bp, Homo sapiens
agaaggcacagtgctgctaaga

SEQ ID NO: 8786061 - DNA, 21 bp, Homo sapiens
agaaggcaaaagcagacatct

SEQ ID NO: 8786062 - DNA, 22 bp, Homo sapiens
agaaggcacagtgctgctaaga

SEQ ID NO: 8786063 - DNA, 22 bp, Homo sapiens
agaaggcagatgggacggagca

SEQ ID NO: 8786064 - DNA, 22 bp, Homo sapiens
agaaggcagaaagtccaggtat

SEQ ID NO: 8786065 - DNA, 22 bp, Homo sapiens
agaaggcagatgggacggagca

SEQ ID NO: 8786066 - DNA, 22 bp, Homo sapiens
agaaggcagatgggacggagca

SEQ ID NO: 8786067 - DNA, 22 bp, Homo sapiens
agaaggcagatgggacggagca

SEQ ID NO: 8786068 - DNA, 22 bp, Homo sapiens
agaaggcagatgggacggagca

SEQ ID NO: 8786069 - DNA, 22 bp, Homo sapiens
agaaggcagatgggacggagca

SEQ ID NO: 8786070 - DNA, 22 bp, Homo sapiens
agaaggcagatgggacggagca

SEQ ID NO: 8786071 - DNA, 22 bp, Homo sapiens
agaaggcagaaagtccaggtat

SEQ ID NO: 8786072 - DNA, 22 bp, Homo sapiens
agaaggcagaaagtccaggtat

SEQ ID NO: 8786073 - DNA, 22 bp, Homo sapiens
agaaggcagaaagtccaggtat

SEQ ID NO: 8786074 - DNA, 22 bp, Homo sapiens
agaaggcactcacactggcacg

SEQ ID NO: 8786075 - DNA, 22 bp, Homo sapiens
agaaggcactcacactggcacg

SEQ ID NO: 8786076 - DNA, 22 bp, Homo sapiens
agaaggcactcacactggcacg

SEQ ID NO: 8786077 - DNA, 22 bp, Homo sapiens
agaaggcactcacactggcacg

SEQ ID NO: 8786078 - DNA, 22 bp, Homo sapiens
agaaggcactcacactggcacg

SEQ ID NO: 8786079 - DNA, 22 bp, Homo sapiens
agaaggcaccgtggccaatatt

SEQ ID NO: 8786080 - DNA, 20 bp, Homo sapiens
agaaggcaggagacaaaagg

SEQ ID NO: 8786081 - DNA, 20 bp, Homo sapiens
agaaggcaggagacaaaagg

SEQ ID NO: 8786082 - DNA, 20 bp, Homo sapiens
agaaggcaggagacaaaagg

SEQ ID NO: 8786083 - DNA, 20 bp, Homo sapiens
agaaggcaggagacaaaagg

SEQ ID NO: 8786084 - DNA, 22 bp, Homo sapiens
agaaggcaggttttaaaatgtc

SEQ ID NO: 8786085 - DNA, 22 bp, Homo sapiens
agaaggcaggttttaaaatgtc

SEQ ID NO: 8786086 - DNA, 22 bp, Homo sapiens
agaaggcaggttttaaaatgtc

SEQ ID NO: 8786087 - DNA, 22 bp, Homo sapiens
agaaggcatcagaagtgtgtag

SEQ ID NO: 8786088 - DNA, 22 bp, Homo sapiens
agaaggcatagaccggattatg

SEQ ID NO: 8786089 - DNA, 22 bp, Homo sapiens
atctgccaagagaacgtgggtc

SEQ ID NO: 8786090 - DNA, 22 bp, Homo sapiens
atctgccaatgccatgagaaga

SEQ ID NO: 8786091 - DNA, 22 bp, Homo sapiens
agaaggcatcagaagtgtgtag

SEQ ID NO: 8786092 - DNA, 22 bp, Homo sapiens
agaaggcatcagaagtgtgtag

SEQ ID NO: 8786093 - DNA, 22 bp, Homo sapiens
agaaggcatcagaagtgtgtag

SEQ ID NO: 8786094 - DNA, 22 bp, Homo sapiens
atctgccaagagaacgtgggtc

SEQ ID NO: 8786095 - DNA, 22 bp, Homo sapiens
atctgccccagtgatgggccat

SEQ ID NO: 8786096 - DNA, 22 bp, Homo sapiens
atctgcccatctgtcctgcttc

SEQ ID NO: 8786097 - DNA, 22 bp, Homo sapiens
atctgcccttgattgccctagg

SEQ ID NO: 8786098 - DNA, 22 bp, Homo sapiens
atctgccctggggccaaaccca

SEQ ID NO: 8786099 - DNA, 22 bp, Homo sapiens
atctgcccatctgtcctgcttc

SEQ ID NO: 8786100 - DNA, 22 bp, Homo sapiens
atctctggttgttttgctccca

SEQ ID NO: 8786101 - DNA, 22 bp, Homo sapiens
atctctggtccaaatgttacct

SEQ ID NO: 8786102 - DNA, 22 bp, Homo sapiens
atctctggttgttttgctccca

SEQ ID NO: 8786103 - DNA, 22 bp, Homo sapiens
atctctggtccaaatgttacct

SEQ ID NO: 8786104 - DNA, 22 bp, Homo sapiens
atctctgggctttgagtttgtt

SEQ ID NO: 8786105 - DNA, 22 bp, Homo sapiens
atctctgggtccatagaagaga

SEQ ID NO: 8786106 - DNA, 22 bp, Homo sapiens
atctctgggtccatagaagaga

SEQ ID NO: 8786107 - DNA, 22 bp, Homo sapiens
atctctggccttccttttccaa

SEQ ID NO: 8786108 - DNA, 22 bp, Homo sapiens
atctctggcccctggggtccga

SEQ ID NO: 8786109 - DNA, 22 bp, Homo sapiens
atctctgggctttgagtttgtt

SEQ ID NO: 8786110 - DNA, 22 bp, Homo sapiens
atctctgggctttgagtttgtt

SEQ ID NO: 8786111 - DNA, 22 bp, Homo sapiens
atctctggccttccttttccaa

SEQ ID NO: 8786112 - DNA, 22 bp, Homo sapiens
atctctggccttccttttccaa

SEQ ID NO: 8786113 - DNA, 22 bp, Homo sapiens
atctctgtaattacatgatatt

SEQ ID NO: 8786114 - DNA, 22 bp, Homo sapiens
atctctggttgttttgctccca

SEQ ID NO: 8786115 - DNA, 22 bp, Homo sapiens
atctctgtaaaccataaattga

SEQ ID NO: 8786116 - DNA, 22 bp, Homo sapiens
atctcttagcagtctagtgacc

SEQ ID NO: 8786117 - DNA, 22 bp, Homo sapiens
atctctgttagatctgcttaaa

SEQ ID NO: 8786118 - DNA, 22 bp, Homo sapiens
atctctgtaattacatgatatt

SEQ ID NO: 8786119 - DNA, 22 bp, Homo sapiens
atctcttcccaactccacattc

SEQ ID NO: 8786120 - DNA, 22 bp, Homo sapiens
atctcttatgtcacataaacca

SEQ ID NO: 8786121 - DNA, 22 bp, Homo sapiens
atctcttctagctctgaaatta

SEQ ID NO: 8786122 - DNA, 22 bp, Homo sapiens
atctcttctgagcaattcctgt

SEQ ID NO: 8786123 - DNA, 22 bp, Homo sapiens
agaagccacaggaaagcagctt

SEQ ID NO: 8786124 - DNA, 22 bp, Homo sapiens
agaagccacaggaaagcagctt

SEQ ID NO: 8786125 - DNA, 22 bp, Homo sapiens
agaagccaatcagctctctgct

SEQ ID NO: 8786126 - DNA, 22 bp, Homo sapiens
agaagccaatccttgtctctct

SEQ ID NO: 8786127 - DNA, 22 bp, Homo sapiens
agaagccaatccttgtctctct

SEQ ID NO: 8786128 - DNA, 22 bp, Homo sapiens
agaagccaacagggcaggagag

SEQ ID NO: 8786129 - DNA, 22 bp, Homo sapiens
agaagccaacagggcaggagag

SEQ ID NO: 8786130 - DNA, 22 bp, Homo sapiens
atctctttgatggctcctgtga

SEQ ID NO: 8786131 - DNA, 22 bp, Homo sapiens
atctcttgccagtcagaatggt

SEQ ID NO: 8786132 - DNA, 22 bp, Homo sapiens
atctctttgatggctcctgtga

SEQ ID NO: 8786133 - DNA, 22 bp, Homo sapiens
agaagccaagaacagacagtgc

SEQ ID NO: 8786134 - DNA, 20 bp, Homo sapiens
agaagccaagtgacatgttt

SEQ ID NO: 8786135 - DNA, 22 bp, Homo sapiens
agaatatatgactgcaagacta

SEQ ID NO: 8786136 - DNA, 22 bp, Homo sapiens
agaatatgattcagaccattag

SEQ ID NO: 8786137 - DNA, 22 bp, Homo sapiens
agaatatgattcagaccattag

SEQ ID NO: 8786138 - DNA, 22 bp, Homo sapiens
agaatattcatctgtattctta

SEQ ID NO: 8786139 - DNA, 22 bp, Homo sapiens
agaatatgccttagcaagccca

SEQ ID NO: 8786140 - DNA, 22 bp, Homo sapiens
agaatatagttaccaaattctg

SEQ ID NO: 8786141 - DNA, 22 bp, Homo sapiens
agaatatagttaccaaattctg

SEQ ID NO: 8786142 - DNA, 22 bp, Homo sapiens
atgaagttctagtgagaaatgc

SEQ ID NO: 8786143 - DNA, 22 bp, Homo sapiens
atgaagttctcaataatcatgt

SEQ ID NO: 8786144 - DNA, 22 bp, Homo sapiens
atgaagttccagtatatgcagt

SEQ ID NO: 8786145 - DNA, 22 bp, Homo sapiens
atgaaggctgtgtagatggatg

SEQ ID NO: 8786146 - DNA, 22 bp, Homo sapiens
atgaaggcagttaaacgtcatc

SEQ ID NO: 8786147 - DNA, 21 bp, Homo sapiens
atgaaggcagtgccaagggct

SEQ ID NO: 8786148 - DNA, 19 bp, Homo sapiens
atgaaggcactgagtggga

SEQ ID NO: 8786149 - DNA, 21 bp, Homo sapiens
atgaaggcagtgccaagggct

SEQ ID NO: 8786150 - DNA, 22 bp, Homo sapiens
atgaagtcgttactaccaattg

SEQ ID NO: 8786151 - DNA, 22 bp, Homo sapiens
atgaagtctatttacctaagct

SEQ ID NO: 8786152 - DNA, 22 bp, Homo sapiens
atgaagcttgaggtgagagctg

SEQ ID NO: 8786153 - DNA, 22 bp, Homo sapiens
atgaaggatagggcaaaatttt

SEQ ID NO: 8786154 - DNA, 22 bp, Homo sapiens
atgaaggatagggcaaaatttt

SEQ ID NO: 8786155 - DNA, 22 bp, Homo sapiens
atgaaggatggctggctgccct

SEQ ID NO: 8786156 - DNA, 19 bp, Homo sapiens
atgaaggcactgagtggga

SEQ ID NO: 8786157 - DNA, 22 bp, Homo sapiens
atgaaggcaagactgaggtgtg

SEQ ID NO: 8786158 - DNA, 22 bp, Homo sapiens
atgaaggcaagactgaggtgtg

SEQ ID NO: 8786159 - DNA, 18 bp, Homo sapiens
atgaacactgagctgaat

SEQ ID NO: 8786160 - DNA, 22 bp, Homo sapiens
atgaagcgttcgagataggtag

SEQ ID NO: 8786161 - DNA, 22 bp, Homo sapiens
atgaagcgttcgagataggtag

SEQ ID NO: 8786162 - DNA, 22 bp, Homo sapiens
atgaagcattacaggatgacag

SEQ ID NO: 8786163 - DNA, 19 bp, Homo sapiens
atgaagcattgtttttgta

SEQ ID NO: 8786164 - DNA, 22 bp, Homo sapiens
atctgcttgcaggctggccctt

SEQ ID NO: 8786165 - DNA, 22 bp, Homo sapiens
atctgcttgaaacttcttatac

SEQ ID NO: 8786166 - DNA, 22 bp, Homo sapiens
atctgcttgaaacttcttatac

SEQ ID NO: 8786167 - DNA, 22 bp, Homo sapiens
atctgcttcctgggctccatga

SEQ ID NO: 8786168 - DNA, 22 bp, Homo sapiens
atctgcttcctgggctccatga

SEQ ID NO: 8786169 - DNA, 22 bp, Homo sapiens
atctgcttcagtgatatgtgaa

SEQ ID NO: 8786170 - DNA, 17 bp, Homo sapiens
atctgcttcacccagca

SEQ ID NO: 8786171 - DNA, 22 bp, Homo sapiens
atctgcctggctccaggtgagc

SEQ ID NO: 8786172 - DNA, 22 bp, Homo sapiens
atctgctatgttatttcccact

SEQ ID NO: 8786173 - DNA, 17 bp, Homo sapiens
atctgctgacattctgt

SEQ ID NO: 8786174 - DNA, 22 bp, Homo sapiens
atctgctggcatctctagccca

SEQ ID NO: 8786175 - DNA, 22 bp, Homo sapiens
atctgctgttcttcacagcttg

SEQ ID NO: 8786176 - DNA, 22 bp, Homo sapiens
atctgcctggctccaggtgagc

SEQ ID NO: 8786177 - DNA, 22 bp, Homo sapiens
atctgcctgcagtggaggtggg

SEQ ID NO: 8786178 - DNA, 22 bp, Homo sapiens
atgagggaggcaaggagatgct

SEQ ID NO: 8786179 - DNA, 22 bp, Homo sapiens
agacaaatttcctgcaatgaag

SEQ ID NO: 8786180 - DNA, 22 bp, Homo sapiens
atgagggcagctatgtaagtgt

SEQ ID NO: 8786181 - DNA, 22 bp, Homo sapiens
atgagggaggggtggtgccgca

SEQ ID NO: 8786182 - DNA, 22 bp, Homo sapiens
atgaggctctcaacaccttgag

SEQ ID NO: 8786183 - DNA, 22 bp, Homo sapiens
atgaggctctcaggggagctgt

SEQ ID NO: 8786184 - DNA, 22 bp, Homo sapiens
atgaggctgaaacacagaggct

SEQ ID NO: 8786185 - DNA, 22 bp, Homo sapiens
atgaggcttaaactgctgcaac

SEQ ID NO: 8786186 - DNA, 22 bp, Homo sapiens
atgagggaagctcacgtgtcca

SEQ ID NO: 8786187 - DNA, 22 bp, Homo sapiens
atgaggctatgaatggggagat

SEQ ID NO: 8786188 - DNA, 22 bp, Homo sapiens
atgaggctatttcatagatttt

SEQ ID NO: 8786189 - DNA, 22 bp, Homo sapiens
atgaggcctatcttggcagagg

SEQ ID NO: 8786190 - DNA, 22 bp, Homo sapiens
agaatattgaaagttcttgaca

SEQ ID NO: 8786191 - DNA, 22 bp, Homo sapiens
agaatattgaaagttcttgaca

SEQ ID NO: 8786192 - DNA, 22 bp, Homo sapiens
agaatcaaagagaaatactttg

SEQ ID NO: 8786193 - DNA, 22 bp, Homo sapiens
agaatcaaagagaaatactttg

SEQ ID NO: 8786194 - DNA, 22 bp, Homo sapiens
agaatcaactgaaaattggtga

SEQ ID NO: 8786195 - DNA, 22 bp, Homo sapiens
agaatcaaggtgaagcccacag

SEQ ID NO: 8786196 - DNA, 22 bp, Homo sapiens
agaatcaactgaaaattggtga

SEQ ID NO: 8786197 - DNA, 22 bp, Homo sapiens
agaatcaattagattctatgag

SEQ ID NO: 8786198 - DNA, 22 bp, Homo sapiens
agaatcaattagattctatgag

SEQ ID NO: 8786199 - DNA, 22 bp, Homo sapiens
atgaggcacttaaaagtgaaga

SEQ ID NO: 8786200 - DNA, 22 bp, Homo sapiens
atgaggcagaaaaaagtcggag

SEQ ID NO: 8786201 - DNA, 22 bp, Homo sapiens
atgaggcacgtgttactggcct

SEQ ID NO: 8786202 - DNA, 22 bp, Homo sapiens
agacaccagaatctgttgagca

SEQ ID NO: 8786203 - DNA, 22 bp, Homo sapiens
agacaccaaagagttggcagtg

SEQ ID NO: 8786204 - DNA, 22 bp, Homo sapiens
agacacattttcagctctgcca

SEQ ID NO: 8786205 - DNA, 23 bp, Homo sapiens
agacactgtaaagaattgcagtt

SEQ ID NO: 8786206 - DNA, 22 bp, Homo sapiens
agacaaggctggagtttaggca

SEQ ID NO: 8786207 - DNA, 22 bp, Homo sapiens
agacaagtgtggtgagagcagt

SEQ ID NO: 8786208 - DNA, 22 bp, Homo sapiens
agacaagtaggaatggttgaag

SEQ ID NO: 8786209 - DNA, 22 bp, Homo sapiens
agacaagttctgtgggtcacct

SEQ ID NO: 8786210 - DNA, 19 bp, Homo sapiens
agacaagtttccagaagcc

SEQ ID NO: 8786211 - DNA, 19 bp, Homo sapiens
agacaagtttccagaagcc

SEQ ID NO: 8786212 - DNA, 22 bp, Homo sapiens
agacactgttctcacatgcttg

SEQ ID NO: 8786213 - DNA, 22 bp, Homo sapiens
agacactgttctcacatgcttg

SEQ ID NO: 8786214 - DNA, 22 bp, Homo sapiens
agacacttatttagtgggagtt

SEQ ID NO: 8786215 - DNA, 22 bp, Homo sapiens
agacacttcatgtaagtggaat

SEQ ID NO: 8786216 - DNA, 21 bp, Homo sapiens
agacagaacaactgctctcca

SEQ ID NO: 8786217 - DNA, 21 bp, Homo sapiens
agacagaacaactgctctcca

SEQ ID NO: 8786218 - DNA, 22 bp, Homo sapiens
agacagaaataggagaaaccag

SEQ ID NO: 8786219 - DNA, 22 bp, Homo sapiens
agacacttggcagagagctgtt

SEQ ID NO: 8786220 - DNA, 22 bp, Homo sapiens
agacactttcagaagtgtttgc

SEQ ID NO: 8786221 - DNA, 22 bp, Homo sapiens
agacaaggaatgtagcttactc

SEQ ID NO: 8786222 - DNA, 22 bp, Homo sapiens
agacaagagctgaggacatatt

SEQ ID NO: 8786223 - DNA, 22 bp, Homo sapiens
agacaagagctgaggacatatt

SEQ ID NO: 8786224 - DNA, 22 bp, Homo sapiens
agacaagactaggcagttgttg

SEQ ID NO: 8786225 - DNA, 22 bp, Homo sapiens
agacaagaaactgggagtctct

SEQ ID NO: 8786226 - DNA, 22 bp, Homo sapiens
agacaactgcagagcaaagaat

SEQ ID NO: 8786227 - DNA, 22 bp, Homo sapiens
agacaagaaactgggagtctct

SEQ ID NO: 8786228 - DNA, 22 bp, Homo sapiens
agacaactagaaaactagacag

SEQ ID NO: 8786229 - DNA, 22 bp, Homo sapiens
agacaacaccaaatgctagtgt

SEQ ID NO: 8786230 - DNA, 22 bp, Homo sapiens
agacaacaccaaatgctagtgt

SEQ ID NO: 8786231 - DNA, 22 bp, Homo sapiens
agacaacaccaaatgctagtgt

SEQ ID NO: 8786232 - DNA, 22 bp, Homo sapiens
agacaacatcactaaagctgag

SEQ ID NO: 8786233 - DNA, 22 bp, Homo sapiens
agacaaatttgttttcctgtct

SEQ ID NO: 8786234 - DNA, 22 bp, Homo sapiens
agacaaatttcctgcaatgaag

SEQ ID NO: 8786235 - DNA, 22 bp, Homo sapiens
agacaaatttcctgcaatgaag

SEQ ID NO: 8786236 - DNA, 22 bp, Homo sapiens
agacaaatttcctgcaatgaag

SEQ ID NO: 8786237 - DNA, 22 bp, Homo sapiens
agacaacatgatcagcagtcct

SEQ ID NO: 8786238 - DNA, 22 bp, Homo sapiens
agacaacatgatcagcagtcct

SEQ ID NO: 8786239 - DNA, 22 bp, Homo sapiens
agacaacatctagtttggtgga

SEQ ID NO: 8786240 - DNA, 22 bp, Homo sapiens
agacaacatcactaaagctgag

SEQ ID NO: 8786241 - DNA, 22 bp, Homo sapiens
agacaacatcactaaagctgag

SEQ ID NO: 8786242 - DNA, 22 bp, Homo sapiens
agacaacatctagtttggtgga

SEQ ID NO: 8786243 - DNA, 22 bp, Homo sapiens
agacaacatctagtttggtgga

SEQ ID NO: 8786244 - DNA, 22 bp, Homo sapiens
atgcagggttctgggctagaga

SEQ ID NO: 8786245 - DNA, 17 bp, Homo sapiens
atgcaggtgtgaggggc

SEQ ID NO: 8786246 - DNA, 21 bp, Homo sapiens
atgatactgaagcacaactat

SEQ ID NO: 8786247 - DNA, 22 bp, Homo sapiens
agacagacacatggtaacagat

SEQ ID NO: 8786248 - DNA, 22 bp, Homo sapiens
agacagacacatggtaacagat

SEQ ID NO: 8786249 - DNA, 22 bp, Homo sapiens
agacagacaaaattcctgcctg

SEQ ID NO: 8786250 - DNA, 22 bp, Homo sapiens
agacagaatttgtcagataaat

SEQ ID NO: 8786251 - DNA, 22 bp, Homo sapiens
agacagaacagaataattgttg

SEQ ID NO: 8786252 - DNA, 22 bp, Homo sapiens
agacacttggcagagagctgtt

SEQ ID NO: 8786253 - DNA, 20 bp, Homo sapiens
agacagaatcagagataaag

SEQ ID NO: 8786254 - DNA, 22 bp, Homo sapiens
agacagacagagaatttaaata

SEQ ID NO: 8786255 - DNA, 18 bp, Homo sapiens
agacagacaggtttgtgc

SEQ ID NO: 8786256 - DNA, 22 bp, Homo sapiens
atgatacatcttcatgtcagtg

SEQ ID NO: 8786257 - DNA, 22 bp, Homo sapiens
atgatacatcttcatgtcagtg

SEQ ID NO: 8786258 - DNA, 15 bp, Homo sapiens
agacagacagtggga

SEQ ID NO: 8786259 - DNA, 22 bp, Homo sapiens
atgcatatgtacccatgttctg

SEQ ID NO: 8786260 - DNA, 22 bp, Homo sapiens
atgcatattgtcatttagtcct

SEQ ID NO: 8786261 - DNA, 22 bp, Homo sapiens
atgcatttttgagtatgaatga

SEQ ID NO: 8786262 - DNA, 22 bp, Homo sapiens
atgccaaaatgttacatttctt

SEQ ID NO: 8786263 - DNA, 22 bp, Homo sapiens
atgccaaagggagcactttggg

SEQ ID NO: 8786264 - DNA, 22 bp, Homo sapiens
atgccaaagggagcactttggg

SEQ ID NO: 8786265 - DNA, 22 bp, Homo sapiens
atgccaaattctactttcagca

SEQ ID NO: 8786266 - DNA, 22 bp, Homo sapiens
atgccaaattctcagcctcttt

SEQ ID NO: 8786267 - DNA, 22 bp, Homo sapiens
atgccaaagcccaagttcatca

SEQ ID NO: 8786268 - DNA, 22 bp, Homo sapiens
atgccaaagcccaagttcatca

SEQ ID NO: 8786269 - DNA, 22 bp, Homo sapiens
atgcatttttgagtatgaatga

SEQ ID NO: 8786270 - DNA, 22 bp, Homo sapiens
atgccaaagcccaagttcatca

SEQ ID NO: 8786271 - DNA, 21 bp, Homo sapiens
atgccaaacttcttctgccct

SEQ ID NO: 8786272 - DNA, 22 bp, Homo sapiens
atgccaaagatgtttgatagaa

SEQ ID NO: 8786273 - DNA, 22 bp, Homo sapiens
atgcatcaggcactaggaatag

SEQ ID NO: 8786274 - DNA, 22 bp, Homo sapiens
atgcatcaccgagttgcccacc

SEQ ID NO: 8786275 - DNA, 22 bp, Homo sapiens
atgcatttgtaaaatataatcg

SEQ ID NO: 8786276 - DNA, 22 bp, Homo sapiens
atgcgctttgtgtgaagcagtg

SEQ ID NO: 8786277 - DNA, 22 bp, Homo sapiens
agactctgataagcaactcttg

SEQ ID NO: 8786278 - DNA, 22 bp, Homo sapiens
agactctgattccctcatgtca

SEQ ID NO: 8786279 - DNA, 22 bp, Homo sapiens
agactggggttctggcaaggag

SEQ ID NO: 8786280 - DNA, 22 bp, Homo sapiens
agactgtaaagggccagaaagt

SEQ ID NO: 8786281 - DNA, 22 bp, Homo sapiens
atgcctttctggtgttcttcct

SEQ ID NO: 8786282 - DNA, 22 bp, Homo sapiens
atgcgagtgatgcagagtggct

SEQ ID NO: 8786283 - DNA, 22 bp, Homo sapiens
atgcgagtgatgcagagtggct

SEQ ID NO: 8786284 - DNA, 22 bp, Homo sapiens
atgcctttgttgaccactataa

SEQ ID NO: 8786285 - DNA, 22 bp, Homo sapiens
atgcctttggcattatttcttg

SEQ ID NO: 8786286 - DNA, 22 bp, Homo sapiens
agacgagggcccccaggacagc

SEQ ID NO: 8786287 - DNA, 22 bp, Homo sapiens
agacgagggcctggcacacagt

SEQ ID NO: 8786288 - DNA, 22 bp, Homo sapiens
agacgagggcctggcacacagt

SEQ ID NO: 8786289 - DNA, 22 bp, Homo sapiens
atgcctggtatgaagcaaggaa

SEQ ID NO: 8786290 - DNA, 22 bp, Homo sapiens
atgcctggtcccacctctaggt

SEQ ID NO: 8786291 - DNA, 22 bp, Homo sapiens
atgcctggtcccacctctaggt

SEQ ID NO: 8786292 - DNA, 22 bp, Homo sapiens
atgcctgtctcagggtctgttt

SEQ ID NO: 8786293 - DNA, 22 bp, Homo sapiens
atgcctttaagagatactgagg

SEQ ID NO: 8786294 - DNA, 22 bp, Homo sapiens
atgccttattccaacaatctag

SEQ ID NO: 8786295 - DNA, 22 bp, Homo sapiens
atgccttattgtaatctttcca

SEQ ID NO: 8786296 - DNA, 22 bp, Homo sapiens
atgccttaaggcgagatactta

SEQ ID NO: 8786297 - DNA, 22 bp, Homo sapiens
agacctttatttcatgatagga

SEQ ID NO: 8786298 - DNA, 22 bp, Homo sapiens
agacctttatttcatgatagga

SEQ ID NO: 8786299 - DNA, 22 bp, Homo sapiens
agacctggtaagcaggttgggc

SEQ ID NO: 8786300 - DNA, 22 bp, Homo sapiens
agacctggtgatagctgtccta

SEQ ID NO: 8786301 - DNA, 22 bp, Homo sapiens
agacctgggttcgagtcctaac

SEQ ID NO: 8786302 - DNA, 22 bp, Homo sapiens
agacctggtaagcaggttgggc

SEQ ID NO: 8786303 - DNA, 22 bp, Homo sapiens
agacctggtgatagctgtccta

SEQ ID NO: 8786304 - DNA, 22 bp, Homo sapiens
agacctgggttcgagtcctaac

SEQ ID NO: 8786305 - DNA, 22 bp, Homo sapiens
agacctgggtgccctgtgcttt

SEQ ID NO: 8786306 - DNA, 22 bp, Homo sapiens
agacctgggtgccctgtgcttt

SEQ ID NO: 8786307 - DNA, 22 bp, Homo sapiens
agacctgggtgccctgtgcttt

SEQ ID NO: 8786308 - DNA, 22 bp, Homo sapiens
agacctggatgtgagggaagta

SEQ ID NO: 8786309 - DNA, 22 bp, Homo sapiens
agacctggagtggggcctcagg

SEQ ID NO: 8786310 - DNA, 22 bp, Homo sapiens
atgccaagtatgattcacatgt

SEQ ID NO: 8786311 - DNA, 22 bp, Homo sapiens
atgccaagtatgattcacatgt

SEQ ID NO: 8786312 - DNA, 22 bp, Homo sapiens
atgccaattgcaggaagaaaac

SEQ ID NO: 8786313 - DNA, 22 bp, Homo sapiens
atgccacataaccagttcactt

SEQ ID NO: 8786314 - DNA, 22 bp, Homo sapiens
agacccagagggctgctgggag

SEQ ID NO: 8786315 - DNA, 22 bp, Homo sapiens
atgccacataaccagttcactt

SEQ ID NO: 8786316 - DNA, 22 bp, Homo sapiens
atgccaaatttctttctgttct

SEQ ID NO: 8786317 - DNA, 22 bp, Homo sapiens
atgccaaattctactttcagca

SEQ ID NO: 8786318 - DNA, 22 bp, Homo sapiens
atgccaaattctcagcctcttt

SEQ ID NO: 8786319 - DNA, 22 bp, Homo sapiens
agacctggagtgaagagttccc

SEQ ID NO: 8786320 - DNA, 22 bp, Homo sapiens
agacctggagacctgagtggta

SEQ ID NO: 8786321 - DNA, 22 bp, Homo sapiens
agacctggagacctgagtggta

SEQ ID NO: 8786322 - DNA, 22 bp, Homo sapiens
agacctggagacctgagtggta

SEQ ID NO: 8786323 - DNA, 22 bp, Homo sapiens
agacccaggattggggctgccg

SEQ ID NO: 8786324 - DNA, 22 bp, Homo sapiens
agacccaggattggggctgccg

SEQ ID NO: 8786325 - DNA, 22 bp, Homo sapiens
agacccaggcttcatgtgaatc

SEQ ID NO: 8786326 - DNA, 22 bp, Homo sapiens
agacccaggtttcaaactactc

SEQ ID NO: 8786327 - DNA, 22 bp, Homo sapiens
agacctggaagttcaagagaaa

SEQ ID NO: 8786328 - DNA, 22 bp, Homo sapiens
agacttagtgagttctaagttt

SEQ ID NO: 8786329 - DNA, 22 bp, Homo sapiens
agacttagtgagttctaagttt

SEQ ID NO: 8786330 - DNA, 20 bp, Homo sapiens
agacttaggcaatttaggct

SEQ ID NO: 8786331 - DNA, 22 bp, Homo sapiens
agacttcacctacagcagtctc

SEQ ID NO: 8786332 - DNA, 21 bp, Homo sapiens
agacttccatcctgagagagg

SEQ ID NO: 8786333 - DNA, 21 bp, Homo sapiens
agacttctagaagtgagatag

SEQ ID NO: 8786334 - DNA, 21 bp, Homo sapiens
agacttctagaagtgagatag

SEQ ID NO: 8786335 - DNA, 22 bp, Homo sapiens
agactgtttgggttccaaatct

SEQ ID NO: 8786336 - DNA, 22 bp, Homo sapiens
agactgttgcctgaacttagcc

SEQ ID NO: 8786337 - DNA, 22 bp, Homo sapiens
agacttaggagctgacatctct

SEQ ID NO: 8786338 - DNA, 22 bp, Homo sapiens
agactgtatgatttgagtttat

SEQ ID NO: 8786339 - DNA, 22 bp, Homo sapiens
agactgttaatttcaattaaaa

SEQ ID NO: 8786340 - DNA, 22 bp, Homo sapiens
agactgtaattgacatgtcagc

SEQ ID NO: 8786341 - DNA, 22 bp, Homo sapiens
agactgtactttctgcagctct

SEQ ID NO: 8786342 - DNA, 22 bp, Homo sapiens
agactgtagggatagaggtctt

SEQ ID NO: 8786343 - DNA, 22 bp, Homo sapiens
agactgtagcttctgtcttgag

SEQ ID NO: 8786344 - DNA, 22 bp, Homo sapiens
agactgtattcaaaatgtggtt

SEQ ID NO: 8786345 - DNA, 22 bp, Homo sapiens
agactgtgagaagatggctgcg

SEQ ID NO: 8786346 - DNA, 22 bp, Homo sapiens
agactgtactttctgcagctct

SEQ ID NO: 8786347 - DNA, 22 bp, Homo sapiens
agactgtaatttgtggcctcct

SEQ ID NO: 8786348 - DNA, 17 bp, Homo sapiens
agactgtactgtaaagc

SEQ ID NO: 8786349 - DNA, 18 bp, Homo sapiens
agactttgagttagaggg

SEQ ID NO: 8786350 - DNA, 22 bp, Homo sapiens
agactttcgtgttatgttgcct

SEQ ID NO: 8786351 - DNA, 22 bp, Homo sapiens
agactttctgtagcatctgtaa

SEQ ID NO: 8786352 - DNA, 22 bp, Homo sapiens
agactttatagtttttggctat

SEQ ID NO: 8786353 - DNA, 22 bp, Homo sapiens
agactttatagtttttggctat

SEQ ID NO: 8786354 - DNA, 22 bp, Homo sapiens
agactttagatacgtcttcttc

SEQ ID NO: 8786355 - DNA, 22 bp, Homo sapiens
agactttagaatcagatagcct

SEQ ID NO: 8786356 - DNA, 22 bp, Homo sapiens
agactttagaatcagatagcct

SEQ ID NO: 8786357 - DNA, 22 bp, Homo sapiens
agactttagaatcagatagcct

SEQ ID NO: 8786358 - DNA, 22 bp, Homo sapiens
agactttataaatcttaatttc

SEQ ID NO: 8786359 - DNA, 22 bp, Homo sapiens
agactttataaatcttaatttc

SEQ ID NO: 8786360 - DNA, 22 bp, Homo sapiens
agactttagggccatggtaggt

SEQ ID NO: 8786361 - DNA, 22 bp, Homo sapiens
agactttagggccatggtaggt

SEQ ID NO: 8786362 - DNA, 22 bp, Homo sapiens
agactttaatgtgcaaatgaaa

SEQ ID NO: 8786363 - DNA, 22 bp, Homo sapiens
agactttaatgtgcaaatgaaa

SEQ ID NO: 8786364 - DNA, 22 bp, Homo sapiens
agactttagaatcagatagcct

SEQ ID NO: 8786365 - DNA, 22 bp, Homo sapiens
agacttgggacctaggaatgga

SEQ ID NO: 8786366 - DNA, 22 bp, Homo sapiens
agacttgggacctaggaatgga

SEQ ID NO: 8786367 - DNA, 22 bp, Homo sapiens
agagaatgcagggcttcggaca

SEQ ID NO: 8786368 - DNA, 22 bp, Homo sapiens
agagaatctgggaagatgttaa

SEQ ID NO: 8786369 - DNA, 22 bp, Homo sapiens
agagaatctagaatgtttatac

SEQ ID NO: 8786370 - DNA, 22 bp, Homo sapiens
agagaatacagggtaacaggaa

SEQ ID NO: 8786371 - DNA, 23 bp, Homo sapiens
agagaatcatggaaactctttct

SEQ ID NO: 8786372 - DNA, 22 bp, Homo sapiens
agagaagtgtcatttcagtttt

SEQ ID NO: 8786373 - DNA, 22 bp, Homo sapiens
agagaagtgagcttgttcactc

SEQ ID NO: 8786374 - DNA, 22 bp, Homo sapiens
agagaatacaaagaagatatgt

SEQ ID NO: 8786375 - DNA, 22 bp, Homo sapiens
agagaatacaaagaagatatgt

SEQ ID NO: 8786376 - DNA, 22 bp, Homo sapiens
agagaagggtgtagcctgggcc

SEQ ID NO: 8786377 - DNA, 22 bp, Homo sapiens
agagaagggtgtagcctgggcc

SEQ ID NO: 8786378 - DNA, 22 bp, Homo sapiens
agagaagggtgtagcctgggcc

SEQ ID NO: 8786379 - DNA, 22 bp, Homo sapiens
agagaagggtgtagcctgggcc

SEQ ID NO: 8786380 - DNA, 22 bp, Homo sapiens
agagaagggtgtagcctgggcc

SEQ ID NO: 8786381 - DNA, 22 bp, Homo sapiens
agagaagggtgtagcctgggcc

SEQ ID NO: 8786382 - DNA, 22 bp, Homo sapiens
agagaaggtcactaaggaccca

SEQ ID NO: 8786383 - DNA, 22 bp, Homo sapiens
agagaaaactcattgaggtgtc

SEQ ID NO: 8786384 - DNA, 22 bp, Homo sapiens
agagaaaactcattgaggtgtc

SEQ ID NO: 8786385 - DNA, 23 bp, Homo sapiens
agagaaaaatatctgggcacatt

SEQ ID NO: 8786386 - DNA, 23 bp, Homo sapiens
agagaaaaatatctgggcacatt

SEQ ID NO: 8786387 - DNA, 23 bp, Homo sapiens
agagaaaaatatctgggcacatt

SEQ ID NO: 8786388 - DNA, 22 bp, Homo sapiens
agactttgagctcttagagaag

SEQ ID NO: 8786389 - DNA, 21 bp, Homo sapiens
agactttgcttgcagagagtc

SEQ ID NO: 8786390 - DNA, 19 bp, Homo sapiens
agacttttgtaagttgaga

SEQ ID NO: 8786391 - DNA, 22 bp, Homo sapiens
agagaaaagagttcaggctttg

SEQ ID NO: 8786392 - DNA, 22 bp, Homo sapiens
agagaaaagagttcaggctttg

SEQ ID NO: 8786393 - DNA, 22 bp, Homo sapiens
agagaaaagagttcaggctttg

SEQ ID NO: 8786394 - DNA, 22 bp, Homo sapiens
agagaaaagagttcaggctttg

SEQ ID NO: 8786395 - DNA, 22 bp, Homo sapiens
agagaagggtagcccattctcc

SEQ ID NO: 8786396 - DNA, 22 bp, Homo sapiens
agagaagggtagcccattctcc

SEQ ID NO: 8786397 - DNA, 22 bp, Homo sapiens
agagaagggtagcccattctcc

SEQ ID NO: 8786398 - DNA, 19 bp, Homo sapiens
agagaaggatcctatggtt

SEQ ID NO: 8786399 - DNA, 22 bp, Homo sapiens
agagagggcatagaaaaaggga

SEQ ID NO: 8786400 - DNA, 21 bp, Homo sapiens
agagagggagatgaaacatcc

SEQ ID NO: 8786401 - DNA, 21 bp, Homo sapiens
agagagggagatgaaacatcc

SEQ ID NO: 8786402 - DNA, 21 bp, Homo sapiens
agagagggagatgaaacatcc

SEQ ID NO: 8786403 - DNA, 22 bp, Homo sapiens
agagagggcatagaaaaaggga

SEQ ID NO: 8786404 - DNA, 22 bp, Homo sapiens
agagagggcatagaaaaaggga

SEQ ID NO: 8786405 - DNA, 22 bp, Homo sapiens
agagagggcatagaaaaaggga

SEQ ID NO: 8786406 - DNA, 22 bp, Homo sapiens
agagaggttaaggagctcttgt

SEQ ID NO: 8786407 - DNA, 19 bp, Homo sapiens
agagaggctgtgtgaggga

SEQ ID NO: 8786408 - DNA, 22 bp, Homo sapiens
agagagggaatatttggggtat

SEQ ID NO: 8786409 - DNA, 22 bp, Homo sapiens
agagaggctgggcgtagggctt

SEQ ID NO: 8786410 - DNA, 22 bp, Homo sapiens
agagaggctgggcgtagggctt

SEQ ID NO: 8786411 - DNA, 22 bp, Homo sapiens
agagaggctgggcgtagggctt

SEQ ID NO: 8786412 - DNA, 22 bp, Homo sapiens
agagaggctgggcgtagggctt

SEQ ID NO: 8786413 - DNA, 22 bp, Homo sapiens
agagagctgactttggagtcag

SEQ ID NO: 8786414 - DNA, 22 bp, Homo sapiens
agagagctctggctgggtgacc

SEQ ID NO: 8786415 - DNA, 22 bp, Homo sapiens
agagagcctgagtggcagctat

SEQ ID NO: 8786416 - DNA, 22 bp, Homo sapiens
agagagcctgagtggcagctat

SEQ ID NO: 8786417 - DNA, 22 bp, Homo sapiens
agagagcccgggccagggcaca

SEQ ID NO: 8786418 - DNA, 22 bp, Homo sapiens
agagaggcattcggtgatccca

SEQ ID NO: 8786419 - DNA, 22 bp, Homo sapiens
agagaggcattcggtgatccca

SEQ ID NO: 8786420 - DNA, 22 bp, Homo sapiens
agagaggatttgtttttctcct

SEQ ID NO: 8786421 - DNA, 22 bp, Homo sapiens
agagaggatttgtttttctcct

SEQ ID NO: 8786422 - DNA, 22 bp, Homo sapiens
agagaggatttgtttttctcct

SEQ ID NO: 8786423 - DNA, 22 bp, Homo sapiens
agagaggcgagttacctgtgct

SEQ ID NO: 8786424 - DNA, 22 bp, Homo sapiens
agagaggcgagttacctgtgct

SEQ ID NO: 8786425 - DNA, 22 bp, Homo sapiens
agagaggctgctggactatatg

SEQ ID NO: 8786426 - DNA, 22 bp, Homo sapiens
agagaggctgctggactatatg

SEQ ID NO: 8786427 - DNA, 22 bp, Homo sapiens
agagacaatgccaatgcacacg

SEQ ID NO: 8786428 - DNA, 22 bp, Homo sapiens
agagacaatgccaatgcacacg

SEQ ID NO: 8786429 - DNA, 19 bp, Homo sapiens
agagacacaggtaagtagg

SEQ ID NO: 8786430 - DNA, 22 bp, Homo sapiens
agagacaatgccaatgcacacg

SEQ ID NO: 8786431 - DNA, 22 bp, Homo sapiens
agagacacatcatataagtata

SEQ ID NO: 8786432 - DNA, 22 bp, Homo sapiens
agagacaatgccaatgcacacg

SEQ ID NO: 8786433 - DNA, 22 bp, Homo sapiens
agagaattaacattccatggct

SEQ ID NO: 8786434 - DNA, 22 bp, Homo sapiens
agagaattacagaagaatgtca

SEQ ID NO: 8786435 - DNA, 22 bp, Homo sapiens
agagaattacagaagaatgtca

SEQ ID NO: 8786436 - DNA, 22 bp, Homo sapiens
agagaattacagaagaatgtca

SEQ ID NO: 8786437 - DNA, 22 bp, Homo sapiens
agagaattctggtgctaacaag

SEQ ID NO: 8786438 - DNA, 21 bp, Homo sapiens
agagaattgccttagatgttc

SEQ ID NO: 8786439 - DNA, 22 bp, Homo sapiens
agagaattctggtgctaacaag

SEQ ID NO: 8786440 - DNA, 22 bp, Homo sapiens
agagaatttgagacttgcccaa

SEQ ID NO: 8786441 - DNA, 22 bp, Homo sapiens
agagacagacacatcgggctgc

SEQ ID NO: 8786442 - DNA, 22 bp, Homo sapiens
agagacaccgcgcatcatggct

SEQ ID NO: 8786443 - DNA, 22 bp, Homo sapiens
agagacagacacatcgggctgc

SEQ ID NO: 8786444 - DNA, 22 bp, Homo sapiens
agagagaagcaatcagtggcca

SEQ ID NO: 8786445 - DNA, 22 bp, Homo sapiens
agagacagacacatcgggctgc

SEQ ID NO: 8786446 - DNA, 21 bp, Homo sapiens
agagacagagaaagtaacatt

SEQ ID NO: 8786447 - DNA, 21 bp, Homo sapiens
agagacagagaaagtaacatt

SEQ ID NO: 8786448 - DNA, 21 bp, Homo sapiens
agagacagagaaagtaacatt

SEQ ID NO: 8786449 - DNA, 21 bp, Homo sapiens
agagacagagaaagtaacatt

SEQ ID NO: 8786450 - DNA, 22 bp, Homo sapiens
agagagcatggcacagaggggt

SEQ ID NO: 8786451 - DNA, 22 bp, Homo sapiens
agagagcatggcacagaggggt

SEQ ID NO: 8786452 - DNA, 22 bp, Homo sapiens
agagagcatggcacagaggggt

SEQ ID NO: 8786453 - DNA, 22 bp, Homo sapiens
agagcacagtatctgcacatca

SEQ ID NO: 8786454 - DNA, 22 bp, Homo sapiens
agagcacatggttcctgtgtcc

SEQ ID NO: 8786455 - DNA, 22 bp, Homo sapiens
agagcactgagtgagcaaggcc

SEQ ID NO: 8786456 - DNA, 22 bp, Homo sapiens
agagcactgagtgagcaaggcc

SEQ ID NO: 8786457 - DNA, 22 bp, Homo sapiens
agagcactgcgccggctcggaa

SEQ ID NO: 8786458 - DNA, 22 bp, Homo sapiens
agagcacggccaccatttacaa

SEQ ID NO: 8786459 - DNA, 22 bp, Homo sapiens
agagcactttcgagagccggag

SEQ ID NO: 8786460 - DNA, 22 bp, Homo sapiens
agagcagacatccttgtcttgt

SEQ ID NO: 8786461 - DNA, 22 bp, Homo sapiens
agagcactttcgagagccggag

SEQ ID NO: 8786462 - DNA, 22 bp, Homo sapiens
agagcagagtggctgtagcttg

SEQ ID NO: 8786463 - DNA, 22 bp, Homo sapiens
agagagttgaggaagcaacact

SEQ ID NO: 8786464 - DNA, 22 bp, Homo sapiens
agagcacaggctctggagtcta

SEQ ID NO: 8786465 - DNA, 22 bp, Homo sapiens
agagcacaggctctggagtcta

SEQ ID NO: 8786466 - DNA, 22 bp, Homo sapiens
agagcacaggctctggagtcta

SEQ ID NO: 8786467 - DNA, 22 bp, Homo sapiens
agagattgctagctggctttaa

SEQ ID NO: 8786468 - DNA, 22 bp, Homo sapiens
agagatttacacatgccttttc

SEQ ID NO: 8786469 - DNA, 22 bp, Homo sapiens
agagcacaggctctggagtcta

SEQ ID NO: 8786470 - DNA, 22 bp, Homo sapiens
agagcacaggtgctggagccca

SEQ ID NO: 8786471 - DNA, 22 bp, Homo sapiens
agagcacagtatctgcacatca

SEQ ID NO: 8786472 - DNA, 22 bp, Homo sapiens
agagcacagtgcaggatccccg

SEQ ID NO: 8786473 - DNA, 21 bp, Homo sapiens
agagcacaggtggacaatgct

SEQ ID NO: 8786474 - DNA, 22 bp, Homo sapiens
agagcccaggtcctggagaggg

SEQ ID NO: 8786475 - DNA, 22 bp, Homo sapiens
agagcccagtctttgtgtgaag

SEQ ID NO: 8786476 - DNA, 22 bp, Homo sapiens
agagcccatcagtggcagtgga

SEQ ID NO: 8786477 - DNA, 22 bp, Homo sapiens
agagcccatcagtggcagtgga

SEQ ID NO: 8786478 - DNA, 22 bp, Homo sapiens
agagcccctggtggagtgagaa

SEQ ID NO: 8786479 - DNA, 22 bp, Homo sapiens
agagcccctcggtggaggggtc

SEQ ID NO: 8786480 - DNA, 22 bp, Homo sapiens
agagcccagaaagtatgtcata

SEQ ID NO: 8786481 - DNA, 22 bp, Homo sapiens
agagcccaggcaggcatccagg

SEQ ID NO: 8786482 - DNA, 22 bp, Homo sapiens
agagccaggccaggccggggca

SEQ ID NO: 8786483 - DNA, 22 bp, Homo sapiens
agagccaggccaggccggggca

SEQ ID NO: 8786484 - DNA, 22 bp, Homo sapiens
agagccaggccaggccggggca

SEQ ID NO: 8786485 - DNA, 22 bp, Homo sapiens
agagccaggccaggccggggca

SEQ ID NO: 8786486 - DNA, 22 bp, Homo sapiens
agagcagatggccagggggcct

SEQ ID NO: 8786487 - DNA, 22 bp, Homo sapiens
agagcagcacgttgtccccaca

SEQ ID NO: 8786488 - DNA, 22 bp, Homo sapiens
agagcagatggagctggaagag

SEQ ID NO: 8786489 - DNA, 22 bp, Homo sapiens
agagcagatggccagggggcct

SEQ ID NO: 8786490 - DNA, 22 bp, Homo sapiens
agagcagatggagctggaagag

SEQ ID NO: 8786491 - DNA, 22 bp, Homo sapiens
agagccctggagggcagtcccg

SEQ ID NO: 8786492 - DNA, 22 bp, Homo sapiens
agagccctggagggcagtcccg

SEQ ID NO: 8786493 - DNA, 22 bp, Homo sapiens
agagcctctgtcatggagagaa

SEQ ID NO: 8786494 - DNA, 22 bp, Homo sapiens
agagcctctgtcatggagagaa

SEQ ID NO: 8786495 - DNA, 23 bp, Homo sapiens
agagcctgaaagacttctggcac

SEQ ID NO: 8786496 - DNA, 22 bp, Homo sapiens
agagccctttctccaggcacct

SEQ ID NO: 8786497 - DNA, 22 bp, Homo sapiens
agagccctttctccaggcacct

SEQ ID NO: 8786498 - DNA, 22 bp, Homo sapiens
agagccctcttcactgcccctt

SEQ ID NO: 8786499 - DNA, 22 bp, Homo sapiens
agagcccctggtggagtgagaa

SEQ ID NO: 8786500 - DNA, 22 bp, Homo sapiens
agagccctgacggggacagatg

SEQ ID NO: 8786501 - DNA, 22 bp, Homo sapiens
agagccctgaagcagagctaaa

SEQ ID NO: 8786502 - DNA, 22 bp, Homo sapiens
agagccctgagtcagttctgga

SEQ ID NO: 8786503 - DNA, 22 bp, Homo sapiens
agagccctgagtcagttctgga

SEQ ID NO: 8786504 - DNA, 22 bp, Homo sapiens
agagcctgcagctgtgaagaaa

SEQ ID NO: 8786505 - DNA, 22 bp, Homo sapiens
agagcctgaggtctaacagggg

SEQ ID NO: 8786506 - DNA, 22 bp, Homo sapiens
agagcctgaggccaggaaaatg

SEQ ID NO: 8786507 - DNA, 22 bp, Homo sapiens
agagcctgaggccctgagaggg

SEQ ID NO: 8786508 - DNA, 22 bp, Homo sapiens
agagcctgaggccctgagaggg

SEQ ID NO: 8786509 - DNA, 22 bp, Homo sapiens
agagcctgaggccctgagaggg

SEQ ID NO: 8786510 - DNA, 22 bp, Homo sapiens
agagcctgaggccctgagaggg

SEQ ID NO: 8786511 - DNA, 21 bp, Homo sapiens
agagcctgagatcttccagca

SEQ ID NO: 8786512 - DNA, 21 bp, Homo sapiens
agagcctgagatcttccagca

SEQ ID NO: 8786513 - DNA, 21 bp, Homo sapiens
agagcctgagatcttccagca

SEQ ID NO: 8786514 - DNA, 21 bp, Homo sapiens
agagcctgagatcttccagca

SEQ ID NO: 8786515 - DNA, 22 bp, Homo sapiens
agagcctgagaggataatgggg

SEQ ID NO: 8786516 - DNA, 23 bp, Homo sapiens
agagcctgaaagacttctggcac

SEQ ID NO: 8786517 - DNA, 22 bp, Homo sapiens
agagcctgaggatgtcccagct

SEQ ID NO: 8786518 - DNA, 22 bp, Homo sapiens
agagcctgaggatgtcccagct

SEQ ID NO: 8786519 - DNA, 22 bp, Homo sapiens
agagcctgagcctgaaagccct

SEQ ID NO: 8786520 - DNA, 22 bp, Homo sapiens
agagctggccagggatcactct

SEQ ID NO: 8786521 - DNA, 22 bp, Homo sapiens
agagctggccagggatcactct

SEQ ID NO: 8786522 - DNA, 22 bp, Homo sapiens
agagctggccagggatcactct

SEQ ID NO: 8786523 - DNA, 22 bp, Homo sapiens
agagctggcagcagcttctcct

SEQ ID NO: 8786524 - DNA, 22 bp, Homo sapiens
agagctggctgctgcggtgctt

SEQ ID NO: 8786525 - DNA, 21 bp, Homo sapiens
agagctggcctgccaggccct

SEQ ID NO: 8786526 - DNA, 22 bp, Homo sapiens
agagctggctgtgggtgacttt

SEQ ID NO: 8786527 - DNA, 22 bp, Homo sapiens
agagctggctgtgggtgacttt

SEQ ID NO: 8786528 - DNA, 22 bp, Homo sapiens
agagctggctggtagccctgat

SEQ ID NO: 8786529 - DNA, 22 bp, Homo sapiens
agagctggctggtagccctgat

SEQ ID NO: 8786530 - DNA, 22 bp, Homo sapiens
agagctggctggtagccctgat

SEQ ID NO: 8786531 - DNA, 22 bp, Homo sapiens
agagctggctgctgcggtgctt

SEQ ID NO: 8786532 - DNA, 22 bp, Homo sapiens
agagctggctgctgcggtgctt

SEQ ID NO: 8786533 - DNA, 22 bp, Homo sapiens
agagctggctgctgcggtgctt

SEQ ID NO: 8786534 - DNA, 22 bp, Homo sapiens
agagctggctgctgcggtgctt

SEQ ID NO: 8786535 - DNA, 22 bp, Homo sapiens
agagctggatggtcaagatggc

SEQ ID NO: 8786536 - DNA, 22 bp, Homo sapiens
agagctggcactgaccctcacc

SEQ ID NO: 8786537 - DNA, 22 bp, Homo sapiens
agagctggcagcagcttctcct

SEQ ID NO: 8786538 - DNA, 22 bp, Homo sapiens
agagctggcagcagcttctcct

SEQ ID NO: 8786539 - DNA, 22 bp, Homo sapiens
agagctggatggtcaagatggc

SEQ ID NO: 8786540 - DNA, 22 bp, Homo sapiens
agagctggatggtcaagatggc

SEQ ID NO: 8786541 - DNA, 22 bp, Homo sapiens
agagctggagcagccccactgg

SEQ ID NO: 8786542 - DNA, 22 bp, Homo sapiens
agagctggagcagccccactgg

SEQ ID NO: 8786543 - DNA, 22 bp, Homo sapiens
agagctggacgtctgagcccta

SEQ ID NO: 8786544 - DNA, 22 bp, Homo sapiens
agagctggacgtctgagcccta

SEQ ID NO: 8786545 - DNA, 22 bp, Homo sapiens
agagctgaaaaagctgacccgg

SEQ ID NO: 8786546 - DNA, 22 bp, Homo sapiens
agatataataatttacaagtgt

SEQ ID NO: 8786547 - DNA, 22 bp, Homo sapiens
agatattaggaggattcataat

SEQ ID NO: 8786548 - DNA, 22 bp, Homo sapiens
agatatttgtatcttgctattg

SEQ ID NO: 8786549 - DNA, 22 bp, Homo sapiens
agatattgtgcatactgctgtt

SEQ ID NO: 8786550 - DNA, 22 bp, Homo sapiens
agatatttaaatcagacaaaga

SEQ ID NO: 8786551 - DNA, 22 bp, Homo sapiens
agatatttaaatcagacaaaga

SEQ ID NO: 8786552 - DNA, 22 bp, Homo sapiens
agatcactgaattgaaagtaat

SEQ ID NO: 8786553 - DNA, 22 bp, Homo sapiens
agatcacagttctctattcgta

SEQ ID NO: 8786554 - DNA, 22 bp, Homo sapiens
agatcacataatttcctgtgac

SEQ ID NO: 8786555 - DNA, 23 bp, Homo sapiens
agatcacatagttatcagatgac

SEQ ID NO: 8786556 - DNA, 23 bp, Homo sapiens
agatcacatagttatcagatgac

SEQ ID NO: 8786557 - DNA, 23 bp, Homo sapiens
agatcacatgctgatggaaaatg

SEQ ID NO: 8786558 - DNA, 22 bp, Homo sapiens
agatcacagtggcaactccctt

SEQ ID NO: 8786559 - DNA, 22 bp, Homo sapiens
agatcacagtggcaactccctt

SEQ ID NO: 8786560 - DNA, 22 bp, Homo sapiens
agatcacagtcaattgcaagtt

SEQ ID NO: 8786561 - DNA, 22 bp, Homo sapiens
agatcaaaaacttaatggcttt

SEQ ID NO: 8786562 - DNA, 22 bp, Homo sapiens
agatattttgtgtgatgtttca

SEQ ID NO: 8786563 - DNA, 22 bp, Homo sapiens
agatattttgtgtgatgtttca

SEQ ID NO: 8786564 - DNA, 22 bp, Homo sapiens
agatcaaatctgggatttctaa

SEQ ID NO: 8786565 - DNA, 22 bp, Homo sapiens
agatcaaatctgggatttctaa

SEQ ID NO: 8786566 - DNA, 22 bp, Homo sapiens
agatcacagcccccagatgcca

SEQ ID NO: 8786567 - DNA, 22 bp, Homo sapiens
agatcacagcccccagatgcca

SEQ ID NO: 8786568 - DNA, 22 bp, Homo sapiens
agatcacagagccaagattcca

SEQ ID NO: 8786569 - DNA, 22 bp, Homo sapiens
attggccatttgcatgtattat

SEQ ID NO: 8786570 - DNA, 22 bp, Homo sapiens
attggccatttgcatgtattat

SEQ ID NO: 8786571 - DNA, 22 bp, Homo sapiens
attggcctaaagaaatgacaga

SEQ ID NO: 8786572 - DNA, 22 bp, Homo sapiens
agagtggcagcaagtcaggtag

SEQ ID NO: 8786573 - DNA, 20 bp, Homo sapiens
attggctggggttctgatgc

SEQ ID NO: 8786574 - DNA, 22 bp, Homo sapiens
attggctccttctaacatgtct

SEQ ID NO: 8786575 - DNA, 22 bp, Homo sapiens
attggctccctgtgatctggtg

SEQ ID NO: 8786576 - DNA, 22 bp, Homo sapiens
attggctttcttttgtgaaaat

SEQ ID NO: 8786577 - DNA, 22 bp, Homo sapiens
attggctttgatatctaaaggg

SEQ ID NO: 8786578 - DNA, 22 bp, Homo sapiens
agagtggcagcaaaaagtgtgc

SEQ ID NO: 8786579 - DNA, 21 bp, Homo sapiens
agagtggcaaagtgtccaaga

SEQ ID NO: 8786580 - DNA, 22 bp, Homo sapiens
agagtggcaccttacctgagac

SEQ ID NO: 8786581 - DNA, 22 bp, Homo sapiens
attggcataggttaaacagcgg

SEQ ID NO: 8786582 - DNA, 22 bp, Homo sapiens
agagtggcagtaaaatagagca

SEQ ID NO: 8786583 - DNA, 22 bp, Homo sapiens
attgggatgccggctgataaga

SEQ ID NO: 8786584 - DNA, 22 bp, Homo sapiens
attgggatgccggctgataaga

SEQ ID NO: 8786585 - DNA, 22 bp, Homo sapiens
attggtagttttgtatttctct

SEQ ID NO: 8786586 - DNA, 22 bp, Homo sapiens
attggggagagctaatatttta

SEQ ID NO: 8786587 - DNA, 22 bp, Homo sapiens
attggtatgtattctgaaaact

SEQ ID NO: 8786588 - DNA, 22 bp, Homo sapiens
attggtagttttgtatttctct

SEQ ID NO: 8786589 - DNA, 22 bp, Homo sapiens
attggtctggggaaatgaagag

SEQ ID NO: 8786590 - DNA, 22 bp, Homo sapiens
attggtctggggaaatgaagag

SEQ ID NO: 8786591 - DNA, 22 bp, Homo sapiens
attggtctctagagtctattgt

SEQ ID NO: 8786592 - DNA, 22 bp, Homo sapiens
attggtctctgctaaagggagg

SEQ ID NO: 8786593 - DNA, 22 bp, Homo sapiens
attggtctaggctttaaaaaga

SEQ ID NO: 8786594 - DNA, 22 bp, Homo sapiens
attggtctccacttgttttaga

SEQ ID NO: 8786595 - DNA, 22 bp, Homo sapiens
attggtctaaagttaagaagat

SEQ ID NO: 8786596 - DNA, 22 bp, Homo sapiens
agatcagaaagccaatatcata

SEQ ID NO: 8786597 - DNA, 22 bp, Homo sapiens
agatcagagatgctaaaagagc

SEQ ID NO: 8786598 - DNA, 22 bp, Homo sapiens
agatcagagatgctaaaagagc

SEQ ID NO: 8786599 - DNA, 22 bp, Homo sapiens
agatcagactttgtgactagga

SEQ ID NO: 8786600 - DNA, 22 bp, Homo sapiens
agatcagagtggattgtgctgc

SEQ ID NO: 8786601 - DNA, 22 bp, Homo sapiens
agatcagatctccttttgcatt

SEQ ID NO: 8786602 - DNA, 22 bp, Homo sapiens
agatccagatccttcctggttg

SEQ ID NO: 8786603 - DNA, 22 bp, Homo sapiens
agatccaggatgtcccaaaata

SEQ ID NO: 8786604 - DNA, 21 bp, Homo sapiens
agatgctgtgctccaggagca

SEQ ID NO: 8786605 - DNA, 21 bp, Homo sapiens
agatgctgtgctccaggagca

SEQ ID NO: 8786606 - DNA, 22 bp, Homo sapiens
agatgctgtgtctgttcccttg

SEQ ID NO: 8786607 - DNA, 22 bp, Homo sapiens
agatggagaccttggatgaact

SEQ ID NO: 8786608 - DNA, 22 bp, Homo sapiens
agatggaaaatatagacagaga

SEQ ID NO: 8786609 - DNA, 22 bp, Homo sapiens
agatgctttcctgatatttatg

SEQ ID NO: 8786610 - DNA, 22 bp, Homo sapiens
agatgctgtgaggaagctagga

SEQ ID NO: 8786611 - DNA, 22 bp, Homo sapiens
agatgctgtcttgctggctttg

SEQ ID NO: 8786612 - DNA, 22 bp, Homo sapiens
agatgctgtcttgctggctttg

SEQ ID NO: 8786613 - DNA, 22 bp, Homo sapiens
agatgctgggatgcttggatgg

SEQ ID NO: 8786614 - DNA, 22 bp, Homo sapiens
agatgctgtcacacacactgtt

SEQ ID NO: 8786615 - DNA, 22 bp, Homo sapiens
agatgctgtcacacacactgtt

SEQ ID NO: 8786616 - DNA, 22 bp, Homo sapiens
agatgctgggaggctgagtgca

SEQ ID NO: 8786617 - DNA, 22 bp, Homo sapiens
agatgctggggcccctcggatg

SEQ ID NO: 8786618 - DNA, 17 bp, Homo sapiens
agatgctggccacatgt

SEQ ID NO: 8786619 - DNA, 22 bp, Homo sapiens
agatgctggatggaaaatgatc

SEQ ID NO: 8786620 - DNA, 22 bp, Homo sapiens
agatgcactataaaagcatctt

SEQ ID NO: 8786621 - DNA, 22 bp, Homo sapiens
agatggcagcagaacaaacagg

SEQ ID NO: 8786622 - DNA, 17 bp, Homo sapiens
agatggcaggaggcaga

SEQ ID NO: 8786623 - DNA, 17 bp, Homo sapiens
agatggcaggaggcaga

SEQ ID NO: 8786624 - DNA, 22 bp, Homo sapiens
agatggagttgtagcagtgact

SEQ ID NO: 8786625 - DNA, 22 bp, Homo sapiens
agatggagttgtagcagtgact

SEQ ID NO: 8786626 - DNA, 22 bp, Homo sapiens
agatggagttgtagcagtgact

SEQ ID NO: 8786627 - DNA, 22 bp, Homo sapiens
agatggagttgtagcagtgact

SEQ ID NO: 8786628 - DNA, 22 bp, Homo sapiens
agatggagtggagatgagtaaa

SEQ ID NO: 8786629 - DNA, 22 bp, Homo sapiens
agatggagtggagatgagtaaa

SEQ ID NO: 8786630 - DNA, 22 bp, Homo sapiens
agatggagttagtaccagagtc

SEQ ID NO: 8786631 - DNA, 22 bp, Homo sapiens
agatggagtggagatgagtaaa

SEQ ID NO: 8786632 - DNA, 22 bp, Homo sapiens
agatggagttagtaccagagtc

SEQ ID NO: 8786633 - DNA, 22 bp, Homo sapiens
agatggagaccttggatgaact

SEQ ID NO: 8786634 - DNA, 22 bp, Homo sapiens
agatggagaccttggatgaact

SEQ ID NO: 8786635 - DNA, 22 bp, Homo sapiens
agatggagtctcactcttgttg

SEQ ID NO: 8786636 - DNA, 22 bp, Homo sapiens
agatggaggaaggctgaactca

SEQ ID NO: 8786637 - DNA, 22 bp, Homo sapiens
agatgggccttcgagcatgccc

SEQ ID NO: 8786638 - DNA, 19 bp, Homo sapiens
agatggcttggactgaaaa

SEQ ID NO: 8786639 - DNA, 22 bp, Homo sapiens
agatggcttccttctcactgtg

SEQ ID NO: 8786640 - DNA, 22 bp, Homo sapiens
agatggctggaggtagatgctc

SEQ ID NO: 8786641 - DNA, 22 bp, Homo sapiens
agatggctgatggcaggagcca

SEQ ID NO: 8786642 - DNA, 22 bp, Homo sapiens
agatggctgattaactccatgg

SEQ ID NO: 8786643 - DNA, 22 bp, Homo sapiens
agatggcttagcctggctccca

SEQ ID NO: 8786644 - DNA, 22 bp, Homo sapiens
agatggctgggctcgtccgcag

SEQ ID NO: 8786645 - DNA, 22 bp, Homo sapiens
agatggctgggccccaccccag

SEQ ID NO: 8786646 - DNA, 22 bp, Homo sapiens
agatggctagattgcaagaact

SEQ ID NO: 8786647 - DNA, 17 bp, Homo sapiens
agatggcctctaagatt

SEQ ID NO: 8786648 - DNA, 22 bp, Homo sapiens
agatggcaggccctgtgggggt

SEQ ID NO: 8786649 - DNA, 17 bp, Homo sapiens
agatggcaggaggcaga

SEQ ID NO: 8786650 - DNA, 21 bp, Homo sapiens
agatggctcccaggtctctgg

SEQ ID NO: 8786651 - DNA, 22 bp, Homo sapiens
agatggctgatggcaggagcca

SEQ ID NO: 8786652 - DNA, 22 bp, Homo sapiens
agatggctgatggcaggagcca

SEQ ID NO: 8786653 - DNA, 22 bp, Homo sapiens
caaagattttagaatttgcaat

SEQ ID NO: 8786654 - DNA, 22 bp, Homo sapiens
caaagatatgacatggaaaatg

SEQ ID NO: 8786655 - DNA, 22 bp, Homo sapiens
caaagatgtcattggtaagaca

SEQ ID NO: 8786656 - DNA, 22 bp, Homo sapiens
caaagatgtcattggtaagaca

SEQ ID NO: 8786657 - DNA, 22 bp, Homo sapiens
caaagatgtcattggtaagaca

SEQ ID NO: 8786658 - DNA, 22 bp, Homo sapiens
caaagatgccaaaaggaagaca

SEQ ID NO: 8786659 - DNA, 22 bp, Homo sapiens
caaagatgccaaaaggaagaca

SEQ ID NO: 8786660 - DNA, 22 bp, Homo sapiens
caaagatgccaaaaggaagaca

SEQ ID NO: 8786661 - DNA, 22 bp, Homo sapiens
caaagatgccaaaaggaagaca

SEQ ID NO: 8786662 - DNA, 22 bp, Homo sapiens
caaagatgctgatgttggatca

SEQ ID NO: 8786663 - DNA, 22 bp, Homo sapiens
caaagatgctgatgttggatca

SEQ ID NO: 8786664 - DNA, 22 bp, Homo sapiens
caaagatatgacatggaaaatg

SEQ ID NO: 8786665 - DNA, 23 bp, Homo sapiens
caaagatgattggaacatggctt

SEQ ID NO: 8786666 - DNA, 23 bp, Homo sapiens
caaagatgattggaacatggctt

SEQ ID NO: 8786667 - DNA, 20 bp, Homo sapiens
agcaagagtaaggacagcga

SEQ ID NO: 8786668 - DNA, 20 bp, Homo sapiens
agcaagagtgtacctggcca

SEQ ID NO: 8786669 - DNA, 17 bp, Homo sapiens
caaaccagtaagactgc

SEQ ID NO: 8786670 - DNA, 22 bp, Homo sapiens
caaaccagtaggaagtctatta

SEQ ID NO: 8786671 - DNA, 22 bp, Homo sapiens
caaaccagtaggaagtctatta

SEQ ID NO: 8786672 - DNA, 22 bp, Homo sapiens
caaagataatcacagaataccc

SEQ ID NO: 8786673 - DNA, 22 bp, Homo sapiens
caaagcaagggctgaagactcc

SEQ ID NO: 8786674 - DNA, 22 bp, Homo sapiens
caaagcaagggctgaagactcc

SEQ ID NO: 8786675 - DNA, 22 bp, Homo sapiens
caaagcaagggctgaagactcc

SEQ ID NO: 8786676 - DNA, 22 bp, Homo sapiens
caaagcaagggctgaagactcc

SEQ ID NO: 8786677 - DNA, 22 bp, Homo sapiens
caaagcaagggctgaagactcc

SEQ ID NO: 8786678 - DNA, 22 bp, Homo sapiens
caaagcaaggctcagtttgaac

SEQ ID NO: 8786679 - DNA, 22 bp, Homo sapiens
caaagcaaggctcagtttgaac

SEQ ID NO: 8786680 - DNA, 22 bp, Homo sapiens
caaagcaaggctcagtttgaac

SEQ ID NO: 8786681 - DNA, 22 bp, Homo sapiens
caaagcaaggctcagtttgaac

SEQ ID NO: 8786682 - DNA, 22 bp, Homo sapiens
caaagcaaggctcagtttgaac

SEQ ID NO: 8786683 - DNA, 22 bp, Homo sapiens
caaagcaaggctcagtttgaac

SEQ ID NO: 8786684 - DNA, 22 bp, Homo sapiens
caaaggcaggtgctgaatattc

SEQ ID NO: 8786685 - DNA, 22 bp, Homo sapiens
caaaggcaggtgctgaatattc

SEQ ID NO: 8786686 - DNA, 22 bp, Homo sapiens
caaaggcaggtgctgaatattc

SEQ ID NO: 8786687 - DNA, 22 bp, Homo sapiens
caaaggcaggtgctgaatattc

SEQ ID NO: 8786688 - DNA, 22 bp, Homo sapiens
caaaggcaggtcatggccactt

SEQ ID NO: 8786689 - DNA, 22 bp, Homo sapiens
caaaggcaggtcatggccactt

SEQ ID NO: 8786690 - DNA, 22 bp, Homo sapiens
caaaggcaggtcatggccactt

SEQ ID NO: 8786691 - DNA, 22 bp, Homo sapiens
caaagcagaaggttctgtggta

SEQ ID NO: 8786692 - DNA, 22 bp, Homo sapiens
agcaacaggaccatggagccca

SEQ ID NO: 8786693 - DNA, 18 bp, Homo sapiens
agcaacaggatcccaggg

SEQ ID NO: 8786694 - DNA, 18 bp, Homo sapiens
agcaacaggatcccaggg

SEQ ID NO: 8786695 - DNA, 22 bp, Homo sapiens
agcaacaggcataatgtgttga

SEQ ID NO: 8786696 - DNA, 18 bp, Homo sapiens
agcaacaggatcccaggg

SEQ ID NO: 8786697 - DNA, 22 bp, Homo sapiens
agcaacagggggatggccactg

SEQ ID NO: 8786698 - DNA, 22 bp, Homo sapiens
agcaacagggtggtcttcagaa

SEQ ID NO: 8786699 - DNA, 22 bp, Homo sapiens
agcaacagggtggtcttcagaa

SEQ ID NO: 8786700 - DNA, 22 bp, Homo sapiens
agcaacagggggatggccactg

SEQ ID NO: 8786701 - DNA, 22 bp, Homo sapiens
agcaacaggtttattatcttat

SEQ ID NO: 8786702 - DNA, 22 bp, Homo sapiens
agcaacatttttcaattaacat

SEQ ID NO: 8786703 - DNA, 22 bp, Homo sapiens
agcaacagtgtatatcataggc

SEQ ID NO: 8786704 - DNA, 22 bp, Homo sapiens
agcaacagtgtatatcataggc

SEQ ID NO: 8786705 - DNA, 19 bp, Homo sapiens
agcaacctgtcagagatgc

SEQ ID NO: 8786706 - DNA, 22 bp, Homo sapiens
agcaactgggctcattttttaa

SEQ ID NO: 8786707 - DNA, 22 bp, Homo sapiens
agcaagaagggcaaggaagttt

SEQ ID NO: 8786708 - DNA, 22 bp, Homo sapiens
agcaagaagggcaaggaagttt

SEQ ID NO: 8786709 - DNA, 21 bp, Homo sapiens
agcaagaatcaggaaggctct

SEQ ID NO: 8786710 - DNA, 22 bp, Homo sapiens
agcaagaatatttctgccactg

SEQ ID NO: 8786711 - DNA, 22 bp, Homo sapiens
agcaagaatatttctgccactg

SEQ ID NO: 8786712 - DNA, 22 bp, Homo sapiens
agcaagaaaatctctgtccaat

SEQ ID NO: 8786713 - DNA, 22 bp, Homo sapiens
agcaacttttctagacatggtc

SEQ ID NO: 8786714 - DNA, 22 bp, Homo sapiens
agcaagaaaatctctgtccaat

SEQ ID NO: 8786715 - DNA, 22 bp, Homo sapiens
agcaactgttacaagaacaaca

SEQ ID NO: 8786716 - DNA, 22 bp, Homo sapiens
agcaacttctacagatatagca

SEQ ID NO: 8786717 - DNA, 17 bp, Homo sapiens
agcaacttctcccacag

SEQ ID NO: 8786718 - DNA, 22 bp, Homo sapiens
agcaactttattccactgggca

SEQ ID NO: 8786719 - DNA, 22 bp, Homo sapiens
agcaactttgagatagacttag

SEQ ID NO: 8786720 - DNA, 22 bp, Homo sapiens
agcaagaagctttgctgtgata

SEQ ID NO: 8786721 - DNA, 20 bp, Homo sapiens
agcaagaacgttctgaggga

SEQ ID NO: 8786722 - DNA, 22 bp, Homo sapiens
agcaagaaatcttcagtgttct

SEQ ID NO: 8786723 - DNA, 22 bp, Homo sapiens
agcaagaagctttgctgtgata

SEQ ID NO: 8786724 - DNA, 22 bp, Homo sapiens
agcaagaagctttgctgtgata

SEQ ID NO: 8786725 - DNA, 22 bp, Homo sapiens
attttatctgcttactttcagg

SEQ ID NO: 8786726 - DNA, 22 bp, Homo sapiens
attttatccccactggattaca

SEQ ID NO: 8786727 - DNA, 22 bp, Homo sapiens
attttatctgcttactttcagg

SEQ ID NO: 8786728 - DNA, 22 bp, Homo sapiens
attttcaaaacatctgctgtgt

SEQ ID NO: 8786729 - DNA, 22 bp, Homo sapiens
attttagatttaagaataaggt

SEQ ID NO: 8786730 - DNA, 22 bp, Homo sapiens
attttaaccctcttatatatac

SEQ ID NO: 8786731 - DNA, 22 bp, Homo sapiens
attttagatttaagaataaggt

SEQ ID NO: 8786732 - DNA, 22 bp, Homo sapiens
attttaaccctcttatatatac

SEQ ID NO: 8786733 - DNA, 22 bp, Homo sapiens
attttagctgtccagtggattg

SEQ ID NO: 8786734 - DNA, 22 bp, Homo sapiens
attttagtacctcaagtatcca

SEQ ID NO: 8786735 - DNA, 22 bp, Homo sapiens
attttagcagttctctaatttc

SEQ ID NO: 8786736 - DNA, 22 bp, Homo sapiens
attttagcaaatgcaagatgga

SEQ ID NO: 8786737 - DNA, 23 bp, Homo sapiens
attttagctgaatgacttcttta

SEQ ID NO: 8786738 - DNA, 22 bp, Homo sapiens
attttagctgtccagtggattg

SEQ ID NO: 8786739 - DNA, 22 bp, Homo sapiens
attttcaagggagaggcctctg

SEQ ID NO: 8786740 - DNA, 22 bp, Homo sapiens
agatgtggcctttgggagatta

SEQ ID NO: 8786741 - DNA, 22 bp, Homo sapiens
agatgtggccggctagggagag

SEQ ID NO: 8786742 - DNA, 22 bp, Homo sapiens
agatgtggcctttgggagatta

SEQ ID NO: 8786743 - DNA, 22 bp, Homo sapiens
agatgtggccggctagggagag

SEQ ID NO: 8786744 - DNA, 22 bp, Homo sapiens
agatgtggccggctagggagag

SEQ ID NO: 8786745 - DNA, 22 bp, Homo sapiens
agatgtggatcctagggtagaa

SEQ ID NO: 8786746 - DNA, 22 bp, Homo sapiens
agatgtggatcctagggtagaa

SEQ ID NO: 8786747 - DNA, 22 bp, Homo sapiens
agatgtgtttctagttcctgca

SEQ ID NO: 8786748 - DNA, 22 bp, Homo sapiens
agatgtgtttctagttcctgca

SEQ ID NO: 8786749 - DNA, 22 bp, Homo sapiens
agatgtgtttctagttcctgca

SEQ ID NO: 8786750 - DNA, 22 bp, Homo sapiens
agatgtggtagttgaagggaag

SEQ ID NO: 8786751 - DNA, 22 bp, Homo sapiens
agatgtgggcaatggaatggag

SEQ ID NO: 8786752 - DNA, 22 bp, Homo sapiens
agatgtgggcaatggaatggag

SEQ ID NO: 8786753 - DNA, 22 bp, Homo sapiens
agatgtgggtgtcaggcagtga

SEQ ID NO: 8786754 - DNA, 22 bp, Homo sapiens
agatgtgtttctagttcctgca

SEQ ID NO: 8786755 - DNA, 22 bp, Homo sapiens
agatgttcctagatgcgtgggc

SEQ ID NO: 8786756 - DNA, 22 bp, Homo sapiens
agatgttccagccaatgggaat

SEQ ID NO: 8786757 - DNA, 18 bp, Homo sapiens
agatgttcaatatttctc

SEQ ID NO: 8786758 - DNA, 22 bp, Homo sapiens
agcaaagctatctctatggaga

SEQ ID NO: 8786759 - DNA, 22 bp, Homo sapiens
agcaaatattttgttgaagtgc

SEQ ID NO: 8786760 - DNA, 22 bp, Homo sapiens
agcaacagaagatagagtgaat

SEQ ID NO: 8786761 - DNA, 22 bp, Homo sapiens
agcaacagaagatagagtgaat

SEQ ID NO: 8786762 - DNA, 22 bp, Homo sapiens
agcaacagccctgaggttcatg

SEQ ID NO: 8786763 - DNA, 22 bp, Homo sapiens
agcaacaggaaatagctgatta

SEQ ID NO: 8786764 - DNA, 22 bp, Homo sapiens
agcaacaggaaatagctgatta

SEQ ID NO: 8786765 - DNA, 22 bp, Homo sapiens
agcaacagccctgaggttcatg

SEQ ID NO: 8786766 - DNA, 22 bp, Homo sapiens
agcaacacgcagtagtatacga

SEQ ID NO: 8786767 - DNA, 19 bp, Homo sapiens
agcaacaccgtttatttcc

SEQ ID NO: 8786768 - DNA, 22 bp, Homo sapiens
agcaaattcagaagcagaatgg

SEQ ID NO: 8786769 - DNA, 20 bp, Homo sapiens
agcaacaataaaatgtcctg

SEQ ID NO: 8786770 - DNA, 22 bp, Homo sapiens
agcaaatcagctgctcaggaaa

SEQ ID NO: 8786771 - DNA, 22 bp, Homo sapiens
attacacactcaagtcctgtta

SEQ ID NO: 8786772 - DNA, 22 bp, Homo sapiens
attacacaggatttgccttact

SEQ ID NO: 8786773 - DNA, 22 bp, Homo sapiens
attacacagcggttactactag

SEQ ID NO: 8786774 - DNA, 22 bp, Homo sapiens
attacacagcggttactactag

SEQ ID NO: 8786775 - DNA, 22 bp, Homo sapiens
attacactaatgtgacaacaat

SEQ ID NO: 8786776 - DNA, 22 bp, Homo sapiens
attacactaatgtgacaacaat

SEQ ID NO: 8786777 - DNA, 22 bp, Homo sapiens
attacacatagacattcgttca

SEQ ID NO: 8786778 - DNA, 22 bp, Homo sapiens
attacacatagacattcgttca

SEQ ID NO: 8786779 - DNA, 22 bp, Homo sapiens
attacacaggctggctctttga

SEQ ID NO: 8786780 - DNA, 22 bp, Homo sapiens
attacacaggctggctctttga

SEQ ID NO: 8786781 - DNA, 22 bp, Homo sapiens
agaggcaccatctggaacagcc

SEQ ID NO: 8786782 - DNA, 22 bp, Homo sapiens
agaggcacccgcgcgcggccat

SEQ ID NO: 8786783 - DNA, 22 bp, Homo sapiens
agaggcacggaggctgcatgga

SEQ ID NO: 8786784 - DNA, 22 bp, Homo sapiens
agaggcactaagggaagagcag

SEQ ID NO: 8786785 - DNA, 22 bp, Homo sapiens
agaggcactaagggaagagcag

SEQ ID NO: 8786786 - DNA, 22 bp, Homo sapiens
attacagtaacagctacaatgc

SEQ ID NO: 8786787 - DNA, 22 bp, Homo sapiens
attacagtaacagctacaatgc

SEQ ID NO: 8786788 - DNA, 22 bp, Homo sapiens
attacagtaacagctacaatgc

SEQ ID NO: 8786789 - DNA, 23 bp, Homo sapiens
agaggcaggagtggcttgcccgg

SEQ ID NO: 8786790 - DNA, 23 bp, Homo sapiens
agaggcaggagtggcttgcccgg

SEQ ID NO: 8786791 - DNA, 22 bp, Homo sapiens
agaggcaggaggttgacttgag

SEQ ID NO: 8786792 - DNA, 22 bp, Homo sapiens
attacagtaacagctacaatgc

SEQ ID NO: 8786793 - DNA, 22 bp, Homo sapiens
attacagtaacagctacaatgc

SEQ ID NO: 8786794 - DNA, 22 bp, Homo sapiens
attacagtaaatgctacaggca

SEQ ID NO: 8786795 - DNA, 22 bp, Homo sapiens
attacagatagactttgaagct

SEQ ID NO: 8786796 - DNA, 22 bp, Homo sapiens
attacagatagactttgaagct

SEQ ID NO: 8786797 - DNA, 22 bp, Homo sapiens
attacagaagatatgctcaaca

SEQ ID NO: 8786798 - DNA, 22 bp, Homo sapiens
attacacttgttcatcatcacc

SEQ ID NO: 8786799 - DNA, 22 bp, Homo sapiens
attacagaagatatgctcaaca

SEQ ID NO: 8786800 - DNA, 22 bp, Homo sapiens
agagctggctgtgggtgacttt

SEQ ID NO: 8786801 - DNA, 22 bp, Homo sapiens
agagctggctgtgggtgacttt

SEQ ID NO: 8786802 - DNA, 22 bp, Homo sapiens
agagctggctgtgggtgacttt

SEQ ID NO: 8786803 - DNA, 22 bp, Homo sapiens
agagctggctgtgggtgacttt

SEQ ID NO: 8786804 - DNA, 22 bp, Homo sapiens
agagctggctgtgggtgacttt

SEQ ID NO: 8786805 - DNA, 20 bp, Homo sapiens
agagctgggaagctccctat

SEQ ID NO: 8786806 - DNA, 22 bp, Homo sapiens
agagctgggaccgtctggaagt

SEQ ID NO: 8786807 - DNA, 20 bp, Homo sapiens
agagctgggaagctccctat

SEQ ID NO: 8786808 - DNA, 21 bp, Homo sapiens
agagctgggacttgcctgaga

SEQ ID NO: 8786809 - DNA, 22 bp, Homo sapiens
agagctgggaccgtctggaagt

SEQ ID NO: 8786810 - DNA, 22 bp, Homo sapiens
agagctgggaccgtctggaagt

SEQ ID NO: 8786811 - DNA, 22 bp, Homo sapiens
agagctgggaccgtctggaagt

SEQ ID NO: 8786812 - DNA, 22 bp, Homo sapiens
agagctgggaccgtctggaagt

SEQ ID NO: 8786813 - DNA, 22 bp, Homo sapiens
agaggaggtccttttctgatgt

SEQ ID NO: 8786814 - DNA, 21 bp, Homo sapiens
agagctgggacttgcctgaga

SEQ ID NO: 8786815 - DNA, 22 bp, Homo sapiens
agaggaggctgggtccagataa

SEQ ID NO: 8786816 - DNA, 22 bp, Homo sapiens
agaggaggctgggtccagataa

SEQ ID NO: 8786817 - DNA, 22 bp, Homo sapiens
agaggcacagaggcagtcccct

SEQ ID NO: 8786818 - DNA, 22 bp, Homo sapiens
agaggcacaacagtcccattgt

SEQ ID NO: 8786819 - DNA, 22 bp, Homo sapiens
agaggcacatggagggtggaag

SEQ ID NO: 8786820 - DNA, 22 bp, Homo sapiens
agaggcaatgaaagcagtctct

SEQ ID NO: 8786821 - DNA, 22 bp, Homo sapiens
agaggcacaaactggaaaggac

SEQ ID NO: 8786822 - DNA, 22 bp, Homo sapiens
agaggcaagttcagagctagga

SEQ ID NO: 8786823 - DNA, 19 bp, Homo sapiens
agaggcaagggtggaagta

SEQ ID NO: 8786824 - DNA, 19 bp, Homo sapiens
agaggcaagggctcatgac

SEQ ID NO: 8786825 - DNA, 22 bp, Homo sapiens
agaggaggctgggtccagataa

SEQ ID NO: 8786826 - DNA, 23 bp, Homo sapiens
agaggccagcctttggagacacc

SEQ ID NO: 8786827 - DNA, 22 bp, Homo sapiens
agaggccagcactgcagggaag

SEQ ID NO: 8786828 - DNA, 22 bp, Homo sapiens
agaggccagcaaccacagtaaa

SEQ ID NO: 8786829 - DNA, 22 bp, Homo sapiens
agaggccagatcatcatagatg

SEQ ID NO: 8786830 - DNA, 22 bp, Homo sapiens
agaggccaccttctcttgagaa

SEQ ID NO: 8786831 - DNA, 23 bp, Homo sapiens
agaggcaggagtggcttgcccgg

SEQ ID NO: 8786832 - DNA, 22 bp, Homo sapiens
agaggccaccactgtcagggac

SEQ ID NO: 8786833 - DNA, 22 bp, Homo sapiens
agaggctgatggagtagtgtct

SEQ ID NO: 8786834 - DNA, 22 bp, Homo sapiens
agaggctgcacttgctcatgat

SEQ ID NO: 8786835 - DNA, 22 bp, Homo sapiens
agaggctgcacttgctcatgat

SEQ ID NO: 8786836 - DNA, 22 bp, Homo sapiens
agaggctgcacttgctcatgat

SEQ ID NO: 8786837 - DNA, 23 bp, Homo sapiens
agaggccagcctttggagacacc

SEQ ID NO: 8786838 - DNA, 22 bp, Homo sapiens
agaggccaggctgcagagggat

SEQ ID NO: 8786839 - DNA, 18 bp, Homo sapiens
agaggctggacaggggat

SEQ ID NO: 8786840 - DNA, 23 bp, Homo sapiens
agaggctgcagggtattgagaat

SEQ ID NO: 8786841 - DNA, 22 bp, Homo sapiens
agaggctgcacttgctcatgat

SEQ ID NO: 8786842 - DNA, 18 bp, Homo sapiens
agaggctggacaggggat

SEQ ID NO: 8786843 - DNA, 18 bp, Homo sapiens
agaggctggacaggggat

SEQ ID NO: 8786844 - DNA, 22 bp, Homo sapiens
agaggctggattgagcatagac

SEQ ID NO: 8786845 - DNA, 22 bp, Homo sapiens
agaggctggattgagcatagac

SEQ ID NO: 8786846 - DNA, 22 bp, Homo sapiens
agaggggcaagtaaagagtctt

SEQ ID NO: 8786847 - DNA, 22 bp, Homo sapiens
agaggggcaagtaaagagtctt

SEQ ID NO: 8786848 - DNA, 22 bp, Homo sapiens
agaggggcagggtctccggatt

SEQ ID NO: 8786849 - DNA, 18 bp, Homo sapiens
agaggggaggtaagtctg

SEQ ID NO: 8786850 - DNA, 18 bp, Homo sapiens
agaggggaggtaagtctg

SEQ ID NO: 8786851 - DNA, 22 bp, Homo sapiens
agaggggctcaagcagtggtct

SEQ ID NO: 8786852 - DNA, 22 bp, Homo sapiens
agaggggctcaagcagtggtct

SEQ ID NO: 8786853 - DNA, 22 bp, Homo sapiens
agaggggctcaagcagtggtct

SEQ ID NO: 8786854 - DNA, 22 bp, Homo sapiens
agaggggctcaagcagtggtct

SEQ ID NO: 8786855 - DNA, 22 bp, Homo sapiens
agaggggctcaagcagtggtct

SEQ ID NO: 8786856 - DNA, 22 bp, Homo sapiens
agaggggctcaagcagtggtct

SEQ ID NO: 8786857 - DNA, 22 bp, Homo sapiens
agaggggctcaagcagtggtct

SEQ ID NO: 8786858 - DNA, 22 bp, Homo sapiens
agaggtgacataggagaggctc

SEQ ID NO: 8786859 - DNA, 22 bp, Homo sapiens
agaggggcgggaactcaacctc

SEQ ID NO: 8786860 - DNA, 22 bp, Homo sapiens
agaggggcgggaactcaacctc

SEQ ID NO: 8786861 - DNA, 22 bp, Homo sapiens
agaggggcccggttctccgtct

SEQ ID NO: 8786862 - DNA, 22 bp, Homo sapiens
agaggggaggcgaaccagagtc

SEQ ID NO: 8786863 - DNA, 22 bp, Homo sapiens
agaggggaggcgaaccagagtc

SEQ ID NO: 8786864 - DNA, 22 bp, Homo sapiens
agaggggaggcgaaccagagtc

SEQ ID NO: 8786865 - DNA, 22 bp, Homo sapiens
agaggggaggcgaaccagagtc

SEQ ID NO: 8786866 - DNA, 23 bp, Homo sapiens
agaggggagcatctgctggctga

SEQ ID NO: 8786867 - DNA, 23 bp, Homo sapiens
agaggggagcatctgctggctga

SEQ ID NO: 8786868 - DNA, 23 bp, Homo sapiens
agaggggagcatctgctggctga

SEQ ID NO: 8786869 - DNA, 22 bp, Homo sapiens
agaggggagagctaagcaattc

SEQ ID NO: 8786870 - DNA, 22 bp, Homo sapiens
agaggggacagccacctgcccg

SEQ ID NO: 8786871 - DNA, 22 bp, Homo sapiens
agaggggaagtaatgaatgata

SEQ ID NO: 8786872 - DNA, 22 bp, Homo sapiens
agaggggaagtaatgaatgata

SEQ ID NO: 8786873 - DNA, 22 bp, Homo sapiens
agaggggaaggatgtgatgtga

SEQ ID NO: 8786874 - DNA, 22 bp, Homo sapiens
agaggggaaggatgtgatgtga

SEQ ID NO: 8786875 - DNA, 22 bp, Homo sapiens
agagggctttgattctcagttc

SEQ ID NO: 8786876 - DNA, 22 bp, Homo sapiens
agagggcttccctaggagtgag

SEQ ID NO: 8786877 - DNA, 22 bp, Homo sapiens
agaggctgtcccttgctattcc

SEQ ID NO: 8786878 - DNA, 19 bp, Homo sapiens
agaggctgtcacctgtagc

SEQ ID NO: 8786879 - DNA, 22 bp, Homo sapiens
agaggctgggtacgggccacct

SEQ ID NO: 8786880 - DNA, 22 bp, Homo sapiens
agaggctgggtacgggccacct

SEQ ID NO: 8786881 - DNA, 22 bp, Homo sapiens
agaggctgggaagggtccccgg

SEQ ID NO: 8786882 - DNA, 22 bp, Homo sapiens
agaggctgggtacgggccacct

SEQ ID NO: 8786883 - DNA, 22 bp, Homo sapiens
agagtgatcctaattgatttgg

SEQ ID NO: 8786884 - DNA, 23 bp, Homo sapiens
agagtgcagagatatgcttgtgt

SEQ ID NO: 8786885 - DNA, 22 bp, Homo sapiens
agagtgagggggcactgagacg

SEQ ID NO: 8786886 - DNA, 22 bp, Homo sapiens
agagtgagggggcactgagacg

SEQ ID NO: 8786887 - DNA, 22 bp, Homo sapiens
agagtgagggggcactgagacg

SEQ ID NO: 8786888 - DNA, 22 bp, Homo sapiens
agagtgagggggcactgagacg

SEQ ID NO: 8786889 - DNA, 22 bp, Homo sapiens
agagtgccactgacaggtccct

SEQ ID NO: 8786890 - DNA, 22 bp, Homo sapiens
agagtgcccaagcctggcaggg

SEQ ID NO: 8786891 - DNA, 22 bp, Homo sapiens
agagtgccctgctctgagctct

SEQ ID NO: 8786892 - DNA, 20 bp, Homo sapiens
agagtgctggactgaggagc

SEQ ID NO: 8786893 - DNA, 22 bp, Homo sapiens
agagtgctagcctgagggaggt

SEQ ID NO: 8786894 - DNA, 22 bp, Homo sapiens
agagtgctagcctgagggaggt

SEQ ID NO: 8786895 - DNA, 22 bp, Homo sapiens
agagtctgatatttgtaccaga

SEQ ID NO: 8786896 - DNA, 22 bp, Homo sapiens
agagtctgatatttgtaccaga

SEQ ID NO: 8786897 - DNA, 22 bp, Homo sapiens
agagtctgatatttgtaccaga

SEQ ID NO: 8786898 - DNA, 21 bp, Homo sapiens
agagtctgagtgtgcaagggc

SEQ ID NO: 8786899 - DNA, 22 bp, Homo sapiens
agagtctgaggcagctgcagcc

SEQ ID NO: 8786900 - DNA, 22 bp, Homo sapiens
agagtctgaatgctcagagttg

SEQ ID NO: 8786901 - DNA, 22 bp, Homo sapiens
agagtctgaggaggaccaacag

SEQ ID NO: 8786902 - DNA, 22 bp, Homo sapiens
agagtccatgaagacagctgag

SEQ ID NO: 8786903 - DNA, 22 bp, Homo sapiens
agagtccatatgtgggaggagt

SEQ ID NO: 8786904 - DNA, 22 bp, Homo sapiens
agagtccaggtgggctggaggc

SEQ ID NO: 8786905 - DNA, 22 bp, Homo sapiens
agagtccatatattgatttgtt

SEQ ID NO: 8786906 - DNA, 22 bp, Homo sapiens
agagtccaccctggggtcaggc

SEQ ID NO: 8786907 - DNA, 22 bp, Homo sapiens
agagtccaccctggggtcaggc

SEQ ID NO: 8786908 - DNA, 22 bp, Homo sapiens
agagtcagcttatgacacagtc

SEQ ID NO: 8786909 - DNA, 22 bp, Homo sapiens
agagtcagcttatgacacagtc

SEQ ID NO: 8786910 - DNA, 22 bp, Homo sapiens
agagtcagaaagcagacagggg

SEQ ID NO: 8786911 - DNA, 22 bp, Homo sapiens
agagtcaccttttcctcaggat

SEQ ID NO: 8786912 - DNA, 22 bp, Homo sapiens
agagtcaccttttcctcaggat

SEQ ID NO: 8786913 - DNA, 22 bp, Homo sapiens
agagtcagaaccaagatgaggc

SEQ ID NO: 8786914 - DNA, 22 bp, Homo sapiens
agagtactgcctcagttatgaa

SEQ ID NO: 8786915 - DNA, 22 bp, Homo sapiens
agaggtggagctcttggcatca

SEQ ID NO: 8786916 - DNA, 22 bp, Homo sapiens
agaggtgacataggagaggctc

SEQ ID NO: 8786917 - DNA, 22 bp, Homo sapiens
agagtataggcaggatgccagt

SEQ ID NO: 8786918 - DNA, 18 bp, Homo sapiens
agagtatacagacaacaa

SEQ ID NO: 8786919 - DNA, 22 bp, Homo sapiens
agagtataattagtgtcttcta

SEQ ID NO: 8786920 - DNA, 21 bp, Homo sapiens
agagtataataaaggcatgtc

SEQ ID NO: 8786921 - DNA, 22 bp, Homo sapiens
agagtcaccttttcctcaggat

SEQ ID NO: 8786922 - DNA, 22 bp, Homo sapiens
agagtcaccaaagggccaacat

SEQ ID NO: 8786923 - DNA, 22 bp, Homo sapiens
agagtcaccaaagggccaacat

SEQ ID NO: 8786924 - DNA, 22 bp, Homo sapiens
agagtattgtgaccatttgtca

SEQ ID NO: 8786925 - DNA, 22 bp, Homo sapiens
agagtattttgattatcctgga

SEQ ID NO: 8786926 - DNA, 22 bp, Homo sapiens
agagtcaaaatttaccagaatg

SEQ ID NO: 8786927 - DNA, 22 bp, Homo sapiens
agagtcaaaatttaccagaatg

SEQ ID NO: 8786928 - DNA, 22 bp, Homo sapiens
agagtcaaaatttaccagaatg

SEQ ID NO: 8786929 - DNA, 19 bp, Homo sapiens
agagtattgaatttgccct

SEQ ID NO: 8786930 - DNA, 22 bp, Homo sapiens
agagtatgcatctattgtacct

SEQ ID NO: 8786931 - DNA, 22 bp, Homo sapiens
agagtatgctacaaagccagcc

SEQ ID NO: 8786932 - DNA, 22 bp, Homo sapiens
caaagggcattttagtgaactg

SEQ ID NO: 8786933 - DNA, 22 bp, Homo sapiens
caaagggcggctgtcggagggt

SEQ ID NO: 8786934 - DNA, 22 bp, Homo sapiens
agcaccaggtcgctggcacgct

SEQ ID NO: 8786935 - DNA, 22 bp, Homo sapiens
caaagggcggctgtcggagggt

SEQ ID NO: 8786936 - DNA, 22 bp, Homo sapiens
agcaccaggtcgctggcacgct

SEQ ID NO: 8786937 - DNA, 18 bp, Homo sapiens
agcaccagtcactaacag

SEQ ID NO: 8786938 - DNA, 22 bp, Homo sapiens
agcacctgcttgtgactaggga

SEQ ID NO: 8786939 - DNA, 22 bp, Homo sapiens
agcacctgcttgtgactaggga

SEQ ID NO: 8786940 - DNA, 22 bp, Homo sapiens
agcacctgcttaatgtgcagtg

SEQ ID NO: 8786941 - DNA, 22 bp, Homo sapiens
agcacctgcttaatgtgcagtg

SEQ ID NO: 8786942 - DNA, 22 bp, Homo sapiens
agcacctgcttaatgtgcagtg

SEQ ID NO: 8786943 - DNA, 22 bp, Homo sapiens
agcacctggagggctgggacct

SEQ ID NO: 8786944 - DNA, 22 bp, Homo sapiens
agcacctgtcacaagcagaagg

SEQ ID NO: 8786945 - DNA, 22 bp, Homo sapiens
agcacctgtcacaagcagaagg

SEQ ID NO: 8786946 - DNA, 23 bp, Homo sapiens
agcacctgtgatttcctagctct

SEQ ID NO: 8786947 - DNA, 22 bp, Homo sapiens
caaaggctggtagaatgagcca

SEQ ID NO: 8786948 - DNA, 22 bp, Homo sapiens
caaaggctgccactgtggctgt

SEQ ID NO: 8786949 - DNA, 22 bp, Homo sapiens
caaaggcctgagaactgagggg

SEQ ID NO: 8786950 - DNA, 22 bp, Homo sapiens
caaaggcatcggcaattaggga

SEQ ID NO: 8786951 - DNA, 22 bp, Homo sapiens
caaaggcagttactgaatgaag

SEQ ID NO: 8786952 - DNA, 22 bp, Homo sapiens
caaaggcagttactgaatgaag

SEQ ID NO: 8786953 - DNA, 22 bp, Homo sapiens
caaaggcatgtgagtatatgtg

SEQ ID NO: 8786954 - DNA, 22 bp, Homo sapiens
caaaggcatgtgagtatatgtg

SEQ ID NO: 8786955 - DNA, 22 bp, Homo sapiens
caaaggctttgctatgatgcat

SEQ ID NO: 8786956 - DNA, 22 bp, Homo sapiens
caaaggctttgctatgatgcat

SEQ ID NO: 8786957 - DNA, 22 bp, Homo sapiens
caaaggcttccactgcatcctt

SEQ ID NO: 8786958 - DNA, 22 bp, Homo sapiens
caaaggcttcatctcagagcag

SEQ ID NO: 8786959 - DNA, 22 bp, Homo sapiens
caaagggcatggcctgagcact

SEQ ID NO: 8786960 - DNA, 17 bp, Homo sapiens
caaagggagcccaccaa

SEQ ID NO: 8786961 - DNA, 22 bp, Homo sapiens
agcactgattttgttgcactta

SEQ ID NO: 8786962 - DNA, 22 bp, Homo sapiens
agcactgatttaaactggattt

SEQ ID NO: 8786963 - DNA, 22 bp, Homo sapiens
agcactgctttagagcctctgc

SEQ ID NO: 8786964 - DNA, 22 bp, Homo sapiens
agcactgctttagagcctctgc

SEQ ID NO: 8786965 - DNA, 22 bp, Homo sapiens
agcactgattttgttgcactta

SEQ ID NO: 8786966 - DNA, 22 bp, Homo sapiens
agcactggagtttagtgggatt

SEQ ID NO: 8786967 - DNA, 22 bp, Homo sapiens
agcactggagtttagtgggatt

SEQ ID NO: 8786968 - DNA, 22 bp, Homo sapiens
agcactggaaagttaagagttt

SEQ ID NO: 8786969 - DNA, 22 bp, Homo sapiens
agcactggaaagttaagagttt

SEQ ID NO: 8786970 - DNA, 22 bp, Homo sapiens
agcactggagtttagtgggatt

SEQ ID NO: 8786971 - DNA, 22 bp, Homo sapiens
agcactggagtttagtgggatt

SEQ ID NO: 8786972 - DNA, 22 bp, Homo sapiens
agcactgggaacgcatggggcc

SEQ ID NO: 8786973 - DNA, 22 bp, Homo sapiens
agcactgtagttatagctaaca

SEQ ID NO: 8786974 - DNA, 22 bp, Homo sapiens
agcactgggaacgcatggggcc

SEQ ID NO: 8786975 - DNA, 22 bp, Homo sapiens
agcacctgtgtggtagggaggt

SEQ ID NO: 8786976 - DNA, 22 bp, Homo sapiens
agcacctgtgtgagctagatgt

SEQ ID NO: 8786977 - DNA, 22 bp, Homo sapiens
agcacctgtgtggtagggaggt

SEQ ID NO: 8786978 - DNA, 21 bp, Homo sapiens
agcaccttacagctataatgg

SEQ ID NO: 8786979 - DNA, 22 bp, Homo sapiens
agcacctgtgttcatgcctcat

SEQ ID NO: 8786980 - DNA, 22 bp, Homo sapiens
agcacctgtgccctgatggaga

SEQ ID NO: 8786981 - DNA, 20 bp, Homo sapiens
agcacctgtgtagaagcatc

SEQ ID NO: 8786982 - DNA, 20 bp, Homo sapiens
agcacctgtgtagaagcatc

SEQ ID NO: 8786983 - DNA, 22 bp, Homo sapiens
agcacctgtggctcatgctcgt

SEQ ID NO: 8786984 - DNA, 22 bp, Homo sapiens
agcaccttgatcttggacttcc

SEQ ID NO: 8786985 - DNA, 22 bp, Homo sapiens
agcaccttgagatcaagcagtg

SEQ ID NO: 8786986 - DNA, 22 bp, Homo sapiens
agcacgttcttcattacttcac

SEQ ID NO: 8786987 - DNA, 17 bp, Homo sapiens
agcactaaaatgcttcc

SEQ ID NO: 8786988 - DNA, 22 bp, Homo sapiens
agcacgttttactaaacctcca

SEQ ID NO: 8786989 - DNA, 17 bp, Homo sapiens
agcactaaggataatac

SEQ ID NO: 8786990 - DNA, 22 bp, Homo sapiens
agcagaggtttgttggaaacct

SEQ ID NO: 8786991 - DNA, 22 bp, Homo sapiens
agcagaggtttgttggaaacct

SEQ ID NO: 8786992 - DNA, 20 bp, Homo sapiens
agcagagtgcccatcccgga

SEQ ID NO: 8786993 - DNA, 21 bp, Homo sapiens
agcagaggctgcctggtgact

SEQ ID NO: 8786994 - DNA, 20 bp, Homo sapiens
caataatttacttccctatt

SEQ ID NO: 8786995 - DNA, 22 bp, Homo sapiens
caatacaattaccagttaatca

SEQ ID NO: 8786996 - DNA, 22 bp, Homo sapiens
caatacaattaccagttaatca

SEQ ID NO: 8786997 - DNA, 22 bp, Homo sapiens
caatacaattaccagttaatca

SEQ ID NO: 8786998 - DNA, 22 bp, Homo sapiens
caataatatcctgtgctgtttg

SEQ ID NO: 8786999 - DNA, 22 bp, Homo sapiens
caataatatcctgtgctgtttg

SEQ ID NO: 8787000 - DNA, 22 bp, Homo sapiens
caataatatcctgtgctgtttg

SEQ ID NO: 8787001 - DNA, 22 bp, Homo sapiens
caataatatcctgtgctgtttg

SEQ ID NO: 8787002 - DNA, 22 bp, Homo sapiens
caagtgagtgaccagagttggt

SEQ ID NO: 8787003 - DNA, 19 bp, Homo sapiens
caataagtcagtagtgggc

SEQ ID NO: 8787004 - DNA, 22 bp, Homo sapiens
caagtgactgtgctggcaacat

SEQ ID NO: 8787005 - DNA, 22 bp, Homo sapiens
caagtgacttctttgagcccgt

SEQ ID NO: 8787006 - DNA, 22 bp, Homo sapiens
caagtgagcctcctctttttaa

SEQ ID NO: 8787007 - DNA, 22 bp, Homo sapiens
caagtgagtgaccagagttggt

SEQ ID NO: 8787008 - DNA, 20 bp, Homo sapiens
agcagagtgcccatcccgga

SEQ ID NO: 8787009 - DNA, 20 bp, Homo sapiens
agcagagtgcccatcccgga

SEQ ID NO: 8787010 - DNA, 20 bp, Homo sapiens
agcagagtgcccatcccgga

SEQ ID NO: 8787011 - DNA, 22 bp, Homo sapiens
agcagagctttttggactcaga

SEQ ID NO: 8787012 - DNA, 22 bp, Homo sapiens
agcagagctgggatcctgggtc

SEQ ID NO: 8787013 - DNA, 22 bp, Homo sapiens
agcagagctgggatcctgggtc

SEQ ID NO: 8787014 - DNA, 22 bp, Homo sapiens
agcagagctttttggactcaga

SEQ ID NO: 8787015 - DNA, 22 bp, Homo sapiens
agcagagctttttggactcaga

SEQ ID NO: 8787016 - DNA, 22 bp, Homo sapiens
agcagaggacagttcttaggaa

SEQ ID NO: 8787017 - DNA, 21 bp, Homo sapiens
agcagaggcagaatgtatgca

SEQ ID NO: 8787018 - DNA, 21 bp, Homo sapiens
agcagaggcagaatgtatgca

SEQ ID NO: 8787019 - DNA, 21 bp, Homo sapiens
agcagaggctgcctggtgact

SEQ ID NO: 8787020 - DNA, 22 bp, Homo sapiens
agcagagcggggcctccggaag

SEQ ID NO: 8787021 - DNA, 22 bp, Homo sapiens
agcagagcgcctgctcagaggg

SEQ ID NO: 8787022 - DNA, 22 bp, Homo sapiens
agcagagcgcctgctcagaggg

SEQ ID NO: 8787023 - DNA, 22 bp, Homo sapiens
agcagagctgcagtggcctgct

SEQ ID NO: 8787024 - DNA, 22 bp, Homo sapiens
agcagagctgcagtggcctgct

SEQ ID NO: 8787025 - DNA, 22 bp, Homo sapiens
agcagagctattcttgtgcaat

SEQ ID NO: 8787026 - DNA, 22 bp, Homo sapiens
agcagagctgcagtggcctgct

SEQ ID NO: 8787027 - DNA, 22 bp, Homo sapiens
agcagagctgcagtggcctgct

SEQ ID NO: 8787028 - DNA, 22 bp, Homo sapiens
agcagagaccatatagcccaga

SEQ ID NO: 8787029 - DNA, 22 bp, Homo sapiens
agcagagaccatatagcccaga

SEQ ID NO: 8787030 - DNA, 22 bp, Homo sapiens
agcagagcgcctgctcagaggg

SEQ ID NO: 8787031 - DNA, 22 bp, Homo sapiens
agcagagcgcctgctcagaggg

SEQ ID NO: 8787032 - DNA, 16 bp, Homo sapiens
caatacatggcatttc

SEQ ID NO: 8787033 - DNA, 16 bp, Homo sapiens
caatacatggcatttc

SEQ ID NO: 8787034 - DNA, 19 bp, Homo sapiens
agcagcagaagtgtgcctt

SEQ ID NO: 8787035 - DNA, 22 bp, Homo sapiens
caatacatcaggtcaaaatgtg

SEQ ID NO: 8787036 - DNA, 22 bp, Homo sapiens
caatacaattaccagttaatca

SEQ ID NO: 8787037 - DNA, 22 bp, Homo sapiens
caatacaattaccagttaatca

SEQ ID NO: 8787038 - DNA, 22 bp, Homo sapiens
agcagcagatcaaacaggcttg

SEQ ID NO: 8787039 - DNA, 22 bp, Homo sapiens
agcagcagatcaaacaggcttg

SEQ ID NO: 8787040 - DNA, 22 bp, Homo sapiens
agcagcagatcaaacaggcttg

SEQ ID NO: 8787041 - DNA, 22 bp, Homo sapiens
agcagcagatcaaacaggcttg

SEQ ID NO: 8787042 - DNA, 22 bp, Homo sapiens
agcagcagatccaaaaaatgtg

SEQ ID NO: 8787043 - DNA, 22 bp, Homo sapiens
agcagcagaggtcagaaaggta

SEQ ID NO: 8787044 - DNA, 22 bp, Homo sapiens
agcagcagaggtcagaaaggta

SEQ ID NO: 8787045 - DNA, 22 bp, Homo sapiens
agcagcagaggtcagaaaggta

SEQ ID NO: 8787046 - DNA, 22 bp, Homo sapiens
agcagcagatcaaacaggcttg

SEQ ID NO: 8787047 - DNA, 22 bp, Homo sapiens
agcagcagagctctggtctgca

SEQ ID NO: 8787048 - DNA, 22 bp, Homo sapiens
agcagcagaggtcagaaaggta

SEQ ID NO: 8787049 - DNA, 22 bp, Homo sapiens
agcagccagagaatgatgcagt

SEQ ID NO: 8787050 - DNA, 21 bp, Homo sapiens
agcagcagatctggtgagggc

SEQ ID NO: 8787051 - DNA, 21 bp, Homo sapiens
agcagcagatctggtgagggc

SEQ ID NO: 8787052 - DNA, 21 bp, Homo sapiens
agcagcagatctggtgagggc

SEQ ID NO: 8787053 - DNA, 21 bp, Homo sapiens
agcagcagatctggtgagggc

SEQ ID NO: 8787054 - DNA, 23 bp, Homo sapiens
agcagcccagatgccttccatcc

SEQ ID NO: 8787055 - DNA, 22 bp, Homo sapiens
agcagcccagttgtactgagtg

SEQ ID NO: 8787056 - DNA, 23 bp, Homo sapiens
agcagcccagatgccttccatcc

SEQ ID NO: 8787057 - DNA, 22 bp, Homo sapiens
agcagcccgaggatcatgtgtc

SEQ ID NO: 8787058 - DNA, 22 bp, Homo sapiens
agcagcccgaggatcatgtgtc

SEQ ID NO: 8787059 - DNA, 23 bp, Homo sapiens
agcagccctgggacctggcctgc

SEQ ID NO: 8787060 - DNA, 22 bp, Homo sapiens
agcagccctatgtaattggact

SEQ ID NO: 8787061 - DNA, 22 bp, Homo sapiens
agcagcctggacttggatgtgg

SEQ ID NO: 8787062 - DNA, 22 bp, Homo sapiens
agcagcctggtctctcgccaat

SEQ ID NO: 8787063 - DNA, 22 bp, Homo sapiens
agcagctagacttcagaatctg

SEQ ID NO: 8787064 - DNA, 22 bp, Homo sapiens
agcagctcaaagcctgcaagga

SEQ ID NO: 8787065 - DNA, 22 bp, Homo sapiens
agcagctatttcttccagagag

SEQ ID NO: 8787066 - DNA, 22 bp, Homo sapiens
agcagctcaaagcctgcaagga

SEQ ID NO: 8787067 - DNA, 22 bp, Homo sapiens
agcagctcaaagcctgcaagga

SEQ ID NO: 8787068 - DNA, 22 bp, Homo sapiens
agcagcctttgatcatctggga

SEQ ID NO: 8787069 - DNA, 22 bp, Homo sapiens
agcagctcaacagtgtctctat

SEQ ID NO: 8787070 - DNA, 22 bp, Homo sapiens
agcagctcaaagcctgcaagga

SEQ ID NO: 8787071 - DNA, 22 bp, Homo sapiens
agcagctcaagacttaaatttg

SEQ ID NO: 8787072 - DNA, 22 bp, Homo sapiens
agcagctcagaggcaccagggc

SEQ ID NO: 8787073 - DNA, 19 bp, Homo sapiens
agcagctcagggaggcacc

SEQ ID NO: 8787074 - DNA, 22 bp, Homo sapiens
agcagctcagaggcaccagggc

SEQ ID NO: 8787075 - DNA, 19 bp, Homo sapiens
agcagctcagggaggcacc

SEQ ID NO: 8787076 - DNA, 22 bp, Homo sapiens
agcagctcatggagtaggcact

SEQ ID NO: 8787077 - DNA, 22 bp, Homo sapiens
cacagagatcggaacagaagta

SEQ ID NO: 8787078 - DNA, 22 bp, Homo sapiens
cacagagatcggaacagaagta

SEQ ID NO: 8787079 - DNA, 22 bp, Homo sapiens
cacagagatcggaacagaagta

SEQ ID NO: 8787080 - DNA, 22 bp, Homo sapiens
cacagagatggccagggcacat

SEQ ID NO: 8787081 - DNA, 22 bp, Homo sapiens
cacagagatcggaacagaagta

SEQ ID NO: 8787082 - DNA, 22 bp, Homo sapiens
cacagagatcggaacagaagta

SEQ ID NO: 8787083 - DNA, 21 bp, Homo sapiens
cacagagatattggtgagcct

SEQ ID NO: 8787084 - DNA, 21 bp, Homo sapiens
cacagagatattggtgagcct

SEQ ID NO: 8787085 - DNA, 21 bp, Homo sapiens
cacagagatattggtgagcct

SEQ ID NO: 8787086 - DNA, 21 bp, Homo sapiens
cacagagatattggtgagcct

SEQ ID NO: 8787087 - DNA, 22 bp, Homo sapiens
cacagagatcggaacagaagta

SEQ ID NO: 8787088 - DNA, 22 bp, Homo sapiens
cacagagatcggaacagaagta

SEQ ID NO: 8787089 - DNA, 21 bp, Homo sapiens
cacagagatattggtgagcct

SEQ ID NO: 8787090 - DNA, 21 bp, Homo sapiens
cacagagatattggtgagcct

SEQ ID NO: 8787091 - DNA, 22 bp, Homo sapiens
agcagctcatggagtaggcact

SEQ ID NO: 8787092 - DNA, 22 bp, Homo sapiens
agcagctcccctcatgctccac

SEQ ID NO: 8787093 - DNA, 22 bp, Homo sapiens
agcagctcccctcatgctccac

SEQ ID NO: 8787094 - DNA, 22 bp, Homo sapiens
agcagctcccctcatgctccac

SEQ ID NO: 8787095 - DNA, 22 bp, Homo sapiens
cacagaacatccttagctcatg

SEQ ID NO: 8787096 - DNA, 22 bp, Homo sapiens
cacagaacatccttagctcatg

SEQ ID NO: 8787097 - DNA, 22 bp, Homo sapiens
cacagagattagaattagacta

SEQ ID NO: 8787098 - DNA, 22 bp, Homo sapiens
cacagagattagaattagacta

SEQ ID NO: 8787099 - DNA, 22 bp, Homo sapiens
cacagagattagaattagacta

SEQ ID NO: 8787100 - DNA, 22 bp, Homo sapiens
cacagagatggtctggcaggtg

SEQ ID NO: 8787101 - DNA, 22 bp, Homo sapiens
cacagagatggtctggcaggtg

SEQ ID NO: 8787102 - DNA, 22 bp, Homo sapiens
cacagagatggtctggcaggtg

SEQ ID NO: 8787103 - DNA, 22 bp, Homo sapiens
cacagagatggtctggcaggtg

SEQ ID NO: 8787104 - DNA, 22 bp, Homo sapiens
cacagagatggtctggcaggtg

SEQ ID NO: 8787105 - DNA, 22 bp, Homo sapiens
cacagagatggccagggcacat

SEQ ID NO: 8787106 - DNA, 22 bp, Homo sapiens
cacagagatggccagggcacat

SEQ ID NO: 8787107 - DNA, 22 bp, Homo sapiens
cacagagatggccagggcacat

SEQ ID NO: 8787108 - DNA, 22 bp, Homo sapiens
cacagagatggccagggcacat

SEQ ID NO: 8787109 - DNA, 22 bp, Homo sapiens
cacagagatggccagggcacat

SEQ ID NO: 8787110 - DNA, 22 bp, Homo sapiens
agcagctgcttttcttcattgg

SEQ ID NO: 8787111 - DNA, 22 bp, Homo sapiens
agcagctggaacatatgaagaa

SEQ ID NO: 8787112 - DNA, 22 bp, Homo sapiens
agcagctggaacatatgaagaa

SEQ ID NO: 8787113 - DNA, 22 bp, Homo sapiens
cacagagcaggggtctgtgtca

SEQ ID NO: 8787114 - DNA, 22 bp, Homo sapiens
cacagagcaggtgctgggaaga

SEQ ID NO: 8787115 - DNA, 22 bp, Homo sapiens
cacagagcaggtgctgggaaga

SEQ ID NO: 8787116 - DNA, 22 bp, Homo sapiens
agcagctggcagcttcttctct

SEQ ID NO: 8787117 - DNA, 17 bp, Homo sapiens
agcagctggcacaggag

SEQ ID NO: 8787118 - DNA, 17 bp, Homo sapiens
agcagctggcacaggag

SEQ ID NO: 8787119 - DNA, 17 bp, Homo sapiens
agcagctggcacaggag

SEQ ID NO: 8787120 - DNA, 17 bp, Homo sapiens
agcagctggcacaggag

SEQ ID NO: 8787121 - DNA, 22 bp, Homo sapiens
agcagctggaactaatagtggt

SEQ ID NO: 8787122 - DNA, 22 bp, Homo sapiens
agcagctggaactaatagtggt

SEQ ID NO: 8787123 - DNA, 19 bp, Homo sapiens
agcagctggaggtggagtg

SEQ ID NO: 8787124 - DNA, 19 bp, Homo sapiens
agcagctggaggtggagtg

SEQ ID NO: 8787125 - DNA, 17 bp, Homo sapiens
agcagctggcacaggag

SEQ ID NO: 8787126 - DNA, 19 bp, Homo sapiens
agcagctggaggtggagtg

SEQ ID NO: 8787127 - DNA, 19 bp, Homo sapiens
agcagctggaggtggagtg

SEQ ID NO: 8787128 - DNA, 22 bp, Homo sapiens
cacatttaatcctttataagta

SEQ ID NO: 8787129 - DNA, 22 bp, Homo sapiens
caccactgtatccctagcactt

SEQ ID NO: 8787130 - DNA, 22 bp, Homo sapiens
caccactgtatccctagcactt

SEQ ID NO: 8787131 - DNA, 22 bp, Homo sapiens
cacatttaatcctttataagta

SEQ ID NO: 8787132 - DNA, 22 bp, Homo sapiens
cacatttaatcctttataagta

SEQ ID NO: 8787133 - DNA, 22 bp, Homo sapiens
cacatttaatcctttataagta

SEQ ID NO: 8787134 - DNA, 22 bp, Homo sapiens
cacatttaatcctttataagta

SEQ ID NO: 8787135 - DNA, 22 bp, Homo sapiens
agcagggcagtgatcagaaagg

SEQ ID NO: 8787136 - DNA, 22 bp, Homo sapiens
agcagggcaggtaaggatcaga

SEQ ID NO: 8787137 - DNA, 22 bp, Homo sapiens
agcagggcaggtaaggatcaga

SEQ ID NO: 8787138 - DNA, 22 bp, Homo sapiens
agcagggcagcttttttcagaa

SEQ ID NO: 8787139 - DNA, 22 bp, Homo sapiens
agcagggcaggtaaggatcaga

SEQ ID NO: 8787140 - DNA, 22 bp, Homo sapiens
agcagggcagctgatgcgcacg

SEQ ID NO: 8787141 - DNA, 22 bp, Homo sapiens
agcagggcagctgatgcgcacg

SEQ ID NO: 8787142 - DNA, 22 bp, Homo sapiens
agcagggcactggaaggcactg

SEQ ID NO: 8787143 - DNA, 22 bp, Homo sapiens
agcagggcagctgatgcgcacg

SEQ ID NO: 8787144 - DNA, 22 bp, Homo sapiens
agcagggcactggaaggcactg

SEQ ID NO: 8787145 - DNA, 22 bp, Homo sapiens
agcagggcactggaaggcactg

SEQ ID NO: 8787146 - DNA, 17 bp, Homo sapiens
agcagggagtcaaggga

SEQ ID NO: 8787147 - DNA, 17 bp, Homo sapiens
agcagggagtcaaggga

SEQ ID NO: 8787148 - DNA, 17 bp, Homo sapiens
agcagggagtcaaggga

SEQ ID NO: 8787149 - DNA, 19 bp, Homo sapiens
agcagggagtggttgtggg

SEQ ID NO: 8787150 - DNA, 22 bp, Homo sapiens
agcagggcaaagtcaggctaac

SEQ ID NO: 8787151 - DNA, 19 bp, Homo sapiens
agcagggagtggttgtggg

SEQ ID NO: 8787152 - DNA, 22 bp, Homo sapiens
agcagggcaaagtcaggctaac

SEQ ID NO: 8787153 - DNA, 22 bp, Homo sapiens
agcagggcaaagtcaggctaac

SEQ ID NO: 8787154 - DNA, 22 bp, Homo sapiens
agcagggctctgtggagggtgg

SEQ ID NO: 8787155 - DNA, 22 bp, Homo sapiens
agcagggctctgtggagggtgg

SEQ ID NO: 8787156 - DNA, 22 bp, Homo sapiens
agcagggctgcagtgtgtcttt

SEQ ID NO: 8787157 - DNA, 22 bp, Homo sapiens
agcagggctctgtggagggtgg

SEQ ID NO: 8787158 - DNA, 22 bp, Homo sapiens
agcagggctgcagtgtgtcttt

SEQ ID NO: 8787159 - DNA, 22 bp, Homo sapiens
caccagctaattaaaacagcag

SEQ ID NO: 8787160 - DNA, 22 bp, Homo sapiens
caccagctacagactactgtgt

SEQ ID NO: 8787161 - DNA, 22 bp, Homo sapiens
agcagggctctgccatgggccc

SEQ ID NO: 8787162 - DNA, 22 bp, Homo sapiens
agcagggctctgccatgggccc

SEQ ID NO: 8787163 - DNA, 22 bp, Homo sapiens
caccagccagagtgacagctcc

SEQ ID NO: 8787164 - DNA, 22 bp, Homo sapiens
caccagccccctcacgctgtca

SEQ ID NO: 8787165 - DNA, 22 bp, Homo sapiens
caccagccccctcacgctgtca

SEQ ID NO: 8787166 - DNA, 22 bp, Homo sapiens
caccagccccctcacgctgtca

SEQ ID NO: 8787167 - DNA, 22 bp, Homo sapiens
caccagcgactgtgaccagcaa

SEQ ID NO: 8787168 - DNA, 23 bp, Homo sapiens
caccactttctccttctccttgg

SEQ ID NO: 8787169 - DNA, 23 bp, Homo sapiens
caccactttctccttctccttgg

SEQ ID NO: 8787170 - DNA, 22 bp, Homo sapiens
caccagatgaaaggacatatca

SEQ ID NO: 8787171 - DNA, 22 bp, Homo sapiens
caccagagccacttggaggtca

SEQ ID NO: 8787172 - DNA, 22 bp, Homo sapiens
caccagcagaagactgagggtg

SEQ ID NO: 8787173 - DNA, 22 bp, Homo sapiens
caccagatgaatgtttgatgct

SEQ ID NO: 8787174 - DNA, 22 bp, Homo sapiens
caccagagtgggtgagggtgat

SEQ ID NO: 8787175 - DNA, 22 bp, Homo sapiens
caccagcaccagctctgtgcct

SEQ ID NO: 8787176 - DNA, 20 bp, Homo sapiens
caccagcagcagctgccacc

SEQ ID NO: 8787177 - DNA, 20 bp, Homo sapiens
caccagcagcagctgccacc

SEQ ID NO: 8787178 - DNA, 22 bp, Homo sapiens
agcaggaaggggatgatgggca

SEQ ID NO: 8787179 - DNA, 22 bp, Homo sapiens
agcaggaactgacaccaagcca

SEQ ID NO: 8787180 - DNA, 22 bp, Homo sapiens
agcaggaactgacaccaagcca

SEQ ID NO: 8787181 - DNA, 22 bp, Homo sapiens
agcaggaactgacaccaagcca

SEQ ID NO: 8787182 - DNA, 22 bp, Homo sapiens
agcaggaacgagttcatgggga

SEQ ID NO: 8787183 - DNA, 22 bp, Homo sapiens
agcaggaactgacaccaagcca

SEQ ID NO: 8787184 - DNA, 21 bp, Homo sapiens
agcagctgggcaacatggagg

SEQ ID NO: 8787185 - DNA, 21 bp, Homo sapiens
agcagctgggcaacatggagg

SEQ ID NO: 8787186 - DNA, 21 bp, Homo sapiens
agcagctgggcaacatggagg

SEQ ID NO: 8787187 - DNA, 17 bp, Homo sapiens
agcaggaccccagagca

SEQ ID NO: 8787188 - DNA, 22 bp, Homo sapiens
cacagcaagagctaaatgacca

SEQ ID NO: 8787189 - DNA, 22 bp, Homo sapiens
cacagcaagagctaaatgacca

SEQ ID NO: 8787190 - DNA, 22 bp, Homo sapiens
cacagcaatagctaactgatac

SEQ ID NO: 8787191 - DNA, 22 bp, Homo sapiens
cacagcaatagctaactgatac

SEQ ID NO: 8787192 - DNA, 22 bp, Homo sapiens
cacagcaagagctaaatgacca

SEQ ID NO: 8787193 - DNA, 22 bp, Homo sapiens
cacagcaatagctaactgatac

SEQ ID NO: 8787194 - DNA, 22 bp, Homo sapiens
agcaggaagtagtctgtaagca

SEQ ID NO: 8787195 - DNA, 22 bp, Homo sapiens
agcaggaagtcctctcaggaga

SEQ ID NO: 8787196 - DNA, 22 bp, Homo sapiens
agcaggaagtcctctcaggaga

SEQ ID NO: 8787197 - DNA, 22 bp, Homo sapiens
agcagggaggcggtgtgctggc

SEQ ID NO: 8787198 - DNA, 22 bp, Homo sapiens
agcagggaggtctagcacgtgg

SEQ ID NO: 8787199 - DNA, 22 bp, Homo sapiens
agcagggaggcggtgtgctggc

SEQ ID NO: 8787200 - DNA, 22 bp, Homo sapiens
agcagggaggcggtgtgctggc

SEQ ID NO: 8787201 - DNA, 22 bp, Homo sapiens
agcagggaggtctagcacgtgg

SEQ ID NO: 8787202 - DNA, 22 bp, Homo sapiens
agcagggaggtctagcacgtgg

SEQ ID NO: 8787203 - DNA, 17 bp, Homo sapiens
agcagggagtcaaggga

SEQ ID NO: 8787204 - DNA, 17 bp, Homo sapiens
agcagggagtcaaggga

SEQ ID NO: 8787205 - DNA, 17 bp, Homo sapiens
agcagggagtcaaggga

SEQ ID NO: 8787206 - DNA, 22 bp, Homo sapiens
agcagggaggcccagggcactg

SEQ ID NO: 8787207 - DNA, 22 bp, Homo sapiens
agcagggaggcccagggcactg

SEQ ID NO: 8787208 - DNA, 22 bp, Homo sapiens
agcagggaggcccagggcactg

SEQ ID NO: 8787209 - DNA, 22 bp, Homo sapiens
agcagggaggcccagggcactg

SEQ ID NO: 8787210 - DNA, 22 bp, Homo sapiens
agcagggaggcccagggcactg

SEQ ID NO: 8787211 - DNA, 22 bp, Homo sapiens
agcagggagaccatctcttcct

SEQ ID NO: 8787212 - DNA, 22 bp, Homo sapiens
agcagggagaccatctcttcct

SEQ ID NO: 8787213 - DNA, 22 bp, Homo sapiens
agcagggagaccatctcttcct

SEQ ID NO: 8787214 - DNA, 22 bp, Homo sapiens
agcagggagaccatctcttcct

SEQ ID NO: 8787215 - DNA, 22 bp, Homo sapiens
agcaggcttactttctgattag

SEQ ID NO: 8787216 - DNA, 22 bp, Homo sapiens
agcaggcttatggttgaaggga

SEQ ID NO: 8787217 - DNA, 22 bp, Homo sapiens
agcaggctgggcaatatgggca

SEQ ID NO: 8787218 - DNA, 22 bp, Homo sapiens
cacagcagaaagtgtaggagga

SEQ ID NO: 8787219 - DNA, 22 bp, Homo sapiens
cacagcagaaagtgtaggagga

SEQ ID NO: 8787220 - DNA, 22 bp, Homo sapiens
cacagcagacagggaggcggct

SEQ ID NO: 8787221 - DNA, 22 bp, Homo sapiens
cacagcagacagggaggcggct

SEQ ID NO: 8787222 - DNA, 22 bp, Homo sapiens
cacagcagagggagccattgaa

SEQ ID NO: 8787223 - DNA, 22 bp, Homo sapiens
agcaggctgggcaatatgggca

SEQ ID NO: 8787224 - DNA, 22 bp, Homo sapiens
agcatggccatctgggccgtcc

SEQ ID NO: 8787225 - DNA, 22 bp, Homo sapiens
agcatggccacgggggtaggta

SEQ ID NO: 8787226 - DNA, 22 bp, Homo sapiens
agcatggcctcccgggcctggc

SEQ ID NO: 8787227 - DNA, 22 bp, Homo sapiens
agcatggcctgcagcggccacc

SEQ ID NO: 8787228 - DNA, 22 bp, Homo sapiens
agcatggcctcccgggcctggc

SEQ ID NO: 8787229 - DNA, 22 bp, Homo sapiens
agcatggctttggaggatagca

SEQ ID NO: 8787230 - DNA, 22 bp, Homo sapiens
agcatggctttggaggatagca

SEQ ID NO: 8787231 - DNA, 22 bp, Homo sapiens
agcatgtaaagctcttagcacc

SEQ ID NO: 8787232 - DNA, 22 bp, Homo sapiens
agcatggggcaatgcatgtgct

SEQ ID NO: 8787233 - DNA, 22 bp, Homo sapiens
agcatgttcatcttctgttggt

SEQ ID NO: 8787234 - DNA, 23 bp, Homo sapiens
agcatgttgtgatgttaccactg

SEQ ID NO: 8787235 - DNA, 22 bp, Homo sapiens
agcatgtgtggagaaatatttt

SEQ ID NO: 8787236 - DNA, 22 bp, Homo sapiens
agcatggacagtggcagcagtg

SEQ ID NO: 8787237 - DNA, 23 bp, Homo sapiens
agcatggaataggaaagaggcag

SEQ ID NO: 8787238 - DNA, 18 bp, Homo sapiens
agcatggcacaggctccc

SEQ ID NO: 8787239 - DNA, 18 bp, Homo sapiens
agcatggcacaggctccc

SEQ ID NO: 8787240 - DNA, 22 bp, Homo sapiens
agcatggccacgggggtaggta

SEQ ID NO: 8787241 - DNA, 22 bp, Homo sapiens
agcatggcattattggaaggac

SEQ ID NO: 8787242 - DNA, 22 bp, Homo sapiens
agcatggacagtggcagcagtg

SEQ ID NO: 8787243 - DNA, 22 bp, Homo sapiens
agcatggcattattggaaggac

SEQ ID NO: 8787244 - DNA, 22 bp, Homo sapiens
agcatgcaggaaccacatggca

SEQ ID NO: 8787245 - DNA, 22 bp, Homo sapiens
agcatgcatgaagattcagcaa

SEQ ID NO: 8787246 - DNA, 22 bp, Homo sapiens
agcatgcatttttggactgtgc

SEQ ID NO: 8787247 - DNA, 22 bp, Homo sapiens
agcatgcttggcatttgtcaga

SEQ ID NO: 8787248 - DNA, 22 bp, Homo sapiens
agcatgctgggtcatttttgcc

SEQ ID NO: 8787249 - DNA, 22 bp, Homo sapiens
cactttactatctataaaataa

SEQ ID NO: 8787250 - DNA, 22 bp, Homo sapiens
cacttaaagtcttagcttacag

SEQ ID NO: 8787251 - DNA, 22 bp, Homo sapiens
cactgtttggctcctgtactta

SEQ ID NO: 8787252 - DNA, 22 bp, Homo sapiens
cactgttttattccaacatagg

SEQ ID NO: 8787253 - DNA, 22 bp, Homo sapiens
cactgtgtctggagtgagctgg

SEQ ID NO: 8787254 - DNA, 22 bp, Homo sapiens
cactgtgtcagagtatgatgat

SEQ ID NO: 8787255 - DNA, 22 bp, Homo sapiens
cactgtgtctggagtgagctgg

SEQ ID NO: 8787256 - DNA, 22 bp, Homo sapiens
cactgttattactactatacat

SEQ ID NO: 8787257 - DNA, 22 bp, Homo sapiens
cactgttattactactatacat

SEQ ID NO: 8787258 - DNA, 22 bp, Homo sapiens
cactgttgaagatacttcctct

SEQ ID NO: 8787259 - DNA, 19 bp, Homo sapiens
cactgttgtcctagtactt

SEQ ID NO: 8787260 - DNA, 22 bp, Homo sapiens
cactgttgagcaatgtacagtg

SEQ ID NO: 8787261 - DNA, 22 bp, Homo sapiens
cactgtgggcctgtcgtgggtg

SEQ ID NO: 8787262 - DNA, 22 bp, Homo sapiens
cactgtggggtttggctggaac

SEQ ID NO: 8787263 - DNA, 22 bp, Homo sapiens
agcattagaagaaatgattata

SEQ ID NO: 8787264 - DNA, 22 bp, Homo sapiens
agcattagattaaaaatttaga

SEQ ID NO: 8787265 - DNA, 19 bp, Homo sapiens
agcattaggcaaattttga

SEQ ID NO: 8787266 - DNA, 22 bp, Homo sapiens
agcattactattctcaaaaaca

SEQ ID NO: 8787267 - DNA, 22 bp, Homo sapiens
agcattaataagaaatggctcc

SEQ ID NO: 8787268 - DNA, 22 bp, Homo sapiens
agcatgttgggatgagaaggaa

SEQ ID NO: 8787269 - DNA, 22 bp, Homo sapiens
cactgtggggtttggctggaac

SEQ ID NO: 8787270 - DNA, 22 bp, Homo sapiens
cactgtgggtcccagactggag

SEQ ID NO: 8787271 - DNA, 22 bp, Homo sapiens
cactgtgtaagaagatgggctt

SEQ ID NO: 8787272 - DNA, 22 bp, Homo sapiens
cactgtgtaagaagatgggctt

SEQ ID NO: 8787273 - DNA, 22 bp, Homo sapiens
cactgtgtcagagtatgatgat

SEQ ID NO: 8787274 - DNA, 23 bp, Homo sapiens
agcagtcagggtggtaagccatc

SEQ ID NO: 8787275 - DNA, 22 bp, Homo sapiens
agcagtcattttaggtcatgca

SEQ ID NO: 8787276 - DNA, 22 bp, Homo sapiens
agcagtccaactgaggtggcat

SEQ ID NO: 8787277 - DNA, 22 bp, Homo sapiens
agcagtaagtgaagactagttt

SEQ ID NO: 8787278 - DNA, 20 bp, Homo sapiens
agcagtaggacctctgggcc

SEQ ID NO: 8787279 - DNA, 22 bp, Homo sapiens
agcagtattctcctgtggtgga

SEQ ID NO: 8787280 - DNA, 22 bp, Homo sapiens
agcagtaagacttttttctgtg

SEQ ID NO: 8787281 - DNA, 23 bp, Homo sapiens
agcagtaacttcagaaacatcag

SEQ ID NO: 8787282 - DNA, 22 bp, Homo sapiens
agcaggttgttttgtggccagg

SEQ ID NO: 8787283 - DNA, 23 bp, Homo sapiens
agcagtaacttcagaaacatcag

SEQ ID NO: 8787284 - DNA, 23 bp, Homo sapiens
agcagtaacttcagaaacatcag

SEQ ID NO: 8787285 - DNA, 22 bp, Homo sapiens
agcaggttgtgatacactcaga

SEQ ID NO: 8787286 - DNA, 18 bp, Homo sapiens
agcaggtgtgcagaatgt

SEQ ID NO: 8787287 - DNA, 22 bp, Homo sapiens
agcaggtgggcatgaaagctga

SEQ ID NO: 8787288 - DNA, 22 bp, Homo sapiens
agcaggtgttggctgggccatc

SEQ ID NO: 8787289 - DNA, 22 bp, Homo sapiens
agcagggctggatttggcaaga

SEQ ID NO: 8787290 - DNA, 22 bp, Homo sapiens
agcagggctggatttggcaaga

SEQ ID NO: 8787291 - DNA, 22 bp, Homo sapiens
agcagggctggatttggcaaga

SEQ ID NO: 8787292 - DNA, 22 bp, Homo sapiens
agcagggctgcggccccaccac

SEQ ID NO: 8787293 - DNA, 22 bp, Homo sapiens
agcaggtgtcggcgagggtctt

SEQ ID NO: 8787294 - DNA, 22 bp, Homo sapiens
agcagggctggggcacgagcca

SEQ ID NO: 8787295 - DNA, 22 bp, Homo sapiens
agcagtgccgcatcttgtgacc

SEQ ID NO: 8787296 - DNA, 22 bp, Homo sapiens
agcagtgatgcatgacagccta

SEQ ID NO: 8787297 - DNA, 22 bp, Homo sapiens
agcagtgatgcatgacagccta

SEQ ID NO: 8787298 - DNA, 22 bp, Homo sapiens
agcagtgattctcttggactca

SEQ ID NO: 8787299 - DNA, 22 bp, Homo sapiens
agcagtgctatggccaggctaa

SEQ ID NO: 8787300 - DNA, 22 bp, Homo sapiens
agcagtgctatggccaggctaa

SEQ ID NO: 8787301 - DNA, 22 bp, Homo sapiens
agcagtggacctcagtgctatt

SEQ ID NO: 8787302 - DNA, 22 bp, Homo sapiens
agcagtgatgaaatgagcatcc

SEQ ID NO: 8787303 - DNA, 22 bp, Homo sapiens
agcagtgagtgggaggaccatg

SEQ ID NO: 8787304 - DNA, 22 bp, Homo sapiens
agcagtgagtgggaggaccatg

SEQ ID NO: 8787305 - DNA, 23 bp, Homo sapiens
agcagtgagtaaacagataggat

SEQ ID NO: 8787306 - DNA, 22 bp, Homo sapiens
agcagtgagtaacacagaccag

SEQ ID NO: 8787307 - DNA, 22 bp, Homo sapiens
agcagtgaaacagctgcatatg

SEQ ID NO: 8787308 - DNA, 22 bp, Homo sapiens
agcagtgagccataagtgctag

SEQ ID NO: 8787309 - DNA, 22 bp, Homo sapiens
agcagtgagccataagtgctag

SEQ ID NO: 8787310 - DNA, 22 bp, Homo sapiens
agcatattgtatgtctatatgt

SEQ ID NO: 8787311 - DNA, 22 bp, Homo sapiens
agcatattgtatgtctatatgt

SEQ ID NO: 8787312 - DNA, 22 bp, Homo sapiens
agcatattgtatgtctatatgt

SEQ ID NO: 8787313 - DNA, 22 bp, Homo sapiens
agcatattcatgccagactact

SEQ ID NO: 8787314 - DNA, 22 bp, Homo sapiens
agcatattgtctttggtgtctc

SEQ ID NO: 8787315 - DNA, 22 bp, Homo sapiens
agcatattgtctttggtgtctc

SEQ ID NO: 8787316 - DNA, 22 bp, Homo sapiens
agcatcagagagaagttaacta

SEQ ID NO: 8787317 - DNA, 22 bp, Homo sapiens
agcagtggcctggggctctgtg

SEQ ID NO: 8787318 - DNA, 22 bp, Homo sapiens
agcatataggaaatgttgaatc

SEQ ID NO: 8787319 - DNA, 19 bp, Homo sapiens
agcagtggagccatgcctg

SEQ ID NO: 8787320 - DNA, 18 bp, Homo sapiens
agcatgagtcaggggtgc

SEQ ID NO: 8787321 - DNA, 18 bp, Homo sapiens
agcatgagagaggctgtg

SEQ ID NO: 8787322 - DNA, 18 bp, Homo sapiens
agcatgagagaggctgtg

SEQ ID NO: 8787323 - DNA, 22 bp, Homo sapiens
agcatgaagacttcagagctag

SEQ ID NO: 8787324 - DNA, 22 bp, Homo sapiens
agcatgaaagcataggacagtc

SEQ ID NO: 8787325 - DNA, 17 bp, Homo sapiens
agctcctggggtcttta

SEQ ID NO: 8787326 - DNA, 20 bp, Homo sapiens
agctcctggtataggtgcct

SEQ ID NO: 8787327 - DNA, 22 bp, Homo sapiens
agctcctgtctcaagggagcct

SEQ ID NO: 8787328 - DNA, 22 bp, Homo sapiens
agctcctgtctcaagggagcct

SEQ ID NO: 8787329 - DNA, 23 bp, Homo sapiens
agctcctgtaaggtggtcgtcac

SEQ ID NO: 8787330 - DNA, 22 bp, Homo sapiens
agctcctgggcacctctttcac

SEQ ID NO: 8787331 - DNA, 22 bp, Homo sapiens
agctcctgggccatcacaacca

SEQ ID NO: 8787332 - DNA, 22 bp, Homo sapiens
agctcctgggccatcacaacca

SEQ ID NO: 8787333 - DNA, 19 bp, Homo sapiens
agctcctgggctctgggcc

SEQ ID NO: 8787334 - DNA, 22 bp, Homo sapiens
agctcctggctttcctctcacc

SEQ ID NO: 8787335 - DNA, 22 bp, Homo sapiens
agctcctgggagcaggtggtac

SEQ ID NO: 8787336 - DNA, 22 bp, Homo sapiens
agctcctggcaaggtcatggtg

SEQ ID NO: 8787337 - DNA, 22 bp, Homo sapiens
agctcctggcaaggtcatggtg

SEQ ID NO: 8787338 - DNA, 22 bp, Homo sapiens
agctcttcctgcacctgtggct

SEQ ID NO: 8787339 - DNA, 22 bp, Homo sapiens
agctctttatgggtaaatgcca

SEQ ID NO: 8787340 - DNA, 22 bp, Homo sapiens
agctcttacatttaggtctatg

SEQ ID NO: 8787341 - DNA, 22 bp, Homo sapiens
agctcttacatttaggtctatg

SEQ ID NO: 8787342 - DNA, 22 bp, Homo sapiens
agctcttacatttaggtctatg

SEQ ID NO: 8787343 - DNA, 22 bp, Homo sapiens
agctcttacatttaggtctatg

SEQ ID NO: 8787344 - DNA, 22 bp, Homo sapiens
agctcttcctgcacctgtggct

SEQ ID NO: 8787345 - DNA, 22 bp, Homo sapiens
agctctttctacaagcaggcag

SEQ ID NO: 8787346 - DNA, 22 bp, Homo sapiens
agctctttgagaaggcagtgtg

SEQ ID NO: 8787347 - DNA, 22 bp, Homo sapiens
agctctttgagcaaggcagctc

SEQ ID NO: 8787348 - DNA, 22 bp, Homo sapiens
agctctttgctggcagtaggct

SEQ ID NO: 8787349 - DNA, 22 bp, Homo sapiens
agctctttggcactgagcagca

SEQ ID NO: 8787350 - DNA, 22 bp, Homo sapiens
agctcctgtggctgaaagagga

SEQ ID NO: 8787351 - DNA, 22 bp, Homo sapiens
agctcctgtggcagctcttctg

SEQ ID NO: 8787352 - DNA, 22 bp, Homo sapiens
agctctggtttagaaggggaaa

SEQ ID NO: 8787353 - DNA, 19 bp, Homo sapiens
agctctgtcaggctacata

SEQ ID NO: 8787354 - DNA, 22 bp, Homo sapiens
agctctgtctttctcttagtaa

SEQ ID NO: 8787355 - DNA, 22 bp, Homo sapiens
agctctggtttagaaggggaaa

SEQ ID NO: 8787356 - DNA, 22 bp, Homo sapiens
agctctgtgttcacagcactaa

SEQ ID NO: 8787357 - DNA, 22 bp, Homo sapiens
agctctgtgttcacagcactaa

SEQ ID NO: 8787358 - DNA, 22 bp, Homo sapiens
agctctgtggccttgggtgaat

SEQ ID NO: 8787359 - DNA, 22 bp, Homo sapiens
agctctgtgcaggcagaggcat

SEQ ID NO: 8787360 - DNA, 22 bp, Homo sapiens
agctctgtgaagccagcagttc

SEQ ID NO: 8787361 - DNA, 19 bp, Homo sapiens
agctcctgattgtgcctcg

SEQ ID NO: 8787362 - DNA, 22 bp, Homo sapiens
agctcctggacgaacagggagt

SEQ ID NO: 8787363 - DNA, 22 bp, Homo sapiens
agctcctggaggtgcgcactcg

SEQ ID NO: 8787364 - DNA, 20 bp, Homo sapiens
agctcctggactagagagtg

SEQ ID NO: 8787365 - DNA, 21 bp, Homo sapiens
agctccaggctcctggggttc

SEQ ID NO: 8787366 - DNA, 22 bp, Homo sapiens
agctccaggccttgggccccgg

SEQ ID NO: 8787367 - DNA, 22 bp, Homo sapiens
agctccaggccttgggccccgg

SEQ ID NO: 8787368 - DNA, 19 bp, Homo sapiens
agctcctgattgtgcctcg

SEQ ID NO: 8787369 - DNA, 23 bp, Homo sapiens
agctccagctgacgtgggcagcc

SEQ ID NO: 8787370 - DNA, 22 bp, Homo sapiens
agctccagcctcttctggaggt

SEQ ID NO: 8787371 - DNA, 23 bp, Homo sapiens
agctccagctgacgtgggcagcc

SEQ ID NO: 8787372 - DNA, 23 bp, Homo sapiens
agctccagctgacgtgggcagcc

SEQ ID NO: 8787373 - DNA, 23 bp, Homo sapiens
agctccagctgacgtgggcagcc

SEQ ID NO: 8787374 - DNA, 22 bp, Homo sapiens
agctccaggataagacaggtgc

SEQ ID NO: 8787375 - DNA, 22 bp, Homo sapiens
agctccagattaattgtaggag

SEQ ID NO: 8787376 - DNA, 22 bp, Homo sapiens
agctccagcccatctgctcgtg

SEQ ID NO: 8787377 - DNA, 22 bp, Homo sapiens
agctccagccgctgatgggttt

SEQ ID NO: 8787378 - DNA, 22 bp, Homo sapiens
agctccagccgctgatgggttt

SEQ ID NO: 8787379 - DNA, 22 bp, Homo sapiens
agctccagcctcttctggaggt

SEQ ID NO: 8787380 - DNA, 22 bp, Homo sapiens
agctccagccctagtacagctg

SEQ ID NO: 8787381 - DNA, 22 bp, Homo sapiens
agctccagaagcctgcaaggta

SEQ ID NO: 8787382 - DNA, 22 bp, Homo sapiens
agctccagaggcagtgatgaag

SEQ ID NO: 8787383 - DNA, 22 bp, Homo sapiens
agctccagaagcctgcaaggta

SEQ ID NO: 8787384 - DNA, 22 bp, Homo sapiens
agctccagaagcctgcaaggta

SEQ ID NO: 8787385 - DNA, 23 bp, Homo sapiens
agctccagaacatagcacaggaa

SEQ ID NO: 8787386 - DNA, 20 bp, Homo sapiens
agctaggagaaagcatggag

SEQ ID NO: 8787387 - DNA, 20 bp, Homo sapiens
agctaggagaaagcatggag

SEQ ID NO: 8787388 - DNA, 22 bp, Homo sapiens
agctccagaaaggtacacacag

SEQ ID NO: 8787389 - DNA, 22 bp, Homo sapiens
agctaggaaattgaggctgaga

SEQ ID NO: 8787390 - DNA, 22 bp, Homo sapiens
agctagcaggaagcagtttagt

SEQ ID NO: 8787391 - DNA, 22 bp, Homo sapiens
agctagctttaactcttagaca

SEQ ID NO: 8787392 - DNA, 21 bp, Homo sapiens
agcctgggaggcggaggttgc

SEQ ID NO: 8787393 - DNA, 22 bp, Homo sapiens
agcctgggagacactaagttgt

SEQ ID NO: 8787394 - DNA, 21 bp, Homo sapiens
agcctgggaggcggaggttgc

SEQ ID NO: 8787395 - DNA, 22 bp, Homo sapiens
agcctgggaatttagagttcgg

SEQ ID NO: 8787396 - DNA, 22 bp, Homo sapiens
agcctgggaatttagagttcgg

SEQ ID NO: 8787397 - DNA, 17 bp, Homo sapiens
agcctgggaaggagtga

SEQ ID NO: 8787398 - DNA, 17 bp, Homo sapiens
agcctgggaaggagtga

SEQ ID NO: 8787399 - DNA, 22 bp, Homo sapiens
agcctgggaatttagagttcgg

SEQ ID NO: 8787400 - DNA, 22 bp, Homo sapiens
agcctgggcatgggacgggagg

SEQ ID NO: 8787401 - DNA, 22 bp, Homo sapiens
agcctgggcaacagagcaaaac

SEQ ID NO: 8787402 - DNA, 22 bp, Homo sapiens
agcctgggcaacagagcaaaac

SEQ ID NO: 8787403 - DNA, 21 bp, Homo sapiens
agcctgggaggcggaggttgc

SEQ ID NO: 8787404 - DNA, 22 bp, Homo sapiens
agcctgggcaacaacacagcga

SEQ ID NO: 8787405 - DNA, 22 bp, Homo sapiens
agcctgggcaacaacacagcga

SEQ ID NO: 8787406 - DNA, 22 bp, Homo sapiens
agcctgggcaacaacacagcga

SEQ ID NO: 8787407 - DNA, 22 bp, Homo sapiens
agcctgggcaacaacacagcga

SEQ ID NO: 8787408 - DNA, 22 bp, Homo sapiens
agcctgggcaacagagcaaaac

SEQ ID NO: 8787409 - DNA, 17 bp, Homo sapiens
agcctgggaaggagtga

SEQ ID NO: 8787410 - DNA, 17 bp, Homo sapiens
agcctgggaaggagtga

SEQ ID NO: 8787411 - DNA, 17 bp, Homo sapiens
agcctgggaaggagtga

SEQ ID NO: 8787412 - DNA, 19 bp, Homo sapiens
agcctggctttgctctgct

SEQ ID NO: 8787413 - DNA, 19 bp, Homo sapiens
agcctggctttgctctgct

SEQ ID NO: 8787414 - DNA, 22 bp, Homo sapiens
agcctggcttagctctctcact

SEQ ID NO: 8787415 - DNA, 22 bp, Homo sapiens
agcctggcttagctctctcact

SEQ ID NO: 8787416 - DNA, 22 bp, Homo sapiens
agcctggccactcagggcctga

SEQ ID NO: 8787417 - DNA, 22 bp, Homo sapiens
agcctggcttagctctctcact

SEQ ID NO: 8787418 - DNA, 20 bp, Homo sapiens
cagcaactttggactgagtt

SEQ ID NO: 8787419 - DNA, 22 bp, Homo sapiens
cagcaagaaaattcacatgctc

SEQ ID NO: 8787420 - DNA, 22 bp, Homo sapiens
cagcaagaaaattcacatgctc

SEQ ID NO: 8787421 - DNA, 22 bp, Homo sapiens
cagatggtagcagtagcttgct

SEQ ID NO: 8787422 - DNA, 22 bp, Homo sapiens
cagatggggcaaggccatctgt

SEQ ID NO: 8787423 - DNA, 20 bp, Homo sapiens
cagatgggacgtggaggagt

SEQ ID NO: 8787424 - DNA, 22 bp, Homo sapiens
cagatggggcaaggccatctgt

SEQ ID NO: 8787425 - DNA, 20 bp, Homo sapiens
cagatgggacgtggaggagt

SEQ ID NO: 8787426 - DNA, 20 bp, Homo sapiens
cagatgggacgtggaggagt

SEQ ID NO: 8787427 - DNA, 18 bp, Homo sapiens
cagatggtggagttttta

SEQ ID NO: 8787428 - DNA, 22 bp, Homo sapiens
cagatgtaatctgacagctgga

SEQ ID NO: 8787429 - DNA, 22 bp, Homo sapiens
cagatgtaattactcaagtcaa

SEQ ID NO: 8787430 - DNA, 22 bp, Homo sapiens
cagatgtaattactcaagtcaa

SEQ ID NO: 8787431 - DNA, 22 bp, Homo sapiens
cagatgtacatgaagggcaatg

SEQ ID NO: 8787432 - DNA, 22 bp, Homo sapiens
cagatgtacatgaagggcaatg

SEQ ID NO: 8787433 - DNA, 22 bp, Homo sapiens
cagatgtacatgaagggcaatg

SEQ ID NO: 8787434 - DNA, 22 bp, Homo sapiens
cagatgtcgaaggatgtgaccg

SEQ ID NO: 8787435 - DNA, 22 bp, Homo sapiens
cagatgtagtagctttattgca

SEQ ID NO: 8787436 - DNA, 23 bp, Homo sapiens
cagatgtgcaactctaggcaatg

SEQ ID NO: 8787437 - DNA, 22 bp, Homo sapiens
cagatgtgcctccagggctttg

SEQ ID NO: 8787438 - DNA, 22 bp, Homo sapiens
cagcaacatgtggtagtgtagg

SEQ ID NO: 8787439 - DNA, 22 bp, Homo sapiens
cagcaacatatatgaaactgtg

SEQ ID NO: 8787440 - DNA, 22 bp, Homo sapiens
cagcaaattttaatactgcttt

SEQ ID NO: 8787441 - DNA, 22 bp, Homo sapiens
cagcaaatactactagttttta

SEQ ID NO: 8787442 - DNA, 22 bp, Homo sapiens
cagatgtggaatgcagcaggct

SEQ ID NO: 8787443 - DNA, 22 bp, Homo sapiens
cagcaaatactactagttttta

SEQ ID NO: 8787444 - DNA, 21 bp, Homo sapiens
cagcaaatcattgggcagact

SEQ ID NO: 8787445 - DNA, 22 bp, Homo sapiens
cagcaacttaggcagaacatct

SEQ ID NO: 8787446 - DNA, 22 bp, Homo sapiens
cagcaactgtgcctgacacaca

SEQ ID NO: 8787447 - DNA, 22 bp, Homo sapiens
cagcaactctcctgtgctcaaa

SEQ ID NO: 8787448 - DNA, 20 bp, Homo sapiens
cagcaactttggactgagtt

SEQ ID NO: 8787449 - DNA, 18 bp, Homo sapiens
cagcaactttagatcctg

SEQ ID NO: 8787450 - DNA, 22 bp, Homo sapiens
cagcaactggtcattgctctcc

SEQ ID NO: 8787451 - DNA, 22 bp, Homo sapiens
cagcaactcctgtagcttatgc

SEQ ID NO: 8787452 - DNA, 22 bp, Homo sapiens
agcctgggtgggggttcggaga

SEQ ID NO: 8787453 - DNA, 22 bp, Homo sapiens
agcctgggttagggttcttccc

SEQ ID NO: 8787454 - DNA, 22 bp, Homo sapiens
agcctggtgtggggctgcagag

SEQ ID NO: 8787455 - DNA, 22 bp, Homo sapiens
agcctgggtttttattaaggag

SEQ ID NO: 8787456 - DNA, 20 bp, Homo sapiens
agcggcagcttcctgcttcg

SEQ ID NO: 8787457 - DNA, 22 bp, Homo sapiens
agcggcagcagatgtgatcagg

SEQ ID NO: 8787458 - DNA, 21 bp, Homo sapiens
agcggcagaccctgcatttga

SEQ ID NO: 8787459 - DNA, 21 bp, Homo sapiens
agcctgggtatcctttgagga

SEQ ID NO: 8787460 - DNA, 21 bp, Homo sapiens
agcctgggtatcctttgagga

SEQ ID NO: 8787461 - DNA, 21 bp, Homo sapiens
agcctgggtatcctttgagga

SEQ ID NO: 8787462 - DNA, 22 bp, Homo sapiens
agcctggggtttcagtttgcac

SEQ ID NO: 8787463 - DNA, 22 bp, Homo sapiens
agcctggggtttcagtttgcac

SEQ ID NO: 8787464 - DNA, 22 bp, Homo sapiens
agcctgggggcgcagaaaccgg

SEQ ID NO: 8787465 - DNA, 22 bp, Homo sapiens
agcctggggtttcagtttgcac

SEQ ID NO: 8787466 - DNA, 22 bp, Homo sapiens
agcctggggcacttctccaaac

SEQ ID NO: 8787467 - DNA, 22 bp, Homo sapiens
agcctggggcacttctccaaac

SEQ ID NO: 8787468 - DNA, 18 bp, Homo sapiens
agcctgggctctgcctgg

SEQ ID NO: 8787469 - DNA, 18 bp, Homo sapiens
agcctgggctctgcctgg

SEQ ID NO: 8787470 - DNA, 20 bp, Homo sapiens
agcctggggaattccacccc

SEQ ID NO: 8787471 - DNA, 20 bp, Homo sapiens
agcctggggaattccacccc

SEQ ID NO: 8787472 - DNA, 18 bp, Homo sapiens
agcctgggctctgcctgg

SEQ ID NO: 8787473 - DNA, 18 bp, Homo sapiens
agcctgggctctgcctgg

SEQ ID NO: 8787474 - DNA, 18 bp, Homo sapiens
agcctgggctctgcctgg

SEQ ID NO: 8787475 - DNA, 22 bp, Homo sapiens
agcctgggcatgggacgggagg

SEQ ID NO: 8787476 - DNA, 22 bp, Homo sapiens
agcctgggcatgggacgggagg

SEQ ID NO: 8787477 - DNA, 22 bp, Homo sapiens
agcctgggccctgcctcttctc

SEQ ID NO: 8787478 - DNA, 22 bp, Homo sapiens
agctacaacttttccatgagca

SEQ ID NO: 8787479 - DNA, 20 bp, Homo sapiens
agctacaatgcgaagctggc

SEQ ID NO: 8787480 - DNA, 22 bp, Homo sapiens
agctaaggaatcagaagaggtt

SEQ ID NO: 8787481 - DNA, 23 bp, Homo sapiens
agctaaggaagctgaggcacagt

SEQ ID NO: 8787482 - DNA, 22 bp, Homo sapiens
agctaaggaactctgtaacacc

SEQ ID NO: 8787483 - DNA, 23 bp, Homo sapiens
agctaaggaagctgaggcacagt

SEQ ID NO: 8787484 - DNA, 22 bp, Homo sapiens
agctaagatttattaaaggccc

SEQ ID NO: 8787485 - DNA, 19 bp, Homo sapiens
agctaactcactaactatg

SEQ ID NO: 8787486 - DNA, 20 bp, Homo sapiens
agctaagaggaaaagtgaga

SEQ ID NO: 8787487 - DNA, 20 bp, Homo sapiens
agctaagaggaaaagtgaga

SEQ ID NO: 8787488 - DNA, 22 bp, Homo sapiens
agctaaggtgtcctggaggccc

SEQ ID NO: 8787489 - DNA, 22 bp, Homo sapiens
agctaaggatgactagtacttc

SEQ ID NO: 8787490 - DNA, 22 bp, Homo sapiens
agctaaggccgcgttggggtaa

SEQ ID NO: 8787491 - DNA, 22 bp, Homo sapiens
agctaaggactggagggtttct

SEQ ID NO: 8787492 - DNA, 22 bp, Homo sapiens
agctaaggagcaagtaggagtt

SEQ ID NO: 8787493 - DNA, 22 bp, Homo sapiens
agctaaggacagttgatttaga

SEQ ID NO: 8787494 - DNA, 22 bp, Homo sapiens
agctacctgatccttcttctga

SEQ ID NO: 8787495 - DNA, 22 bp, Homo sapiens
agctacagttgccctcagcagg

SEQ ID NO: 8787496 - DNA, 22 bp, Homo sapiens
agctacccgaggacaggctaag

SEQ ID NO: 8787497 - DNA, 22 bp, Homo sapiens
agctacagctgtactctgcagg

SEQ ID NO: 8787498 - DNA, 22 bp, Homo sapiens
agctacagctgtactctgcagg

SEQ ID NO: 8787499 - DNA, 22 bp, Homo sapiens
agctacagtcggaaggacagac

SEQ ID NO: 8787500 - DNA, 22 bp, Homo sapiens
agctacagtggacaagtgaact

SEQ ID NO: 8787501 - DNA, 22 bp, Homo sapiens
agctacagtggacaagtgaact

SEQ ID NO: 8787502 - DNA, 22 bp, Homo sapiens
agctacagggaactaaaagcta

SEQ ID NO: 8787503 - DNA, 22 bp, Homo sapiens
agctagaatattgatctgaaat

SEQ ID NO: 8787504 - DNA, 22 bp, Homo sapiens
agctagagaatgacagagtctg

SEQ ID NO: 8787505 - DNA, 22 bp, Homo sapiens
agctagactttccctttccatg

SEQ ID NO: 8787506 - DNA, 22 bp, Homo sapiens
agctagagaatgacagagtctg

SEQ ID NO: 8787507 - DNA, 22 bp, Homo sapiens
agctagagctgagaagcacttg

SEQ ID NO: 8787508 - DNA, 22 bp, Homo sapiens
agctacttccctgtaggaaaca

SEQ ID NO: 8787509 - DNA, 22 bp, Homo sapiens
agctacttccctgtaggaaaca

SEQ ID NO: 8787510 - DNA, 22 bp, Homo sapiens
agctagaagtacagccatatga

SEQ ID NO: 8787511 - DNA, 22 bp, Homo sapiens
agctactactaccaaactaaag

SEQ ID NO: 8787512 - DNA, 22 bp, Homo sapiens
agccagtgcaacagcagtgaag

SEQ ID NO: 8787513 - DNA, 22 bp, Homo sapiens
agccagtgccagtcatgcctgc

SEQ ID NO: 8787514 - DNA, 22 bp, Homo sapiens
agccagtgccagtcatgcctgc

SEQ ID NO: 8787515 - DNA, 18 bp, Homo sapiens
cagagctcctggatgcag

SEQ ID NO: 8787516 - DNA, 22 bp, Homo sapiens
cagagctctgacagctacagcc

SEQ ID NO: 8787517 - DNA, 22 bp, Homo sapiens
cagagctctgacagctacagcc

SEQ ID NO: 8787518 - DNA, 22 bp, Homo sapiens
agccagtgtcgtgtgacatgag

SEQ ID NO: 8787519 - DNA, 22 bp, Homo sapiens
agccagtggtgtaatgccgtct

SEQ ID NO: 8787520 - DNA, 22 bp, Homo sapiens
agccagtgggattagagcctct

SEQ ID NO: 8787521 - DNA, 22 bp, Homo sapiens
agccagtgtcgtgtgacatgag

SEQ ID NO: 8787522 - DNA, 22 bp, Homo sapiens
agccagtgttaagtgactggtt

SEQ ID NO: 8787523 - DNA, 22 bp, Homo sapiens
agccagttcaagttatggcgtt

SEQ ID NO: 8787524 - DNA, 22 bp, Homo sapiens
agccagttccagcacaccactg

SEQ ID NO: 8787525 - DNA, 22 bp, Homo sapiens
agccagttccagcacaccactg

SEQ ID NO: 8787526 - DNA, 17 bp, Homo sapiens
agccagttcatagcact

SEQ ID NO: 8787527 - DNA, 17 bp, Homo sapiens
agccagttcatagcact

SEQ ID NO: 8787528 - DNA, 22 bp, Homo sapiens
agccagttcaagttatggcgtt

SEQ ID NO: 8787529 - DNA, 22 bp, Homo sapiens
agcccagggacagggcggatgt

SEQ ID NO: 8787530 - DNA, 22 bp, Homo sapiens
agcccagggacagggcggatgt

SEQ ID NO: 8787531 - DNA, 22 bp, Homo sapiens
agcccaggttgaggctgcagtg

SEQ ID NO: 8787532 - DNA, 22 bp, Homo sapiens
agcccaggttctaaagccaaac

SEQ ID NO: 8787533 - DNA, 22 bp, Homo sapiens
agccagttggctatgaggagga

SEQ ID NO: 8787534 - DNA, 19 bp, Homo sapiens
agccagttggtaagaggct

SEQ ID NO: 8787535 - DNA, 22 bp, Homo sapiens
agccagttctctagtgatattt

SEQ ID NO: 8787536 - DNA, 19 bp, Homo sapiens
agccagttctagacaatgg

SEQ ID NO: 8787537 - DNA, 19 bp, Homo sapiens
agccagttctagacaatgg

SEQ ID NO: 8787538 - DNA, 22 bp, Homo sapiens
agccagttggctatgaggagga

SEQ ID NO: 8787539 - DNA, 22 bp, Homo sapiens
agccagttgatgggtttccaat

SEQ ID NO: 8787540 - DNA, 22 bp, Homo sapiens
agccagttgatgggtttccaat

SEQ ID NO: 8787541 - DNA, 22 bp, Homo sapiens
agccagttctctagtgatattt

SEQ ID NO: 8787542 - DNA, 22 bp, Homo sapiens
agccagttgtggggctagccct

SEQ ID NO: 8787543 - DNA, 22 bp, Homo sapiens
agccagtttccagatattaact

SEQ ID NO: 8787544 - DNA, 22 bp, Homo sapiens
agccagtttgcttgtaataaca

SEQ ID NO: 8787545 - DNA, 22 bp, Homo sapiens
agccagtttccagatattaact

SEQ ID NO: 8787546 - DNA, 19 bp, Homo sapiens
agccagttggtaagaggct

SEQ ID NO: 8787547 - DNA, 23 bp, Homo sapiens
agccagttgtagccacagaactc

SEQ ID NO: 8787548 - DNA, 23 bp, Homo sapiens
agccagttgtagccacagaactc

SEQ ID NO: 8787549 - DNA, 22 bp, Homo sapiens
agccagtttaagcaggaggggt

SEQ ID NO: 8787550 - DNA, 22 bp, Homo sapiens
agccagttgtggggctagccct

SEQ ID NO: 8787551 - DNA, 22 bp, Homo sapiens
agccagtttaagcaggaggggt

SEQ ID NO: 8787552 - DNA, 20 bp, Homo sapiens
agcccatctcccacagctac

SEQ ID NO: 8787553 - DNA, 22 bp, Homo sapiens
agcccatgcaacaggcctagcg

SEQ ID NO: 8787554 - DNA, 22 bp, Homo sapiens
agcccaggttgaggctgcagtg

SEQ ID NO: 8787555 - DNA, 22 bp, Homo sapiens
agcccagttgctccacgctgca

SEQ ID NO: 8787556 - DNA, 22 bp, Homo sapiens
agcccagtgggccgaggcgggg

SEQ ID NO: 8787557 - DNA, 22 bp, Homo sapiens
agcccagttgctccacgctgca

SEQ ID NO: 8787558 - DNA, 22 bp, Homo sapiens
agcccagtgggccgaggcgggg

SEQ ID NO: 8787559 - DNA, 22 bp, Homo sapiens
agcccaggttgaggctgcagtg

SEQ ID NO: 8787560 - DNA, 22 bp, Homo sapiens
agccccaggcccggacgcctct

SEQ ID NO: 8787561 - DNA, 22 bp, Homo sapiens
agccccaggatgggccgcagga

SEQ ID NO: 8787562 - DNA, 22 bp, Homo sapiens
agccccaggatgggccgcagga

SEQ ID NO: 8787563 - DNA, 22 bp, Homo sapiens
agccccagtaagggagggcctg

SEQ ID NO: 8787564 - DNA, 22 bp, Homo sapiens
agccccagtaagggagggcctg

SEQ ID NO: 8787565 - DNA, 22 bp, Homo sapiens
agccccagcccctctctcacaa

SEQ ID NO: 8787566 - DNA, 20 bp, Homo sapiens
agccccacccttgtcctggc

SEQ ID NO: 8787567 - DNA, 22 bp, Homo sapiens
cagatgaagatcatagaatagt

SEQ ID NO: 8787568 - DNA, 20 bp, Homo sapiens
cagatggcacgtcagggcat

SEQ ID NO: 8787569 - DNA, 22 bp, Homo sapiens
cagatgaagtaggtgacgagca

SEQ ID NO: 8787570 - DNA, 22 bp, Homo sapiens
cagatgaaggcctgaatgtcta

SEQ ID NO: 8787571 - DNA, 22 bp, Homo sapiens
agccctgggcagccaaggaagc

SEQ ID NO: 8787572 - DNA, 22 bp, Homo sapiens
agccctgggcagccaaggaagc

SEQ ID NO: 8787573 - DNA, 22 bp, Homo sapiens
agccctgggcgttactgggatg

SEQ ID NO: 8787574 - DNA, 22 bp, Homo sapiens
agccctgggcgttactgggatg

SEQ ID NO: 8787575 - DNA, 22 bp, Homo sapiens
agccctgggcgttactgggatg

SEQ ID NO: 8787576 - DNA, 22 bp, Homo sapiens
agccctgggcgttactgggatg

SEQ ID NO: 8787577 - DNA, 22 bp, Homo sapiens
cagatggctgccaagatgggct

SEQ ID NO: 8787578 - DNA, 22 bp, Homo sapiens
cagatggctgccaagatgggct

SEQ ID NO: 8787579 - DNA, 22 bp, Homo sapiens
cagatggcagggcagctctgca

SEQ ID NO: 8787580 - DNA, 22 bp, Homo sapiens
agccctgggcacctgtgagggg

SEQ ID NO: 8787581 - DNA, 22 bp, Homo sapiens
agccctgggcacctgtgagggg

SEQ ID NO: 8787582 - DNA, 22 bp, Homo sapiens
agccctgggcacctgtgagggg

SEQ ID NO: 8787583 - DNA, 22 bp, Homo sapiens
agccctgggcacctgtgagggg

SEQ ID NO: 8787584 - DNA, 22 bp, Homo sapiens
agccctgggcacctgtgagggg

SEQ ID NO: 8787585 - DNA, 22 bp, Homo sapiens
agccctgggcacctgtgagggg

SEQ ID NO: 8787586 - DNA, 22 bp, Homo sapiens
agccctgggatacagtaaaagc

SEQ ID NO: 8787587 - DNA, 22 bp, Homo sapiens
agccctgggaggccagcttgta

SEQ ID NO: 8787588 - DNA, 22 bp, Homo sapiens
agccctgggaggccagcttgta

SEQ ID NO: 8787589 - DNA, 22 bp, Homo sapiens
agccctgggaggccagcttgta

SEQ ID NO: 8787590 - DNA, 22 bp, Homo sapiens
agccctggctcccagcagcgct

SEQ ID NO: 8787591 - DNA, 22 bp, Homo sapiens
agccctgggagattttctgggt

SEQ ID NO: 8787592 - DNA, 22 bp, Homo sapiens
agccctgggagattttctgggt

SEQ ID NO: 8787593 - DNA, 22 bp, Homo sapiens
agccctggctcccagcagcgct

SEQ ID NO: 8787594 - DNA, 22 bp, Homo sapiens
agccctgggaggccagcttgta

SEQ ID NO: 8787595 - DNA, 22 bp, Homo sapiens
agccctggcccggctgtgcttt

SEQ ID NO: 8787596 - DNA, 22 bp, Homo sapiens
agccctggctcccagcagcgct

SEQ ID NO: 8787597 - DNA, 22 bp, Homo sapiens
agccctggattctgaggtccaa

SEQ ID NO: 8787598 - DNA, 22 bp, Homo sapiens
agccctggcccggctgtgcttt

SEQ ID NO: 8787599 - DNA, 22 bp, Homo sapiens
agccctggcccggctgtgcttt

SEQ ID NO: 8787600 - DNA, 22 bp, Homo sapiens
agccctggcccggctgtgcttt

SEQ ID NO: 8787601 - DNA, 22 bp, Homo sapiens
agccctggcccggctgtgcttt

SEQ ID NO: 8787602 - DNA, 22 bp, Homo sapiens
agccctggcccggctgtgcttt

SEQ ID NO: 8787603 - DNA, 22 bp, Homo sapiens
agccctggagcaaaggtgtctt

SEQ ID NO: 8787604 - DNA, 22 bp, Homo sapiens
agccctggagcaaaggtgtctt

SEQ ID NO: 8787605 - DNA, 22 bp, Homo sapiens
agccctggagcaaaggtgtctt

SEQ ID NO: 8787606 - DNA, 22 bp, Homo sapiens
agccctggaccttagcccccac

SEQ ID NO: 8787607 - DNA, 22 bp, Homo sapiens
agccctggaagccacagtccta

SEQ ID NO: 8787608 - DNA, 22 bp, Homo sapiens
agccctggaagccacagtccta

SEQ ID NO: 8787609 - DNA, 22 bp, Homo sapiens
agccctggaagccacagtccta

SEQ ID NO: 8787610 - DNA, 22 bp, Homo sapiens
agccctggaagccacagtccta

SEQ ID NO: 8787611 - DNA, 22 bp, Homo sapiens
agccctggattctgaggtccaa

SEQ ID NO: 8787612 - DNA, 22 bp, Homo sapiens
agccctggatggacagtttccc

SEQ ID NO: 8787613 - DNA, 22 bp, Homo sapiens
agccctggatggacagtttccc

SEQ ID NO: 8787614 - DNA, 22 bp, Homo sapiens
agccctggcagagccaggtagt

SEQ ID NO: 8787615 - DNA, 22 bp, Homo sapiens
agccctggcagagccaggtagt

SEQ ID NO: 8787616 - DNA, 22 bp, Homo sapiens
agccctggcagagccaggtagt

SEQ ID NO: 8787617 - DNA, 22 bp, Homo sapiens
agccctgcgtgccaggggactg

SEQ ID NO: 8787618 - DNA, 22 bp, Homo sapiens
agccctgattaaccttggcttt

SEQ ID NO: 8787619 - DNA, 22 bp, Homo sapiens
agccctgctgcctgaattagct

SEQ ID NO: 8787620 - DNA, 23 bp, Homo sapiens
agccctgctgagacccagctccc

SEQ ID NO: 8787621 - DNA, 23 bp, Homo sapiens
agccctgctgagacccagctccc

SEQ ID NO: 8787622 - DNA, 17 bp, Homo sapiens
agcccccactcccaagt

SEQ ID NO: 8787623 - DNA, 22 bp, Homo sapiens
agcccccaaaagtgcttatgat

SEQ ID NO: 8787624 - DNA, 22 bp, Homo sapiens
agcccccaaaagtgcttatgat

SEQ ID NO: 8787625 - DNA, 22 bp, Homo sapiens
agccccagttccctggaagtct

SEQ ID NO: 8787626 - DNA, 22 bp, Homo sapiens
agccccagttccctggaagtct

SEQ ID NO: 8787627 - DNA, 22 bp, Homo sapiens
agccccagttccctggaagtct

SEQ ID NO: 8787628 - DNA, 22 bp, Homo sapiens
agccccagttccctggaagtct

SEQ ID NO: 8787629 - DNA, 22 bp, Homo sapiens
agccccagtccgctgcgggcgg

SEQ ID NO: 8787630 - DNA, 22 bp, Homo sapiens
agccagagttgaatgtgagtct

SEQ ID NO: 8787631 - DNA, 21 bp, Homo sapiens
agccagatccattttgcatgg

SEQ ID NO: 8787632 - DNA, 22 bp, Homo sapiens
agccagagttgaatgtgagtct

SEQ ID NO: 8787633 - DNA, 19 bp, Homo sapiens
agccagagtggcccagggg

SEQ ID NO: 8787634 - DNA, 19 bp, Homo sapiens
agccagagtggcccagggg

SEQ ID NO: 8787635 - DNA, 22 bp, Homo sapiens
agccagagagtgttggagatgt

SEQ ID NO: 8787636 - DNA, 22 bp, Homo sapiens
cactttctgtgttgtgcaaaaa

SEQ ID NO: 8787637 - DNA, 21 bp, Homo sapiens
agccagcaacacagcatctcc

SEQ ID NO: 8787638 - DNA, 22 bp, Homo sapiens
agccagatgaagaggtccttaa

SEQ ID NO: 8787639 - DNA, 22 bp, Homo sapiens
agccagcacggcgccatggagt

SEQ ID NO: 8787640 - DNA, 22 bp, Homo sapiens
agccagcacggatttcccagga

SEQ ID NO: 8787641 - DNA, 22 bp, Homo sapiens
agccagcacggcgccatggagt

SEQ ID NO: 8787642 - DNA, 22 bp, Homo sapiens
agccagcactttttctctgggc

SEQ ID NO: 8787643 - DNA, 22 bp, Homo sapiens
cactttcaagtttcagaggata

SEQ ID NO: 8787644 - DNA, 22 bp, Homo sapiens
cactttcaagtttcagaggata

SEQ ID NO: 8787645 - DNA, 22 bp, Homo sapiens
cactttctcatgaatttggccc

SEQ ID NO: 8787646 - DNA, 22 bp, Homo sapiens
cactttctgtgtatcttccatt

SEQ ID NO: 8787647 - DNA, 22 bp, Homo sapiens
cactttctgtgtatcttccatt

SEQ ID NO: 8787648 - DNA, 22 bp, Homo sapiens
cactttatgggaagcaaaaatt

SEQ ID NO: 8787649 - DNA, 19 bp, Homo sapiens
cactttatttctgttttgt

SEQ ID NO: 8787650 - DNA, 19 bp, Homo sapiens
cactttatttctgttttgt

SEQ ID NO: 8787651 - DNA, 22 bp, Homo sapiens
cactttcaagtttcagaggata

SEQ ID NO: 8787652 - DNA, 22 bp, Homo sapiens
cactttatgggaagcaaaaatt

SEQ ID NO: 8787653 - DNA, 22 bp, Homo sapiens
cactttatgggaagcaaaaatt

SEQ ID NO: 8787654 - DNA, 22 bp, Homo sapiens
cactttataaaattggtgtgag

SEQ ID NO: 8787655 - DNA, 22 bp, Homo sapiens
agccagcccctgactgtgtcct

SEQ ID NO: 8787656 - DNA, 22 bp, Homo sapiens
agccagcccctgactgtgtcct

SEQ ID NO: 8787657 - DNA, 22 bp, Homo sapiens
agccagcatgaagacagaggcc

SEQ ID NO: 8787658 - DNA, 22 bp, Homo sapiens
agccagcatcccttcagtctcc

SEQ ID NO: 8787659 - DNA, 22 bp, Homo sapiens
agccagcatcccttcagtctcc

SEQ ID NO: 8787660 - DNA, 22 bp, Homo sapiens
agccagcatcccttcagtctcc

SEQ ID NO: 8787661 - DNA, 22 bp, Homo sapiens
agccagcatcccttcagtctcc

SEQ ID NO: 8787662 - DNA, 22 bp, Homo sapiens
agccagcatcttgcttcttgag

SEQ ID NO: 8787663 - DNA, 22 bp, Homo sapiens
agccagcaggtgagtgcagcct

SEQ ID NO: 8787664 - DNA, 17 bp, Homo sapiens
agccagcagtagctggt

SEQ ID NO: 8787665 - DNA, 17 bp, Homo sapiens
agccagcagtagctggt

SEQ ID NO: 8787666 - DNA, 22 bp, Homo sapiens
agccagcaggtgcagaattcca

SEQ ID NO: 8787667 - DNA, 22 bp, Homo sapiens
agccagcaggtgggaaactgga

SEQ ID NO: 8787668 - DNA, 19 bp, Homo sapiens
agccagcagcgtagcatct

SEQ ID NO: 8787669 - DNA, 22 bp, Homo sapiens
agccagcactttttctctgggc

SEQ ID NO: 8787670 - DNA, 22 bp, Homo sapiens
agccagcagggcttagaggaca

SEQ ID NO: 8787671 - DNA, 19 bp, Homo sapiens
agccagcaggcctctgagc

SEQ ID NO: 8787672 - DNA, 22 bp, Homo sapiens
cagagctcagagctgccaggca

SEQ ID NO: 8787673 - DNA, 22 bp, Homo sapiens
cagagctcagagcagggcactc

SEQ ID NO: 8787674 - DNA, 22 bp, Homo sapiens
cagagcggccactagagggcgc

SEQ ID NO: 8787675 - DNA, 22 bp, Homo sapiens
cagagctcagagcagggcactc

SEQ ID NO: 8787676 - DNA, 22 bp, Homo sapiens
cagagcggccactagagggcgc

SEQ ID NO: 8787677 - DNA, 22 bp, Homo sapiens
cagagctcagagcagggcactc

SEQ ID NO: 8787678 - DNA, 22 bp, Homo sapiens
cagagccttagttctcctagaa

SEQ ID NO: 8787679 - DNA, 22 bp, Homo sapiens
cagagccttagttctcctagaa

SEQ ID NO: 8787680 - DNA, 19 bp, Homo sapiens
cagagccttcagtgactcc

SEQ ID NO: 8787681 - DNA, 19 bp, Homo sapiens
cagagccttcagtgactcc

SEQ ID NO: 8787682 - DNA, 22 bp, Homo sapiens
cagagccttcctagcagactct

SEQ ID NO: 8787683 - DNA, 22 bp, Homo sapiens
cagagccttcctagcagactct

SEQ ID NO: 8787684 - DNA, 22 bp, Homo sapiens
cagagcggccactagagggcgc

SEQ ID NO: 8787685 - DNA, 22 bp, Homo sapiens
cagagcctttgtgtccacattt

SEQ ID NO: 8787686 - DNA, 22 bp, Homo sapiens
cagagcctttgtgtccacattt

SEQ ID NO: 8787687 - DNA, 22 bp, Homo sapiens
agccaggccagctgtcttgagt

SEQ ID NO: 8787688 - DNA, 22 bp, Homo sapiens
agccaggccagactcacaccct

SEQ ID NO: 8787689 - DNA, 22 bp, Homo sapiens
agccaggccagctgtcttgagt

SEQ ID NO: 8787690 - DNA, 22 bp, Homo sapiens
agccaggccttagggagaggca

SEQ ID NO: 8787691 - DNA, 22 bp, Homo sapiens
agccaggccttagggagaggca

SEQ ID NO: 8787692 - DNA, 20 bp, Homo sapiens
agccaggcctcaagttaagt

SEQ ID NO: 8787693 - DNA, 22 bp, Homo sapiens
cagagcctggcgatgtcatgga

SEQ ID NO: 8787694 - DNA, 22 bp, Homo sapiens
cagagcctggcgatgtcatgga

SEQ ID NO: 8787695 - DNA, 22 bp, Homo sapiens
cagagcctggcgatgtcatgga

SEQ ID NO: 8787696 - DNA, 22 bp, Homo sapiens
cagagcccaagagcaagccatg

SEQ ID NO: 8787697 - DNA, 22 bp, Homo sapiens
cagagccattatggagacttgc

SEQ ID NO: 8787698 - DNA, 22 bp, Homo sapiens
cagagccattatggagacttgc

SEQ ID NO: 8787699 - DNA, 22 bp, Homo sapiens
agccaggccttttctcaaggtt

SEQ ID NO: 8787700 - DNA, 22 bp, Homo sapiens
agccaggccttagggagaggca

SEQ ID NO: 8787701 - DNA, 22 bp, Homo sapiens
cagagacatgtggcctgcacgt

SEQ ID NO: 8787702 - DNA, 22 bp, Homo sapiens
cagagacatgtggcctgcacgt

SEQ ID NO: 8787703 - DNA, 22 bp, Homo sapiens
cagagacattaagtgccatgat

SEQ ID NO: 8787704 - DNA, 22 bp, Homo sapiens
cagagacattaagtgccatgat

SEQ ID NO: 8787705 - DNA, 22 bp, Homo sapiens
cagagacattaagtgccatgat

SEQ ID NO: 8787706 - DNA, 22 bp, Homo sapiens
cagagacattcagtaaattatc

SEQ ID NO: 8787707 - DNA, 22 bp, Homo sapiens
cagagacattctccccattgga

SEQ ID NO: 8787708 - DNA, 22 bp, Homo sapiens
cagagacattcagtaaattatc

SEQ ID NO: 8787709 - DNA, 22 bp, Homo sapiens
cagagacattcagtaaattatc

SEQ ID NO: 8787710 - DNA, 22 bp, Homo sapiens
cagagacattaagtgccatgat

SEQ ID NO: 8787711 - DNA, 22 bp, Homo sapiens
cagagacatgtggcctgcacgt

SEQ ID NO: 8787712 - DNA, 22 bp, Homo sapiens
cagagacatgtggcctgcacgt

SEQ ID NO: 8787713 - DNA, 22 bp, Homo sapiens
cagagacatccatgttagttgg

SEQ ID NO: 8787714 - DNA, 20 bp, Homo sapiens
cagagacccaggcttcagct

SEQ ID NO: 8787715 - DNA, 20 bp, Homo sapiens
cagagacccaggcttcagct

SEQ ID NO: 8787716 - DNA, 22 bp, Homo sapiens
cagagaccccgctgcccttctg

SEQ ID NO: 8787717 - DNA, 20 bp, Homo sapiens
cagagacccaggcttcagct

SEQ ID NO: 8787718 - DNA, 22 bp, Homo sapiens
cagagaccctaggcaggtgaca

SEQ ID NO: 8787719 - DNA, 22 bp, Homo sapiens
cagagacccctggcatggtggt

SEQ ID NO: 8787720 - DNA, 17 bp, Homo sapiens
agccaggcatatgaagt

SEQ ID NO: 8787721 - DNA, 22 bp, Homo sapiens
cagagacccttctcagtggcca

SEQ ID NO: 8787722 - DNA, 22 bp, Homo sapiens
cagagacccttctcagtggcca

SEQ ID NO: 8787723 - DNA, 22 bp, Homo sapiens
cagagacccttctcagtggcca

SEQ ID NO: 8787724 - DNA, 22 bp, Homo sapiens
aaatcatgttggcacaataaaa

SEQ ID NO: 8787725 - DNA, 22 bp, Homo sapiens
aaatcatggtggaagaaacaga

SEQ ID NO: 8787726 - DNA, 22 bp, Homo sapiens
aaatcatgtgcagagatcagga

SEQ ID NO: 8787727 - DNA, 22 bp, Homo sapiens
aaatcatctctgcatccttagc

SEQ ID NO: 8787728 - DNA, 22 bp, Homo sapiens
aaatcatctctgcatccttagc

SEQ ID NO: 8787729 - DNA, 22 bp, Homo sapiens
aaatcatctctgcatccttagc

SEQ ID NO: 8787730 - DNA, 21 bp, Homo sapiens
aaatccaaacactagtccaca

SEQ ID NO: 8787731 - DNA, 22 bp, Homo sapiens
aaatcattatttacagttctga

SEQ ID NO: 8787732 - DNA, 22 bp, Homo sapiens
aaatcattatttacagttctga

SEQ ID NO: 8787733 - DNA, 21 bp, Homo sapiens
aaatccaaacactagtccaca

SEQ ID NO: 8787734 - DNA, 22 bp, Homo sapiens
aaatccagtgggtcctcatgag

SEQ ID NO: 8787735 - DNA, 22 bp, Homo sapiens
aaatattagggagaacagggac

SEQ ID NO: 8787736 - DNA, 22 bp, Homo sapiens
aaatatgttttccagttgtcat

SEQ ID NO: 8787737 - DNA, 22 bp, Homo sapiens
aaatatgttttccagttgtcat

SEQ ID NO: 8787738 - DNA, 22 bp, Homo sapiens
aaatatgtgatcagtgaataaa

SEQ ID NO: 8787739 - DNA, 22 bp, Homo sapiens
aaatatgttttccagttgtcat

SEQ ID NO: 8787740 - DNA, 22 bp, Homo sapiens
aaatcagttgttatattaaaga

SEQ ID NO: 8787741 - DNA, 22 bp, Homo sapiens
aaatcagttggaacacaagcag

SEQ ID NO: 8787742 - DNA, 22 bp, Homo sapiens
aaatcagttctccctttcttca

SEQ ID NO: 8787743 - DNA, 22 bp, Homo sapiens
aaatcagttggaacacaagcag

SEQ ID NO: 8787744 - DNA, 22 bp, Homo sapiens
aaatcagttggaacacaagcag

SEQ ID NO: 8787745 - DNA, 22 bp, Homo sapiens
aaatcagtccctcttggaattt

SEQ ID NO: 8787746 - DNA, 22 bp, Homo sapiens
aaatcagtccctcttggaattt

SEQ ID NO: 8787747 - DNA, 22 bp, Homo sapiens
aaatcagttagtggtaggattg

SEQ ID NO: 8787748 - DNA, 22 bp, Homo sapiens
aaatgcagctgggcatgagagg

SEQ ID NO: 8787749 - DNA, 20 bp, Homo sapiens
aaatgccagtgattctgctt

SEQ ID NO: 8787750 - DNA, 22 bp, Homo sapiens
aaatgcctagaaatcacgcaga

SEQ ID NO: 8787751 - DNA, 22 bp, Homo sapiens
aaatgcctctgctgtacacaat

SEQ ID NO: 8787752 - DNA, 22 bp, Homo sapiens
aaatgcctcccattctactgac

SEQ ID NO: 8787753 - DNA, 18 bp, Homo sapiens
aaatgctaggctacatga

SEQ ID NO: 8787754 - DNA, 22 bp, Homo sapiens
aaatgctacacaggaattctca

SEQ ID NO: 8787755 - DNA, 22 bp, Homo sapiens
aaatgctaacaaggaatgctgc

SEQ ID NO: 8787756 - DNA, 22 bp, Homo sapiens
aaatgctagggagaaactctcc

SEQ ID NO: 8787757 - DNA, 18 bp, Homo sapiens
aaatgctaggctacatga

SEQ ID NO: 8787758 - DNA, 22 bp, Homo sapiens
aaatgctctggggataagactg

SEQ ID NO: 8787759 - DNA, 22 bp, Homo sapiens
aaatgctctctaatgtaataca

SEQ ID NO: 8787760 - DNA, 22 bp, Homo sapiens
aaatgctctgcatctgatagac

SEQ ID NO: 8787761 - DNA, 22 bp, Homo sapiens
aaatgctctggatgaccttgga

SEQ ID NO: 8787762 - DNA, 22 bp, Homo sapiens
aaatgctcaccacagggatgtg

SEQ ID NO: 8787763 - DNA, 22 bp, Homo sapiens
aaatgctctccaaaatgaaagt

SEQ ID NO: 8787764 - DNA, 22 bp, Homo sapiens
aaatgctcgccttggccgagac

SEQ ID NO: 8787765 - DNA, 22 bp, Homo sapiens
aaatgctcatagatggcaatga

SEQ ID NO: 8787766 - DNA, 23 bp, Homo sapiens
aaatgctgaatctttactgttta

SEQ ID NO: 8787767 - DNA, 23 bp, Homo sapiens
aaatgctgaatctttactgttta

SEQ ID NO: 8787768 - DNA, 23 bp, Homo sapiens
aaatgctgaatctttactgttta

SEQ ID NO: 8787769 - DNA, 20 bp, Homo sapiens
aaatgctgagaagtccttaa

SEQ ID NO: 8787770 - DNA, 22 bp, Homo sapiens
aaatgctgagtgtttagagatc

SEQ ID NO: 8787771 - DNA, 22 bp, Homo sapiens
aaatggcaggctctttgctagt

SEQ ID NO: 8787772 - DNA, 22 bp, Homo sapiens
aaatggcagtagaaaagaatcc

SEQ ID NO: 8787773 - DNA, 22 bp, Homo sapiens
aaatggcattcagcaacctttc

SEQ ID NO: 8787774 - DNA, 23 bp, Homo sapiens
aaatggccaaaaccaggtggtta

SEQ ID NO: 8787775 - DNA, 22 bp, Homo sapiens
aaactaaggtgctgtggactga

SEQ ID NO: 8787776 - DNA, 22 bp, Homo sapiens
aaactaagactaatgaagaact

SEQ ID NO: 8787777 - DNA, 20 bp, Homo sapiens
aaactaaaggtgtttggttt

SEQ ID NO: 8787778 - DNA, 23 bp, Homo sapiens
aaactacatttatagtttttctc

SEQ ID NO: 8787779 - DNA, 23 bp, Homo sapiens
aaactacatttatagtttttctc

SEQ ID NO: 8787780 - DNA, 22 bp, Homo sapiens
aaactacatctcatggatgagg

SEQ ID NO: 8787781 - DNA, 22 bp, Homo sapiens
aaactacatctcatggatgagg

SEQ ID NO: 8787782 - DNA, 22 bp, Homo sapiens
aaactactttatagtgccttca

SEQ ID NO: 8787783 - DNA, 22 bp, Homo sapiens
aaatataatttctgcctcaata

SEQ ID NO: 8787784 - DNA, 22 bp, Homo sapiens
aaactactatgggaatgtactt

SEQ ID NO: 8787785 - DNA, 22 bp, Homo sapiens
aaactactatgggaatgtactt

SEQ ID NO: 8787786 - DNA, 22 bp, Homo sapiens
aaactactggattagtaactta

SEQ ID NO: 8787787 - DNA, 22 bp, Homo sapiens
aaactactgatttgtgaattga

SEQ ID NO: 8787788 - DNA, 22 bp, Homo sapiens
aaactactgatgcctgggccct

SEQ ID NO: 8787789 - DNA, 22 bp, Homo sapiens
aaatatgtaagattagcactag

SEQ ID NO: 8787790 - DNA, 22 bp, Homo sapiens
aaatatgtaagattagcactag

SEQ ID NO: 8787791 - DNA, 22 bp, Homo sapiens
aaatatgtaagattagcactag

SEQ ID NO: 8787792 - DNA, 22 bp, Homo sapiens
aaatatgtaaccaaggtgaagt

SEQ ID NO: 8787793 - DNA, 22 bp, Homo sapiens
aaatataatttctgcctcaata

SEQ ID NO: 8787794 - DNA, 23 bp, Homo sapiens
aaatatgtctgagggcaaagaat

SEQ ID NO: 8787795 - DNA, 22 bp, Homo sapiens
aaatatgtgatcagtgaataaa

SEQ ID NO: 8787796 - DNA, 22 bp, Homo sapiens
aaatatgtgatcagtgaataaa

SEQ ID NO: 8787797 - DNA, 22 bp, Homo sapiens
aaatatgtgatcagtgaataaa

SEQ ID NO: 8787798 - DNA, 22 bp, Homo sapiens
aaatatgtatggagttcatgaa

SEQ ID NO: 8787799 - DNA, 22 bp, Homo sapiens
aaatatgtatggagttcatgaa

SEQ ID NO: 8787800 - DNA, 23 bp, Homo sapiens
aaatatgtctgagggcaaagaat

SEQ ID NO: 8787801 - DNA, 22 bp, Homo sapiens
aaatatgtaagattagcactag

SEQ ID NO: 8787802 - DNA, 22 bp, Homo sapiens
aaatactgttgaatgaagtaag

SEQ ID NO: 8787803 - DNA, 22 bp, Homo sapiens
aaatactgttgaatgaagtaag

SEQ ID NO: 8787804 - DNA, 22 bp, Homo sapiens
aaatactgttttattccatgat

SEQ ID NO: 8787805 - DNA, 22 bp, Homo sapiens
aaatagaaaccaacaaggtcag

SEQ ID NO: 8787806 - DNA, 22 bp, Homo sapiens
aaatagaaaccaacaaggtcag

SEQ ID NO: 8787807 - DNA, 22 bp, Homo sapiens
aaatactgtccaccatggagca

SEQ ID NO: 8787808 - DNA, 22 bp, Homo sapiens
aaatacagattctgactcagag

SEQ ID NO: 8787809 - DNA, 22 bp, Homo sapiens
aaatactgtccaccatggagca

SEQ ID NO: 8787810 - DNA, 22 bp, Homo sapiens
aaacatctatcagcatttttta

SEQ ID NO: 8787811 - DNA, 22 bp, Homo sapiens
aaatagaattggaagcagagtt

SEQ ID NO: 8787812 - DNA, 22 bp, Homo sapiens
aaatagaattggaagcagagtt

SEQ ID NO: 8787813 - DNA, 22 bp, Homo sapiens
aaatagaattggaagcagagtt

SEQ ID NO: 8787814 - DNA, 22 bp, Homo sapiens
aaatagaattggaagcagagtt

SEQ ID NO: 8787815 - DNA, 22 bp, Homo sapiens
aaatagaattggaagcagagtt

SEQ ID NO: 8787816 - DNA, 23 bp, Homo sapiens
aaaccttttgtagaacaattgct

SEQ ID NO: 8787817 - DNA, 20 bp, Homo sapiens
aaacgagccatcattctggt

SEQ ID NO: 8787818 - DNA, 22 bp, Homo sapiens
aaacggaatgagtaagagtatc

SEQ ID NO: 8787819 - DNA, 22 bp, Homo sapiens
aaacggagggcaaatgctgtta

SEQ ID NO: 8787820 - DNA, 22 bp, Homo sapiens
aaactaaacctggcttagtaag

SEQ ID NO: 8787821 - DNA, 22 bp, Homo sapiens
aaactaaacctggcttagtaag

SEQ ID NO: 8787822 - DNA, 22 bp, Homo sapiens
aaatagaattaactagctactg

SEQ ID NO: 8787823 - DNA, 22 bp, Homo sapiens
aaatagaattaactagctactg

SEQ ID NO: 8787824 - DNA, 22 bp, Homo sapiens
aaatagaattaactagctactg

SEQ ID NO: 8787825 - DNA, 22 bp, Homo sapiens
aaatagaattaactagctactg

SEQ ID NO: 8787826 - DNA, 22 bp, Homo sapiens
aaatagaaaccaacaaggtcag

SEQ ID NO: 8787827 - DNA, 22 bp, Homo sapiens
aaatagaattaactagctactg

SEQ ID NO: 8787828 - DNA, 22 bp, Homo sapiens
aaatagaattggaagcagagtt

SEQ ID NO: 8787829 - DNA, 22 bp, Homo sapiens
aaagcaatgatggtagacacgt

SEQ ID NO: 8787830 - DNA, 22 bp, Homo sapiens
aaagcaatgatggtagacacgt

SEQ ID NO: 8787831 - DNA, 22 bp, Homo sapiens
aaagcaatgcttgtggaatgta

SEQ ID NO: 8787832 - DNA, 22 bp, Homo sapiens
aaagcaatgcccgttcattatc

SEQ ID NO: 8787833 - DNA, 22 bp, Homo sapiens
aaagcaatgcccgttcattatc

SEQ ID NO: 8787834 - DNA, 22 bp, Homo sapiens
aaagcaatctagttccaattct

SEQ ID NO: 8787835 - DNA, 22 bp, Homo sapiens
aaagcaatcagattcagatgtc

SEQ ID NO: 8787836 - DNA, 22 bp, Homo sapiens
aaagcaatagtaatggtaatag

SEQ ID NO: 8787837 - DNA, 22 bp, Homo sapiens
aaagcaatagtaatggtaatag

SEQ ID NO: 8787838 - DNA, 22 bp, Homo sapiens
aaagcaatagtaatggtaatag

SEQ ID NO: 8787839 - DNA, 22 bp, Homo sapiens
aaagcaatcagattcagatgtc

SEQ ID NO: 8787840 - DNA, 22 bp, Homo sapiens
aaagatgtcatacacattaaga

SEQ ID NO: 8787841 - DNA, 22 bp, Homo sapiens
aaagatgtcatacacattaaga

SEQ ID NO: 8787842 - DNA, 22 bp, Homo sapiens
aaagatgtccaagtaaagttaa

SEQ ID NO: 8787843 - DNA, 22 bp, Homo sapiens
aaagatgtccaagtaaagttaa

SEQ ID NO: 8787844 - DNA, 19 bp, Homo sapiens
aaagatgtccttttgggct

SEQ ID NO: 8787845 - DNA, 22 bp, Homo sapiens
aaagatgtcagtttgaaataac

SEQ ID NO: 8787846 - DNA, 22 bp, Homo sapiens
aaagatgtcagtttgaaataac

SEQ ID NO: 8787847 - DNA, 22 bp, Homo sapiens
aaagatgtcagtttgaaataac

SEQ ID NO: 8787848 - DNA, 22 bp, Homo sapiens
aaagatgtcagtttgaaataac

SEQ ID NO: 8787849 - DNA, 22 bp, Homo sapiens
aaagatgtcagtttgaaataac

SEQ ID NO: 8787850 - DNA, 22 bp, Homo sapiens
aaagatgtcagtttgaaataac

SEQ ID NO: 8787851 - DNA, 22 bp, Homo sapiens
aaagcaataggttaggtcaaga

SEQ ID NO: 8787852 - DNA, 22 bp, Homo sapiens
aaagcaataggttaggtcaaga

SEQ ID NO: 8787853 - DNA, 22 bp, Homo sapiens
aaagcaataggttaggtcaaga

SEQ ID NO: 8787854 - DNA, 22 bp, Homo sapiens
aaagatgtgtaagaaataaaca

SEQ ID NO: 8787855 - DNA, 22 bp, Homo sapiens
aaagatgtgcctgtttcatagt

SEQ ID NO: 8787856 - DNA, 22 bp, Homo sapiens
aaagatgtgcctgtttcatagt

SEQ ID NO: 8787857 - DNA, 22 bp, Homo sapiens
aaagatgtgcctgtttcatagt

SEQ ID NO: 8787858 - DNA, 23 bp, Homo sapiens
aaagatgtgagtattcatatggc

SEQ ID NO: 8787859 - DNA, 23 bp, Homo sapiens
aaagatgtgagtattcatatggc

SEQ ID NO: 8787860 - DNA, 23 bp, Homo sapiens
aaagatgtgagtattcatatggc

SEQ ID NO: 8787861 - DNA, 19 bp, Homo sapiens
aaagatgtccttttgggct

SEQ ID NO: 8787862 - DNA, 22 bp, Homo sapiens
aaaggcatgtggtcaaggctca

SEQ ID NO: 8787863 - DNA, 22 bp, Homo sapiens
aaaggcatgtgggctggttgta

SEQ ID NO: 8787864 - DNA, 22 bp, Homo sapiens
aaaggccaataaagacaagctg

SEQ ID NO: 8787865 - DNA, 22 bp, Homo sapiens
aaaggccacacagagcagggag

SEQ ID NO: 8787866 - DNA, 22 bp, Homo sapiens
aaaggaggaatggagagatgct

SEQ ID NO: 8787867 - DNA, 22 bp, Homo sapiens
aaaggaggaatggagagatgct

SEQ ID NO: 8787868 - DNA, 22 bp, Homo sapiens
aaaggaggaatggagagatgct

SEQ ID NO: 8787869 - DNA, 22 bp, Homo sapiens
aaaggaggaatggagagatgct

SEQ ID NO: 8787870 - DNA, 22 bp, Homo sapiens
aaaggaggaatggagagatgct

SEQ ID NO: 8787871 - DNA, 22 bp, Homo sapiens
aaagcaatggatgagaatctgt

SEQ ID NO: 8787872 - DNA, 22 bp, Homo sapiens
aaagcaatgcttgtggaatgta

SEQ ID NO: 8787873 - DNA, 22 bp, Homo sapiens
aaagcaatgcttgtggaatgta

SEQ ID NO: 8787874 - DNA, 22 bp, Homo sapiens
aaaggccttttccccacttctt

SEQ ID NO: 8787875 - DNA, 22 bp, Homo sapiens
aaaggccttaaagagcatgcct

SEQ ID NO: 8787876 - DNA, 22 bp, Homo sapiens
aaaggccttgagctgggtgcca

SEQ ID NO: 8787877 - DNA, 22 bp, Homo sapiens
aaaggctagtggattcattgat

SEQ ID NO: 8787878 - DNA, 22 bp, Homo sapiens
aaaggcctctgtcctagtgcct

SEQ ID NO: 8787879 - DNA, 22 bp, Homo sapiens
aaaggcccacagtcagtctacc

SEQ ID NO: 8787880 - DNA, 22 bp, Homo sapiens
aaaggcctgtgcttctaatgtg

SEQ ID NO: 8787881 - DNA, 22 bp, Homo sapiens
aaaggcctgtgcttctaatgtg

SEQ ID NO: 8787882 - DNA, 22 bp, Homo sapiens
aaaggcctctgtcctagtgcct

SEQ ID NO: 8787883 - DNA, 22 bp, Homo sapiens
aaaggcctctgtcctagtgcct

SEQ ID NO: 8787884 - DNA, 21 bp, Homo sapiens
aaaggccataatcacggagca

SEQ ID NO: 8787885 - DNA, 21 bp, Homo sapiens
aaaggccataatcacggagca

SEQ ID NO: 8787886 - DNA, 22 bp, Homo sapiens
aaacactgatggatatttttcc

SEQ ID NO: 8787887 - DNA, 22 bp, Homo sapiens
aaacactgcagggtttacttga

SEQ ID NO: 8787888 - DNA, 22 bp, Homo sapiens
aaacactgatggatatttttcc

SEQ ID NO: 8787889 - DNA, 22 bp, Homo sapiens
aaacactgcagggtttacttga

SEQ ID NO: 8787890 - DNA, 22 bp, Homo sapiens
aaacactgcagggtttacttga

SEQ ID NO: 8787891 - DNA, 22 bp, Homo sapiens
aaacactgcgtggtggcaactc

SEQ ID NO: 8787892 - DNA, 22 bp, Homo sapiens
aaacactggcaatttcatgcac

SEQ ID NO: 8787893 - DNA, 20 bp, Homo sapiens
aaacactggctggggcacag

SEQ ID NO: 8787894 - DNA, 22 bp, Homo sapiens
aaacactggtatgatgtatagt

SEQ ID NO: 8787895 - DNA, 22 bp, Homo sapiens
aaacactgtacaatctgcaggg

SEQ ID NO: 8787896 - DNA, 22 bp, Homo sapiens
aaacactggtatgatgtatagt

SEQ ID NO: 8787897 - DNA, 22 bp, Homo sapiens
aaacactgtacaatctgcaggg

SEQ ID NO: 8787898 - DNA, 22 bp, Homo sapiens
aaacactgtctctggtattgaa

SEQ ID NO: 8787899 - DNA, 22 bp, Homo sapiens
aaacactgtctctggtattgaa

SEQ ID NO: 8787900 - DNA, 22 bp, Homo sapiens
aaagtcatttagccttatctcc

SEQ ID NO: 8787901 - DNA, 23 bp, Homo sapiens
aaagtgcagttgaggaatcatag

SEQ ID NO: 8787902 - DNA, 23 bp, Homo sapiens
aaagtgcagttgaggaatcatag

SEQ ID NO: 8787903 - DNA, 22 bp, Homo sapiens
aaagtgcagtccatgaaattaa

SEQ ID NO: 8787904 - DNA, 22 bp, Homo sapiens
aaagtgcagtccatgaaattaa

SEQ ID NO: 8787905 - DNA, 22 bp, Homo sapiens
aaagtgcagtccatgaaattaa

SEQ ID NO: 8787906 - DNA, 22 bp, Homo sapiens
aaagtgctaaataagccctgaa

SEQ ID NO: 8787907 - DNA, 22 bp, Homo sapiens
aaagtgcattgtttgtgttcct

SEQ ID NO: 8787908 - DNA, 22 bp, Homo sapiens
aaagtgcattgtttgtgttcct

SEQ ID NO: 8787909 - DNA, 22 bp, Homo sapiens
aaagtgcatcaaatgacttccc

SEQ ID NO: 8787910 - DNA, 22 bp, Homo sapiens
aaagtgcatcaaatgacttccc

SEQ ID NO: 8787911 - DNA, 22 bp, Homo sapiens
aaagtgcattcgaaagtccatc

SEQ ID NO: 8787912 - DNA, 22 bp, Homo sapiens
aaagtgcatagagtagtgccta

SEQ ID NO: 8787913 - DNA, 22 bp, Homo sapiens
aaagtgcatagagtagtgccta

SEQ ID NO: 8787914 - DNA, 22 bp, Homo sapiens
aaacatctattatgtgctgagc

SEQ ID NO: 8787915 - DNA, 22 bp, Homo sapiens
aaacatctactgtaggctggag

SEQ ID NO: 8787916 - DNA, 22 bp, Homo sapiens
aaacatctactgtaggctggag

SEQ ID NO: 8787917 - DNA, 22 bp, Homo sapiens
aaacatctactgtaggctggag

SEQ ID NO: 8787918 - DNA, 22 bp, Homo sapiens
aaacatcataggcatgcatgat

SEQ ID NO: 8787919 - DNA, 22 bp, Homo sapiens
aaacatctactgtaggctggag

SEQ ID NO: 8787920 - DNA, 22 bp, Homo sapiens
aaacatcataggcatgcatgat

SEQ ID NO: 8787921 - DNA, 22 bp, Homo sapiens
aaacatcataggcatgcatgat

SEQ ID NO: 8787922 - DNA, 22 bp, Homo sapiens
aaacatcaattgcatctcccaa

SEQ ID NO: 8787923 - DNA, 22 bp, Homo sapiens
aaacatcaccattttacctaat

SEQ ID NO: 8787924 - DNA, 22 bp, Homo sapiens
aaacatcaattgcatctcccaa

SEQ ID NO: 8787925 - DNA, 22 bp, Homo sapiens
aaacatcaccattttacctaat

SEQ ID NO: 8787926 - DNA, 22 bp, Homo sapiens
aaacatagataatagatagatg

SEQ ID NO: 8787927 - DNA, 22 bp, Homo sapiens
aaacatagataatagatagatg

SEQ ID NO: 8787928 - DNA, 22 bp, Homo sapiens
aaagtgctaagtcacccagcta

SEQ ID NO: 8787929 - DNA, 22 bp, Homo sapiens
aaagtgctcggcgctggtccca

SEQ ID NO: 8787930 - DNA, 22 bp, Homo sapiens
aaagtgctgaagacctagctgt

SEQ ID NO: 8787931 - DNA, 22 bp, Homo sapiens
aaacagttttctcatttagtgt

SEQ ID NO: 8787932 - DNA, 22 bp, Homo sapiens
aaacagttttgccaaaaggaca

SEQ ID NO: 8787933 - DNA, 22 bp, Homo sapiens
aaagtgctgggattataggcat

SEQ ID NO: 8787934 - DNA, 22 bp, Homo sapiens
aaaaagactagtcgagtgcagt

SEQ ID NO: 8787935 - DNA, 22 bp, Homo sapiens
aaaaagacagaggatgaggcag

SEQ ID NO: 8787936 - DNA, 22 bp, Homo sapiens
aaaaagacagaggatgaggcag

SEQ ID NO: 8787937 - DNA, 22 bp, Homo sapiens
aaaaagactagtcgagtgcagt

SEQ ID NO: 8787938 - DNA, 22 bp, Homo sapiens
aaaaagactagtcgagtgcagt

SEQ ID NO: 8787939 - DNA, 22 bp, Homo sapiens
aaaaagacttccaactcaggag

SEQ ID NO: 8787940 - DNA, 22 bp, Homo sapiens
aaaaagacttccaactcaggag

SEQ ID NO: 8787941 - DNA, 19 bp, Homo sapiens
aaaaacttagtccagaaag

SEQ ID NO: 8787942 - DNA, 19 bp, Homo sapiens
aaaaacttagtccagaaag

SEQ ID NO: 8787943 - DNA, 20 bp, Homo sapiens
aaaaagacaaaacgagttgg

SEQ ID NO: 8787944 - DNA, 20 bp, Homo sapiens
aaaaagacaaaacgagttgg

SEQ ID NO: 8787945 - DNA, 19 bp, Homo sapiens
aaaaacttagtccagaaag

SEQ ID NO: 8787946 - DNA, 19 bp, Homo sapiens
aaaaacttagtccagaaag

SEQ ID NO: 8787947 - DNA, 22 bp, Homo sapiens
aaaaactgtaattacttttgca

SEQ ID NO: 8787948 - DNA, 22 bp, Homo sapiens
aaaaactggtaactattcccca

SEQ ID NO: 8787949 - DNA, 22 bp, Homo sapiens
aaaaatgaattcttcagtggca

SEQ ID NO: 8787950 - DNA, 22 bp, Homo sapiens
aaaaatgaattcttcagtggca

SEQ ID NO: 8787951 - DNA, 21 bp, Homo sapiens
aaaaatgaagttgttcaggaa

SEQ ID NO: 8787952 - DNA, 21 bp, Homo sapiens
aaaaatgaagttgttcaggaa

SEQ ID NO: 8787953 - DNA, 22 bp, Homo sapiens
aaaaagatgtcctgaagtttag

SEQ ID NO: 8787954 - DNA, 22 bp, Homo sapiens
aaaaagatgtcctgaagtttag

SEQ ID NO: 8787955 - DNA, 22 bp, Homo sapiens
aaaaagatgtcctgaagtttag

SEQ ID NO: 8787956 - DNA, 22 bp, Homo sapiens
aaaaagatgtcctgaagtttag

SEQ ID NO: 8787957 - DNA, 22 bp, Homo sapiens
aaaaagatgtcctgaagtttag

SEQ ID NO: 8787958 - DNA, 22 bp, Homo sapiens
aaaaagacttccaactcaggag

SEQ ID NO: 8787959 - DNA, 19 bp, Homo sapiens
aaaaagaggctataatatt

SEQ ID NO: 8787960 - DNA, 19 bp, Homo sapiens
aaaaagaggctataatatt

SEQ ID NO: 8787961 - DNA, 22 bp, Homo sapiens
aaaaatgcttggacttaataaa

SEQ ID NO: 8787962 - DNA, 22 bp, Homo sapiens
aaaaatgcttggacttaataaa

SEQ ID NO: 8787963 - DNA, 22 bp, Homo sapiens
aaaaatgctgtggtagctgtgt

SEQ ID NO: 8787964 - DNA, 22 bp, Homo sapiens
aaaaggctcttcaaaatggaag

SEQ ID NO: 8787965 - DNA, 22 bp, Homo sapiens
aaaaatgtgaccacagggtgtt

SEQ ID NO: 8787966 - DNA, 22 bp, Homo sapiens
aaaaatgtgaccacagggtgtt

SEQ ID NO: 8787967 - DNA, 22 bp, Homo sapiens
aaaaatgtgaccacagggtgtt

SEQ ID NO: 8787968 - DNA, 22 bp, Homo sapiens
aaaaatgtcattatggaactga

SEQ ID NO: 8787969 - DNA, 22 bp, Homo sapiens
aaaaatgtcattatggaactga

SEQ ID NO: 8787970 - DNA, 22 bp, Homo sapiens
aaaaatgtcattatggaactga

SEQ ID NO: 8787971 - DNA, 22 bp, Homo sapiens
aaaaatgtcattatggaactga

SEQ ID NO: 8787972 - DNA, 22 bp, Homo sapiens
aaaagtctgctctcatttcaga

SEQ ID NO: 8787973 - DNA, 22 bp, Homo sapiens
aaaagtctgctctcatttcaga

SEQ ID NO: 8787974 - DNA, 19 bp, Homo sapiens
aaaagtctattcaattaca

SEQ ID NO: 8787975 - DNA, 19 bp, Homo sapiens
aaaagtctattcaattaca

SEQ ID NO: 8787976 - DNA, 19 bp, Homo sapiens
aaaagtctattcaattaca

SEQ ID NO: 8787977 - DNA, 19 bp, Homo sapiens
aaaagtctattcaattaca

SEQ ID NO: 8787978 - DNA, 19 bp, Homo sapiens
aaaagtctattcaattaca

SEQ ID NO: 8787979 - DNA, 22 bp, Homo sapiens
aaaagtctctctgagtaaaagt

SEQ ID NO: 8787980 - DNA, 22 bp, Homo sapiens
aaaagtctctctgagtaaaagt

SEQ ID NO: 8787981 - DNA, 19 bp, Homo sapiens
aaaagtctattcaattaca

SEQ ID NO: 8787982 - DNA, 22 bp, Homo sapiens
aaaagtcagtctctcctagctc

SEQ ID NO: 8787983 - DNA, 22 bp, Homo sapiens
aaaagtattttggatctcagat

SEQ ID NO: 8787984 - DNA, 22 bp, Homo sapiens
aaaagtattttggatctcagat

SEQ ID NO: 8787985 - DNA, 22 bp, Homo sapiens
aaaagtattttggatctcagat

SEQ ID NO: 8787986 - DNA, 22 bp, Homo sapiens
aaaagggactactctcagctcc

SEQ ID NO: 8787987 - DNA, 22 bp, Homo sapiens
aaaatagctatggaatgtcact

SEQ ID NO: 8787988 - DNA, 22 bp, Homo sapiens
aaaatagctatggaatgtcact

SEQ ID NO: 8787989 - DNA, 22 bp, Homo sapiens
aaaataggtacggattagaatg

SEQ ID NO: 8787990 - DNA, 22 bp, Homo sapiens
aaaattcatggcttgggaaaag

SEQ ID NO: 8787991 - DNA, 22 bp, Homo sapiens
aaaattcatggcttgggaaaag

SEQ ID NO: 8787992 - DNA, 22 bp, Homo sapiens
aaaattcattcctcagactgcc

SEQ ID NO: 8787993 - DNA, 22 bp, Homo sapiens
aaaatagctatggaatgtcact

SEQ ID NO: 8787994 - DNA, 22 bp, Homo sapiens
aaaatagcctcacataattgct

SEQ ID NO: 8787995 - DNA, 22 bp, Homo sapiens
aaaatagcctcacataattgct

SEQ ID NO: 8787996 - DNA, 22 bp, Homo sapiens
aaaatagcctcacataattgct

SEQ ID NO: 8787997 - DNA, 20 bp, Homo sapiens
aaaatagccccaggctcatt

SEQ ID NO: 8787998 - DNA, 22 bp, Homo sapiens
aaaagtgtccagattatgaaga

SEQ ID NO: 8787999 - DNA, 22 bp, Homo sapiens
aaaagtgtccagattatgaaga

SEQ ID NO: 8788000 - DNA, 22 bp, Homo sapiens
aaaagtgaggcagcccaaggga

SEQ ID NO: 8788001 - DNA, 22 bp, Homo sapiens
aaaagtgatgggatggcacttc

SEQ ID NO: 8788002 - DNA, 22 bp, Homo sapiens
aaaagtgatgggatggcacttc

SEQ ID NO: 8788003 - DNA, 22 bp, Homo sapiens
aaaagtgatgggatggcacttc

SEQ ID NO: 8788004 - DNA, 22 bp, Homo sapiens
aaaagtctgctttctattatca

SEQ ID NO: 8788005 - DNA, 22 bp, Homo sapiens
aaaagtctgctttctattatca

SEQ ID NO: 8788006 - DNA, 22 bp, Homo sapiens
aaaagtgaggcagcccaaggga

SEQ ID NO: 8788007 - DNA, 22 bp, Homo sapiens
aaaagtgaggcagcccaaggga

SEQ ID NO: 8788008 - DNA, 22 bp, Homo sapiens
aaaatagattctaggatgtctt

SEQ ID NO: 8788009 - DNA, 22 bp, Homo sapiens
aaaatagattctaggatgtctt

SEQ ID NO: 8788010 - DNA, 22 bp, Homo sapiens
aaaatagattctaggatgtctt

SEQ ID NO: 8788011 - DNA, 22 bp, Homo sapiens
aaaatagattctaggatgtctt

SEQ ID NO: 8788012 - DNA, 22 bp, Homo sapiens
aaaatagatgaaaggaagtctg

SEQ ID NO: 8788013 - DNA, 22 bp, Homo sapiens
aaaatagatgaaaggaagtctg

SEQ ID NO: 8788014 - DNA, 22 bp, Homo sapiens
aaaatagatgaaaggaagtctg

SEQ ID NO: 8788015 - DNA, 22 bp, Homo sapiens
aaaatagatgaaaggaagtctg

SEQ ID NO: 8788016 - DNA, 22 bp, Homo sapiens
aaaatagataatgccagggtca

SEQ ID NO: 8788017 - DNA, 22 bp, Homo sapiens
aaaatagataatgccagggtca

SEQ ID NO: 8788018 - DNA, 22 bp, Homo sapiens
aaacacacctttggaactgtga

SEQ ID NO: 8788019 - DNA, 19 bp, Homo sapiens
aaacacagatttcttacca

SEQ ID NO: 8788020 - DNA, 22 bp, Homo sapiens
aaacacacagaaatgaatgagg

SEQ ID NO: 8788021 - DNA, 22 bp, Homo sapiens
aaacacacctttggaactgtga

SEQ ID NO: 8788022 - DNA, 22 bp, Homo sapiens
aaacacacagaaatgaatgagg

SEQ ID NO: 8788023 - DNA, 22 bp, Homo sapiens
aaacaagagcttacatggctgc

SEQ ID NO: 8788024 - DNA, 22 bp, Homo sapiens
aaacaagagcttacatggctgc

SEQ ID NO: 8788025 - DNA, 22 bp, Homo sapiens
aaacaacttctgcactatgggt

SEQ ID NO: 8788026 - DNA, 22 bp, Homo sapiens
aaacaagagcttacatggctgc

SEQ ID NO: 8788027 - DNA, 22 bp, Homo sapiens
aaacaacttctgcactatgggt

SEQ ID NO: 8788028 - DNA, 22 bp, Homo sapiens
aaacaacgatgtacacatttat

SEQ ID NO: 8788029 - DNA, 22 bp, Homo sapiens
aaacaacctaaagttactgatc

SEQ ID NO: 8788030 - DNA, 22 bp, Homo sapiens
aaacaacatggtgggtgtgtag

SEQ ID NO: 8788031 - DNA, 22 bp, Homo sapiens
aaacaaagcatcttgctatgca

SEQ ID NO: 8788032 - DNA, 22 bp, Homo sapiens
aaacaaagcatcttgctatgca

SEQ ID NO: 8788033 - DNA, 22 bp, Homo sapiens
aaacaaagcatcttgctatgca

SEQ ID NO: 8788034 - DNA, 22 bp, Homo sapiens
aaacaaagccagggaagttatg

SEQ ID NO: 8788035 - DNA, 22 bp, Homo sapiens
aaacaaagccagggaagttatg

SEQ ID NO: 8788036 - DNA, 22 bp, Homo sapiens
aaacaaacataggtttgaaagt

SEQ ID NO: 8788037 - DNA, 22 bp, Homo sapiens
aaacaaacataggtttgaaagt

SEQ ID NO: 8788038 - DNA, 22 bp, Homo sapiens
aaacaaatttcaagctgtgaca

SEQ ID NO: 8788039 - DNA, 22 bp, Homo sapiens
aaacaaatttcaagctgtgaca

SEQ ID NO: 8788040 - DNA, 22 bp, Homo sapiens
aaacaaatttcaagctgtgaca

SEQ ID NO: 8788041 - DNA, 22 bp, Homo sapiens
aaacaacaatccaatgggagct

SEQ ID NO: 8788042 - DNA, 22 bp, Homo sapiens
aaacaaatttcaagctgtgaca

SEQ ID NO: 8788043 - DNA, 22 bp, Homo sapiens
aaacaaagccagggaagttatg

SEQ ID NO: 8788044 - DNA, 22 bp, Homo sapiens
aaacaaagccagggaagttatg

SEQ ID NO: 8788045 - DNA, 22 bp, Homo sapiens
aaacaaagccagggaagttatg

SEQ ID NO: 8788046 - DNA, 22 bp, Homo sapiens
aaacaaatagtgcatgggaatt

SEQ ID NO: 8788047 - DNA, 22 bp, Homo sapiens
aaacaaatagtgcatgggaatt

SEQ ID NO: 8788048 - DNA, 22 bp, Homo sapiens
aaacttgagccaagggcttggg

SEQ ID NO: 8788049 - DNA, 22 bp, Homo sapiens
aaacttgaccctatccaattac

SEQ ID NO: 8788050 - DNA, 22 bp, Homo sapiens
aaacttgagcagtcagatgaag

SEQ ID NO: 8788051 - DNA, 22 bp, Homo sapiens
aaacttgagcagtcagatgaag

SEQ ID NO: 8788052 - DNA, 22 bp, Homo sapiens
aaacttgacagtagacagatta

SEQ ID NO: 8788053 - DNA, 22 bp, Homo sapiens
aaaccattgcatctttcttaat

SEQ ID NO: 8788054 - DNA, 22 bp, Homo sapiens
aaacttcttgctgcattttctg

SEQ ID NO: 8788055 - DNA, 22 bp, Homo sapiens
aaacttgaaaggtactgttggt

SEQ ID NO: 8788056 - DNA, 22 bp, Homo sapiens
aaacttgaaaggtactgttggt

SEQ ID NO: 8788057 - DNA, 23 bp, Homo sapiens
aaacttgctatggctgaaatcat

SEQ ID NO: 8788058 - DNA, 23 bp, Homo sapiens
aaacttgctatggctgaaatcat

SEQ ID NO: 8788059 - DNA, 23 bp, Homo sapiens
aaacttgctatggctgaaatcat

SEQ ID NO: 8788060 - DNA, 22 bp, Homo sapiens
aaacttgatttagaactaaggc

SEQ ID NO: 8788061 - DNA, 22 bp, Homo sapiens
aaacttgatttagaactaaggc

SEQ ID NO: 8788062 - DNA, 22 bp, Homo sapiens
aaacttgatttagaactaaggc

SEQ ID NO: 8788063 - DNA, 22 bp, Homo sapiens
aaacttgcgtcatgtcatgaaa

SEQ ID NO: 8788064 - DNA, 20 bp, Homo sapiens
aaacttgatggcatagaata

SEQ ID NO: 8788065 - DNA, 20 bp, Homo sapiens
aaacttgatggcatagaata

SEQ ID NO: 8788066 - DNA, 22 bp, Homo sapiens
aaactttaaatttgtacctctg

SEQ ID NO: 8788067 - DNA, 22 bp, Homo sapiens
aaactttaagacagtcctcaag

SEQ ID NO: 8788068 - DNA, 22 bp, Homo sapiens
aaactttaggaaggaatttaca

SEQ ID NO: 8788069 - DNA, 22 bp, Homo sapiens
aaactttaagacagtcctcaag

SEQ ID NO: 8788070 - DNA, 22 bp, Homo sapiens
aaactttaagacagtcctcaag

SEQ ID NO: 8788071 - DNA, 22 bp, Homo sapiens
aaacttgggtgaccctgagcaa

SEQ ID NO: 8788072 - DNA, 22 bp, Homo sapiens
aaacttgtgagctaaataaatg

SEQ ID NO: 8788073 - DNA, 22 bp, Homo sapiens
aaagaacttatcctagaatttg

SEQ ID NO: 8788074 - DNA, 22 bp, Homo sapiens
aaagaacttatcctagaatttg

SEQ ID NO: 8788075 - DNA, 22 bp, Homo sapiens
aaagaactcagagaggatttta

SEQ ID NO: 8788076 - DNA, 22 bp, Homo sapiens
aaagaactacctgtatgatatt

SEQ ID NO: 8788077 - DNA, 22 bp, Homo sapiens
aaactttaggaaggaatttaca

SEQ ID NO: 8788078 - DNA, 22 bp, Homo sapiens
aaactttaggaaggaatttaca

SEQ ID NO: 8788079 - DNA, 22 bp, Homo sapiens
aaactttaggaaggaatttaca

SEQ ID NO: 8788080 - DNA, 22 bp, Homo sapiens
aaactttaggaaggaatttaca

SEQ ID NO: 8788081 - DNA, 21 bp, Homo sapiens
aaagatgagaactggatggct

SEQ ID NO: 8788082 - DNA, 21 bp, Homo sapiens
aaagatgagaactggatggct

SEQ ID NO: 8788083 - DNA, 22 bp, Homo sapiens
aaagatctgtgttaactcaagg

SEQ ID NO: 8788084 - DNA, 22 bp, Homo sapiens
aaagatgaccgtatgtcagagc

SEQ ID NO: 8788085 - DNA, 22 bp, Homo sapiens
aaagatgagtccggcagacata

SEQ ID NO: 8788086 - DNA, 22 bp, Homo sapiens
aaagatgatctacaagttcatt

SEQ ID NO: 8788087 - DNA, 22 bp, Homo sapiens
aaagatggcccatgatctcttg

SEQ ID NO: 8788088 - DNA, 22 bp, Homo sapiens
aaagatgtcacaagatgtgatg

SEQ ID NO: 8788089 - DNA, 22 bp, Homo sapiens
aaagatgtcagtcagataggat

SEQ ID NO: 8788090 - DNA, 22 bp, Homo sapiens
aaagatgtcacaagatgtgatg

SEQ ID NO: 8788091 - DNA, 22 bp, Homo sapiens
aaagatgtcacaagatgtgatg

SEQ ID NO: 8788092 - DNA, 22 bp, Homo sapiens
aaagagctttagaaatctcaga

SEQ ID NO: 8788093 - DNA, 22 bp, Homo sapiens
aaagatcatgctgttttgtgat

SEQ ID NO: 8788094 - DNA, 22 bp, Homo sapiens
aaagatcattctctggtccaga

SEQ ID NO: 8788095 - DNA, 22 bp, Homo sapiens
aaagatcattctctggtccaga

SEQ ID NO: 8788096 - DNA, 22 bp, Homo sapiens
aaagatctatgggcatttagct

SEQ ID NO: 8788097 - DNA, 22 bp, Homo sapiens
aaagatctgacttagacacaga

SEQ ID NO: 8788098 - DNA, 22 bp, Homo sapiens
aaagaagatggagacctgacta

SEQ ID NO: 8788099 - DNA, 22 bp, Homo sapiens
aaagaagagctggaaggagtct

SEQ ID NO: 8788100 - DNA, 22 bp, Homo sapiens
aaagaagatggagacctgacta

SEQ ID NO: 8788101 - DNA, 22 bp, Homo sapiens
aaagaagcataggctagacttc

SEQ ID NO: 8788102 - DNA, 22 bp, Homo sapiens
aaagaagacagacatttctttc

SEQ ID NO: 8788103 - DNA, 22 bp, Homo sapiens
aaagaagacagacatttctttc

SEQ ID NO: 8788104 - DNA, 22 bp, Homo sapiens
aaagaagacagacatttctttc

SEQ ID NO: 8788105 - DNA, 22 bp, Homo sapiens
aaagaagacagacatttctttc

SEQ ID NO: 8788106 - DNA, 22 bp, Homo sapiens
aaagaagagctggaaggagtct

SEQ ID NO: 8788107 - DNA, 22 bp, Homo sapiens
aaagaagagctggaaggagtct

SEQ ID NO: 8788108 - DNA, 22 bp, Homo sapiens
aaagaagagcaaatttgttgta

SEQ ID NO: 8788109 - DNA, 22 bp, Homo sapiens
aaagaagcataggctagacttc

SEQ ID NO: 8788110 - DNA, 22 bp, Homo sapiens
aaagaaggacctggaggaggat

SEQ ID NO: 8788111 - DNA, 22 bp, Homo sapiens
aaagaaggacctggaggaggat

SEQ ID NO: 8788112 - DNA, 22 bp, Homo sapiens
aaagaaggatgggagaaatcct

SEQ ID NO: 8788113 - DNA, 18 bp, Homo sapiens
aaagaaggattggagagc

SEQ ID NO: 8788114 - DNA, 18 bp, Homo sapiens
aaagaaggattggagagc

SEQ ID NO: 8788115 - DNA, 22 bp, Homo sapiens
aaagaagggacagactgcctct

SEQ ID NO: 8788116 - DNA, 22 bp, Homo sapiens
aaacagtgactggtacataata

SEQ ID NO: 8788117 - DNA, 22 bp, Homo sapiens
aaacagtctgatgccatctgcc

SEQ ID NO: 8788118 - DNA, 22 bp, Homo sapiens
aaacacagggatatatattcca

SEQ ID NO: 8788119 - DNA, 22 bp, Homo sapiens
aaacacagggatatatattcca

SEQ ID NO: 8788120 - DNA, 22 bp, Homo sapiens
aaacacagggatatatattcca

SEQ ID NO: 8788121 - DNA, 22 bp, Homo sapiens
aaacagtcctctttatttagtc

SEQ ID NO: 8788122 - DNA, 22 bp, Homo sapiens
aaacacaggtactgcagaagtg

SEQ ID NO: 8788123 - DNA, 19 bp, Homo sapiens
aaacacagatttcttacca

SEQ ID NO: 8788124 - DNA, 19 bp, Homo sapiens
aaacacagatttcttacca

SEQ ID NO: 8788125 - DNA, 22 bp, Homo sapiens
aaacacagcatgtccttgggga

SEQ ID NO: 8788126 - DNA, 22 bp, Homo sapiens
aaacacagcatgtccttgggga

SEQ ID NO: 8788127 - DNA, 22 bp, Homo sapiens
aaacacagggatatatattcca

SEQ ID NO: 8788128 - DNA, 20 bp, Homo sapiens
aaacacagcctctctttaca

SEQ ID NO: 8788129 - DNA, 20 bp, Homo sapiens
aaacacagcctctctttaca

SEQ ID NO: 8788130 - DNA, 22 bp, Homo sapiens
aaacatgagcatctcttcaagc

SEQ ID NO: 8788131 - DNA, 22 bp, Homo sapiens
aaacatgagcacttgcttcata

SEQ ID NO: 8788132 - DNA, 22 bp, Homo sapiens
aaacatgagcacttgcttcata

SEQ ID NO: 8788133 - DNA, 22 bp, Homo sapiens
aaacatgaatagatattaaaca

SEQ ID NO: 8788134 - DNA, 22 bp, Homo sapiens
aaacatgaatagatattaaaca

SEQ ID NO: 8788135 - DNA, 22 bp, Homo sapiens
aaacatgaatagatattaaaca

SEQ ID NO: 8788136 - DNA, 22 bp, Homo sapiens
aaacatctttctattgcaagtt

SEQ ID NO: 8788137 - DNA, 22 bp, Homo sapiens
aaacatcttctcttgattcttt

SEQ ID NO: 8788138 - DNA, 22 bp, Homo sapiens
aaacatctggttacctagggtc

SEQ ID NO: 8788139 - DNA, 22 bp, Homo sapiens
aaacatgaatagatattaaaca

SEQ ID NO: 8788140 - DNA, 22 bp, Homo sapiens
aaacatctttctattgcaagtt

SEQ ID NO: 8788141 - DNA, 22 bp, Homo sapiens
aaacatgaatagatattaaaca

SEQ ID NO: 8788142 - DNA, 22 bp, Homo sapiens
aaacatcttctcttgattcttt

SEQ ID NO: 8788143 - DNA, 22 bp, Homo sapiens
aaacatcttgctctgattggta

SEQ ID NO: 8788144 - DNA, 22 bp, Homo sapiens
aaacatcttgctctgattggta

SEQ ID NO: 8788145 - DNA, 22 bp, Homo sapiens
aaacatgagcatttctgtttaa

SEQ ID NO: 8788146 - DNA, 22 bp, Homo sapiens
aaacatgagcatttctgtttaa

SEQ ID NO: 8788147 - DNA, 22 bp, Homo sapiens
aaacatgagcatctcttcaagc

SEQ ID NO: 8788148 - DNA, 22 bp, Homo sapiens
aaacatgagcatctcttcaagc

SEQ ID NO: 8788149 - DNA, 22 bp, Homo sapiens
aaacatgagttaaaagtaactg

SEQ ID NO: 8788150 - DNA, 22 bp, Homo sapiens
aaacatgagttaaaagtaactg

SEQ ID NO: 8788151 - DNA, 22 bp, Homo sapiens
aaacattgttatgataaattac

SEQ ID NO: 8788152 - DNA, 22 bp, Homo sapiens
aaacatgagcatctcttcaagc

SEQ ID NO: 8788153 - DNA, 22 bp, Homo sapiens
aaacatgatattgaggctgggc

SEQ ID NO: 8788154 - DNA, 22 bp, Homo sapiens
aaacatgatcactccggctttt

SEQ ID NO: 8788155 - DNA, 22 bp, Homo sapiens
aaacatttttcttcatcatcct

SEQ ID NO: 8788156 - DNA, 22 bp, Homo sapiens
aaacatttttctaggtcttggt

SEQ ID NO: 8788157 - DNA, 22 bp, Homo sapiens
aaacatttgcaactcggtttgg

SEQ ID NO: 8788158 - DNA, 23 bp, Homo sapiens
aaacatttctcttttcctgcctc

SEQ ID NO: 8788159 - DNA, 22 bp, Homo sapiens
aaaccatggctcattggagatg

SEQ ID NO: 8788160 - DNA, 22 bp, Homo sapiens
aaaccatggctcattggagatg

SEQ ID NO: 8788161 - DNA, 22 bp, Homo sapiens
aaaccatggagtaagttcacat

SEQ ID NO: 8788162 - DNA, 22 bp, Homo sapiens
aaaccatgctttgatgatttta

SEQ ID NO: 8788163 - DNA, 22 bp, Homo sapiens
aaaccatgcagtctgtgtacat

SEQ ID NO: 8788164 - DNA, 22 bp, Homo sapiens
aaaccatcagataattcatact

SEQ ID NO: 8788165 - DNA, 22 bp, Homo sapiens
aaaccattaggttttatctact

SEQ ID NO: 8788166 - DNA, 22 bp, Homo sapiens
aaaccattgcatctttcttaat

SEQ ID NO: 8788167 - DNA, 22 bp, Homo sapiens
aaaccatttgaattattactga

SEQ ID NO: 8788168 - DNA, 22 bp, Homo sapiens
aaaccacagttcagtgcttttg

SEQ ID NO: 8788169 - DNA, 22 bp, Homo sapiens
aaaccacacttagcagtttcgt

SEQ ID NO: 8788170 - DNA, 22 bp, Homo sapiens
aaaccaaccctggctggcctag

SEQ ID NO: 8788171 - DNA, 22 bp, Homo sapiens
aaaccaaacatttgcggtggtg

SEQ ID NO: 8788172 - DNA, 22 bp, Homo sapiens
aagaaagtgatgagctacagat

SEQ ID NO: 8788173 - DNA, 22 bp, Homo sapiens
aagaaagtgctttgtaaattat

SEQ ID NO: 8788174 - DNA, 22 bp, Homo sapiens
aagaaagtgctttgtaaattat

SEQ ID NO: 8788175 - DNA, 22 bp, Homo sapiens
aagaaagtgatgagctacagat

SEQ ID NO: 8788176 - DNA, 22 bp, Homo sapiens
aagaaagggctattgttctcca

SEQ ID NO: 8788177 - DNA, 22 bp, Homo sapiens
aagaaaggtgtgtttgcagatg

SEQ ID NO: 8788178 - DNA, 22 bp, Homo sapiens
aagaaaggtgtgtttgcagatg

SEQ ID NO: 8788179 - DNA, 22 bp, Homo sapiens
aagaaaggtctctgcccgctat

SEQ ID NO: 8788180 - DNA, 22 bp, Homo sapiens
aagaagttctgcctaagggaca

SEQ ID NO: 8788181 - DNA, 22 bp, Homo sapiens
aagaagttaataatggtgagaa

SEQ ID NO: 8788182 - DNA, 22 bp, Homo sapiens
aagaaagtgtggagagcctagc

SEQ ID NO: 8788183 - DNA, 22 bp, Homo sapiens
aagaaagtgggtaatatgattt

SEQ ID NO: 8788184 - DNA, 22 bp, Homo sapiens
aagaaagtgggtaatatgattt

SEQ ID NO: 8788185 - DNA, 22 bp, Homo sapiens
aagaatggtggtggggccagca

SEQ ID NO: 8788186 - DNA, 22 bp, Homo sapiens
aagaatgtcaagcagaaggtct

SEQ ID NO: 8788187 - DNA, 22 bp, Homo sapiens
aagaatgtcaagcagaaggtct

SEQ ID NO: 8788188 - DNA, 22 bp, Homo sapiens
aagaatgtcaagcagaaggtct

SEQ ID NO: 8788189 - DNA, 22 bp, Homo sapiens
aagaatgtctctggtgaggcgc

SEQ ID NO: 8788190 - DNA, 22 bp, Homo sapiens
aagaatgtgggtggatatgatg

SEQ ID NO: 8788191 - DNA, 22 bp, Homo sapiens
aagaatgtggcatttatttata

SEQ ID NO: 8788192 - DNA, 22 bp, Homo sapiens
aagaatgtggcatttatttata

SEQ ID NO: 8788193 - DNA, 22 bp, Homo sapiens
aagaatgagctcaaagatctta

SEQ ID NO: 8788194 - DNA, 22 bp, Homo sapiens
aagaatgagctcaaagatctta

SEQ ID NO: 8788195 - DNA, 22 bp, Homo sapiens
aagaatgagctcaaagatctta

SEQ ID NO: 8788196 - DNA, 22 bp, Homo sapiens
aagaatgattacaaagcaacga

SEQ ID NO: 8788197 - DNA, 22 bp, Homo sapiens
aagaatgattacaaagcaacga

SEQ ID NO: 8788198 - DNA, 22 bp, Homo sapiens
aactttctttgcatctaagttt

SEQ ID NO: 8788199 - DNA, 22 bp, Homo sapiens
aactttgcaagggggccctgcg

SEQ ID NO: 8788200 - DNA, 22 bp, Homo sapiens
aactttgagtcattgcctcttt

SEQ ID NO: 8788201 - DNA, 22 bp, Homo sapiens
aactttgcataactaactacag

SEQ ID NO: 8788202 - DNA, 23 bp, Homo sapiens
aactttgccaggagacagcacag

SEQ ID NO: 8788203 - DNA, 22 bp, Homo sapiens
aactttctttcacagaagtatc

SEQ ID NO: 8788204 - DNA, 22 bp, Homo sapiens
aactttctttcacagaagtatc

SEQ ID NO: 8788205 - DNA, 22 bp, Homo sapiens
aactttgctggaaaattggagc

SEQ ID NO: 8788206 - DNA, 19 bp, Homo sapiens
aactttgctaccctatcct

SEQ ID NO: 8788207 - DNA, 20 bp, Homo sapiens
aactttgcattttattctcc

SEQ ID NO: 8788208 - DNA, 23 bp, Homo sapiens
aactttgccaggagacagcacag

SEQ ID NO: 8788209 - DNA, 21 bp, Homo sapiens
aactttgcttaactgtgtgga

SEQ ID NO: 8788210 - DNA, 22 bp, Homo sapiens
aactttgcttgggtcaaactca

SEQ ID NO: 8788211 - DNA, 22 bp, Homo sapiens
aactttgcttttgtgggtaaag

SEQ ID NO: 8788212 - DNA, 22 bp, Homo sapiens
aactttgggcctaagtactgtt

SEQ ID NO: 8788213 - DNA, 22 bp, Homo sapiens
aactttggcaagtcagacttct

SEQ ID NO: 8788214 - DNA, 22 bp, Homo sapiens
aactttgggtaatgcttcaatt

SEQ ID NO: 8788215 - DNA, 22 bp, Homo sapiens
aactttgttttattcactgctg

SEQ ID NO: 8788216 - DNA, 22 bp, Homo sapiens
aactttgtgtgtttaatatggc

SEQ ID NO: 8788217 - DNA, 22 bp, Homo sapiens
aactttgtcttttatgcttaca

SEQ ID NO: 8788218 - DNA, 22 bp, Homo sapiens
aagaaagggagaaggatggtgt

SEQ ID NO: 8788219 - DNA, 22 bp, Homo sapiens
aagaaaggatatatgggaggta

SEQ ID NO: 8788220 - DNA, 22 bp, Homo sapiens
aactttttctgggatggagggt

SEQ ID NO: 8788221 - DNA, 22 bp, Homo sapiens
aacttttgtccgatctcctgga

SEQ ID NO: 8788222 - DNA, 22 bp, Homo sapiens
aagaaagccaaagttcatacct

SEQ ID NO: 8788223 - DNA, 22 bp, Homo sapiens
aagaaagctgaatattctgtgt

SEQ ID NO: 8788224 - DNA, 22 bp, Homo sapiens
aacttttcacaggctagctctt

SEQ ID NO: 8788225 - DNA, 22 bp, Homo sapiens
aacttttcattccaaaggtgct

SEQ ID NO: 8788226 - DNA, 22 bp, Homo sapiens
aacttttcattgaatcatgtca

SEQ ID NO: 8788227 - DNA, 22 bp, Homo sapiens
aacttttacaaattgtcatcat

SEQ ID NO: 8788228 - DNA, 22 bp, Homo sapiens
aacttttaaaatacacagacaa

SEQ ID NO: 8788229 - DNA, 22 bp, Homo sapiens
aacttttacaaattgtcatcat

SEQ ID NO: 8788230 - DNA, 22 bp, Homo sapiens
aagacagaccacgtgacagggc

SEQ ID NO: 8788231 - DNA, 22 bp, Homo sapiens
aagacagaccacgtgacagggc

SEQ ID NO: 8788232 - DNA, 22 bp, Homo sapiens
aagacagaccacgtgacagggc

SEQ ID NO: 8788233 - DNA, 22 bp, Homo sapiens
aagacagagactctgcaacagg

SEQ ID NO: 8788234 - DNA, 22 bp, Homo sapiens
aagacagagactctgcaacagg

SEQ ID NO: 8788235 - DNA, 22 bp, Homo sapiens
aagacagagactctgcaacagg

SEQ ID NO: 8788236 - DNA, 17 bp, Homo sapiens
aagacagaagccatgag

SEQ ID NO: 8788237 - DNA, 17 bp, Homo sapiens
aagacagaagccatgag

SEQ ID NO: 8788238 - DNA, 22 bp, Homo sapiens
aagacagaagtgatttgatgtg

SEQ ID NO: 8788239 - DNA, 22 bp, Homo sapiens
aagacagaagtgatttgatgtg

SEQ ID NO: 8788240 - DNA, 22 bp, Homo sapiens
aagacagaagtgatttgatgtg

SEQ ID NO: 8788241 - DNA, 22 bp, Homo sapiens
aagagagagttcctaggcaaaa

SEQ ID NO: 8788242 - DNA, 20 bp, Homo sapiens
aagagaggaagttatactag

SEQ ID NO: 8788243 - DNA, 22 bp, Homo sapiens
aagagcagtgttttactcagct

SEQ ID NO: 8788244 - DNA, 22 bp, Homo sapiens
aagagcagtgttttactcagct

SEQ ID NO: 8788245 - DNA, 22 bp, Homo sapiens
aagagcagtgttttactcagct

SEQ ID NO: 8788246 - DNA, 20 bp, Homo sapiens
aagagcatagtacaggaaga

SEQ ID NO: 8788247 - DNA, 22 bp, Homo sapiens
aagagcatatatgtatgtttgt

SEQ ID NO: 8788248 - DNA, 22 bp, Homo sapiens
aagacactttctaaatagaagt

SEQ ID NO: 8788249 - DNA, 21 bp, Homo sapiens
aagacagaaaagcctattttc

SEQ ID NO: 8788250 - DNA, 21 bp, Homo sapiens
aagacagaaaagcctattttc

SEQ ID NO: 8788251 - DNA, 22 bp, Homo sapiens
aagacactgggggctgcagcca

SEQ ID NO: 8788252 - DNA, 21 bp, Homo sapiens
aagacagaaaagcctattttc

SEQ ID NO: 8788253 - DNA, 22 bp, Homo sapiens
aagacactgggggctgcagcca

SEQ ID NO: 8788254 - DNA, 22 bp, Homo sapiens
aagaattatctgaaagctgtgt

SEQ ID NO: 8788255 - DNA, 22 bp, Homo sapiens
aagaatgttcttgtagtcatga

SEQ ID NO: 8788256 - DNA, 22 bp, Homo sapiens
aagaatgttcttgtagtcatga

SEQ ID NO: 8788257 - DNA, 22 bp, Homo sapiens
aagaatgttcttgtagtcatga

SEQ ID NO: 8788258 - DNA, 22 bp, Homo sapiens
aagaatgtgggtggatatgatg

SEQ ID NO: 8788259 - DNA, 22 bp, Homo sapiens
aagaatgttagtttctgataca

SEQ ID NO: 8788260 - DNA, 22 bp, Homo sapiens
aagaatgttagtttctgataca

SEQ ID NO: 8788261 - DNA, 22 bp, Homo sapiens
aagaatgttagtttctgataca

SEQ ID NO: 8788262 - DNA, 22 bp, Homo sapiens
aagaatgttcaacgcttttttg

SEQ ID NO: 8788263 - DNA, 22 bp, Homo sapiens
aagaggaagtctccatggagag

SEQ ID NO: 8788264 - DNA, 22 bp, Homo sapiens
aagaggaagtctccatggagag

SEQ ID NO: 8788265 - DNA, 22 bp, Homo sapiens
aagaggaatgggtgtgtttatg

SEQ ID NO: 8788266 - DNA, 22 bp, Homo sapiens
aagaggacagtattcaatatga

SEQ ID NO: 8788267 - DNA, 22 bp, Homo sapiens
aagaggaatgggtgtgtttatg

SEQ ID NO: 8788268 - DNA, 22 bp, Homo sapiens
aagaggagaaaggctggctttg

SEQ ID NO: 8788269 - DNA, 22 bp, Homo sapiens
aagaggagaaaggctggctttg

SEQ ID NO: 8788270 - DNA, 22 bp, Homo sapiens
aagaggacttgtgaagatgtac

SEQ ID NO: 8788271 - DNA, 22 bp, Homo sapiens
aagagcctctgtgtttcagcct

SEQ ID NO: 8788272 - DNA, 22 bp, Homo sapiens
aagagcctctgtgtttcagcct

SEQ ID NO: 8788273 - DNA, 22 bp, Homo sapiens
aagagcctggctgctaggctca

SEQ ID NO: 8788274 - DNA, 22 bp, Homo sapiens
aagagcctggctgctaggctca

SEQ ID NO: 8788275 - DNA, 22 bp, Homo sapiens
aagagccctggttgaaaataac

SEQ ID NO: 8788276 - DNA, 22 bp, Homo sapiens
aagagccctggttgaaaataac

SEQ ID NO: 8788277 - DNA, 22 bp, Homo sapiens
aagagccatatatgcagctaga

SEQ ID NO: 8788278 - DNA, 22 bp, Homo sapiens
aagagccatttcatatcatctc

SEQ ID NO: 8788279 - DNA, 22 bp, Homo sapiens
aagagcatcggtggagccccca

SEQ ID NO: 8788280 - DNA, 22 bp, Homo sapiens
aagagcatctatttcacagtgg

SEQ ID NO: 8788281 - DNA, 22 bp, Homo sapiens
aagagcatatggttctcaaagc

SEQ ID NO: 8788282 - DNA, 22 bp, Homo sapiens
aagagcatcaatgactcgcagt

SEQ ID NO: 8788283 - DNA, 22 bp, Homo sapiens
aagagccagctagtgaagaggc

SEQ ID NO: 8788284 - DNA, 22 bp, Homo sapiens
aagagccagctagtgaagaggc

SEQ ID NO: 8788285 - DNA, 22 bp, Homo sapiens
aagagcatgtaattggatttct

SEQ ID NO: 8788286 - DNA, 22 bp, Homo sapiens
aagagcattccgttctgattct

SEQ ID NO: 8788287 - DNA, 22 bp, Homo sapiens
aagccacttggggaaagatgga

SEQ ID NO: 8788288 - DNA, 22 bp, Homo sapiens
aagccactttcagctgtctcag

SEQ ID NO: 8788289 - DNA, 22 bp, Homo sapiens
aagccagagtttttgagaactt

SEQ ID NO: 8788290 - DNA, 18 bp, Homo sapiens
aagccagagaccactgcc

SEQ ID NO: 8788291 - DNA, 22 bp, Homo sapiens
aagccagagtttttgagaactt

SEQ ID NO: 8788292 - DNA, 22 bp, Homo sapiens
aagccagattccttaagcacag

SEQ ID NO: 8788293 - DNA, 22 bp, Homo sapiens
aagccagattccttaagcacag

SEQ ID NO: 8788294 - DNA, 22 bp, Homo sapiens
aagccagattccttaagcacag

SEQ ID NO: 8788295 - DNA, 22 bp, Homo sapiens
aagccacaatctgcatcagcat

SEQ ID NO: 8788296 - DNA, 22 bp, Homo sapiens
aagccacaatctgcatcagcat

SEQ ID NO: 8788297 - DNA, 22 bp, Homo sapiens
aagccacaatctgcatcagcat

SEQ ID NO: 8788298 - DNA, 22 bp, Homo sapiens
aagccaccctggctgcacatgc

SEQ ID NO: 8788299 - DNA, 22 bp, Homo sapiens
aagccactgagatttcactgca

SEQ ID NO: 8788300 - DNA, 22 bp, Homo sapiens
aagccactgcagcaggagctgc

SEQ ID NO: 8788301 - DNA, 22 bp, Homo sapiens
aagccactcacaataactgtcc

SEQ ID NO: 8788302 - DNA, 22 bp, Homo sapiens
aagcagcagacctgattttgaa

SEQ ID NO: 8788303 - DNA, 22 bp, Homo sapiens
aagcagcagcaggattaaagag

SEQ ID NO: 8788304 - DNA, 23 bp, Homo sapiens
aagcatggttcacagttagtact

SEQ ID NO: 8788305 - DNA, 22 bp, Homo sapiens
aagcagcagccatcccccaagg

SEQ ID NO: 8788306 - DNA, 22 bp, Homo sapiens
aagcagcatagctcccttagtt

SEQ ID NO: 8788307 - DNA, 22 bp, Homo sapiens
aagcagaaagaacaactgagtg

SEQ ID NO: 8788308 - DNA, 22 bp, Homo sapiens
aagcagagttagcttgtcacct

SEQ ID NO: 8788309 - DNA, 22 bp, Homo sapiens
aagcagagttagcttgtcacct

SEQ ID NO: 8788310 - DNA, 22 bp, Homo sapiens
aagcagaaagaacaactgagtg

SEQ ID NO: 8788311 - DNA, 22 bp, Homo sapiens
aagcagattggggatttccatg

SEQ ID NO: 8788312 - DNA, 22 bp, Homo sapiens
aagcagcaagtttatttctatc

SEQ ID NO: 8788313 - DNA, 22 bp, Homo sapiens
aagcagatgggactccaaggca

SEQ ID NO: 8788314 - DNA, 22 bp, Homo sapiens
aagcagatctgatagggccctg

SEQ ID NO: 8788315 - DNA, 22 bp, Homo sapiens
aagcagatgccaagatttacca

SEQ ID NO: 8788316 - DNA, 22 bp, Homo sapiens
aagcactggagatgccagagtg

SEQ ID NO: 8788317 - DNA, 22 bp, Homo sapiens
aagcactgaggaaaaatttgat

SEQ ID NO: 8788318 - DNA, 22 bp, Homo sapiens
aagcactgggaggaggctgaga

SEQ ID NO: 8788319 - DNA, 22 bp, Homo sapiens
aagcactgggaggaggctgaga

SEQ ID NO: 8788320 - DNA, 22 bp, Homo sapiens
aagcactgagcacagtggctga

SEQ ID NO: 8788321 - DNA, 22 bp, Homo sapiens
aagcactaatattttggcacct

SEQ ID NO: 8788322 - DNA, 22 bp, Homo sapiens
aagcactgggtatagcaatgat

SEQ ID NO: 8788323 - DNA, 22 bp, Homo sapiens
aagcactgtgcctcatatctga

SEQ ID NO: 8788324 - DNA, 22 bp, Homo sapiens
aagcacagctggaacagcagga

SEQ ID NO: 8788325 - DNA, 22 bp, Homo sapiens
aagcacagctggaacagcagga

SEQ ID NO: 8788326 - DNA, 22 bp, Homo sapiens
aagcacagctggaacagcagga

SEQ ID NO: 8788327 - DNA, 22 bp, Homo sapiens
aaatatgactagaatgccaggt

SEQ ID NO: 8788328 - DNA, 22 bp, Homo sapiens
aagcacctgcagttgacaaaaa

SEQ ID NO: 8788329 - DNA, 22 bp, Homo sapiens
aagcacctgcagttgacaaaaa

SEQ ID NO: 8788330 - DNA, 22 bp, Homo sapiens
aagcacagctggaacagcagga

SEQ ID NO: 8788331 - DNA, 22 bp, Homo sapiens
aagcaccttccagatttgcacg

SEQ ID NO: 8788332 - DNA, 22 bp, Homo sapiens
aaatatcttaggagtatatgag

SEQ ID NO: 8788333 - DNA, 22 bp, Homo sapiens
aaatatcatttataacttttaa

SEQ ID NO: 8788334 - DNA, 22 bp, Homo sapiens
aaatatgaatgataagagttat

SEQ ID NO: 8788335 - DNA, 22 bp, Homo sapiens
aaatatcattctggtgcacaga

SEQ ID NO: 8788336 - DNA, 22 bp, Homo sapiens
aaatatcattctggtgcacaga

SEQ ID NO: 8788337 - DNA, 19 bp, Homo sapiens
aaatatcagagagatgata

SEQ ID NO: 8788338 - DNA, 22 bp, Homo sapiens
aaatatcatttataacttttaa

SEQ ID NO: 8788339 - DNA, 22 bp, Homo sapiens
aaatatcatttataacttttaa

SEQ ID NO: 8788340 - DNA, 22 bp, Homo sapiens
aaatatcatttataacttttaa

SEQ ID NO: 8788341 - DNA, 19 bp, Homo sapiens
aaatatcagagagatgata

SEQ ID NO: 8788342 - DNA, 22 bp, Homo sapiens
aagcaactgttgaattggacta

SEQ ID NO: 8788343 - DNA, 22 bp, Homo sapiens
aagcaactccctcctcattttt

SEQ ID NO: 8788344 - DNA, 22 bp, Homo sapiens
aagcaacattctctgtggcatt

SEQ ID NO: 8788345 - DNA, 22 bp, Homo sapiens
aagcaacattctctgtggcatt

SEQ ID NO: 8788346 - DNA, 22 bp, Homo sapiens
aagcaacattctctgtggcatt

SEQ ID NO: 8788347 - DNA, 18 bp, Homo sapiens
aagaggaggagcaggttg

SEQ ID NO: 8788348 - DNA, 18 bp, Homo sapiens
aagaggaggagcaggttg

SEQ ID NO: 8788349 - DNA, 18 bp, Homo sapiens
aagaggaggagcaggttg

SEQ ID NO: 8788350 - DNA, 18 bp, Homo sapiens
aagaggaggagcaggttg

SEQ ID NO: 8788351 - DNA, 18 bp, Homo sapiens
aagaggaggagcaggttg

SEQ ID NO: 8788352 - DNA, 22 bp, Homo sapiens
aagattctccctgagatattta

SEQ ID NO: 8788353 - DNA, 22 bp, Homo sapiens
aagaggaggacggttcccagaa

SEQ ID NO: 8788354 - DNA, 18 bp, Homo sapiens
aagaggaggaaacccagg

SEQ ID NO: 8788355 - DNA, 18 bp, Homo sapiens
aagaggaggaaacccagg

SEQ ID NO: 8788356 - DNA, 22 bp, Homo sapiens
aagaggagacttcagcaacttg

SEQ ID NO: 8788357 - DNA, 22 bp, Homo sapiens
aagaggagacttcagcaacttg

SEQ ID NO: 8788358 - DNA, 22 bp, Homo sapiens
aagaggagacttcagcaacttg

SEQ ID NO: 8788359 - DNA, 22 bp, Homo sapiens
aagaggagacttcagcaacttg

SEQ ID NO: 8788360 - DNA, 22 bp, Homo sapiens
aagaggagacttcagcaacttg

SEQ ID NO: 8788361 - DNA, 22 bp, Homo sapiens
aagcaaaggaaagctgactttt

SEQ ID NO: 8788362 - DNA, 22 bp, Homo sapiens
aagcaaagagtttagtgggtga

SEQ ID NO: 8788363 - DNA, 22 bp, Homo sapiens
aagcaaatgtgggtgcagaatt

SEQ ID NO: 8788364 - DNA, 22 bp, Homo sapiens
aagcaaatatttctagagactg

SEQ ID NO: 8788365 - DNA, 22 bp, Homo sapiens
aagcaaatgaaccagaggtaat

SEQ ID NO: 8788366 - DNA, 22 bp, Homo sapiens
aagcaaatatttctagagactg

SEQ ID NO: 8788367 - DNA, 22 bp, Homo sapiens
aagcaaattctggaggtgaggt

SEQ ID NO: 8788368 - DNA, 22 bp, Homo sapiens
aagcaaatgtgggtgcagaatt

SEQ ID NO: 8788369 - DNA, 22 bp, Homo sapiens
aagcaaattctggaggtgaggt

SEQ ID NO: 8788370 - DNA, 22 bp, Homo sapiens
aagcaaattggatgtctgtgag

SEQ ID NO: 8788371 - DNA, 22 bp, Homo sapiens
aactatgttaataagtttcatt

SEQ ID NO: 8788372 - DNA, 22 bp, Homo sapiens
aactatttttggagctaactct

SEQ ID NO: 8788373 - DNA, 22 bp, Homo sapiens
aactatactctgtaaatgtgct

SEQ ID NO: 8788374 - DNA, 22 bp, Homo sapiens
aactatactctgtaaatgtgct

SEQ ID NO: 8788375 - DNA, 22 bp, Homo sapiens
aactatcacaaacagagtgtct

SEQ ID NO: 8788376 - DNA, 22 bp, Homo sapiens
aactatcacaaacagagtgtct

SEQ ID NO: 8788377 - DNA, 21 bp, Homo sapiens
aactatggaggaaataagtcc

SEQ ID NO: 8788378 - DNA, 22 bp, Homo sapiens
aactatcacaaacagagtgtct

SEQ ID NO: 8788379 - DNA, 22 bp, Homo sapiens
aactcacacaagtattgcctgc

SEQ ID NO: 8788380 - DNA, 22 bp, Homo sapiens
aactcacagctgtttggattag

SEQ ID NO: 8788381 - DNA, 22 bp, Homo sapiens
aactcactttgtggcttctgaa

SEQ ID NO: 8788382 - DNA, 22 bp, Homo sapiens
aactcacagctgtttggattag

SEQ ID NO: 8788383 - DNA, 22 bp, Homo sapiens
aactcaaagatgcatgacgctt

SEQ ID NO: 8788384 - DNA, 22 bp, Homo sapiens
aactcaaagatgcatgacgctt

SEQ ID NO: 8788385 - DNA, 22 bp, Homo sapiens
aactcaaagatgcatgacgctt

SEQ ID NO: 8788386 - DNA, 22 bp, Homo sapiens
aactcaaagatgcatgacgctt

SEQ ID NO: 8788387 - DNA, 22 bp, Homo sapiens
aactcaaagatgcatgacgctt

SEQ ID NO: 8788388 - DNA, 22 bp, Homo sapiens
aactcaaagatgcatgacgctt

SEQ ID NO: 8788389 - DNA, 22 bp, Homo sapiens
aactcaaagatgcatgacgctt

SEQ ID NO: 8788390 - DNA, 22 bp, Homo sapiens
aactcaaagatgcatgacgctt

SEQ ID NO: 8788391 - DNA, 22 bp, Homo sapiens
aacatttgtgaagtacttagat

SEQ ID NO: 8788392 - DNA, 22 bp, Homo sapiens
aactaatacattaatacatgtg

SEQ ID NO: 8788393 - DNA, 22 bp, Homo sapiens
aactaatacattaatacatgtg

SEQ ID NO: 8788394 - DNA, 22 bp, Homo sapiens
aactacaatatgtatgtatgta

SEQ ID NO: 8788395 - DNA, 22 bp, Homo sapiens
aactaatacattaatacatgtg

SEQ ID NO: 8788396 - DNA, 22 bp, Homo sapiens
aactaagttgcccagtccctgg

SEQ ID NO: 8788397 - DNA, 22 bp, Homo sapiens
aacatttgcagaggaaagctat

SEQ ID NO: 8788398 - DNA, 22 bp, Homo sapiens
aacatttgcatgctttattaga

SEQ ID NO: 8788399 - DNA, 22 bp, Homo sapiens
aacatttcttctgaaactgagt

SEQ ID NO: 8788400 - DNA, 22 bp, Homo sapiens
aacatttgaaaatcaagaatct

SEQ ID NO: 8788401 - DNA, 22 bp, Homo sapiens
aactcagaatagggtgcagggc

SEQ ID NO: 8788402 - DNA, 22 bp, Homo sapiens
aactcactttgtggcttctgaa

SEQ ID NO: 8788403 - DNA, 22 bp, Homo sapiens
aactcactttgtggcttctgaa

SEQ ID NO: 8788404 - DNA, 22 bp, Homo sapiens
aactcagcatcagtgtccagaa

SEQ ID NO: 8788405 - DNA, 22 bp, Homo sapiens
aactcagcatcctgcacagaga

SEQ ID NO: 8788406 - DNA, 22 bp, Homo sapiens
aactgaacataatgaaagccaa

SEQ ID NO: 8788407 - DNA, 22 bp, Homo sapiens
aactgaactgataacatacacg

SEQ ID NO: 8788408 - DNA, 22 bp, Homo sapiens
aactgaacagcaggcttctacc

SEQ ID NO: 8788409 - DNA, 22 bp, Homo sapiens
aactgaattttaaatacaggcc

SEQ ID NO: 8788410 - DNA, 22 bp, Homo sapiens
aactgaaagtttcacctgaggt

SEQ ID NO: 8788411 - DNA, 22 bp, Homo sapiens
aactgaaacttaggaagtaatc

SEQ ID NO: 8788412 - DNA, 22 bp, Homo sapiens
aactgaacagaactcagagatt

SEQ ID NO: 8788413 - DNA, 22 bp, Homo sapiens
aactgaaatcaatcagtgattc

SEQ ID NO: 8788414 - DNA, 22 bp, Homo sapiens
aactgaaatcaatcagtgattc

SEQ ID NO: 8788415 - DNA, 22 bp, Homo sapiens
aactgaggccaagtgaggaaag

SEQ ID NO: 8788416 - DNA, 22 bp, Homo sapiens
aactgagttataactagaggta

SEQ ID NO: 8788417 - DNA, 22 bp, Homo sapiens
aactgcaaaaatggtagtctta

SEQ ID NO: 8788418 - DNA, 22 bp, Homo sapiens
aactgatttcaagttcagtttc

SEQ ID NO: 8788419 - DNA, 22 bp, Homo sapiens
aactgaggccaagtgaggaaag

SEQ ID NO: 8788420 - DNA, 22 bp, Homo sapiens
aactgagattacaagagacatt

SEQ ID NO: 8788421 - DNA, 22 bp, Homo sapiens
aactgaggaataactgagttgc

SEQ ID NO: 8788422 - DNA, 22 bp, Homo sapiens
aactgagcccctgcacttgtga

SEQ ID NO: 8788423 - DNA, 23 bp, Homo sapiens
aactgagataatgtatgtaaagc

SEQ ID NO: 8788424 - DNA, 22 bp, Homo sapiens
aactgagattacaagagacatt

SEQ ID NO: 8788425 - DNA, 23 bp, Homo sapiens
aactgagataatgtatgtaaagc

SEQ ID NO: 8788426 - DNA, 22 bp, Homo sapiens
aacagtgagaaggtggacagga

SEQ ID NO: 8788427 - DNA, 20 bp, Homo sapiens
aacagtgaatgaggccagag

SEQ ID NO: 8788428 - DNA, 22 bp, Homo sapiens
aacagtcttggaagtcttgtta

SEQ ID NO: 8788429 - DNA, 22 bp, Homo sapiens
aacagtctactgaatatctgcg

SEQ ID NO: 8788430 - DNA, 22 bp, Homo sapiens
aacagtcaaagtttggttcctt

SEQ ID NO: 8788431 - DNA, 22 bp, Homo sapiens
aacagtattggttgaactcaag

SEQ ID NO: 8788432 - DNA, 22 bp, Homo sapiens
aacagtattggttgaactcaag

SEQ ID NO: 8788433 - DNA, 22 bp, Homo sapiens
aacagtatggaagccattagga

SEQ ID NO: 8788434 - DNA, 22 bp, Homo sapiens
aacagtatgtgagatttacaca

SEQ ID NO: 8788435 - DNA, 22 bp, Homo sapiens
aacagtatgtgagatttacaca

SEQ ID NO: 8788436 - DNA, 22 bp, Homo sapiens
aacagtatgtgagatttacaca

SEQ ID NO: 8788437 - DNA, 22 bp, Homo sapiens
aacagtatctacgggaactatt

SEQ ID NO: 8788438 - DNA, 22 bp, Homo sapiens
aacagtatatgaaatgttagga

SEQ ID NO: 8788439 - DNA, 22 bp, Homo sapiens
aacagtatctacgggaactatt

SEQ ID NO: 8788440 - DNA, 22 bp, Homo sapiens
aacagtatcttttatcagaaat

SEQ ID NO: 8788441 - DNA, 22 bp, Homo sapiens
aacagtatcttttatcagaaat

SEQ ID NO: 8788442 - DNA, 22 bp, Homo sapiens
aacagtatcttttatcagaaat

SEQ ID NO: 8788443 - DNA, 22 bp, Homo sapiens
aacagtatcttttatcagaaat

SEQ ID NO: 8788444 - DNA, 22 bp, Homo sapiens
aacagtagtggtcaatatgcca

SEQ ID NO: 8788445 - DNA, 22 bp, Homo sapiens
aacagtagtggtcaatatgcca

SEQ ID NO: 8788446 - DNA, 22 bp, Homo sapiens
aacagtatatgaaatgttagga

SEQ ID NO: 8788447 - DNA, 22 bp, Homo sapiens
aacagtatatgaaatgttagga

SEQ ID NO: 8788448 - DNA, 22 bp, Homo sapiens
aacagtactggacaaggagtca

SEQ ID NO: 8788449 - DNA, 22 bp, Homo sapiens
aacagtacttgataatttgcac

SEQ ID NO: 8788450 - DNA, 20 bp, Homo sapiens
aacagtaccatttatctcag

SEQ ID NO: 8788451 - DNA, 22 bp, Homo sapiens
aacagtactggacaaggagtca

SEQ ID NO: 8788452 - DNA, 20 bp, Homo sapiens
aacagtaccccccttgttct

SEQ ID NO: 8788453 - DNA, 22 bp, Homo sapiens
aacagtacaactccacaagact

SEQ ID NO: 8788454 - DNA, 22 bp, Homo sapiens
aacaggaactatttgtattcca

SEQ ID NO: 8788455 - DNA, 22 bp, Homo sapiens
aacaggaactatttgtattcca

SEQ ID NO: 8788456 - DNA, 22 bp, Homo sapiens
aacaggaaatacttatgaggta

SEQ ID NO: 8788457 - DNA, 22 bp, Homo sapiens
aacaggaaacaagttgttagga

SEQ ID NO: 8788458 - DNA, 22 bp, Homo sapiens
aacaggaaaacagcacaatagc

SEQ ID NO: 8788459 - DNA, 22 bp, Homo sapiens
aacagcttttttggtcagcatt

SEQ ID NO: 8788460 - DNA, 22 bp, Homo sapiens
aacaggaaacaagttgttagga

SEQ ID NO: 8788461 - DNA, 22 bp, Homo sapiens
aacaggaaacaagttgttagga

SEQ ID NO: 8788462 - DNA, 22 bp, Homo sapiens
aacaggaaaacagcacaatagc

SEQ ID NO: 8788463 - DNA, 22 bp, Homo sapiens
aacattaagatggcggaacagt

SEQ ID NO: 8788464 - DNA, 22 bp, Homo sapiens
aacattaattacagtcaaacat

SEQ ID NO: 8788465 - DNA, 22 bp, Homo sapiens
aacattaattacagtcaaacat

SEQ ID NO: 8788466 - DNA, 22 bp, Homo sapiens
aacattaattacagtcaaacat

SEQ ID NO: 8788467 - DNA, 22 bp, Homo sapiens
aacattaattacagtcaaacat

SEQ ID NO: 8788468 - DNA, 22 bp, Homo sapiens
aacatgcaaagctatgatgtat

SEQ ID NO: 8788469 - DNA, 22 bp, Homo sapiens
aacatgcaaagctatgatgtat

SEQ ID NO: 8788470 - DNA, 22 bp, Homo sapiens
aacatgcaatgtctgaaaatcc

SEQ ID NO: 8788471 - DNA, 22 bp, Homo sapiens
aacattcaagttctggtttatg

SEQ ID NO: 8788472 - DNA, 22 bp, Homo sapiens
aacattcaagttctggtttatg

SEQ ID NO: 8788473 - DNA, 22 bp, Homo sapiens
aacattcaaaacccagttcagt

SEQ ID NO: 8788474 - DNA, 22 bp, Homo sapiens
aacattcaattgaggaagttaa

SEQ ID NO: 8788475 - DNA, 22 bp, Homo sapiens
aacattcaattgaggaagttaa

SEQ ID NO: 8788476 - DNA, 22 bp, Homo sapiens
aacattaattacagtcaaacat

SEQ ID NO: 8788477 - DNA, 21 bp, Homo sapiens
aacattagtaatttgactttt

SEQ ID NO: 8788478 - DNA, 22 bp, Homo sapiens
aacattcacctctacctccttc

SEQ ID NO: 8788479 - DNA, 22 bp, Homo sapiens
aacattcagctgatgggtcata

SEQ ID NO: 8788480 - DNA, 22 bp, Homo sapiens
aacattcagctgggtggagcag

SEQ ID NO: 8788481 - DNA, 22 bp, Homo sapiens
aacattctactgtactgcattg

SEQ ID NO: 8788482 - DNA, 22 bp, Homo sapiens
aacattctcattgggatatgtg

SEQ ID NO: 8788483 - DNA, 22 bp, Homo sapiens
aacattctatgtgcattcagaa

SEQ ID NO: 8788484 - DNA, 16 bp, Homo sapiens
aacattcatatgagtg

SEQ ID NO: 8788485 - DNA, 22 bp, Homo sapiens
aacatttcattggaagctatgt

SEQ ID NO: 8788486 - DNA, 22 bp, Homo sapiens
aacatttcattggaagctatgt

SEQ ID NO: 8788487 - DNA, 22 bp, Homo sapiens
aacatttccggccttttgttct

SEQ ID NO: 8788488 - DNA, 22 bp, Homo sapiens
aacatttccggccttttgttct

SEQ ID NO: 8788489 - DNA, 22 bp, Homo sapiens
aacatttctgagaatatcagtt

SEQ ID NO: 8788490 - DNA, 21 bp, Homo sapiens
aacatttctgggagaactcac

SEQ ID NO: 8788491 - DNA, 21 bp, Homo sapiens
aacatttctgggagaactcac

SEQ ID NO: 8788492 - DNA, 22 bp, Homo sapiens
aacaactgctaaggtgtgtcct

SEQ ID NO: 8788493 - DNA, 22 bp, Homo sapiens
aacaactgcttattgagtgact

SEQ ID NO: 8788494 - DNA, 22 bp, Homo sapiens
aacaactgagcaggagtgacag

SEQ ID NO: 8788495 - DNA, 22 bp, Homo sapiens
aacaactgaaaagctttttctg

SEQ ID NO: 8788496 - DNA, 22 bp, Homo sapiens
aacaactgaaaagctttttctg

SEQ ID NO: 8788497 - DNA, 22 bp, Homo sapiens
aacaaccaaaaagatgaatgta

SEQ ID NO: 8788498 - DNA, 22 bp, Homo sapiens
aacaacaacggagaaagggttg

SEQ ID NO: 8788499 - DNA, 22 bp, Homo sapiens
aacaacaacggagaaagggttg

SEQ ID NO: 8788500 - DNA, 22 bp, Homo sapiens
aacaacagctgctaaagagttg

SEQ ID NO: 8788501 - DNA, 22 bp, Homo sapiens
aacaaattagttgcaagactgg

SEQ ID NO: 8788502 - DNA, 22 bp, Homo sapiens
aacaaatttagctctgagtgct

SEQ ID NO: 8788503 - DNA, 22 bp, Homo sapiens
aacaaattagttgcaagactgg

SEQ ID NO: 8788504 - DNA, 22 bp, Homo sapiens
aaagcactcggcttcatccagg

SEQ ID NO: 8788505 - DNA, 22 bp, Homo sapiens
aaagcacagagctcccacagga

SEQ ID NO: 8788506 - DNA, 22 bp, Homo sapiens
aaagcaatttaatggaccatga

SEQ ID NO: 8788507 - DNA, 22 bp, Homo sapiens
aaagcacagggtgctagagagt

SEQ ID NO: 8788508 - DNA, 22 bp, Homo sapiens
aaagcacatagtagaaggattt

SEQ ID NO: 8788509 - DNA, 22 bp, Homo sapiens
aaagcacagggtgctagagagt

SEQ ID NO: 8788510 - DNA, 22 bp, Homo sapiens
aaagcacaggagagttcagtaa

SEQ ID NO: 8788511 - DNA, 22 bp, Homo sapiens
aaagcacatgagtagtgtagta

SEQ ID NO: 8788512 - DNA, 22 bp, Homo sapiens
aaagcacatgagtagtgtagta

SEQ ID NO: 8788513 - DNA, 22 bp, Homo sapiens
aaagcacattacaagctcagtc

SEQ ID NO: 8788514 - DNA, 22 bp, Homo sapiens
aaagcacatagtagaaggattt

SEQ ID NO: 8788515 - DNA, 22 bp, Homo sapiens
aaagcacatagtagaaggattt

SEQ ID NO: 8788516 - DNA, 22 bp, Homo sapiens
aaagcacatagtagaaggattt

SEQ ID NO: 8788517 - DNA, 22 bp, Homo sapiens
aaagcacatagtagaaggattt

SEQ ID NO: 8788518 - DNA, 19 bp, Homo sapiens
aaatggctttctacttaat

SEQ ID NO: 8788519 - DNA, 22 bp, Homo sapiens
aaatggctttgagggtaggaca

SEQ ID NO: 8788520 - DNA, 16 bp, Homo sapiens
aaatggcttaggctta

SEQ ID NO: 8788521 - DNA, 19 bp, Homo sapiens
aaatggctttctacttaat

SEQ ID NO: 8788522 - DNA, 22 bp, Homo sapiens
aaatggcgatatattcaggcaa

SEQ ID NO: 8788523 - DNA, 22 bp, Homo sapiens
aaatggtatgaaaagagatttc

SEQ ID NO: 8788524 - DNA, 22 bp, Homo sapiens
aaatggtcactggtgagtgtca

SEQ ID NO: 8788525 - DNA, 22 bp, Homo sapiens
aaatggtataatgtcatgtatt

SEQ ID NO: 8788526 - DNA, 22 bp, Homo sapiens
aaatggtataatgtcatgtatt

SEQ ID NO: 8788527 - DNA, 23 bp, Homo sapiens
aaatgggtttctgttttgtggac

SEQ ID NO: 8788528 - DNA, 22 bp, Homo sapiens
aaagcaagtctctacaaagtac

SEQ ID NO: 8788529 - DNA, 22 bp, Homo sapiens
aaagcaagtctctacaaagtac

SEQ ID NO: 8788530 - DNA, 22 bp, Homo sapiens
aaagcaagtctctacaaagtac

SEQ ID NO: 8788531 - DNA, 22 bp, Homo sapiens
aaagcaagtctctacaaagtac

SEQ ID NO: 8788532 - DNA, 22 bp, Homo sapiens
aaagcaagtctctacaaagtac

SEQ ID NO: 8788533 - DNA, 22 bp, Homo sapiens
aaatggtgagggaattgaacag

SEQ ID NO: 8788534 - DNA, 22 bp, Homo sapiens
aaatggtccatcctaaagaagt

SEQ ID NO: 8788535 - DNA, 17 bp, Homo sapiens
aaatggtcctagggatt

SEQ ID NO: 8788536 - DNA, 22 bp, Homo sapiens
aaagcaatagagggtaagactg

SEQ ID NO: 8788537 - DNA, 22 bp, Homo sapiens
aaagcaatgggtctaaggtaaa

SEQ ID NO: 8788538 - DNA, 22 bp, Homo sapiens
aaagcaatggcacatgatggta

SEQ ID NO: 8788539 - DNA, 22 bp, Homo sapiens
aaagcaatgtctctgcctggtt

SEQ ID NO: 8788540 - DNA, 22 bp, Homo sapiens
aaagcaattacaaaagggataa

SEQ ID NO: 8788541 - DNA, 22 bp, Homo sapiens
aaagcaattacaaaagggataa

SEQ ID NO: 8788542 - DNA, 22 bp, Homo sapiens
aaagcaatgtctctgcctggtt

SEQ ID NO: 8788543 - DNA, 22 bp, Homo sapiens
aaagcaattgtggtttttgtca

SEQ ID NO: 8788544 - DNA, 22 bp, Homo sapiens
aaagcaattgtggtttttgcca

SEQ ID NO: 8788545 - DNA, 22 bp, Homo sapiens
aacacatgaaagttggtgagta

SEQ ID NO: 8788546 - DNA, 22 bp, Homo sapiens
aacacatgccttaagaataagt

SEQ ID NO: 8788547 - DNA, 22 bp, Homo sapiens
aacacatgaaagttggtgagta

SEQ ID NO: 8788548 - DNA, 22 bp, Homo sapiens
aacacatggcaagagcaggaaa

SEQ ID NO: 8788549 - DNA, 22 bp, Homo sapiens
aacacatgccttaagaataagt

SEQ ID NO: 8788550 - DNA, 22 bp, Homo sapiens
aacacatgccttaagaataagt

SEQ ID NO: 8788551 - DNA, 22 bp, Homo sapiens
aacacatggcaagagcaggaaa

SEQ ID NO: 8788552 - DNA, 22 bp, Homo sapiens
aacacatggcaagagcaggaaa

SEQ ID NO: 8788553 - DNA, 22 bp, Homo sapiens
aacacatgggtgtttattgtac

SEQ ID NO: 8788554 - DNA, 22 bp, Homo sapiens
aacacatgggtgtttattgtac

SEQ ID NO: 8788555 - DNA, 22 bp, Homo sapiens
aacacatgaaagttggtgagta

SEQ ID NO: 8788556 - DNA, 22 bp, Homo sapiens
aacacatatttatatatgcaca

SEQ ID NO: 8788557 - DNA, 22 bp, Homo sapiens
aacacatatttatatatgcaca

SEQ ID NO: 8788558 - DNA, 21 bp, Homo sapiens
aacacatccagagtatttgac

SEQ ID NO: 8788559 - DNA, 22 bp, Homo sapiens
aacacatatttttgctgagcat

SEQ ID NO: 8788560 - DNA, 22 bp, Homo sapiens
aacagctttgcttctggagaca

SEQ ID NO: 8788561 - DNA, 22 bp, Homo sapiens
aacagctttgcttctggagaca

SEQ ID NO: 8788562 - DNA, 22 bp, Homo sapiens
aacagctttgtatacagtaact

SEQ ID NO: 8788563 - DNA, 22 bp, Homo sapiens
aacagcttttttggtcagcatt

SEQ ID NO: 8788564 - DNA, 22 bp, Homo sapiens
aacagctttgtgctcagatttg

SEQ ID NO: 8788565 - DNA, 22 bp, Homo sapiens
aacagctttgtgctcagatttg

SEQ ID NO: 8788566 - DNA, 22 bp, Homo sapiens
aacagctttgtatacagtaact

SEQ ID NO: 8788567 - DNA, 22 bp, Homo sapiens
aacagctttgagcagttctgta

SEQ ID NO: 8788568 - DNA, 22 bp, Homo sapiens
aacagctttagaggataatagt

SEQ ID NO: 8788569 - DNA, 22 bp, Homo sapiens
aacagctttgagcagttctgta

SEQ ID NO: 8788570 - DNA, 22 bp, Homo sapiens
aacagcttgctgcaccttaata

SEQ ID NO: 8788571 - DNA, 22 bp, Homo sapiens
aacagctttagaggataatagt

SEQ ID NO: 8788572 - DNA, 22 bp, Homo sapiens
aacagcttgaggaatatcatca

SEQ ID NO: 8788573 - DNA, 22 bp, Homo sapiens
aacagcttgctgcaccttaata

SEQ ID NO: 8788574 - DNA, 22 bp, Homo sapiens
aacagcagcatgacagctgggt

SEQ ID NO: 8788575 - DNA, 23 bp, Homo sapiens
aacacattgctaattacattcaa

SEQ ID NO: 8788576 - DNA, 23 bp, Homo sapiens
aacacattgctaattacattcaa

SEQ ID NO: 8788577 - DNA, 22 bp, Homo sapiens
aacacattggaagccaagaatg

SEQ ID NO: 8788578 - DNA, 22 bp, Homo sapiens
aacacattgccagagatcagca

SEQ ID NO: 8788579 - DNA, 22 bp, Homo sapiens
aacaattatcatatacattgca

SEQ ID NO: 8788580 - DNA, 22 bp, Homo sapiens
aacaattatcatatacattgca

SEQ ID NO: 8788581 - DNA, 22 bp, Homo sapiens
aacaattatcatatacattgca

SEQ ID NO: 8788582 - DNA, 22 bp, Homo sapiens
aacaattgacacttcattgtga

SEQ ID NO: 8788583 - DNA, 22 bp, Homo sapiens
aacacaaaaattctcaggggca

SEQ ID NO: 8788584 - DNA, 22 bp, Homo sapiens
aacacaaagaagctgcaggatc

SEQ ID NO: 8788585 - DNA, 22 bp, Homo sapiens
aacacaaaaattctcaggggca

SEQ ID NO: 8788586 - DNA, 22 bp, Homo sapiens
aacacaaagaagctgcaggatc

SEQ ID NO: 8788587 - DNA, 22 bp, Homo sapiens
aacacaaagaagctgcaggatc

SEQ ID NO: 8788588 - DNA, 22 bp, Homo sapiens
aacacaaagaagctgcaggatc

SEQ ID NO: 8788589 - DNA, 22 bp, Homo sapiens
aacacaaagaagctgcaggatc

SEQ ID NO: 8788590 - DNA, 23 bp, Homo sapiens
aacacaaagctgattccagtggc

SEQ ID NO: 8788591 - DNA, 22 bp, Homo sapiens
aacacataggcagagcatgaca

SEQ ID NO: 8788592 - DNA, 22 bp, Homo sapiens
aacacataggcagagcatgaca

SEQ ID NO: 8788593 - DNA, 23 bp, Homo sapiens
aacacaaagctgattccagtggc

SEQ ID NO: 8788594 - DNA, 23 bp, Homo sapiens
aacacaaagctgattccagtggc

SEQ ID NO: 8788595 - DNA, 22 bp, Homo sapiens
aacaagagactctgttccagaa

SEQ ID NO: 8788596 - DNA, 22 bp, Homo sapiens
aacaatgtgattgaagctagaa

SEQ ID NO: 8788597 - DNA, 22 bp, Homo sapiens
aacaatgtgattgaagctagaa

SEQ ID NO: 8788598 - DNA, 22 bp, Homo sapiens
aacaatgtgttcagcactgtgg

SEQ ID NO: 8788599 - DNA, 22 bp, Homo sapiens
aacaattagactgacggtatta

SEQ ID NO: 8788600 - DNA, 22 bp, Homo sapiens
aacaattactaccaaggcctgt

SEQ ID NO: 8788601 - DNA, 22 bp, Homo sapiens
aacaatgttcttttagcttgaa

SEQ ID NO: 8788602 - DNA, 22 bp, Homo sapiens
aacaacttgcgttcagagatgt

SEQ ID NO: 8788603 - DNA, 22 bp, Homo sapiens
aacaacttgcgttcagagatgt

SEQ ID NO: 8788604 - DNA, 22 bp, Homo sapiens
aacaagaacacctacagttcta

SEQ ID NO: 8788605 - DNA, 22 bp, Homo sapiens
aacaagaacacctacagttcta

SEQ ID NO: 8788606 - DNA, 22 bp, Homo sapiens
aacaagaacacctacagttcta

SEQ ID NO: 8788607 - DNA, 22 bp, Homo sapiens
aacaagaagagagggacgtaat

SEQ ID NO: 8788608 - DNA, 22 bp, Homo sapiens
aacaagaataagtggtttctgg

SEQ ID NO: 8788609 - DNA, 22 bp, Homo sapiens
aacaagaagggaaggcatgatt

SEQ ID NO: 8788610 - DNA, 22 bp, Homo sapiens
aacaagaagggaaggcatgatt

SEQ ID NO: 8788611 - DNA, 22 bp, Homo sapiens
aacaagaagggaaggcatgatt

SEQ ID NO: 8788612 - DNA, 22 bp, Homo sapiens
aacaagaagagagggacgtaat

SEQ ID NO: 8788613 - DNA, 22 bp, Homo sapiens
aagttctatagtctttctacta

SEQ ID NO: 8788614 - DNA, 20 bp, Homo sapiens
aagttacattgtattgtacc

SEQ ID NO: 8788615 - DNA, 22 bp, Homo sapiens
aagttctatatctgcctcacca

SEQ ID NO: 8788616 - DNA, 22 bp, Homo sapiens
aagttctattgtcactttatta

SEQ ID NO: 8788617 - DNA, 22 bp, Homo sapiens
aagttctatgaatctactccaa

SEQ ID NO: 8788618 - DNA, 19 bp, Homo sapiens
aagttctcagagttcaaag

SEQ ID NO: 8788619 - DNA, 23 bp, Homo sapiens
aagttctattagtgctggtctag

SEQ ID NO: 8788620 - DNA, 22 bp, Homo sapiens
aacactgtaacagcatcatttt

SEQ ID NO: 8788621 - DNA, 22 bp, Homo sapiens
aacactggtttggcattagatg

SEQ ID NO: 8788622 - DNA, 22 bp, Homo sapiens
aagttcttagacaagcttgtgg

SEQ ID NO: 8788623 - DNA, 23 bp, Homo sapiens
aagttcttaggttgatactaatg

SEQ ID NO: 8788624 - DNA, 23 bp, Homo sapiens
aagttcttttagatgtcttcgtg

SEQ ID NO: 8788625 - DNA, 22 bp, Homo sapiens
aagttgaatgcgtacgtgacat

SEQ ID NO: 8788626 - DNA, 22 bp, Homo sapiens
aagttgatggcgtctttgagat

SEQ ID NO: 8788627 - DNA, 19 bp, Homo sapiens
aagttgatcattttgacag

SEQ ID NO: 8788628 - DNA, 22 bp, Homo sapiens
aagttgatcaagtagcgagttc

SEQ ID NO: 8788629 - DNA, 22 bp, Homo sapiens
aagttgatagcatgttaagctc

SEQ ID NO: 8788630 - DNA, 22 bp, Homo sapiens
aagttgatttaaactactagtc

SEQ ID NO: 8788631 - DNA, 22 bp, Homo sapiens
aagttgattaatctttcgagaa

SEQ ID NO: 8788632 - DNA, 22 bp, Homo sapiens
aagttgattgcttcaaatttct

SEQ ID NO: 8788633 - DNA, 22 bp, Homo sapiens
aagtatttcgttctgaaaaagt

SEQ ID NO: 8788634 - DNA, 22 bp, Homo sapiens
aagtatttcgttctgaaaaagt

SEQ ID NO: 8788635 - DNA, 22 bp, Homo sapiens
aagtcaaaccttgctcacagga

SEQ ID NO: 8788636 - DNA, 22 bp, Homo sapiens
aagtattcataaggacatatgt

SEQ ID NO: 8788637 - DNA, 22 bp, Homo sapiens
aagtattcataaggacatatgt

SEQ ID NO: 8788638 - DNA, 22 bp, Homo sapiens
aagtattcataaggacatatgt

SEQ ID NO: 8788639 - DNA, 22 bp, Homo sapiens
aagtattatttaacaaatttgt

SEQ ID NO: 8788640 - DNA, 22 bp, Homo sapiens
aagtattctacaaagaaattga

SEQ ID NO: 8788641 - DNA, 22 bp, Homo sapiens
aagtattctggcagtcattcag

SEQ ID NO: 8788642 - DNA, 22 bp, Homo sapiens
aagtattctacaaagaaattga

SEQ ID NO: 8788643 - DNA, 22 bp, Homo sapiens
aagtatttcagcggttctttgt

SEQ ID NO: 8788644 - DNA, 22 bp, Homo sapiens
aagtattgtgggaaagcagaaa

SEQ ID NO: 8788645 - DNA, 19 bp, Homo sapiens
aagtattctttgttagcag

SEQ ID NO: 8788646 - DNA, 22 bp, Homo sapiens
aagtattctggcagtcattcag

SEQ ID NO: 8788647 - DNA, 22 bp, Homo sapiens
aacactgatggaaagtatgttt

SEQ ID NO: 8788648 - DNA, 22 bp, Homo sapiens
aacactgctccaaaaaaggctt

SEQ ID NO: 8788649 - DNA, 22 bp, Homo sapiens
aacactgcctacactttatgaa

SEQ ID NO: 8788650 - DNA, 22 bp, Homo sapiens
aacactgctgctgggttctgtg

SEQ ID NO: 8788651 - DNA, 22 bp, Homo sapiens
aacactgagtatcagagttggg

SEQ ID NO: 8788652 - DNA, 22 bp, Homo sapiens
aacactgagtatcagagttggg

SEQ ID NO: 8788653 - DNA, 22 bp, Homo sapiens
aacactggaagggacatcaagt

SEQ ID NO: 8788654 - DNA, 22 bp, Homo sapiens
aacactgctgctgggttctgtg

SEQ ID NO: 8788655 - DNA, 20 bp, Homo sapiens
aacactgcttctatattttc

SEQ ID NO: 8788656 - DNA, 20 bp, Homo sapiens
aacactgcttctatattttc

SEQ ID NO: 8788657 - DNA, 22 bp, Homo sapiens
aacactgagggaaaagagatag

SEQ ID NO: 8788658 - DNA, 20 bp, Homo sapiens
aacactgagggctactcttc

SEQ ID NO: 8788659 - DNA, 20 bp, Homo sapiens
aacactgagggctactcttc

SEQ ID NO: 8788660 - DNA, 20 bp, Homo sapiens
aacactgagggctactcttc

SEQ ID NO: 8788661 - DNA, 20 bp, Homo sapiens
aacactgagggctactcttc

SEQ ID NO: 8788662 - DNA, 20 bp, Homo sapiens
aacactgagggctactcttc

SEQ ID NO: 8788663 - DNA, 20 bp, Homo sapiens
aacactgaggcctactcttc

SEQ ID NO: 8788664 - DNA, 20 bp, Homo sapiens
aacactgaggcctactcttc

SEQ ID NO: 8788665 - DNA, 22 bp, Homo sapiens
aacactgagggaaaagagatag

SEQ ID NO: 8788666 - DNA, 22 bp, Homo sapiens
aagtcaaagctttcagaggaaa

SEQ ID NO: 8788667 - DNA, 22 bp, Homo sapiens
aagtcaaagctttcagaggaaa

SEQ ID NO: 8788668 - DNA, 20 bp, Homo sapiens
aacactgaggcctactcttc

SEQ ID NO: 8788669 - DNA, 20 bp, Homo sapiens
aacactgaggcctactcttc

SEQ ID NO: 8788670 - DNA, 21 bp, Homo sapiens
aagtcaatacagataagtctt

SEQ ID NO: 8788671 - DNA, 22 bp, Homo sapiens
aagtcaagtgttattattgtag

SEQ ID NO: 8788672 - DNA, 22 bp, Homo sapiens
aataaaatggtcagttttctca

SEQ ID NO: 8788673 - DNA, 22 bp, Homo sapiens
aataaaatggtcagttttctca

SEQ ID NO: 8788674 - DNA, 22 bp, Homo sapiens
aataaacaaaggacaaggaggt

SEQ ID NO: 8788675 - DNA, 22 bp, Homo sapiens
aataaacaaaggacaaggaggt

SEQ ID NO: 8788676 - DNA, 20 bp, Homo sapiens
aagtttgccccaggaaattg

SEQ ID NO: 8788677 - DNA, 22 bp, Homo sapiens
aagtttgacagaagtttctaat

SEQ ID NO: 8788678 - DNA, 22 bp, Homo sapiens
aagtttgacagaagtttctaat

SEQ ID NO: 8788679 - DNA, 22 bp, Homo sapiens
aagttgatttaaactactagtc

SEQ ID NO: 8788680 - DNA, 22 bp, Homo sapiens
aagttgctaatgatgtgtttgc

SEQ ID NO: 8788681 - DNA, 22 bp, Homo sapiens
aagtttctgtatgctcttctgt

SEQ ID NO: 8788682 - DNA, 22 bp, Homo sapiens
aagtttctgttcatatctctga

SEQ ID NO: 8788683 - DNA, 22 bp, Homo sapiens
aacagtttcagttactgatgag

SEQ ID NO: 8788684 - DNA, 22 bp, Homo sapiens
aacagtttcagttactgatgag

SEQ ID NO: 8788685 - DNA, 22 bp, Homo sapiens
aataaacttccactgtgttttt

SEQ ID NO: 8788686 - DNA, 22 bp, Homo sapiens
aacagtttgcctgaaatgtatt

SEQ ID NO: 8788687 - DNA, 22 bp, Homo sapiens
aacagtttgcctgaaatgtatt

SEQ ID NO: 8788688 - DNA, 22 bp, Homo sapiens
aacagtttgagctttgaatttc

SEQ ID NO: 8788689 - DNA, 22 bp, Homo sapiens
aacagtttgcctgaaatgtatt

SEQ ID NO: 8788690 - DNA, 22 bp, Homo sapiens
aacagtttgagctttgaatttc

SEQ ID NO: 8788691 - DNA, 20 bp, Homo sapiens
aataaactactgagagatgt

SEQ ID NO: 8788692 - DNA, 20 bp, Homo sapiens
aataaactactgagagatgt

SEQ ID NO: 8788693 - DNA, 20 bp, Homo sapiens
aataaactactgagagatgt

SEQ ID NO: 8788694 - DNA, 20 bp, Homo sapiens
aataaactactgagagatgt

SEQ ID NO: 8788695 - DNA, 22 bp, Homo sapiens
aataaactgctcaattgcatca

SEQ ID NO: 8788696 - DNA, 22 bp, Homo sapiens
aataaactgctcaattgcatca

SEQ ID NO: 8788697 - DNA, 22 bp, Homo sapiens
aataaactgctcaattgcatca

SEQ ID NO: 8788698 - DNA, 22 bp, Homo sapiens
aataaactgctcaattgcatca

SEQ ID NO: 8788699 - DNA, 22 bp, Homo sapiens
aataaactgctcaattgcatca

SEQ ID NO: 8788700 - DNA, 22 bp, Homo sapiens
aataaactgctcaattgcatca

SEQ ID NO: 8788701 - DNA, 22 bp, Homo sapiens
aataaacaaatccttccttccc

SEQ ID NO: 8788702 - DNA, 22 bp, Homo sapiens
aataaacaaaggacaaggaggt

SEQ ID NO: 8788703 - DNA, 22 bp, Homo sapiens
aataaacaaaggacaaggaggt

SEQ ID NO: 8788704 - DNA, 22 bp, Homo sapiens
aataaacaaaggacaaggaggt

SEQ ID NO: 8788705 - DNA, 22 bp, Homo sapiens
aataaacaaatctttcctgtgg

SEQ ID NO: 8788706 - DNA, 22 bp, Homo sapiens
aataaacaaatctttcctgtgg

SEQ ID NO: 8788707 - DNA, 22 bp, Homo sapiens
aataaacaaatctttcctgtgg

SEQ ID NO: 8788708 - DNA, 22 bp, Homo sapiens
aataaacaaatctttcctgtgg

SEQ ID NO: 8788709 - DNA, 22 bp, Homo sapiens
aataaacaaatctttcctgtgg

SEQ ID NO: 8788710 - DNA, 22 bp, Homo sapiens
aataaacaaatccttccttccc

SEQ ID NO: 8788711 - DNA, 22 bp, Homo sapiens
aataaacaaatccttccttccc

SEQ ID NO: 8788712 - DNA, 22 bp, Homo sapiens
aactccagggggtcaatattta

SEQ ID NO: 8788713 - DNA, 20 bp, Homo sapiens
aactcctagcctcaagtgat

SEQ ID NO: 8788714 - DNA, 22 bp, Homo sapiens
aactcagtgtgtttcttagtat

SEQ ID NO: 8788715 - DNA, 22 bp, Homo sapiens
aactcagtgtgtttcttagtat

SEQ ID NO: 8788716 - DNA, 22 bp, Homo sapiens
aactcagttacatattagaata

SEQ ID NO: 8788717 - DNA, 22 bp, Homo sapiens
aaccatgtcttgttttcctagt

SEQ ID NO: 8788718 - DNA, 22 bp, Homo sapiens
aaccatgtactttattctgttt

SEQ ID NO: 8788719 - DNA, 22 bp, Homo sapiens
aaccagtttagtcatgctgtaa

SEQ ID NO: 8788720 - DNA, 22 bp, Homo sapiens
aaccagtttcaaagaaaattgc

SEQ ID NO: 8788721 - DNA, 22 bp, Homo sapiens
aaccagtgaaacaccaggcaag

SEQ ID NO: 8788722 - DNA, 22 bp, Homo sapiens
aaccagtcccagtgagatgaac

SEQ ID NO: 8788723 - DNA, 22 bp, Homo sapiens
aaccagttggcaaccagcagtt

SEQ ID NO: 8788724 - DNA, 22 bp, Homo sapiens
aaccagtttaagcaaataactg

SEQ ID NO: 8788725 - DNA, 22 bp, Homo sapiens
aaccagttgtatgtcctccagc

SEQ ID NO: 8788726 - DNA, 22 bp, Homo sapiens
aaccagtgaaacaccaggcaag

SEQ ID NO: 8788727 - DNA, 22 bp, Homo sapiens
aaccagtactttacacagctct

SEQ ID NO: 8788728 - DNA, 22 bp, Homo sapiens
aaccaggtgactcatggtgagc

SEQ ID NO: 8788729 - DNA, 22 bp, Homo sapiens
aaccaggtgactcatggtgagc

SEQ ID NO: 8788730 - DNA, 20 bp, Homo sapiens
aaccaggatagaccagggaa

SEQ ID NO: 8788731 - DNA, 22 bp, Homo sapiens
aatcacattgaatctgctacct

SEQ ID NO: 8788732 - DNA, 22 bp, Homo sapiens
aatcacatttacattgctaatt

SEQ ID NO: 8788733 - DNA, 22 bp, Homo sapiens
aatcacattagtgaaacactga

SEQ ID NO: 8788734 - DNA, 22 bp, Homo sapiens
aatcacattagtgaaacactga

SEQ ID NO: 8788735 - DNA, 22 bp, Homo sapiens
aatcacattacagcatatctgt

SEQ ID NO: 8788736 - DNA, 22 bp, Homo sapiens
aatcacattacagcatatctgt

SEQ ID NO: 8788737 - DNA, 22 bp, Homo sapiens
aatcacattacagcatatctgt

SEQ ID NO: 8788738 - DNA, 22 bp, Homo sapiens
aatcacattacagcatatctgt

SEQ ID NO: 8788739 - DNA, 22 bp, Homo sapiens
aatcacattaagccctgttcag

SEQ ID NO: 8788740 - DNA, 22 bp, Homo sapiens
aatcacttgtaaggaattcaat

SEQ ID NO: 8788741 - DNA, 23 bp, Homo sapiens
aatcacttccctccaaatggatt

SEQ ID NO: 8788742 - DNA, 22 bp, Homo sapiens
aatcacttgtaaggaattcaat

SEQ ID NO: 8788743 - DNA, 22 bp, Homo sapiens
aatcacttgtaaggaattcaat

SEQ ID NO: 8788744 - DNA, 22 bp, Homo sapiens
aatcacttaatagctacactgg

SEQ ID NO: 8788745 - DNA, 22 bp, Homo sapiens
aatcacatttgcccccatattc

SEQ ID NO: 8788746 - DNA, 23 bp, Homo sapiens
aatcaccagcagccaatgtgcag

SEQ ID NO: 8788747 - DNA, 22 bp, Homo sapiens
aatcacatttacattgctaatt

SEQ ID NO: 8788748 - DNA, 22 bp, Homo sapiens
aatcacatttacattgctaatt

SEQ ID NO: 8788749 - DNA, 22 bp, Homo sapiens
aatcacttaatagctacactgg

SEQ ID NO: 8788750 - DNA, 22 bp, Homo sapiens
aatcagaaaattcagtggaatt

SEQ ID NO: 8788751 - DNA, 22 bp, Homo sapiens
aatcacttttctctaatgtagc

SEQ ID NO: 8788752 - DNA, 22 bp, Homo sapiens
aatcactttgcactcttatttg

SEQ ID NO: 8788753 - DNA, 22 bp, Homo sapiens
aaccagatcgactgttaacagc

SEQ ID NO: 8788754 - DNA, 22 bp, Homo sapiens
aaccagctccagcctccattca

SEQ ID NO: 8788755 - DNA, 22 bp, Homo sapiens
aaccagctccagcctccattca

SEQ ID NO: 8788756 - DNA, 22 bp, Homo sapiens
aaccagctctgcaaaatgtcat

SEQ ID NO: 8788757 - DNA, 22 bp, Homo sapiens
aaccagctttgatacgcattat

SEQ ID NO: 8788758 - DNA, 22 bp, Homo sapiens
aaccagctgagaatgcttctgc

SEQ ID NO: 8788759 - DNA, 22 bp, Homo sapiens
aacattgaatttaaaatacagt

SEQ ID NO: 8788760 - DNA, 22 bp, Homo sapiens
aacattgaatttaaaatacagt

SEQ ID NO: 8788761 - DNA, 22 bp, Homo sapiens
aacattgagttctacttccatt

SEQ ID NO: 8788762 - DNA, 20 bp, Homo sapiens
aacattgaaagtctagaaga

SEQ ID NO: 8788763 - DNA, 22 bp, Homo sapiens
aacattgaaatatttgcaatag

SEQ ID NO: 8788764 - DNA, 22 bp, Homo sapiens
aacattgaaatatttgcaatag

SEQ ID NO: 8788765 - DNA, 20 bp, Homo sapiens
aacattgaaagtctagaaga

SEQ ID NO: 8788766 - DNA, 22 bp, Homo sapiens
aacatttacaaatccttctgca

SEQ ID NO: 8788767 - DNA, 22 bp, Homo sapiens
aacatttacaaatccttctgca

SEQ ID NO: 8788768 - DNA, 22 bp, Homo sapiens
aacatttacaaatccttctgca

SEQ ID NO: 8788769 - DNA, 22 bp, Homo sapiens
aacatttacaaatccttctgca

SEQ ID NO: 8788770 - DNA, 22 bp, Homo sapiens
aacatttacaaatccttctgca

SEQ ID NO: 8788771 - DNA, 22 bp, Homo sapiens
aacatttacaaatccttctgca

SEQ ID NO: 8788772 - DNA, 20 bp, Homo sapiens
aacattgtttgtaaaagcag

SEQ ID NO: 8788773 - DNA, 22 bp, Homo sapiens
aacattgttttccctatatcca

SEQ ID NO: 8788774 - DNA, 22 bp, Homo sapiens
aacatgttgctttaataatatt

SEQ ID NO: 8788775 - DNA, 22 bp, Homo sapiens
aacataaatttgaagtggcaaa

SEQ ID NO: 8788776 - DNA, 22 bp, Homo sapiens
aacataaatttgaagtggcaaa

SEQ ID NO: 8788777 - DNA, 22 bp, Homo sapiens
aacagtttgtggatagcttgta

SEQ ID NO: 8788778 - DNA, 22 bp, Homo sapiens
aacattctggttctaaaaacct

SEQ ID NO: 8788779 - DNA, 22 bp, Homo sapiens
aacattctggttctaaaaacct

SEQ ID NO: 8788780 - DNA, 22 bp, Homo sapiens
aacattctgtcaattgatgacc

SEQ ID NO: 8788781 - DNA, 22 bp, Homo sapiens
aacattctgtcaattgatgacc

SEQ ID NO: 8788782 - DNA, 22 bp, Homo sapiens
aacattaagatggcggaacagt

SEQ ID NO: 8788783 - DNA, 22 bp, Homo sapiens
aacattaagatggcggaacagt

SEQ ID NO: 8788784 - DNA, 22 bp, Homo sapiens
aacattcttcaaatatcactct

SEQ ID NO: 8788785 - DNA, 22 bp, Homo sapiens
aacattcttaagatttgtgtct

SEQ ID NO: 8788786 - DNA, 22 bp, Homo sapiens
aacatttattctaattctggga

SEQ ID NO: 8788787 - DNA, 22 bp, Homo sapiens
aacatttattctaattctggga

SEQ ID NO: 8788788 - DNA, 22 bp, Homo sapiens
aacatttattctaattctggga

SEQ ID NO: 8788789 - DNA, 22 bp, Homo sapiens
aacatttattctaattctggga

SEQ ID NO: 8788790 - DNA, 22 bp, Homo sapiens
aacatttattgagcacctactg

SEQ ID NO: 8788791 - DNA, 22 bp, Homo sapiens
aacatttattgagcacctactg

SEQ ID NO: 8788792 - DNA, 22 bp, Homo sapiens
aacatttattgagcacctactg

SEQ ID NO: 8788793 - DNA, 22 bp, Homo sapiens
aacatttatggtagtcattgca

SEQ ID NO: 8788794 - DNA, 22 bp, Homo sapiens
aacatttatggtagtcattgca

SEQ ID NO: 8788795 - DNA, 22 bp, Homo sapiens
aacatttatggtagtcattgca

SEQ ID NO: 8788796 - DNA, 22 bp, Homo sapiens
aacatttatggtagtcattgca

SEQ ID NO: 8788797 - DNA, 22 bp, Homo sapiens
aacatttatatgggttcatgaa

SEQ ID NO: 8788798 - DNA, 22 bp, Homo sapiens
aacatttatatgggttcatgaa

SEQ ID NO: 8788799 - DNA, 22 bp, Homo sapiens
aacatttatgattgaggtaaat

SEQ ID NO: 8788800 - DNA, 22 bp, Homo sapiens
aacatttatgattgaggtaaat

SEQ ID NO: 8788801 - DNA, 22 bp, Homo sapiens
aacatttatgattgaggtaaat

SEQ ID NO: 8788802 - DNA, 22 bp, Homo sapiens
aacatttatgattgaggtaaat

SEQ ID NO: 8788803 - DNA, 22 bp, Homo sapiens
aacatttaggaaggacctcctc

SEQ ID NO: 8788804 - DNA, 22 bp, Homo sapiens
aacatttaggaaggacctcctc

SEQ ID NO: 8788805 - DNA, 22 bp, Homo sapiens
aacatttatatgggttcatgaa

SEQ ID NO: 8788806 - DNA, 22 bp, Homo sapiens
aacatttaggaaggacctcctc

SEQ ID NO: 8788807 - DNA, 22 bp, Homo sapiens
aacatttattgagcacctactg

SEQ ID NO: 8788808 - DNA, 22 bp, Homo sapiens
aacatttattgagcacctactg

SEQ ID NO: 8788809 - DNA, 22 bp, Homo sapiens
aacatttcagcaaataagaaca

SEQ ID NO: 8788810 - DNA, 22 bp, Homo sapiens
aacatttcagcaaataagaaca

SEQ ID NO: 8788811 - DNA, 21 bp, Homo sapiens
aacatttcaggatccaaattg

SEQ ID NO: 8788812 - DNA, 22 bp, Homo sapiens
aatatttgcatcattagctatt

SEQ ID NO: 8788813 - DNA, 22 bp, Homo sapiens
aatcacatgcagggcctccacc

SEQ ID NO: 8788814 - DNA, 22 bp, Homo sapiens
aatatttcttctaaagcccttt

SEQ ID NO: 8788815 - DNA, 22 bp, Homo sapiens
aatatttctgtagctatgttct

SEQ ID NO: 8788816 - DNA, 22 bp, Homo sapiens
aatcacatgtgggtcttgtagc

SEQ ID NO: 8788817 - DNA, 22 bp, Homo sapiens
aatcacattaagccctgttcag

SEQ ID NO: 8788818 - DNA, 22 bp, Homo sapiens
aatcacatgtgctcaattttaa

SEQ ID NO: 8788819 - DNA, 22 bp, Homo sapiens
aatcacatgtgctcaattttaa

SEQ ID NO: 8788820 - DNA, 22 bp, Homo sapiens
aatcacatgtgctcaattttaa

SEQ ID NO: 8788821 - DNA, 22 bp, Homo sapiens
aatcacatgtgctcaattttaa

SEQ ID NO: 8788822 - DNA, 22 bp, Homo sapiens
aagccatgcaagccacaaggtg

SEQ ID NO: 8788823 - DNA, 22 bp, Homo sapiens
aagccatcgaactgtacactta

SEQ ID NO: 8788824 - DNA, 22 bp, Homo sapiens
aagccagttagcacatcattgc

SEQ ID NO: 8788825 - DNA, 22 bp, Homo sapiens
aagccagttagcacatcattgc

SEQ ID NO: 8788826 - DNA, 22 bp, Homo sapiens
aagccagttagcacatcattgc

SEQ ID NO: 8788827 - DNA, 16 bp, Homo sapiens
aagccagttcagcatt

SEQ ID NO: 8788828 - DNA, 16 bp, Homo sapiens
aagccagttcagcatt

SEQ ID NO: 8788829 - DNA, 22 bp, Homo sapiens
aagccagtgtgacaggaaactt

SEQ ID NO: 8788830 - DNA, 22 bp, Homo sapiens
aagccagtgtgacaggaaactt

SEQ ID NO: 8788831 - DNA, 22 bp, Homo sapiens
aagccagtgtggtctgcccatt

SEQ ID NO: 8788832 - DNA, 22 bp, Homo sapiens
aagccagtgtggtctgcccatt

SEQ ID NO: 8788833 - DNA, 22 bp, Homo sapiens
aagccagtgtttttgagagttg

SEQ ID NO: 8788834 - DNA, 22 bp, Homo sapiens
aagccagtgtttttgagagttg

SEQ ID NO: 8788835 - DNA, 22 bp, Homo sapiens
aagccagtattcaatggggcta

SEQ ID NO: 8788836 - DNA, 22 bp, Homo sapiens
aagccagtattcaatggggcta

SEQ ID NO: 8788837 - DNA, 22 bp, Homo sapiens
aagccagtaagtttttgtcatt

SEQ ID NO: 8788838 - DNA, 22 bp, Homo sapiens
aagccagtaagtttttgtcatt

SEQ ID NO: 8788839 - DNA, 22 bp, Homo sapiens
aagccagtgggcatagcagttg

SEQ ID NO: 8788840 - DNA, 22 bp, Homo sapiens
aagccagtggcttctccctgct

SEQ ID NO: 8788841 - DNA, 22 bp, Homo sapiens
aagccagtggtgagaagatagc

SEQ ID NO: 8788842 - DNA, 22 bp, Homo sapiens
aagccagtggtgagaagatagc

SEQ ID NO: 8788843 - DNA, 22 bp, Homo sapiens
aagccagtgtccagaatgggca

SEQ ID NO: 8788844 - DNA, 22 bp, Homo sapiens
aagccagtgtccagaatgggca

SEQ ID NO: 8788845 - DNA, 22 bp, Homo sapiens
aagccagtggcttctccctgct

SEQ ID NO: 8788846 - DNA, 22 bp, Homo sapiens
aagccagtcctctactgggcac

SEQ ID NO: 8788847 - DNA, 22 bp, Homo sapiens
aagccagtgggcatagcagttg

SEQ ID NO: 8788848 - DNA, 22 bp, Homo sapiens
aagccagtcctctactgggcac

SEQ ID NO: 8788849 - DNA, 22 bp, Homo sapiens
aagccatttgttgtccttcagg

SEQ ID NO: 8788850 - DNA, 22 bp, Homo sapiens
aagcccagatgagatccctgga

SEQ ID NO: 8788851 - DNA, 22 bp, Homo sapiens
aagctggcatgtcacctgagaa

SEQ ID NO: 8788852 - DNA, 18 bp, Homo sapiens
aagctgggaaggagacag

SEQ ID NO: 8788853 - DNA, 23 bp, Homo sapiens
aagctggctgggagcagaaggga

SEQ ID NO: 8788854 - DNA, 22 bp, Homo sapiens
aagctggctctgatgtcagaat

SEQ ID NO: 8788855 - DNA, 22 bp, Homo sapiens
aagctggctctgatgtcagaat

SEQ ID NO: 8788856 - DNA, 21 bp, Homo sapiens
aaggaaaagcttggtctctga

SEQ ID NO: 8788857 - DNA, 22 bp, Homo sapiens
aagcttttctctgtattacctg

SEQ ID NO: 8788858 - DNA, 22 bp, Homo sapiens
aagctttttggatttgcttcag

SEQ ID NO: 8788859 - DNA, 21 bp, Homo sapiens
aagcttttcctgagagttgtc

SEQ ID NO: 8788860 - DNA, 22 bp, Homo sapiens
aagcttttctcagtgtccttgg

SEQ ID NO: 8788861 - DNA, 22 bp, Homo sapiens
aagctttgttcttcacagagtg

SEQ ID NO: 8788862 - DNA, 22 bp, Homo sapiens
aagctttgggcagaagaggatt

SEQ ID NO: 8788863 - DNA, 22 bp, Homo sapiens
aagctttgtccaaggccatgca

SEQ ID NO: 8788864 - DNA, 22 bp, Homo sapiens
aagctttggagaggcgggcagg

SEQ ID NO: 8788865 - DNA, 22 bp, Homo sapiens
aagctttgcaccggtggctgga

SEQ ID NO: 8788866 - DNA, 22 bp, Homo sapiens
aagctttggaagggcagggttg

SEQ ID NO: 8788867 - DNA, 22 bp, Homo sapiens
aagctttgataattggattact

SEQ ID NO: 8788868 - DNA, 22 bp, Homo sapiens
aagctttgcaatgcttcattat

SEQ ID NO: 8788869 - DNA, 22 bp, Homo sapiens
aagctttatgatctctcagcta

SEQ ID NO: 8788870 - DNA, 22 bp, Homo sapiens
aagctttgactactgcctcttg

SEQ ID NO: 8788871 - DNA, 22 bp, Homo sapiens
aagctgggacttagcgcagata

SEQ ID NO: 8788872 - DNA, 20 bp, Homo sapiens
aagctgggtaggagaggagc

SEQ ID NO: 8788873 - DNA, 20 bp, Homo sapiens
aagctgggtaggagaggagc

SEQ ID NO: 8788874 - DNA, 22 bp, Homo sapiens
aagctggggactcagaccccat

SEQ ID NO: 8788875 - DNA, 22 bp, Homo sapiens
aagctttatgacttggagacag

SEQ ID NO: 8788876 - DNA, 22 bp, Homo sapiens
aagctgtcagtgtcaggctaaa

SEQ ID NO: 8788877 - DNA, 22 bp, Homo sapiens
aagctgtgaaatagattacaca

SEQ ID NO: 8788878 - DNA, 22 bp, Homo sapiens
aagctgtcaggaggttaccttt

SEQ ID NO: 8788879 - DNA, 22 bp, Homo sapiens
aagctgtcaatgtatctagtct

SEQ ID NO: 8788880 - DNA, 22 bp, Homo sapiens
aagctgtatgacctaaatcttg

SEQ ID NO: 8788881 - DNA, 22 bp, Homo sapiens
aaattattacaagctagttggc

SEQ ID NO: 8788882 - DNA, 22 bp, Homo sapiens
aaattattacaagctagttggc

SEQ ID NO: 8788883 - DNA, 22 bp, Homo sapiens
aaattattacaagctagttggc

SEQ ID NO: 8788884 - DNA, 22 bp, Homo sapiens
aaattattatgcccctctataa

SEQ ID NO: 8788885 - DNA, 22 bp, Homo sapiens
aaattattatgcccctctataa

SEQ ID NO: 8788886 - DNA, 22 bp, Homo sapiens
aaattattatgcccctctataa

SEQ ID NO: 8788887 - DNA, 22 bp, Homo sapiens
aaggacatttacaaggatttct

SEQ ID NO: 8788888 - DNA, 17 bp, Homo sapiens
aaggaccaacaggaaat

SEQ ID NO: 8788889 - DNA, 22 bp, Homo sapiens
aaggacaggttggggcttcagg

SEQ ID NO: 8788890 - DNA, 22 bp, Homo sapiens
aaggacaggttggggcttcagg

SEQ ID NO: 8788891 - DNA, 22 bp, Homo sapiens
aaattagtacattgcaaagtcc

SEQ ID NO: 8788892 - DNA, 22 bp, Homo sapiens
aaattagtacattgcaaagtcc

SEQ ID NO: 8788893 - DNA, 21 bp, Homo sapiens
aaattagcttcaagttctgca

SEQ ID NO: 8788894 - DNA, 22 bp, Homo sapiens
aaggaaacactgaactttgtag

SEQ ID NO: 8788895 - DNA, 22 bp, Homo sapiens
aaattaactatcacttttgtga

SEQ ID NO: 8788896 - DNA, 22 bp, Homo sapiens
aaattataggtgccaccttgga

SEQ ID NO: 8788897 - DNA, 22 bp, Homo sapiens
aaattagtcggtttaggaattt

SEQ ID NO: 8788898 - DNA, 22 bp, Homo sapiens
aaattagtcggtttaggaattt

SEQ ID NO: 8788899 - DNA, 22 bp, Homo sapiens
aaattagtcatgttgtattact

SEQ ID NO: 8788900 - DNA, 22 bp, Homo sapiens
aaattagtcatgttgtattact

SEQ ID NO: 8788901 - DNA, 22 bp, Homo sapiens
aaggactagattatacaatagg

SEQ ID NO: 8788902 - DNA, 22 bp, Homo sapiens
aaggactagatattcatacatg

SEQ ID NO: 8788903 - DNA, 21 bp, Homo sapiens
aaggacgaggttttgattaca

SEQ ID NO: 8788904 - DNA, 21 bp, Homo sapiens
aaggacgaggttttgattaca

SEQ ID NO: 8788905 - DNA, 22 bp, Homo sapiens
aaggacctgattttgagcatct

SEQ ID NO: 8788906 - DNA, 22 bp, Homo sapiens
aaggaccagattatccttaata

SEQ ID NO: 8788907 - DNA, 22 bp, Homo sapiens
aaggaccagattatccttaata

SEQ ID NO: 8788908 - DNA, 22 bp, Homo sapiens
aaggaccagttttgcagaattg

SEQ ID NO: 8788909 - DNA, 22 bp, Homo sapiens
aaggactgtctaaggcctccaa

SEQ ID NO: 8788910 - DNA, 22 bp, Homo sapiens
aaggagaaatggtagatgtgca

SEQ ID NO: 8788911 - DNA, 22 bp, Homo sapiens
aaattgcattgagctgcttatt

SEQ ID NO: 8788912 - DNA, 22 bp, Homo sapiens
aaggagaaatggtagatgtgca

SEQ ID NO: 8788913 - DNA, 22 bp, Homo sapiens
aaatttaaaaagcagcattgca

SEQ ID NO: 8788914 - DNA, 22 bp, Homo sapiens
aaatttaaaaagcagcattgca

SEQ ID NO: 8788915 - DNA, 22 bp, Homo sapiens
aaatttaaaaagcagcattgca

SEQ ID NO: 8788916 - DNA, 22 bp, Homo sapiens
aaatttaaaaagcagcattgca

SEQ ID NO: 8788917 - DNA, 22 bp, Homo sapiens
aaatttaaaaagcagcattgca

SEQ ID NO: 8788918 - DNA, 22 bp, Homo sapiens
aaatttaaaaagcagcattgca

SEQ ID NO: 8788919 - DNA, 22 bp, Homo sapiens
aaatttaaggaggtgctcactt

SEQ ID NO: 8788920 - DNA, 22 bp, Homo sapiens
aaatttaaggaggtgctcactt

SEQ ID NO: 8788921 - DNA, 22 bp, Homo sapiens
aaattgtggcgtctgtaagagt

SEQ ID NO: 8788922 - DNA, 21 bp, Homo sapiens
aaattgccacacatttcttcc

SEQ ID NO: 8788923 - DNA, 22 bp, Homo sapiens
aaattgccaaattgttttccag

SEQ ID NO: 8788924 - DNA, 22 bp, Homo sapiens
aaattgcctgagtatgtcacat

SEQ ID NO: 8788925 - DNA, 22 bp, Homo sapiens
aaattgttgatctacagtaagg

SEQ ID NO: 8788926 - DNA, 20 bp, Homo sapiens
aaattgtgtttgtgagctcc

SEQ ID NO: 8788927 - DNA, 22 bp, Homo sapiens
aaattgttgatctacagtaagg

SEQ ID NO: 8788928 - DNA, 22 bp, Homo sapiens
aaggggcctcacagatgggctt

SEQ ID NO: 8788929 - DNA, 22 bp, Homo sapiens
aaggggcatgcttttgccagga

SEQ ID NO: 8788930 - DNA, 23 bp, Homo sapiens
aaggggatacttccactttcttt

SEQ ID NO: 8788931 - DNA, 21 bp, Homo sapiens
aaggggcaaacccaggacacc

SEQ ID NO: 8788932 - DNA, 22 bp, Homo sapiens
aaggggcacaattgtacccaag

SEQ ID NO: 8788933 - DNA, 22 bp, Homo sapiens
aaggggagatgtcatgggccct

SEQ ID NO: 8788934 - DNA, 22 bp, Homo sapiens
aaggggagttagtgataaaacc

SEQ ID NO: 8788935 - DNA, 22 bp, Homo sapiens
aaggggagttagtgataaaacc

SEQ ID NO: 8788936 - DNA, 22 bp, Homo sapiens
aaggggaagtagcaccagaggt

SEQ ID NO: 8788937 - DNA, 22 bp, Homo sapiens
aagggagcggggagaccctatg

SEQ ID NO: 8788938 - DNA, 22 bp, Homo sapiens
aagggagcttaggagatcaggc

SEQ ID NO: 8788939 - DNA, 22 bp, Homo sapiens
aagggaggaggatttattgtac

SEQ ID NO: 8788940 - DNA, 22 bp, Homo sapiens
aagggctggagactgggtcttc

SEQ ID NO: 8788941 - DNA, 22 bp, Homo sapiens
aagggaggaggatttattgtac

SEQ ID NO: 8788942 - DNA, 22 bp, Homo sapiens
aagggaggaggatttattgtac

SEQ ID NO: 8788943 - DNA, 22 bp, Homo sapiens
aagggaggccagaggttttgca

SEQ ID NO: 8788944 - DNA, 22 bp, Homo sapiens
aagggagcaaatggacagacgg

SEQ ID NO: 8788945 - DNA, 22 bp, Homo sapiens
aagggagatagttcgccatggg

SEQ ID NO: 8788946 - DNA, 22 bp, Homo sapiens
aagggagcaaatggacagacgg

SEQ ID NO: 8788947 - DNA, 22 bp, Homo sapiens
aagggagcggggagaccctatg

SEQ ID NO: 8788948 - DNA, 22 bp, Homo sapiens
aagggagccaagaaagcagggc

SEQ ID NO: 8788949 - DNA, 21 bp, Homo sapiens
aagggagataggaatcaggcc

SEQ ID NO: 8788950 - DNA, 21 bp, Homo sapiens
aagggagataggaatcaggcc

SEQ ID NO: 8788951 - DNA, 22 bp, Homo sapiens
aagggagaggagggtcttgttg

SEQ ID NO: 8788952 - DNA, 22 bp, Homo sapiens
aagggagaggagggtcttgttg

SEQ ID NO: 8788953 - DNA, 21 bp, Homo sapiens
aagggagataggaatcaggcc

SEQ ID NO: 8788954 - DNA, 21 bp, Homo sapiens
aagggagataggaatcaggcc

SEQ ID NO: 8788955 - DNA, 22 bp, Homo sapiens
aacaatcaagtttctaaatgac

SEQ ID NO: 8788956 - DNA, 22 bp, Homo sapiens
aacaatcaagtttctaaatgac

SEQ ID NO: 8788957 - DNA, 20 bp, Homo sapiens
aacaatctagaagctattct

SEQ ID NO: 8788958 - DNA, 22 bp, Homo sapiens
aacaatctccaagaccaatgtg

SEQ ID NO: 8788959 - DNA, 22 bp, Homo sapiens
aacaatgaggatctgttctgag

SEQ ID NO: 8788960 - DNA, 22 bp, Homo sapiens
aacaatgaccacacaatgtact

SEQ ID NO: 8788961 - DNA, 22 bp, Homo sapiens
aacaatctgttcgatagaaaat

SEQ ID NO: 8788962 - DNA, 22 bp, Homo sapiens
aacaatgaccacacaatgtact

SEQ ID NO: 8788963 - DNA, 22 bp, Homo sapiens
aagggggcacagtcactgtaat

SEQ ID NO: 8788964 - DNA, 22 bp, Homo sapiens
aacaataattgcggttctctat

SEQ ID NO: 8788965 - DNA, 22 bp, Homo sapiens
aacaataggctatatgctaggc

SEQ ID NO: 8788966 - DNA, 22 bp, Homo sapiens
aacaataggagtgatgcagtat

SEQ ID NO: 8788967 - DNA, 22 bp, Homo sapiens
aacaataggagtgatgcagtat

SEQ ID NO: 8788968 - DNA, 23 bp, Homo sapiens
aacaatagagataaagtgagatc

SEQ ID NO: 8788969 - DNA, 22 bp, Homo sapiens
aacaataggagtgatgcagtat

SEQ ID NO: 8788970 - DNA, 22 bp, Homo sapiens
aagtatgctaattaactagcac

SEQ ID NO: 8788971 - DNA, 22 bp, Homo sapiens
aagtatgtcaatcatacttcaa

SEQ ID NO: 8788972 - DNA, 22 bp, Homo sapiens
aagtatgtgatacatgttaatt

SEQ ID NO: 8788973 - DNA, 22 bp, Homo sapiens
aagtatgtctttgggtattatt

SEQ ID NO: 8788974 - DNA, 22 bp, Homo sapiens
aagtatgacatttaagacaatt

SEQ ID NO: 8788975 - DNA, 22 bp, Homo sapiens
aagtacaatctttctgtaaagg

SEQ ID NO: 8788976 - DNA, 22 bp, Homo sapiens
aacaatgatatagggattggca

SEQ ID NO: 8788977 - DNA, 22 bp, Homo sapiens
aacaaatgtgtggcagtgtggg

SEQ ID NO: 8788978 - DNA, 22 bp, Homo sapiens
aaggccagacaggaccacatct

SEQ ID NO: 8788979 - DNA, 23 bp, Homo sapiens
aaggccagaatttcaatggtgcc

SEQ ID NO: 8788980 - DNA, 23 bp, Homo sapiens
aaggccagaatttcaatggtgcc

SEQ ID NO: 8788981 - DNA, 22 bp, Homo sapiens
aaggccactttaccttaaatcc

SEQ ID NO: 8788982 - DNA, 22 bp, Homo sapiens
aaggccactttaccttaaatcc

SEQ ID NO: 8788983 - DNA, 22 bp, Homo sapiens
aaggccacacttgctggccagc

SEQ ID NO: 8788984 - DNA, 22 bp, Homo sapiens
aaggccacacttgctggccagc

SEQ ID NO: 8788985 - DNA, 22 bp, Homo sapiens
aaggccaactaggatgagctag

SEQ ID NO: 8788986 - DNA, 22 bp, Homo sapiens
aaggccaaggctgcagtgagcc

SEQ ID NO: 8788987 - DNA, 22 bp, Homo sapiens
aaggccacacttgctggccagc

SEQ ID NO: 8788988 - DNA, 22 bp, Homo sapiens
aaggccacagagcctcagagag

SEQ ID NO: 8788989 - DNA, 22 bp, Homo sapiens
aaggccacgtctccttccagag

SEQ ID NO: 8788990 - DNA, 22 bp, Homo sapiens
aaggccaaagacacctacacag

SEQ ID NO: 8788991 - DNA, 22 bp, Homo sapiens
aaggccaaagttttcaggctaa

SEQ ID NO: 8788992 - DNA, 22 bp, Homo sapiens
aaggccaaagacacctacacag

SEQ ID NO: 8788993 - DNA, 22 bp, Homo sapiens
aaatttcaagcaaagtagctat

SEQ ID NO: 8788994 - DNA, 22 bp, Homo sapiens
aaatttcagttacctttacgtt

SEQ ID NO: 8788995 - DNA, 22 bp, Homo sapiens
aaatttcagttacctttacgtt

SEQ ID NO: 8788996 - DNA, 22 bp, Homo sapiens
aaatttcagttggaatgagctc

SEQ ID NO: 8788997 - DNA, 22 bp, Homo sapiens
aaatttcagttggaatgagctc

SEQ ID NO: 8788998 - DNA, 22 bp, Homo sapiens
aacaagatcctggaaggggcca

SEQ ID NO: 8788999 - DNA, 22 bp, Homo sapiens
aacaaatgtgttttgtaattaa

SEQ ID NO: 8789000 - DNA, 22 bp, Homo sapiens
aacaaatgtgttttgtaattaa

SEQ ID NO: 8789001 - DNA, 22 bp, Homo sapiens
aacaagatgttttgatatatgt

SEQ ID NO: 8789002 - DNA, 22 bp, Homo sapiens
aacaagatgttttgatatatgt

SEQ ID NO: 8789003 - DNA, 22 bp, Homo sapiens
aacaaggctggtatcttaaaga

SEQ ID NO: 8789004 - DNA, 22 bp, Homo sapiens
aacaaggcaagtctgtgagcat

SEQ ID NO: 8789005 - DNA, 22 bp, Homo sapiens
aacaagcagatgcaatgcactt

SEQ ID NO: 8789006 - DNA, 22 bp, Homo sapiens
aacaagcagatgcaatgcactt

SEQ ID NO: 8789007 - DNA, 22 bp, Homo sapiens
aacaagtgtattaatggaaata

SEQ ID NO: 8789008 - DNA, 22 bp, Homo sapiens
aacaagttactcttaaagtata

SEQ ID NO: 8789009 - DNA, 22 bp, Homo sapiens
aacaagtaagtttatatatatt

SEQ ID NO: 8789010 - DNA, 19 bp, Homo sapiens
aacaagtaggaatggaaga

SEQ ID NO: 8789011 - DNA, 19 bp, Homo sapiens
aacaagtaggaatggaaga

SEQ ID NO: 8789012 - DNA, 22 bp, Homo sapiens
aacaataactagacatgccatg

SEQ ID NO: 8789013 - DNA, 22 bp, Homo sapiens
aagggagacagttgtgtgagga

SEQ ID NO: 8789014 - DNA, 22 bp, Homo sapiens
aagggagacagttgtgtgagga

SEQ ID NO: 8789015 - DNA, 22 bp, Homo sapiens
aagggagacccaccgtcctgga

SEQ ID NO: 8789016 - DNA, 22 bp, Homo sapiens
aagggagacccaccgtcctgga

SEQ ID NO: 8789017 - DNA, 22 bp, Homo sapiens
aagggagacccaccgtcctgga

SEQ ID NO: 8789018 - DNA, 22 bp, Homo sapiens
aagggagacagttgtgtgagga

SEQ ID NO: 8789019 - DNA, 22 bp, Homo sapiens
aagggagacagttgtgtgagga

SEQ ID NO: 8789020 - DNA, 22 bp, Homo sapiens
aacaagttgttgaaaataatta

SEQ ID NO: 8789021 - DNA, 22 bp, Homo sapiens
aacaagttagggtcttttactt

SEQ ID NO: 8789022 - DNA, 22 bp, Homo sapiens
aacaagttactcttaaagtata

SEQ ID NO: 8789023 - DNA, 22 bp, Homo sapiens
aacaagttactcttaaagtata

SEQ ID NO: 8789024 - DNA, 22 bp, Homo sapiens
aacaagttagggtcttttactt

SEQ ID NO: 8789025 - DNA, 22 bp, Homo sapiens
aacaagttctacctcacaaggt

SEQ ID NO: 8789026 - DNA, 22 bp, Homo sapiens
aagatataataactgttgtcat

SEQ ID NO: 8789027 - DNA, 19 bp, Homo sapiens
acagaaatgtaagtgagac

SEQ ID NO: 8789028 - DNA, 19 bp, Homo sapiens
acagaaatgtaagtgagac

SEQ ID NO: 8789029 - DNA, 19 bp, Homo sapiens
acagaaatgtaagtgagac

SEQ ID NO: 8789030 - DNA, 19 bp, Homo sapiens
acagaaatgtaagtgagac

SEQ ID NO: 8789031 - DNA, 19 bp, Homo sapiens
acagaaatgtaagtgagac

SEQ ID NO: 8789032 - DNA, 19 bp, Homo sapiens
acagaaatgtaagtgagac

SEQ ID NO: 8789033 - DNA, 22 bp, Homo sapiens
acagaagaaagggaggttttgc

SEQ ID NO: 8789034 - DNA, 22 bp, Homo sapiens
acagaagaagttcaaggtgaag

SEQ ID NO: 8789035 - DNA, 22 bp, Homo sapiens
acagaagaagttcaaggtgaag

SEQ ID NO: 8789036 - DNA, 22 bp, Homo sapiens
acagaagaagttcaaggtgaag

SEQ ID NO: 8789037 - DNA, 22 bp, Homo sapiens
acagaagaccaagaaagcttcc

SEQ ID NO: 8789038 - DNA, 22 bp, Homo sapiens
acagaagacagagtgttcatct

SEQ ID NO: 8789039 - DNA, 22 bp, Homo sapiens
acagaagacagagtgttcatct

SEQ ID NO: 8789040 - DNA, 20 bp, Homo sapiens
aagatactccagaaattaaa

SEQ ID NO: 8789041 - DNA, 22 bp, Homo sapiens
aagatactcagtggatatgcat

SEQ ID NO: 8789042 - DNA, 22 bp, Homo sapiens
aagatagatgtcatcagcatat

SEQ ID NO: 8789043 - DNA, 22 bp, Homo sapiens
aagatacatgttaggagcaacc

SEQ ID NO: 8789044 - DNA, 22 bp, Homo sapiens
aagatacattgtttttggtagt

SEQ ID NO: 8789045 - DNA, 22 bp, Homo sapiens
aagatacattatgtctctctga

SEQ ID NO: 8789046 - DNA, 22 bp, Homo sapiens
aagatacattttcttcagagaa

SEQ ID NO: 8789047 - DNA, 22 bp, Homo sapiens
aagatacattttcttcagagaa

SEQ ID NO: 8789048 - DNA, 22 bp, Homo sapiens
aagatacatcattcaggagtga

SEQ ID NO: 8789049 - DNA, 22 bp, Homo sapiens
acactacttttcataaaagtaa

SEQ ID NO: 8789050 - DNA, 22 bp, Homo sapiens
aagatacatcattcaggagtga

SEQ ID NO: 8789051 - DNA, 22 bp, Homo sapiens
aagattttctcaactgtatttg

SEQ ID NO: 8789052 - DNA, 22 bp, Homo sapiens
aagatttttttccacagactca

SEQ ID NO: 8789053 - DNA, 22 bp, Homo sapiens
aagatttttttccacagactca

SEQ ID NO: 8789054 - DNA, 22 bp, Homo sapiens
aagcaaaaggttacacttctgg

SEQ ID NO: 8789055 - DNA, 22 bp, Homo sapiens
aagattttcagtgcctaaaaca

SEQ ID NO: 8789056 - DNA, 22 bp, Homo sapiens
aagattttcagtgcctaaaaca

SEQ ID NO: 8789057 - DNA, 22 bp, Homo sapiens
aagattttctcaactgtatttg

SEQ ID NO: 8789058 - DNA, 22 bp, Homo sapiens
aagattttctcaactgtatttg

SEQ ID NO: 8789059 - DNA, 19 bp, Homo sapiens
aagatttggtcattgataa

SEQ ID NO: 8789060 - DNA, 22 bp, Homo sapiens
aagatttgtggatttaaggata

SEQ ID NO: 8789061 - DNA, 22 bp, Homo sapiens
aagatttgtggatttaaggata

SEQ ID NO: 8789062 - DNA, 22 bp, Homo sapiens
acagaagaccaagaaagcttcc

SEQ ID NO: 8789063 - DNA, 22 bp, Homo sapiens
acagaagaccagagagctaact

SEQ ID NO: 8789064 - DNA, 22 bp, Homo sapiens
acagaagaccagagagctaact

SEQ ID NO: 8789065 - DNA, 22 bp, Homo sapiens
acagaagagctggctctgtgct

SEQ ID NO: 8789066 - DNA, 22 bp, Homo sapiens
acagaagataactgggaccaga

SEQ ID NO: 8789067 - DNA, 22 bp, Homo sapiens
acagaagataactgggaccaga

SEQ ID NO: 8789068 - DNA, 22 bp, Homo sapiens
acagaagagctggctctgtgct

SEQ ID NO: 8789069 - DNA, 22 bp, Homo sapiens
acagaagagcacatttagtatg

SEQ ID NO: 8789070 - DNA, 22 bp, Homo sapiens
acagaagcaaaagcaggatctt

SEQ ID NO: 8789071 - DNA, 22 bp, Homo sapiens
acagaagataatgctgccttgg

SEQ ID NO: 8789072 - DNA, 22 bp, Homo sapiens
acagaagataatgctgccttgg

SEQ ID NO: 8789073 - DNA, 22 bp, Homo sapiens
acagaagcagccgtcacagata

SEQ ID NO: 8789074 - DNA, 22 bp, Homo sapiens
aagatttggtatcagaagacct

SEQ ID NO: 8789075 - DNA, 22 bp, Homo sapiens
acagaagcagccgtcacagata

SEQ ID NO: 8789076 - DNA, 22 bp, Homo sapiens
acagaagcagccgtcacagata

SEQ ID NO: 8789077 - DNA, 22 bp, Homo sapiens
acagaagcagccgtcacagata

SEQ ID NO: 8789078 - DNA, 22 bp, Homo sapiens
acagaggaaggctgagctgccc

SEQ ID NO: 8789079 - DNA, 22 bp, Homo sapiens
acagaggaaggctgagctgccc

SEQ ID NO: 8789080 - DNA, 22 bp, Homo sapiens
acagaggaaggctgagctgccc

SEQ ID NO: 8789081 - DNA, 22 bp, Homo sapiens
acagaggaaggctgagctgccc

SEQ ID NO: 8789082 - DNA, 22 bp, Homo sapiens
acagaggaagcatatagcacaa

SEQ ID NO: 8789083 - DNA, 22 bp, Homo sapiens
acagaggaagcatatagcacaa

SEQ ID NO: 8789084 - DNA, 22 bp, Homo sapiens
acagaggaaggctgagctgccc

SEQ ID NO: 8789085 - DNA, 22 bp, Homo sapiens
acagaggacaactaggcgctca

SEQ ID NO: 8789086 - DNA, 22 bp, Homo sapiens
acagaggacaactaggcgctca

SEQ ID NO: 8789087 - DNA, 22 bp, Homo sapiens
acagaggacaactaggcgctca

SEQ ID NO: 8789088 - DNA, 18 bp, Homo sapiens
acagaggcagacatgtat

SEQ ID NO: 8789089 - DNA, 17 bp, Homo sapiens
acagaggcaggagtgga

SEQ ID NO: 8789090 - DNA, 22 bp, Homo sapiens
acagaggacaactaggcgctca

SEQ ID NO: 8789091 - DNA, 22 bp, Homo sapiens
aagcacagttcttagagttaca

SEQ ID NO: 8789092 - DNA, 22 bp, Homo sapiens
aagcacagttcttagagttaca

SEQ ID NO: 8789093 - DNA, 22 bp, Homo sapiens
aagcacatacataataaagtcc

SEQ ID NO: 8789094 - DNA, 22 bp, Homo sapiens
aagcacatacataataaagtcc

SEQ ID NO: 8789095 - DNA, 22 bp, Homo sapiens
acagagcttaattcaggagctt

SEQ ID NO: 8789096 - DNA, 22 bp, Homo sapiens
acagagctgtactacttactga

SEQ ID NO: 8789097 - DNA, 22 bp, Homo sapiens
acagagcttcccagcctgagca

SEQ ID NO: 8789098 - DNA, 22 bp, Homo sapiens
acagaggaagcatatagcacaa

SEQ ID NO: 8789099 - DNA, 22 bp, Homo sapiens
acagagcttaggatgactccca

SEQ ID NO: 8789100 - DNA, 22 bp, Homo sapiens
acagagcttaggatgactccca

SEQ ID NO: 8789101 - DNA, 22 bp, Homo sapiens
acagagcacatagattggagtt

SEQ ID NO: 8789102 - DNA, 22 bp, Homo sapiens
aagcaaacaggagaagagctgt

SEQ ID NO: 8789103 - DNA, 22 bp, Homo sapiens
aagcaaacaggagaagagctgt

SEQ ID NO: 8789104 - DNA, 22 bp, Homo sapiens
aagcaaacaggagaagagctgt

SEQ ID NO: 8789105 - DNA, 22 bp, Homo sapiens
aagcaaacaggagaagagctgt

SEQ ID NO: 8789106 - DNA, 22 bp, Homo sapiens
aagcacatctcctgtgcagaac

SEQ ID NO: 8789107 - DNA, 22 bp, Homo sapiens
aagcacatcatgttgttcagac

SEQ ID NO: 8789108 - DNA, 22 bp, Homo sapiens
aagcacatgagctattcatgct

SEQ ID NO: 8789109 - DNA, 22 bp, Homo sapiens
aagcacatgagctattcatgct

SEQ ID NO: 8789110 - DNA, 22 bp, Homo sapiens
aagcacatttggaaaacatgga

SEQ ID NO: 8789111 - DNA, 20 bp, Homo sapiens
aagcacatttctacaataat

SEQ ID NO: 8789112 - DNA, 20 bp, Homo sapiens
aagcacatttctacaataat

SEQ ID NO: 8789113 - DNA, 20 bp, Homo sapiens
aagcacatttctacaataat

SEQ ID NO: 8789114 - DNA, 22 bp, Homo sapiens
aagcacattgtacatttgtgct

SEQ ID NO: 8789115 - DNA, 22 bp, Homo sapiens
aagcacattgtacatttgtgct

SEQ ID NO: 8789116 - DNA, 22 bp, Homo sapiens
acagatgagaagctgcattcaa

SEQ ID NO: 8789117 - DNA, 22 bp, Homo sapiens
acagatgaattttaattgtgtt

SEQ ID NO: 8789118 - DNA, 22 bp, Homo sapiens
acagatgaattttaattgtgtt

SEQ ID NO: 8789119 - DNA, 22 bp, Homo sapiens
acagatgacttgtctgctgtaa

SEQ ID NO: 8789120 - DNA, 22 bp, Homo sapiens
acagatgagaaggctgaccagt

SEQ ID NO: 8789121 - DNA, 22 bp, Homo sapiens
acagatgagactccaggacctt

SEQ ID NO: 8789122 - DNA, 22 bp, Homo sapiens
acagatgagaaggctgaccagt

SEQ ID NO: 8789123 - DNA, 22 bp, Homo sapiens
acagatgagaagctgcattcaa

SEQ ID NO: 8789124 - DNA, 22 bp, Homo sapiens
acagatgagaagctgcattcaa

SEQ ID NO: 8789125 - DNA, 22 bp, Homo sapiens
acagatgaaacccagctagttg

SEQ ID NO: 8789126 - DNA, 22 bp, Homo sapiens
acagatgaaacccagctagttg

SEQ ID NO: 8789127 - DNA, 23 bp, Homo sapiens
acagatgaaagtgtggctcagag

SEQ ID NO: 8789128 - DNA, 22 bp, Homo sapiens
acagatgaatctgtgattgctg

SEQ ID NO: 8789129 - DNA, 22 bp, Homo sapiens
acagatgaatttatggatggaa

SEQ ID NO: 8789130 - DNA, 22 bp, Homo sapiens
acagatgaatttatggatggaa

SEQ ID NO: 8789131 - DNA, 22 bp, Homo sapiens
acagatgaaaaagcttgtggat

SEQ ID NO: 8789132 - DNA, 22 bp, Homo sapiens
acagatcacctgttagccaaaa

SEQ ID NO: 8789133 - DNA, 22 bp, Homo sapiens
acagatcacttgactaaaatga

SEQ ID NO: 8789134 - DNA, 23 bp, Homo sapiens
acagatcatctcgaaacaactat

SEQ ID NO: 8789135 - DNA, 22 bp, Homo sapiens
acagagtcatggtagtcaaagg

SEQ ID NO: 8789136 - DNA, 22 bp, Homo sapiens
acagagtcattcactgatgaag

SEQ ID NO: 8789137 - DNA, 22 bp, Homo sapiens
acacgcatagaaaattgcacta

SEQ ID NO: 8789138 - DNA, 22 bp, Homo sapiens
acacgcataaatacacagtcta

SEQ ID NO: 8789139 - DNA, 22 bp, Homo sapiens
acacgcatagaaaattgcacta

SEQ ID NO: 8789140 - DNA, 22 bp, Homo sapiens
acacgcatgatgatgcacgtac

SEQ ID NO: 8789141 - DNA, 22 bp, Homo sapiens
acacctttgccccaagtcatag

SEQ ID NO: 8789142 - DNA, 22 bp, Homo sapiens
acacctttcaggtccagacagt

SEQ ID NO: 8789143 - DNA, 22 bp, Homo sapiens
acacccttgtccatagcagatg

SEQ ID NO: 8789144 - DNA, 22 bp, Homo sapiens
acaccttctgagaactgagcag

SEQ ID NO: 8789145 - DNA, 23 bp, Homo sapiens
acacctgtgctgtagtcactaca

SEQ ID NO: 8789146 - DNA, 23 bp, Homo sapiens
acacctgtgctgtagtcactaca

SEQ ID NO: 8789147 - DNA, 23 bp, Homo sapiens
acacctgtgctgtagtcactaca

SEQ ID NO: 8789148 - DNA, 22 bp, Homo sapiens
acacatttctctttttgtaagt

SEQ ID NO: 8789149 - DNA, 22 bp, Homo sapiens
acacccaggctggcgtgcagtg

SEQ ID NO: 8789150 - DNA, 22 bp, Homo sapiens
acacatttctcccagtctccat

SEQ ID NO: 8789151 - DNA, 22 bp, Homo sapiens
acacatttctcccagtctccat

SEQ ID NO: 8789152 - DNA, 23 bp, Homo sapiens
aagagtttagagtcttgcagagt

SEQ ID NO: 8789153 - DNA, 23 bp, Homo sapiens
aagagtttagagtcttgcagagt

SEQ ID NO: 8789154 - DNA, 23 bp, Homo sapiens
aagagtttagagtcttgcagagt

SEQ ID NO: 8789155 - DNA, 22 bp, Homo sapiens
acacggcactttaggaaggggc

SEQ ID NO: 8789156 - DNA, 22 bp, Homo sapiens
acacggcactttaggaaggggc

SEQ ID NO: 8789157 - DNA, 22 bp, Homo sapiens
acacggcactttaggaaggggc

SEQ ID NO: 8789158 - DNA, 22 bp, Homo sapiens
acacggcactttaggaaggggc

SEQ ID NO: 8789159 - DNA, 22 bp, Homo sapiens
acactaaggttggagtcacagt

SEQ ID NO: 8789160 - DNA, 23 bp, Homo sapiens
acactaaatgtgaaggagcaaag

SEQ ID NO: 8789161 - DNA, 22 bp, Homo sapiens
acactaaatgagtctacagtac

SEQ ID NO: 8789162 - DNA, 22 bp, Homo sapiens
acactaaatgagtctacagtac

SEQ ID NO: 8789163 - DNA, 22 bp, Homo sapiens
acactacaacagcagaggtgag

SEQ ID NO: 8789164 - DNA, 22 bp, Homo sapiens
acactacaatctcagaactata

SEQ ID NO: 8789165 - DNA, 22 bp, Homo sapiens
acactacaatctcagaactata

SEQ ID NO: 8789166 - DNA, 22 bp, Homo sapiens
acactacagggagaagactcac

SEQ ID NO: 8789167 - DNA, 22 bp, Homo sapiens
acactacagggagaagactcac

SEQ ID NO: 8789168 - DNA, 22 bp, Homo sapiens
acactacagggccgggatggaa

SEQ ID NO: 8789169 - DNA, 22 bp, Homo sapiens
acactacaatctcagaactata

SEQ ID NO: 8789170 - DNA, 22 bp, Homo sapiens
aagagtcatagagacattgatt

SEQ ID NO: 8789171 - DNA, 22 bp, Homo sapiens
aagagtcagcttctgtatgggt

SEQ ID NO: 8789172 - DNA, 22 bp, Homo sapiens
aagagtatagctttaggattga

SEQ ID NO: 8789173 - DNA, 22 bp, Homo sapiens
aagagtatagctttaggattga

SEQ ID NO: 8789174 - DNA, 19 bp, Homo sapiens
aagagtcacaggcagccct

SEQ ID NO: 8789175 - DNA, 22 bp, Homo sapiens
aagagtatgcatgcatgtttgt

SEQ ID NO: 8789176 - DNA, 22 bp, Homo sapiens
aagaggttgtctgtgatgagtt

SEQ ID NO: 8789177 - DNA, 22 bp, Homo sapiens
aagaggttgtctgtgatgagtt

SEQ ID NO: 8789178 - DNA, 22 bp, Homo sapiens
aagaggttgtctgtgatgagtt

SEQ ID NO: 8789179 - DNA, 22 bp, Homo sapiens
aagaggttctccttggagtggg

SEQ ID NO: 8789180 - DNA, 22 bp, Homo sapiens
aagaggttctccttggagtggg

SEQ ID NO: 8789181 - DNA, 22 bp, Homo sapiens
aagaggttgtacctaaagtgtt

SEQ ID NO: 8789182 - DNA, 22 bp, Homo sapiens
aagaggttgtctgtgatgagtt

SEQ ID NO: 8789183 - DNA, 22 bp, Homo sapiens
aagagtaaatgtctaattagga

SEQ ID NO: 8789184 - DNA, 22 bp, Homo sapiens
aagaggtttaactgactcacag

SEQ ID NO: 8789185 - DNA, 22 bp, Homo sapiens
aagagttagctcaataacttga

SEQ ID NO: 8789186 - DNA, 22 bp, Homo sapiens
aagagttatgaaagcaaggcat

SEQ ID NO: 8789187 - DNA, 22 bp, Homo sapiens
aagagttaagcaacagatacca

SEQ ID NO: 8789188 - DNA, 22 bp, Homo sapiens
aagagtttaccagtgctgcttc

SEQ ID NO: 8789189 - DNA, 22 bp, Homo sapiens
aagagtttaccagtgctgcttc

SEQ ID NO: 8789190 - DNA, 22 bp, Homo sapiens
aagagtttaattttgtctagac

SEQ ID NO: 8789191 - DNA, 22 bp, Homo sapiens
aagagttagctcaataacttga

SEQ ID NO: 8789192 - DNA, 22 bp, Homo sapiens
aagagtttaattttgtctagac

SEQ ID NO: 8789193 - DNA, 22 bp, Homo sapiens
aagagtttaattttgtctagac

SEQ ID NO: 8789194 - DNA, 22 bp, Homo sapiens
aagagttgattcataggtttta

SEQ ID NO: 8789195 - DNA, 22 bp, Homo sapiens
aagagtctattggaactagaca

SEQ ID NO: 8789196 - DNA, 22 bp, Homo sapiens
aagagtgacttttcagctgtga

SEQ ID NO: 8789197 - DNA, 20 bp, Homo sapiens
aagagtctttactgagctaa

SEQ ID NO: 8789198 - DNA, 22 bp, Homo sapiens
aagagtgacttttcagctgtga

SEQ ID NO: 8789199 - DNA, 22 bp, Homo sapiens
aagagtggagaataaaatagga

SEQ ID NO: 8789200 - DNA, 22 bp, Homo sapiens
aagagtggagctggaaagtggg

SEQ ID NO: 8789201 - DNA, 22 bp, Homo sapiens
aagagtggagctggaaagtggg

SEQ ID NO: 8789202 - DNA, 19 bp, Homo sapiens
aagagggaaagtgctatgc

SEQ ID NO: 8789203 - DNA, 22 bp, Homo sapiens
acacacatgcatgcttgccatt

SEQ ID NO: 8789204 - DNA, 22 bp, Homo sapiens
acacacatgcatgcttgccatt

SEQ ID NO: 8789205 - DNA, 22 bp, Homo sapiens
acacacatgcatgcttgccatt

SEQ ID NO: 8789206 - DNA, 22 bp, Homo sapiens
aagaggtcataccagataaggg

SEQ ID NO: 8789207 - DNA, 20 bp, Homo sapiens
aagaggtgataacaggtgag

SEQ ID NO: 8789208 - DNA, 22 bp, Homo sapiens
acacacagagtttatacaggca

SEQ ID NO: 8789209 - DNA, 20 bp, Homo sapiens
acacacagagacatgcgcat

SEQ ID NO: 8789210 - DNA, 20 bp, Homo sapiens
acacacagagacatgcgcat

SEQ ID NO: 8789211 - DNA, 22 bp, Homo sapiens
aagaggcatctcagcttcctct

SEQ ID NO: 8789212 - DNA, 22 bp, Homo sapiens
aagaggcatctcagcttcctct

SEQ ID NO: 8789213 - DNA, 22 bp, Homo sapiens
aagaggcatctcagcttcctct

SEQ ID NO: 8789214 - DNA, 22 bp, Homo sapiens
acacacagcgcctaccatgtgc

SEQ ID NO: 8789215 - DNA, 22 bp, Homo sapiens
acacacagcgcctaccatgtgc

SEQ ID NO: 8789216 - DNA, 22 bp, Homo sapiens
acacacagcgcctaccatgtgc

SEQ ID NO: 8789217 - DNA, 22 bp, Homo sapiens
acacacagcgcctaccatgtgc

SEQ ID NO: 8789218 - DNA, 22 bp, Homo sapiens
acacacaggtaaaggagcctgg

SEQ ID NO: 8789219 - DNA, 22 bp, Homo sapiens
acacacaggtaaaggagcctgg

SEQ ID NO: 8789220 - DNA, 22 bp, Homo sapiens
aagacattttagagatagggaa

SEQ ID NO: 8789221 - DNA, 22 bp, Homo sapiens
aagacattttgaaattggaagc

SEQ ID NO: 8789222 - DNA, 22 bp, Homo sapiens
aagacatttatttgaatcaatt

SEQ ID NO: 8789223 - DNA, 22 bp, Homo sapiens
aagacattttgaaattggaagc

SEQ ID NO: 8789224 - DNA, 22 bp, Homo sapiens
aagacattttgaaattggaagc

SEQ ID NO: 8789225 - DNA, 22 bp, Homo sapiens
aagacatttatttgaatcaatt

SEQ ID NO: 8789226 - DNA, 22 bp, Homo sapiens
aagaccagaggatataaccaga

SEQ ID NO: 8789227 - DNA, 22 bp, Homo sapiens
aagacattttgaaattggaagc

SEQ ID NO: 8789228 - DNA, 22 bp, Homo sapiens
aagacatttatttgaatcaatt

SEQ ID NO: 8789229 - DNA, 22 bp, Homo sapiens
aagacatttatttgaatcaatt

SEQ ID NO: 8789230 - DNA, 22 bp, Homo sapiens
aagacatttatgaaaagtgctg

SEQ ID NO: 8789231 - DNA, 21 bp, Homo sapiens
aagaggaagcattatggcata

SEQ ID NO: 8789232 - DNA, 23 bp, Homo sapiens
aagaggaggccctgctcccgtcc

SEQ ID NO: 8789233 - DNA, 22 bp, Homo sapiens
aagaggaggattgatgtgggag

SEQ ID NO: 8789234 - DNA, 22 bp, Homo sapiens
aagaggaggattgatgtgggag

SEQ ID NO: 8789235 - DNA, 22 bp, Homo sapiens
aagaggaggattgatgtgggag

SEQ ID NO: 8789236 - DNA, 22 bp, Homo sapiens
aagaggcagcccgctgaggctg

SEQ ID NO: 8789237 - DNA, 22 bp, Homo sapiens
aagaggcagtggtgatgaatgg

SEQ ID NO: 8789238 - DNA, 22 bp, Homo sapiens
aagaggcagtggtgatgaatgg

SEQ ID NO: 8789239 - DNA, 22 bp, Homo sapiens
aagaggcagtggtgatgaatgg

SEQ ID NO: 8789240 - DNA, 23 bp, Homo sapiens
aagaggaggccctgctcccgtcc

SEQ ID NO: 8789241 - DNA, 23 bp, Homo sapiens
aagaggaggccctgctcccgtcc

SEQ ID NO: 8789242 - DNA, 22 bp, Homo sapiens
aagaggagggcagattcaaggc

SEQ ID NO: 8789243 - DNA, 22 bp, Homo sapiens
aagaggagggcagattcaaggc

SEQ ID NO: 8789244 - DNA, 22 bp, Homo sapiens
aagaggagtagatgtggttggt

SEQ ID NO: 8789245 - DNA, 22 bp, Homo sapiens
aagaggagtagatgtggttggt

SEQ ID NO: 8789246 - DNA, 22 bp, Homo sapiens
aagaggagtagatgtggttggt

SEQ ID NO: 8789247 - DNA, 22 bp, Homo sapiens
aagaggagtagatgtggttggt

SEQ ID NO: 8789248 - DNA, 19 bp, Homo sapiens
aagaggcaaccctcgagcc

SEQ ID NO: 8789249 - DNA, 22 bp, Homo sapiens
aagacattgtcattttataatt

SEQ ID NO: 8789250 - DNA, 22 bp, Homo sapiens
aagacattgtggagatgttgct

SEQ ID NO: 8789251 - DNA, 22 bp, Homo sapiens
aagacattgtcattttataatt

SEQ ID NO: 8789252 - DNA, 22 bp, Homo sapiens
aagacattggcattgactgtaa

SEQ ID NO: 8789253 - DNA, 22 bp, Homo sapiens
aagacattgtcattttataatt

SEQ ID NO: 8789254 - DNA, 22 bp, Homo sapiens
aagacattgtcattttataatt

SEQ ID NO: 8789255 - DNA, 22 bp, Homo sapiens
aagacattgtcattttataatt

SEQ ID NO: 8789256 - DNA, 22 bp, Homo sapiens
aagacattgctgcttttaattg

SEQ ID NO: 8789257 - DNA, 22 bp, Homo sapiens
aagacattgcatgataatgctg

SEQ ID NO: 8789258 - DNA, 22 bp, Homo sapiens
aagacattgctgcttttaattg

SEQ ID NO: 8789259 - DNA, 22 bp, Homo sapiens
aagacattgctgcttttaattg

SEQ ID NO: 8789260 - DNA, 22 bp, Homo sapiens
aagacattggacaatccagagg

SEQ ID NO: 8789261 - DNA, 22 bp, Homo sapiens
aagacattggacaatccagagg

SEQ ID NO: 8789262 - DNA, 22 bp, Homo sapiens
aagacattggacaatccagagg

SEQ ID NO: 8789263 - DNA, 22 bp, Homo sapiens
aagacattggcattgactgtaa

SEQ ID NO: 8789264 - DNA, 22 bp, Homo sapiens
aagacattggcattgactgtaa

SEQ ID NO: 8789265 - DNA, 22 bp, Homo sapiens
aagacattccaaagtggctaat

SEQ ID NO: 8789266 - DNA, 22 bp, Homo sapiens
aagacattgcatgataatgctg

SEQ ID NO: 8789267 - DNA, 22 bp, Homo sapiens
aagacattgctgcttttaattg

SEQ ID NO: 8789268 - DNA, 22 bp, Homo sapiens
aagacattgcatgataatgctg

SEQ ID NO: 8789269 - DNA, 22 bp, Homo sapiens
aagacattcatgaagaagggat

SEQ ID NO: 8789270 - DNA, 22 bp, Homo sapiens
aagacattccaaagtggctaat

SEQ ID NO: 8789271 - DNA, 22 bp, Homo sapiens
aagacattcacaaatgttcact

SEQ ID NO: 8789272 - DNA, 22 bp, Homo sapiens
aagacattcacaaatgttcact

SEQ ID NO: 8789273 - DNA, 22 bp, Homo sapiens
aagacattcacaaatgttcact

SEQ ID NO: 8789274 - DNA, 22 bp, Homo sapiens
aagacattcacaaatgttcact

SEQ ID NO: 8789275 - DNA, 22 bp, Homo sapiens
aagacattcacaaatgttcact

SEQ ID NO: 8789276 - DNA, 22 bp, Homo sapiens
acaagaatgtagattagttaag

SEQ ID NO: 8789277 - DNA, 22 bp, Homo sapiens
aagacattagaatcagcctgtt

SEQ ID NO: 8789278 - DNA, 22 bp, Homo sapiens
aagacattagaatcagcctgtt

SEQ ID NO: 8789279 - DNA, 22 bp, Homo sapiens
aagacattagaatcagcctgtt

SEQ ID NO: 8789280 - DNA, 22 bp, Homo sapiens
acaagaataaggataagagatt

SEQ ID NO: 8789281 - DNA, 22 bp, Homo sapiens
acaagaataaggataagagatt

SEQ ID NO: 8789282 - DNA, 23 bp, Homo sapiens
acaactttacagatacattttgt

SEQ ID NO: 8789283 - DNA, 23 bp, Homo sapiens
acaactttacagatacattttgt

SEQ ID NO: 8789284 - DNA, 22 bp, Homo sapiens
acaactgttggaggaacacagg

SEQ ID NO: 8789285 - DNA, 22 bp, Homo sapiens
acaacttggctgtaaagaagaa

SEQ ID NO: 8789286 - DNA, 22 bp, Homo sapiens
acaactttctgggttatctgat

SEQ ID NO: 8789287 - DNA, 22 bp, Homo sapiens
acaactttgacccttgttctta

SEQ ID NO: 8789288 - DNA, 22 bp, Homo sapiens
acaagaataaggataagagatt

SEQ ID NO: 8789289 - DNA, 22 bp, Homo sapiens
acaagaaaggtaggattcaggt

SEQ ID NO: 8789290 - DNA, 22 bp, Homo sapiens
acaagaaccaaagaaggatatt

SEQ ID NO: 8789291 - DNA, 22 bp, Homo sapiens
acaactttgtagcaattccacg

SEQ ID NO: 8789292 - DNA, 22 bp, Homo sapiens
aagacaatgtttctgatagata

SEQ ID NO: 8789293 - DNA, 22 bp, Homo sapiens
aagacaatgtttctgatagata

SEQ ID NO: 8789294 - DNA, 22 bp, Homo sapiens
aagacaatttgatactagttgc

SEQ ID NO: 8789295 - DNA, 22 bp, Homo sapiens
aagacaatttatgttagggtca

SEQ ID NO: 8789296 - DNA, 22 bp, Homo sapiens
aagacaattttgagtatgcaca

SEQ ID NO: 8789297 - DNA, 22 bp, Homo sapiens
aagacaattttgagtatgcaca

SEQ ID NO: 8789298 - DNA, 22 bp, Homo sapiens
acaactgatgggtcatgtggga

SEQ ID NO: 8789299 - DNA, 22 bp, Homo sapiens
acaactctcagttaaataaaga

SEQ ID NO: 8789300 - DNA, 22 bp, Homo sapiens
acaacaaaatgaggaagtggtc

SEQ ID NO: 8789301 - DNA, 22 bp, Homo sapiens
acaactgttagacacttctaag

SEQ ID NO: 8789302 - DNA, 22 bp, Homo sapiens
acaactgttagacacttctaag

SEQ ID NO: 8789303 - DNA, 22 bp, Homo sapiens
acaactgttagacacttctaag

SEQ ID NO: 8789304 - DNA, 22 bp, Homo sapiens
acaactgtcttcttcatgctcc

SEQ ID NO: 8789305 - DNA, 22 bp, Homo sapiens
acaactgtcttcttcatgctcc

SEQ ID NO: 8789306 - DNA, 22 bp, Homo sapiens
acaactgtcagtaaagaatatt

SEQ ID NO: 8789307 - DNA, 22 bp, Homo sapiens
aagacacacacatatgctgagt

SEQ ID NO: 8789308 - DNA, 22 bp, Homo sapiens
aagacacacacatatgctgagt

SEQ ID NO: 8789309 - DNA, 22 bp, Homo sapiens
aagacacacacatatgctgagt

SEQ ID NO: 8789310 - DNA, 22 bp, Homo sapiens
aagacacaatgtagcccagcac

SEQ ID NO: 8789311 - DNA, 22 bp, Homo sapiens
aattattgagcatctactgtgt

SEQ ID NO: 8789312 - DNA, 22 bp, Homo sapiens
aattattgagcatctactgtgt

SEQ ID NO: 8789313 - DNA, 20 bp, Homo sapiens
aattagatgtttaatcaata

SEQ ID NO: 8789314 - DNA, 20 bp, Homo sapiens
aattagatgtttaatcaata

SEQ ID NO: 8789315 - DNA, 22 bp, Homo sapiens
aattagcagcatattctgcgat

SEQ ID NO: 8789316 - DNA, 22 bp, Homo sapiens
aattagaagctgttagcaaaat

SEQ ID NO: 8789317 - DNA, 22 bp, Homo sapiens
aattagaagctgttagcaaaat

SEQ ID NO: 8789318 - DNA, 22 bp, Homo sapiens
aattagaagctgttagcaaaat

SEQ ID NO: 8789319 - DNA, 22 bp, Homo sapiens
aattagaagctgttagcaaaat

SEQ ID NO: 8789320 - DNA, 22 bp, Homo sapiens
aattagaagggagttattgata

SEQ ID NO: 8789321 - DNA, 22 bp, Homo sapiens
aattagactaattttacaaggg

SEQ ID NO: 8789322 - DNA, 22 bp, Homo sapiens
aattagactaattttacaaggg

SEQ ID NO: 8789323 - DNA, 22 bp, Homo sapiens
aattcaatctaagaaatgatca

SEQ ID NO: 8789324 - DNA, 22 bp, Homo sapiens
aattcaatctaagaaatgatca

SEQ ID NO: 8789325 - DNA, 22 bp, Homo sapiens
aattcaatctaagaaatgatca

SEQ ID NO: 8789326 - DNA, 22 bp, Homo sapiens
aattcaatggtttttaggatat

SEQ ID NO: 8789327 - DNA, 22 bp, Homo sapiens
aattcaatctgtagattgtgat

SEQ ID NO: 8789328 - DNA, 23 bp, Homo sapiens
aattcaaattcagtgtgactagg

SEQ ID NO: 8789329 - DNA, 23 bp, Homo sapiens
aattcaaattcagtgtgactagg

SEQ ID NO: 8789330 - DNA, 22 bp, Homo sapiens
aattcaaatttgagtttgtgat

SEQ ID NO: 8789331 - DNA, 23 bp, Homo sapiens
aattcaaattcagtgtgactagg

SEQ ID NO: 8789332 - DNA, 22 bp, Homo sapiens
aattcaaggatctgttaaatct

SEQ ID NO: 8789333 - DNA, 22 bp, Homo sapiens
aattcaaattacaatagttgtt

SEQ ID NO: 8789334 - DNA, 22 bp, Homo sapiens
aattcaaattacaatagttgtt

SEQ ID NO: 8789335 - DNA, 22 bp, Homo sapiens
aattcaaattacaatagttgtt

SEQ ID NO: 8789336 - DNA, 23 bp, Homo sapiens
aattcaaattcagtgtgactagg

SEQ ID NO: 8789337 - DNA, 23 bp, Homo sapiens
aattcaaattcagtgtgactagg

SEQ ID NO: 8789338 - DNA, 23 bp, Homo sapiens
aattcaaattcagtgtgactagg

SEQ ID NO: 8789339 - DNA, 22 bp, Homo sapiens
aattcaaagactagaattttgc

SEQ ID NO: 8789340 - DNA, 22 bp, Homo sapiens
aattcaaagactagaattttgc

SEQ ID NO: 8789341 - DNA, 22 bp, Homo sapiens
aattcaaattacaatagttgtt

SEQ ID NO: 8789342 - DNA, 22 bp, Homo sapiens
aattcaaattacaatagttgtt

SEQ ID NO: 8789343 - DNA, 17 bp, Homo sapiens
aagacaagacaaatgca

SEQ ID NO: 8789344 - DNA, 17 bp, Homo sapiens
aagacaagacaaatgca

SEQ ID NO: 8789345 - DNA, 22 bp, Homo sapiens
aagacaaaggggtccttggatg

SEQ ID NO: 8789346 - DNA, 22 bp, Homo sapiens
aagacaacagagatgacagact

SEQ ID NO: 8789347 - DNA, 22 bp, Homo sapiens
aagacaacagagatgacagact

SEQ ID NO: 8789348 - DNA, 22 bp, Homo sapiens
aagacaacagagatgacagact

SEQ ID NO: 8789349 - DNA, 22 bp, Homo sapiens
aagaatttaaactaaccatatg

SEQ ID NO: 8789350 - DNA, 22 bp, Homo sapiens
aagaattttccagcatgtcagt

SEQ ID NO: 8789351 - DNA, 22 bp, Homo sapiens
aagaattttccagcatgtcagt

SEQ ID NO: 8789352 - DNA, 22 bp, Homo sapiens
aagaattttccagcatgtcagt

SEQ ID NO: 8789353 - DNA, 22 bp, Homo sapiens
aagacaatcctggacagtcagc

SEQ ID NO: 8789354 - DNA, 22 bp, Homo sapiens
aagacaatcctggacagtcagc

SEQ ID NO: 8789355 - DNA, 22 bp, Homo sapiens
aagacaagcatcaaatcaggca

SEQ ID NO: 8789356 - DNA, 22 bp, Homo sapiens
aagacaagccttgtttttctgc

SEQ ID NO: 8789357 - DNA, 17 bp, Homo sapiens
aagacaagacaaatgca

SEQ ID NO: 8789358 - DNA, 17 bp, Homo sapiens
aagacaagacaaatgca

SEQ ID NO: 8789359 - DNA, 22 bp, Homo sapiens
aagaattggtcacatgctacaa

SEQ ID NO: 8789360 - DNA, 22 bp, Homo sapiens
aagaattggtttcctctgtcat

SEQ ID NO: 8789361 - DNA, 22 bp, Homo sapiens
aagaattgcctttcaattgttt

SEQ ID NO: 8789362 - DNA, 22 bp, Homo sapiens
aagaattgatgtgaattgcagc

SEQ ID NO: 8789363 - DNA, 22 bp, Homo sapiens
aagaattcactggtagagtcaa

SEQ ID NO: 8789364 - DNA, 22 bp, Homo sapiens
aagaatgaaggatttagctgtt

SEQ ID NO: 8789365 - DNA, 22 bp, Homo sapiens
aagaattattgcaatactagat

SEQ ID NO: 8789366 - DNA, 22 bp, Homo sapiens
aagaattattgcaatactagat

SEQ ID NO: 8789367 - DNA, 22 bp, Homo sapiens
aattcacaaaaccagattgctt

SEQ ID NO: 8789368 - DNA, 22 bp, Homo sapiens
aattcacaaaaccagattgctt

SEQ ID NO: 8789369 - DNA, 22 bp, Homo sapiens
aattcaatggtttttaggatat

SEQ ID NO: 8789370 - DNA, 22 bp, Homo sapiens
aattcacaaaaccagattgctt

SEQ ID NO: 8789371 - DNA, 22 bp, Homo sapiens
aattcacaaaaccagattgctt

SEQ ID NO: 8789372 - DNA, 22 bp, Homo sapiens
aattcaatggtttttaggatat

SEQ ID NO: 8789373 - DNA, 22 bp, Homo sapiens
aattcacaaaaccagattgctt

SEQ ID NO: 8789374 - DNA, 22 bp, Homo sapiens
aattcacaaaagttagatccat

SEQ ID NO: 8789375 - DNA, 22 bp, Homo sapiens
aattcacaaaagttagatccat

SEQ ID NO: 8789376 - DNA, 22 bp, Homo sapiens
aagaatctgacataatttcctg

SEQ ID NO: 8789377 - DNA, 22 bp, Homo sapiens
aagaatctgttgattccccact

SEQ ID NO: 8789378 - DNA, 22 bp, Homo sapiens
aagaatctgttgattccccact

SEQ ID NO: 8789379 - DNA, 22 bp, Homo sapiens
aagaatcttaatccagaaacct

SEQ ID NO: 8789380 - DNA, 22 bp, Homo sapiens
aagaatctttccagttttgatg

SEQ ID NO: 8789381 - DNA, 22 bp, Homo sapiens
aactgaaacggtgatcttttaa

SEQ ID NO: 8789382 - DNA, 22 bp, Homo sapiens
aactgaaacggtgatcttttaa

SEQ ID NO: 8789383 - DNA, 22 bp, Homo sapiens
aactgaaaccaaacactttagg

SEQ ID NO: 8789384 - DNA, 22 bp, Homo sapiens
aactcttttctgggtcagcaca

SEQ ID NO: 8789385 - DNA, 22 bp, Homo sapiens
aactctttgtggacattaaatt

SEQ ID NO: 8789386 - DNA, 22 bp, Homo sapiens
aactctttggtctcaggaaagg

SEQ ID NO: 8789387 - DNA, 22 bp, Homo sapiens
aactcttaattttcatgaaatg

SEQ ID NO: 8789388 - DNA, 22 bp, Homo sapiens
aactctttacatgtttgattca

SEQ ID NO: 8789389 - DNA, 22 bp, Homo sapiens
aactcctgttctatgacaagag

SEQ ID NO: 8789390 - DNA, 22 bp, Homo sapiens
aactccttaatgaagtccagtt

SEQ ID NO: 8789391 - DNA, 22 bp, Homo sapiens
aactctatttaccctactaaac

SEQ ID NO: 8789392 - DNA, 22 bp, Homo sapiens
aactctatttaccctactaaac

SEQ ID NO: 8789393 - DNA, 22 bp, Homo sapiens
aactctagtgctccttggagga

SEQ ID NO: 8789394 - DNA, 22 bp, Homo sapiens
aactctagggaggcaggaagca

SEQ ID NO: 8789395 - DNA, 22 bp, Homo sapiens
aactctacttgggactcctctg

SEQ ID NO: 8789396 - DNA, 23 bp, Homo sapiens
aactcctgaatcgtgagccatct

SEQ ID NO: 8789397 - DNA, 22 bp, Homo sapiens
aactcctcactgcctctggcac

SEQ ID NO: 8789398 - DNA, 20 bp, Homo sapiens
aactcctagcctcaagtgat

SEQ ID NO: 8789399 - DNA, 20 bp, Homo sapiens
aactcctagcctcaagtgat

SEQ ID NO: 8789400 - DNA, 22 bp, Homo sapiens
aactctgcttatagtttgtcca

SEQ ID NO: 8789401 - DNA, 22 bp, Homo sapiens
aatgtcaaaggctatacattca

SEQ ID NO: 8789402 - DNA, 22 bp, Homo sapiens
aatgtcaaaggctatacattca

SEQ ID NO: 8789403 - DNA, 22 bp, Homo sapiens
aatgtcaaaggctatacattca

SEQ ID NO: 8789404 - DNA, 22 bp, Homo sapiens
aatgtcaaaggctatacattca

SEQ ID NO: 8789405 - DNA, 22 bp, Homo sapiens
aatgtcaaacagagcagagcta

SEQ ID NO: 8789406 - DNA, 22 bp, Homo sapiens
aatgtcaaacagagcagagcta

SEQ ID NO: 8789407 - DNA, 22 bp, Homo sapiens
aatgtcaaaatggaatgagact

SEQ ID NO: 8789408 - DNA, 22 bp, Homo sapiens
aatgtcaaaatggaatgagact

SEQ ID NO: 8789409 - DNA, 22 bp, Homo sapiens
aatgtcaaatgagaggggagaa

SEQ ID NO: 8789410 - DNA, 22 bp, Homo sapiens
aatgtcaaagtgctttgcaaac

SEQ ID NO: 8789411 - DNA, 22 bp, Homo sapiens
aatgtcaaaggctatacattca

SEQ ID NO: 8789412 - DNA, 22 bp, Homo sapiens
aatgtcaaagtgctttgcaaac

SEQ ID NO: 8789413 - DNA, 22 bp, Homo sapiens
aatgtcaaatgagaggggagaa

SEQ ID NO: 8789414 - DNA, 22 bp, Homo sapiens
aatgtcaacacaagagaaatgc

SEQ ID NO: 8789415 - DNA, 22 bp, Homo sapiens
aatgtcaaaataattgatttgt

SEQ ID NO: 8789416 - DNA, 22 bp, Homo sapiens
aatgtcaaaatggaatgagact

SEQ ID NO: 8789417 - DNA, 22 bp, Homo sapiens
aatgtatttgatgtattagcct

SEQ ID NO: 8789418 - DNA, 22 bp, Homo sapiens
aatgtcaacacttggtatgtca

SEQ ID NO: 8789419 - DNA, 22 bp, Homo sapiens
aatgtcaacacaagagaaatgc

SEQ ID NO: 8789420 - DNA, 22 bp, Homo sapiens
aatgtcaagggaagcaggaaat

SEQ ID NO: 8789421 - DNA, 22 bp, Homo sapiens
aatgtcaataactttatccctc

SEQ ID NO: 8789422 - DNA, 22 bp, Homo sapiens
aatgtcaagtagccaatgcttc

SEQ ID NO: 8789423 - DNA, 22 bp, Homo sapiens
aatgtcttgagaagagaaatct

SEQ ID NO: 8789424 - DNA, 20 bp, Homo sapiens
aatgtcttgagacatttcag

SEQ ID NO: 8789425 - DNA, 20 bp, Homo sapiens
aatgtcttgagacatttcag

SEQ ID NO: 8789426 - DNA, 22 bp, Homo sapiens
aatgtcttctcttgttgaattt

SEQ ID NO: 8789427 - DNA, 22 bp, Homo sapiens
aatgtcttctcttgttgaattt

SEQ ID NO: 8789428 - DNA, 22 bp, Homo sapiens
aatgtcaagggaagcaggaaat

SEQ ID NO: 8789429 - DNA, 22 bp, Homo sapiens
aatgtcttcttcagctgaataa

SEQ ID NO: 8789430 - DNA, 22 bp, Homo sapiens
aatgtcttcttcagctgaataa

SEQ ID NO: 8789431 - DNA, 22 bp, Homo sapiens
aatgtctttatttcaggtttac

SEQ ID NO: 8789432 - DNA, 22 bp, Homo sapiens
aatgtctttctcataacagata

SEQ ID NO: 8789433 - DNA, 22 bp, Homo sapiens
aatgtctttctgttctatgaga

SEQ ID NO: 8789434 - DNA, 22 bp, Homo sapiens
aatgtctttaaagtgcaataga

SEQ ID NO: 8789435 - DNA, 22 bp, Homo sapiens
aatgtctttaaagtgcaataga

SEQ ID NO: 8789436 - DNA, 22 bp, Homo sapiens
aatgtcttgagaagagaaatct

SEQ ID NO: 8789437 - DNA, 20 bp, Homo sapiens
aatgtcttgagacatttcag

SEQ ID NO: 8789438 - DNA, 22 bp, Homo sapiens
aatgtctttaaagtgcaataga

SEQ ID NO: 8789439 - DNA, 22 bp, Homo sapiens
aatgttacgatcaacaacacat

SEQ ID NO: 8789440 - DNA, 22 bp, Homo sapiens
aatgttacgatcaacaacacat

SEQ ID NO: 8789441 - DNA, 22 bp, Homo sapiens
aatgttacgatcaacaacacat

SEQ ID NO: 8789442 - DNA, 22 bp, Homo sapiens
aatgttacgatcaacaacacat

SEQ ID NO: 8789443 - DNA, 22 bp, Homo sapiens
aatgttacgatcaacaacacat

SEQ ID NO: 8789444 - DNA, 22 bp, Homo sapiens
aatgttacataacccattgtcc

SEQ ID NO: 8789445 - DNA, 22 bp, Homo sapiens
aatgttaagtttagattataac

SEQ ID NO: 8789446 - DNA, 22 bp, Homo sapiens
aatgttaatgtgtttgcttatg

SEQ ID NO: 8789447 - DNA, 22 bp, Homo sapiens
aatgttaattcacagccaaata

SEQ ID NO: 8789448 - DNA, 22 bp, Homo sapiens
aatgtgttttcactgaagattc

SEQ ID NO: 8789449 - DNA, 22 bp, Homo sapiens
aatgtgttttcactgaagattc

SEQ ID NO: 8789450 - DNA, 22 bp, Homo sapiens
aatgtgttttatgagagaatat

SEQ ID NO: 8789451 - DNA, 22 bp, Homo sapiens
aatgtgaaaccgcacagaataa

SEQ ID NO: 8789452 - DNA, 22 bp, Homo sapiens
aatgtgaactttgtcatgtaac

SEQ ID NO: 8789453 - DNA, 22 bp, Homo sapiens
aatgtcttttgatacaagttac

SEQ ID NO: 8789454 - DNA, 22 bp, Homo sapiens
aatgtcttttcccttactttcc

SEQ ID NO: 8789455 - DNA, 22 bp, Homo sapiens
aatgtcttttcccttactttcc

SEQ ID NO: 8789456 - DNA, 22 bp, Homo sapiens
aatgtcttttcccttactttcc

SEQ ID NO: 8789457 - DNA, 21 bp, Homo sapiens
aatgtctttgtccatgctctg

SEQ ID NO: 8789458 - DNA, 22 bp, Homo sapiens
aatgtcttttaacctctggact

SEQ ID NO: 8789459 - DNA, 22 bp, Homo sapiens
aatgtctttcttggttctggtt

SEQ ID NO: 8789460 - DNA, 22 bp, Homo sapiens
aatgtcttttaaatgttgaggt

SEQ ID NO: 8789461 - DNA, 21 bp, Homo sapiens
aactttagaaagactgggaag

SEQ ID NO: 8789462 - DNA, 20 bp, Homo sapiens
aactttagacataatctctt

SEQ ID NO: 8789463 - DNA, 22 bp, Homo sapiens
aatgttattacacttgtgaaat

SEQ ID NO: 8789464 - DNA, 22 bp, Homo sapiens
aactttagctatttaatctgat

SEQ ID NO: 8789465 - DNA, 22 bp, Homo sapiens
aactttagctatttaatctgat

SEQ ID NO: 8789466 - DNA, 22 bp, Homo sapiens
aactttcaggcaatgaatattt

SEQ ID NO: 8789467 - DNA, 22 bp, Homo sapiens
aactttctagagatgagttcgg

SEQ ID NO: 8789468 - DNA, 22 bp, Homo sapiens
aactttcagcaagtaattctgg

SEQ ID NO: 8789469 - DNA, 22 bp, Homo sapiens
aactttcagcaagtaattctgg

SEQ ID NO: 8789470 - DNA, 22 bp, Homo sapiens
aactttcagaatcctatgcatt

SEQ ID NO: 8789471 - DNA, 22 bp, Homo sapiens
aatgttttgtatgcctctgagc

SEQ ID NO: 8789472 - DNA, 22 bp, Homo sapiens
aatgttttgcattagttttcta

SEQ ID NO: 8789473 - DNA, 22 bp, Homo sapiens
aactttctggctttggggagag

SEQ ID NO: 8789474 - DNA, 22 bp, Homo sapiens
aattactgggtctgagattaat

SEQ ID NO: 8789475 - DNA, 22 bp, Homo sapiens
aattactgtaattttctacagc

SEQ ID NO: 8789476 - DNA, 22 bp, Homo sapiens
aattacttaagagaaactttga

SEQ ID NO: 8789477 - DNA, 22 bp, Homo sapiens
aattagaaccagaagccatatt

SEQ ID NO: 8789478 - DNA, 21 bp, Homo sapiens
agcattcttggccagtccacc

SEQ ID NO: 8789479 - DNA, 21 bp, Homo sapiens
agcattcttggccagtccacc

SEQ ID NO: 8789480 - DNA, 21 bp, Homo sapiens
agcattctgcttctttcctgg

SEQ ID NO: 8789481 - DNA, 20 bp, Homo sapiens
agcattctactagacttttc

SEQ ID NO: 8789482 - DNA, 22 bp, Homo sapiens
agcattctcagaatgtcatttt

SEQ ID NO: 8789483 - DNA, 22 bp, Homo sapiens
agcattccagtgcacagtagaa

SEQ ID NO: 8789484 - DNA, 22 bp, Homo sapiens
agcattccacactgaagtctgc

SEQ ID NO: 8789485 - DNA, 22 bp, Homo sapiens
agcattccacactgaagtctgc

SEQ ID NO: 8789486 - DNA, 22 bp, Homo sapiens
agcattccacactgaagtctgc

SEQ ID NO: 8789487 - DNA, 22 bp, Homo sapiens
agcattccacactgaagtctgc

SEQ ID NO: 8789488 - DNA, 22 bp, Homo sapiens
agcattccacactgaagtctgc

SEQ ID NO: 8789489 - DNA, 22 bp, Homo sapiens
agcattcatgatgacaacagga

SEQ ID NO: 8789490 - DNA, 22 bp, Homo sapiens
agcattcatgatgacaacagga

SEQ ID NO: 8789491 - DNA, 22 bp, Homo sapiens
agcattcattgctagaatgtaa

SEQ ID NO: 8789492 - DNA, 22 bp, Homo sapiens
agcattcattgctagaatgtaa

SEQ ID NO: 8789493 - DNA, 22 bp, Homo sapiens
agcatgaaaacatgaaacagca

SEQ ID NO: 8789494 - DNA, 22 bp, Homo sapiens
agcatctttaggaagagaaaga

SEQ ID NO: 8789495 - DNA, 22 bp, Homo sapiens
agcatgaaaacatgaaacagca

SEQ ID NO: 8789496 - DNA, 22 bp, Homo sapiens
agcatctttaggaagagaaaga

SEQ ID NO: 8789497 - DNA, 20 bp, Homo sapiens
agcatcttgcatcttcaagt

SEQ ID NO: 8789498 - DNA, 20 bp, Homo sapiens
agcatcttgcatcttcaagt

SEQ ID NO: 8789499 - DNA, 22 bp, Homo sapiens
agcatctgttgaatataatatt

SEQ ID NO: 8789500 - DNA, 22 bp, Homo sapiens
agcatcttcaacaggcatttta

SEQ ID NO: 8789501 - DNA, 22 bp, Homo sapiens
agcatcttgaaatataaagtca

SEQ ID NO: 8789502 - DNA, 22 bp, Homo sapiens
agcatctgttaagtgccttcaa

SEQ ID NO: 8789503 - DNA, 22 bp, Homo sapiens
agcatctggtgagggcctagtt

SEQ ID NO: 8789504 - DNA, 22 bp, Homo sapiens
agcatctggtcatgagtgagaa

SEQ ID NO: 8789505 - DNA, 22 bp, Homo sapiens
agcatctgtgatattttgttat

SEQ ID NO: 8789506 - DNA, 22 bp, Homo sapiens
agcatctgcttaatggcttaac

SEQ ID NO: 8789507 - DNA, 22 bp, Homo sapiens
agcatctggatggaaagcaagg

SEQ ID NO: 8789508 - DNA, 22 bp, Homo sapiens
agcatctgcttaatggcttaac

SEQ ID NO: 8789509 - DNA, 23 bp, Homo sapiens
agcatctggcttcccctggatgg

SEQ ID NO: 8789510 - DNA, 22 bp, Homo sapiens
agcatctggcctggttactttt

SEQ ID NO: 8789511 - DNA, 22 bp, Homo sapiens
agcatctggcagaaagtcagaa

SEQ ID NO: 8789512 - DNA, 22 bp, Homo sapiens
agcatctctaaatccagtaagt

SEQ ID NO: 8789513 - DNA, 21 bp, Homo sapiens
agcatctgaggcagtttccta

SEQ ID NO: 8789514 - DNA, 22 bp, Homo sapiens
agcatctgcataatgccttccc

SEQ ID NO: 8789515 - DNA, 22 bp, Homo sapiens
agcatctaaactatcagtttga

SEQ ID NO: 8789516 - DNA, 19 bp, Homo sapiens
agcatctccctgatcattc

SEQ ID NO: 8789517 - DNA, 22 bp, Homo sapiens
agcatcctccttcccagagatg

SEQ ID NO: 8789518 - DNA, 22 bp, Homo sapiens
agcatttaagcttctgcaaagc

SEQ ID NO: 8789519 - DNA, 22 bp, Homo sapiens
agcatttaatcctacatagatc

SEQ ID NO: 8789520 - DNA, 22 bp, Homo sapiens
agcatttaatcctacatagatc

SEQ ID NO: 8789521 - DNA, 22 bp, Homo sapiens
agcatttaatcctacatagatc

SEQ ID NO: 8789522 - DNA, 22 bp, Homo sapiens
agcatttaagggtggatacagg

SEQ ID NO: 8789523 - DNA, 22 bp, Homo sapiens
agcatttaagcttctgcaaagc

SEQ ID NO: 8789524 - DNA, 22 bp, Homo sapiens
agccaggcgcagtggcttatgc

SEQ ID NO: 8789525 - DNA, 22 bp, Homo sapiens
agccaggcggggcaggtttcct

SEQ ID NO: 8789526 - DNA, 22 bp, Homo sapiens
agccaggcggggcaggtttcct

SEQ ID NO: 8789527 - DNA, 22 bp, Homo sapiens
agccaggacagggcagctcgct

SEQ ID NO: 8789528 - DNA, 22 bp, Homo sapiens
agccaggacagggcagctcgct

SEQ ID NO: 8789529 - DNA, 22 bp, Homo sapiens
agccaggacagggcagctcgct

SEQ ID NO: 8789530 - DNA, 22 bp, Homo sapiens
agccaggctaaatgagccatga

SEQ ID NO: 8789531 - DNA, 22 bp, Homo sapiens
agccaggctaaatgagccatga

SEQ ID NO: 8789532 - DNA, 22 bp, Homo sapiens
agccaggctaaatgagccatga

SEQ ID NO: 8789533 - DNA, 22 bp, Homo sapiens
agccaggcgggtctttgctcct

SEQ ID NO: 8789534 - DNA, 22 bp, Homo sapiens
agccaggctactccttgctgac

SEQ ID NO: 8789535 - DNA, 20 bp, Homo sapiens
agccaggctcaagctccccc

SEQ ID NO: 8789536 - DNA, 22 bp, Homo sapiens
acagaacagagggttttagaat

SEQ ID NO: 8789537 - DNA, 22 bp, Homo sapiens
agcccaggtgactcatacaccc

SEQ ID NO: 8789538 - DNA, 22 bp, Homo sapiens
agcccaggtgaggggttcgaaa

SEQ ID NO: 8789539 - DNA, 22 bp, Homo sapiens
agcccaggtgaggggttcgaaa

SEQ ID NO: 8789540 - DNA, 22 bp, Homo sapiens
agcccaggtggagtgtgtgggg

SEQ ID NO: 8789541 - DNA, 22 bp, Homo sapiens
agcccaggtctggcccagcctg

SEQ ID NO: 8789542 - DNA, 22 bp, Homo sapiens
agcccaggtctggcccagcctg

SEQ ID NO: 8789543 - DNA, 21 bp, Homo sapiens
acagacagtccagagaaaaga

SEQ ID NO: 8789544 - DNA, 21 bp, Homo sapiens
acagacagtccagagaaaaga

SEQ ID NO: 8789545 - DNA, 21 bp, Homo sapiens
acagacagtccagagaaaaga

SEQ ID NO: 8789546 - DNA, 21 bp, Homo sapiens
acagacagtccagagaaaaga

SEQ ID NO: 8789547 - DNA, 21 bp, Homo sapiens
acagacagtccagagaaaaga

SEQ ID NO: 8789548 - DNA, 22 bp, Homo sapiens
acagacatatttggcccatagc

SEQ ID NO: 8789549 - DNA, 22 bp, Homo sapiens
acagacatcatcaacatcttcc

SEQ ID NO: 8789550 - DNA, 22 bp, Homo sapiens
acagacatcatcaacatcttcc

SEQ ID NO: 8789551 - DNA, 22 bp, Homo sapiens
acagacatctatccatttaatt

SEQ ID NO: 8789552 - DNA, 16 bp, Homo sapiens
acagacatgagtgagc

SEQ ID NO: 8789553 - DNA, 22 bp, Homo sapiens
acagacagtaaatagtgtggct

SEQ ID NO: 8789554 - DNA, 21 bp, Homo sapiens
acagacagggccagtgtcccc

SEQ ID NO: 8789555 - DNA, 22 bp, Homo sapiens
acagaactgcaggaggaaaagc

SEQ ID NO: 8789556 - DNA, 22 bp, Homo sapiens
acagaactgcaggaggaaaagc

SEQ ID NO: 8789557 - DNA, 22 bp, Homo sapiens
acagaactgcagacagtgccaa

SEQ ID NO: 8789558 - DNA, 22 bp, Homo sapiens
acagaactgagaattctctatc

SEQ ID NO: 8789559 - DNA, 22 bp, Homo sapiens
acagaacatggatttttgaagt

SEQ ID NO: 8789560 - DNA, 22 bp, Homo sapiens
acagaacaggctgagaaaaaca

SEQ ID NO: 8789561 - DNA, 22 bp, Homo sapiens
acagaacaggctgagaaaaaca

SEQ ID NO: 8789562 - DNA, 22 bp, Homo sapiens
acagaacaggctgagaaaaaca

SEQ ID NO: 8789563 - DNA, 22 bp, Homo sapiens
acagaacaggctgagaaaaaca

SEQ ID NO: 8789564 - DNA, 22 bp, Homo sapiens
acagaacatattgcttctctca

SEQ ID NO: 8789565 - DNA, 22 bp, Homo sapiens
acagaacatattgcttctctca

SEQ ID NO: 8789566 - DNA, 22 bp, Homo sapiens
agcccagggctaataggaacca

SEQ ID NO: 8789567 - DNA, 22 bp, Homo sapiens
agcccaggtccagttcactgca

SEQ ID NO: 8789568 - DNA, 22 bp, Homo sapiens
acagaacttcagtagtattccc

SEQ ID NO: 8789569 - DNA, 22 bp, Homo sapiens
agcccagctttcacccctctgg

SEQ ID NO: 8789570 - DNA, 22 bp, Homo sapiens
agcccagctttcacccctctgg

SEQ ID NO: 8789571 - DNA, 22 bp, Homo sapiens
acagaacttcagtagtattccc

SEQ ID NO: 8789572 - DNA, 22 bp, Homo sapiens
acagaactgtgatctcataaat

SEQ ID NO: 8789573 - DNA, 22 bp, Homo sapiens
acagaactgggggcacagatag

SEQ ID NO: 8789574 - DNA, 22 bp, Homo sapiens
acagaactgggaaatgcacata

SEQ ID NO: 8789575 - DNA, 22 bp, Homo sapiens
acagaactgggaaatgcacata

SEQ ID NO: 8789576 - DNA, 22 bp, Homo sapiens
agctccaaggttgaggagtgag

SEQ ID NO: 8789577 - DNA, 22 bp, Homo sapiens
agctccactaaacagaatactc

SEQ ID NO: 8789578 - DNA, 22 bp, Homo sapiens
agctccaggtagtgccttatcg

SEQ ID NO: 8789579 - DNA, 22 bp, Homo sapiens
agctcaggtcattccagggatg

SEQ ID NO: 8789580 - DNA, 22 bp, Homo sapiens
agctcaggtcattccagggatg

SEQ ID NO: 8789581 - DNA, 22 bp, Homo sapiens
agctcaggtctcaggaggtgtc

SEQ ID NO: 8789582 - DNA, 22 bp, Homo sapiens
agctcattgaagtcatgacctg

SEQ ID NO: 8789583 - DNA, 22 bp, Homo sapiens
agctcagggccatcggcccttt

SEQ ID NO: 8789584 - DNA, 22 bp, Homo sapiens
agctcagggcgatctgtctcgg

SEQ ID NO: 8789585 - DNA, 22 bp, Homo sapiens
agctcagggcaaagactcaaat

SEQ ID NO: 8789586 - DNA, 22 bp, Homo sapiens
agctcaggctctgcagggacta

SEQ ID NO: 8789587 - DNA, 22 bp, Homo sapiens
agctcaggctctgcagggacta

SEQ ID NO: 8789588 - DNA, 22 bp, Homo sapiens
agctcaggctctgcagggacta

SEQ ID NO: 8789589 - DNA, 22 bp, Homo sapiens
agctcaagctacacacagagtc

SEQ ID NO: 8789590 - DNA, 22 bp, Homo sapiens
agccttagatttgggcaagaac

SEQ ID NO: 8789591 - DNA, 22 bp, Homo sapiens
agccttagataaatgctagctc

SEQ ID NO: 8789592 - DNA, 23 bp, Homo sapiens
agctcaaggcagtccacatttcc

SEQ ID NO: 8789593 - DNA, 22 bp, Homo sapiens
agctcaagtgcaagcattctat

SEQ ID NO: 8789594 - DNA, 22 bp, Homo sapiens
agctcaggccggagctacaggc

SEQ ID NO: 8789595 - DNA, 22 bp, Homo sapiens
agctcaggccggagctacaggc

SEQ ID NO: 8789596 - DNA, 22 bp, Homo sapiens
agcctgtctgtctccaaagctg

SEQ ID NO: 8789597 - DNA, 22 bp, Homo sapiens
agcctgtctgtctccaaagctg

SEQ ID NO: 8789598 - DNA, 22 bp, Homo sapiens
agcctggcttaatcctcctttt

SEQ ID NO: 8789599 - DNA, 22 bp, Homo sapiens
agcctggcttaatcctcctttt

SEQ ID NO: 8789600 - DNA, 22 bp, Homo sapiens
agcctgtgagggatgctgcagt

SEQ ID NO: 8789601 - DNA, 22 bp, Homo sapiens
agcctgtgactctgtgaaacca

SEQ ID NO: 8789602 - DNA, 22 bp, Homo sapiens
agcctgtgactctgtgaaacca

SEQ ID NO: 8789603 - DNA, 22 bp, Homo sapiens
agcctggctgtaacctcatggt

SEQ ID NO: 8789604 - DNA, 22 bp, Homo sapiens
agcctggctgggaagagcctct

SEQ ID NO: 8789605 - DNA, 22 bp, Homo sapiens
agcctggctgggaagagcctct

SEQ ID NO: 8789606 - DNA, 22 bp, Homo sapiens
agcctggctgtaacctcatggt

SEQ ID NO: 8789607 - DNA, 22 bp, Homo sapiens
agcctggctgtaacctcatggt

SEQ ID NO: 8789608 - DNA, 22 bp, Homo sapiens
agcctggctaaattctcccatg

SEQ ID NO: 8789609 - DNA, 22 bp, Homo sapiens
agcctggctaaattctcccatg

SEQ ID NO: 8789610 - DNA, 22 bp, Homo sapiens
agcctggcggtcgtcggtcagg

SEQ ID NO: 8789611 - DNA, 22 bp, Homo sapiens
agcctggctaaattctcccatg

SEQ ID NO: 8789612 - DNA, 22 bp, Homo sapiens
agcctggctaaattctcccatg

SEQ ID NO: 8789613 - DNA, 22 bp, Homo sapiens
agcctggctgggaagagcctct

SEQ ID NO: 8789614 - DNA, 22 bp, Homo sapiens
agcctggctaaattctcccatg

SEQ ID NO: 8789615 - DNA, 22 bp, Homo sapiens
agcctgtgtgctttggacaggg

SEQ ID NO: 8789616 - DNA, 22 bp, Homo sapiens
agcctgtgttgctctggcgata

SEQ ID NO: 8789617 - DNA, 22 bp, Homo sapiens
agcctgtgttgctctggcgata

SEQ ID NO: 8789618 - DNA, 22 bp, Homo sapiens
agcctgtgttttttctattgca

SEQ ID NO: 8789619 - DNA, 21 bp, Homo sapiens
agcctgttggtttactgctca

SEQ ID NO: 8789620 - DNA, 22 bp, Homo sapiens
agccttaaatgctagattcata

SEQ ID NO: 8789621 - DNA, 22 bp, Homo sapiens
agccttagaggaaaacattagt

SEQ ID NO: 8789622 - DNA, 22 bp, Homo sapiens
agccttagataaatgctagctc

SEQ ID NO: 8789623 - DNA, 22 bp, Homo sapiens
agccttagagacttaaaacagg

SEQ ID NO: 8789624 - DNA, 22 bp, Homo sapiens
agccttacataaacagccttat

SEQ ID NO: 8789625 - DNA, 22 bp, Homo sapiens
agcctgtggaaactgggtgcag

SEQ ID NO: 8789626 - DNA, 22 bp, Homo sapiens
agcctgtggaaactgggtgcag

SEQ ID NO: 8789627 - DNA, 22 bp, Homo sapiens
agcctgtggatccctgcactgg

SEQ ID NO: 8789628 - DNA, 20 bp, Homo sapiens
agcctgtgtacttgcctgtg

SEQ ID NO: 8789629 - DNA, 22 bp, Homo sapiens
agccctgcaggaggtgggagag

SEQ ID NO: 8789630 - DNA, 22 bp, Homo sapiens
agccctgcaggaggtgggagag

SEQ ID NO: 8789631 - DNA, 22 bp, Homo sapiens
agccctgcaggaggtgggagag

SEQ ID NO: 8789632 - DNA, 22 bp, Homo sapiens
agccctgcacagttcgggagga

SEQ ID NO: 8789633 - DNA, 22 bp, Homo sapiens
agccctgcaggatgagggaggt

SEQ ID NO: 8789634 - DNA, 22 bp, Homo sapiens
agccctgcaggatgagggaggt

SEQ ID NO: 8789635 - DNA, 22 bp, Homo sapiens
agccctgcataaatcagttggt

SEQ ID NO: 8789636 - DNA, 22 bp, Homo sapiens
agccctgcacaggtctgtggct

SEQ ID NO: 8789637 - DNA, 22 bp, Homo sapiens
agccctgcacaggtctgtggct

SEQ ID NO: 8789638 - DNA, 22 bp, Homo sapiens
agcccctgtcctctctgatgac

SEQ ID NO: 8789639 - DNA, 22 bp, Homo sapiens
acagacatggaccaagcactgt

SEQ ID NO: 8789640 - DNA, 22 bp, Homo sapiens
acagacatggaccaagcactgt

SEQ ID NO: 8789641 - DNA, 22 bp, Homo sapiens
acagacatgctgtttgggtggt

SEQ ID NO: 8789642 - DNA, 22 bp, Homo sapiens
acagacatgggccgctcttgag

SEQ ID NO: 8789643 - DNA, 22 bp, Homo sapiens
agccctgcgctcacgttctgca

SEQ ID NO: 8789644 - DNA, 22 bp, Homo sapiens
agccctgcgatcgtgatttctt

SEQ ID NO: 8789645 - DNA, 22 bp, Homo sapiens
agccctggggctggtcttggaa

SEQ ID NO: 8789646 - DNA, 22 bp, Homo sapiens
agccctggggctggtcttggaa

SEQ ID NO: 8789647 - DNA, 22 bp, Homo sapiens
agccctggggctggtcttggaa

SEQ ID NO: 8789648 - DNA, 22 bp, Homo sapiens
agccctggggctggtcttggaa

SEQ ID NO: 8789649 - DNA, 22 bp, Homo sapiens
agccctgccctgccatgtggca

SEQ ID NO: 8789650 - DNA, 22 bp, Homo sapiens
agccctgccctgccatgtggca

SEQ ID NO: 8789651 - DNA, 22 bp, Homo sapiens
agccctgccattctctggagct

SEQ ID NO: 8789652 - DNA, 22 bp, Homo sapiens
agccctgccattctctggagct

SEQ ID NO: 8789653 - DNA, 22 bp, Homo sapiens
agccctgccctgccatgtggca

SEQ ID NO: 8789654 - DNA, 22 bp, Homo sapiens
agcctggcctgggcaggcacat

SEQ ID NO: 8789655 - DNA, 22 bp, Homo sapiens
agcctggcctgggcaggcacat

SEQ ID NO: 8789656 - DNA, 22 bp, Homo sapiens
agcctggcctgggcaggcacat

SEQ ID NO: 8789657 - DNA, 22 bp, Homo sapiens
agcctggcggtcgtcggtcagg

SEQ ID NO: 8789658 - DNA, 21 bp, Homo sapiens
agcctggcccagggggaggct

SEQ ID NO: 8789659 - DNA, 22 bp, Homo sapiens
agcctggccctgctgaactctg

SEQ ID NO: 8789660 - DNA, 21 bp, Homo sapiens
agcctggcccagggggaggct

SEQ ID NO: 8789661 - DNA, 21 bp, Homo sapiens
agcctggcccagggggaggct

SEQ ID NO: 8789662 - DNA, 21 bp, Homo sapiens
agcctggcccagggggaggct

SEQ ID NO: 8789663 - DNA, 22 bp, Homo sapiens
agcctgctgggaagggaggctt

SEQ ID NO: 8789664 - DNA, 22 bp, Homo sapiens
agcctgctggaccaagctcatg

SEQ ID NO: 8789665 - DNA, 22 bp, Homo sapiens
agcctgcttccctttgtgcccc

SEQ ID NO: 8789666 - DNA, 22 bp, Homo sapiens
agcctggccaggcctgcccagg

SEQ ID NO: 8789667 - DNA, 22 bp, Homo sapiens
agcctggccaggcctgcccagg

SEQ ID NO: 8789668 - DNA, 22 bp, Homo sapiens
agcctggccactcagggcctga

SEQ ID NO: 8789669 - DNA, 22 bp, Homo sapiens
agcctggccactcagggcctga

SEQ ID NO: 8789670 - DNA, 22 bp, Homo sapiens
agcctggccaggcctgcccagg

SEQ ID NO: 8789671 - DNA, 22 bp, Homo sapiens
agcctggccaggcctgcccagg

SEQ ID NO: 8789672 - DNA, 22 bp, Homo sapiens
agccctgggtcccagtcctggc

SEQ ID NO: 8789673 - DNA, 22 bp, Homo sapiens
agccctggggctggtgcttacc

SEQ ID NO: 8789674 - DNA, 22 bp, Homo sapiens
agccctggggctggtgcttacc

SEQ ID NO: 8789675 - DNA, 22 bp, Homo sapiens
agccctggggtgcagaaccatg

SEQ ID NO: 8789676 - DNA, 22 bp, Homo sapiens
agccctggggtgcagaaccatg

SEQ ID NO: 8789677 - DNA, 22 bp, Homo sapiens
agccctggggtgcagaaccatg

SEQ ID NO: 8789678 - DNA, 22 bp, Homo sapiens
agccctggggctggtgcttacc

SEQ ID NO: 8789679 - DNA, 22 bp, Homo sapiens
agccctgggttagggtgggagc

SEQ ID NO: 8789680 - DNA, 22 bp, Homo sapiens
agccctgggttagggtgggagc

SEQ ID NO: 8789681 - DNA, 22 bp, Homo sapiens
agccctgggtcccagtcctggc

SEQ ID NO: 8789682 - DNA, 22 bp, Homo sapiens
agccctgggttagggtgggagc

SEQ ID NO: 8789683 - DNA, 22 bp, Homo sapiens
agccctgggtcccagtcctggc

SEQ ID NO: 8789684 - DNA, 22 bp, Homo sapiens
agccctgggtcccagtcctggc

SEQ ID NO: 8789685 - DNA, 22 bp, Homo sapiens
agccctgggtcccagtcctggc

SEQ ID NO: 8789686 - DNA, 22 bp, Homo sapiens
agccctggtttgcagcatttgc

SEQ ID NO: 8789687 - DNA, 22 bp, Homo sapiens
agccctggtagcctgctgccat

SEQ ID NO: 8789688 - DNA, 22 bp, Homo sapiens
agccctggtagcctgctgccat

SEQ ID NO: 8789689 - DNA, 22 bp, Homo sapiens
agccctggtagcctgctgccat

SEQ ID NO: 8789690 - DNA, 22 bp, Homo sapiens
agccctggtagcctgctgccat

SEQ ID NO: 8789691 - DNA, 22 bp, Homo sapiens
agccctggtagcctgctgccat

SEQ ID NO: 8789692 - DNA, 22 bp, Homo sapiens
agccctgggttagggtgggagc

SEQ ID NO: 8789693 - DNA, 22 bp, Homo sapiens
agccctggtagcctgctgccat

SEQ ID NO: 8789694 - DNA, 22 bp, Homo sapiens
acacactgctcgctcagattaa

SEQ ID NO: 8789695 - DNA, 22 bp, Homo sapiens
acacactggaggtaaatggggt

SEQ ID NO: 8789696 - DNA, 22 bp, Homo sapiens
acacactggaggtaaatggggt

SEQ ID NO: 8789697 - DNA, 17 bp, Homo sapiens
agcacttgaaaatttct

SEQ ID NO: 8789698 - DNA, 22 bp, Homo sapiens
agcacttcattagtaggtagtc

SEQ ID NO: 8789699 - DNA, 22 bp, Homo sapiens
acacactgagtgccataggacc

SEQ ID NO: 8789700 - DNA, 21 bp, Homo sapiens
acacactgagttttccactgt

SEQ ID NO: 8789701 - DNA, 22 bp, Homo sapiens
acacactgaattttgtggaaac

SEQ ID NO: 8789702 - DNA, 22 bp, Homo sapiens
acacactcaattgcataagcac

SEQ ID NO: 8789703 - DNA, 21 bp, Homo sapiens
acacactctgagtcttctatt

SEQ ID NO: 8789704 - DNA, 21 bp, Homo sapiens
acacactctgagtcttctatt

SEQ ID NO: 8789705 - DNA, 22 bp, Homo sapiens
acacactcaattgcataagcac

SEQ ID NO: 8789706 - DNA, 19 bp, Homo sapiens
acacaccagtgcctgtgac

SEQ ID NO: 8789707 - DNA, 22 bp, Homo sapiens
agcactttaagcaacagatcaa

SEQ ID NO: 8789708 - DNA, 23 bp, Homo sapiens
agcacttgtatcttactaaaatg

SEQ ID NO: 8789709 - DNA, 22 bp, Homo sapiens
agcacttgtagactagaatttt

SEQ ID NO: 8789710 - DNA, 22 bp, Homo sapiens
agcactttgggagataaagctg

SEQ ID NO: 8789711 - DNA, 22 bp, Homo sapiens
agcactttgagcagatgaagga

SEQ ID NO: 8789712 - DNA, 22 bp, Homo sapiens
agcactttgtgcatttctgaag

SEQ ID NO: 8789713 - DNA, 22 bp, Homo sapiens
agcagaaaactttcatgctctg

SEQ ID NO: 8789714 - DNA, 22 bp, Homo sapiens
agcagaaacagccagtctggac

SEQ ID NO: 8789715 - DNA, 22 bp, Homo sapiens
agcagaaacagccagtctggac

SEQ ID NO: 8789716 - DNA, 22 bp, Homo sapiens
agcagaaagcttattttgactg

SEQ ID NO: 8789717 - DNA, 22 bp, Homo sapiens
agcagaaagcttattttgactg

SEQ ID NO: 8789718 - DNA, 22 bp, Homo sapiens
agcagaaagcttattttgactg

SEQ ID NO: 8789719 - DNA, 22 bp, Homo sapiens
agcagaaatagaagtcaatgat

SEQ ID NO: 8789720 - DNA, 22 bp, Homo sapiens
agcagaaatgatggtatgggac

SEQ ID NO: 8789721 - DNA, 22 bp, Homo sapiens
agcagaaaattggaaatgacaa

SEQ ID NO: 8789722 - DNA, 22 bp, Homo sapiens
agcagaaaattggaaatgacaa

SEQ ID NO: 8789723 - DNA, 22 bp, Homo sapiens
agcagaaaattggaaatgacaa

SEQ ID NO: 8789724 - DNA, 22 bp, Homo sapiens
agcagaaaactttcatgctctg

SEQ ID NO: 8789725 - DNA, 22 bp, Homo sapiens
agatttgttgtgagcaggaata

SEQ ID NO: 8789726 - DNA, 22 bp, Homo sapiens
acacacatggtattgttcagaa

SEQ ID NO: 8789727 - DNA, 22 bp, Homo sapiens
acacacagaaggaagccccact

SEQ ID NO: 8789728 - DNA, 22 bp, Homo sapiens
acacacatgcctttcctaagta

SEQ ID NO: 8789729 - DNA, 22 bp, Homo sapiens
acacacatgcctttcctaagta

SEQ ID NO: 8789730 - DNA, 22 bp, Homo sapiens
agatttcctcttttgtaaagtg

SEQ ID NO: 8789731 - DNA, 22 bp, Homo sapiens
agatttgcggctttactttgca

SEQ ID NO: 8789732 - DNA, 22 bp, Homo sapiens
agatttgcggctttactttgca

SEQ ID NO: 8789733 - DNA, 22 bp, Homo sapiens
agatttgccatggatgttcttt

SEQ ID NO: 8789734 - DNA, 22 bp, Homo sapiens
agatttgataaaagtagcagtt

SEQ ID NO: 8789735 - DNA, 22 bp, Homo sapiens
agatttgaaacttgcttcataa

SEQ ID NO: 8789736 - DNA, 22 bp, Homo sapiens
agatttgtatagatgtggttga

SEQ ID NO: 8789737 - DNA, 22 bp, Homo sapiens
agatttgtatgtctaaatgtaa

SEQ ID NO: 8789738 - DNA, 16 bp, Homo sapiens
agcagccagcactgga

SEQ ID NO: 8789739 - DNA, 22 bp, Homo sapiens
agcagccagagtctgaacatta

SEQ ID NO: 8789740 - DNA, 22 bp, Homo sapiens
agcagccaggaatctgcagagc

SEQ ID NO: 8789741 - DNA, 22 bp, Homo sapiens
agcagccaggaatctgcagagc

SEQ ID NO: 8789742 - DNA, 22 bp, Homo sapiens
acacagaacctcatagcctctc

SEQ ID NO: 8789743 - DNA, 22 bp, Homo sapiens
acacacttttgctaaaaattgt

SEQ ID NO: 8789744 - DNA, 22 bp, Homo sapiens
acacacttttgctaaaaattgt

SEQ ID NO: 8789745 - DNA, 23 bp, Homo sapiens
acacagaagaagacccaaggaag

SEQ ID NO: 8789746 - DNA, 23 bp, Homo sapiens
acacagaagaagacccaaggaag

SEQ ID NO: 8789747 - DNA, 22 bp, Homo sapiens
acacagaacctcatagcctctc

SEQ ID NO: 8789748 - DNA, 23 bp, Homo sapiens
acacagaagaagacccaaggaag

SEQ ID NO: 8789749 - DNA, 22 bp, Homo sapiens
acacactggcccccagtactga

SEQ ID NO: 8789750 - DNA, 22 bp, Homo sapiens
acacactggcccccagtactga

SEQ ID NO: 8789751 - DNA, 22 bp, Homo sapiens
acacactggcccccagtactga

SEQ ID NO: 8789752 - DNA, 22 bp, Homo sapiens
acacactgggcatggtttatgc

SEQ ID NO: 8789753 - DNA, 22 bp, Homo sapiens
acacactggcaggagctataaa

SEQ ID NO: 8789754 - DNA, 22 bp, Homo sapiens
acacactggcaggagctataaa

SEQ ID NO: 8789755 - DNA, 22 bp, Homo sapiens
agcagcagctcattcttcctgt

SEQ ID NO: 8789756 - DNA, 20 bp, Homo sapiens
acacactttgatcttgagcc

SEQ ID NO: 8789757 - DNA, 22 bp, Homo sapiens
acacactttaaattaaacctct

SEQ ID NO: 8789758 - DNA, 22 bp, Homo sapiens
acacactttaaattaaacctct

SEQ ID NO: 8789759 - DNA, 22 bp, Homo sapiens
acacacttcagatgtaatttgt

SEQ ID NO: 8789760 - DNA, 22 bp, Homo sapiens
acacacttcagatgtaatttgt

SEQ ID NO: 8789761 - DNA, 22 bp, Homo sapiens
acacacttgcagagaggaggga

SEQ ID NO: 8789762 - DNA, 22 bp, Homo sapiens
acacactttaaattaaacctct

SEQ ID NO: 8789763 - DNA, 22 bp, Homo sapiens
acacacttgcagagaggaggga

SEQ ID NO: 8789764 - DNA, 22 bp, Homo sapiens
acacactgttgctcatccaggc

SEQ ID NO: 8789765 - DNA, 22 bp, Homo sapiens
acacacttcacccttgagctaa

SEQ ID NO: 8789766 - DNA, 22 bp, Homo sapiens
acacactgtaaggactatcact

SEQ ID NO: 8789767 - DNA, 22 bp, Homo sapiens
acacactgtaaggactatcact

SEQ ID NO: 8789768 - DNA, 22 bp, Homo sapiens
acacactgtaaggactatcact

SEQ ID NO: 8789769 - DNA, 22 bp, Homo sapiens
agcagcagccgtagccttatta

SEQ ID NO: 8789770 - DNA, 19 bp, Homo sapiens
agcagcagctaccacttgt

SEQ ID NO: 8789771 - DNA, 19 bp, Homo sapiens
agcagcagcaccagggatt

SEQ ID NO: 8789772 - DNA, 23 bp, Homo sapiens
agcagcagcaattaagtggatat

SEQ ID NO: 8789773 - DNA, 23 bp, Homo sapiens
agcagcagcaattaagtggatat

SEQ ID NO: 8789774 - DNA, 19 bp, Homo sapiens
agcagcagcaccagggatt

SEQ ID NO: 8789775 - DNA, 19 bp, Homo sapiens
agcagcagcaccagggatt

SEQ ID NO: 8789776 - DNA, 21 bp, Homo sapiens
agcagcagcagtggggcttct

SEQ ID NO: 8789777 - DNA, 19 bp, Homo sapiens
agcagcagcaccagggatt

SEQ ID NO: 8789778 - DNA, 22 bp, Homo sapiens
agcagcagattcagcaggaatg

SEQ ID NO: 8789779 - DNA, 22 bp, Homo sapiens
agcagcagattcagcaggaatg

SEQ ID NO: 8789780 - DNA, 22 bp, Homo sapiens
agcagcagattatggtctacat

SEQ ID NO: 8789781 - DNA, 22 bp, Homo sapiens
agcagcagattatggtctacat

SEQ ID NO: 8789782 - DNA, 22 bp, Homo sapiens
agcagcagattatggtctacat

SEQ ID NO: 8789783 - DNA, 19 bp, Homo sapiens
agcagcaactgttgattca

SEQ ID NO: 8789784 - DNA, 22 bp, Homo sapiens
agcagcagattatggtctacat

SEQ ID NO: 8789785 - DNA, 22 bp, Homo sapiens
agcagcaaagtattgggcaaga

SEQ ID NO: 8789786 - DNA, 21 bp, Homo sapiens
agcagcaaccacatagttttt

SEQ ID NO: 8789787 - DNA, 22 bp, Homo sapiens
agcagcaactgctagagtggca

SEQ ID NO: 8789788 - DNA, 22 bp, Homo sapiens
agcagaacattttcagggctgt

SEQ ID NO: 8789789 - DNA, 21 bp, Homo sapiens
agcagaacagtcgagcactgc

SEQ ID NO: 8789790 - DNA, 22 bp, Homo sapiens
agcaggagctgtgggaagatgg

SEQ ID NO: 8789791 - DNA, 22 bp, Homo sapiens
agcaggagctgtgggaagatgg

SEQ ID NO: 8789792 - DNA, 22 bp, Homo sapiens
agcaggaggagagcctggcggt

SEQ ID NO: 8789793 - DNA, 22 bp, Homo sapiens
agcaggaggagagcctggcggt

SEQ ID NO: 8789794 - DNA, 22 bp, Homo sapiens
agcaggaggagagcctggcggt

SEQ ID NO: 8789795 - DNA, 21 bp, Homo sapiens
agcaggaggcagtcacagctc

SEQ ID NO: 8789796 - DNA, 22 bp, Homo sapiens
agcaggaaagaaaaatctgtgt

SEQ ID NO: 8789797 - DNA, 22 bp, Homo sapiens
agcaggagcccttatcaccagg

SEQ ID NO: 8789798 - DNA, 22 bp, Homo sapiens
agcagctgagatggtaagattc

SEQ ID NO: 8789799 - DNA, 22 bp, Homo sapiens
agcagctgagatggtaagattc

SEQ ID NO: 8789800 - DNA, 22 bp, Homo sapiens
agcaggaaagaaaaatctgtgt

SEQ ID NO: 8789801 - DNA, 22 bp, Homo sapiens
agcagctgagccccagctgtga

SEQ ID NO: 8789802 - DNA, 22 bp, Homo sapiens
agcaggagggttttgtagagtc

SEQ ID NO: 8789803 - DNA, 22 bp, Homo sapiens
agcaggagggttttgtagagtc

SEQ ID NO: 8789804 - DNA, 22 bp, Homo sapiens
agcaggagggttttgtagagtc

SEQ ID NO: 8789805 - DNA, 22 bp, Homo sapiens
agcaggagggttttgtagagtc

SEQ ID NO: 8789806 - DNA, 21 bp, Homo sapiens
agcaggaggcagtcacagctc

SEQ ID NO: 8789807 - DNA, 22 bp, Homo sapiens
agcaggagtgtcccctggctgt

SEQ ID NO: 8789808 - DNA, 22 bp, Homo sapiens
agcaggagggttttgtagagtc

SEQ ID NO: 8789809 - DNA, 22 bp, Homo sapiens
agcaggagtgtcccctggctgt

SEQ ID NO: 8789810 - DNA, 22 bp, Homo sapiens
agcaggcaggctgccagtgaat

SEQ ID NO: 8789811 - DNA, 22 bp, Homo sapiens
agcaggcaggctgccagtgaat

SEQ ID NO: 8789812 - DNA, 22 bp, Homo sapiens
agcaggcaggctgccagtgaat

SEQ ID NO: 8789813 - DNA, 22 bp, Homo sapiens
agcaggcaggctgccagtgaat

SEQ ID NO: 8789814 - DNA, 19 bp, Homo sapiens
agcagccatagacaatatg

SEQ ID NO: 8789815 - DNA, 22 bp, Homo sapiens
agcagccagttctctgtggtag

SEQ ID NO: 8789816 - DNA, 22 bp, Homo sapiens
agcagccatccttagagaaaga

SEQ ID NO: 8789817 - DNA, 22 bp, Homo sapiens
agcagccatagatagcatgcaa

SEQ ID NO: 8789818 - DNA, 21 bp, Homo sapiens
agcagccatttcacagagact

SEQ ID NO: 8789819 - DNA, 22 bp, Homo sapiens
agcagcccaaacagactaagac

SEQ ID NO: 8789820 - DNA, 22 bp, Homo sapiens
agcagctcctgccatgagtgct

SEQ ID NO: 8789821 - DNA, 19 bp, Homo sapiens
agcagccatcgaccatgga

SEQ ID NO: 8789822 - DNA, 21 bp, Homo sapiens
agcagccatggatggtatgta

SEQ ID NO: 8789823 - DNA, 22 bp, Homo sapiens
agcagctctggcactgtagcat

SEQ ID NO: 8789824 - DNA, 22 bp, Homo sapiens
agcagctctggcactgtagcat

SEQ ID NO: 8789825 - DNA, 22 bp, Homo sapiens
agcagctcttaacaaagcatgg

SEQ ID NO: 8789826 - DNA, 22 bp, Homo sapiens
agcagctcttaacaaagcatgg

SEQ ID NO: 8789827 - DNA, 22 bp, Homo sapiens
agcagctctgtttacctggagg

SEQ ID NO: 8789828 - DNA, 22 bp, Homo sapiens
agcagctctgtttacctggagg

SEQ ID NO: 8789829 - DNA, 22 bp, Homo sapiens
agcagctcgggctacagagggg

SEQ ID NO: 8789830 - DNA, 22 bp, Homo sapiens
agcagctcggccagtcaccagg

SEQ ID NO: 8789831 - DNA, 22 bp, Homo sapiens
agcagctcctgccatgagtgct

SEQ ID NO: 8789832 - DNA, 22 bp, Homo sapiens
agcagctcctgtttttgggata

SEQ ID NO: 8789833 - DNA, 22 bp, Homo sapiens
agcagctcgggctacagagggg

SEQ ID NO: 8789834 - DNA, 22 bp, Homo sapiens
agcagctctgagaggccagcac

SEQ ID NO: 8789835 - DNA, 22 bp, Homo sapiens
agcagctcggccagtcaccagg

SEQ ID NO: 8789836 - DNA, 22 bp, Homo sapiens
agcagctcgggctacagagggg

SEQ ID NO: 8789837 - DNA, 22 bp, Homo sapiens
agcagctctgagaggccagcac

SEQ ID NO: 8789838 - DNA, 22 bp, Homo sapiens
agcagctctgagaggccagcac

SEQ ID NO: 8789839 - DNA, 22 bp, Homo sapiens
agcagctgaaaggcaaacttct

SEQ ID NO: 8789840 - DNA, 17 bp, Homo sapiens
agcagctgaagcagcca

SEQ ID NO: 8789841 - DNA, 22 bp, Homo sapiens
agcagctgaccagtgagtcctg

SEQ ID NO: 8789842 - DNA, 17 bp, Homo sapiens
agcagctgaagcagcca

SEQ ID NO: 8789843 - DNA, 22 bp, Homo sapiens
agcagctgaccagtgagtcctg

SEQ ID NO: 8789844 - DNA, 22 bp, Homo sapiens
agcagctgaccagtgagtcctg

SEQ ID NO: 8789845 - DNA, 19 bp, Homo sapiens
agcaggccacagggccagc

SEQ ID NO: 8789846 - DNA, 22 bp, Homo sapiens
agcaggccaaggaactttgtgg

SEQ ID NO: 8789847 - DNA, 22 bp, Homo sapiens
agcaggcatttgatatatattt

SEQ ID NO: 8789848 - DNA, 22 bp, Homo sapiens
agcaggccaaggaactttgtgg

SEQ ID NO: 8789849 - DNA, 22 bp, Homo sapiens
agcaggcatttgatatatattt

SEQ ID NO: 8789850 - DNA, 23 bp, Homo sapiens
agcaggcatctgtggcacaaggc

SEQ ID NO: 8789851 - DNA, 23 bp, Homo sapiens
agcaggcatctgtggcacaaggc

SEQ ID NO: 8789852 - DNA, 23 bp, Homo sapiens
agcaggcatctgtggcacaaggc

SEQ ID NO: 8789853 - DNA, 22 bp, Homo sapiens
agcaggcagtgtagagccttca

SEQ ID NO: 8789854 - DNA, 22 bp, Homo sapiens
agcaggcagtgtagagccttca

SEQ ID NO: 8789855 - DNA, 22 bp, Homo sapiens
agcaggcatagagtagcactca

SEQ ID NO: 8789856 - DNA, 19 bp, Homo sapiens
agcaggcaggtggcccagg

SEQ ID NO: 8789857 - DNA, 19 bp, Homo sapiens
agcaggcaggtggcccagg

SEQ ID NO: 8789858 - DNA, 19 bp, Homo sapiens
agcaggcaggtggcccagg

SEQ ID NO: 8789859 - DNA, 22 bp, Homo sapiens
agcagggctgtgtaggtaatga

SEQ ID NO: 8789860 - DNA, 22 bp, Homo sapiens
agcagggcctctggcactggtc

SEQ ID NO: 8789861 - DNA, 22 bp, Homo sapiens
agcagggctgtgctccttccga

SEQ ID NO: 8789862 - DNA, 22 bp, Homo sapiens
agcagggcttctgtgcctgtgc

SEQ ID NO: 8789863 - DNA, 22 bp, Homo sapiens
agcagggcttgccgcttgtcct

SEQ ID NO: 8789864 - DNA, 22 bp, Homo sapiens
agcagggcttgccgcttgtcct

SEQ ID NO: 8789865 - DNA, 22 bp, Homo sapiens
agcagggctttgcagacttggg

SEQ ID NO: 8789866 - DNA, 22 bp, Homo sapiens
agcagttatattgaaataaaaa

SEQ ID NO: 8789867 - DNA, 22 bp, Homo sapiens
agcagttatgtgtctcttgact

SEQ ID NO: 8789868 - DNA, 19 bp, Homo sapiens
agcagttatatgcatggga

SEQ ID NO: 8789869 - DNA, 22 bp, Homo sapiens
agcatcagtactaatctggcca

SEQ ID NO: 8789870 - DNA, 22 bp, Homo sapiens
agcatccagcatcctatagaaa

SEQ ID NO: 8789871 - DNA, 22 bp, Homo sapiens
agcaggtgacccaagcaggctg

SEQ ID NO: 8789872 - DNA, 22 bp, Homo sapiens
agcagggctttgtctctgtgaa

SEQ ID NO: 8789873 - DNA, 22 bp, Homo sapiens
agcagggctttgcagacttggg

SEQ ID NO: 8789874 - DNA, 22 bp, Homo sapiens
agcagggctttggctggctttc

SEQ ID NO: 8789875 - DNA, 22 bp, Homo sapiens
agcagggctttggctggctttc

SEQ ID NO: 8789876 - DNA, 22 bp, Homo sapiens
agcagggctttgtctctgtgaa

SEQ ID NO: 8789877 - DNA, 21 bp, Homo sapiens
agcaggtgaacctccagtaca

SEQ ID NO: 8789878 - DNA, 22 bp, Homo sapiens
agcaggtgaattcctggatgtg

SEQ ID NO: 8789879 - DNA, 22 bp, Homo sapiens
agatatacacccatatcacata

SEQ ID NO: 8789880 - DNA, 22 bp, Homo sapiens
agataatgtcaaattctgtctg

SEQ ID NO: 8789881 - DNA, 22 bp, Homo sapiens
agataatgtcaaattctgtctg

SEQ ID NO: 8789882 - DNA, 22 bp, Homo sapiens
agagtctgttacttgtccccta

SEQ ID NO: 8789883 - DNA, 22 bp, Homo sapiens
agagtcttatcttttacaagta

SEQ ID NO: 8789884 - DNA, 22 bp, Homo sapiens
agagtctgtgctttcatcagga

SEQ ID NO: 8789885 - DNA, 22 bp, Homo sapiens
agagtctgttacttgtccccta

SEQ ID NO: 8789886 - DNA, 22 bp, Homo sapiens
agagtcttctggggccactttc

SEQ ID NO: 8789887 - DNA, 22 bp, Homo sapiens
agagtcttccaggcagcctgag

SEQ ID NO: 8789888 - DNA, 22 bp, Homo sapiens
agagtcttggctgagaacaaga

SEQ ID NO: 8789889 - DNA, 22 bp, Homo sapiens
agagtgaaaagctagagcagta

SEQ ID NO: 8789890 - DNA, 22 bp, Homo sapiens
agagtgaaaagctagagcagta

SEQ ID NO: 8789891 - DNA, 22 bp, Homo sapiens
agagtcttttgtcagtaatgtt

SEQ ID NO: 8789892 - DNA, 22 bp, Homo sapiens
agagtctgtgctggggccagct

SEQ ID NO: 8789893 - DNA, 19 bp, Homo sapiens
agagtctgtgctcttccta

SEQ ID NO: 8789894 - DNA, 19 bp, Homo sapiens
agagtctgtgctcttccta

SEQ ID NO: 8789895 - DNA, 22 bp, Homo sapiens
agagtctgtgagtccctgagca

SEQ ID NO: 8789896 - DNA, 22 bp, Homo sapiens
agagtctgcctttttctcctgc

SEQ ID NO: 8789897 - DNA, 21 bp, Homo sapiens
agagtctgcatttctgacaag

SEQ ID NO: 8789898 - DNA, 22 bp, Homo sapiens
agagtctgcatttctacaagct

SEQ ID NO: 8789899 - DNA, 22 bp, Homo sapiens
agagtctgcattgtaacaagat

SEQ ID NO: 8789900 - DNA, 23 bp, Homo sapiens
agagtaatgtttttactgtattc

SEQ ID NO: 8789901 - DNA, 22 bp, Homo sapiens
agagtaatgaacacattccaca

SEQ ID NO: 8789902 - DNA, 22 bp, Homo sapiens
agagtaatttctgctgaaaagg

SEQ ID NO: 8789903 - DNA, 22 bp, Homo sapiens
agagtacactgtacacacaatt

SEQ ID NO: 8789904 - DNA, 22 bp, Homo sapiens
agagtactgcctcagttatgaa

SEQ ID NO: 8789905 - DNA, 22 bp, Homo sapiens
agagtaaagtacttggaatacc

SEQ ID NO: 8789906 - DNA, 22 bp, Homo sapiens
agaggttgggtctgaggtgaga

SEQ ID NO: 8789907 - DNA, 22 bp, Homo sapiens
agagtaacttttaactttacgt

SEQ ID NO: 8789908 - DNA, 22 bp, Homo sapiens
agagtaaataggagatgacagc

SEQ ID NO: 8789909 - DNA, 22 bp, Homo sapiens
agaggttgggtctgaggtgaga

SEQ ID NO: 8789910 - DNA, 22 bp, Homo sapiens
agaggttcaaacttcataattt

SEQ ID NO: 8789911 - DNA, 22 bp, Homo sapiens
agaggtggccatgggcgctgga

SEQ ID NO: 8789912 - DNA, 22 bp, Homo sapiens
agaggtggccatgggcgctgga

SEQ ID NO: 8789913 - DNA, 22 bp, Homo sapiens
agaggtggccatgggcgctgga

SEQ ID NO: 8789914 - DNA, 22 bp, Homo sapiens
agaggtgggagcctggtcacat

SEQ ID NO: 8789915 - DNA, 22 bp, Homo sapiens
acaaaaaccgtggattcagcat

SEQ ID NO: 8789916 - DNA, 22 bp, Homo sapiens
aattttgttttagtggaggctg

SEQ ID NO: 8789917 - DNA, 22 bp, Homo sapiens
aattttgtttaagtgatctgct

SEQ ID NO: 8789918 - DNA, 22 bp, Homo sapiens
aattttgtttaagtgatctgct

SEQ ID NO: 8789919 - DNA, 22 bp, Homo sapiens
aattttgtttaagtgatctgct

SEQ ID NO: 8789920 - DNA, 22 bp, Homo sapiens
aattttgttcttggaaatcagg

SEQ ID NO: 8789921 - DNA, 22 bp, Homo sapiens
acaaaaaccgtggattcagcat

SEQ ID NO: 8789922 - DNA, 22 bp, Homo sapiens
acaaaaagctccattactgtcc

SEQ ID NO: 8789923 - DNA, 22 bp, Homo sapiens
acaaaaagctccattactgtcc

SEQ ID NO: 8789924 - DNA, 22 bp, Homo sapiens
agaggggttatgcttgacattt

SEQ ID NO: 8789925 - DNA, 22 bp, Homo sapiens
agaggtggccatgggcgctgga

SEQ ID NO: 8789926 - DNA, 20 bp, Homo sapiens
agattaggggctttcttctt

SEQ ID NO: 8789927 - DNA, 22 bp, Homo sapiens
agattacagcatgggaatggga

SEQ ID NO: 8789928 - DNA, 21 bp, Homo sapiens
agattacaggtgtgatccacc

SEQ ID NO: 8789929 - DNA, 21 bp, Homo sapiens
agattacaggtgtgatccacc

SEQ ID NO: 8789930 - DNA, 22 bp, Homo sapiens
agattacaacatgggacgcata

SEQ ID NO: 8789931 - DNA, 22 bp, Homo sapiens
agattacaacatgggacgcata

SEQ ID NO: 8789932 - DNA, 22 bp, Homo sapiens
agattacagaagaataagtaga

SEQ ID NO: 8789933 - DNA, 22 bp, Homo sapiens
agattacagaagaataagtaga

SEQ ID NO: 8789934 - DNA, 22 bp, Homo sapiens
agattatttccagactaatgaa

SEQ ID NO: 8789935 - DNA, 22 bp, Homo sapiens
agattcaaagtgaagaacttaa

SEQ ID NO: 8789936 - DNA, 21 bp, Homo sapiens
agattcacacccaggccagct

SEQ ID NO: 8789937 - DNA, 22 bp, Homo sapiens
agattatttaagacaggaacca

SEQ ID NO: 8789938 - DNA, 23 bp, Homo sapiens
agatctgatgttaccaagaattg

SEQ ID NO: 8789939 - DNA, 22 bp, Homo sapiens
agatctgcccagggtacaaagg

SEQ ID NO: 8789940 - DNA, 22 bp, Homo sapiens
agatctggaaaatcacaggtgc

SEQ ID NO: 8789941 - DNA, 22 bp, Homo sapiens
agatctggaactgaggtttatt

SEQ ID NO: 8789942 - DNA, 22 bp, Homo sapiens
agatctggaaaatcacaggtgc

SEQ ID NO: 8789943 - DNA, 22 bp, Homo sapiens
agatctggttggagtcctgaca

SEQ ID NO: 8789944 - DNA, 22 bp, Homo sapiens
agatctggccctcagcttgatt

SEQ ID NO: 8789945 - DNA, 22 bp, Homo sapiens
agatctggttggagtcctgaca

SEQ ID NO: 8789946 - DNA, 22 bp, Homo sapiens
agatctttaaaagttattatta

SEQ ID NO: 8789947 - DNA, 22 bp, Homo sapiens
agattacaaatcctctgtgttt

SEQ ID NO: 8789948 - DNA, 22 bp, Homo sapiens
agattaactctcagaaaagagg

SEQ ID NO: 8789949 - DNA, 21 bp, Homo sapiens
agattaaaatctgtgagaagg

SEQ ID NO: 8789950 - DNA, 21 bp, Homo sapiens
agattaaaatctgtgagaagg

SEQ ID NO: 8789951 - DNA, 22 bp, Homo sapiens
agattaactctcagaaaagagg

SEQ ID NO: 8789952 - DNA, 22 bp, Homo sapiens
agatgttttgtgtatttcatca

SEQ ID NO: 8789953 - DNA, 22 bp, Homo sapiens
agatgtttttccaggtctaatt

SEQ ID NO: 8789954 - DNA, 22 bp, Homo sapiens
agatatgactagaagctcattt

SEQ ID NO: 8789955 - DNA, 22 bp, Homo sapiens
agatatctgcaatataatttaa

SEQ ID NO: 8789956 - DNA, 22 bp, Homo sapiens
agatatctgcaatataatttaa

SEQ ID NO: 8789957 - DNA, 22 bp, Homo sapiens
agatatctgtattgtttccaat

SEQ ID NO: 8789958 - DNA, 22 bp, Homo sapiens
agatatggtttgcataaataag

SEQ ID NO: 8789959 - DNA, 22 bp, Homo sapiens
agatatggttttctcttctcct

SEQ ID NO: 8789960 - DNA, 22 bp, Homo sapiens
agatatggtttgcataaataag

SEQ ID NO: 8789961 - DNA, 18 bp, Homo sapiens
agatatggagggggtggg

SEQ ID NO: 8789962 - DNA, 22 bp, Homo sapiens
agatatgcttgaagacaggaca

SEQ ID NO: 8789963 - DNA, 22 bp, Homo sapiens
agatatgatgcatgtaaacatt

SEQ ID NO: 8789964 - DNA, 22 bp, Homo sapiens
agatatgagattttcaaacaag

SEQ ID NO: 8789965 - DNA, 22 bp, Homo sapiens
agatatgatctatgattttgac

SEQ ID NO: 8789966 - DNA, 22 bp, Homo sapiens
agatatctccagtgatgctcgt

SEQ ID NO: 8789967 - DNA, 22 bp, Homo sapiens
agatatcaccagttttacatac

SEQ ID NO: 8789968 - DNA, 22 bp, Homo sapiens
agatatgtgccaattgttataa

SEQ ID NO: 8789969 - DNA, 22 bp, Homo sapiens
agatccagttaatagcttcatt

SEQ ID NO: 8789970 - DNA, 22 bp, Homo sapiens
agatcccaggatactggcctat

SEQ ID NO: 8789971 - DNA, 22 bp, Homo sapiens
agagggcataaaatagagcacg

SEQ ID NO: 8789972 - DNA, 22 bp, Homo sapiens
agagggcataaaatagagcacg

SEQ ID NO: 8789973 - DNA, 22 bp, Homo sapiens
agagggcatgcttggtggcctg

SEQ ID NO: 8789974 - DNA, 22 bp, Homo sapiens
agagggcatgcttggtggcctg

SEQ ID NO: 8789975 - DNA, 22 bp, Homo sapiens
agagggcatgcttggtggcctg

SEQ ID NO: 8789976 - DNA, 22 bp, Homo sapiens
agagggccataggtgcatagtt

SEQ ID NO: 8789977 - DNA, 22 bp, Homo sapiens
agagggccataggtgcatagtt

SEQ ID NO: 8789978 - DNA, 22 bp, Homo sapiens
agagggcccatgttgggctgct

SEQ ID NO: 8789979 - DNA, 22 bp, Homo sapiens
agagggcccatgttgggctgct

SEQ ID NO: 8789980 - DNA, 22 bp, Homo sapiens
agagggcgcccaggcccacgcc

SEQ ID NO: 8789981 - DNA, 21 bp, Homo sapiens
aattttgaaggaagattaagg

SEQ ID NO: 8789982 - DNA, 21 bp, Homo sapiens
aattttgaaggaagattaagg

SEQ ID NO: 8789983 - DNA, 21 bp, Homo sapiens
aattttgaaggaagattaagg

SEQ ID NO: 8789984 - DNA, 22 bp, Homo sapiens
aattttgtgtgggatcaaagga

SEQ ID NO: 8789985 - DNA, 22 bp, Homo sapiens
aattttgtgtgggatcaaagga

SEQ ID NO: 8789986 - DNA, 22 bp, Homo sapiens
aattttgttcttggaaatcagg

SEQ ID NO: 8789987 - DNA, 22 bp, Homo sapiens
aattttctggtgtgtaatgaag

SEQ ID NO: 8789988 - DNA, 22 bp, Homo sapiens
agagggctgctgcacagtgctc

SEQ ID NO: 8789989 - DNA, 22 bp, Homo sapiens
agagggctgctgcacagtgctc

SEQ ID NO: 8789990 - DNA, 22 bp, Homo sapiens
agagggctgcctcagtcagcta

SEQ ID NO: 8789991 - DNA, 22 bp, Homo sapiens
agagggctgcctcagtcagcta

SEQ ID NO: 8789992 - DNA, 17 bp, Homo sapiens
agagggctcaaggcatc

SEQ ID NO: 8789993 - DNA, 22 bp, Homo sapiens
agagggctaaggtttgggagat

SEQ ID NO: 8789994 - DNA, 17 bp, Homo sapiens
agagggctcaaggcatc

SEQ ID NO: 8789995 - DNA, 22 bp, Homo sapiens
aatttcaagtggcatctttgat

SEQ ID NO: 8789996 - DNA, 22 bp, Homo sapiens
aatttcaagtggcatctttgat

SEQ ID NO: 8789997 - DNA, 22 bp, Homo sapiens
aatttcaagtggcatctttgat

SEQ ID NO: 8789998 - DNA, 22 bp, Homo sapiens
aatttcaatgcactcatggttg

SEQ ID NO: 8789999 - DNA, 22 bp, Homo sapiens
aatttcaagtggcatctttgat

SEQ ID NO: 8790000 - DNA, 22 bp, Homo sapiens
aatttcaatgcactcatggttg

SEQ ID NO: 8790001 - DNA, 22 bp, Homo sapiens
aatttcaatgcactcatggttg

SEQ ID NO: 8790002 - DNA, 22 bp, Homo sapiens
agaggcttggaggtgcaaggtt

SEQ ID NO: 8790003 - DNA, 22 bp, Homo sapiens
agaggcttggcctcagttctgt

SEQ ID NO: 8790004 - DNA, 20 bp, Homo sapiens
agaggctttcttgtagtcag

SEQ ID NO: 8790005 - DNA, 20 bp, Homo sapiens
agaggctttcttgtagtcag

SEQ ID NO: 8790006 - DNA, 22 bp, Homo sapiens
aatttcaaactcttgccctcag

SEQ ID NO: 8790007 - DNA, 22 bp, Homo sapiens
aatttcaaactaataggaacca

SEQ ID NO: 8790008 - DNA, 22 bp, Homo sapiens
aatttcaaagctcactggcata

SEQ ID NO: 8790009 - DNA, 22 bp, Homo sapiens
aatttcaaactcttgccctcag

SEQ ID NO: 8790010 - DNA, 22 bp, Homo sapiens
aatttcaaactaataggaacca

SEQ ID NO: 8790011 - DNA, 22 bp, Homo sapiens
aatttcaaagctcactggcata

SEQ ID NO: 8790012 - DNA, 22 bp, Homo sapiens
aatttcaaagctcactggcata

SEQ ID NO: 8790013 - DNA, 22 bp, Homo sapiens
aatttcaagtggcatctttgat

SEQ ID NO: 8790014 - DNA, 22 bp, Homo sapiens
aatttcaagtcttgaagaagta

SEQ ID NO: 8790015 - DNA, 22 bp, Homo sapiens
aatttcaagtcttgaagaagta

SEQ ID NO: 8790016 - DNA, 22 bp, Homo sapiens
aatttcaagtcttgaagaagta

SEQ ID NO: 8790017 - DNA, 22 bp, Homo sapiens
aatttatttcctgccagtacac

SEQ ID NO: 8790018 - DNA, 22 bp, Homo sapiens
agaggccaatagtaggtggcat

SEQ ID NO: 8790019 - DNA, 22 bp, Homo sapiens
agaggccaatagtaggtggcat

SEQ ID NO: 8790020 - DNA, 22 bp, Homo sapiens
agagcaggcataaagctttgaa

SEQ ID NO: 8790021 - DNA, 22 bp, Homo sapiens
agagcaggtggcaactctggga

SEQ ID NO: 8790022 - DNA, 22 bp, Homo sapiens
agagcagctggggcagagacca

SEQ ID NO: 8790023 - DNA, 22 bp, Homo sapiens
agagcagctggggcagagacca

SEQ ID NO: 8790024 - DNA, 22 bp, Homo sapiens
agagcagctggctgcatctaga

SEQ ID NO: 8790025 - DNA, 22 bp, Homo sapiens
agagcagctggctgcatctaga

SEQ ID NO: 8790026 - DNA, 22 bp, Homo sapiens
agagcagctgtgacatggacag

SEQ ID NO: 8790027 - DNA, 22 bp, Homo sapiens
agagcagctgtgacatggacag

SEQ ID NO: 8790028 - DNA, 22 bp, Homo sapiens
agagcagctgtgacatggacag

SEQ ID NO: 8790029 - DNA, 22 bp, Homo sapiens
agagcagctgtgacatggacag

SEQ ID NO: 8790030 - DNA, 22 bp, Homo sapiens
agagcaggcataaagctttgaa

SEQ ID NO: 8790031 - DNA, 22 bp, Homo sapiens
agagcagcttttcggaaccact

SEQ ID NO: 8790032 - DNA, 22 bp, Homo sapiens
agagcagcttttcggaaccact

SEQ ID NO: 8790033 - DNA, 21 bp, Homo sapiens
agaggcaggcattaagtacac

SEQ ID NO: 8790034 - DNA, 21 bp, Homo sapiens
agaggcaggcattaagtacac

SEQ ID NO: 8790035 - DNA, 22 bp, Homo sapiens
agaggcagtatacaatccgagc

SEQ ID NO: 8790036 - DNA, 21 bp, Homo sapiens
agaggcaggcattaagtacac

SEQ ID NO: 8790037 - DNA, 19 bp, Homo sapiens
agaggcagtctccaacagg

SEQ ID NO: 8790038 - DNA, 19 bp, Homo sapiens
agaggcagtctccaacagg

SEQ ID NO: 8790039 - DNA, 19 bp, Homo sapiens
agaggcagtctccaacagg

SEQ ID NO: 8790040 - DNA, 22 bp, Homo sapiens
agaggcagtatacaatccgagc

SEQ ID NO: 8790041 - DNA, 22 bp, Homo sapiens
agaggcagtatacaatccgagc

SEQ ID NO: 8790042 - DNA, 19 bp, Homo sapiens
agaggcagtctccaacagg

SEQ ID NO: 8790043 - DNA, 19 bp, Homo sapiens
agaggcagtctccaacagg

SEQ ID NO: 8790044 - DNA, 22 bp, Homo sapiens
agagcagcgtttgtggaacact

SEQ ID NO: 8790045 - DNA, 22 bp, Homo sapiens
agagcagcgtttgtggaacact

SEQ ID NO: 8790046 - DNA, 18 bp, Homo sapiens
agagcagcggcatcacac

SEQ ID NO: 8790047 - DNA, 18 bp, Homo sapiens
agagcagcggcatcacac

SEQ ID NO: 8790048 - DNA, 22 bp, Homo sapiens
agagcagctgcattcagcacct

SEQ ID NO: 8790049 - DNA, 22 bp, Homo sapiens
agagcagctgcattcagcacct

SEQ ID NO: 8790050 - DNA, 22 bp, Homo sapiens
aattcagagacatgaagtgaca

SEQ ID NO: 8790051 - DNA, 22 bp, Homo sapiens
aattcagaagcacaaaacctag

SEQ ID NO: 8790052 - DNA, 22 bp, Homo sapiens
aattcagaagcacaaaacctag

SEQ ID NO: 8790053 - DNA, 22 bp, Homo sapiens
aattcagagtcctggccccacg

SEQ ID NO: 8790054 - DNA, 22 bp, Homo sapiens
aattcagagactcattctggag

SEQ ID NO: 8790055 - DNA, 22 bp, Homo sapiens
aattcagatggaagattctggc

SEQ ID NO: 8790056 - DNA, 20 bp, Homo sapiens
aattcagctgccttcatgct

SEQ ID NO: 8790057 - DNA, 22 bp, Homo sapiens
aattcatactctatattgcttt

SEQ ID NO: 8790058 - DNA, 22 bp, Homo sapiens
aattcacaggaggtatttgtcc

SEQ ID NO: 8790059 - DNA, 22 bp, Homo sapiens
aattcacaggaggtatttgtcc

SEQ ID NO: 8790060 - DNA, 22 bp, Homo sapiens
aattcacagcatttgcccatct

SEQ ID NO: 8790061 - DNA, 22 bp, Homo sapiens
aattcacagcatttgcccatct

SEQ ID NO: 8790062 - DNA, 22 bp, Homo sapiens
aattcacagcatttgcccatct

SEQ ID NO: 8790063 - DNA, 22 bp, Homo sapiens
aattcacatatacattattcct

SEQ ID NO: 8790064 - DNA, 22 bp, Homo sapiens
aattcacagttctgcaccttac

SEQ ID NO: 8790065 - DNA, 22 bp, Homo sapiens
aattcacaggatcacaggagag

SEQ ID NO: 8790066 - DNA, 22 bp, Homo sapiens
aattcacaggatcacaggagag

SEQ ID NO: 8790067 - DNA, 22 bp, Homo sapiens
aattcacaggatcacaggagag

SEQ ID NO: 8790068 - DNA, 22 bp, Homo sapiens
aattcacatatacattattcct

SEQ ID NO: 8790069 - DNA, 22 bp, Homo sapiens
aattcacatatacattattcct

SEQ ID NO: 8790070 - DNA, 22 bp, Homo sapiens
aattcacatccgaccaggtcaa

SEQ ID NO: 8790071 - DNA, 22 bp, Homo sapiens
aattcacatgttgaagtcctaa

SEQ ID NO: 8790072 - DNA, 22 bp, Homo sapiens
aattcacatgttgaagtcctaa

SEQ ID NO: 8790073 - DNA, 22 bp, Homo sapiens
aattcacatgttgaagtcctaa

SEQ ID NO: 8790074 - DNA, 22 bp, Homo sapiens
aattcacatgttgaagtcctaa

SEQ ID NO: 8790075 - DNA, 22 bp, Homo sapiens
aattcacatgcatgtctgtgca

SEQ ID NO: 8790076 - DNA, 22 bp, Homo sapiens
aattcacatgcatgtctgtgca

SEQ ID NO: 8790077 - DNA, 22 bp, Homo sapiens
aattcagaaaaattcactccta

SEQ ID NO: 8790078 - DNA, 22 bp, Homo sapiens
agactcttggagaagagctata

SEQ ID NO: 8790079 - DNA, 19 bp, Homo sapiens
agactctgtgtgagacttt

SEQ ID NO: 8790080 - DNA, 22 bp, Homo sapiens
agactgaaccctctgctgcact

SEQ ID NO: 8790081 - DNA, 22 bp, Homo sapiens
agactgaaacaatctgcaggca

SEQ ID NO: 8790082 - DNA, 22 bp, Homo sapiens
agactgaaacaatctgcaggca

SEQ ID NO: 8790083 - DNA, 22 bp, Homo sapiens
agactcttggtcattggcatta

SEQ ID NO: 8790084 - DNA, 22 bp, Homo sapiens
agactgaagctccttgaggaca

SEQ ID NO: 8790085 - DNA, 22 bp, Homo sapiens
agactgaagtaagaatgcagct

SEQ ID NO: 8790086 - DNA, 22 bp, Homo sapiens
agactgaaatagtgcacaccaa

SEQ ID NO: 8790087 - DNA, 22 bp, Homo sapiens
agactgaagcaattcaaccagt

SEQ ID NO: 8790088 - DNA, 20 bp, Homo sapiens
agactgaagccatgtgacta

SEQ ID NO: 8790089 - DNA, 22 bp, Homo sapiens
agactgcagcaaccccttcagc

SEQ ID NO: 8790090 - DNA, 23 bp, Homo sapiens
agactgaggctgccagggtcaga

SEQ ID NO: 8790091 - DNA, 22 bp, Homo sapiens
agactgagactggggaaagaca

SEQ ID NO: 8790092 - DNA, 22 bp, Homo sapiens
agactgaataggaaagagggaa

SEQ ID NO: 8790093 - DNA, 22 bp, Homo sapiens
agactgagactggggaaagaca

SEQ ID NO: 8790094 - DNA, 17 bp, Homo sapiens
agactgaggacacagga

SEQ ID NO: 8790095 - DNA, 22 bp, Homo sapiens
agactggatagctttggacttg

SEQ ID NO: 8790096 - DNA, 21 bp, Homo sapiens
agactgccattgttcttttgg

SEQ ID NO: 8790097 - DNA, 22 bp, Homo sapiens
agactggaagcctgccaagcaa

SEQ ID NO: 8790098 - DNA, 21 bp, Homo sapiens
agactgccattgttcttttgg

SEQ ID NO: 8790099 - DNA, 18 bp, Homo sapiens
agactggcagggaaaggg

SEQ ID NO: 8790100 - DNA, 18 bp, Homo sapiens
agactggcagggaaaggg

SEQ ID NO: 8790101 - DNA, 22 bp, Homo sapiens
agactgggattctccctgatca

SEQ ID NO: 8790102 - DNA, 22 bp, Homo sapiens
agactgggccatttccccagct

SEQ ID NO: 8790103 - DNA, 23 bp, Homo sapiens
agagaaagggataacacgttgaa

SEQ ID NO: 8790104 - DNA, 23 bp, Homo sapiens
agagaaagggataacacgttgaa

SEQ ID NO: 8790105 - DNA, 18 bp, Homo sapiens
agagaaagaccaaagcat

SEQ ID NO: 8790106 - DNA, 18 bp, Homo sapiens
agagaaagaccaaagcat

SEQ ID NO: 8790107 - DNA, 18 bp, Homo sapiens
agagaaagaccaaagcat

SEQ ID NO: 8790108 - DNA, 23 bp, Homo sapiens
agagaaagggataacacgttgaa

SEQ ID NO: 8790109 - DNA, 19 bp, Homo sapiens
agagaaagaattgagtcta

SEQ ID NO: 8790110 - DNA, 19 bp, Homo sapiens
agagaaagaattgagtcta

SEQ ID NO: 8790111 - DNA, 22 bp, Homo sapiens
agagaaacaggtcagctgggag

SEQ ID NO: 8790112 - DNA, 22 bp, Homo sapiens
agactggggttctggcaaggag

SEQ ID NO: 8790113 - DNA, 23 bp, Homo sapiens
agactggggcataagaagatggc

SEQ ID NO: 8790114 - DNA, 23 bp, Homo sapiens
agactggggcataagaagatggc

SEQ ID NO: 8790115 - DNA, 23 bp, Homo sapiens
agactggggcataagaagatggc

SEQ ID NO: 8790116 - DNA, 22 bp, Homo sapiens
agactggaggcattttgctcct

SEQ ID NO: 8790117 - DNA, 22 bp, Homo sapiens
agactggcttgctttacaagga

SEQ ID NO: 8790118 - DNA, 22 bp, Homo sapiens
agagaaacccttcagtgttttg

SEQ ID NO: 8790119 - DNA, 22 bp, Homo sapiens
agagaaactgatgtcctttgaa

SEQ ID NO: 8790120 - DNA, 22 bp, Homo sapiens
agagaaactgatgtcctttgaa

SEQ ID NO: 8790121 - DNA, 22 bp, Homo sapiens
agagaaactgatgtcctttgaa

SEQ ID NO: 8790122 - DNA, 22 bp, Homo sapiens
agagaaacccttcagtgttttg

SEQ ID NO: 8790123 - DNA, 22 bp, Homo sapiens
agactctggagtcagctaggat

SEQ ID NO: 8790124 - DNA, 19 bp, Homo sapiens
agactctgccactcttctc

SEQ ID NO: 8790125 - DNA, 22 bp, Homo sapiens
agacctctgctcccttcatggt

SEQ ID NO: 8790126 - DNA, 22 bp, Homo sapiens
agacctctgagggcatcttgtc

SEQ ID NO: 8790127 - DNA, 22 bp, Homo sapiens
agacctctgagggcatcttgtc

SEQ ID NO: 8790128 - DNA, 17 bp, Homo sapiens
agacactgagccaagta

SEQ ID NO: 8790129 - DNA, 22 bp, Homo sapiens
agacactgatgttcagctcaat

SEQ ID NO: 8790130 - DNA, 22 bp, Homo sapiens
agacactgatgttcagctcaat

SEQ ID NO: 8790131 - DNA, 22 bp, Homo sapiens
agacacctaatagatgaattca

SEQ ID NO: 8790132 - DNA, 22 bp, Homo sapiens
aatgtacagctgctgctgaagg

SEQ ID NO: 8790133 - DNA, 22 bp, Homo sapiens
aatgtataaccataggaaattt

SEQ ID NO: 8790134 - DNA, 22 bp, Homo sapiens
agagagaggggcgagcaaacac

SEQ ID NO: 8790135 - DNA, 22 bp, Homo sapiens
agagagagggaaactgctaaac

SEQ ID NO: 8790136 - DNA, 22 bp, Homo sapiens
agagagaggcagcagtgctcac

SEQ ID NO: 8790137 - DNA, 22 bp, Homo sapiens
agagagagggaaactgctaaac

SEQ ID NO: 8790138 - DNA, 20 bp, Homo sapiens
agagagaggtaaattgagca

SEQ ID NO: 8790139 - DNA, 20 bp, Homo sapiens
agagagaggtaaattgagca

SEQ ID NO: 8790140 - DNA, 20 bp, Homo sapiens
agagagaggtaaattgagca

SEQ ID NO: 8790141 - DNA, 22 bp, Homo sapiens
agagagaggggcgagcaaacac

SEQ ID NO: 8790142 - DNA, 22 bp, Homo sapiens
agagagaggggcgagcaaacac

SEQ ID NO: 8790143 - DNA, 22 bp, Homo sapiens
agagagacgggggctgctgctt

SEQ ID NO: 8790144 - DNA, 22 bp, Homo sapiens
agagagacgggggctgctgctt

SEQ ID NO: 8790145 - DNA, 22 bp, Homo sapiens
agagagagaaatgaaatgtgct

SEQ ID NO: 8790146 - DNA, 22 bp, Homo sapiens
agagagaattggataaattggt

SEQ ID NO: 8790147 - DNA, 22 bp, Homo sapiens
agagagagaaatgaaatgtgct

SEQ ID NO: 8790148 - DNA, 17 bp, Homo sapiens
agagagagcatgccacc

SEQ ID NO: 8790149 - DNA, 17 bp, Homo sapiens
agagagagcatgccacc

SEQ ID NO: 8790150 - DNA, 17 bp, Homo sapiens
agagagagcatgccacc

SEQ ID NO: 8790151 - DNA, 17 bp, Homo sapiens
agagagagcatgccacc

SEQ ID NO: 8790152 - DNA, 17 bp, Homo sapiens
agagagagcatgccacc

SEQ ID NO: 8790153 - DNA, 22 bp, Homo sapiens
agagagaggcagcagtgctcac

SEQ ID NO: 8790154 - DNA, 22 bp, Homo sapiens
agagagaggcagcagtgctcac

SEQ ID NO: 8790155 - DNA, 21 bp, Homo sapiens
agagaaagtcatggctgtggc

SEQ ID NO: 8790156 - DNA, 22 bp, Homo sapiens
agagaaagtaaagattctacct

SEQ ID NO: 8790157 - DNA, 22 bp, Homo sapiens
agagaaagtaaagattctacct

SEQ ID NO: 8790158 - DNA, 22 bp, Homo sapiens
agagaaagtaaagattctacct

SEQ ID NO: 8790159 - DNA, 22 bp, Homo sapiens
agagaaagtcctgatctctcta

SEQ ID NO: 8790160 - DNA, 22 bp, Homo sapiens
agagacagggttttgccatgtt

SEQ ID NO: 8790161 - DNA, 22 bp, Homo sapiens
agagacagggttttgccatgtt

SEQ ID NO: 8790162 - DNA, 22 bp, Homo sapiens
agagaaagtcctgatctctcta

SEQ ID NO: 8790163 - DNA, 20 bp, Homo sapiens
agagagacctaggcctagtc

SEQ ID NO: 8790164 - DNA, 18 bp, Homo sapiens
agagagaattccagtagg

SEQ ID NO: 8790165 - DNA, 22 bp, Homo sapiens
agagagaattggataaattggt

SEQ ID NO: 8790166 - DNA, 21 bp, Homo sapiens
agagagaaggccatatggtcc

SEQ ID NO: 8790167 - DNA, 22 bp, Homo sapiens
agagacagggttttgccatgtt

SEQ ID NO: 8790168 - DNA, 20 bp, Homo sapiens
agagagcacaggcaggaaag

SEQ ID NO: 8790169 - DNA, 20 bp, Homo sapiens
agagagcacaggcaggaaag

SEQ ID NO: 8790170 - DNA, 23 bp, Homo sapiens
agagagagtttgtgtcaggtacc

SEQ ID NO: 8790171 - DNA, 23 bp, Homo sapiens
agagagagtttgtgtcaggtacc

SEQ ID NO: 8790172 - DNA, 23 bp, Homo sapiens
agagagagtttgtgtcaggtacc

SEQ ID NO: 8790173 - DNA, 22 bp, Homo sapiens
agagagcaggacttcactgagc

SEQ ID NO: 8790174 - DNA, 22 bp, Homo sapiens
agagagttgtatgtttctaaaa

SEQ ID NO: 8790175 - DNA, 22 bp, Homo sapiens
agagagcagtctggaagaaaca

SEQ ID NO: 8790176 - DNA, 22 bp, Homo sapiens
agagagcagtggatcacctagc

SEQ ID NO: 8790177 - DNA, 22 bp, Homo sapiens
agagagcagtctggaagaaaca

SEQ ID NO: 8790178 - DNA, 22 bp, Homo sapiens
agagagcagtctggaagaaaca

SEQ ID NO: 8790179 - DNA, 22 bp, Homo sapiens
agagatatggatgtcagaaact

SEQ ID NO: 8790180 - DNA, 22 bp, Homo sapiens
agagataattaggttaaatgag

SEQ ID NO: 8790181 - DNA, 22 bp, Homo sapiens
agagataaagctatgatttatg

SEQ ID NO: 8790182 - DNA, 22 bp, Homo sapiens
agagataaggattgtttttctc

SEQ ID NO: 8790183 - DNA, 20 bp, Homo sapiens
agagagttgtcagtagcttc

SEQ ID NO: 8790184 - DNA, 22 bp, Homo sapiens
agagagtttaagtgacttgccg

SEQ ID NO: 8790185 - DNA, 22 bp, Homo sapiens
agagatattatttaccaagtta

SEQ ID NO: 8790186 - DNA, 22 bp, Homo sapiens
agagatcagttaaaatcttttt

SEQ ID NO: 8790187 - DNA, 22 bp, Homo sapiens
agagatcactacatttgtaaaa

SEQ ID NO: 8790188 - DNA, 22 bp, Homo sapiens
agagatctagcacctgctggtc

SEQ ID NO: 8790189 - DNA, 22 bp, Homo sapiens
aattatgtagccatatgaaaca

SEQ ID NO: 8790190 - DNA, 22 bp, Homo sapiens
agagatctgtgcttactacaag

SEQ ID NO: 8790191 - DNA, 22 bp, Homo sapiens
agagatctgtctactatttaag

SEQ ID NO: 8790192 - DNA, 22 bp, Homo sapiens
agagatctctgaagctgctgct

SEQ ID NO: 8790193 - DNA, 21 bp, Homo sapiens
agagatctgaagaaccattag

SEQ ID NO: 8790194 - DNA, 22 bp, Homo sapiens
aattcacagaaccatggtgctc

SEQ ID NO: 8790195 - DNA, 22 bp, Homo sapiens
aattcacagaaccatggtgctc

SEQ ID NO: 8790196 - DNA, 22 bp, Homo sapiens
aattcacagaaccatggtgctc

SEQ ID NO: 8790197 - DNA, 22 bp, Homo sapiens
aattcacacctccggtttttct

SEQ ID NO: 8790198 - DNA, 22 bp, Homo sapiens
aattatgtttgctttagatgga

SEQ ID NO: 8790199 - DNA, 21 bp, Homo sapiens
agaatccattcagaccttctc

SEQ ID NO: 8790200 - DNA, 22 bp, Homo sapiens
agaatcctattgtcagattctt

SEQ ID NO: 8790201 - DNA, 22 bp, Homo sapiens
agaatcctcttcagtaaattct

SEQ ID NO: 8790202 - DNA, 22 bp, Homo sapiens
agaatcctgatgaaaaggagag

SEQ ID NO: 8790203 - DNA, 22 bp, Homo sapiens
agaatcctggagaagctgtacc

SEQ ID NO: 8790204 - DNA, 22 bp, Homo sapiens
agaatcctggccaggtcagagc

SEQ ID NO: 8790205 - DNA, 22 bp, Homo sapiens
agaatcctgatgaaaaggagag

SEQ ID NO: 8790206 - DNA, 22 bp, Homo sapiens
agaatcctgttttacttcatca

SEQ ID NO: 8790207 - DNA, 22 bp, Homo sapiens
agaatcctggccaggtcagagc

SEQ ID NO: 8790208 - DNA, 19 bp, Homo sapiens
agaatctaaattatttctg

SEQ ID NO: 8790209 - DNA, 22 bp, Homo sapiens
agaatccttgactcaggctgag

SEQ ID NO: 8790210 - DNA, 22 bp, Homo sapiens
agaatctaaatatgcaatttga

SEQ ID NO: 8790211 - DNA, 20 bp, Homo sapiens
agaatctgacccagagagac

SEQ ID NO: 8790212 - DNA, 22 bp, Homo sapiens
agaatctgaaggcacctctggt

SEQ ID NO: 8790213 - DNA, 20 bp, Homo sapiens
agaatctgacccagagagac

SEQ ID NO: 8790214 - DNA, 20 bp, Homo sapiens
agaatctgacccagagagac

SEQ ID NO: 8790215 - DNA, 22 bp, Homo sapiens
agaatctacattttaacaagat

SEQ ID NO: 8790216 - DNA, 22 bp, Homo sapiens
agaatctaagtacacagacaga

SEQ ID NO: 8790217 - DNA, 22 bp, Homo sapiens
agaatctctactcaagtacttg

SEQ ID NO: 8790218 - DNA, 22 bp, Homo sapiens
agaatctgcatttctaataagc

SEQ ID NO: 8790219 - DNA, 22 bp, Homo sapiens
agaatctgcatttctaataagc

SEQ ID NO: 8790220 - DNA, 22 bp, Homo sapiens
agaatctgcatttttaataaca

SEQ ID NO: 8790221 - DNA, 22 bp, Homo sapiens
agaatctgcattttaacaagct

SEQ ID NO: 8790222 - DNA, 22 bp, Homo sapiens
agaatctgcatttttaataaca

SEQ ID NO: 8790223 - DNA, 22 bp, Homo sapiens
agaatctgcattttaacaagat

SEQ ID NO: 8790224 - DNA, 22 bp, Homo sapiens
agaatctgcattttaacaagcc

SEQ ID NO: 8790225 - DNA, 22 bp, Homo sapiens
agaatcttcagatgatttgtca

SEQ ID NO: 8790226 - DNA, 22 bp, Homo sapiens
agaatcttgggcaaattcatct

SEQ ID NO: 8790227 - DNA, 22 bp, Homo sapiens
agaatctgctttttaacaagat

SEQ ID NO: 8790228 - DNA, 22 bp, Homo sapiens
agaatcttggaactcagatcac

SEQ ID NO: 8790229 - DNA, 22 bp, Homo sapiens
agaatcttcggtaactggaaga

SEQ ID NO: 8790230 - DNA, 22 bp, Homo sapiens
agaatcttcagtctaattccta

SEQ ID NO: 8790231 - DNA, 22 bp, Homo sapiens
agaattgtaagcaatttgatta

SEQ ID NO: 8790232 - DNA, 22 bp, Homo sapiens
agaattgtaagcaatttgatta

SEQ ID NO: 8790233 - DNA, 23 bp, Homo sapiens
agaattgtaaatagaatatacct

SEQ ID NO: 8790234 - DNA, 22 bp, Homo sapiens
agaattgtaataataatagcat

SEQ ID NO: 8790235 - DNA, 22 bp, Homo sapiens
agaattgttctgtagcttggct

SEQ ID NO: 8790236 - DNA, 22 bp, Homo sapiens
agaattgtaataataatagcat

SEQ ID NO: 8790237 - DNA, 19 bp, Homo sapiens
agaattgttttatgtcttc

SEQ ID NO: 8790238 - DNA, 19 bp, Homo sapiens
agaattgttttatgtcttc

SEQ ID NO: 8790239 - DNA, 23 bp, Homo sapiens
agaattgttgttagggaaaagta

SEQ ID NO: 8790240 - DNA, 22 bp, Homo sapiens
agaattgttggggtaataaaag

SEQ ID NO: 8790241 - DNA, 22 bp, Homo sapiens
agaatttcaaaaggaagccagc

SEQ ID NO: 8790242 - DNA, 22 bp, Homo sapiens
agaatttcaaaaggaagccagc

SEQ ID NO: 8790243 - DNA, 23 bp, Homo sapiens
agaatttcaaagtccagcacatt

SEQ ID NO: 8790244 - DNA, 23 bp, Homo sapiens
agaatttcaaagtccagcacatt

SEQ ID NO: 8790245 - DNA, 22 bp, Homo sapiens
agaatttcaaatggaagtttta

SEQ ID NO: 8790246 - DNA, 22 bp, Homo sapiens
agaatttatgacaacgatagcc

SEQ ID NO: 8790247 - DNA, 22 bp, Homo sapiens
agaatttaggatgcatgtgaat

SEQ ID NO: 8790248 - DNA, 22 bp, Homo sapiens
agaatttaggatgcatgtgaat

SEQ ID NO: 8790249 - DNA, 22 bp, Homo sapiens
agaatttagctccttggtcata

SEQ ID NO: 8790250 - DNA, 22 bp, Homo sapiens
agaatttagctccttggtcata

SEQ ID NO: 8790251 - DNA, 19 bp, Homo sapiens
agaattgttttgagacccc

SEQ ID NO: 8790252 - DNA, 22 bp, Homo sapiens
agaatttagctccttggtcata

SEQ ID NO: 8790253 - DNA, 23 bp, Homo sapiens
agacaaaagcctcagtcttaggc

SEQ ID NO: 8790254 - DNA, 22 bp, Homo sapiens
agaatttttgcagtttagccat

SEQ ID NO: 8790255 - DNA, 23 bp, Homo sapiens
agacaaaagcctcagtcttaggc

SEQ ID NO: 8790256 - DNA, 23 bp, Homo sapiens
agacaaaagcctcagtcttaggc

SEQ ID NO: 8790257 - DNA, 23 bp, Homo sapiens
agacaaaagcctcagtcttaggc

SEQ ID NO: 8790258 - DNA, 22 bp, Homo sapiens
aatgtaaacagcaagagaaggg

SEQ ID NO: 8790259 - DNA, 22 bp, Homo sapiens
aatgtaaacagcaagagaaggg

SEQ ID NO: 8790260 - DNA, 22 bp, Homo sapiens
aatgtacaccgtgggtttttta

SEQ ID NO: 8790261 - DNA, 22 bp, Homo sapiens
aatgtacactgaaagcctatca

SEQ ID NO: 8790262 - DNA, 22 bp, Homo sapiens
aatgtacactgaaagcctatca

SEQ ID NO: 8790263 - DNA, 22 bp, Homo sapiens
aatgtacactgaaagcctatca

SEQ ID NO: 8790264 - DNA, 22 bp, Homo sapiens
agaatttgtaaaagataagaca

SEQ ID NO: 8790265 - DNA, 22 bp, Homo sapiens
agaatttttgattatctactcg

SEQ ID NO: 8790266 - DNA, 22 bp, Homo sapiens
agaatttttgattatctactcg

SEQ ID NO: 8790267 - DNA, 22 bp, Homo sapiens
agaatttgtaaaagataagaca

SEQ ID NO: 8790268 - DNA, 22 bp, Homo sapiens
agaatttctggaagattgcaag

SEQ ID NO: 8790269 - DNA, 22 bp, Homo sapiens
agaatttctggaagattgcaag

SEQ ID NO: 8790270 - DNA, 22 bp, Homo sapiens
agaatttgagtgctttctgtgt

SEQ ID NO: 8790271 - DNA, 22 bp, Homo sapiens
agaatttcctatgagagattcc

SEQ ID NO: 8790272 - DNA, 23 bp, Homo sapiens
agaatttctaactctagctctgt

SEQ ID NO: 8790273 - DNA, 23 bp, Homo sapiens
agaatttctaactctagctctgt

SEQ ID NO: 8790274 - DNA, 22 bp, Homo sapiens
aatgtactaataagcaacattt

SEQ ID NO: 8790275 - DNA, 22 bp, Homo sapiens
aatgtaccagcctaagaagtgg

SEQ ID NO: 8790276 - DNA, 22 bp, Homo sapiens
aatgtagatgagatattttttg

SEQ ID NO: 8790277 - DNA, 22 bp, Homo sapiens
aatgtacagctgctgctgaagg

SEQ ID NO: 8790278 - DNA, 22 bp, Homo sapiens
aatgtacagctgctgctgaagg

SEQ ID NO: 8790279 - DNA, 22 bp, Homo sapiens
aatgtacagctgtctttcctcc

SEQ ID NO: 8790280 - DNA, 22 bp, Homo sapiens
aatgtacagctgtctttcctcc

SEQ ID NO: 8790281 - DNA, 22 bp, Homo sapiens
aatgtacatctcagtgtagtac

SEQ ID NO: 8790282 - DNA, 22 bp, Homo sapiens
aatgtacaggctggctatgggg

SEQ ID NO: 8790283 - DNA, 22 bp, Homo sapiens
aatgtacaggctggctatgggg

SEQ ID NO: 8790284 - DNA, 22 bp, Homo sapiens
agaataaaatagtctgaagatg

SEQ ID NO: 8790285 - DNA, 22 bp, Homo sapiens
agaataaaatagtctgaagatg

SEQ ID NO: 8790286 - DNA, 22 bp, Homo sapiens
agaataaaatagtctgaagatg

SEQ ID NO: 8790287 - DNA, 22 bp, Homo sapiens
agaataaatgctacctatcaca

SEQ ID NO: 8790288 - DNA, 22 bp, Homo sapiens
agaataaatgttggacttagga

SEQ ID NO: 8790289 - DNA, 22 bp, Homo sapiens
agaataaatgctacctatcaca

SEQ ID NO: 8790290 - DNA, 22 bp, Homo sapiens
agaataaactgctttagggcag

SEQ ID NO: 8790291 - DNA, 22 bp, Homo sapiens
agaataaactgctttagggcag

SEQ ID NO: 8790292 - DNA, 22 bp, Homo sapiens
agaataaccagtgtttcacagt

SEQ ID NO: 8790293 - DNA, 22 bp, Homo sapiens
agaataaccagtgtttcacagt

SEQ ID NO: 8790294 - DNA, 22 bp, Homo sapiens
agaataaccagtgtttcacagt

SEQ ID NO: 8790295 - DNA, 22 bp, Homo sapiens
agaataaccagtgtttcacagt

SEQ ID NO: 8790296 - DNA, 22 bp, Homo sapiens
agaataaatgttggacttagga

SEQ ID NO: 8790297 - DNA, 22 bp, Homo sapiens
agaataatactgaaatgctgaa

SEQ ID NO: 8790298 - DNA, 22 bp, Homo sapiens
agaataatcactgaagttcaaa

SEQ ID NO: 8790299 - DNA, 22 bp, Homo sapiens
agaatcattatatttattaagc

SEQ ID NO: 8790300 - DNA, 22 bp, Homo sapiens
agaatcagtgctggctattagc

SEQ ID NO: 8790301 - DNA, 22 bp, Homo sapiens
agaatcattagagagaaaactt

SEQ ID NO: 8790302 - DNA, 22 bp, Homo sapiens
agaatcaggacctgtggctgtc

SEQ ID NO: 8790303 - DNA, 22 bp, Homo sapiens
agaataatcactgaagttcaaa

SEQ ID NO: 8790304 - DNA, 22 bp, Homo sapiens
agaatcagtgctggctattagc

SEQ ID NO: 8790305 - DNA, 22 bp, Homo sapiens
aatggaatacctaggtggccca

SEQ ID NO: 8790306 - DNA, 22 bp, Homo sapiens
aatggaatacctaggtggccca

SEQ ID NO: 8790307 - DNA, 22 bp, Homo sapiens
aatggaatacctaggtggccca

SEQ ID NO: 8790308 - DNA, 22 bp, Homo sapiens
aatggacaaacttgggaagtat

SEQ ID NO: 8790309 - DNA, 22 bp, Homo sapiens
aatggacaggagagcatagtca

SEQ ID NO: 8790310 - DNA, 22 bp, Homo sapiens
aatggagacaagaacccaggac

SEQ ID NO: 8790311 - DNA, 22 bp, Homo sapiens
aatggagaccctaaggaagagg

SEQ ID NO: 8790312 - DNA, 22 bp, Homo sapiens
aatggaattctccattagatgt

SEQ ID NO: 8790313 - DNA, 22 bp, Homo sapiens
aatggaatgcctcacatgtatt

SEQ ID NO: 8790314 - DNA, 22 bp, Homo sapiens
aatgctttttgcgaaatgtgca

SEQ ID NO: 8790315 - DNA, 22 bp, Homo sapiens
aatggaacctagttatccacat

SEQ ID NO: 8790316 - DNA, 22 bp, Homo sapiens
aatgctttttgcgaaatgtgca

SEQ ID NO: 8790317 - DNA, 22 bp, Homo sapiens
aatgcttttgctgtcattgctt

SEQ ID NO: 8790318 - DNA, 22 bp, Homo sapiens
aatgcttttacgacatgtacct

SEQ ID NO: 8790319 - DNA, 22 bp, Homo sapiens
aatgcttttacgacatgtacct

SEQ ID NO: 8790320 - DNA, 22 bp, Homo sapiens
aatgcttttacgacatgtacct

SEQ ID NO: 8790321 - DNA, 22 bp, Homo sapiens
aatgcttttacgacatgtacct

SEQ ID NO: 8790322 - DNA, 22 bp, Homo sapiens
aatgctttgtctgctccagact

SEQ ID NO: 8790323 - DNA, 22 bp, Homo sapiens
aatgcttttacgacatgtacct

SEQ ID NO: 8790324 - DNA, 22 bp, Homo sapiens
aatgctttgagggaagatgaaa

SEQ ID NO: 8790325 - DNA, 22 bp, Homo sapiens
aatgctttgactatatctataa

SEQ ID NO: 8790326 - DNA, 22 bp, Homo sapiens
aatgctttgccaacagctattg

SEQ ID NO: 8790327 - DNA, 22 bp, Homo sapiens
aatgaaaattggaccctagaac

SEQ ID NO: 8790328 - DNA, 22 bp, Homo sapiens
aatgaaaattggaccctagaac

SEQ ID NO: 8790329 - DNA, 22 bp, Homo sapiens
aatgaaaattggaccctagaac

SEQ ID NO: 8790330 - DNA, 22 bp, Homo sapiens
acattctattctgcaggacaag

SEQ ID NO: 8790331 - DNA, 22 bp, Homo sapiens
acattctcaaatatttgtggaa

SEQ ID NO: 8790332 - DNA, 22 bp, Homo sapiens
acattcaaaatatttctgatgt

SEQ ID NO: 8790333 - DNA, 22 bp, Homo sapiens
acattcaaaattaggttagttg

SEQ ID NO: 8790334 - DNA, 22 bp, Homo sapiens
acattcaaaaagcatctgtcac

SEQ ID NO: 8790335 - DNA, 22 bp, Homo sapiens
acattctgaatgcctgacagta

SEQ ID NO: 8790336 - DNA, 22 bp, Homo sapiens
acattctgaataggcattttat

SEQ ID NO: 8790337 - DNA, 22 bp, Homo sapiens
acattctggatgtctgatgaga

SEQ ID NO: 8790338 - DNA, 22 bp, Homo sapiens
acattctgggtgatgttcttca

SEQ ID NO: 8790339 - DNA, 22 bp, Homo sapiens
acattctgaaaaacagtgtttt

SEQ ID NO: 8790340 - DNA, 22 bp, Homo sapiens
acattagaacattaatattggg

SEQ ID NO: 8790341 - DNA, 22 bp, Homo sapiens
acattagaacattaatattggg

SEQ ID NO: 8790342 - DNA, 22 bp, Homo sapiens
acattacataagattgtaacct

SEQ ID NO: 8790343 - DNA, 22 bp, Homo sapiens
acattacctggcatttgatctt

SEQ ID NO: 8790344 - DNA, 22 bp, Homo sapiens
acattacttaccttgggttcta

SEQ ID NO: 8790345 - DNA, 22 bp, Homo sapiens
acattagataactcagaaagga

SEQ ID NO: 8790346 - DNA, 22 bp, Homo sapiens
acattagcccatctggtatttg

SEQ ID NO: 8790347 - DNA, 22 bp, Homo sapiens
acattagagaagcttggagatg

SEQ ID NO: 8790348 - DNA, 23 bp, Homo sapiens
acattacttagccagagtctcag

SEQ ID NO: 8790349 - DNA, 22 bp, Homo sapiens
acattagaacattaatattggg

SEQ ID NO: 8790350 - DNA, 22 bp, Homo sapiens
acattagtttctcagatcattt

SEQ ID NO: 8790351 - DNA, 21 bp, Homo sapiens
acattataattcatattccac

SEQ ID NO: 8790352 - DNA, 22 bp, Homo sapiens
acattatagctttgagtttgga

SEQ ID NO: 8790353 - DNA, 22 bp, Homo sapiens
acattcaaaaagcatctgtcac

SEQ ID NO: 8790354 - DNA, 22 bp, Homo sapiens
acattatagttgctacagagta

SEQ ID NO: 8790355 - DNA, 22 bp, Homo sapiens
acattatagttgctacagagta

SEQ ID NO: 8790356 - DNA, 22 bp, Homo sapiens
acattacagcaagtttacgtta

SEQ ID NO: 8790357 - DNA, 22 bp, Homo sapiens
acattacagcaagtttacgtta

SEQ ID NO: 8790358 - DNA, 21 bp, Homo sapiens
acattacagggtgatgtgtct

SEQ ID NO: 8790359 - DNA, 22 bp, Homo sapiens
acattacataagattgtaacct

SEQ ID NO: 8790360 - DNA, 22 bp, Homo sapiens
acattacctggcatttgatctt

SEQ ID NO: 8790361 - DNA, 22 bp, Homo sapiens
acattacataagattgtaacct

SEQ ID NO: 8790362 - DNA, 22 bp, Homo sapiens
aaggccaggcctagcacggagg

SEQ ID NO: 8790363 - DNA, 22 bp, Homo sapiens
aaggccaggccagatgacagtc

SEQ ID NO: 8790364 - DNA, 22 bp, Homo sapiens
aaggccaggccagatgacagtc

SEQ ID NO: 8790365 - DNA, 22 bp, Homo sapiens
aaggccaggcctagcacggagg

SEQ ID NO: 8790366 - DNA, 22 bp, Homo sapiens
aaggccaggagacttggagtca

SEQ ID NO: 8790367 - DNA, 22 bp, Homo sapiens
aaggccaggacaccaggggact

SEQ ID NO: 8790368 - DNA, 22 bp, Homo sapiens
acatggtgtgctgagaatgaca

SEQ ID NO: 8790369 - DNA, 22 bp, Homo sapiens
aaggccagctggagggatgagg

SEQ ID NO: 8790370 - DNA, 22 bp, Homo sapiens
aaggccagcttgtagggctggt

SEQ ID NO: 8790371 - DNA, 22 bp, Homo sapiens
aaggccaggacaccaggggact

SEQ ID NO: 8790372 - DNA, 22 bp, Homo sapiens
aaggccagcttgtagggctggt

SEQ ID NO: 8790373 - DNA, 22 bp, Homo sapiens
aaggccagcttgtagggctggt

SEQ ID NO: 8790374 - DNA, 22 bp, Homo sapiens
acatgggcatctatgaggctct

SEQ ID NO: 8790375 - DNA, 22 bp, Homo sapiens
acatggtaaaagttttggcaat

SEQ ID NO: 8790376 - DNA, 22 bp, Homo sapiens
acatggtatgtattttaagaga

SEQ ID NO: 8790377 - DNA, 22 bp, Homo sapiens
acatggggcccaaagagaggtc

SEQ ID NO: 8790378 - DNA, 17 bp, Homo sapiens
acatgggctgagactcc

SEQ ID NO: 8790379 - DNA, 19 bp, Homo sapiens
acatggctctccagtctgg

SEQ ID NO: 8790380 - DNA, 22 bp, Homo sapiens
acatggctggcaccttaaattt

SEQ ID NO: 8790381 - DNA, 21 bp, Homo sapiens
acatgggacctgcgaaaggaa

SEQ ID NO: 8790382 - DNA, 22 bp, Homo sapiens
acatgcattctctaaaagcaaa

SEQ ID NO: 8790383 - DNA, 22 bp, Homo sapiens
acatgccaagatcctcgtcttt

SEQ ID NO: 8790384 - DNA, 23 bp, Homo sapiens
acatagaacagaatatatttgtg

SEQ ID NO: 8790385 - DNA, 23 bp, Homo sapiens
acatagaacagaatatatttgtg

SEQ ID NO: 8790386 - DNA, 22 bp, Homo sapiens
acatagaaatttatttcttaca

SEQ ID NO: 8790387 - DNA, 22 bp, Homo sapiens
acatacttatgtgtatatgtgt

SEQ ID NO: 8790388 - DNA, 22 bp, Homo sapiens
acatacttgaagcaagtgatca

SEQ ID NO: 8790389 - DNA, 22 bp, Homo sapiens
acatacttaacattaaagtcat

SEQ ID NO: 8790390 - DNA, 22 bp, Homo sapiens
acatacttatgctaaaaatata

SEQ ID NO: 8790391 - DNA, 22 bp, Homo sapiens
acataacactcttctctagtga

SEQ ID NO: 8790392 - DNA, 22 bp, Homo sapiens
acataacaatcataggacatag

SEQ ID NO: 8790393 - DNA, 22 bp, Homo sapiens
acataacactcttctctagtga

SEQ ID NO: 8790394 - DNA, 22 bp, Homo sapiens
acataagttatggataaaatgt

SEQ ID NO: 8790395 - DNA, 22 bp, Homo sapiens
acataacatgtcaatcacccga

SEQ ID NO: 8790396 - DNA, 22 bp, Homo sapiens
acataatacctaggacagtttg

SEQ ID NO: 8790397 - DNA, 22 bp, Homo sapiens
acataatacctaggacagtttg

SEQ ID NO: 8790398 - DNA, 22 bp, Homo sapiens
acataataggtacctgaataat

SEQ ID NO: 8790399 - DNA, 22 bp, Homo sapiens
acataatagcatttctaatttg

SEQ ID NO: 8790400 - DNA, 22 bp, Homo sapiens
acatacattgcctcattggtaa

SEQ ID NO: 8790401 - DNA, 18 bp, Homo sapiens
acatacattctgtctgca

SEQ ID NO: 8790402 - DNA, 22 bp, Homo sapiens
acatacaaatagagctgtagta

SEQ ID NO: 8790403 - DNA, 22 bp, Homo sapiens
acataatgaaatgcagaaatca

SEQ ID NO: 8790404 - DNA, 22 bp, Homo sapiens
acataataggtgcctgaatatt

SEQ ID NO: 8790405 - DNA, 22 bp, Homo sapiens
acataatgaaatgcagaaatca

SEQ ID NO: 8790406 - DNA, 22 bp, Homo sapiens
acataatgagctctttataaat

SEQ ID NO: 8790407 - DNA, 22 bp, Homo sapiens
acattctgtgagtcatgtttta

SEQ ID NO: 8790408 - DNA, 22 bp, Homo sapiens
acattctgtcaacagtgagcag

SEQ ID NO: 8790409 - DNA, 22 bp, Homo sapiens
acattctgtcaacagtgagcag

SEQ ID NO: 8790410 - DNA, 22 bp, Homo sapiens
acattctgtttccccaaagaga

SEQ ID NO: 8790411 - DNA, 22 bp, Homo sapiens
acattctgtgagtcatgtttta

SEQ ID NO: 8790412 - DNA, 22 bp, Homo sapiens
acattctgaaaaacagtgtttt

SEQ ID NO: 8790413 - DNA, 20 bp, Homo sapiens
acattttggcatactctcaa

SEQ ID NO: 8790414 - DNA, 22 bp, Homo sapiens
accacaggggaggaatgatgcc

SEQ ID NO: 8790415 - DNA, 22 bp, Homo sapiens
acattttgcccttatttgctga

SEQ ID NO: 8790416 - DNA, 22 bp, Homo sapiens
acattttgcccttatttgctga

SEQ ID NO: 8790417 - DNA, 22 bp, Homo sapiens
acattcttcagctttgtcaggc

SEQ ID NO: 8790418 - DNA, 22 bp, Homo sapiens
acattcttataagagtgaggca

SEQ ID NO: 8790419 - DNA, 22 bp, Homo sapiens
acattcttaacagttaaaaact

SEQ ID NO: 8790420 - DNA, 22 bp, Homo sapiens
acattcttataagagtgaggca

SEQ ID NO: 8790421 - DNA, 22 bp, Homo sapiens
acattcttaacagttaaaaact

SEQ ID NO: 8790422 - DNA, 22 bp, Homo sapiens
accacccattcagaaacactga

SEQ ID NO: 8790423 - DNA, 22 bp, Homo sapiens
accaccaggggattttcagaac

SEQ ID NO: 8790424 - DNA, 22 bp, Homo sapiens
accacccccttgggtgtggaag

SEQ ID NO: 8790425 - DNA, 22 bp, Homo sapiens
accacccccttgggtgtggaag

SEQ ID NO: 8790426 - DNA, 22 bp, Homo sapiens
accacagtttcattcatgcagg

SEQ ID NO: 8790427 - DNA, 18 bp, Homo sapiens
accacatgatatcttgcc

SEQ ID NO: 8790428 - DNA, 22 bp, Homo sapiens
accacagtgggccacaagaagt

SEQ ID NO: 8790429 - DNA, 22 bp, Homo sapiens
accacagtctcgaagcactgca

SEQ ID NO: 8790430 - DNA, 22 bp, Homo sapiens
accacagtatgaaatctgaaat

SEQ ID NO: 8790431 - DNA, 22 bp, Homo sapiens
accacctcatcaagctggattg

SEQ ID NO: 8790432 - DNA, 22 bp, Homo sapiens
accactgcactccagtctgggc

SEQ ID NO: 8790433 - DNA, 22 bp, Homo sapiens
aagggcagcctgactcacggtc

SEQ ID NO: 8790434 - DNA, 22 bp, Homo sapiens
aagggcagcctgactcacggtc

SEQ ID NO: 8790435 - DNA, 22 bp, Homo sapiens
aagggcagcctgactcacggtc

SEQ ID NO: 8790436 - DNA, 22 bp, Homo sapiens
aagggcagctattatcgtcatc

SEQ ID NO: 8790437 - DNA, 22 bp, Homo sapiens
aagggcagctattatcgtcatc

SEQ ID NO: 8790438 - DNA, 22 bp, Homo sapiens
aagggcagctgacagatgctta

SEQ ID NO: 8790439 - DNA, 22 bp, Homo sapiens
aagggcagctgacagatgctta

SEQ ID NO: 8790440 - DNA, 22 bp, Homo sapiens
aagggcagctgacagatgctta

SEQ ID NO: 8790441 - DNA, 22 bp, Homo sapiens
accagcacttccagaggtcagg

SEQ ID NO: 8790442 - DNA, 22 bp, Homo sapiens
accagcacttccagaggtcagg

SEQ ID NO: 8790443 - DNA, 22 bp, Homo sapiens
aagggcagcttaaattggtagc

SEQ ID NO: 8790444 - DNA, 22 bp, Homo sapiens
accagctgccttttcttagtag

SEQ ID NO: 8790445 - DNA, 22 bp, Homo sapiens
accagctgccttttcttagtag

SEQ ID NO: 8790446 - DNA, 22 bp, Homo sapiens
accagctgctgattgctaaatg

SEQ ID NO: 8790447 - DNA, 22 bp, Homo sapiens
accagctgccttttcttagtag

SEQ ID NO: 8790448 - DNA, 23 bp, Homo sapiens
accagctgccctgaactttgtgc

SEQ ID NO: 8790449 - DNA, 23 bp, Homo sapiens
accagctgccctgaactttgtgc

SEQ ID NO: 8790450 - DNA, 23 bp, Homo sapiens
accagctgccctgaactttgtgc

SEQ ID NO: 8790451 - DNA, 22 bp, Homo sapiens
accagctgcctggtctatctgc

SEQ ID NO: 8790452 - DNA, 22 bp, Homo sapiens
accagctgccaagggctacact

SEQ ID NO: 8790453 - DNA, 22 bp, Homo sapiens
accagctgatttaagaataaag

SEQ ID NO: 8790454 - DNA, 22 bp, Homo sapiens
accagctgagttctcggatggt

SEQ ID NO: 8790455 - DNA, 22 bp, Homo sapiens
aaggttccctctctggaagcct

SEQ ID NO: 8790456 - DNA, 22 bp, Homo sapiens
aaggttgcagcagtgttgatga

SEQ ID NO: 8790457 - DNA, 22 bp, Homo sapiens
aaggtttaaggtctataaatgt

SEQ ID NO: 8790458 - DNA, 22 bp, Homo sapiens
aaggttgctgttttgcttcaaa

SEQ ID NO: 8790459 - DNA, 22 bp, Homo sapiens
accaggccaaaatcatatttac

SEQ ID NO: 8790460 - DNA, 21 bp, Homo sapiens
accaggccaggaggctggcac

SEQ ID NO: 8790461 - DNA, 22 bp, Homo sapiens
accaggcatgatgtggagcaca

SEQ ID NO: 8790462 - DNA, 22 bp, Homo sapiens
accaggcatgatgtggagcaca

SEQ ID NO: 8790463 - DNA, 22 bp, Homo sapiens
accaggcatgatgtggagcaca

SEQ ID NO: 8790464 - DNA, 22 bp, Homo sapiens
accaggcatgatgtggagcaca

SEQ ID NO: 8790465 - DNA, 22 bp, Homo sapiens
aagtaaaacacacagtccaccg

SEQ ID NO: 8790466 - DNA, 22 bp, Homo sapiens
aagtaaaacacacagtccaccg

SEQ ID NO: 8790467 - DNA, 22 bp, Homo sapiens
aagtaaaacacacagtccaccg

SEQ ID NO: 8790468 - DNA, 22 bp, Homo sapiens
aagtaaaacacacagtccaccg

SEQ ID NO: 8790469 - DNA, 22 bp, Homo sapiens
aagtaaaagcaggtgtgctggg

SEQ ID NO: 8790470 - DNA, 22 bp, Homo sapiens
aagtaaaacacacagtccaccg

SEQ ID NO: 8790471 - DNA, 22 bp, Homo sapiens
aagtaaaacacacagtccaccg

SEQ ID NO: 8790472 - DNA, 22 bp, Homo sapiens
aagtaaaattcaatcttcactg

SEQ ID NO: 8790473 - DNA, 22 bp, Homo sapiens
aagtaaaattcaatcttcactg

SEQ ID NO: 8790474 - DNA, 22 bp, Homo sapiens
aagtaaaattcaatcttcactg

SEQ ID NO: 8790475 - DNA, 22 bp, Homo sapiens
aagtaaaattcaatcttcactg

SEQ ID NO: 8790476 - DNA, 22 bp, Homo sapiens
aagtaaaatgtttcctttatta

SEQ ID NO: 8790477 - DNA, 22 bp, Homo sapiens
aagtaaaatgtttcctttatta

SEQ ID NO: 8790478 - DNA, 22 bp, Homo sapiens
aagtaaaagctttaccatgcgc

SEQ ID NO: 8790479 - DNA, 22 bp, Homo sapiens
aagtaaaagctttaccatgcgc

SEQ ID NO: 8790480 - DNA, 22 bp, Homo sapiens
accaggcaactgtgaatgggct

SEQ ID NO: 8790481 - DNA, 22 bp, Homo sapiens
accaggcactcctgaggtctga

SEQ ID NO: 8790482 - DNA, 22 bp, Homo sapiens
accaggcaaaaccacaggagca

SEQ ID NO: 8790483 - DNA, 22 bp, Homo sapiens
accaggcaaaaccacaggagca

SEQ ID NO: 8790484 - DNA, 22 bp, Homo sapiens
accaggcaaaaccacaggagca

SEQ ID NO: 8790485 - DNA, 22 bp, Homo sapiens
accaggcagtcaccgtccagga

SEQ ID NO: 8790486 - DNA, 22 bp, Homo sapiens
accaggcagctgggggtgatgt

SEQ ID NO: 8790487 - DNA, 22 bp, Homo sapiens
accaggcagtatggtgctgcaa

SEQ ID NO: 8790488 - DNA, 22 bp, Homo sapiens
accaggcagtatggtgctgcaa

SEQ ID NO: 8790489 - DNA, 22 bp, Homo sapiens
accaggcagagctgggccttaa

SEQ ID NO: 8790490 - DNA, 22 bp, Homo sapiens
accaggcactcttgtggcagtg

SEQ ID NO: 8790491 - DNA, 22 bp, Homo sapiens
accaggcactcttgtggcagtg

SEQ ID NO: 8790492 - DNA, 22 bp, Homo sapiens
accagctggtcacctgggcact

SEQ ID NO: 8790493 - DNA, 22 bp, Homo sapiens
accagctggtcacctgggcact

SEQ ID NO: 8790494 - DNA, 22 bp, Homo sapiens
accagctggcccatgagcacgt

SEQ ID NO: 8790495 - DNA, 22 bp, Homo sapiens
accagctggcccatgagcacgt

SEQ ID NO: 8790496 - DNA, 22 bp, Homo sapiens
accagctgtgtcctggctgcag

SEQ ID NO: 8790497 - DNA, 22 bp, Homo sapiens
accagctgtgtcctggctgcag

SEQ ID NO: 8790498 - DNA, 22 bp, Homo sapiens
accagctggtcagggcttttct

SEQ ID NO: 8790499 - DNA, 22 bp, Homo sapiens
accagctggtcagggcttttct

SEQ ID NO: 8790500 - DNA, 22 bp, Homo sapiens
accagctggtcagttgaagatt

SEQ ID NO: 8790501 - DNA, 22 bp, Homo sapiens
accaggaaactgtgcccacgac

SEQ ID NO: 8790502 - DNA, 22 bp, Homo sapiens
accaggagttttgaccaggggc

SEQ ID NO: 8790503 - DNA, 22 bp, Homo sapiens
accaggagttttgaccaggggc

SEQ ID NO: 8790504 - DNA, 22 bp, Homo sapiens
accagctgttatctgtagtatc

SEQ ID NO: 8790505 - DNA, 22 bp, Homo sapiens
accagctgttaggcttggtgct

SEQ ID NO: 8790506 - DNA, 22 bp, Homo sapiens
accagctgtgtgacctgaggca

SEQ ID NO: 8790507 - DNA, 22 bp, Homo sapiens
accagctgttaggcttggtgct

SEQ ID NO: 8790508 - DNA, 22 bp, Homo sapiens
accagctgtgtgacttttaatg

SEQ ID NO: 8790509 - DNA, 22 bp, Homo sapiens
acagattttggtatttgcaatg

SEQ ID NO: 8790510 - DNA, 22 bp, Homo sapiens
acagatttttcagctcctgtgt

SEQ ID NO: 8790511 - DNA, 22 bp, Homo sapiens
acagattttggtatttgcaatg

SEQ ID NO: 8790512 - DNA, 22 bp, Homo sapiens
acagattttggtatttgcaatg

SEQ ID NO: 8790513 - DNA, 22 bp, Homo sapiens
acagattttggtatttgcaatg

SEQ ID NO: 8790514 - DNA, 21 bp, Homo sapiens
acagattttatatctctgctg

SEQ ID NO: 8790515 - DNA, 21 bp, Homo sapiens
acagattttatatctctgctg

SEQ ID NO: 8790516 - DNA, 22 bp, Homo sapiens
acagattttaaatttgtagttg

SEQ ID NO: 8790517 - DNA, 22 bp, Homo sapiens
acagattttaaatttgtagttg

SEQ ID NO: 8790518 - DNA, 16 bp, Homo sapiens
acagcttgaagctagg

SEQ ID NO: 8790519 - DNA, 22 bp, Homo sapiens
acagctggagtgttggtgaggt

SEQ ID NO: 8790520 - DNA, 22 bp, Homo sapiens
acagctggagtgttggtgaggt

SEQ ID NO: 8790521 - DNA, 22 bp, Homo sapiens
acagcttgcacaagggaactca

SEQ ID NO: 8790522 - DNA, 22 bp, Homo sapiens
acagcttgaatcttaagctctt

SEQ ID NO: 8790523 - DNA, 22 bp, Homo sapiens
acagatttttggtaaataattt

SEQ ID NO: 8790524 - DNA, 22 bp, Homo sapiens
acagatttttcagctcctgtgt

SEQ ID NO: 8790525 - DNA, 22 bp, Homo sapiens
acagatttttggtaaataattt

SEQ ID NO: 8790526 - DNA, 22 bp, Homo sapiens
acagatttttggtaaataattt

SEQ ID NO: 8790527 - DNA, 22 bp, Homo sapiens
acagatttttggtaaataattt

SEQ ID NO: 8790528 - DNA, 22 bp, Homo sapiens
acagatgaggaatttatttggt

SEQ ID NO: 8790529 - DNA, 22 bp, Homo sapiens
acagatgaggaaacagggtcag

SEQ ID NO: 8790530 - DNA, 22 bp, Homo sapiens
acagatgagaaggctgaccagt

SEQ ID NO: 8790531 - DNA, 22 bp, Homo sapiens
acagatgagactccaggacctt

SEQ ID NO: 8790532 - DNA, 22 bp, Homo sapiens
acagatgagagacaatgtgcta

SEQ ID NO: 8790533 - DNA, 20 bp, Homo sapiens
acagatgaggaaaatgaagt

SEQ ID NO: 8790534 - DNA, 22 bp, Homo sapiens
acagatttggcccagccaatgc

SEQ ID NO: 8790535 - DNA, 22 bp, Homo sapiens
acagatttggcccagccaatgc

SEQ ID NO: 8790536 - DNA, 22 bp, Homo sapiens
acagatttgttcttttgggcta

SEQ ID NO: 8790537 - DNA, 22 bp, Homo sapiens
acagattttaaatgacactccc

SEQ ID NO: 8790538 - DNA, 22 bp, Homo sapiens
acagatttgatctgagaacaaa

SEQ ID NO: 8790539 - DNA, 22 bp, Homo sapiens
acagatttgatctgagaacaaa

SEQ ID NO: 8790540 - DNA, 22 bp, Homo sapiens
acagatttattgaagctgctgc

SEQ ID NO: 8790541 - DNA, 22 bp, Homo sapiens
acagatttgactggtacctggc

SEQ ID NO: 8790542 - DNA, 22 bp, Homo sapiens
acagctttttactaatagattg

SEQ ID NO: 8790543 - DNA, 22 bp, Homo sapiens
acagctttttactaatagattg

SEQ ID NO: 8790544 - DNA, 22 bp, Homo sapiens
acagcttttatgggaccagcca

SEQ ID NO: 8790545 - DNA, 22 bp, Homo sapiens
acagcttttatgggaccagcca

SEQ ID NO: 8790546 - DNA, 22 bp, Homo sapiens
acagcttttcaattctgctgag

SEQ ID NO: 8790547 - DNA, 22 bp, Homo sapiens
acagcttttctgatagatcctg

SEQ ID NO: 8790548 - DNA, 22 bp, Homo sapiens
acagcttttgaaaaattactgg

SEQ ID NO: 8790549 - DNA, 22 bp, Homo sapiens
acagctttttactaatagattg

SEQ ID NO: 8790550 - DNA, 22 bp, Homo sapiens
acagctttagtgtgggtggtgc

SEQ ID NO: 8790551 - DNA, 22 bp, Homo sapiens
acagctttatctcagggatcag

SEQ ID NO: 8790552 - DNA, 22 bp, Homo sapiens
acagctttgggcaatgctatga

SEQ ID NO: 8790553 - DNA, 22 bp, Homo sapiens
acagctttatctcagggatcag

SEQ ID NO: 8790554 - DNA, 22 bp, Homo sapiens
acagctttgggcaatgctatga

SEQ ID NO: 8790555 - DNA, 22 bp, Homo sapiens
acagctttgttttccctgctga

SEQ ID NO: 8790556 - DNA, 22 bp, Homo sapiens
acagctttgtgttaatgggaag

SEQ ID NO: 8790557 - DNA, 22 bp, Homo sapiens
acagcttgtatcccaatggagc

SEQ ID NO: 8790558 - DNA, 22 bp, Homo sapiens
acagcttgtctggtttcaggtc

SEQ ID NO: 8790559 - DNA, 22 bp, Homo sapiens
acagcttgtctggtttcaggtc

SEQ ID NO: 8790560 - DNA, 22 bp, Homo sapiens
acagcttgtctaccccagaggt

SEQ ID NO: 8790561 - DNA, 22 bp, Homo sapiens
acagcttgtatcccaatggagc

SEQ ID NO: 8790562 - DNA, 22 bp, Homo sapiens
acagcttgggatgctttatttc

SEQ ID NO: 8790563 - DNA, 22 bp, Homo sapiens
acagcttggggaggccctggga

SEQ ID NO: 8790564 - DNA, 22 bp, Homo sapiens
acagcttgtagaggccctggca

SEQ ID NO: 8790565 - DNA, 22 bp, Homo sapiens
acagcttgcaatggctttcaac

SEQ ID NO: 8790566 - DNA, 22 bp, Homo sapiens
acagcttgcatgcagaggcact

SEQ ID NO: 8790567 - DNA, 23 bp, Homo sapiens
acagcttgccaattagccttccg

SEQ ID NO: 8790568 - DNA, 22 bp, Homo sapiens
acagcttgctgtgccccctgcc

SEQ ID NO: 8790569 - DNA, 21 bp, Homo sapiens
acaggagaccgcctggcagtc

SEQ ID NO: 8790570 - DNA, 21 bp, Homo sapiens
acaggagaccgcctggcagtc

SEQ ID NO: 8790571 - DNA, 22 bp, Homo sapiens
acaggaaccaggcaggtcgatt

SEQ ID NO: 8790572 - DNA, 21 bp, Homo sapiens
acaggagaccgcctggcagtc

SEQ ID NO: 8790573 - DNA, 21 bp, Homo sapiens
acaggagaccgcctggcagtc

SEQ ID NO: 8790574 - DNA, 22 bp, Homo sapiens
acaggaaattggcatatcagtt

SEQ ID NO: 8790575 - DNA, 22 bp, Homo sapiens
acaggaaattggcatatcagtt

SEQ ID NO: 8790576 - DNA, 22 bp, Homo sapiens
acaggaaagagctaggcatagg

SEQ ID NO: 8790577 - DNA, 22 bp, Homo sapiens
acaggaaatgaaatggtatcta

SEQ ID NO: 8790578 - DNA, 22 bp, Homo sapiens
acaggaaatgaaatggtatcta

SEQ ID NO: 8790579 - DNA, 22 bp, Homo sapiens
acaggaaagagctaggcatagg

SEQ ID NO: 8790580 - DNA, 22 bp, Homo sapiens
acaggaaagagctaggcatagg

SEQ ID NO: 8790581 - DNA, 22 bp, Homo sapiens
acaggagctctagggacagcac

SEQ ID NO: 8790582 - DNA, 22 bp, Homo sapiens
acaggagccaaacacatgccag

SEQ ID NO: 8790583 - DNA, 22 bp, Homo sapiens
acaggaggagcagctgtgtgcc

SEQ ID NO: 8790584 - DNA, 22 bp, Homo sapiens
acaggaggagcagctgtgtgcc

SEQ ID NO: 8790585 - DNA, 22 bp, Homo sapiens
acaggaggagcagctgtgtgcc

SEQ ID NO: 8790586 - DNA, 20 bp, Homo sapiens
acaggagatctgaggaaagg

SEQ ID NO: 8790587 - DNA, 20 bp, Homo sapiens
acaggagatctgaggaaagg

SEQ ID NO: 8790588 - DNA, 20 bp, Homo sapiens
acaggagatctgaggaaagg

SEQ ID NO: 8790589 - DNA, 20 bp, Homo sapiens
acaggagatctgaggaaagg

SEQ ID NO: 8790590 - DNA, 22 bp, Homo sapiens
acaggagcaacagactaagaca

SEQ ID NO: 8790591 - DNA, 22 bp, Homo sapiens
acaggagccaaacacatgccag

SEQ ID NO: 8790592 - DNA, 19 bp, Homo sapiens
acaggcagaattgggtgtg

SEQ ID NO: 8790593 - DNA, 22 bp, Homo sapiens
acaggcagagaactcagccaga

SEQ ID NO: 8790594 - DNA, 22 bp, Homo sapiens
acaggcagagaactcagccaga

SEQ ID NO: 8790595 - DNA, 19 bp, Homo sapiens
acaggcagaattgggtgtg

SEQ ID NO: 8790596 - DNA, 22 bp, Homo sapiens
acaggcactttgacatgccatc

SEQ ID NO: 8790597 - DNA, 22 bp, Homo sapiens
acaggcactttgacatgccatc

SEQ ID NO: 8790598 - DNA, 19 bp, Homo sapiens
acaggcagaattgggtgtg

SEQ ID NO: 8790599 - DNA, 22 bp, Homo sapiens
acaggcactttgacatgccatc

SEQ ID NO: 8790600 - DNA, 22 bp, Homo sapiens
acaggcactgtcaagtcatgaa

SEQ ID NO: 8790601 - DNA, 22 bp, Homo sapiens
acaggcactctcattaaaatag

SEQ ID NO: 8790602 - DNA, 22 bp, Homo sapiens
acaggaggagctgtttcaggga

SEQ ID NO: 8790603 - DNA, 22 bp, Homo sapiens
acaggaggagctgtttcaggga

SEQ ID NO: 8790604 - DNA, 22 bp, Homo sapiens
acaggaggagctgtttcaggga

SEQ ID NO: 8790605 - DNA, 22 bp, Homo sapiens
acaggcacctgccaccacatct

SEQ ID NO: 8790606 - DNA, 22 bp, Homo sapiens
acaggcacctgccaccacatct

SEQ ID NO: 8790607 - DNA, 22 bp, Homo sapiens
acaggcactgtcaagtcatgaa

SEQ ID NO: 8790608 - DNA, 22 bp, Homo sapiens
acaggcactttgacatgccatc

SEQ ID NO: 8790609 - DNA, 22 bp, Homo sapiens
acaggcactgtcaagtcatgaa

SEQ ID NO: 8790610 - DNA, 22 bp, Homo sapiens
acaggcagagaactcagccaga

SEQ ID NO: 8790611 - DNA, 22 bp, Homo sapiens
acaggcagagtcaggttgggtt

SEQ ID NO: 8790612 - DNA, 22 bp, Homo sapiens
acaggcagagagtggcggactc

SEQ ID NO: 8790613 - DNA, 22 bp, Homo sapiens
acaggcagagtcaggttgggtt

SEQ ID NO: 8790614 - DNA, 22 bp, Homo sapiens
acaggcagagagtggcggactc

SEQ ID NO: 8790615 - DNA, 22 bp, Homo sapiens
acaggcagagagtggcggactc

SEQ ID NO: 8790616 - DNA, 22 bp, Homo sapiens
acaggcagagagtggcggactc

SEQ ID NO: 8790617 - DNA, 22 bp, Homo sapiens
acaggcagagagtggcggactc

SEQ ID NO: 8790618 - DNA, 22 bp, Homo sapiens
aagccctgagcactgcagagaa

SEQ ID NO: 8790619 - DNA, 22 bp, Homo sapiens
aagccctgagcactgcagagaa

SEQ ID NO: 8790620 - DNA, 22 bp, Homo sapiens
aagccctgacctgagagtccgt

SEQ ID NO: 8790621 - DNA, 22 bp, Homo sapiens
aagccctgactatgaagacata

SEQ ID NO: 8790622 - DNA, 22 bp, Homo sapiens
aagccctgcagtctctgccaca

SEQ ID NO: 8790623 - DNA, 22 bp, Homo sapiens
aagccctgataggaaaatgctg

SEQ ID NO: 8790624 - DNA, 22 bp, Homo sapiens
acaggctctggggcaggatggc

SEQ ID NO: 8790625 - DNA, 22 bp, Homo sapiens
acaggctctggggcaggatggc

SEQ ID NO: 8790626 - DNA, 22 bp, Homo sapiens
acaggccagaggtggggcagcc

SEQ ID NO: 8790627 - DNA, 22 bp, Homo sapiens
aagccctggctcagctcaccag

SEQ ID NO: 8790628 - DNA, 22 bp, Homo sapiens
acaggccagaggtggggcagcc

SEQ ID NO: 8790629 - DNA, 22 bp, Homo sapiens
aagccctggcgggtggagggcc

SEQ ID NO: 8790630 - DNA, 22 bp, Homo sapiens
aagccctggcgggtggagggcc

SEQ ID NO: 8790631 - DNA, 22 bp, Homo sapiens
aagccctggcccaaccttgatt

SEQ ID NO: 8790632 - DNA, 22 bp, Homo sapiens
aagccctggcaatgtcagatga

SEQ ID NO: 8790633 - DNA, 22 bp, Homo sapiens
aagccctggcaatgtcagatga

SEQ ID NO: 8790634 - DNA, 22 bp, Homo sapiens
aagccctggattaaagatgcca

SEQ ID NO: 8790635 - DNA, 22 bp, Homo sapiens
aagccctggattaaagatgcca

SEQ ID NO: 8790636 - DNA, 22 bp, Homo sapiens
aagccctggatagagagaactg

SEQ ID NO: 8790637 - DNA, 22 bp, Homo sapiens
aagccctgccacccattcactg

SEQ ID NO: 8790638 - DNA, 22 bp, Homo sapiens
aagccctggaactttcctagcc

SEQ ID NO: 8790639 - DNA, 22 bp, Homo sapiens
aagccctggacggcccttcccc

SEQ ID NO: 8790640 - DNA, 22 bp, Homo sapiens
acaggctgagcgtccatcttca

SEQ ID NO: 8790641 - DNA, 22 bp, Homo sapiens
acaggctgagcgtccatcttca

SEQ ID NO: 8790642 - DNA, 22 bp, Homo sapiens
acaggctgagcgtccatcttca

SEQ ID NO: 8790643 - DNA, 22 bp, Homo sapiens
acaggctgacttcctgccatgt

SEQ ID NO: 8790644 - DNA, 22 bp, Homo sapiens
acaggctgaggatgattgcatc

SEQ ID NO: 8790645 - DNA, 22 bp, Homo sapiens
acaggctgaggatgattgcatc

SEQ ID NO: 8790646 - DNA, 22 bp, Homo sapiens
acaggctctggggcaggatggc

SEQ ID NO: 8790647 - DNA, 23 bp, Homo sapiens
acaggctcttaatcagtgctcct

SEQ ID NO: 8790648 - DNA, 22 bp, Homo sapiens
acaggctgaaagttaagttctg

SEQ ID NO: 8790649 - DNA, 22 bp, Homo sapiens
acaggctgaaagttaagttctg

SEQ ID NO: 8790650 - DNA, 22 bp, Homo sapiens
acaggctgacttcctgccatgt

SEQ ID NO: 8790651 - DNA, 22 bp, Homo sapiens
acaggctgatagaccataaata

SEQ ID NO: 8790652 - DNA, 22 bp, Homo sapiens
acaggcttactgtttcataggg

SEQ ID NO: 8790653 - DNA, 22 bp, Homo sapiens
acaggctgccacttgcatccaa

SEQ ID NO: 8790654 - DNA, 22 bp, Homo sapiens
acaggctgccacttgcatccaa

SEQ ID NO: 8790655 - DNA, 22 bp, Homo sapiens
acaggcttcttttgaaatcaga

SEQ ID NO: 8790656 - DNA, 22 bp, Homo sapiens
acaggcttgcactagggtggca

SEQ ID NO: 8790657 - DNA, 22 bp, Homo sapiens
acaggcttctcacagaaaaggg

SEQ ID NO: 8790658 - DNA, 22 bp, Homo sapiens
acaggcttgcactagggtggca

SEQ ID NO: 8790659 - DNA, 22 bp, Homo sapiens
acaggcttggcagctatcattt

SEQ ID NO: 8790660 - DNA, 22 bp, Homo sapiens
acaggcttggggctcagacaga

SEQ ID NO: 8790661 - DNA, 22 bp, Homo sapiens
acaggcttggggctcagacaga

SEQ ID NO: 8790662 - DNA, 22 bp, Homo sapiens
acaggcttactgtttcataggg

SEQ ID NO: 8790663 - DNA, 22 bp, Homo sapiens
acaggcttactgtttcataggg

SEQ ID NO: 8790664 - DNA, 22 bp, Homo sapiens
acaggcttagggcaggctgacc

SEQ ID NO: 8790665 - DNA, 22 bp, Homo sapiens
acaggcttagggcaggctgacc

SEQ ID NO: 8790666 - DNA, 22 bp, Homo sapiens
acaggcttcagatgtattaact

SEQ ID NO: 8790667 - DNA, 22 bp, Homo sapiens
acaggcttcattacttcagcgt

SEQ ID NO: 8790668 - DNA, 23 bp, Homo sapiens
acagggcttatctgtcactcatc

SEQ ID NO: 8790669 - DNA, 22 bp, Homo sapiens
acaggcttttttagaatgacat

SEQ ID NO: 8790670 - DNA, 22 bp, Homo sapiens
acaggcttttttgctctcgaat

SEQ ID NO: 8790671 - DNA, 22 bp, Homo sapiens
acaggtagatacatacttctaa

SEQ ID NO: 8790672 - DNA, 23 bp, Homo sapiens
acaggtacacttgattgcaatcc

SEQ ID NO: 8790673 - DNA, 22 bp, Homo sapiens
acaggtactttgtaatgaagga

SEQ ID NO: 8790674 - DNA, 22 bp, Homo sapiens
acaggtaccggtcagattacgg

SEQ ID NO: 8790675 - DNA, 22 bp, Homo sapiens
acaggtaccggtcagattacgg

SEQ ID NO: 8790676 - DNA, 22 bp, Homo sapiens
acaggtagcatttttcctcttt

SEQ ID NO: 8790677 - DNA, 22 bp, Homo sapiens
acaggtagcatttttcctcttt

SEQ ID NO: 8790678 - DNA, 22 bp, Homo sapiens
acaggctttaaatttaaaacca

SEQ ID NO: 8790679 - DNA, 21 bp, Homo sapiens
acaggctttagaaaatgactc

SEQ ID NO: 8790680 - DNA, 20 bp, Homo sapiens
acaggctttctgaggctggc

SEQ ID NO: 8790681 - DNA, 23 bp, Homo sapiens
acagggaaaagtcatcagtgtga

SEQ ID NO: 8790682 - DNA, 22 bp, Homo sapiens
acaggctttggcgaggcccatc

SEQ ID NO: 8790683 - DNA, 20 bp, Homo sapiens
acaggctttggagtctgaat

SEQ ID NO: 8790684 - DNA, 22 bp, Homo sapiens
acaggtcaacgagagcaggcaa

SEQ ID NO: 8790685 - DNA, 22 bp, Homo sapiens
acaggtcagataaaggctggtg

SEQ ID NO: 8790686 - DNA, 22 bp, Homo sapiens
acaggtctgcagtaactgggaa

SEQ ID NO: 8790687 - DNA, 22 bp, Homo sapiens
acaggtctccagagtgagagga

SEQ ID NO: 8790688 - DNA, 22 bp, Homo sapiens
acaggtctactggcaagcagtg

SEQ ID NO: 8790689 - DNA, 22 bp, Homo sapiens
acaggtctactggcaagcagtg

SEQ ID NO: 8790690 - DNA, 22 bp, Homo sapiens
acaggtctgtgtgcacagtgct

SEQ ID NO: 8790691 - DNA, 22 bp, Homo sapiens
acaggtctggtctgggtgggac

SEQ ID NO: 8790692 - DNA, 22 bp, Homo sapiens
acaggtgacctgctcatatgaa

SEQ ID NO: 8790693 - DNA, 22 bp, Homo sapiens
acaggtgacctgctcatatgaa

SEQ ID NO: 8790694 - DNA, 22 bp, Homo sapiens
acagtgccctatgaacagctct

SEQ ID NO: 8790695 - DNA, 22 bp, Homo sapiens
acagtgccctatgaacagctct

SEQ ID NO: 8790696 - DNA, 22 bp, Homo sapiens
acagtgcattattgctgaatgc

SEQ ID NO: 8790697 - DNA, 20 bp, Homo sapiens
acagtgcatggggggacagc

SEQ ID NO: 8790698 - DNA, 20 bp, Homo sapiens
acagtgcatggggggacagc

SEQ ID NO: 8790699 - DNA, 20 bp, Homo sapiens
acagtgcatggggggacagc

SEQ ID NO: 8790700 - DNA, 19 bp, Homo sapiens
acagtgcatgggacctggt

SEQ ID NO: 8790701 - DNA, 19 bp, Homo sapiens
acagtgcatgggacctggt

SEQ ID NO: 8790702 - DNA, 22 bp, Homo sapiens
acagtgcaggtctcaacaatta

SEQ ID NO: 8790703 - DNA, 22 bp, Homo sapiens
acagtgcaggtctcaacaatta

SEQ ID NO: 8790704 - DNA, 22 bp, Homo sapiens
acagtgcagtgtgatgagtatt

SEQ ID NO: 8790705 - DNA, 22 bp, Homo sapiens
acagtgcataaaaacaactttt

SEQ ID NO: 8790706 - DNA, 22 bp, Homo sapiens
acaggtgattcaggctctggga

SEQ ID NO: 8790707 - DNA, 22 bp, Homo sapiens
acaggtgtaggtacatttgcat

SEQ ID NO: 8790708 - DNA, 22 bp, Homo sapiens
acaggtgtagcaggagcatcaa

SEQ ID NO: 8790709 - DNA, 22 bp, Homo sapiens
acaggtgtagcaggagcatcaa

SEQ ID NO: 8790710 - DNA, 22 bp, Homo sapiens
acaggtgtgagaacatgccttg

SEQ ID NO: 8790711 - DNA, 22 bp, Homo sapiens
acaggtgtatgaatatgttcca

SEQ ID NO: 8790712 - DNA, 22 bp, Homo sapiens
acaggtgtctaaggcagacagc

SEQ ID NO: 8790713 - DNA, 22 bp, Homo sapiens
acaggtgtcctcacagggggtg

SEQ ID NO: 8790714 - DNA, 22 bp, Homo sapiens
acaggtgtctaaggcagacagc

SEQ ID NO: 8790715 - DNA, 22 bp, Homo sapiens
acaggtgtctgcaagttactgg

SEQ ID NO: 8790716 - DNA, 22 bp, Homo sapiens
acagtgtagtgtgatgtcaaaa

SEQ ID NO: 8790717 - DNA, 22 bp, Homo sapiens
acagtgtagtgtgatgtcaaaa

SEQ ID NO: 8790718 - DNA, 22 bp, Homo sapiens
acagtgtatattgtttatctgg

SEQ ID NO: 8790719 - DNA, 22 bp, Homo sapiens
acagtgtactaggtacatgttc

SEQ ID NO: 8790720 - DNA, 22 bp, Homo sapiens
acagtgtagaatcctgtactta

SEQ ID NO: 8790721 - DNA, 22 bp, Homo sapiens
acagtgtccttgtggtccctgt

SEQ ID NO: 8790722 - DNA, 22 bp, Homo sapiens
acagtgtcatcagtttctcaac

SEQ ID NO: 8790723 - DNA, 22 bp, Homo sapiens
acagtgtccccagctctgtgag

SEQ ID NO: 8790724 - DNA, 22 bp, Homo sapiens
acagtgtcatgtcgtgttcccc

SEQ ID NO: 8790725 - DNA, 22 bp, Homo sapiens
acagtgtcatgtcgtgttcccc

SEQ ID NO: 8790726 - DNA, 22 bp, Homo sapiens
acagtggtgagtgactgatagg

SEQ ID NO: 8790727 - DNA, 18 bp, Homo sapiens
acagtggtttgatgtgct

SEQ ID NO: 8790728 - DNA, 18 bp, Homo sapiens
acagtggtttgatgtgct

SEQ ID NO: 8790729 - DNA, 20 bp, Homo sapiens
acagtgggtggggagcactg

SEQ ID NO: 8790730 - DNA, 20 bp, Homo sapiens
acagtgggtggggagcactg

SEQ ID NO: 8790731 - DNA, 20 bp, Homo sapiens
acagtgggtggggagcactg

SEQ ID NO: 8790732 - DNA, 20 bp, Homo sapiens
acagtgggtggggagcactg

SEQ ID NO: 8790733 - DNA, 22 bp, Homo sapiens
acagtgctaatgatgccaagat

SEQ ID NO: 8790734 - DNA, 22 bp, Homo sapiens
acagtgctcatgtgacatggtg

SEQ ID NO: 8790735 - DNA, 22 bp, Homo sapiens
acagtgctcatgtgacatggtg

SEQ ID NO: 8790736 - DNA, 22 bp, Homo sapiens
acagtgcgggctgcggtgggtc

SEQ ID NO: 8790737 - DNA, 22 bp, Homo sapiens
acagtgctgaacgacatggaag

SEQ ID NO: 8790738 - DNA, 22 bp, Homo sapiens
acagtgctgatctagactgacc

SEQ ID NO: 8790739 - DNA, 22 bp, Homo sapiens
actgagactgcccctgtaacaa

SEQ ID NO: 8790740 - DNA, 19 bp, Homo sapiens
actgagaccacagacaagt

SEQ ID NO: 8790741 - DNA, 22 bp, Homo sapiens
actgagaatacaatgttgcagg

SEQ ID NO: 8790742 - DNA, 22 bp, Homo sapiens
aataaaatggtcagttttctca

SEQ ID NO: 8790743 - DNA, 22 bp, Homo sapiens
aataaacttccactgtgttttt

SEQ ID NO: 8790744 - DNA, 19 bp, Homo sapiens
actgagaacctgacccagg

SEQ ID NO: 8790745 - DNA, 22 bp, Homo sapiens
actgagaactcaagagaaaagg

SEQ ID NO: 8790746 - DNA, 22 bp, Homo sapiens
actgagaacttgccaaggactg

SEQ ID NO: 8790747 - DNA, 22 bp, Homo sapiens
actgagaacttgccaaggactg

SEQ ID NO: 8790748 - DNA, 22 bp, Homo sapiens
actgagaacttggggacagagg

SEQ ID NO: 8790749 - DNA, 22 bp, Homo sapiens
actgagaacttggggacagagg

SEQ ID NO: 8790750 - DNA, 22 bp, Homo sapiens
actgagaacttgccaaggactg

SEQ ID NO: 8790751 - DNA, 22 bp, Homo sapiens
actgagaaatagcaagtgtctc

SEQ ID NO: 8790752 - DNA, 22 bp, Homo sapiens
actgagaaagaccacatggaga

SEQ ID NO: 8790753 - DNA, 22 bp, Homo sapiens
actgactttggaatatttctag

SEQ ID NO: 8790754 - DNA, 22 bp, Homo sapiens
actgaccagatatgtcatacct

SEQ ID NO: 8790755 - DNA, 21 bp, Homo sapiens
actgaccacttctgcctgtct

SEQ ID NO: 8790756 - DNA, 21 bp, Homo sapiens
aagttttatgttgccatttgt

SEQ ID NO: 8790757 - DNA, 22 bp, Homo sapiens
aagttttattggaacatagcca

SEQ ID NO: 8790758 - DNA, 22 bp, Homo sapiens
aagttttattggaacatagcca

SEQ ID NO: 8790759 - DNA, 22 bp, Homo sapiens
aagttttatgggaagatgtgca

SEQ ID NO: 8790760 - DNA, 22 bp, Homo sapiens
aagttttatgggaagatgtgca

SEQ ID NO: 8790761 - DNA, 22 bp, Homo sapiens
aagttttatgggaagatgtgca

SEQ ID NO: 8790762 - DNA, 21 bp, Homo sapiens
aagttttatgttgccatttgt

SEQ ID NO: 8790763 - DNA, 22 bp, Homo sapiens
aagttttattggctatagcact

SEQ ID NO: 8790764 - DNA, 22 bp, Homo sapiens
actgacactgactaagacagca

SEQ ID NO: 8790765 - DNA, 22 bp, Homo sapiens
aagttttattggctatagcact

SEQ ID NO: 8790766 - DNA, 22 bp, Homo sapiens
aataaagactcagaggcccagg

SEQ ID NO: 8790767 - DNA, 22 bp, Homo sapiens
aataaagacaaacaggggagcc

SEQ ID NO: 8790768 - DNA, 22 bp, Homo sapiens
aataaagactcagaggcccagg

SEQ ID NO: 8790769 - DNA, 22 bp, Homo sapiens
aataaagaatggatgagatcgt

SEQ ID NO: 8790770 - DNA, 22 bp, Homo sapiens
aataaagaatggatgagatcgt

SEQ ID NO: 8790771 - DNA, 22 bp, Homo sapiens
aataaagcacttgggttggtaa

SEQ ID NO: 8790772 - DNA, 22 bp, Homo sapiens
aataaagtagcgtttaaggtgc

SEQ ID NO: 8790773 - DNA, 22 bp, Homo sapiens
aataaagcctgtctctttagag

SEQ ID NO: 8790774 - DNA, 22 bp, Homo sapiens
aataaagtgtattctttgtcat

SEQ ID NO: 8790775 - DNA, 22 bp, Homo sapiens
aataaagtagcgtttaaggtgc

SEQ ID NO: 8790776 - DNA, 22 bp, Homo sapiens
aataaatgttaagattgtctca

SEQ ID NO: 8790777 - DNA, 22 bp, Homo sapiens
aataaatgtttgttggatgttt

SEQ ID NO: 8790778 - DNA, 22 bp, Homo sapiens
aataaatcaatcctattggtag

SEQ ID NO: 8790779 - DNA, 22 bp, Homo sapiens
aataaatgaacaaagcaggttg

SEQ ID NO: 8790780 - DNA, 22 bp, Homo sapiens
aataaatgaacaaagcaggttg

SEQ ID NO: 8790781 - DNA, 22 bp, Homo sapiens
aataaatgttaagattgtctca

SEQ ID NO: 8790782 - DNA, 22 bp, Homo sapiens
aataaatgtttgttggatgttt

SEQ ID NO: 8790783 - DNA, 22 bp, Homo sapiens
aataaatgtttgttggatgttt

SEQ ID NO: 8790784 - DNA, 22 bp, Homo sapiens
aataacagagtcttcaagatag

SEQ ID NO: 8790785 - DNA, 22 bp, Homo sapiens
aataacagagtcttcaagatag

SEQ ID NO: 8790786 - DNA, 22 bp, Homo sapiens
actcagttccatattggtaagt

SEQ ID NO: 8790787 - DNA, 22 bp, Homo sapiens
actcagttatcatgtgtccaca

SEQ ID NO: 8790788 - DNA, 22 bp, Homo sapiens
actcagtgggcttgatgtcgaa

SEQ ID NO: 8790789 - DNA, 22 bp, Homo sapiens
actcatatactgttgtttttaa

SEQ ID NO: 8790790 - DNA, 22 bp, Homo sapiens
actcatcagcctctaggaaaga

SEQ ID NO: 8790791 - DNA, 22 bp, Homo sapiens
actcatcaactgttacaaatgt

SEQ ID NO: 8790792 - DNA, 23 bp, Homo sapiens
actcatccttgatttgcagatgt

SEQ ID NO: 8790793 - DNA, 22 bp, Homo sapiens
actcatcagtggttttaatcaa

SEQ ID NO: 8790794 - DNA, 23 bp, Homo sapiens
actcagagaccccgggaagtgac

SEQ ID NO: 8790795 - DNA, 22 bp, Homo sapiens
aagtgcataagtatgattattt

SEQ ID NO: 8790796 - DNA, 22 bp, Homo sapiens
actcagagcagagcagcctgag

SEQ ID NO: 8790797 - DNA, 22 bp, Homo sapiens
actcatgtaagcggaatgtagt

SEQ ID NO: 8790798 - DNA, 22 bp, Homo sapiens
actcatgatatgcctataagat

SEQ ID NO: 8790799 - DNA, 22 bp, Homo sapiens
actcatgatatgcctataagat

SEQ ID NO: 8790800 - DNA, 22 bp, Homo sapiens
actcatgtcctaggagtaaagc

SEQ ID NO: 8790801 - DNA, 22 bp, Homo sapiens
actcatgtcctaggagtaaagc

SEQ ID NO: 8790802 - DNA, 22 bp, Homo sapiens
aagtggagtccctacaaccagc

SEQ ID NO: 8790803 - DNA, 22 bp, Homo sapiens
aagtttgtcgaaattatcagca

SEQ ID NO: 8790804 - DNA, 22 bp, Homo sapiens
aagtttgtcgaaattatcagca

SEQ ID NO: 8790805 - DNA, 22 bp, Homo sapiens
aagtttgtagctggatgtctgt

SEQ ID NO: 8790806 - DNA, 22 bp, Homo sapiens
aagtttgtgaggttaatccctt

SEQ ID NO: 8790807 - DNA, 22 bp, Homo sapiens
aagtttgtctcatttgatcttc

SEQ ID NO: 8790808 - DNA, 22 bp, Homo sapiens
aagtttgtggtcatttattata

SEQ ID NO: 8790809 - DNA, 22 bp, Homo sapiens
aagtttgtggttatacttgatt

SEQ ID NO: 8790810 - DNA, 22 bp, Homo sapiens
aagtttgttcattcattcatcc

SEQ ID NO: 8790811 - DNA, 22 bp, Homo sapiens
aagtttgttcagggcttacatt

SEQ ID NO: 8790812 - DNA, 22 bp, Homo sapiens
aagtttgttcattcattcatcc

SEQ ID NO: 8790813 - DNA, 22 bp, Homo sapiens
aagtttgttttagtctaatgat

SEQ ID NO: 8790814 - DNA, 22 bp, Homo sapiens
aagttttaacaagtacttacta

SEQ ID NO: 8790815 - DNA, 22 bp, Homo sapiens
aagttttaacaagtacttacta

SEQ ID NO: 8790816 - DNA, 22 bp, Homo sapiens
aagttttaacaagtacttacta

SEQ ID NO: 8790817 - DNA, 22 bp, Homo sapiens
aagttttactgaggacacatgt

SEQ ID NO: 8790818 - DNA, 22 bp, Homo sapiens
aagttttactgaggacacatgt

SEQ ID NO: 8790819 - DNA, 22 bp, Homo sapiens
aagttttactgaggacacatgt

SEQ ID NO: 8790820 - DNA, 22 bp, Homo sapiens
aagtggctttgagcttctgcca

SEQ ID NO: 8790821 - DNA, 18 bp, Homo sapiens
aagtgggaaaagcaagca

SEQ ID NO: 8790822 - DNA, 22 bp, Homo sapiens
aagtgggaatagaaatgaaggt

SEQ ID NO: 8790823 - DNA, 21 bp, Homo sapiens
aagtttctccctaattgttgc

SEQ ID NO: 8790824 - DNA, 22 bp, Homo sapiens
aagtttggggagaatttcattt

SEQ ID NO: 8790825 - DNA, 22 bp, Homo sapiens
aagtggctcatgtggcttctgc

SEQ ID NO: 8790826 - DNA, 22 bp, Homo sapiens
aagtggctcatgtggcttctgc

SEQ ID NO: 8790827 - DNA, 22 bp, Homo sapiens
aagtggcagttcaggaagcaga

SEQ ID NO: 8790828 - DNA, 22 bp, Homo sapiens
acctggcttctaatcatggctc

SEQ ID NO: 8790829 - DNA, 20 bp, Homo sapiens
acctggcttcctcttggcat

SEQ ID NO: 8790830 - DNA, 22 bp, Homo sapiens
acctggcttcagagtctggcca

SEQ ID NO: 8790831 - DNA, 22 bp, Homo sapiens
acctggcttcagagtctggcca

SEQ ID NO: 8790832 - DNA, 22 bp, Homo sapiens
acctggctgttctcatttctag

SEQ ID NO: 8790833 - DNA, 18 bp, Homo sapiens
acctggctgtgtgagctg

SEQ ID NO: 8790834 - DNA, 22 bp, Homo sapiens
aagtaacagcatcaagtctcaa

SEQ ID NO: 8790835 - DNA, 22 bp, Homo sapiens
aagtaacaatgctgttgaattg

SEQ ID NO: 8790836 - DNA, 18 bp, Homo sapiens
aagtaacagaagagcaca

SEQ ID NO: 8790837 - DNA, 22 bp, Homo sapiens
aagtaacacggaacttgaagca

SEQ ID NO: 8790838 - DNA, 18 bp, Homo sapiens
aagtaacagaagagcaca

SEQ ID NO: 8790839 - DNA, 18 bp, Homo sapiens
aagtaacagaagagcaca

SEQ ID NO: 8790840 - DNA, 22 bp, Homo sapiens
aagtaacagagggggtgttgct

SEQ ID NO: 8790841 - DNA, 22 bp, Homo sapiens
aagtaaacattgagagacaaga

SEQ ID NO: 8790842 - DNA, 23 bp, Homo sapiens
aagtaaacattagaagttgaggt

SEQ ID NO: 8790843 - DNA, 22 bp, Homo sapiens
aagtaaacagataagaaatctg

SEQ ID NO: 8790844 - DNA, 22 bp, Homo sapiens
aagtaaacagataagaaatctg

SEQ ID NO: 8790845 - DNA, 22 bp, Homo sapiens
aagtaaacagataagaaatctg

SEQ ID NO: 8790846 - DNA, 22 bp, Homo sapiens
aagtaaacttacacatagtaaa

SEQ ID NO: 8790847 - DNA, 22 bp, Homo sapiens
aagtaaaccacagagaagccac

SEQ ID NO: 8790848 - DNA, 22 bp, Homo sapiens
aagtaaacattgagagacaaga

SEQ ID NO: 8790849 - DNA, 23 bp, Homo sapiens
aagtaaacattagaagttgaggt

SEQ ID NO: 8790850 - DNA, 22 bp, Homo sapiens
aagtaaacattgagagacaaga

SEQ ID NO: 8790851 - DNA, 22 bp, Homo sapiens
aagtaaacattgagagacaaga

SEQ ID NO: 8790852 - DNA, 21 bp, Homo sapiens
aagtaaatcagagaaataacc

SEQ ID NO: 8790853 - DNA, 22 bp, Homo sapiens
aagtaaaccacagagaagccac

SEQ ID NO: 8790854 - DNA, 22 bp, Homo sapiens
aagtaaatatctgtttatagca

SEQ ID NO: 8790855 - DNA, 21 bp, Homo sapiens
aagtaaatcagagaaataacc

SEQ ID NO: 8790856 - DNA, 22 bp, Homo sapiens
acctgggaaaaggagtggccat

SEQ ID NO: 8790857 - DNA, 22 bp, Homo sapiens
acctgggaacgctttgtggagg

SEQ ID NO: 8790858 - DNA, 20 bp, Homo sapiens
acctgggaaaaccttttcct

SEQ ID NO: 8790859 - DNA, 20 bp, Homo sapiens
acctgggaaaaccttttcct

SEQ ID NO: 8790860 - DNA, 22 bp, Homo sapiens
acctggcttgtttctacctcct

SEQ ID NO: 8790861 - DNA, 22 bp, Homo sapiens
acctggctttggggataggctt

SEQ ID NO: 8790862 - DNA, 22 bp, Homo sapiens
acctgggaggcagaggttgcag

SEQ ID NO: 8790863 - DNA, 22 bp, Homo sapiens
acctgggagagaggagccggcg

SEQ ID NO: 8790864 - DNA, 22 bp, Homo sapiens
acctgggaggcagaggttgcag

SEQ ID NO: 8790865 - DNA, 22 bp, Homo sapiens
acctgggaggcggaggttgcag

SEQ ID NO: 8790866 - DNA, 22 bp, Homo sapiens
acctgggaggcggaggttgcag

SEQ ID NO: 8790867 - DNA, 22 bp, Homo sapiens
acctgggagtatgcagtggtga

SEQ ID NO: 8790868 - DNA, 22 bp, Homo sapiens
acctgggagtatgcagtggtga

SEQ ID NO: 8790869 - DNA, 22 bp, Homo sapiens
acctgggatggggccaggttta

SEQ ID NO: 8790870 - DNA, 20 bp, Homo sapiens
acctgggattagatacccaa

SEQ ID NO: 8790871 - DNA, 22 bp, Homo sapiens
accttctgaccagttatcttga

SEQ ID NO: 8790872 - DNA, 22 bp, Homo sapiens
accttctggtctgcctgacagc

SEQ ID NO: 8790873 - DNA, 22 bp, Homo sapiens
acctgggtctggtgttgggacg

SEQ ID NO: 8790874 - DNA, 22 bp, Homo sapiens
accttcttccaccaaaaacgtc

SEQ ID NO: 8790875 - DNA, 22 bp, Homo sapiens
accttgaacccagcttgctgca

SEQ ID NO: 8790876 - DNA, 22 bp, Homo sapiens
accttgaacccagcttgctgca

SEQ ID NO: 8790877 - DNA, 22 bp, Homo sapiens
accttgaacccagcttgctgca

SEQ ID NO: 8790878 - DNA, 22 bp, Homo sapiens
accttctgaccagttatcttga

SEQ ID NO: 8790879 - DNA, 20 bp, Homo sapiens
acctggggttgcctgtgctc

SEQ ID NO: 8790880 - DNA, 22 bp, Homo sapiens
acctgggtctggtgttgggacg

SEQ ID NO: 8790881 - DNA, 22 bp, Homo sapiens
acctgggcattttggatgatta

SEQ ID NO: 8790882 - DNA, 23 bp, Homo sapiens
accttggacttcccagcttccag

SEQ ID NO: 8790883 - DNA, 22 bp, Homo sapiens
accttggaactgaagtgttttt

SEQ ID NO: 8790884 - DNA, 22 bp, Homo sapiens
accttggaaatgcccattgcct

SEQ ID NO: 8790885 - DNA, 22 bp, Homo sapiens
accttggaaagtttaattgagg

SEQ ID NO: 8790886 - DNA, 20 bp, Homo sapiens
accttgatattatatgcagt

SEQ ID NO: 8790887 - DNA, 22 bp, Homo sapiens
accttgatggggctgttggagt

SEQ ID NO: 8790888 - DNA, 22 bp, Homo sapiens
aagtgaatagcctatttactag

SEQ ID NO: 8790889 - DNA, 22 bp, Homo sapiens
aagtgaatgtagcaaacttgaa

SEQ ID NO: 8790890 - DNA, 22 bp, Homo sapiens
aagtgaatgtttggtagcagtg

SEQ ID NO: 8790891 - DNA, 22 bp, Homo sapiens
aagtgaattcattgtgttatat

SEQ ID NO: 8790892 - DNA, 17 bp, Homo sapiens
aagtgacatcaggctgc

SEQ ID NO: 8790893 - DNA, 22 bp, Homo sapiens
aagtgacataccttacatatgt

SEQ ID NO: 8790894 - DNA, 22 bp, Homo sapiens
aagtgacataaaatctcccagg

SEQ ID NO: 8790895 - DNA, 22 bp, Homo sapiens
aagtgacataaaatctcccagg

SEQ ID NO: 8790896 - DNA, 22 bp, Homo sapiens
aagtgacataccttacatatgt

SEQ ID NO: 8790897 - DNA, 22 bp, Homo sapiens
aagtgacaaaagggtatccaaa

SEQ ID NO: 8790898 - DNA, 22 bp, Homo sapiens
aagtgaatttcattccaattct

SEQ ID NO: 8790899 - DNA, 22 bp, Homo sapiens
aagtgacacatttgtgatgaat

SEQ ID NO: 8790900 - DNA, 22 bp, Homo sapiens
aagtctcttttcttcctgtatt

SEQ ID NO: 8790901 - DNA, 22 bp, Homo sapiens
acctttatcgccatcattgtgc

SEQ ID NO: 8790902 - DNA, 22 bp, Homo sapiens
aagtctctttgggtactttatt

SEQ ID NO: 8790903 - DNA, 22 bp, Homo sapiens
aagtctctttgggtactttatt

SEQ ID NO: 8790904 - DNA, 22 bp, Homo sapiens
aagtctcttttcttcctgtatt

SEQ ID NO: 8790905 - DNA, 22 bp, Homo sapiens
aagtgaaattgccattcttata

SEQ ID NO: 8790906 - DNA, 22 bp, Homo sapiens
aagtgaaattgccattcttata

SEQ ID NO: 8790907 - DNA, 22 bp, Homo sapiens
aagtgaagaaatacatgagaat

SEQ ID NO: 8790908 - DNA, 22 bp, Homo sapiens
accttgtcttttatagaacaag

SEQ ID NO: 8790909 - DNA, 21 bp, Homo sapiens
acctttaattcaagcatcagg

SEQ ID NO: 8790910 - DNA, 22 bp, Homo sapiens
acctttatagctgattatgaca

SEQ ID NO: 8790911 - DNA, 22 bp, Homo sapiens
acctttatagctgattatgaca

SEQ ID NO: 8790912 - DNA, 22 bp, Homo sapiens
acctttatatgaaagatgacat

SEQ ID NO: 8790913 - DNA, 22 bp, Homo sapiens
aagtgagtcacaagtttgcttt

SEQ ID NO: 8790914 - DNA, 22 bp, Homo sapiens
aagtgagtgaaaatgcagaata

SEQ ID NO: 8790915 - DNA, 22 bp, Homo sapiens
aagtgagtggcctggagaggtg

SEQ ID NO: 8790916 - DNA, 22 bp, Homo sapiens
aagtgagtggtaaggagcatgg

SEQ ID NO: 8790917 - DNA, 22 bp, Homo sapiens
aagtgagttgtctgaccctttc

SEQ ID NO: 8790918 - DNA, 22 bp, Homo sapiens
aagtgagttcagcattcactcg

SEQ ID NO: 8790919 - DNA, 22 bp, Homo sapiens
aagtgagttaatggatgtgaac

SEQ ID NO: 8790920 - DNA, 22 bp, Homo sapiens
aagtgagattatatgtacggga

SEQ ID NO: 8790921 - DNA, 22 bp, Homo sapiens
aagtgaggcctaggcactgggt

SEQ ID NO: 8790922 - DNA, 22 bp, Homo sapiens
aagtgactatttgagtacatca

SEQ ID NO: 8790923 - DNA, 22 bp, Homo sapiens
aagtgatctaaagaatattgaa

SEQ ID NO: 8790924 - DNA, 22 bp, Homo sapiens
aagtgatgctacgactttgaca

SEQ ID NO: 8790925 - DNA, 22 bp, Homo sapiens
aagtgatgctacgactttgaca

SEQ ID NO: 8790926 - DNA, 22 bp, Homo sapiens
aagtgatgctacgactttgaca

SEQ ID NO: 8790927 - DNA, 22 bp, Homo sapiens
aagtgatgctacgactttgaca

SEQ ID NO: 8790928 - DNA, 22 bp, Homo sapiens
aagtgatgctacgactttgaca

SEQ ID NO: 8790929 - DNA, 22 bp, Homo sapiens
aagtgattaaccatgctctgct

SEQ ID NO: 8790930 - DNA, 22 bp, Homo sapiens
aagtgattatttaatgcggttt

SEQ ID NO: 8790931 - DNA, 17 bp, Homo sapiens
aagtgattcagccctca

SEQ ID NO: 8790932 - DNA, 22 bp, Homo sapiens
aagtgattccttgcagacacac

SEQ ID NO: 8790933 - DNA, 22 bp, Homo sapiens
aagtgattctagtcatgattct

SEQ ID NO: 8790934 - DNA, 22 bp, Homo sapiens
aagtgattgttccgttgagtgt

SEQ ID NO: 8790935 - DNA, 22 bp, Homo sapiens
aagtgattctagtcatgattct

SEQ ID NO: 8790936 - DNA, 22 bp, Homo sapiens
aagtgattctagtcatgattct

SEQ ID NO: 8790937 - DNA, 22 bp, Homo sapiens
aagtgattctagtcatgattct

SEQ ID NO: 8790938 - DNA, 22 bp, Homo sapiens
aagtgatttagtcttataaagg

SEQ ID NO: 8790939 - DNA, 22 bp, Homo sapiens
aagtgatttagtcttataaagg

SEQ ID NO: 8790940 - DNA, 22 bp, Homo sapiens
aagtgatttagtcttataaagg

SEQ ID NO: 8790941 - DNA, 22 bp, Homo sapiens
aagtgatttgcatgcttaattc

SEQ ID NO: 8790942 - DNA, 22 bp, Homo sapiens
aagtgatttctgcctgcatgtt

SEQ ID NO: 8790943 - DNA, 22 bp, Homo sapiens
aagtgatttctgcctgcatgtt

SEQ ID NO: 8790944 - DNA, 22 bp, Homo sapiens
aagtgattttcccaccatctac

SEQ ID NO: 8790945 - DNA, 22 bp, Homo sapiens
aagtgattttcctacttgctaa

SEQ ID NO: 8790946 - DNA, 22 bp, Homo sapiens
aagtgcaaatctgtggctgaaa

SEQ ID NO: 8790947 - DNA, 22 bp, Homo sapiens
aagtgattttcttcttagttat

SEQ ID NO: 8790948 - DNA, 22 bp, Homo sapiens
aagtgcaatttgaaattctgca

SEQ ID NO: 8790949 - DNA, 22 bp, Homo sapiens
aagtgcaatttgaaattctgca

SEQ ID NO: 8790950 - DNA, 22 bp, Homo sapiens
aagtgcaatttgaaattctgca

SEQ ID NO: 8790951 - DNA, 22 bp, Homo sapiens
aagtgcaatgaatagctgcaat

SEQ ID NO: 8790952 - DNA, 22 bp, Homo sapiens
aagtgcaatgaatagctgcaat

SEQ ID NO: 8790953 - DNA, 22 bp, Homo sapiens
aatctttaaggactcagtctct

SEQ ID NO: 8790954 - DNA, 22 bp, Homo sapiens
aatctttaaggactcagtctct

SEQ ID NO: 8790955 - DNA, 22 bp, Homo sapiens
aatcttgagggactcatgaggt

SEQ ID NO: 8790956 - DNA, 22 bp, Homo sapiens
aatcttgagggactcatgaggt

SEQ ID NO: 8790957 - DNA, 22 bp, Homo sapiens
aatcttgagtgttactctcatt

SEQ ID NO: 8790958 - DNA, 22 bp, Homo sapiens
aatcttggcaaatgtagcttcc

SEQ ID NO: 8790959 - DNA, 22 bp, Homo sapiens
aatcttctttcttaacagtaca

SEQ ID NO: 8790960 - DNA, 22 bp, Homo sapiens
aatcttctacttgacagttctc

SEQ ID NO: 8790961 - DNA, 22 bp, Homo sapiens
aatcttctacttgacagttctc

SEQ ID NO: 8790962 - DNA, 22 bp, Homo sapiens
aatcttcattttgacaagattc

SEQ ID NO: 8790963 - DNA, 22 bp, Homo sapiens
aatcttcattttgacaagattc

SEQ ID NO: 8790964 - DNA, 21 bp, Homo sapiens
aatctttctaaccctggtggc

SEQ ID NO: 8790965 - DNA, 22 bp, Homo sapiens
aatctttctagattccagcggt

SEQ ID NO: 8790966 - DNA, 22 bp, Homo sapiens
aatctttcgtttctcctgtctg

SEQ ID NO: 8790967 - DNA, 21 bp, Homo sapiens
aatctttctaaccctggtggc

SEQ ID NO: 8790968 - DNA, 22 bp, Homo sapiens
aatctttcgtttctcctgtctg

SEQ ID NO: 8790969 - DNA, 22 bp, Homo sapiens
aatctttcaaatttctttgggt

SEQ ID NO: 8790970 - DNA, 22 bp, Homo sapiens
aatctttcattcattcatacat

SEQ ID NO: 8790971 - DNA, 22 bp, Homo sapiens
aatctttcaaatttctttgggt

SEQ ID NO: 8790972 - DNA, 22 bp, Homo sapiens
aatctttcattcattcatacat

SEQ ID NO: 8790973 - DNA, 19 bp, Homo sapiens
aatctttccacaatgaggc

SEQ ID NO: 8790974 - DNA, 19 bp, Homo sapiens
aatctttccacaatgaggc

SEQ ID NO: 8790975 - DNA, 22 bp, Homo sapiens
aatctttttcacaagaaagcac

SEQ ID NO: 8790976 - DNA, 22 bp, Homo sapiens
aatctttttcacaagaaagcac

SEQ ID NO: 8790977 - DNA, 22 bp, Homo sapiens
aatctttttcacaagaaagcac

SEQ ID NO: 8790978 - DNA, 22 bp, Homo sapiens
aatcttttaggggatcctgagg

SEQ ID NO: 8790979 - DNA, 22 bp, Homo sapiens
aatcttttaggggatcctgagg

SEQ ID NO: 8790980 - DNA, 22 bp, Homo sapiens
aatcttttaggggatcctgagg

SEQ ID NO: 8790981 - DNA, 22 bp, Homo sapiens
aatcttcaaaatgttctgcttg

SEQ ID NO: 8790982 - DNA, 22 bp, Homo sapiens
aatcttcacagagaaaattagg

SEQ ID NO: 8790983 - DNA, 22 bp, Homo sapiens
aatcttcacagagaaaattagg

SEQ ID NO: 8790984 - DNA, 22 bp, Homo sapiens
aatcttcacagaaaaatgtctg

SEQ ID NO: 8790985 - DNA, 22 bp, Homo sapiens
aatcttcaacagaatggtagga

SEQ ID NO: 8790986 - DNA, 22 bp, Homo sapiens
aatcttagagtgtttttgaagc

SEQ ID NO: 8790987 - DNA, 22 bp, Homo sapiens
aatcttaagctgaattctctcc

SEQ ID NO: 8790988 - DNA, 22 bp, Homo sapiens
aatcttcaaaaacaattgaggg

SEQ ID NO: 8790989 - DNA, 22 bp, Homo sapiens
aatcttcactaaaatggacaag

SEQ ID NO: 8790990 - DNA, 22 bp, Homo sapiens
aatcttcactcattcagagttg

SEQ ID NO: 8790991 - DNA, 22 bp, Homo sapiens
aatcttcactcattcagagttg

SEQ ID NO: 8790992 - DNA, 22 bp, Homo sapiens
aatcttcactcattcagagttg

SEQ ID NO: 8790993 - DNA, 22 bp, Homo sapiens
aatcttcactcttaactgtgca

SEQ ID NO: 8790994 - DNA, 22 bp, Homo sapiens
aatcttcactcttaactgtgca

SEQ ID NO: 8790995 - DNA, 22 bp, Homo sapiens
aatcttcagagaccatggagcc

SEQ ID NO: 8790996 - DNA, 22 bp, Homo sapiens
aatcttcagtgtctaaaaagca

SEQ ID NO: 8790997 - DNA, 22 bp, Homo sapiens
aatcttcagtgtctaaaaagca

SEQ ID NO: 8790998 - DNA, 22 bp, Homo sapiens
aatcttcagtgtctaaaaagca

SEQ ID NO: 8790999 - DNA, 22 bp, Homo sapiens
aatcttcagggtcctggggctc

SEQ ID NO: 8791000 - DNA, 22 bp, Homo sapiens
aatcttcagcactccagagact

SEQ ID NO: 8791001 - DNA, 22 bp, Homo sapiens
aatcttcagcactccagagact

SEQ ID NO: 8791002 - DNA, 22 bp, Homo sapiens
aatcttcataaaaatctagtag

SEQ ID NO: 8791003 - DNA, 22 bp, Homo sapiens
aatcttcataaaaatctagtag

SEQ ID NO: 8791004 - DNA, 22 bp, Homo sapiens
aatcttcataaaaatctagtag

SEQ ID NO: 8791005 - DNA, 22 bp, Homo sapiens
aatcttcatgtcctctctaatt

SEQ ID NO: 8791006 - DNA, 22 bp, Homo sapiens
agaaacgcctgtgaaattatct

SEQ ID NO: 8791007 - DNA, 22 bp, Homo sapiens
agaaacctgtgtgctgtgatga

SEQ ID NO: 8791008 - DNA, 22 bp, Homo sapiens
agaaacgcctgtgaaattatct

SEQ ID NO: 8791009 - DNA, 22 bp, Homo sapiens
agaaactacttggaggaaagat

SEQ ID NO: 8791010 - DNA, 22 bp, Homo sapiens
agaaactatcctgagtagcaaa

SEQ ID NO: 8791011 - DNA, 22 bp, Homo sapiens
agaaactacttggaggaaagat

SEQ ID NO: 8791012 - DNA, 22 bp, Homo sapiens
agaaactaagtcataactcttt

SEQ ID NO: 8791013 - DNA, 22 bp, Homo sapiens
agaaactaagtcataactcttt

SEQ ID NO: 8791014 - DNA, 22 bp, Homo sapiens
agaaactcatgccatctcgttg

SEQ ID NO: 8791015 - DNA, 22 bp, Homo sapiens
agaaactctggaagaactttta

SEQ ID NO: 8791016 - DNA, 22 bp, Homo sapiens
agaaactctggaagaactttta

SEQ ID NO: 8791017 - DNA, 22 bp, Homo sapiens
aatctatatgcttttcacatac

SEQ ID NO: 8791018 - DNA, 22 bp, Homo sapiens
agaaactattatggtaaacaaa

SEQ ID NO: 8791019 - DNA, 22 bp, Homo sapiens
agaaactattatggtaaacaaa

SEQ ID NO: 8791020 - DNA, 22 bp, Homo sapiens
agaaactattatggtaaacaaa

SEQ ID NO: 8791021 - DNA, 22 bp, Homo sapiens
agaaactcatcctggagatgac

SEQ ID NO: 8791022 - DNA, 22 bp, Homo sapiens
agaaactctggaagaactttta

SEQ ID NO: 8791023 - DNA, 22 bp, Homo sapiens
agaaactctaggtcaattgagg

SEQ ID NO: 8791024 - DNA, 22 bp, Homo sapiens
aatctgtcccttaactagtcat

SEQ ID NO: 8791025 - DNA, 22 bp, Homo sapiens
aatctgtgctccctgcatttgt

SEQ ID NO: 8791026 - DNA, 22 bp, Homo sapiens
aatctgtattgttaacaagtaa

SEQ ID NO: 8791027 - DNA, 17 bp, Homo sapiens
aatctgtttacagtcag

SEQ ID NO: 8791028 - DNA, 22 bp, Homo sapiens
aatctgtttaacagatttctgt

SEQ ID NO: 8791029 - DNA, 22 bp, Homo sapiens
aatctgtcttcttttgtggttt

SEQ ID NO: 8791030 - DNA, 22 bp, Homo sapiens
aatctgttcctgaggcaccaga

SEQ ID NO: 8791031 - DNA, 22 bp, Homo sapiens
aatctgttgtcaggaatccaca

SEQ ID NO: 8791032 - DNA, 22 bp, Homo sapiens
aatctgttctactctattcaga

SEQ ID NO: 8791033 - DNA, 22 bp, Homo sapiens
aatctgtttccaatacttgcta

SEQ ID NO: 8791034 - DNA, 22 bp, Homo sapiens
aatctgtttccatgttttattg

SEQ ID NO: 8791035 - DNA, 22 bp, Homo sapiens
aatctgtttagttctgcgtatg

SEQ ID NO: 8791036 - DNA, 22 bp, Homo sapiens
aatctgtttgatgcttgtgata

SEQ ID NO: 8791037 - DNA, 22 bp, Homo sapiens
aatctgtttccattagagtcat

SEQ ID NO: 8791038 - DNA, 22 bp, Homo sapiens
aatctgtttgtttacacctttt

SEQ ID NO: 8791039 - DNA, 22 bp, Homo sapiens
aatctgtttttgaaactttgta

SEQ ID NO: 8791040 - DNA, 22 bp, Homo sapiens
aatctgttttatcatttgttac

SEQ ID NO: 8791041 - DNA, 22 bp, Homo sapiens
aatcttaaagaatattctacca

SEQ ID NO: 8791042 - DNA, 22 bp, Homo sapiens
aatatgcagcatgatgaagtaa

SEQ ID NO: 8791043 - DNA, 22 bp, Homo sapiens
aatatgcagcatgatgaagtaa

SEQ ID NO: 8791044 - DNA, 22 bp, Homo sapiens
aatatgcaaataggtgtaatga

SEQ ID NO: 8791045 - DNA, 22 bp, Homo sapiens
aatatgcagcttatcttctagg

SEQ ID NO: 8791046 - DNA, 22 bp, Homo sapiens
aatatgtttataagatatcttc

SEQ ID NO: 8791047 - DNA, 22 bp, Homo sapiens
aatatgtttataagatatcttc

SEQ ID NO: 8791048 - DNA, 22 bp, Homo sapiens
aatatgttccacttaaagctgg

SEQ ID NO: 8791049 - DNA, 22 bp, Homo sapiens
aatatgttccacttaaagctgg

SEQ ID NO: 8791050 - DNA, 22 bp, Homo sapiens
aatatgttgagtctatctttat

SEQ ID NO: 8791051 - DNA, 22 bp, Homo sapiens
aatatgttgagtctatctttat

SEQ ID NO: 8791052 - DNA, 22 bp, Homo sapiens
aatatgttcaaaatagatcact

SEQ ID NO: 8791053 - DNA, 22 bp, Homo sapiens
aatatgttcaaaatagatcact

SEQ ID NO: 8791054 - DNA, 22 bp, Homo sapiens
aatatgttcaaaatagatcact

SEQ ID NO: 8791055 - DNA, 22 bp, Homo sapiens
aatatgttcaaaatagatcact

SEQ ID NO: 8791056 - DNA, 20 bp, Homo sapiens
agaaaatgttttcagctgga

SEQ ID NO: 8791057 - DNA, 20 bp, Homo sapiens
agaaaatgttttcagctgga

SEQ ID NO: 8791058 - DNA, 20 bp, Homo sapiens
agaaaatgttttcagctgga

SEQ ID NO: 8791059 - DNA, 22 bp, Homo sapiens
agaaaatgtgaacttgtgaatt

SEQ ID NO: 8791060 - DNA, 22 bp, Homo sapiens
agaaaatgtgaacttgtgaatt

SEQ ID NO: 8791061 - DNA, 22 bp, Homo sapiens
agaaaccagggcttaccagtgc

SEQ ID NO: 8791062 - DNA, 22 bp, Homo sapiens
agaaaccagacttggcccattt

SEQ ID NO: 8791063 - DNA, 22 bp, Homo sapiens
agaaaccatctttatatatctg

SEQ ID NO: 8791064 - DNA, 22 bp, Homo sapiens
agaaaccatctttatatatctg

SEQ ID NO: 8791065 - DNA, 22 bp, Homo sapiens
agaaacctcacagcaattctga

SEQ ID NO: 8791066 - DNA, 22 bp, Homo sapiens
agaaaccatctttatatatctg

SEQ ID NO: 8791067 - DNA, 22 bp, Homo sapiens
agaaaccatctttatatatctg

SEQ ID NO: 8791068 - DNA, 22 bp, Homo sapiens
agaaaccatctttatatatctg

SEQ ID NO: 8791069 - DNA, 23 bp, Homo sapiens
agaaaccactgaagagatccagt

SEQ ID NO: 8791070 - DNA, 23 bp, Homo sapiens
agaaaccactgaagagatccagt

SEQ ID NO: 8791071 - DNA, 22 bp, Homo sapiens
agaaaccagacttggcccattt

SEQ ID NO: 8791072 - DNA, 22 bp, Homo sapiens
agaaaccagacttggcccattt

SEQ ID NO: 8791073 - DNA, 22 bp, Homo sapiens
agaaaattactccagagacaag

SEQ ID NO: 8791074 - DNA, 22 bp, Homo sapiens
agaaaattactccagagacaag

SEQ ID NO: 8791075 - DNA, 22 bp, Homo sapiens
agaaaataatttcttggctggt

SEQ ID NO: 8791076 - DNA, 22 bp, Homo sapiens
agaaaatattcattgagaggct

SEQ ID NO: 8791077 - DNA, 22 bp, Homo sapiens
agaaaatattcattgagaggct

SEQ ID NO: 8791078 - DNA, 22 bp, Homo sapiens
agaaaatattcattgagaggct

SEQ ID NO: 8791079 - DNA, 22 bp, Homo sapiens
agaaaatattcattgagaggct

SEQ ID NO: 8791080 - DNA, 22 bp, Homo sapiens
agaaaatattcattgagaggct

SEQ ID NO: 8791081 - DNA, 22 bp, Homo sapiens
agaaaatattcattgagaggct

SEQ ID NO: 8791082 - DNA, 21 bp, Homo sapiens
agaaaatggcgttttagattt

SEQ ID NO: 8791083 - DNA, 22 bp, Homo sapiens
agaaaatattcattgagaggct

SEQ ID NO: 8791084 - DNA, 22 bp, Homo sapiens
agaaaataatttcttggctggt

SEQ ID NO: 8791085 - DNA, 22 bp, Homo sapiens
agaaaataatttcttggctggt

SEQ ID NO: 8791086 - DNA, 22 bp, Homo sapiens
agaaaataatttcttggctggt

SEQ ID NO: 8791087 - DNA, 22 bp, Homo sapiens
agaaaataatttcttggctggt

SEQ ID NO: 8791088 - DNA, 22 bp, Homo sapiens
agaaaactggagcctggggttg

SEQ ID NO: 8791089 - DNA, 22 bp, Homo sapiens
agaaaataatttcttggctggt

SEQ ID NO: 8791090 - DNA, 22 bp, Homo sapiens
agaaaactgggaggagagcttc

SEQ ID NO: 8791091 - DNA, 22 bp, Homo sapiens
aatattcaagttattctttctt

SEQ ID NO: 8791092 - DNA, 22 bp, Homo sapiens
aatattcaagttattctttctt

SEQ ID NO: 8791093 - DNA, 22 bp, Homo sapiens
actgtgggagcgcagtggcagc

SEQ ID NO: 8791094 - DNA, 23 bp, Homo sapiens
actgtgggcaccacagagagtgt

SEQ ID NO: 8791095 - DNA, 22 bp, Homo sapiens
actgtggggtgcgaggcagtga

SEQ ID NO: 8791096 - DNA, 22 bp, Homo sapiens
aatactgctgctgctgaaatca

SEQ ID NO: 8791097 - DNA, 17 bp, Homo sapiens
aatactgcttatccagg

SEQ ID NO: 8791098 - DNA, 22 bp, Homo sapiens
aatactgtaaatggagcagcca

SEQ ID NO: 8791099 - DNA, 22 bp, Homo sapiens
aatactgtctttcacagatatt

SEQ ID NO: 8791100 - DNA, 22 bp, Homo sapiens
aatactgtctttcacagatatt

SEQ ID NO: 8791101 - DNA, 22 bp, Homo sapiens
aatacttttgaactgaaaggca

SEQ ID NO: 8791102 - DNA, 22 bp, Homo sapiens
aatagaaaggaggggctcttgt

SEQ ID NO: 8791103 - DNA, 22 bp, Homo sapiens
aatactttgccaagttcgaaga

SEQ ID NO: 8791104 - DNA, 22 bp, Homo sapiens
aatactttgccaagttcgaaga

SEQ ID NO: 8791105 - DNA, 22 bp, Homo sapiens
aatactttcctatataaggtgc

SEQ ID NO: 8791106 - DNA, 22 bp, Homo sapiens
aatactttcctatataaggtgc

SEQ ID NO: 8791107 - DNA, 22 bp, Homo sapiens
aatacttgtcagatgaataaga

SEQ ID NO: 8791108 - DNA, 22 bp, Homo sapiens
aatacttgtcagatgaataaga

SEQ ID NO: 8791109 - DNA, 22 bp, Homo sapiens
aatacttgggctgagatttttg

SEQ ID NO: 8791110 - DNA, 22 bp, Homo sapiens
aatacttgtcagatgaataaga

SEQ ID NO: 8791111 - DNA, 22 bp, Homo sapiens
aatacttgtcagatgaataaga

SEQ ID NO: 8791112 - DNA, 22 bp, Homo sapiens
aatacttgtgaattcaaagtct

SEQ ID NO: 8791113 - DNA, 22 bp, Homo sapiens
aatacttgtgaattcaaagtct

SEQ ID NO: 8791114 - DNA, 22 bp, Homo sapiens
aatacttgaatttcatgtcagg

SEQ ID NO: 8791115 - DNA, 22 bp, Homo sapiens
aatacttgaatttcatgtcagg

SEQ ID NO: 8791116 - DNA, 17 bp, Homo sapiens
aatacttccaactagtg

SEQ ID NO: 8791117 - DNA, 22 bp, Homo sapiens
actgtctgcaaaactcatactc

SEQ ID NO: 8791118 - DNA, 22 bp, Homo sapiens
actgtctgccctgagatgccag

SEQ ID NO: 8791119 - DNA, 22 bp, Homo sapiens
actgtctgcacccgaggaggcc

SEQ ID NO: 8791120 - DNA, 18 bp, Homo sapiens
actgtctgccagattggg

SEQ ID NO: 8791121 - DNA, 22 bp, Homo sapiens
actgtgctatctactgaattat

SEQ ID NO: 8791122 - DNA, 22 bp, Homo sapiens
actgtctgctggcccctggtta

SEQ ID NO: 8791123 - DNA, 19 bp, Homo sapiens
actgtgctcgggaaccact

SEQ ID NO: 8791124 - DNA, 21 bp, Homo sapiens
aataaccactaatatagtggc

SEQ ID NO: 8791125 - DNA, 22 bp, Homo sapiens
aataaccttacttattacatgg

SEQ ID NO: 8791126 - DNA, 22 bp, Homo sapiens
aataaccttacttattacatgg

SEQ ID NO: 8791127 - DNA, 22 bp, Homo sapiens
aataaccttacttattacatgg

SEQ ID NO: 8791128 - DNA, 22 bp, Homo sapiens
aataacagggttgatttgcaat

SEQ ID NO: 8791129 - DNA, 21 bp, Homo sapiens
aataaccactaatatagtggc

SEQ ID NO: 8791130 - DNA, 22 bp, Homo sapiens
aataacaggctcatcagatgct

SEQ ID NO: 8791131 - DNA, 22 bp, Homo sapiens
aataacagggttgatttgcaat

SEQ ID NO: 8791132 - DNA, 22 bp, Homo sapiens
actgtggagaaagaaagactgc

SEQ ID NO: 8791133 - DNA, 22 bp, Homo sapiens
actgtggagcagtggctaggga

SEQ ID NO: 8791134 - DNA, 22 bp, Homo sapiens
actgtgctggcaatgactcagg

SEQ ID NO: 8791135 - DNA, 22 bp, Homo sapiens
actgtggataagtcagagatgt

SEQ ID NO: 8791136 - DNA, 22 bp, Homo sapiens
actgtggatcaaagacttgggg

SEQ ID NO: 8791137 - DNA, 22 bp, Homo sapiens
actgtggcaaaagaacattgga

SEQ ID NO: 8791138 - DNA, 22 bp, Homo sapiens
actgtggcaaagaagcaggctc

SEQ ID NO: 8791139 - DNA, 22 bp, Homo sapiens
actgtggccaaagcctctggga

SEQ ID NO: 8791140 - DNA, 22 bp, Homo sapiens
actgtggcactaggcaccttac

SEQ ID NO: 8791141 - DNA, 22 bp, Homo sapiens
actgtggcgtcaggaagaaatt

SEQ ID NO: 8791142 - DNA, 22 bp, Homo sapiens
actgtggccttgtgggttcagg

SEQ ID NO: 8791143 - DNA, 22 bp, Homo sapiens
actgtggctaattcatttggtc

SEQ ID NO: 8791144 - DNA, 22 bp, Homo sapiens
actgtggccggaacagtgggac

SEQ ID NO: 8791145 - DNA, 22 bp, Homo sapiens
actgtggccggaacagtgggac

SEQ ID NO: 8791146 - DNA, 22 bp, Homo sapiens
actgtggcctgctgtatgggct

SEQ ID NO: 8791147 - DNA, 22 bp, Homo sapiens
actgtggctcatcaggctggtg

SEQ ID NO: 8791148 - DNA, 22 bp, Homo sapiens
aatatgacatagaattgagatg

SEQ ID NO: 8791149 - DNA, 22 bp, Homo sapiens
aatatgaattattgttacaagt

SEQ ID NO: 8791150 - DNA, 22 bp, Homo sapiens
aatatgaattattgttacaagt

SEQ ID NO: 8791151 - DNA, 22 bp, Homo sapiens
aatatgaattattgttacaagt

SEQ ID NO: 8791152 - DNA, 22 bp, Homo sapiens
acttcctgcagcttctcagccc

SEQ ID NO: 8791153 - DNA, 19 bp, Homo sapiens
acttcctgcccgctccttt

SEQ ID NO: 8791154 - DNA, 19 bp, Homo sapiens
acttcctgcccgctccttt

SEQ ID NO: 8791155 - DNA, 22 bp, Homo sapiens
aatatcagctctgtcacttact

SEQ ID NO: 8791156 - DNA, 22 bp, Homo sapiens
aatatcagctctgtcacttact

SEQ ID NO: 8791157 - DNA, 22 bp, Homo sapiens
aatatcagctctgtcacttact

SEQ ID NO: 8791158 - DNA, 22 bp, Homo sapiens
acttccaggttccacccaagac

SEQ ID NO: 8791159 - DNA, 22 bp, Homo sapiens
acttccagtgtctgctgctagc

SEQ ID NO: 8791160 - DNA, 22 bp, Homo sapiens
acttccagtgtctgctgctagc

SEQ ID NO: 8791161 - DNA, 22 bp, Homo sapiens
acttccagttttaattaaattg

SEQ ID NO: 8791162 - DNA, 22 bp, Homo sapiens
acttccagttttaattaaattg

SEQ ID NO: 8791163 - DNA, 23 bp, Homo sapiens
acttccagttataggaactcttc

SEQ ID NO: 8791164 - DNA, 23 bp, Homo sapiens
acttccagttataggaactcttc

SEQ ID NO: 8791165 - DNA, 23 bp, Homo sapiens
acttccagttgcttcagcatatg

SEQ ID NO: 8791166 - DNA, 23 bp, Homo sapiens
acttccagttgcttcagcatatg

SEQ ID NO: 8791167 - DNA, 17 bp, Homo sapiens
acttcccacccctccag

SEQ ID NO: 8791168 - DNA, 22 bp, Homo sapiens
acttcccaacgtgggcctccca

SEQ ID NO: 8791169 - DNA, 22 bp, Homo sapiens
acttcccaacgtgggcctccca

SEQ ID NO: 8791170 - DNA, 22 bp, Homo sapiens
acttcccaacgtgggcctccca

SEQ ID NO: 8791171 - DNA, 22 bp, Homo sapiens
acttcctgaatggggctaatta

SEQ ID NO: 8791172 - DNA, 22 bp, Homo sapiens
acttcctgacttctgggttgga

SEQ ID NO: 8791173 - DNA, 22 bp, Homo sapiens
acttccctgtgggcaggtagtg

SEQ ID NO: 8791174 - DNA, 22 bp, Homo sapiens
acttccccgaagctggaaatag

SEQ ID NO: 8791175 - DNA, 22 bp, Homo sapiens
acttccgggtgctagatgattc

SEQ ID NO: 8791176 - DNA, 21 bp, Homo sapiens
acttcccaggacctactcaga

SEQ ID NO: 8791177 - DNA, 22 bp, Homo sapiens
acttcccaggtggtgtggagtt

SEQ ID NO: 8791178 - DNA, 21 bp, Homo sapiens
acttcccaggacctactcaga

SEQ ID NO: 8791179 - DNA, 22 bp, Homo sapiens
acttcccatttctctgctttag

SEQ ID NO: 8791180 - DNA, 22 bp, Homo sapiens
acttattagacatcttcattgt

SEQ ID NO: 8791181 - DNA, 22 bp, Homo sapiens
acttatgtagtacctcttatgt

SEQ ID NO: 8791182 - DNA, 22 bp, Homo sapiens
acttatttattcattcagctca

SEQ ID NO: 8791183 - DNA, 22 bp, Homo sapiens
acttatttattcattcagctca

SEQ ID NO: 8791184 - DNA, 22 bp, Homo sapiens
acttatttattcattcagctca

SEQ ID NO: 8791185 - DNA, 22 bp, Homo sapiens
acttatatttgctttatgcttc

SEQ ID NO: 8791186 - DNA, 22 bp, Homo sapiens
acttatcacacactaaattagg

SEQ ID NO: 8791187 - DNA, 22 bp, Homo sapiens
acttccagctgccctgtgtgct

SEQ ID NO: 8791188 - DNA, 22 bp, Homo sapiens
acttccagctgccctgtgtgct

SEQ ID NO: 8791189 - DNA, 22 bp, Homo sapiens
acttccaggttccacccaagac

SEQ ID NO: 8791190 - DNA, 22 bp, Homo sapiens
acttccagggtagaggggaaga

SEQ ID NO: 8791191 - DNA, 22 bp, Homo sapiens
acttccagggtagaggggaaga

SEQ ID NO: 8791192 - DNA, 16 bp, Homo sapiens
acttccaggggagccc

SEQ ID NO: 8791193 - DNA, 16 bp, Homo sapiens
acttccaggggagccc

SEQ ID NO: 8791194 - DNA, 22 bp, Homo sapiens
acttccaggaggtgtcactgaa

SEQ ID NO: 8791195 - DNA, 22 bp, Homo sapiens
acttccaggaggtgtcactgaa

SEQ ID NO: 8791196 - DNA, 22 bp, Homo sapiens
acttccaggaactgccgctaac

SEQ ID NO: 8791197 - DNA, 22 bp, Homo sapiens
acttccaggaactgccgctaac

SEQ ID NO: 8791198 - DNA, 22 bp, Homo sapiens
acttccagctttataattcagt

SEQ ID NO: 8791199 - DNA, 22 bp, Homo sapiens
acttccagctttataattcagt

SEQ ID NO: 8791200 - DNA, 22 bp, Homo sapiens
acttagaattagtgtagaatga

SEQ ID NO: 8791201 - DNA, 22 bp, Homo sapiens
acttagcaaatcttttggattc

SEQ ID NO: 8791202 - DNA, 22 bp, Homo sapiens
acttagcaatttgattaaaaga

SEQ ID NO: 8791203 - DNA, 22 bp, Homo sapiens
acttagcagagtgagttgacta

SEQ ID NO: 8791204 - DNA, 22 bp, Homo sapiens
acttagcagagttgaatgtact

SEQ ID NO: 8791205 - DNA, 22 bp, Homo sapiens
acttagcacgaacatttacttt

SEQ ID NO: 8791206 - DNA, 22 bp, Homo sapiens
acttagcacagagccaggtagg

SEQ ID NO: 8791207 - DNA, 22 bp, Homo sapiens
acttagcacctatggcattttt

SEQ ID NO: 8791208 - DNA, 22 bp, Homo sapiens
acttagcacctatggcattttt

SEQ ID NO: 8791209 - DNA, 22 bp, Homo sapiens
actgttggcttctggtagtgac

SEQ ID NO: 8791210 - DNA, 22 bp, Homo sapiens
actgttggtcagggatattgtg

SEQ ID NO: 8791211 - DNA, 23 bp, Homo sapiens
actgttggtgcagaagtgccttg

SEQ ID NO: 8791212 - DNA, 20 bp, Homo sapiens
actgttggaagtggagaatg

SEQ ID NO: 8791213 - DNA, 23 bp, Homo sapiens
actgttggtgcagaagtgccttg

SEQ ID NO: 8791214 - DNA, 22 bp, Homo sapiens
actgttggagtcttgagtttct

SEQ ID NO: 8791215 - DNA, 22 bp, Homo sapiens
acttagaattaaatatttttgg

SEQ ID NO: 8791216 - DNA, 22 bp, Homo sapiens
aatagaacaataattgtaaact

SEQ ID NO: 8791217 - DNA, 22 bp, Homo sapiens
acttataagagtgctatgggga

SEQ ID NO: 8791218 - DNA, 22 bp, Homo sapiens
acttagtggctatgtgacctta

SEQ ID NO: 8791219 - DNA, 20 bp, Homo sapiens
acttagtgtagggttcctag

SEQ ID NO: 8791220 - DNA, 22 bp, Homo sapiens
acttataagagtgctatgggga

SEQ ID NO: 8791221 - DNA, 22 bp, Homo sapiens
acttataggccaagtagactgt

SEQ ID NO: 8791222 - DNA, 22 bp, Homo sapiens
acttatagccagaattaattat

SEQ ID NO: 8791223 - DNA, 22 bp, Homo sapiens
acttagcattatgtaattacta

SEQ ID NO: 8791224 - DNA, 22 bp, Homo sapiens
acttagtgccctggcccttaca

SEQ ID NO: 8791225 - DNA, 22 bp, Homo sapiens
acttagcacgaacatttacttt

SEQ ID NO: 8791226 - DNA, 22 bp, Homo sapiens
acttagtatttttcagctttga

SEQ ID NO: 8791227 - DNA, 22 bp, Homo sapiens
gcccagtgtctaggaggtgaac

SEQ ID NO: 8791228 - DNA, 22 bp, Homo sapiens
gcccagtttcagctctgccttt

SEQ ID NO: 8791229 - DNA, 22 bp, Homo sapiens
gcccatccatggggtcatggcc

SEQ ID NO: 8791230 - DNA, 22 bp, Homo sapiens
gcccatccctgaaccaactggg

SEQ ID NO: 8791231 - DNA, 22 bp, Homo sapiens
gcccagtggtaaaagcaggcct

SEQ ID NO: 8791232 - DNA, 22 bp, Homo sapiens
gcccagtggtaaaagcaggcct

SEQ ID NO: 8791233 - DNA, 22 bp, Homo sapiens
gcccagtgtctaggaggtgaac

SEQ ID NO: 8791234 - DNA, 22 bp, Homo sapiens
gcccaggggcagcgcatagtgg

SEQ ID NO: 8791235 - DNA, 22 bp, Homo sapiens
gcccaggggcagcgcatagtgg

SEQ ID NO: 8791236 - DNA, 22 bp, Homo sapiens
gcccaggggcagcgcatagtgg

SEQ ID NO: 8791237 - DNA, 22 bp, Homo sapiens
gcccaggggagtagtcaattta

SEQ ID NO: 8791238 - DNA, 22 bp, Homo sapiens
gcccagggcttcaaagagagaa

SEQ ID NO: 8791239 - DNA, 20 bp, Homo sapiens
gcccatgaggactgcagctg

SEQ ID NO: 8791240 - DNA, 23 bp, Homo sapiens
gcccatggagtctggatctggcc

SEQ ID NO: 8791241 - DNA, 22 bp, Homo sapiens
gcccatggaaaacctgtcctct

SEQ ID NO: 8791242 - DNA, 22 bp, Homo sapiens
gcccatggacacccaagtgcca

SEQ ID NO: 8791243 - DNA, 22 bp, Homo sapiens
gcccatggaaaacctgtcctct

SEQ ID NO: 8791244 - DNA, 23 bp, Homo sapiens
gcccatgctgttgggcccgagca

SEQ ID NO: 8791245 - DNA, 22 bp, Homo sapiens
gccctctgtgtaacaatccaga

SEQ ID NO: 8791246 - DNA, 22 bp, Homo sapiens
gccctctggtgggtgagccccg

SEQ ID NO: 8791247 - DNA, 22 bp, Homo sapiens
gccctctggggcacacagagga

SEQ ID NO: 8791248 - DNA, 22 bp, Homo sapiens
gccctctggggcacacagagga

SEQ ID NO: 8791249 - DNA, 22 bp, Homo sapiens
gccctctggtggccgcctcggc

SEQ ID NO: 8791250 - DNA, 18 bp, Homo sapiens
gccctctggctgctgatg

SEQ ID NO: 8791251 - DNA, 22 bp, Homo sapiens
gcccatggcagaactgtgagca

SEQ ID NO: 8791252 - DNA, 22 bp, Homo sapiens
gcccaggctggagtgcagtggt

SEQ ID NO: 8791253 - DNA, 22 bp, Homo sapiens
gcccaggctggagtgcagtggt

SEQ ID NO: 8791254 - DNA, 22 bp, Homo sapiens
gcccaggctggagtgcagtggt

SEQ ID NO: 8791255 - DNA, 22 bp, Homo sapiens
gcccagcaaggaccaagggccg

SEQ ID NO: 8791256 - DNA, 22 bp, Homo sapiens
gcccagcaaggaccaagggccg

SEQ ID NO: 8791257 - DNA, 22 bp, Homo sapiens
gcccagcaactgcacccttctt

SEQ ID NO: 8791258 - DNA, 22 bp, Homo sapiens
gcccagagtggccacttggctc

SEQ ID NO: 8791259 - DNA, 22 bp, Homo sapiens
gcccagagttcaaggctgcagt

SEQ ID NO: 8791260 - DNA, 22 bp, Homo sapiens
gcccagagttcaaggctgcagt

SEQ ID NO: 8791261 - DNA, 22 bp, Homo sapiens
gcccagagttcaaggctgcagt

SEQ ID NO: 8791262 - DNA, 22 bp, Homo sapiens
gcccagggcagggcaagagtga

SEQ ID NO: 8791263 - DNA, 22 bp, Homo sapiens
gcccagggcagggcaagagtga

SEQ ID NO: 8791264 - DNA, 22 bp, Homo sapiens
gcccagggcagggcaagagtga

SEQ ID NO: 8791265 - DNA, 22 bp, Homo sapiens
gcccagggcagggcaagagtga

SEQ ID NO: 8791266 - DNA, 23 bp, Homo sapiens
gcccagggactgggaatcagtgg

SEQ ID NO: 8791267 - DNA, 22 bp, Homo sapiens
gcccaggctggagttcagtggt

SEQ ID NO: 8791268 - DNA, 22 bp, Homo sapiens
gcccaggctggagtgcagtggt

SEQ ID NO: 8791269 - DNA, 22 bp, Homo sapiens
gcccaggctggagttcagtggt

SEQ ID NO: 8791270 - DNA, 23 bp, Homo sapiens
gcccagggactgggaatcagtgg

SEQ ID NO: 8791271 - DNA, 23 bp, Homo sapiens
gcccagggactgggaatcagtgg

SEQ ID NO: 8791272 - DNA, 22 bp, Homo sapiens
gcccagggctgcaagtggacgc

SEQ ID NO: 8791273 - DNA, 22 bp, Homo sapiens
gcccagggctgcaagtggacgc

SEQ ID NO: 8791274 - DNA, 22 bp, Homo sapiens
gcccagggcgatggtcggggcc

SEQ ID NO: 8791275 - DNA, 22 bp, Homo sapiens
gcccagggcgatggtcggggcc

SEQ ID NO: 8791276 - DNA, 22 bp, Homo sapiens
gcccagggcgatggtcggggcc

SEQ ID NO: 8791277 - DNA, 22 bp, Homo sapiens
gcccagggcgatggtcggggcc

SEQ ID NO: 8791278 - DNA, 22 bp, Homo sapiens
gcctacggactccttgccctgt

SEQ ID NO: 8791279 - DNA, 22 bp, Homo sapiens
gcctagagaaaaagcctctgca

SEQ ID NO: 8791280 - DNA, 22 bp, Homo sapiens
gcctacagttggctgagggcct

SEQ ID NO: 8791281 - DNA, 22 bp, Homo sapiens
gcctacagttggctgagggcct

SEQ ID NO: 8791282 - DNA, 20 bp, Homo sapiens
gcctagagatggaaggcgca

SEQ ID NO: 8791283 - DNA, 23 bp, Homo sapiens
gcctcagagaaacagctgcacac

SEQ ID NO: 8791284 - DNA, 22 bp, Homo sapiens
gccctgaggggtggtgtctgta

SEQ ID NO: 8791285 - DNA, 22 bp, Homo sapiens
gccctgaggggtggtgtctgta

SEQ ID NO: 8791286 - DNA, 22 bp, Homo sapiens
gcctaagactgaggcttttgtc

SEQ ID NO: 8791287 - DNA, 22 bp, Homo sapiens
gcctaagattgtgttttcctga

SEQ ID NO: 8791288 - DNA, 20 bp, Homo sapiens
gcctaagagctagctgtcac

SEQ ID NO: 8791289 - DNA, 22 bp, Homo sapiens
gcctaatacatgatgataggta

SEQ ID NO: 8791290 - DNA, 22 bp, Homo sapiens
gcctaatgtctcattccctagt

SEQ ID NO: 8791291 - DNA, 22 bp, Homo sapiens
gcctcagccggcggacgccagg

SEQ ID NO: 8791292 - DNA, 20 bp, Homo sapiens
gcctcagccaacccatgggg

SEQ ID NO: 8791293 - DNA, 22 bp, Homo sapiens
gcctcagctgttgcaggggccc

SEQ ID NO: 8791294 - DNA, 22 bp, Homo sapiens
gcctcaggactggcatactcat

SEQ ID NO: 8791295 - DNA, 22 bp, Homo sapiens
gcctcagctcccagcccaggct

SEQ ID NO: 8791296 - DNA, 22 bp, Homo sapiens
gcctcagctcccagcccaggct

SEQ ID NO: 8791297 - DNA, 22 bp, Homo sapiens
gccctctgttattgcatcctta

SEQ ID NO: 8791298 - DNA, 22 bp, Homo sapiens
gccctgaaatatttccacggcc

SEQ ID NO: 8791299 - DNA, 22 bp, Homo sapiens
gccctgaacgaggggtctggag

SEQ ID NO: 8791300 - DNA, 22 bp, Homo sapiens
gccctgaagctgagggtgttaa

SEQ ID NO: 8791301 - DNA, 22 bp, Homo sapiens
gccctgaaggcagaggtggagc

SEQ ID NO: 8791302 - DNA, 22 bp, Homo sapiens
gccctgaattcctcaggctgtg

SEQ ID NO: 8791303 - DNA, 22 bp, Homo sapiens
gccctgaataatagagtgggga

SEQ ID NO: 8791304 - DNA, 19 bp, Homo sapiens
gccctgaccttggctgctc

SEQ ID NO: 8791305 - DNA, 22 bp, Homo sapiens
gccctgacactttgcagctgag

SEQ ID NO: 8791306 - DNA, 22 bp, Homo sapiens
gccctgagaatgtgtgtgtcta

SEQ ID NO: 8791307 - DNA, 22 bp, Homo sapiens
gccctgagaagaagtcggaggg

SEQ ID NO: 8791308 - DNA, 22 bp, Homo sapiens
gccctgagactgagcatgggtt

SEQ ID NO: 8791309 - DNA, 22 bp, Homo sapiens
gccctgaggcaaaagaacagtc

SEQ ID NO: 8791310 - DNA, 22 bp, Homo sapiens
gccctgagctagtgtgggcagg

SEQ ID NO: 8791311 - DNA, 22 bp, Homo sapiens
gccctgagcctatgagcctctc

SEQ ID NO: 8791312 - DNA, 22 bp, Homo sapiens
gccctgagcctatgagcctctc

SEQ ID NO: 8791313 - DNA, 22 bp, Homo sapiens
gccctgagaggcaatgactctt

SEQ ID NO: 8791314 - DNA, 22 bp, Homo sapiens
gccctgagcacacagtagcaaa

SEQ ID NO: 8791315 - DNA, 22 bp, Homo sapiens
gccctgagattcttggattctg

SEQ ID NO: 8791316 - DNA, 22 bp, Homo sapiens
gccctgagcactgctgctgggg

SEQ ID NO: 8791317 - DNA, 22 bp, Homo sapiens
gccctgagcactgctgctgggg

SEQ ID NO: 8791318 - DNA, 22 bp, Homo sapiens
gccctgagcactgctgctgggg

SEQ ID NO: 8791319 - DNA, 22 bp, Homo sapiens
gccctgagccaccaatgccatt

SEQ ID NO: 8791320 - DNA, 22 bp, Homo sapiens
gcccacaggggacctggtggct

SEQ ID NO: 8791321 - DNA, 22 bp, Homo sapiens
gccagtggcttgccaggcagga

SEQ ID NO: 8791322 - DNA, 22 bp, Homo sapiens
gccagtggcttgccaggcagga

SEQ ID NO: 8791323 - DNA, 22 bp, Homo sapiens
gcccacaggtcctacctctttc

SEQ ID NO: 8791324 - DNA, 22 bp, Homo sapiens
gcccacaggtcctacctctttc

SEQ ID NO: 8791325 - DNA, 22 bp, Homo sapiens
gcccacagtacgaggctcaggc

SEQ ID NO: 8791326 - DNA, 22 bp, Homo sapiens
gcccacagtacgaggctcaggc

SEQ ID NO: 8791327 - DNA, 22 bp, Homo sapiens
gccagtggaggacccatggaga

SEQ ID NO: 8791328 - DNA, 22 bp, Homo sapiens
gccagtggcttgccaggcagga

SEQ ID NO: 8791329 - DNA, 22 bp, Homo sapiens
gccagtctgataggggagaagt

SEQ ID NO: 8791330 - DNA, 22 bp, Homo sapiens
gccagtctgataggggagaagt

SEQ ID NO: 8791331 - DNA, 22 bp, Homo sapiens
gccagtaaaacaaaggccatgt

SEQ ID NO: 8791332 - DNA, 22 bp, Homo sapiens
gccaggttgctgacgacgatct

SEQ ID NO: 8791333 - DNA, 22 bp, Homo sapiens
gccagtaagtggtagagactta

SEQ ID NO: 8791334 - DNA, 22 bp, Homo sapiens
gccagtaaaacaaaggccatgt

SEQ ID NO: 8791335 - DNA, 22 bp, Homo sapiens
gccagtaagtggtagagttgag

SEQ ID NO: 8791336 - DNA, 22 bp, Homo sapiens
gccagtaagtggtagagttgag

SEQ ID NO: 8791337 - DNA, 22 bp, Homo sapiens
gccaggttgctgacgacgatct

SEQ ID NO: 8791338 - DNA, 18 bp, Homo sapiens
gccagtgccctggctcac

SEQ ID NO: 8791339 - DNA, 22 bp, Homo sapiens
gccagtgcttgtggagctggca

SEQ ID NO: 8791340 - DNA, 22 bp, Homo sapiens
gcccagacatttggccaaacat

SEQ ID NO: 8791341 - DNA, 22 bp, Homo sapiens
gcccagaagttgaggctgcagt

SEQ ID NO: 8791342 - DNA, 22 bp, Homo sapiens
gcccactgagtgactccctcag

SEQ ID NO: 8791343 - DNA, 22 bp, Homo sapiens
gcccactgagtgactccctcag

SEQ ID NO: 8791344 - DNA, 22 bp, Homo sapiens
gcccagagggaagaggtgtcat

SEQ ID NO: 8791345 - DNA, 23 bp, Homo sapiens
gcccagagaggctcaccaggaat

SEQ ID NO: 8791346 - DNA, 22 bp, Homo sapiens
gcccagagagatgctgtagacc

SEQ ID NO: 8791347 - DNA, 22 bp, Homo sapiens
gcccagagtgagtcctgggccc

SEQ ID NO: 8791348 - DNA, 22 bp, Homo sapiens
gcccagagtgagtcctgggccc

SEQ ID NO: 8791349 - DNA, 22 bp, Homo sapiens
gcccagagtgagtcctgggccc

SEQ ID NO: 8791350 - DNA, 18 bp, Homo sapiens
gcccagaggtctgggccc

SEQ ID NO: 8791351 - DNA, 22 bp, Homo sapiens
gccaggaatggagaggtggcct

SEQ ID NO: 8791352 - DNA, 22 bp, Homo sapiens
gccaggaatggagaggtggcct

SEQ ID NO: 8791353 - DNA, 22 bp, Homo sapiens
gccaggaatttcaagagccact

SEQ ID NO: 8791354 - DNA, 22 bp, Homo sapiens
gccaggaatttcaagagccact

SEQ ID NO: 8791355 - DNA, 22 bp, Homo sapiens
gccaggaatttcaagagccact

SEQ ID NO: 8791356 - DNA, 22 bp, Homo sapiens
gccaggaccctggagggcatct

SEQ ID NO: 8791357 - DNA, 22 bp, Homo sapiens
gccaggacctcagatgcagggc

SEQ ID NO: 8791358 - DNA, 21 bp, Homo sapiens
gccaggaccagcagaccactt

SEQ ID NO: 8791359 - DNA, 21 bp, Homo sapiens
gccaggaccagcagaccactt

SEQ ID NO: 8791360 - DNA, 19 bp, Homo sapiens
gccaggacatcctcctgct

SEQ ID NO: 8791361 - DNA, 21 bp, Homo sapiens
gccaggaccagcagaccactt

SEQ ID NO: 8791362 - DNA, 22 bp, Homo sapiens
gccaggagaaaaggcgaatgat

SEQ ID NO: 8791363 - DNA, 22 bp, Homo sapiens
gccaggactgagaatgggagca

SEQ ID NO: 8791364 - DNA, 22 bp, Homo sapiens
gccaggagaaaaggcgaatgat

SEQ ID NO: 8791365 - DNA, 22 bp, Homo sapiens
gccaggactcttcctagaaggt

SEQ ID NO: 8791366 - DNA, 22 bp, Homo sapiens
gccaggagccagcttcttagca

SEQ ID NO: 8791367 - DNA, 22 bp, Homo sapiens
gccaggagcatgtcattgttga

SEQ ID NO: 8791368 - DNA, 22 bp, Homo sapiens
gccaggagcatgtcattgttga

SEQ ID NO: 8791369 - DNA, 22 bp, Homo sapiens
gccaggagccctgggcaagttc

SEQ ID NO: 8791370 - DNA, 22 bp, Homo sapiens
gccaggaggctgctgtgtaggc

SEQ ID NO: 8791371 - DNA, 22 bp, Homo sapiens
gccaggaggctgctgtgtaggc

SEQ ID NO: 8791372 - DNA, 22 bp, Homo sapiens
gccaggaggctgctgtgtaggc

SEQ ID NO: 8791373 - DNA, 22 bp, Homo sapiens
gccaggagagctccttcaggtt

SEQ ID NO: 8791374 - DNA, 22 bp, Homo sapiens
gccaggagaatgctagcagagg

SEQ ID NO: 8791375 - DNA, 22 bp, Homo sapiens
gccaggagaatgctagcagagg

SEQ ID NO: 8791376 - DNA, 22 bp, Homo sapiens
gccaggagaatgctagcagagg

SEQ ID NO: 8791377 - DNA, 22 bp, Homo sapiens
gccaggagaatgctagcagagg

SEQ ID NO: 8791378 - DNA, 22 bp, Homo sapiens
gccaggagactccattcatttg

SEQ ID NO: 8791379 - DNA, 23 bp, Homo sapiens
gccaggcacatggtggacacgca

SEQ ID NO: 8791380 - DNA, 23 bp, Homo sapiens
gccaggcacatggtggacacgca

SEQ ID NO: 8791381 - DNA, 23 bp, Homo sapiens
gccaggcacatggtggacacgca

SEQ ID NO: 8791382 - DNA, 23 bp, Homo sapiens
gccaggcacatggtggacacgca

SEQ ID NO: 8791383 - DNA, 22 bp, Homo sapiens
gccaggcacagttctaggtgct

SEQ ID NO: 8791384 - DNA, 22 bp, Homo sapiens
gccaggcacagttctaggtgct

SEQ ID NO: 8791385 - DNA, 22 bp, Homo sapiens
gccaggcaatgtgttagaagcg

SEQ ID NO: 8791386 - DNA, 22 bp, Homo sapiens
gccaggagttcagatgcatgtt

SEQ ID NO: 8791387 - DNA, 22 bp, Homo sapiens
gccaggagttcagatgcatgtt

SEQ ID NO: 8791388 - DNA, 22 bp, Homo sapiens
gccaggagttcagatgcatgtt

SEQ ID NO: 8791389 - DNA, 22 bp, Homo sapiens
gccaggcaaattaaggaatgca

SEQ ID NO: 8791390 - DNA, 22 bp, Homo sapiens
gccaggcaaattaaggaatgca

SEQ ID NO: 8791391 - DNA, 22 bp, Homo sapiens
gccaggcaaattaaggaatgca

SEQ ID NO: 8791392 - DNA, 22 bp, Homo sapiens
gccaggagttcagatgcatgtt

SEQ ID NO: 8791393 - DNA, 22 bp, Homo sapiens
gccaggcaaattaaggaatgca

SEQ ID NO: 8791394 - DNA, 22 bp, Homo sapiens
gccaggtctcataaatgcagct

SEQ ID NO: 8791395 - DNA, 22 bp, Homo sapiens
gccaggtgggagacagacagca

SEQ ID NO: 8791396 - DNA, 22 bp, Homo sapiens
gccaggtggctgagtgactgag

SEQ ID NO: 8791397 - DNA, 22 bp, Homo sapiens
gccaggtgtagtggccacacct

SEQ ID NO: 8791398 - DNA, 22 bp, Homo sapiens
gccaggttctggggaggtacaa

SEQ ID NO: 8791399 - DNA, 22 bp, Homo sapiens
gccaggtgtcctcacagtgagg

SEQ ID NO: 8791400 - DNA, 22 bp, Homo sapiens
gccaggtgggagacagacagca

SEQ ID NO: 8791401 - DNA, 22 bp, Homo sapiens
gccaggtggtctggctccagag

SEQ ID NO: 8791402 - DNA, 22 bp, Homo sapiens
gccaggtggtctggctccagag

SEQ ID NO: 8791403 - DNA, 22 bp, Homo sapiens
gccagagccacttttgggtgat

SEQ ID NO: 8791404 - DNA, 22 bp, Homo sapiens
gccagagcagaatagagtggcc

SEQ ID NO: 8791405 - DNA, 22 bp, Homo sapiens
gccaagggggcagtgcatgggt

SEQ ID NO: 8791406 - DNA, 22 bp, Homo sapiens
gccaagtcaggcagggcttctg

SEQ ID NO: 8791407 - DNA, 22 bp, Homo sapiens
gccagagagactgatacatgct

SEQ ID NO: 8791408 - DNA, 22 bp, Homo sapiens
gccagagcacaggctggtagta

SEQ ID NO: 8791409 - DNA, 22 bp, Homo sapiens
gccagagagatggaaaagctta

SEQ ID NO: 8791410 - DNA, 22 bp, Homo sapiens
gccagagagagtccctgggcct

SEQ ID NO: 8791411 - DNA, 22 bp, Homo sapiens
gccagagagagtccctgggcct

SEQ ID NO: 8791412 - DNA, 22 bp, Homo sapiens
gccagagaggccgaggtaccca

SEQ ID NO: 8791413 - DNA, 22 bp, Homo sapiens
gccagagaggcaaatcctagca

SEQ ID NO: 8791414 - DNA, 22 bp, Homo sapiens
gccagagaggcctaaggccata

SEQ ID NO: 8791415 - DNA, 22 bp, Homo sapiens
gccagagaggcctaaggccata

SEQ ID NO: 8791416 - DNA, 22 bp, Homo sapiens
gcatttttctaatcattggcat

SEQ ID NO: 8791417 - DNA, 22 bp, Homo sapiens
gcatttttcatccctcttgggt

SEQ ID NO: 8791418 - DNA, 22 bp, Homo sapiens
gcatttttcatccctcttgggt

SEQ ID NO: 8791419 - DNA, 22 bp, Homo sapiens
gcatttttcatccctcttgggt

SEQ ID NO: 8791420 - DNA, 22 bp, Homo sapiens
gcatttttctaatcattggcat

SEQ ID NO: 8791421 - DNA, 22 bp, Homo sapiens
gcatttttctctcctataggag

SEQ ID NO: 8791422 - DNA, 22 bp, Homo sapiens
gcatttttcatccctcttgggt

SEQ ID NO: 8791423 - DNA, 22 bp, Homo sapiens
gcatttttctaatcattggcat

SEQ ID NO: 8791424 - DNA, 22 bp, Homo sapiens
gcatttttctaatcattggcat

SEQ ID NO: 8791425 - DNA, 22 bp, Homo sapiens
gcatttgtacaaaatgcagtag

SEQ ID NO: 8791426 - DNA, 22 bp, Homo sapiens
gcatttgtgtggcggaaggatt

SEQ ID NO: 8791427 - DNA, 22 bp, Homo sapiens
gcatttgttccgctttgtcatc

SEQ ID NO: 8791428 - DNA, 22 bp, Homo sapiens
gcatttgttccgctttgtcatc

SEQ ID NO: 8791429 - DNA, 22 bp, Homo sapiens
gccaagcttggaaggatcatgg

SEQ ID NO: 8791430 - DNA, 22 bp, Homo sapiens
gccaagctttgcaggagtgttg

SEQ ID NO: 8791431 - DNA, 22 bp, Homo sapiens
gccaagcttatatgatgcttga

SEQ ID NO: 8791432 - DNA, 22 bp, Homo sapiens
gccaagctgtttttcagagacg

SEQ ID NO: 8791433 - DNA, 22 bp, Homo sapiens
gccaagctggatgaagaggttg

SEQ ID NO: 8791434 - DNA, 22 bp, Homo sapiens
gccaagctgtttttcagagacg

SEQ ID NO: 8791435 - DNA, 22 bp, Homo sapiens
gccaagctctttaaaggccaaa

SEQ ID NO: 8791436 - DNA, 22 bp, Homo sapiens
gcatttttctctcctataggag

SEQ ID NO: 8791437 - DNA, 22 bp, Homo sapiens
gcatttttgatcccactaggat

SEQ ID NO: 8791438 - DNA, 22 bp, Homo sapiens
gcatttttgatcccactaggat

SEQ ID NO: 8791439 - DNA, 22 bp, Homo sapiens
gcatttttctctcctataggag

SEQ ID NO: 8791440 - DNA, 22 bp, Homo sapiens
gcatttttgatcccactaggat

SEQ ID NO: 8791441 - DNA, 22 bp, Homo sapiens
gccaagctcaccttctgatgga

SEQ ID NO: 8791442 - DNA, 22 bp, Homo sapiens
gcatttttgatcccactaggat

SEQ ID NO: 8791443 - DNA, 22 bp, Homo sapiens
gccaagcctgtagacacaagct

SEQ ID NO: 8791444 - DNA, 22 bp, Homo sapiens
gccaaggcctctgcaggatgag

SEQ ID NO: 8791445 - DNA, 22 bp, Homo sapiens
gccaaggcctctgcaggatgag

SEQ ID NO: 8791446 - DNA, 22 bp, Homo sapiens
gccaaggataccagctgtgaga

SEQ ID NO: 8791447 - DNA, 22 bp, Homo sapiens
gccaaggcctctgcaggatgag

SEQ ID NO: 8791448 - DNA, 22 bp, Homo sapiens
gccaaggcctgcagcacctcat

SEQ ID NO: 8791449 - DNA, 22 bp, Homo sapiens
gccaaggctgaggccctgggct

SEQ ID NO: 8791450 - DNA, 21 bp, Homo sapiens
gccaaggaggctagagaacat

SEQ ID NO: 8791451 - DNA, 22 bp, Homo sapiens
gccagcagtccagtccttagtg

SEQ ID NO: 8791452 - DNA, 22 bp, Homo sapiens
gccagcagtccagtccttagtg

SEQ ID NO: 8791453 - DNA, 22 bp, Homo sapiens
gccagcagtatgtcctggcagt

SEQ ID NO: 8791454 - DNA, 22 bp, Homo sapiens
gccagcagtatgtcctggcagt

SEQ ID NO: 8791455 - DNA, 22 bp, Homo sapiens
gccagcagtcctgctgtgtgcc

SEQ ID NO: 8791456 - DNA, 22 bp, Homo sapiens
gccagcagtccagtccttagtg

SEQ ID NO: 8791457 - DNA, 22 bp, Homo sapiens
gccagcagtcctgctgtgtgcc

SEQ ID NO: 8791458 - DNA, 22 bp, Homo sapiens
gccagccataggccagcactgg

SEQ ID NO: 8791459 - DNA, 22 bp, Homo sapiens
gccagcatagtaagcagtcatc

SEQ ID NO: 8791460 - DNA, 22 bp, Homo sapiens
gccagcagtggccaccaccagg

SEQ ID NO: 8791461 - DNA, 22 bp, Homo sapiens
gccagcatagtaagcagtcatc

SEQ ID NO: 8791462 - DNA, 22 bp, Homo sapiens
gccagcccattaacccctgtcc

SEQ ID NO: 8791463 - DNA, 22 bp, Homo sapiens
gccagcccattaacccctgtcc

SEQ ID NO: 8791464 - DNA, 22 bp, Homo sapiens
gccagcccagctccaggggaaa

SEQ ID NO: 8791465 - DNA, 22 bp, Homo sapiens
gccagcccagctccaggggaaa

SEQ ID NO: 8791466 - DNA, 21 bp, Homo sapiens
gccagccatgcttgcctaggc

SEQ ID NO: 8791467 - DNA, 22 bp, Homo sapiens
gccagccccttagggctctccc

SEQ ID NO: 8791468 - DNA, 22 bp, Homo sapiens
gccagccccttagggctctccc

SEQ ID NO: 8791469 - DNA, 22 bp, Homo sapiens
gccagccccttagggctctccc

SEQ ID NO: 8791470 - DNA, 22 bp, Homo sapiens
gccagccccttagggctctccc

SEQ ID NO: 8791471 - DNA, 22 bp, Homo sapiens
gccagccccagacatcctatcg

SEQ ID NO: 8791472 - DNA, 22 bp, Homo sapiens
gccagcccctccatcctgttca

SEQ ID NO: 8791473 - DNA, 22 bp, Homo sapiens
gccagaggcccaaggacagctg

SEQ ID NO: 8791474 - DNA, 22 bp, Homo sapiens
gccagcagggcccaaatgctgg

SEQ ID NO: 8791475 - DNA, 20 bp, Homo sapiens
gccagaggccggcaggggct

SEQ ID NO: 8791476 - DNA, 22 bp, Homo sapiens
gccagcagggcggagccatcta

SEQ ID NO: 8791477 - DNA, 22 bp, Homo sapiens
gccagcagggcggagccatcta

SEQ ID NO: 8791478 - DNA, 22 bp, Homo sapiens
gccagcaggtggagagatcaag

SEQ ID NO: 8791479 - DNA, 22 bp, Homo sapiens
gccagcaggtggagagatcaag

SEQ ID NO: 8791480 - DNA, 22 bp, Homo sapiens
gccagcaggttgtcaaggagct

SEQ ID NO: 8791481 - DNA, 22 bp, Homo sapiens
gccagcaggttgtcaaggagct

SEQ ID NO: 8791482 - DNA, 22 bp, Homo sapiens
gccagcaggttgtcaaggagct

SEQ ID NO: 8791483 - DNA, 22 bp, Homo sapiens
gccagagcttcccccgagtgtg

SEQ ID NO: 8791484 - DNA, 23 bp, Homo sapiens
gccagaggaacgcagagctttct

SEQ ID NO: 8791485 - DNA, 22 bp, Homo sapiens
gccagagctgagtgaggttctt

SEQ ID NO: 8791486 - DNA, 22 bp, Homo sapiens
gccagagctgagacacgagtcc

SEQ ID NO: 8791487 - DNA, 23 bp, Homo sapiens
gccagaggaacgcagagctttct

SEQ ID NO: 8791488 - DNA, 22 bp, Homo sapiens
gccagaggaacgctgcgcgccc

SEQ ID NO: 8791489 - DNA, 22 bp, Homo sapiens
gccagaggcccaaggacagctg

SEQ ID NO: 8791490 - DNA, 22 bp, Homo sapiens
gccagaggcccaaggacagctg

SEQ ID NO: 8791491 - DNA, 22 bp, Homo sapiens
gcatccaggctgcccctctgcg

SEQ ID NO: 8791492 - DNA, 22 bp, Homo sapiens
gcatccaggctgcccctctgcg

SEQ ID NO: 8791493 - DNA, 22 bp, Homo sapiens
gcatccaggctgcccctctgcg

SEQ ID NO: 8791494 - DNA, 22 bp, Homo sapiens
gcatccagtcttggctcctgga

SEQ ID NO: 8791495 - DNA, 20 bp, Homo sapiens
gcatccagacacccagctgc

SEQ ID NO: 8791496 - DNA, 23 bp, Homo sapiens
gcatccagagctcagtccccttt

SEQ ID NO: 8791497 - DNA, 22 bp, Homo sapiens
gcataaacttaagattttgttt

SEQ ID NO: 8791498 - DNA, 22 bp, Homo sapiens
gcataaacttaagattttgttt

SEQ ID NO: 8791499 - DNA, 22 bp, Homo sapiens
gcataaactccaaaaggcaggg

SEQ ID NO: 8791500 - DNA, 19 bp, Homo sapiens
gcataaatacactattgtc

SEQ ID NO: 8791501 - DNA, 22 bp, Homo sapiens
gcatccaaaccattcatcagcc

SEQ ID NO: 8791502 - DNA, 19 bp, Homo sapiens
gcatccatggaggccgctt

SEQ ID NO: 8791503 - DNA, 22 bp, Homo sapiens
gcatcccaaatctgaaagtcca

SEQ ID NO: 8791504 - DNA, 19 bp, Homo sapiens
gcatccatggaggccgctt

SEQ ID NO: 8791505 - DNA, 22 bp, Homo sapiens
gcatccttaactctgtagatgc

SEQ ID NO: 8791506 - DNA, 22 bp, Homo sapiens
gcatccttaactctgtagatgc

SEQ ID NO: 8791507 - DNA, 22 bp, Homo sapiens
gcatcctggctctaggtgtcat

SEQ ID NO: 8791508 - DNA, 22 bp, Homo sapiens
gcatctaaggtggataacttct

SEQ ID NO: 8791509 - DNA, 20 bp, Homo sapiens
gcatctccagggctgtctcc

SEQ ID NO: 8791510 - DNA, 22 bp, Homo sapiens
gcatctaaacttgcatcattgt

SEQ ID NO: 8791511 - DNA, 22 bp, Homo sapiens
gcatctaaataaacgtgggagt

SEQ ID NO: 8791512 - DNA, 22 bp, Homo sapiens
gcatcctttcctttccattgtg

SEQ ID NO: 8791513 - DNA, 22 bp, Homo sapiens
gcatccttgggcccagctcctg

SEQ ID NO: 8791514 - DNA, 22 bp, Homo sapiens
gcatctgtgtttctagctagga

SEQ ID NO: 8791515 - DNA, 22 bp, Homo sapiens
gcatctctacaacgaagacagt

SEQ ID NO: 8791516 - DNA, 22 bp, Homo sapiens
gcatctgatccaatagatatat

SEQ ID NO: 8791517 - DNA, 22 bp, Homo sapiens
gcatctctttagaatcagatgg

SEQ ID NO: 8791518 - DNA, 21 bp, Homo sapiens
gcatgaaaacagcctgtgctc

SEQ ID NO: 8791519 - DNA, 22 bp, Homo sapiens
gcatgaaatgagcgaatataat

SEQ ID NO: 8791520 - DNA, 22 bp, Homo sapiens
gcatctttctgtccattcagca

SEQ ID NO: 8791521 - DNA, 22 bp, Homo sapiens
gcatctttagcctctccgtggc

SEQ ID NO: 8791522 - DNA, 22 bp, Homo sapiens
gcatctgttagagtgtgcatgc

SEQ ID NO: 8791523 - DNA, 22 bp, Homo sapiens
gcatgaggtttgggctctgtga

SEQ ID NO: 8791524 - DNA, 19 bp, Homo sapiens
gcatttctctttacagcca

SEQ ID NO: 8791525 - DNA, 22 bp, Homo sapiens
gcatgcaaaaaatgtatttgtt

SEQ ID NO: 8791526 - DNA, 22 bp, Homo sapiens
gcatgcaactcccagttctgcc

SEQ ID NO: 8791527 - DNA, 22 bp, Homo sapiens
gcatttggaacttggttgagat

SEQ ID NO: 8791528 - DNA, 22 bp, Homo sapiens
gcatttggtgatgcaccgttta

SEQ ID NO: 8791529 - DNA, 22 bp, Homo sapiens
gcatttggaacttggttgagat

SEQ ID NO: 8791530 - DNA, 22 bp, Homo sapiens
gcagggctcattgccaggcatt

SEQ ID NO: 8791531 - DNA, 22 bp, Homo sapiens
gcagggctcattgccaggcatt

SEQ ID NO: 8791532 - DNA, 22 bp, Homo sapiens
gcagggctcattgccaggcatt

SEQ ID NO: 8791533 - DNA, 22 bp, Homo sapiens
gcagggctccactgtggccaag

SEQ ID NO: 8791534 - DNA, 22 bp, Homo sapiens
gcagggctccactgtggccaag

SEQ ID NO: 8791535 - DNA, 22 bp, Homo sapiens
gcagggctccactgtggccaag

SEQ ID NO: 8791536 - DNA, 22 bp, Homo sapiens
gcagggctcattgccaggcatt

SEQ ID NO: 8791537 - DNA, 22 bp, Homo sapiens
gcagggctcagccgctcccacc

SEQ ID NO: 8791538 - DNA, 22 bp, Homo sapiens
gcagggctcaacaggacacccc

SEQ ID NO: 8791539 - DNA, 22 bp, Homo sapiens
gcagggctattggaaggagatg

SEQ ID NO: 8791540 - DNA, 22 bp, Homo sapiens
gcagtattcattgtttccctga

SEQ ID NO: 8791541 - DNA, 22 bp, Homo sapiens
gcagtatctatgtgatgggttg

SEQ ID NO: 8791542 - DNA, 22 bp, Homo sapiens
gcagtatatggattttaaacat

SEQ ID NO: 8791543 - DNA, 22 bp, Homo sapiens
gcagtatatccattacttcata

SEQ ID NO: 8791544 - DNA, 22 bp, Homo sapiens
gcagggctccactgtggccaag

SEQ ID NO: 8791545 - DNA, 22 bp, Homo sapiens
gcagggctctgctgtagtccta

SEQ ID NO: 8791546 - DNA, 22 bp, Homo sapiens
gcagtcagtaaggcagccagaa

SEQ ID NO: 8791547 - DNA, 22 bp, Homo sapiens
gcagtcagacaggaggagctcc

SEQ ID NO: 8791548 - DNA, 22 bp, Homo sapiens
gcagtcagacaggaggagctcc

SEQ ID NO: 8791549 - DNA, 22 bp, Homo sapiens
gcagtccattgacagaggtctt

SEQ ID NO: 8791550 - DNA, 22 bp, Homo sapiens
gcagtcatccagcctttccact

SEQ ID NO: 8791551 - DNA, 21 bp, Homo sapiens
gcagtcatcatcaagctttgg

SEQ ID NO: 8791552 - DNA, 22 bp, Homo sapiens
gcagtccaaagtggctctcacc

SEQ ID NO: 8791553 - DNA, 22 bp, Homo sapiens
gcagtcatggaaaaatgtatac

SEQ ID NO: 8791554 - DNA, 22 bp, Homo sapiens
gcagtcctgtagcgactttttt

SEQ ID NO: 8791555 - DNA, 20 bp, Homo sapiens
gcagtctgtcacagagcatg

SEQ ID NO: 8791556 - DNA, 19 bp, Homo sapiens
gcagtctgttgaagggcag

SEQ ID NO: 8791557 - DNA, 19 bp, Homo sapiens
gcagtctgttgaagggcag

SEQ ID NO: 8791558 - DNA, 22 bp, Homo sapiens
gcagtcttgccacagggtttca

SEQ ID NO: 8791559 - DNA, 22 bp, Homo sapiens
gcagtctataaatcagctttgc

SEQ ID NO: 8791560 - DNA, 22 bp, Homo sapiens
gcagtctatcttgtgatttaac

SEQ ID NO: 8791561 - DNA, 22 bp, Homo sapiens
gcagtctctcaggatttaagct

SEQ ID NO: 8791562 - DNA, 20 bp, Homo sapiens
gcagtctgcctctgtgtggt

SEQ ID NO: 8791563 - DNA, 20 bp, Homo sapiens
gcagtctgcctctgtgtggt

SEQ ID NO: 8791564 - DNA, 22 bp, Homo sapiens
gcagtctttgagtatcttcaaa

SEQ ID NO: 8791565 - DNA, 22 bp, Homo sapiens
gcagtctttttcttctagctaa

SEQ ID NO: 8791566 - DNA, 22 bp, Homo sapiens
gcagtctttttcttctagctaa

SEQ ID NO: 8791567 - DNA, 17 bp, Homo sapiens
gcagtgaaaagagatca

SEQ ID NO: 8791568 - DNA, 22 bp, Homo sapiens
gcaggctgccaccttctgagtt

SEQ ID NO: 8791569 - DNA, 22 bp, Homo sapiens
gcaggctgccaccttctgagtt

SEQ ID NO: 8791570 - DNA, 22 bp, Homo sapiens
gcaggctgccaccttctgagtt

SEQ ID NO: 8791571 - DNA, 22 bp, Homo sapiens
gcaggctgccaccttctgagtt

SEQ ID NO: 8791572 - DNA, 22 bp, Homo sapiens
gcagggccttagcagcggctgc

SEQ ID NO: 8791573 - DNA, 22 bp, Homo sapiens
gcagggccttagcagcggctgc

SEQ ID NO: 8791574 - DNA, 22 bp, Homo sapiens
gcagggccttggtcatcttttt

SEQ ID NO: 8791575 - DNA, 22 bp, Homo sapiens
gcagggccttagcagcggctgc

SEQ ID NO: 8791576 - DNA, 22 bp, Homo sapiens
gcaggctgatgactggagttgg

SEQ ID NO: 8791577 - DNA, 22 bp, Homo sapiens
gcaggctgatgactggagttgg

SEQ ID NO: 8791578 - DNA, 22 bp, Homo sapiens
gcaggctgatgactggagttgg

SEQ ID NO: 8791579 - DNA, 22 bp, Homo sapiens
gcaggctgatgactggagttgg

SEQ ID NO: 8791580 - DNA, 22 bp, Homo sapiens
gcaggctgatagaggattccat

SEQ ID NO: 8791581 - DNA, 22 bp, Homo sapiens
gcaggctgatagaggattccat

SEQ ID NO: 8791582 - DNA, 22 bp, Homo sapiens
gcagggctaggtcttctagggc

SEQ ID NO: 8791583 - DNA, 22 bp, Homo sapiens
gcagggctagatatttgcaagt

SEQ ID NO: 8791584 - DNA, 22 bp, Homo sapiens
gcagggctcaacaggacacccc

SEQ ID NO: 8791585 - DNA, 22 bp, Homo sapiens
gcagggctattggaaggagatg

SEQ ID NO: 8791586 - DNA, 22 bp, Homo sapiens
gcagggctaatggggcaagtag

SEQ ID NO: 8791587 - DNA, 22 bp, Homo sapiens
gcagggcggcccagagcaggcc

SEQ ID NO: 8791588 - DNA, 22 bp, Homo sapiens
gcagggcggcccagagcaggcc

SEQ ID NO: 8791589 - DNA, 22 bp, Homo sapiens
gcagggcggcccagagcaggcc

SEQ ID NO: 8791590 - DNA, 22 bp, Homo sapiens
gcagggcgcgtttgagcgggct

SEQ ID NO: 8791591 - DNA, 20 bp, Homo sapiens
gcagggcgacacgggggagg

SEQ ID NO: 8791592 - DNA, 22 bp, Homo sapiens
gcaggctgagttgggaaaccaa

SEQ ID NO: 8791593 - DNA, 22 bp, Homo sapiens
gcaggctgagttgggaaaccaa

SEQ ID NO: 8791594 - DNA, 22 bp, Homo sapiens
gcaggctgagttgggaaaccaa

SEQ ID NO: 8791595 - DNA, 22 bp, Homo sapiens
gcaggctgagtattaccctagt

SEQ ID NO: 8791596 - DNA, 22 bp, Homo sapiens
gcaggctgagtattaccctagt

SEQ ID NO: 8791597 - DNA, 22 bp, Homo sapiens
gcaggctgagtattaccctagt

SEQ ID NO: 8791598 - DNA, 22 bp, Homo sapiens
gcaggctgagagtccaagaagg

SEQ ID NO: 8791599 - DNA, 22 bp, Homo sapiens
gcaggctgagagtccaagaagg

SEQ ID NO: 8791600 - DNA, 22 bp, Homo sapiens
gcaggctgaaactcggggtcta

SEQ ID NO: 8791601 - DNA, 22 bp, Homo sapiens
gcaggctgaaactcggggtcta

SEQ ID NO: 8791602 - DNA, 22 bp, Homo sapiens
gcaggctgagagtccaagaagg

SEQ ID NO: 8791603 - DNA, 22 bp, Homo sapiens
gcaggctgaaactcggggtcta

SEQ ID NO: 8791604 - DNA, 22 bp, Homo sapiens
gcaggctcgttggaagtcccct

SEQ ID NO: 8791605 - DNA, 22 bp, Homo sapiens
gcaggctcttctttctgcccag

SEQ ID NO: 8791606 - DNA, 22 bp, Homo sapiens
gcaggctcccttgcagagcagg

SEQ ID NO: 8791607 - DNA, 22 bp, Homo sapiens
gcaggctcccttgcagagcagg

SEQ ID NO: 8791608 - DNA, 20 bp, Homo sapiens
gcaggctccgggcttgggag

SEQ ID NO: 8791609 - DNA, 22 bp, Homo sapiens
gcaggctccaggccggcccctt

SEQ ID NO: 8791610 - DNA, 22 bp, Homo sapiens
gcaggctccaaggcctgggaga

SEQ ID NO: 8791611 - DNA, 22 bp, Homo sapiens
gcaggctccaaggcctgggaga

SEQ ID NO: 8791612 - DNA, 22 bp, Homo sapiens
gcaggctcaaaagctggtagga

SEQ ID NO: 8791613 - DNA, 22 bp, Homo sapiens
gcaggctatgtcagggccgctc

SEQ ID NO: 8791614 - DNA, 22 bp, Homo sapiens
gcaggctccaactggaggagtt

SEQ ID NO: 8791615 - DNA, 22 bp, Homo sapiens
gcaggctccaactggaggagtt

SEQ ID NO: 8791616 - DNA, 22 bp, Homo sapiens
gcaggctcagagcagattagca

SEQ ID NO: 8791617 - DNA, 22 bp, Homo sapiens
gcaggctcactctgtttggctc

SEQ ID NO: 8791618 - DNA, 22 bp, Homo sapiens
gcaggagttaggcgtcgtggat

SEQ ID NO: 8791619 - DNA, 22 bp, Homo sapiens
gcaggcctctgttgagggcctt

SEQ ID NO: 8791620 - DNA, 22 bp, Homo sapiens
gcaggagtgtggtgggacatcc

SEQ ID NO: 8791621 - DNA, 22 bp, Homo sapiens
gcaggagtggagaccatgggga

SEQ ID NO: 8791622 - DNA, 22 bp, Homo sapiens
gcaggagtgacatggatgtgga

SEQ ID NO: 8791623 - DNA, 22 bp, Homo sapiens
gcaggagtatgcagctatggtt

SEQ ID NO: 8791624 - DNA, 22 bp, Homo sapiens
gcaggaggttgagccaggactg

SEQ ID NO: 8791625 - DNA, 22 bp, Homo sapiens
gcaggaggttgagccaggactg

SEQ ID NO: 8791626 - DNA, 22 bp, Homo sapiens
gcaggaggttgagccaggactg

SEQ ID NO: 8791627 - DNA, 22 bp, Homo sapiens
gcaggaggttgagccaggactg

SEQ ID NO: 8791628 - DNA, 22 bp, Homo sapiens
gcaggaggttgagccaggactg

SEQ ID NO: 8791629 - DNA, 22 bp, Homo sapiens
gcagctggatttcaagagggag

SEQ ID NO: 8791630 - DNA, 22 bp, Homo sapiens
gcagctggagccagccagacac

SEQ ID NO: 8791631 - DNA, 22 bp, Homo sapiens
gcagctggagccagccagacac

SEQ ID NO: 8791632 - DNA, 22 bp, Homo sapiens
gcagctggagcatcttctcatc

SEQ ID NO: 8791633 - DNA, 22 bp, Homo sapiens
gcagctggagaaataccaccct

SEQ ID NO: 8791634 - DNA, 22 bp, Homo sapiens
gcagctggagaaataccaccct

SEQ ID NO: 8791635 - DNA, 22 bp, Homo sapiens
gcagctggagaaataccaccct

SEQ ID NO: 8791636 - DNA, 22 bp, Homo sapiens
gcagctggacccacacggctta

SEQ ID NO: 8791637 - DNA, 22 bp, Homo sapiens
gcagctggacccacacggctta

SEQ ID NO: 8791638 - DNA, 22 bp, Homo sapiens
gcagctggacccacacggctta

SEQ ID NO: 8791639 - DNA, 22 bp, Homo sapiens
gcaggaggatcacttgagccca

SEQ ID NO: 8791640 - DNA, 22 bp, Homo sapiens
gcaggaggatcacttgagccca

SEQ ID NO: 8791641 - DNA, 22 bp, Homo sapiens
gcaggaggatcacttgagccca

SEQ ID NO: 8791642 - DNA, 22 bp, Homo sapiens
gcaggaggatcacttgagccca

SEQ ID NO: 8791643 - DNA, 22 bp, Homo sapiens
gcaggagctggaaagtgatgtt

SEQ ID NO: 8791644 - DNA, 22 bp, Homo sapiens
gcagctggccctgacacgcaga

SEQ ID NO: 8791645 - DNA, 22 bp, Homo sapiens
gcagctggccctgacacgcaga

SEQ ID NO: 8791646 - DNA, 22 bp, Homo sapiens
gcagctggcccctttccttgtt

SEQ ID NO: 8791647 - DNA, 22 bp, Homo sapiens
gcagctggcccctttccttgtt

SEQ ID NO: 8791648 - DNA, 22 bp, Homo sapiens
gcaggagctggaaagtgatgtt

SEQ ID NO: 8791649 - DNA, 22 bp, Homo sapiens
gcaggagctgctctcctgacga

SEQ ID NO: 8791650 - DNA, 22 bp, Homo sapiens
gcaggagctgctctcctgacga

SEQ ID NO: 8791651 - DNA, 22 bp, Homo sapiens
gcagctggccctgacacgcaga

SEQ ID NO: 8791652 - DNA, 22 bp, Homo sapiens
gcaggagctggaaagtgatgtt

SEQ ID NO: 8791653 - DNA, 22 bp, Homo sapiens
gcagaggaggacccaggaatta

SEQ ID NO: 8791654 - DNA, 22 bp, Homo sapiens
gcagaggaggacccaggaatta

SEQ ID NO: 8791655 - DNA, 22 bp, Homo sapiens
gcagcagccgacatggattgca

SEQ ID NO: 8791656 - DNA, 22 bp, Homo sapiens
gcagcagccgacatggattgca

SEQ ID NO: 8791657 - DNA, 22 bp, Homo sapiens
gcagcagcccagggctctcaga

SEQ ID NO: 8791658 - DNA, 22 bp, Homo sapiens
gcagcagcggggcccctgcgcg

SEQ ID NO: 8791659 - DNA, 22 bp, Homo sapiens
gcagcagcggggcccctgcgcg

SEQ ID NO: 8791660 - DNA, 22 bp, Homo sapiens
gcagaggaggacccaggaatta

SEQ ID NO: 8791661 - DNA, 22 bp, Homo sapiens
gcagaggagcaagttgctacag

SEQ ID NO: 8791662 - DNA, 23 bp, Homo sapiens
gcagaggagcaagctggacacca

SEQ ID NO: 8791663 - DNA, 23 bp, Homo sapiens
gcagaggagcaagctggacacca

SEQ ID NO: 8791664 - DNA, 23 bp, Homo sapiens
gcagaggagcaagctggacacca

SEQ ID NO: 8791665 - DNA, 22 bp, Homo sapiens
gcagcagctctgaatgggcccc

SEQ ID NO: 8791666 - DNA, 22 bp, Homo sapiens
gcagcagctgacagtgggtgcc

SEQ ID NO: 8791667 - DNA, 22 bp, Homo sapiens
gcagcagctccctatccaggct

SEQ ID NO: 8791668 - DNA, 22 bp, Homo sapiens
gcagcagctccctatccaggct

SEQ ID NO: 8791669 - DNA, 22 bp, Homo sapiens
gcagcagctctgaatgggcccc

SEQ ID NO: 8791670 - DNA, 22 bp, Homo sapiens
gcagcagctctgaatgggcccc

SEQ ID NO: 8791671 - DNA, 22 bp, Homo sapiens
gcagcagctcagccgggcactg

SEQ ID NO: 8791672 - DNA, 22 bp, Homo sapiens
gcagcagctcagccgggcactg

SEQ ID NO: 8791673 - DNA, 22 bp, Homo sapiens
gcagcagctcagccgggcactg

SEQ ID NO: 8791674 - DNA, 22 bp, Homo sapiens
gcagcagctcagccgggcactg

SEQ ID NO: 8791675 - DNA, 22 bp, Homo sapiens
gcagcagctcagttctgggagg

SEQ ID NO: 8791676 - DNA, 22 bp, Homo sapiens
gcagcagctcagttctgggagg

SEQ ID NO: 8791677 - DNA, 22 bp, Homo sapiens
gcagcagctcagttctgggagg

SEQ ID NO: 8791678 - DNA, 22 bp, Homo sapiens
gcagcagctccctatccaggct

SEQ ID NO: 8791679 - DNA, 22 bp, Homo sapiens
gcagcagctgacagtgggtgcc

SEQ ID NO: 8791680 - DNA, 22 bp, Homo sapiens
gcagcaggaataggataagcaa

SEQ ID NO: 8791681 - DNA, 22 bp, Homo sapiens
gcagcaggagagtttgtcctgc

SEQ ID NO: 8791682 - DNA, 22 bp, Homo sapiens
gcagcaggagagtaatagcggt

SEQ ID NO: 8791683 - DNA, 22 bp, Homo sapiens
gcagcaggcacttaccgttgct

SEQ ID NO: 8791684 - DNA, 22 bp, Homo sapiens
gcagcaggatggccaattgcca

SEQ ID NO: 8791685 - DNA, 22 bp, Homo sapiens
gcagcaggatggccaattgcca

SEQ ID NO: 8791686 - DNA, 22 bp, Homo sapiens
gcagcaggcacggtctcgacat

SEQ ID NO: 8791687 - DNA, 22 bp, Homo sapiens
gcagctgcaggtggtcccatgc

SEQ ID NO: 8791688 - DNA, 18 bp, Homo sapiens
gcagctgcagttgtagct

SEQ ID NO: 8791689 - DNA, 22 bp, Homo sapiens
gcagctgcaggcaggcttgctg

SEQ ID NO: 8791690 - DNA, 22 bp, Homo sapiens
gcagctgccgtgagctcacgcc

SEQ ID NO: 8791691 - DNA, 22 bp, Homo sapiens
gcagctgccgtgagctcacgcc

SEQ ID NO: 8791692 - DNA, 22 bp, Homo sapiens
gcagctgcctaaagtgctaaga

SEQ ID NO: 8791693 - DNA, 22 bp, Homo sapiens
gcagctgccgtgagctcacgcc

SEQ ID NO: 8791694 - DNA, 22 bp, Homo sapiens
gcagctgccccgactgtgagtc

SEQ ID NO: 8791695 - DNA, 22 bp, Homo sapiens
gcagctgccccgactgtgagtc

SEQ ID NO: 8791696 - DNA, 20 bp, Homo sapiens
gcagctgcccccagtccctg

SEQ ID NO: 8791697 - DNA, 22 bp, Homo sapiens
gcagctgccccgactgtgagtc

SEQ ID NO: 8791698 - DNA, 22 bp, Homo sapiens
gcagctgcaataggcatcaagc

SEQ ID NO: 8791699 - DNA, 22 bp, Homo sapiens
gcagctgcagagaccgggtggg

SEQ ID NO: 8791700 - DNA, 22 bp, Homo sapiens
gcagctgcagaccctcagtgct

SEQ ID NO: 8791701 - DNA, 22 bp, Homo sapiens
gcagctgcaagcacttctggca

SEQ ID NO: 8791702 - DNA, 22 bp, Homo sapiens
gcagccacactgttacagaatg

SEQ ID NO: 8791703 - DNA, 21 bp, Homo sapiens
gcagcatgagaaagccccaaa

SEQ ID NO: 8791704 - DNA, 22 bp, Homo sapiens
gcagcatgtgccttaaatcatt

SEQ ID NO: 8791705 - DNA, 22 bp, Homo sapiens
gcagcatgttgaaagggccaca

SEQ ID NO: 8791706 - DNA, 22 bp, Homo sapiens
gcagcatcaggttcactgcgtg

SEQ ID NO: 8791707 - DNA, 22 bp, Homo sapiens
gcagcatcaatccatgcttctc

SEQ ID NO: 8791708 - DNA, 22 bp, Homo sapiens
gcagcatccccaggcagcaggg

SEQ ID NO: 8791709 - DNA, 22 bp, Homo sapiens
gcagcatctagggcactggcct

SEQ ID NO: 8791710 - DNA, 22 bp, Homo sapiens
gcagcatctgtacatagacgct

SEQ ID NO: 8791711 - DNA, 22 bp, Homo sapiens
gcagcatctagggcactggcct

SEQ ID NO: 8791712 - DNA, 22 bp, Homo sapiens
gcagcatccttggcctccaccc

SEQ ID NO: 8791713 - DNA, 22 bp, Homo sapiens
gcagcatcctgggccacagtcc

SEQ ID NO: 8791714 - DNA, 22 bp, Homo sapiens
gcagcagtgcgggcagctacag

SEQ ID NO: 8791715 - DNA, 22 bp, Homo sapiens
gcagcagtgcgggcagctacag

SEQ ID NO: 8791716 - DNA, 22 bp, Homo sapiens
gcagcagtgctttggaatcctg

SEQ ID NO: 8791717 - DNA, 19 bp, Homo sapiens
gcagcagtggaaggaaaaa

SEQ ID NO: 8791718 - DNA, 22 bp, Homo sapiens
gcagcagtaggaaataacacag

SEQ ID NO: 8791719 - DNA, 22 bp, Homo sapiens
gcagcagtggcagttaatattt

SEQ ID NO: 8791720 - DNA, 22 bp, Homo sapiens
gcagcagtggctgcaggtccca

SEQ ID NO: 8791721 - DNA, 22 bp, Homo sapiens
gcagcagtggtctgtagaagga

SEQ ID NO: 8791722 - DNA, 22 bp, Homo sapiens
gcagcagtggttttatcatttt

SEQ ID NO: 8791723 - DNA, 22 bp, Homo sapiens
gcagcatacagggagagtactc

SEQ ID NO: 8791724 - DNA, 21 bp, Homo sapiens
gcagcagtgttctagaatact

SEQ ID NO: 8791725 - DNA, 22 bp, Homo sapiens
gcactgtttatctaagtcttga

SEQ ID NO: 8791726 - DNA, 22 bp, Homo sapiens
gcacttaactggaaaagaattt

SEQ ID NO: 8791727 - DNA, 22 bp, Homo sapiens
gcacttcacatgccttttcctg

SEQ ID NO: 8791728 - DNA, 22 bp, Homo sapiens
gcacttcacatgccttttcctg

SEQ ID NO: 8791729 - DNA, 22 bp, Homo sapiens
gcactgtgctagaagccagggg

SEQ ID NO: 8791730 - DNA, 22 bp, Homo sapiens
gcactgtgctagaagccagggg

SEQ ID NO: 8791731 - DNA, 20 bp, Homo sapiens
gcactgttacaaagcacacc

SEQ ID NO: 8791732 - DNA, 18 bp, Homo sapiens
gcacttcacccagctagt

SEQ ID NO: 8791733 - DNA, 22 bp, Homo sapiens
gcacttgagccaatgctagtag

SEQ ID NO: 8791734 - DNA, 22 bp, Homo sapiens
gcacttgaagaattgaactgga

SEQ ID NO: 8791735 - DNA, 22 bp, Homo sapiens
gcactgggctccaggaaggagg

SEQ ID NO: 8791736 - DNA, 22 bp, Homo sapiens
gcactgggctccaggaaggagg

SEQ ID NO: 8791737 - DNA, 22 bp, Homo sapiens
gcactgggctccaggaaggagg

SEQ ID NO: 8791738 - DNA, 22 bp, Homo sapiens
gcactgggctccaggaaggagg

SEQ ID NO: 8791739 - DNA, 22 bp, Homo sapiens
gcactgggctccaggaaggagg

SEQ ID NO: 8791740 - DNA, 16 bp, Homo sapiens
gcactgggatgtcttc

SEQ ID NO: 8791741 - DNA, 22 bp, Homo sapiens
gcactgggagtctgtgggggtt

SEQ ID NO: 8791742 - DNA, 22 bp, Homo sapiens
gcactgggagtctgtgggggtt

SEQ ID NO: 8791743 - DNA, 22 bp, Homo sapiens
gcactgtgatcaaggctaagca

SEQ ID NO: 8791744 - DNA, 22 bp, Homo sapiens
gcactgtgctaaacatgtatca

SEQ ID NO: 8791745 - DNA, 22 bp, Homo sapiens
gcactgggctccaggaaggagg

SEQ ID NO: 8791746 - DNA, 23 bp, Homo sapiens
gcactgggctctcagcaaggtgt

SEQ ID NO: 8791747 - DNA, 23 bp, Homo sapiens
gcactgggctctcagcaaggtgt

SEQ ID NO: 8791748 - DNA, 23 bp, Homo sapiens
gcactgggctctcagcaaggtgt

SEQ ID NO: 8791749 - DNA, 22 bp, Homo sapiens
gcactgggaatgtgagcagctg

SEQ ID NO: 8791750 - DNA, 22 bp, Homo sapiens
gcactgggaatgtgagcagctg

SEQ ID NO: 8791751 - DNA, 22 bp, Homo sapiens
gcactgggaatgtgagcagctg

SEQ ID NO: 8791752 - DNA, 22 bp, Homo sapiens
gcactgggagctgcctgccggt

SEQ ID NO: 8791753 - DNA, 22 bp, Homo sapiens
gcactgggaatgctgatgggct

SEQ ID NO: 8791754 - DNA, 22 bp, Homo sapiens
gcactgggaatgctgatgggct

SEQ ID NO: 8791755 - DNA, 22 bp, Homo sapiens
gcactgggaatgtgagcagctg

SEQ ID NO: 8791756 - DNA, 22 bp, Homo sapiens
gcactgggaatgtgagcagctg

SEQ ID NO: 8791757 - DNA, 22 bp, Homo sapiens
gcactgggaatgctgatgggct

SEQ ID NO: 8791758 - DNA, 22 bp, Homo sapiens
gcactgggaatgctgatgggct

SEQ ID NO: 8791759 - DNA, 22 bp, Homo sapiens
gcactgggaatgagggcagctt

SEQ ID NO: 8791760 - DNA, 22 bp, Homo sapiens
gcagaggacacaggagggcaag

SEQ ID NO: 8791761 - DNA, 22 bp, Homo sapiens
gcagaggacacaggagggcaag

SEQ ID NO: 8791762 - DNA, 22 bp, Homo sapiens
gcagaggacacaggagggcaag

SEQ ID NO: 8791763 - DNA, 22 bp, Homo sapiens
gcagaggacacaggagggcaag

SEQ ID NO: 8791764 - DNA, 22 bp, Homo sapiens
gcagaggacacaggagggcaag

SEQ ID NO: 8791765 - DNA, 22 bp, Homo sapiens
gcagaggacacaggagggcaag

SEQ ID NO: 8791766 - DNA, 22 bp, Homo sapiens
gcagagctgagcggctgcccgg

SEQ ID NO: 8791767 - DNA, 22 bp, Homo sapiens
gcagagctctgttcttatctcc

SEQ ID NO: 8791768 - DNA, 21 bp, Homo sapiens
gcacttggaaacttcaactag

SEQ ID NO: 8791769 - DNA, 22 bp, Homo sapiens
gcacttggatatacaaatgaag

SEQ ID NO: 8791770 - DNA, 22 bp, Homo sapiens
gcacttggagggagggttcaag

SEQ ID NO: 8791771 - DNA, 22 bp, Homo sapiens
gcagaggacacaggagggcaag

SEQ ID NO: 8791772 - DNA, 22 bp, Homo sapiens
gcagaggacagggatttagatt

SEQ ID NO: 8791773 - DNA, 22 bp, Homo sapiens
gcagaggactcaatcaaggtat

SEQ ID NO: 8791774 - DNA, 22 bp, Homo sapiens
gcagaggactcaatcaaggtat

SEQ ID NO: 8791775 - DNA, 23 bp, Homo sapiens
gcagaggagcaagctggacacca

SEQ ID NO: 8791776 - DNA, 23 bp, Homo sapiens
gcagaggagcaagctggacacca

SEQ ID NO: 8791777 - DNA, 23 bp, Homo sapiens
gcagaggagcaagctggacacca

SEQ ID NO: 8791778 - DNA, 22 bp, Homo sapiens
gcagaggagcaagctggacacc

SEQ ID NO: 8791779 - DNA, 22 bp, Homo sapiens
gcagaggagcaagctggacacc

SEQ ID NO: 8791780 - DNA, 22 bp, Homo sapiens
gcagaggagcaagctggacacc

SEQ ID NO: 8791781 - DNA, 22 bp, Homo sapiens
gcactgaaattatatgcatttg

SEQ ID NO: 8791782 - DNA, 22 bp, Homo sapiens
gcactctgtgatctgcagagcc

SEQ ID NO: 8791783 - DNA, 22 bp, Homo sapiens
gcactctcctggctgccacagt

SEQ ID NO: 8791784 - DNA, 17 bp, Homo sapiens
gcactcccccacctcct

SEQ ID NO: 8791785 - DNA, 17 bp, Homo sapiens
gcactcccccacctcct

SEQ ID NO: 8791786 - DNA, 17 bp, Homo sapiens
gcactcccccacctcct

SEQ ID NO: 8791787 - DNA, 22 bp, Homo sapiens
gcacaggccatgggaggacagc

SEQ ID NO: 8791788 - DNA, 22 bp, Homo sapiens
gcacaggcacagagggccactg

SEQ ID NO: 8791789 - DNA, 22 bp, Homo sapiens
gcacaggcacagagggccactg

SEQ ID NO: 8791790 - DNA, 22 bp, Homo sapiens
gcacaggcaatagatacagcta

SEQ ID NO: 8791791 - DNA, 22 bp, Homo sapiens
gcacctgggcaaggattcagag

SEQ ID NO: 8791792 - DNA, 22 bp, Homo sapiens
gcacctgggacccagaggcacc

SEQ ID NO: 8791793 - DNA, 22 bp, Homo sapiens
gcacctgggacccagaggcacc

SEQ ID NO: 8791794 - DNA, 22 bp, Homo sapiens
gcacctgggacccagaggcacc

SEQ ID NO: 8791795 - DNA, 22 bp, Homo sapiens
gcacctgggacccagaggcacc

SEQ ID NO: 8791796 - DNA, 22 bp, Homo sapiens
gcactgaatgcttttactgtaa

SEQ ID NO: 8791797 - DNA, 22 bp, Homo sapiens
gcactgagaactgttttctaga

SEQ ID NO: 8791798 - DNA, 22 bp, Homo sapiens
gcactgagagctttattctaga

SEQ ID NO: 8791799 - DNA, 19 bp, Homo sapiens
gcactgaagagttggtcac

SEQ ID NO: 8791800 - DNA, 20 bp, Homo sapiens
gcactgaaattcaatgtttg

SEQ ID NO: 8791801 - DNA, 22 bp, Homo sapiens
gcactgaaattatatgcatttg

SEQ ID NO: 8791802 - DNA, 17 bp, Homo sapiens
gcactgagccacagttt

SEQ ID NO: 8791803 - DNA, 22 bp, Homo sapiens
gcactgagcattgttatttcca

SEQ ID NO: 8791804 - DNA, 21 bp, Homo sapiens
gcactgagcatctcctctgcc

SEQ ID NO: 8791805 - DNA, 22 bp, Homo sapiens
gcactgagcaccagccacagat

SEQ ID NO: 8791806 - DNA, 22 bp, Homo sapiens
gcactgagcaccagccacagat

SEQ ID NO: 8791807 - DNA, 22 bp, Homo sapiens
gcactgagatacatttctaagg

SEQ ID NO: 8791808 - DNA, 22 bp, Homo sapiens
gcactgagcaccagccacagat

SEQ ID NO: 8791809 - DNA, 22 bp, Homo sapiens
gcactgaggaaggagggagtgg

SEQ ID NO: 8791810 - DNA, 22 bp, Homo sapiens
gcactgaggaaggagggagtgg

SEQ ID NO: 8791811 - DNA, 18 bp, Homo sapiens
gcactgaggaaaacctct

SEQ ID NO: 8791812 - DNA, 22 bp, Homo sapiens
gcactgaggaaggagggagtgg

SEQ ID NO: 8791813 - DNA, 23 bp, Homo sapiens
gcactgagctcactagtcccctg

SEQ ID NO: 8791814 - DNA, 23 bp, Homo sapiens
gcactgagctcactagtcccctg

SEQ ID NO: 8791815 - DNA, 17 bp, Homo sapiens
gcactgagccacagttt

SEQ ID NO: 8791816 - DNA, 17 bp, Homo sapiens
gcactgagccacagttt

SEQ ID NO: 8791817 - DNA, 22 bp, Homo sapiens
gcactgagctttggaggagcag

SEQ ID NO: 8791818 - DNA, 22 bp, Homo sapiens
gcactgagctttggaggagcag

SEQ ID NO: 8791819 - DNA, 18 bp, Homo sapiens
gcactgaggaaaacctct

SEQ ID NO: 8791820 - DNA, 16 bp, Homo sapiens
gcactgccttgggccc

SEQ ID NO: 8791821 - DNA, 22 bp, Homo sapiens
gcactgcctgtgagccctggtt

SEQ ID NO: 8791822 - DNA, 22 bp, Homo sapiens
gcactgcctcatgctaataaat

SEQ ID NO: 8791823 - DNA, 22 bp, Homo sapiens
gcactgcctgtgagccctggtt

SEQ ID NO: 8791824 - DNA, 22 bp, Homo sapiens
gcactgcctgtgttcagggtaa

SEQ ID NO: 8791825 - DNA, 23 bp, Homo sapiens
gcactgccatgtgctctgcaggc

SEQ ID NO: 8791826 - DNA, 22 bp, Homo sapiens
gcactgcctatgcaaatgtact

SEQ ID NO: 8791827 - DNA, 22 bp, Homo sapiens
gcactgccctcttcggggttcc

SEQ ID NO: 8791828 - DNA, 22 bp, Homo sapiens
gcactgccatcaatgcatgaca

SEQ ID NO: 8791829 - DNA, 22 bp, Homo sapiens
gcactgccacataatctcagca

SEQ ID NO: 8791830 - DNA, 22 bp, Homo sapiens
gcactgccatcaatgcatgaca

SEQ ID NO: 8791831 - DNA, 22 bp, Homo sapiens
gcactgcagcctcagatggtgg

SEQ ID NO: 8791832 - DNA, 22 bp, Homo sapiens
gcactgcatctactggcaagta

SEQ ID NO: 8791833 - DNA, 22 bp, Homo sapiens
gcactgcaggtgggtggagagg

SEQ ID NO: 8791834 - DNA, 22 bp, Homo sapiens
gcactgcaggtgggtggagagg

SEQ ID NO: 8791835 - DNA, 22 bp, Homo sapiens
gcactgagtctgtcatgctgca

SEQ ID NO: 8791836 - DNA, 22 bp, Homo sapiens
gcactgagtctgtcatgctgca

SEQ ID NO: 8791837 - DNA, 22 bp, Homo sapiens
gcactgggaatgagggcagctt

SEQ ID NO: 8791838 - DNA, 22 bp, Homo sapiens
gcactgggaatgagggcagctt

SEQ ID NO: 8791839 - DNA, 22 bp, Homo sapiens
gcactgggaatgagggcagctt

SEQ ID NO: 8791840 - DNA, 22 bp, Homo sapiens
gcactgggaagaatgagcctgt

SEQ ID NO: 8791841 - DNA, 22 bp, Homo sapiens
gcactgggaatgagggcagctt

SEQ ID NO: 8791842 - DNA, 22 bp, Homo sapiens
gcactggagggtgtagttgctg

SEQ ID NO: 8791843 - DNA, 22 bp, Homo sapiens
gcactggatcttgggagacgtg

SEQ ID NO: 8791844 - DNA, 22 bp, Homo sapiens
gcactgggaagaatgagcctgt

SEQ ID NO: 8791845 - DNA, 22 bp, Homo sapiens
gcactggagatacagagatgaa

SEQ ID NO: 8791846 - DNA, 22 bp, Homo sapiens
gcactggagatacagagatgaa

SEQ ID NO: 8791847 - DNA, 22 bp, Homo sapiens
gcactggacaggagtgaaatta

SEQ ID NO: 8791848 - DNA, 23 bp, Homo sapiens
gcactggaaaaatgaagattact

SEQ ID NO: 8791849 - DNA, 22 bp, Homo sapiens
gcactggaaatacctagatgaa

SEQ ID NO: 8791850 - DNA, 22 bp, Homo sapiens
gagggggacgtatcctggtatg

SEQ ID NO: 8791851 - DNA, 22 bp, Homo sapiens
gagggggaaagtccctggagtc

SEQ ID NO: 8791852 - DNA, 22 bp, Homo sapiens
gagggggaaagtccctggagtc

SEQ ID NO: 8791853 - DNA, 22 bp, Homo sapiens
gaggggcttgaggccctgatgg

SEQ ID NO: 8791854 - DNA, 22 bp, Homo sapiens
gaggggctgtggagctctctgg

SEQ ID NO: 8791855 - DNA, 22 bp, Homo sapiens
gaggggctgtggagctctctgg

SEQ ID NO: 8791856 - DNA, 22 bp, Homo sapiens
gaggggctgggtagggcaaccc

SEQ ID NO: 8791857 - DNA, 22 bp, Homo sapiens
gaggggctgggtagggcaaccc

SEQ ID NO: 8791858 - DNA, 22 bp, Homo sapiens
gaggggctgtggagctctctgg

SEQ ID NO: 8791859 - DNA, 22 bp, Homo sapiens
gaggggctgggtagggcaaccc

SEQ ID NO: 8791860 - DNA, 22 bp, Homo sapiens
gaggggctggggttgactccaa

SEQ ID NO: 8791861 - DNA, 22 bp, Homo sapiens
gaggggctggggttgactccaa

SEQ ID NO: 8791862 - DNA, 22 bp, Homo sapiens
gaggggctgggcagtccctgga

SEQ ID NO: 8791863 - DNA, 22 bp, Homo sapiens
gaggggctgggcagtccctgga

SEQ ID NO: 8791864 - DNA, 22 bp, Homo sapiens
gaggggctggggttgactccaa

SEQ ID NO: 8791865 - DNA, 22 bp, Homo sapiens
gaggggctggggttgactccaa

SEQ ID NO: 8791866 - DNA, 22 bp, Homo sapiens
gaggggctgggtagggcaaccc

SEQ ID NO: 8791867 - DNA, 22 bp, Homo sapiens
gaggggtcttttgttgtcaggg

SEQ ID NO: 8791868 - DNA, 22 bp, Homo sapiens
gaggggtcctgccttggctgga

SEQ ID NO: 8791869 - DNA, 22 bp, Homo sapiens
gaggggtccaggaggcacttac

SEQ ID NO: 8791870 - DNA, 22 bp, Homo sapiens
gaggggtcttttgttgtcaggg

SEQ ID NO: 8791871 - DNA, 22 bp, Homo sapiens
gaggggtccaggaggcacttac

SEQ ID NO: 8791872 - DNA, 22 bp, Homo sapiens
gaggggtccaggaggcacttac

SEQ ID NO: 8791873 - DNA, 22 bp, Homo sapiens
gaggggtcacatgggctggctt

SEQ ID NO: 8791874 - DNA, 22 bp, Homo sapiens
gagggggagatgtgcacacact

SEQ ID NO: 8791875 - DNA, 22 bp, Homo sapiens
gaggggtcctgccttggctgga

SEQ ID NO: 8791876 - DNA, 22 bp, Homo sapiens
gagggtcagaagggcctggttc

SEQ ID NO: 8791877 - DNA, 22 bp, Homo sapiens
gaggggtgtggagccatcagtt

SEQ ID NO: 8791878 - DNA, 22 bp, Homo sapiens
gagggtccctgctcagggccag

SEQ ID NO: 8791879 - DNA, 22 bp, Homo sapiens
gcaaatccttctgcgaccaggt

SEQ ID NO: 8791880 - DNA, 22 bp, Homo sapiens
gagggtcagaagggcctggttc

SEQ ID NO: 8791881 - DNA, 22 bp, Homo sapiens
gagggtccccatgcagagctca

SEQ ID NO: 8791882 - DNA, 22 bp, Homo sapiens
gagggtcccgagccctgtcaga

SEQ ID NO: 8791883 - DNA, 22 bp, Homo sapiens
gagggtcccgagccctgtcaga

SEQ ID NO: 8791884 - DNA, 22 bp, Homo sapiens
gcaaatgcactgcatttagatt

SEQ ID NO: 8791885 - DNA, 22 bp, Homo sapiens
gcaagacatgtctaaggtttaa

SEQ ID NO: 8791886 - DNA, 22 bp, Homo sapiens
gcaagacaatggagcataaacg

SEQ ID NO: 8791887 - DNA, 22 bp, Homo sapiens
gcaagacaatggagcataaacg

SEQ ID NO: 8791888 - DNA, 22 bp, Homo sapiens
gcaagaaaagagccttcagtgg

SEQ ID NO: 8791889 - DNA, 22 bp, Homo sapiens
gcaaatgctaaagtgtagagac

SEQ ID NO: 8791890 - DNA, 22 bp, Homo sapiens
gcaagaaaagagccttcagtgg

SEQ ID NO: 8791891 - DNA, 22 bp, Homo sapiens
gcaagaaaagagccttcagtgg

SEQ ID NO: 8791892 - DNA, 22 bp, Homo sapiens
gcaagcaaaatgggagattccc

SEQ ID NO: 8791893 - DNA, 22 bp, Homo sapiens
gcaagattccgctctagagcct

SEQ ID NO: 8791894 - DNA, 22 bp, Homo sapiens
gcaagcaaaatgggagattccc

SEQ ID NO: 8791895 - DNA, 22 bp, Homo sapiens
gcaagcaagcaggtagagctga

SEQ ID NO: 8791896 - DNA, 22 bp, Homo sapiens
gcaagcaatggacggtgacttt

SEQ ID NO: 8791897 - DNA, 19 bp, Homo sapiens
gcaagagcttaggaggggt

SEQ ID NO: 8791898 - DNA, 22 bp, Homo sapiens
gcaagagttttttctctcttga

SEQ ID NO: 8791899 - DNA, 22 bp, Homo sapiens
gcaagagtttctggagcagagt

SEQ ID NO: 8791900 - DNA, 19 bp, Homo sapiens
gcaagagcttaggaggggt

SEQ ID NO: 8791901 - DNA, 22 bp, Homo sapiens
gcaagatagagttgcaaatatt

SEQ ID NO: 8791902 - DNA, 22 bp, Homo sapiens
gcaagagcaactttatggagct

SEQ ID NO: 8791903 - DNA, 22 bp, Homo sapiens
gcaagacctatctagttgctgt

SEQ ID NO: 8791904 - DNA, 22 bp, Homo sapiens
gcaagacctatctagttgctgt

SEQ ID NO: 8791905 - DNA, 23 bp, Homo sapiens
gcaagagacagagcatcctgttc

SEQ ID NO: 8791906 - DNA, 21 bp, Homo sapiens
gcacagcatgagtgttggcat

SEQ ID NO: 8791907 - DNA, 22 bp, Homo sapiens
gcacagccactgagtgagaacc

SEQ ID NO: 8791908 - DNA, 22 bp, Homo sapiens
gcacagccacgtaatgtggtca

SEQ ID NO: 8791909 - DNA, 22 bp, Homo sapiens
gcacagccactgagtgagaacc

SEQ ID NO: 8791910 - DNA, 22 bp, Homo sapiens
gcacagccagcatctgagggat

SEQ ID NO: 8791911 - DNA, 22 bp, Homo sapiens
gcacagccactgagtgagaacc

SEQ ID NO: 8791912 - DNA, 22 bp, Homo sapiens
gcacagcagtggcataaacaat

SEQ ID NO: 8791913 - DNA, 22 bp, Homo sapiens
gcaagctgtgatttatgtgaat

SEQ ID NO: 8791914 - DNA, 22 bp, Homo sapiens
gcaagctggctgttagaggatg

SEQ ID NO: 8791915 - DNA, 22 bp, Homo sapiens
gcaagcagggttccttagggca

SEQ ID NO: 8791916 - DNA, 22 bp, Homo sapiens
gcaagcagttgtggcttctgag

SEQ ID NO: 8791917 - DNA, 22 bp, Homo sapiens
gcaagcagttgtggcttctgag

SEQ ID NO: 8791918 - DNA, 22 bp, Homo sapiens
gcaagcagttcgcagcccgcct

SEQ ID NO: 8791919 - DNA, 22 bp, Homo sapiens
gcaagcagttacccaggattcg

SEQ ID NO: 8791920 - DNA, 22 bp, Homo sapiens
gcaagcagatctccggagggaa

SEQ ID NO: 8791921 - DNA, 22 bp, Homo sapiens
gcaagcagcccagaacagctct

SEQ ID NO: 8791922 - DNA, 22 bp, Homo sapiens
gcaagcagactgggcccctgtg

SEQ ID NO: 8791923 - DNA, 22 bp, Homo sapiens
gcaagcagacattcaggtaggt

SEQ ID NO: 8791924 - DNA, 22 bp, Homo sapiens
gcaagcagacattcaggtaggt

SEQ ID NO: 8791925 - DNA, 22 bp, Homo sapiens
gcaagctgcttaagctcattgt

SEQ ID NO: 8791926 - DNA, 18 bp, Homo sapiens
gcaagccctctccattaa

SEQ ID NO: 8791927 - DNA, 22 bp, Homo sapiens
gcaagcagttgtggcttctgag

SEQ ID NO: 8791928 - DNA, 22 bp, Homo sapiens
gcaagcagttgtggcttctgag

SEQ ID NO: 8791929 - DNA, 22 bp, Homo sapiens
gcaagctctctgcaggcagagc

SEQ ID NO: 8791930 - DNA, 22 bp, Homo sapiens
gcaagctctctgcaggcagagc

SEQ ID NO: 8791931 - DNA, 18 bp, Homo sapiens
gcacagcgaaaaactagt

SEQ ID NO: 8791932 - DNA, 22 bp, Homo sapiens
gcacagccttgccctgtgccct

SEQ ID NO: 8791933 - DNA, 22 bp, Homo sapiens
gcacagcctgtccctgtcctgg

SEQ ID NO: 8791934 - DNA, 22 bp, Homo sapiens
gcacagccctggtcggggcccc

SEQ ID NO: 8791935 - DNA, 22 bp, Homo sapiens
gcacagccggaccgaggaaaag

SEQ ID NO: 8791936 - DNA, 22 bp, Homo sapiens
gcacagccggaccgaggaaaag

SEQ ID NO: 8791937 - DNA, 22 bp, Homo sapiens
gcacagccctggtcggggcccc

SEQ ID NO: 8791938 - DNA, 22 bp, Homo sapiens
gcacagccagcatctgagggat

SEQ ID NO: 8791939 - DNA, 22 bp, Homo sapiens
gcacagccagcatctgagggat

SEQ ID NO: 8791940 - DNA, 22 bp, Homo sapiens
gcacagccctgagcgcatgtct

SEQ ID NO: 8791941 - DNA, 22 bp, Homo sapiens
gcacagctcgagctcaggaggg

SEQ ID NO: 8791942 - DNA, 22 bp, Homo sapiens
gcacagctcctggtaagctggg

SEQ ID NO: 8791943 - DNA, 22 bp, Homo sapiens
gcacagctccgcttcctcacac

SEQ ID NO: 8791944 - DNA, 22 bp, Homo sapiens
gcacagctcagtactccctctg

SEQ ID NO: 8791945 - DNA, 22 bp, Homo sapiens
gcacagctagacggtagccaaa

SEQ ID NO: 8791946 - DNA, 18 bp, Homo sapiens
gcacagctaggagggtcc

SEQ ID NO: 8791947 - DNA, 18 bp, Homo sapiens
gcacagctaggagggtcc

SEQ ID NO: 8791948 - DNA, 22 bp, Homo sapiens
gcacagctcagcatgggaggac

SEQ ID NO: 8791949 - DNA, 18 bp, Homo sapiens
gcacagctaggagggtcc

SEQ ID NO: 8791950 - DNA, 22 bp, Homo sapiens
gcacaggaggccgatgctcatg

SEQ ID NO: 8791951 - DNA, 22 bp, Homo sapiens
gcacaggaggccgatgctcatg

SEQ ID NO: 8791952 - DNA, 19 bp, Homo sapiens
gcacaggacatctgatgga

SEQ ID NO: 8791953 - DNA, 22 bp, Homo sapiens
gcacaggaggccgatgctcatg

SEQ ID NO: 8791954 - DNA, 22 bp, Homo sapiens
gcacaggaatcttcatttttta

SEQ ID NO: 8791955 - DNA, 22 bp, Homo sapiens
gcacaggcaatagatacagcta

SEQ ID NO: 8791956 - DNA, 22 bp, Homo sapiens
gcacaggcaatagatacagcta

SEQ ID NO: 8791957 - DNA, 22 bp, Homo sapiens
gcacaggatgatgggttgaggg

SEQ ID NO: 8791958 - DNA, 22 bp, Homo sapiens
gcacaggcaatagatacagcta

SEQ ID NO: 8791959 - DNA, 22 bp, Homo sapiens
gcacaggaaatgactcatgtta

SEQ ID NO: 8791960 - DNA, 22 bp, Homo sapiens
gcacaggaaatgactcatgtta

SEQ ID NO: 8791961 - DNA, 20 bp, Homo sapiens
gcacagctgagttcagggtc

SEQ ID NO: 8791962 - DNA, 22 bp, Homo sapiens
gcacagctctccccaagacgaa

SEQ ID NO: 8791963 - DNA, 22 bp, Homo sapiens
gcacagctcgagctcaggaggg

SEQ ID NO: 8791964 - DNA, 22 bp, Homo sapiens
gcacagctctccccaagacgaa

SEQ ID NO: 8791965 - DNA, 17 bp, Homo sapiens
gcttcccctgccctctc

SEQ ID NO: 8791966 - DNA, 22 bp, Homo sapiens
gcttcccctccaagcactgcct

SEQ ID NO: 8791967 - DNA, 22 bp, Homo sapiens
gcttcccctccaagcactgcct

SEQ ID NO: 8791968 - DNA, 22 bp, Homo sapiens
gcttcctacatgtgtctgcgag

SEQ ID NO: 8791969 - DNA, 22 bp, Homo sapiens
gcttcctagatctgtggtactc

SEQ ID NO: 8791970 - DNA, 22 bp, Homo sapiens
gcttcctcaccttctcttgcat

SEQ ID NO: 8791971 - DNA, 20 bp, Homo sapiens
gcttcccaattcttgatctg

SEQ ID NO: 8791972 - DNA, 22 bp, Homo sapiens
gcttcccacagctggactgggg

SEQ ID NO: 8791973 - DNA, 19 bp, Homo sapiens
gcttcccaccagccagccc

SEQ ID NO: 8791974 - DNA, 22 bp, Homo sapiens
gcttcctccctgctgctcacta

SEQ ID NO: 8791975 - DNA, 22 bp, Homo sapiens
gcttcctccctgctgctcacta

SEQ ID NO: 8791976 - DNA, 22 bp, Homo sapiens
gcttcctccctgctgctcacta

SEQ ID NO: 8791977 - DNA, 22 bp, Homo sapiens
gcttcctccagggaggggcctg

SEQ ID NO: 8791978 - DNA, 17 bp, Homo sapiens
gcttcctcatgcagttc

SEQ ID NO: 8791979 - DNA, 18 bp, Homo sapiens
gcttcctgaaagctgccc

SEQ ID NO: 8791980 - DNA, 18 bp, Homo sapiens
gcttcctgaaagctgccc

SEQ ID NO: 8791981 - DNA, 18 bp, Homo sapiens
gcttcctgaaagctgccc

SEQ ID NO: 8791982 - DNA, 18 bp, Homo sapiens
gcttcctgaaagctgccc

SEQ ID NO: 8791983 - DNA, 18 bp, Homo sapiens
gcttcctgaaagctgccc

SEQ ID NO: 8791984 - DNA, 22 bp, Homo sapiens
gcttcctgagacaacattgagt

SEQ ID NO: 8791985 - DNA, 22 bp, Homo sapiens
gcttcctgagagagacagttcc

SEQ ID NO: 8791986 - DNA, 22 bp, Homo sapiens
gcttcctgagacaacattgagt

SEQ ID NO: 8791987 - DNA, 22 bp, Homo sapiens
gcttcctgagaaacaatctgat

SEQ ID NO: 8791988 - DNA, 22 bp, Homo sapiens
gcttcctgagaaacaatctgat

SEQ ID NO: 8791989 - DNA, 22 bp, Homo sapiens
gcttcctgagaaacaatctgat

SEQ ID NO: 8791990 - DNA, 22 bp, Homo sapiens
ggaaaggagatattggagagtg

SEQ ID NO: 8791991 - DNA, 22 bp, Homo sapiens
ggaaaggagatattggagagtg

SEQ ID NO: 8791992 - DNA, 22 bp, Homo sapiens
ggaaaggagatattggagagtg

SEQ ID NO: 8791993 - DNA, 22 bp, Homo sapiens
ggaaagctctacaaagccacag

SEQ ID NO: 8791994 - DNA, 22 bp, Homo sapiens
gcttcctgatattcatactgtt

SEQ ID NO: 8791995 - DNA, 22 bp, Homo sapiens
gcttcctgatattcatactgtt

SEQ ID NO: 8791996 - DNA, 22 bp, Homo sapiens
gcttcctgagtacaccctcatc

SEQ ID NO: 8791997 - DNA, 22 bp, Homo sapiens
gcttcctggaacaactgttgct

SEQ ID NO: 8791998 - DNA, 22 bp, Homo sapiens
ggaaaggagatattggagagtg

SEQ ID NO: 8791999 - DNA, 22 bp, Homo sapiens
ggaaaggagatgaataggatta

SEQ ID NO: 8792000 - DNA, 22 bp, Homo sapiens
ggaaaggcctgggtgtcctggg

SEQ ID NO: 8792001 - DNA, 22 bp, Homo sapiens
ggaaaggcctgggtgtcctggg

SEQ ID NO: 8792002 - DNA, 22 bp, Homo sapiens
ggaaaggcaggggccctgccca

SEQ ID NO: 8792003 - DNA, 22 bp, Homo sapiens
ggaaaggcaggggccctgccca

SEQ ID NO: 8792004 - DNA, 22 bp, Homo sapiens
ggaaagggagttttgcttatga

SEQ ID NO: 8792005 - DNA, 22 bp, Homo sapiens
ggaaagggagttttgcttatga

SEQ ID NO: 8792006 - DNA, 22 bp, Homo sapiens
ggaaagggcagaggccttggag

SEQ ID NO: 8792007 - DNA, 22 bp, Homo sapiens
ggaaaggcctgggtgtcctggg

SEQ ID NO: 8792008 - DNA, 22 bp, Homo sapiens
ggaaaggcctgggtgtcctggg

SEQ ID NO: 8792009 - DNA, 22 bp, Homo sapiens
ggaaaggctaacagtcatggaa

SEQ ID NO: 8792010 - DNA, 22 bp, Homo sapiens
ggaaaggctaacagtcatggaa

SEQ ID NO: 8792011 - DNA, 22 bp, Homo sapiens
ggaaagggcatggccttttcac

SEQ ID NO: 8792012 - DNA, 22 bp, Homo sapiens
ggaaaggggcctggatcttttg

SEQ ID NO: 8792013 - DNA, 22 bp, Homo sapiens
ggaaaggggcctggatcttttg

SEQ ID NO: 8792014 - DNA, 22 bp, Homo sapiens
ggaaagggcatggccttttcac

SEQ ID NO: 8792015 - DNA, 22 bp, Homo sapiens
ggaaagtccttctaaagccaga

SEQ ID NO: 8792016 - DNA, 22 bp, Homo sapiens
ggaaagtggtggtggaaagagg

SEQ ID NO: 8792017 - DNA, 22 bp, Homo sapiens
ggaaatacaaagatacaccact

SEQ ID NO: 8792018 - DNA, 22 bp, Homo sapiens
ggaaatcagcagatgctggtga

SEQ ID NO: 8792019 - DNA, 22 bp, Homo sapiens
ggaaatcatgggagagttggaa

SEQ ID NO: 8792020 - DNA, 22 bp, Homo sapiens
ggaaatattttgtctaatttgt

SEQ ID NO: 8792021 - DNA, 22 bp, Homo sapiens
ggaaatattttgtctaatttgt

SEQ ID NO: 8792022 - DNA, 22 bp, Homo sapiens
ggaaatattgattgctctgtat

SEQ ID NO: 8792023 - DNA, 22 bp, Homo sapiens
ggaaatatcttgtactatgtga

SEQ ID NO: 8792024 - DNA, 22 bp, Homo sapiens
ggaaatataagcagtttgtgtg

SEQ ID NO: 8792025 - DNA, 22 bp, Homo sapiens
ggaaggaagtgaccaggatatc

SEQ ID NO: 8792026 - DNA, 22 bp, Homo sapiens
ggacacagtggaagacagcttg

SEQ ID NO: 8792027 - DNA, 22 bp, Homo sapiens
ggaaggaagtaaatgatgctat

SEQ ID NO: 8792028 - DNA, 22 bp, Homo sapiens
ggaaggaagaggaccgagctgg

SEQ ID NO: 8792029 - DNA, 22 bp, Homo sapiens
ggaaggaaagcagcttggccct

SEQ ID NO: 8792030 - DNA, 22 bp, Homo sapiens
ggaaggaaattggggcagttgt

SEQ ID NO: 8792031 - DNA, 22 bp, Homo sapiens
ggaaggaaattggggcagttgt

SEQ ID NO: 8792032 - DNA, 22 bp, Homo sapiens
ggaaggaacaaaccctgtgtgg

SEQ ID NO: 8792033 - DNA, 22 bp, Homo sapiens
ggaaggaacaaaccctgtgtgg

SEQ ID NO: 8792034 - DNA, 22 bp, Homo sapiens
ggaaggaacaaaccctgtgtgg

SEQ ID NO: 8792035 - DNA, 18 bp, Homo sapiens
ggaaggaagaatgcattt

SEQ ID NO: 8792036 - DNA, 22 bp, Homo sapiens
ggaagccccagacccagagtct

SEQ ID NO: 8792037 - DNA, 22 bp, Homo sapiens
ggaagccccagctgtgggatcc

SEQ ID NO: 8792038 - DNA, 22 bp, Homo sapiens
ggaagccccagcatggccttgg

SEQ ID NO: 8792039 - DNA, 17 bp, Homo sapiens
ggaagcccttctgcctg

SEQ ID NO: 8792040 - DNA, 19 bp, Homo sapiens
ggaagccctgggtcagagc

SEQ ID NO: 8792041 - DNA, 19 bp, Homo sapiens
ggaagccctaaaggaccta

SEQ ID NO: 8792042 - DNA, 22 bp, Homo sapiens
ggaagcccagctgtctcctgtc

SEQ ID NO: 8792043 - DNA, 21 bp, Homo sapiens
ggaagctgtgtccatgctcct

SEQ ID NO: 8792044 - DNA, 22 bp, Homo sapiens
ggaagctgttatcatctgtatc

SEQ ID NO: 8792045 - DNA, 22 bp, Homo sapiens
ggaagctgttcctgtgtggcca

SEQ ID NO: 8792046 - DNA, 22 bp, Homo sapiens
ggaagctgttcctgtgtggcca

SEQ ID NO: 8792047 - DNA, 21 bp, Homo sapiens
ggaagctgtgtccatgctcct

SEQ ID NO: 8792048 - DNA, 20 bp, Homo sapiens
ggaagctgtgggtccccagg

SEQ ID NO: 8792049 - DNA, 22 bp, Homo sapiens
ggaagctgttgtgagtgcagca

SEQ ID NO: 8792050 - DNA, 22 bp, Homo sapiens
ggaacatttcctggcagagagg

SEQ ID NO: 8792051 - DNA, 22 bp, Homo sapiens
ggaacattttttaaggcagaaa

SEQ ID NO: 8792052 - DNA, 22 bp, Homo sapiens
ggaaccacagcccccagcaggc

SEQ ID NO: 8792053 - DNA, 22 bp, Homo sapiens
ggaacccagagctcataaaatt

SEQ ID NO: 8792054 - DNA, 19 bp, Homo sapiens
ggaaccttagagcttcagc

SEQ ID NO: 8792055 - DNA, 22 bp, Homo sapiens
ggaaccttcatactgtttacca

SEQ ID NO: 8792056 - DNA, 22 bp, Homo sapiens
ggaaccttgctagatgctgagg

SEQ ID NO: 8792057 - DNA, 21 bp, Homo sapiens
ggaagcagtggcggcaactcc

SEQ ID NO: 8792058 - DNA, 22 bp, Homo sapiens
ggaagccaggcccagagatgct

SEQ ID NO: 8792059 - DNA, 22 bp, Homo sapiens
ggaagccaggccaatgagaaca

SEQ ID NO: 8792060 - DNA, 22 bp, Homo sapiens
ggaagccaggctgggggatctg

SEQ ID NO: 8792061 - DNA, 22 bp, Homo sapiens
ggacagactttacagccccggg

SEQ ID NO: 8792062 - DNA, 19 bp, Homo sapiens
ggacagacgcagagatctg

SEQ ID NO: 8792063 - DNA, 19 bp, Homo sapiens
ggacagacgcagagatctg

SEQ ID NO: 8792064 - DNA, 22 bp, Homo sapiens
ggacagacaaaaatagtaagca

SEQ ID NO: 8792065 - DNA, 22 bp, Homo sapiens
ggacagacagtgtgagtgaggc

SEQ ID NO: 8792066 - DNA, 22 bp, Homo sapiens
ggacagagcagacgagcagcgg

SEQ ID NO: 8792067 - DNA, 22 bp, Homo sapiens
ggacagagcagacgagcagcgg

SEQ ID NO: 8792068 - DNA, 22 bp, Homo sapiens
ggacagagagtgaatatgacat

SEQ ID NO: 8792069 - DNA, 22 bp, Homo sapiens
ggacagagagtgaatatgacat

SEQ ID NO: 8792070 - DNA, 22 bp, Homo sapiens
ggacagagagtgaatatgacat

SEQ ID NO: 8792071 - DNA, 22 bp, Homo sapiens
ggacagagcagacgagcagcgg

SEQ ID NO: 8792072 - DNA, 22 bp, Homo sapiens
ggacagagcagacgagcagcgg

SEQ ID NO: 8792073 - DNA, 22 bp, Homo sapiens
ggacagagccctggtggcctaa

SEQ ID NO: 8792074 - DNA, 22 bp, Homo sapiens
ggacagagccctggtggcctaa

SEQ ID NO: 8792075 - DNA, 22 bp, Homo sapiens
ggacagagccctggtggcctaa

SEQ ID NO: 8792076 - DNA, 22 bp, Homo sapiens
ggacagagccctggtggcctaa

SEQ ID NO: 8792077 - DNA, 22 bp, Homo sapiens
ggacagagccctggtggcctaa

SEQ ID NO: 8792078 - DNA, 22 bp, Homo sapiens
ggacagagcagacgagcagcgg

SEQ ID NO: 8792079 - DNA, 22 bp, Homo sapiens
ggacactgttcatggggagggg

SEQ ID NO: 8792080 - DNA, 22 bp, Homo sapiens
ggacacttggtggcccattgtg

SEQ ID NO: 8792081 - DNA, 22 bp, Homo sapiens
ggacacttagcctcagtttgct

SEQ ID NO: 8792082 - DNA, 23 bp, Homo sapiens
ggacactgtgcagatgctagtgc

SEQ ID NO: 8792083 - DNA, 22 bp, Homo sapiens
ggacacttgtttggttaggcct

SEQ ID NO: 8792084 - DNA, 22 bp, Homo sapiens
ggacactttgagttgaaggggt

SEQ ID NO: 8792085 - DNA, 22 bp, Homo sapiens
ggacagaaaccatatgagtgta

SEQ ID NO: 8792086 - DNA, 22 bp, Homo sapiens
ggacagaaattcttgttggaca

SEQ ID NO: 8792087 - DNA, 21 bp, Homo sapiens
ggacactgataatcttgttgc

SEQ ID NO: 8792088 - DNA, 22 bp, Homo sapiens
ggacactaaatggaagtgtctg

SEQ ID NO: 8792089 - DNA, 22 bp, Homo sapiens
ggacactacaatctgcctgcat

SEQ ID NO: 8792090 - DNA, 22 bp, Homo sapiens
ggacactagatggagaagggaa

SEQ ID NO: 8792091 - DNA, 22 bp, Homo sapiens
ggacactagatggagaagggaa

SEQ ID NO: 8792092 - DNA, 22 bp, Homo sapiens
ggacactgaagaatctcagatg

SEQ ID NO: 8792093 - DNA, 22 bp, Homo sapiens
ggacaccggtcctattggatga

SEQ ID NO: 8792094 - DNA, 21 bp, Homo sapiens
ggacaccagtcacactggatt

SEQ ID NO: 8792095 - DNA, 17 bp, Homo sapiens
ggacacctggagtctcc

SEQ ID NO: 8792096 - DNA, 22 bp, Homo sapiens
ggacacgatttattgctaaggg

SEQ ID NO: 8792097 - DNA, 22 bp, Homo sapiens
ggacctgaacataaaacgaggc

SEQ ID NO: 8792098 - DNA, 22 bp, Homo sapiens
ggacctgaacataaaacgaggc

SEQ ID NO: 8792099 - DNA, 22 bp, Homo sapiens
ggacctgccagaactcaggcta

SEQ ID NO: 8792100 - DNA, 22 bp, Homo sapiens
ggaccctgggcttgctcctggg

SEQ ID NO: 8792101 - DNA, 22 bp, Homo sapiens
ggacctgaacataaaacgaggc

SEQ ID NO: 8792102 - DNA, 23 bp, Homo sapiens
ggaccctgtggagggtgagagtc

SEQ ID NO: 8792103 - DNA, 22 bp, Homo sapiens
ggacccttggcttctgcagatt

SEQ ID NO: 8792104 - DNA, 23 bp, Homo sapiens
ggaccctgtggagggtgagagtc

SEQ ID NO: 8792105 - DNA, 22 bp, Homo sapiens
ggaccctgggcagctggctgct

SEQ ID NO: 8792106 - DNA, 22 bp, Homo sapiens
ggaccctgggcagctggctgct

SEQ ID NO: 8792107 - DNA, 22 bp, Homo sapiens
ggaccctgggcttgctcctggg

SEQ ID NO: 8792108 - DNA, 20 bp, Homo sapiens
ggaccctgggttcttctgag

SEQ ID NO: 8792109 - DNA, 22 bp, Homo sapiens
ggaccctgggcttgctcctggg

SEQ ID NO: 8792110 - DNA, 22 bp, Homo sapiens
ggaccctgggcagctggctgct

SEQ ID NO: 8792111 - DNA, 22 bp, Homo sapiens
ggaccctggagacccactggga

SEQ ID NO: 8792112 - DNA, 22 bp, Homo sapiens
ggaccctggagacccactggga

SEQ ID NO: 8792113 - DNA, 22 bp, Homo sapiens
ggacccaggaattaattaagag

SEQ ID NO: 8792114 - DNA, 18 bp, Homo sapiens
ggacccagggcctcaccc

SEQ ID NO: 8792115 - DNA, 22 bp, Homo sapiens
ggacccaggggtctctctgtcc

SEQ ID NO: 8792116 - DNA, 22 bp, Homo sapiens
ggacccaggtagggaggaagat

SEQ ID NO: 8792117 - DNA, 22 bp, Homo sapiens
ggacccaggtagggaggaagat

SEQ ID NO: 8792118 - DNA, 22 bp, Homo sapiens
ggacccagctctgagaccctgc

SEQ ID NO: 8792119 - DNA, 21 bp, Homo sapiens
ggacagaggagaaggcaccct

SEQ ID NO: 8792120 - DNA, 21 bp, Homo sapiens
ggacagaggagaaggcaccct

SEQ ID NO: 8792121 - DNA, 21 bp, Homo sapiens
ggacagaggagaaggcaccct

SEQ ID NO: 8792122 - DNA, 23 bp, Homo sapiens
ggacccacggtctttgaggctct

SEQ ID NO: 8792123 - DNA, 22 bp, Homo sapiens
ggacagagggcaggagcccaga

SEQ ID NO: 8792124 - DNA, 22 bp, Homo sapiens
ggacagagggcaggagcccaga

SEQ ID NO: 8792125 - DNA, 22 bp, Homo sapiens
ggacagagggcaggagcccaga

SEQ ID NO: 8792126 - DNA, 22 bp, Homo sapiens
ggactaaactattgacatagtg

SEQ ID NO: 8792127 - DNA, 22 bp, Homo sapiens
ggactatgcagaatatgacagt

SEQ ID NO: 8792128 - DNA, 18 bp, Homo sapiens
ggactacaggcacaggga

SEQ ID NO: 8792129 - DNA, 22 bp, Homo sapiens
ggactcctctagaagttgaggc

SEQ ID NO: 8792130 - DNA, 22 bp, Homo sapiens
ggactctcaggctgtcggcttc

SEQ ID NO: 8792131 - DNA, 22 bp, Homo sapiens
ggactctggtatttcactcttg

SEQ ID NO: 8792132 - DNA, 22 bp, Homo sapiens
ggacctggcaatttgcatctct

SEQ ID NO: 8792133 - DNA, 22 bp, Homo sapiens
ggaccttcctggctcctggggt

SEQ ID NO: 8792134 - DNA, 22 bp, Homo sapiens
ggacctggcaatttgcatctct

SEQ ID NO: 8792135 - DNA, 19 bp, Homo sapiens
ggacctggcaatctgcatt

SEQ ID NO: 8792136 - DNA, 19 bp, Homo sapiens
ggacctggcaatctgcatt

SEQ ID NO: 8792137 - DNA, 22 bp, Homo sapiens
ggacgcagcgagggaagcagcc

SEQ ID NO: 8792138 - DNA, 22 bp, Homo sapiens
ggactgaagtgctgtctagtgt

SEQ ID NO: 8792139 - DNA, 22 bp, Homo sapiens
ggactgagctgacatctgttgg

SEQ ID NO: 8792140 - DNA, 22 bp, Homo sapiens
ggactgaggacatgtgaggcat

SEQ ID NO: 8792141 - DNA, 22 bp, Homo sapiens
ggactgaggacatgtgaggcat

SEQ ID NO: 8792142 - DNA, 22 bp, Homo sapiens
ggactgaggcccacttgaggga

SEQ ID NO: 8792143 - DNA, 22 bp, Homo sapiens
ggactgaggcccacttgaggga

SEQ ID NO: 8792144 - DNA, 22 bp, Homo sapiens
ggagagagatgccgccttgctc

SEQ ID NO: 8792145 - DNA, 22 bp, Homo sapiens
ggagagagatgccgccttgctc

SEQ ID NO: 8792146 - DNA, 22 bp, Homo sapiens
ggagagaggagcccactgctgt

SEQ ID NO: 8792147 - DNA, 22 bp, Homo sapiens
ggagagagatgccgccttgctc

SEQ ID NO: 8792148 - DNA, 22 bp, Homo sapiens
ggagagctggtagctggctcca

SEQ ID NO: 8792149 - DNA, 22 bp, Homo sapiens
ggagaggacatggctcccacag

SEQ ID NO: 8792150 - DNA, 22 bp, Homo sapiens
ggagaggacatggctcccacag

SEQ ID NO: 8792151 - DNA, 22 bp, Homo sapiens
ggagaggacatggctcccacag

SEQ ID NO: 8792152 - DNA, 22 bp, Homo sapiens
ggagaggagattgtggcatttt

SEQ ID NO: 8792153 - DNA, 22 bp, Homo sapiens
ggagaggagctattgggggctc

SEQ ID NO: 8792154 - DNA, 22 bp, Homo sapiens
ggagaggagattgtggcatttt

SEQ ID NO: 8792155 - DNA, 22 bp, Homo sapiens
ggagaggagattgtggcatttt

SEQ ID NO: 8792156 - DNA, 22 bp, Homo sapiens
ggagaggaaatgccagcacttc

SEQ ID NO: 8792157 - DNA, 22 bp, Homo sapiens
ggagaggaaatgccagcacttc

SEQ ID NO: 8792158 - DNA, 22 bp, Homo sapiens
ggagaggaaatgccagcacttc

SEQ ID NO: 8792159 - DNA, 22 bp, Homo sapiens
ggagaggaaatgccagcacttc

SEQ ID NO: 8792160 - DNA, 22 bp, Homo sapiens
ggagaggaaatgccagcacttc

SEQ ID NO: 8792161 - DNA, 22 bp, Homo sapiens
ggagaggaaatgccagcacttc

SEQ ID NO: 8792162 - DNA, 22 bp, Homo sapiens
ggagagcttggagtgcgatttt

SEQ ID NO: 8792163 - DNA, 22 bp, Homo sapiens
ggagagctggtatatgaagaca

SEQ ID NO: 8792164 - DNA, 22 bp, Homo sapiens
ggagaggcttccagagtcgtgc

SEQ ID NO: 8792165 - DNA, 19 bp, Homo sapiens
ggagaggctggagggatgc

SEQ ID NO: 8792166 - DNA, 19 bp, Homo sapiens
ggagaggctggagggatgc

SEQ ID NO: 8792167 - DNA, 22 bp, Homo sapiens
ggagaggcttccagagtcgtgc

SEQ ID NO: 8792168 - DNA, 22 bp, Homo sapiens
ggagaggcttccagagtcgtgc

SEQ ID NO: 8792169 - DNA, 19 bp, Homo sapiens
ggagaggctggagggatgc

SEQ ID NO: 8792170 - DNA, 22 bp, Homo sapiens
ggagaggagctattgggggctc

SEQ ID NO: 8792171 - DNA, 22 bp, Homo sapiens
ggagaggagctattgggggctc

SEQ ID NO: 8792172 - DNA, 22 bp, Homo sapiens
ggagaggagctattgggggctc

SEQ ID NO: 8792173 - DNA, 22 bp, Homo sapiens
ggagaggagctattgggggctc

SEQ ID NO: 8792174 - DNA, 22 bp, Homo sapiens
ggagaggatgttttagtaactt

SEQ ID NO: 8792175 - DNA, 22 bp, Homo sapiens
ggagaggagctattgggggctc

SEQ ID NO: 8792176 - DNA, 22 bp, Homo sapiens
ggagaggatgttttagtaactt

SEQ ID NO: 8792177 - DNA, 22 bp, Homo sapiens
ggagaggcgatgagtcacagcc

SEQ ID NO: 8792178 - DNA, 22 bp, Homo sapiens
ggagaggcgatgagtcacagcc

SEQ ID NO: 8792179 - DNA, 22 bp, Homo sapiens
ggagaggatgttttagtaactt

SEQ ID NO: 8792180 - DNA, 22 bp, Homo sapiens
ggagaggatgttttagtaactt

SEQ ID NO: 8792181 - DNA, 22 bp, Homo sapiens
gctgggaggatctctccctgtc

SEQ ID NO: 8792182 - DNA, 22 bp, Homo sapiens
gctgggaggatctctccctgtc

SEQ ID NO: 8792183 - DNA, 22 bp, Homo sapiens
gctgggagaggccctgaagtga

SEQ ID NO: 8792184 - DNA, 22 bp, Homo sapiens
gctgggagaggccctgaagtga

SEQ ID NO: 8792185 - DNA, 22 bp, Homo sapiens
gctgggagaggccctgaagtga

SEQ ID NO: 8792186 - DNA, 22 bp, Homo sapiens
gctgggagaggcagctttcgga

SEQ ID NO: 8792187 - DNA, 22 bp, Homo sapiens
gctgggacaggcttggccctgt

SEQ ID NO: 8792188 - DNA, 22 bp, Homo sapiens
gctgggacaggcttggccctgt

SEQ ID NO: 8792189 - DNA, 20 bp, Homo sapiens
gctgggacgcccggtccgga

SEQ ID NO: 8792190 - DNA, 22 bp, Homo sapiens
gctgggacaggcttggccctgt

SEQ ID NO: 8792191 - DNA, 22 bp, Homo sapiens
gctgggacaacaggtgagcacc

SEQ ID NO: 8792192 - DNA, 22 bp, Homo sapiens
gctgggaatgattttggagagg

SEQ ID NO: 8792193 - DNA, 22 bp, Homo sapiens
gctgggacaacaggtgagcacc

SEQ ID NO: 8792194 - DNA, 22 bp, Homo sapiens
gctgggaagtggcagagctgga

SEQ ID NO: 8792195 - DNA, 22 bp, Homo sapiens
gctgggaagtgcaagatcaagg

SEQ ID NO: 8792196 - DNA, 22 bp, Homo sapiens
gctgggaaccatgggaaggcag

SEQ ID NO: 8792197 - DNA, 22 bp, Homo sapiens
gctggctgcctggttatgcctt

SEQ ID NO: 8792198 - DNA, 22 bp, Homo sapiens
gctggctgccttactttgtgga

SEQ ID NO: 8792199 - DNA, 22 bp, Homo sapiens
gctggctgcagattttagaggt

SEQ ID NO: 8792200 - DNA, 22 bp, Homo sapiens
gctggctgccaatttcagagct

SEQ ID NO: 8792201 - DNA, 22 bp, Homo sapiens
gctggctgccaatttcagagct

SEQ ID NO: 8792202 - DNA, 22 bp, Homo sapiens
gctggctgcagattttagaggt

SEQ ID NO: 8792203 - DNA, 22 bp, Homo sapiens
gctggctgcacaggggctcact

SEQ ID NO: 8792204 - DNA, 18 bp, Homo sapiens
gctggctgcacttctgct

SEQ ID NO: 8792205 - DNA, 18 bp, Homo sapiens
gctggctgcacttctgct

SEQ ID NO: 8792206 - DNA, 18 bp, Homo sapiens
gctggctgcacttctgct

SEQ ID NO: 8792207 - DNA, 18 bp, Homo sapiens
gctggctgcacttctgct

SEQ ID NO: 8792208 - DNA, 22 bp, Homo sapiens
gctggctgcacaggggctcact

SEQ ID NO: 8792209 - DNA, 22 bp, Homo sapiens
gctggctgcacaggggctcact

SEQ ID NO: 8792210 - DNA, 22 bp, Homo sapiens
gctggctcgggaagcaggggat

SEQ ID NO: 8792211 - DNA, 22 bp, Homo sapiens
gctggctctacatttgaggtca

SEQ ID NO: 8792212 - DNA, 22 bp, Homo sapiens
gctggctcgggaagcaggggat

SEQ ID NO: 8792213 - DNA, 22 bp, Homo sapiens
gctggctcctctgtcctcacgg

SEQ ID NO: 8792214 - DNA, 22 bp, Homo sapiens
gctggctctgccccacctgttc

SEQ ID NO: 8792215 - DNA, 22 bp, Homo sapiens
gctggctctgcacccaggcctc

SEQ ID NO: 8792216 - DNA, 22 bp, Homo sapiens
gctggctctgccccacctgttc

SEQ ID NO: 8792217 - DNA, 22 bp, Homo sapiens
gctggctctgatgggctccagg

SEQ ID NO: 8792218 - DNA, 22 bp, Homo sapiens
gctggctctgatgggctccagg

SEQ ID NO: 8792219 - DNA, 22 bp, Homo sapiens
gctggctctgcacccaggcctc

SEQ ID NO: 8792220 - DNA, 22 bp, Homo sapiens
gctggcagctggaagttgggct

SEQ ID NO: 8792221 - DNA, 22 bp, Homo sapiens
gctggcaggagaaacggggtgc

SEQ ID NO: 8792222 - DNA, 22 bp, Homo sapiens
gctggcaggagaccatacccta

SEQ ID NO: 8792223 - DNA, 22 bp, Homo sapiens
gctggcaggagaccatacccta

SEQ ID NO: 8792224 - DNA, 22 bp, Homo sapiens
gctggcaggagcctttcccttt

SEQ ID NO: 8792225 - DNA, 22 bp, Homo sapiens
gctggcaggagcctttcccttt

SEQ ID NO: 8792226 - DNA, 22 bp, Homo sapiens
gctggcaggataacttctaagc

SEQ ID NO: 8792227 - DNA, 22 bp, Homo sapiens
gctggcaggatagaagtctaat

SEQ ID NO: 8792228 - DNA, 22 bp, Homo sapiens
gctggcaggataacttctaagc

SEQ ID NO: 8792229 - DNA, 22 bp, Homo sapiens
gctggcagctggaagttgggct

SEQ ID NO: 8792230 - DNA, 22 bp, Homo sapiens
gctggcagctggaagttgggct

SEQ ID NO: 8792231 - DNA, 22 bp, Homo sapiens
gctggcagccaagtgaagaggg

SEQ ID NO: 8792232 - DNA, 22 bp, Homo sapiens
gctggcagagacaagaagacta

SEQ ID NO: 8792233 - DNA, 22 bp, Homo sapiens
gctggcagagacaagaagacta

SEQ ID NO: 8792234 - DNA, 22 bp, Homo sapiens
gctggcagagacaagaagacta

SEQ ID NO: 8792235 - DNA, 22 bp, Homo sapiens
gctggcagagacaagaagacta

SEQ ID NO: 8792236 - DNA, 22 bp, Homo sapiens
gctggcagagacaagaagacta

SEQ ID NO: 8792237 - DNA, 22 bp, Homo sapiens
gctggcagggacagctgcgtgt

SEQ ID NO: 8792238 - DNA, 22 bp, Homo sapiens
gctggcagggacagctgcgtgt

SEQ ID NO: 8792239 - DNA, 22 bp, Homo sapiens
gctggcagggacagctgcgtgt

SEQ ID NO: 8792240 - DNA, 22 bp, Homo sapiens
gctggcaggatagaagtctaat

SEQ ID NO: 8792241 - DNA, 22 bp, Homo sapiens
gctggctcaagaggtccagagg

SEQ ID NO: 8792242 - DNA, 22 bp, Homo sapiens
gctggctcaagtgtgcttccca

SEQ ID NO: 8792243 - DNA, 22 bp, Homo sapiens
gctggctccaaaagcaggggct

SEQ ID NO: 8792244 - DNA, 22 bp, Homo sapiens
gctggctccaaaagcaggggct

SEQ ID NO: 8792245 - DNA, 22 bp, Homo sapiens
gctggctcccagaggccccagc

SEQ ID NO: 8792246 - DNA, 22 bp, Homo sapiens
gctggcacatggctcagggcct

SEQ ID NO: 8792247 - DNA, 22 bp, Homo sapiens
gctggcacatggctcagggcct

SEQ ID NO: 8792248 - DNA, 22 bp, Homo sapiens
gctggcacatggctcagggcct

SEQ ID NO: 8792249 - DNA, 22 bp, Homo sapiens
gctggcacaggtggatgctggc

SEQ ID NO: 8792250 - DNA, 22 bp, Homo sapiens
gctggcacaggtggatgctggc

SEQ ID NO: 8792251 - DNA, 22 bp, Homo sapiens
gctggcacagaataagcaggca

SEQ ID NO: 8792252 - DNA, 22 bp, Homo sapiens
gctggcacacagtacacgcctt

SEQ ID NO: 8792253 - DNA, 22 bp, Homo sapiens
gctggcacctatttggacctgg

SEQ ID NO: 8792254 - DNA, 22 bp, Homo sapiens
gctggcacctatttggacctgg

SEQ ID NO: 8792255 - DNA, 22 bp, Homo sapiens
gctggcacctgcaccaagcagg

SEQ ID NO: 8792256 - DNA, 22 bp, Homo sapiens
gctggcacctgcaccaagcagg

SEQ ID NO: 8792257 - DNA, 22 bp, Homo sapiens
gctggcacctgcaccaagcagg

SEQ ID NO: 8792258 - DNA, 19 bp, Homo sapiens
gctggcacttcaagggagc

SEQ ID NO: 8792259 - DNA, 22 bp, Homo sapiens
gctggcactgggaaggactgag

SEQ ID NO: 8792260 - DNA, 22 bp, Homo sapiens
gctgcccaatggtagtgtcttt

SEQ ID NO: 8792261 - DNA, 21 bp, Homo sapiens
gctgcccaaccctgcatctcc

SEQ ID NO: 8792262 - DNA, 21 bp, Homo sapiens
gctgcccaaccctgcatctcc

SEQ ID NO: 8792263 - DNA, 21 bp, Homo sapiens
gctgcccaaccctgcatctcc

SEQ ID NO: 8792264 - DNA, 22 bp, Homo sapiens
gctggattggagcaatagagtc

SEQ ID NO: 8792265 - DNA, 22 bp, Homo sapiens
gctggcacacagtacacgcctt

SEQ ID NO: 8792266 - DNA, 22 bp, Homo sapiens
gctggcaatggtgtggtctggt

SEQ ID NO: 8792267 - DNA, 22 bp, Homo sapiens
gctggcagactgggggcagaac

SEQ ID NO: 8792268 - DNA, 22 bp, Homo sapiens
gctggcagactgggggcagaac

SEQ ID NO: 8792269 - DNA, 22 bp, Homo sapiens
gctggcagactgggggcagaac

SEQ ID NO: 8792270 - DNA, 22 bp, Homo sapiens
gctggcagactgggggcagaac

SEQ ID NO: 8792271 - DNA, 22 bp, Homo sapiens
gctggcagacttcctctggaac

SEQ ID NO: 8792272 - DNA, 22 bp, Homo sapiens
gctggcagacttcctctggaac

SEQ ID NO: 8792273 - DNA, 22 bp, Homo sapiens
gctggcagacttcctctggaac

SEQ ID NO: 8792274 - DNA, 22 bp, Homo sapiens
gctggcagacttcctctggaac

SEQ ID NO: 8792275 - DNA, 22 bp, Homo sapiens
gctggcacttgggacaaaatct

SEQ ID NO: 8792276 - DNA, 22 bp, Homo sapiens
gctggcagaagagctggttcaa

SEQ ID NO: 8792277 - DNA, 22 bp, Homo sapiens
gctggcagaagagctggttcaa

SEQ ID NO: 8792278 - DNA, 19 bp, Homo sapiens
gctggcagaattttgaacc

SEQ ID NO: 8792279 - DNA, 19 bp, Homo sapiens
gctggcagaattttgaacc

SEQ ID NO: 8792280 - DNA, 22 bp, Homo sapiens
gctggcagaatttcttcttgct

SEQ ID NO: 8792281 - DNA, 22 bp, Homo sapiens
gctgtgcagtagtaggtacagt

SEQ ID NO: 8792282 - DNA, 22 bp, Homo sapiens
gctgtgcaggtccccactgcct

SEQ ID NO: 8792283 - DNA, 22 bp, Homo sapiens
gctgtgcagccaagtgcctctg

SEQ ID NO: 8792284 - DNA, 22 bp, Homo sapiens
gctgtgcagccaagtgcctctg

SEQ ID NO: 8792285 - DNA, 22 bp, Homo sapiens
gctgtgcagtgggagttcggtg

SEQ ID NO: 8792286 - DNA, 22 bp, Homo sapiens
gctgtgcattgagcctgagagt

SEQ ID NO: 8792287 - DNA, 22 bp, Homo sapiens
gctgtgcccagctccagctctg

SEQ ID NO: 8792288 - DNA, 22 bp, Homo sapiens
gctgtgcccagctccagctctg

SEQ ID NO: 8792289 - DNA, 22 bp, Homo sapiens
gcttccatctatgtcttcatca

SEQ ID NO: 8792290 - DNA, 22 bp, Homo sapiens
gcttccatgttgctgctggtca

SEQ ID NO: 8792291 - DNA, 23 bp, Homo sapiens
gcttccattctagtttgctgtgc

SEQ ID NO: 8792292 - DNA, 22 bp, Homo sapiens
gcttccagtaagttgctgccat

SEQ ID NO: 8792293 - DNA, 22 bp, Homo sapiens
gcttccagtcctcagaggctgg

SEQ ID NO: 8792294 - DNA, 22 bp, Homo sapiens
gcttccagtcctcagaggctgg

SEQ ID NO: 8792295 - DNA, 22 bp, Homo sapiens
gcttccagtgactttggtcgtg

SEQ ID NO: 8792296 - DNA, 22 bp, Homo sapiens
gcttccagtgactttggtcgtg

SEQ ID NO: 8792297 - DNA, 16 bp, Homo sapiens
gcttccagtttagtgg

SEQ ID NO: 8792298 - DNA, 16 bp, Homo sapiens
gcttccagtttagtgg

SEQ ID NO: 8792299 - DNA, 22 bp, Homo sapiens
gcttccagtcctcagaggctgg

SEQ ID NO: 8792300 - DNA, 22 bp, Homo sapiens
gcttccagtaactcttgaaagg

SEQ ID NO: 8792301 - DNA, 22 bp, Homo sapiens
gcttccagtaactcttgaaagg

SEQ ID NO: 8792302 - DNA, 22 bp, Homo sapiens
gcttccagtaagttgctgccat

SEQ ID NO: 8792303 - DNA, 22 bp, Homo sapiens
gcttccagtaactcttgaaagg

SEQ ID NO: 8792304 - DNA, 22 bp, Homo sapiens
gcttcattttgccctctggtgg

SEQ ID NO: 8792305 - DNA, 20 bp, Homo sapiens
gcttcatttgcaagtctagt

SEQ ID NO: 8792306 - DNA, 22 bp, Homo sapiens
gctgtcttgatgattggatgct

SEQ ID NO: 8792307 - DNA, 22 bp, Homo sapiens
gctgtgagccgctgctgagcat

SEQ ID NO: 8792308 - DNA, 22 bp, Homo sapiens
gctgtgagcactgctgggtgga

SEQ ID NO: 8792309 - DNA, 22 bp, Homo sapiens
gctgtgagctgcctgtgtcaca

SEQ ID NO: 8792310 - DNA, 22 bp, Homo sapiens
gctgtgagctgcctgtgtcaca

SEQ ID NO: 8792311 - DNA, 22 bp, Homo sapiens
gctgtgagctgcctgtgtcaca

SEQ ID NO: 8792312 - DNA, 22 bp, Homo sapiens
gctgtgagctgcctgtgtcaca

SEQ ID NO: 8792313 - DNA, 22 bp, Homo sapiens
gctgtgagaaacagggagtgtc

SEQ ID NO: 8792314 - DNA, 22 bp, Homo sapiens
gctgtgagaaacagggagtgtc

SEQ ID NO: 8792315 - DNA, 22 bp, Homo sapiens
gctgtgagaaacagggagtgtc

SEQ ID NO: 8792316 - DNA, 22 bp, Homo sapiens
gctgtgagaaacagggagtgtc

SEQ ID NO: 8792317 - DNA, 22 bp, Homo sapiens
gctgtgagcactgctgggtgga

SEQ ID NO: 8792318 - DNA, 22 bp, Homo sapiens
gctgtgagggcttctgaggcat

SEQ ID NO: 8792319 - DNA, 22 bp, Homo sapiens
gctgtgagggcttctgaggcat

SEQ ID NO: 8792320 - DNA, 22 bp, Homo sapiens
gctgtgagggtctagtgaggtg

SEQ ID NO: 8792321 - DNA, 22 bp, Homo sapiens
gctgtgagtacaaggccctggg

SEQ ID NO: 8792322 - DNA, 22 bp, Homo sapiens
gctgtgagtacaaggccctggg

SEQ ID NO: 8792323 - DNA, 22 bp, Homo sapiens
gctgtgagggtctagtgaggtg

SEQ ID NO: 8792324 - DNA, 22 bp, Homo sapiens
gctgtgagtacaaggccctggg

SEQ ID NO: 8792325 - DNA, 22 bp, Homo sapiens
gctgtgagtgagctgcctaggc

SEQ ID NO: 8792326 - DNA, 22 bp, Homo sapiens
gctgtgagtgagctgcctaggc

SEQ ID NO: 8792327 - DNA, 22 bp, Homo sapiens
gctgtgagtggaggaggctgag

SEQ ID NO: 8792328 - DNA, 23 bp, Homo sapiens
gctgtgcacgagccactgcctgt

SEQ ID NO: 8792329 - DNA, 22 bp, Homo sapiens
gctgtgattgtcagtcttcaat

SEQ ID NO: 8792330 - DNA, 22 bp, Homo sapiens
gctgtgatgtggagggtgctga

SEQ ID NO: 8792331 - DNA, 22 bp, Homo sapiens
gctgtgatccttgagagaaggt

SEQ ID NO: 8792332 - DNA, 22 bp, Homo sapiens
gctgtgagtggagttctgtgct

SEQ ID NO: 8792333 - DNA, 22 bp, Homo sapiens
gctgtgagtggagttctgtgct

SEQ ID NO: 8792334 - DNA, 22 bp, Homo sapiens
gctgtgatgtggagggtgctga

SEQ ID NO: 8792335 - DNA, 23 bp, Homo sapiens
gctgtgcacgagccactgcctgt

SEQ ID NO: 8792336 - DNA, 20 bp, Homo sapiens
gctgggggtgtgctgagtga

SEQ ID NO: 8792337 - DNA, 22 bp, Homo sapiens
gctgggtcagaatctccctgtg

SEQ ID NO: 8792338 - DNA, 18 bp, Homo sapiens
gctggggttgagctctcc

SEQ ID NO: 8792339 - DNA, 21 bp, Homo sapiens
gctgggtcagcaggtcctctg

SEQ ID NO: 8792340 - DNA, 22 bp, Homo sapiens
gctgggtccatggtcctcgggt

SEQ ID NO: 8792341 - DNA, 22 bp, Homo sapiens
gctgggtcccaagcctggggag

SEQ ID NO: 8792342 - DNA, 22 bp, Homo sapiens
gctgggtcccaagcctggggag

SEQ ID NO: 8792343 - DNA, 20 bp, Homo sapiens
gctgggggtgtgctgagtga

SEQ ID NO: 8792344 - DNA, 22 bp, Homo sapiens
gctgggagtcgcgtctgtggcc

SEQ ID NO: 8792345 - DNA, 22 bp, Homo sapiens
gctgggagtcgcgtctgtggcc

SEQ ID NO: 8792346 - DNA, 22 bp, Homo sapiens
gctgggagtcgcgtctgtggcc

SEQ ID NO: 8792347 - DNA, 22 bp, Homo sapiens
gctgggaggcagcacctttagc

SEQ ID NO: 8792348 - DNA, 16 bp, Homo sapiens
gctgggagggagaggt

SEQ ID NO: 8792349 - DNA, 22 bp, Homo sapiens
gctgggtttccagcaggcagga

SEQ ID NO: 8792350 - DNA, 22 bp, Homo sapiens
gctgggtttccagcaggcagga

SEQ ID NO: 8792351 - DNA, 22 bp, Homo sapiens
gctgggtttccagcaggcagga

SEQ ID NO: 8792352 - DNA, 22 bp, Homo sapiens
gctgggtgtcacggggctcgtg

SEQ ID NO: 8792353 - DNA, 22 bp, Homo sapiens
gctgggtgtcacggggctcgtg

SEQ ID NO: 8792354 - DNA, 22 bp, Homo sapiens
gctgggttttcttccgggccta

SEQ ID NO: 8792355 - DNA, 22 bp, Homo sapiens
gctgggttttcttccgggccta

SEQ ID NO: 8792356 - DNA, 22 bp, Homo sapiens
gctgggttttcttccgggccta

SEQ ID NO: 8792357 - DNA, 22 bp, Homo sapiens
gctgggttttcttccgggccta

SEQ ID NO: 8792358 - DNA, 22 bp, Homo sapiens
gctgggttttcttccgggccta

SEQ ID NO: 8792359 - DNA, 22 bp, Homo sapiens
gctggtcactctgggagctgct

SEQ ID NO: 8792360 - DNA, 22 bp, Homo sapiens
gctgtctgttcgagcgtgtgtt

SEQ ID NO: 8792361 - DNA, 22 bp, Homo sapiens
gctgtctgttcgagcgtgtgtt

SEQ ID NO: 8792362 - DNA, 22 bp, Homo sapiens
gctggtagacctcactgcactc

SEQ ID NO: 8792363 - DNA, 22 bp, Homo sapiens
gctggtagacctcactgcactc

SEQ ID NO: 8792364 - DNA, 22 bp, Homo sapiens
gctggtagacctcactgcactc

SEQ ID NO: 8792365 - DNA, 22 bp, Homo sapiens
gctgggtggatcggaggctctg

SEQ ID NO: 8792366 - DNA, 22 bp, Homo sapiens
gctgggtggatcggaggctctg

SEQ ID NO: 8792367 - DNA, 22 bp, Homo sapiens
gctgggtggatcggaggctctg

SEQ ID NO: 8792368 - DNA, 22 bp, Homo sapiens
gctgggtggatcggaggctctg

SEQ ID NO: 8792369 - DNA, 22 bp, Homo sapiens
gctgggtggatcggaggctctg

SEQ ID NO: 8792370 - DNA, 19 bp, Homo sapiens
gctgggtggggtccacagc

SEQ ID NO: 8792371 - DNA, 19 bp, Homo sapiens
gctgggtggggtccacagc

SEQ ID NO: 8792372 - DNA, 22 bp, Homo sapiens
gctgggtcctatgctggtagag

SEQ ID NO: 8792373 - DNA, 22 bp, Homo sapiens
gctgggtctggatgctcaggtg

SEQ ID NO: 8792374 - DNA, 22 bp, Homo sapiens
gctgggtctctccctggtcctg

SEQ ID NO: 8792375 - DNA, 22 bp, Homo sapiens
gctgggtctggctgtgagccgg

SEQ ID NO: 8792376 - DNA, 22 bp, Homo sapiens
gctgggtctggatgctcaggtg

SEQ ID NO: 8792377 - DNA, 19 bp, Homo sapiens
gctgggtgaggtcgttgga

SEQ ID NO: 8792378 - DNA, 19 bp, Homo sapiens
gctgggtgaggtcgttgga

SEQ ID NO: 8792379 - DNA, 22 bp, Homo sapiens
gctcagggaaagagctcctgtc

SEQ ID NO: 8792380 - DNA, 22 bp, Homo sapiens
gctcctggtctggagcttcaag

SEQ ID NO: 8792381 - DNA, 22 bp, Homo sapiens
gctcctggtctggagcttcaag

SEQ ID NO: 8792382 - DNA, 22 bp, Homo sapiens
gctcctggtctggagcttcaag

SEQ ID NO: 8792383 - DNA, 22 bp, Homo sapiens
gctcaggctggattgcagtggc

SEQ ID NO: 8792384 - DNA, 22 bp, Homo sapiens
gctcagggaaagagctcctgtc

SEQ ID NO: 8792385 - DNA, 19 bp, Homo sapiens
gctcaggctgtgtgtgggg

SEQ ID NO: 8792386 - DNA, 19 bp, Homo sapiens
gctcaggctgtgtgtgggg

SEQ ID NO: 8792387 - DNA, 22 bp, Homo sapiens
gctcaggcctggcccatgggac

SEQ ID NO: 8792388 - DNA, 22 bp, Homo sapiens
gctcaggcctcggacacacaat

SEQ ID NO: 8792389 - DNA, 22 bp, Homo sapiens
gctcaggcctcggacacacaat

SEQ ID NO: 8792390 - DNA, 21 bp, Homo sapiens
gctcaggctcttgacagagca

SEQ ID NO: 8792391 - DNA, 21 bp, Homo sapiens
gctcaggctcttgacagagca

SEQ ID NO: 8792392 - DNA, 22 bp, Homo sapiens
gctcctgtgcaggtctcggttg

SEQ ID NO: 8792393 - DNA, 22 bp, Homo sapiens
gctcctgttttcttccagaaat

SEQ ID NO: 8792394 - DNA, 22 bp, Homo sapiens
gctccttcaggtggtagctgtt

SEQ ID NO: 8792395 - DNA, 22 bp, Homo sapiens
gctccttcaggtggtagctgtt

SEQ ID NO: 8792396 - DNA, 17 bp, Homo sapiens
gctccttctaacttcca

SEQ ID NO: 8792397 - DNA, 22 bp, Homo sapiens
gctcctgttttcttccagaaat

SEQ ID NO: 8792398 - DNA, 22 bp, Homo sapiens
gctctcagatgctccagcagcc

SEQ ID NO: 8792399 - DNA, 22 bp, Homo sapiens
gctctcagcccactgaggggaa

SEQ ID NO: 8792400 - DNA, 22 bp, Homo sapiens
gctctcagatgctccagcagcc

SEQ ID NO: 8792401 - DNA, 21 bp, Homo sapiens
gctctcagctgcctgctggtt

SEQ ID NO: 8792402 - DNA, 22 bp, Homo sapiens
gctctcagatgctccagcagcc

SEQ ID NO: 8792403 - DNA, 22 bp, Homo sapiens
gctctcagatgctccagcagcc

SEQ ID NO: 8792404 - DNA, 21 bp, Homo sapiens
gctcctggtgctgcgtggcgc

SEQ ID NO: 8792405 - DNA, 21 bp, Homo sapiens
gctcctggtgctgcgtggcgc

SEQ ID NO: 8792406 - DNA, 21 bp, Homo sapiens
gctcctggtgctgcgtggcgc

SEQ ID NO: 8792407 - DNA, 18 bp, Homo sapiens
gctcctggttggaaagaa

SEQ ID NO: 8792408 - DNA, 22 bp, Homo sapiens
gctcctggtgctgtagagattt

SEQ ID NO: 8792409 - DNA, 18 bp, Homo sapiens
gctcctggttggaaagaa

SEQ ID NO: 8792410 - DNA, 22 bp, Homo sapiens
gctcctgtcagtcatcaggtgc

SEQ ID NO: 8792411 - DNA, 22 bp, Homo sapiens
gctcctgtcatcaaacaatcct

SEQ ID NO: 8792412 - DNA, 20 bp, Homo sapiens
gctcctgtcctggtggaggg

SEQ ID NO: 8792413 - DNA, 22 bp, Homo sapiens
gctcctgtccttagccccagag

SEQ ID NO: 8792414 - DNA, 22 bp, Homo sapiens
gctcctgtccttagccccagag

SEQ ID NO: 8792415 - DNA, 20 bp, Homo sapiens
gctcctgtcctggtggaggg

SEQ ID NO: 8792416 - DNA, 22 bp, Homo sapiens
gctcctgtgaggacacagccgc

SEQ ID NO: 8792417 - DNA, 22 bp, Homo sapiens
gctcctgtgaaggcattaggtg

SEQ ID NO: 8792418 - DNA, 22 bp, Homo sapiens
gctcctgtgaaggcattaggtg

SEQ ID NO: 8792419 - DNA, 22 bp, Homo sapiens
gctcctgtcttggggcactggc

SEQ ID NO: 8792420 - DNA, 22 bp, Homo sapiens
gctctgctccctcaaatgacat

SEQ ID NO: 8792421 - DNA, 22 bp, Homo sapiens
gctctgctctaacattcctgac

SEQ ID NO: 8792422 - DNA, 22 bp, Homo sapiens
gctctgccttctcactgggttc

SEQ ID NO: 8792423 - DNA, 22 bp, Homo sapiens
gctctgcctggtcgcgtgctgg

SEQ ID NO: 8792424 - DNA, 22 bp, Homo sapiens
gctctgcctggtcgcgtgctgg

SEQ ID NO: 8792425 - DNA, 22 bp, Homo sapiens
gctctgcctctttgctgcgtca

SEQ ID NO: 8792426 - DNA, 22 bp, Homo sapiens
gctctgcctctttgctgcgtca

SEQ ID NO: 8792427 - DNA, 22 bp, Homo sapiens
gctctgcccagtgccctgagac

SEQ ID NO: 8792428 - DNA, 17 bp, Homo sapiens
gctctgccccagcctct

SEQ ID NO: 8792429 - DNA, 17 bp, Homo sapiens
gctctgccccagcctct

SEQ ID NO: 8792430 - DNA, 17 bp, Homo sapiens
gctctgccccagcctct

SEQ ID NO: 8792431 - DNA, 18 bp, Homo sapiens
gctctgcccaggctgccc

SEQ ID NO: 8792432 - DNA, 22 bp, Homo sapiens
gctctccaaaccctgtggcttt

SEQ ID NO: 8792433 - DNA, 22 bp, Homo sapiens
gctctcaggtgccactttgtgg

SEQ ID NO: 8792434 - DNA, 22 bp, Homo sapiens
gctctcaggtacaaagctgtgt

SEQ ID NO: 8792435 - DNA, 22 bp, Homo sapiens
gctctccaaaccctgtggcttt

SEQ ID NO: 8792436 - DNA, 22 bp, Homo sapiens
gctctggcccaaaccctttcta

SEQ ID NO: 8792437 - DNA, 21 bp, Homo sapiens
gctctggcctactgttccctc

SEQ ID NO: 8792438 - DNA, 22 bp, Homo sapiens
gctctggccagaccctcagtgg

SEQ ID NO: 8792439 - DNA, 22 bp, Homo sapiens
gctctggccagaccctcagtgg

SEQ ID NO: 8792440 - DNA, 22 bp, Homo sapiens
gctctggccagaccctcagtgg

SEQ ID NO: 8792441 - DNA, 22 bp, Homo sapiens
gctctggctactccaccctgtt

SEQ ID NO: 8792442 - DNA, 22 bp, Homo sapiens
gctctggctactccaccctgtt

SEQ ID NO: 8792443 - DNA, 21 bp, Homo sapiens
gctctggcctactgttccctc

SEQ ID NO: 8792444 - DNA, 22 bp, Homo sapiens
gctctggctactccaccctgtt

SEQ ID NO: 8792445 - DNA, 22 bp, Homo sapiens
gctctggctactccaccctgtt

SEQ ID NO: 8792446 - DNA, 22 bp, Homo sapiens
gctctggctactccaccctgtt

SEQ ID NO: 8792447 - DNA, 22 bp, Homo sapiens
gctctggctactgtggctaccg

SEQ ID NO: 8792448 - DNA, 22 bp, Homo sapiens
gctctggctactgtggctaccg

SEQ ID NO: 8792449 - DNA, 22 bp, Homo sapiens
gctgaagacctccctctccatg

SEQ ID NO: 8792450 - DNA, 22 bp, Homo sapiens
gctgaagagacttctgttcgaa

SEQ ID NO: 8792451 - DNA, 22 bp, Homo sapiens
gctctggctactgtggctaccg

SEQ ID NO: 8792452 - DNA, 22 bp, Homo sapiens
gctgaagataagtgaagaggct

SEQ ID NO: 8792453 - DNA, 22 bp, Homo sapiens
gctgaagagcaaggctgggtct

SEQ ID NO: 8792454 - DNA, 23 bp, Homo sapiens
gctgaagagcaaaccaggcaaaa

SEQ ID NO: 8792455 - DNA, 23 bp, Homo sapiens
gctgaagagcaaaccaggcaaaa

SEQ ID NO: 8792456 - DNA, 22 bp, Homo sapiens
gctgaagagaggccttgagcac

SEQ ID NO: 8792457 - DNA, 22 bp, Homo sapiens
gctgaagagagatgcgtccagc

SEQ ID NO: 8792458 - DNA, 22 bp, Homo sapiens
gctgaagagagatgcgtccagc

SEQ ID NO: 8792459 - DNA, 22 bp, Homo sapiens
gctctgctgacagctgggacag

SEQ ID NO: 8792460 - DNA, 22 bp, Homo sapiens
gctctgctgcttactagatggt

SEQ ID NO: 8792461 - DNA, 23 bp, Homo sapiens
gctctggcagcttgtgtcagcac

SEQ ID NO: 8792462 - DNA, 23 bp, Homo sapiens
gctctggcagcttgtgtcagcac

SEQ ID NO: 8792463 - DNA, 23 bp, Homo sapiens
gctctggcagcttgtgtcagcac

SEQ ID NO: 8792464 - DNA, 23 bp, Homo sapiens
gctctggcagcttgtgtcagcac

SEQ ID NO: 8792465 - DNA, 23 bp, Homo sapiens
gctctggcagcttgtgtcagcac

SEQ ID NO: 8792466 - DNA, 23 bp, Homo sapiens
gctctggcagcttgtgtcagcac

SEQ ID NO: 8792467 - DNA, 22 bp, Homo sapiens
gctctggcagctgatattagga

SEQ ID NO: 8792468 - DNA, 22 bp, Homo sapiens
gctctggcactggcgcgggatg

SEQ ID NO: 8792469 - DNA, 22 bp, Homo sapiens
gctctggcactggcgcgggatg

SEQ ID NO: 8792470 - DNA, 22 bp, Homo sapiens
gctctgctggaagttctctgga

SEQ ID NO: 8792471 - DNA, 22 bp, Homo sapiens
gctgatgtatatagtgattgag

SEQ ID NO: 8792472 - DNA, 22 bp, Homo sapiens
gctgatgtccctaattagtttt

SEQ ID NO: 8792473 - DNA, 22 bp, Homo sapiens
gctgatgtcccactgacagcca

SEQ ID NO: 8792474 - DNA, 22 bp, Homo sapiens
gctgatgtgatgtcagaagagg

SEQ ID NO: 8792475 - DNA, 22 bp, Homo sapiens
gctgatgtgatgtcagaagagg

SEQ ID NO: 8792476 - DNA, 22 bp, Homo sapiens
gctgatgtttagttgatgttac

SEQ ID NO: 8792477 - DNA, 21 bp, Homo sapiens
gctgatgttgactctgaccct

SEQ ID NO: 8792478 - DNA, 22 bp, Homo sapiens
gctgatgtttagttgatgttac

SEQ ID NO: 8792479 - DNA, 22 bp, Homo sapiens
gctgatgtatatagtgattgag

SEQ ID NO: 8792480 - DNA, 22 bp, Homo sapiens
gctgatgtaagacttttggttt

SEQ ID NO: 8792481 - DNA, 22 bp, Homo sapiens
gctgatggaaggacaggcgccg

SEQ ID NO: 8792482 - DNA, 22 bp, Homo sapiens
gctgatgcagggttgagaggag

SEQ ID NO: 8792483 - DNA, 22 bp, Homo sapiens
gctgatggcttgctggctgaca

SEQ ID NO: 8792484 - DNA, 22 bp, Homo sapiens
gctgcacatggcagaggccttt

SEQ ID NO: 8792485 - DNA, 22 bp, Homo sapiens
gctgcaccagctgcacccagta

SEQ ID NO: 8792486 - DNA, 22 bp, Homo sapiens
gctgcaccagctgcacccagta

SEQ ID NO: 8792487 - DNA, 22 bp, Homo sapiens
gctgcaagcatgtcatcctcac

SEQ ID NO: 8792488 - DNA, 22 bp, Homo sapiens
gctgcaccagctccaccagggc

SEQ ID NO: 8792489 - DNA, 22 bp, Homo sapiens
gctgcacatggcagaggccttt

SEQ ID NO: 8792490 - DNA, 22 bp, Homo sapiens
gctgcacatggcagaggccttt

SEQ ID NO: 8792491 - DNA, 19 bp, Homo sapiens
gctgcacacccagcaactg

SEQ ID NO: 8792492 - DNA, 22 bp, Homo sapiens
gctgcacagaacagtcattggc

SEQ ID NO: 8792493 - DNA, 22 bp, Homo sapiens
gctgcaagttagtatacattct

SEQ ID NO: 8792494 - DNA, 21 bp, Homo sapiens
gctgcaaattctaacaattat

SEQ ID NO: 8792495 - DNA, 22 bp, Homo sapiens
gctgatgtttcaagtatagctt

SEQ ID NO: 8792496 - DNA, 22 bp, Homo sapiens
gctgatgtttcaagtatagctt

SEQ ID NO: 8792497 - DNA, 22 bp, Homo sapiens
gctgattaacttcattgtagtt

SEQ ID NO: 8792498 - DNA, 22 bp, Homo sapiens
gctgaaggcccggaggacaggg

SEQ ID NO: 8792499 - DNA, 19 bp, Homo sapiens
gctgaaggaggtgcctgca

SEQ ID NO: 8792500 - DNA, 19 bp, Homo sapiens
gctgaaggaggtgcctgca

SEQ ID NO: 8792501 - DNA, 22 bp, Homo sapiens
gctgaaggaggctctggtacta

SEQ ID NO: 8792502 - DNA, 22 bp, Homo sapiens
gctgaagcccacgtggcttgta

SEQ ID NO: 8792503 - DNA, 22 bp, Homo sapiens
gctgaagcagatccaggtgtgg

SEQ ID NO: 8792504 - DNA, 22 bp, Homo sapiens
gctgaagatttttgctagcccc

SEQ ID NO: 8792505 - DNA, 22 bp, Homo sapiens
gctgaagataggcatttcagca

SEQ ID NO: 8792506 - DNA, 20 bp, Homo sapiens
gctgaagattcccatgcaag

SEQ ID NO: 8792507 - DNA, 22 bp, Homo sapiens
gctgaagatgcatcccttctct

SEQ ID NO: 8792508 - DNA, 22 bp, Homo sapiens
gctgaagggagtgctgagtctg

SEQ ID NO: 8792509 - DNA, 22 bp, Homo sapiens
gctgaaggtctctggagaggtc

SEQ ID NO: 8792510 - DNA, 20 bp, Homo sapiens
gctgaaggggtgggtttgtt

SEQ ID NO: 8792511 - DNA, 22 bp, Homo sapiens
gctgaaggtatgagttttatct

SEQ ID NO: 8792512 - DNA, 22 bp, Homo sapiens
gctgaaggtgtgtggagagagg

SEQ ID NO: 8792513 - DNA, 22 bp, Homo sapiens
gctgaataatgtgtaatgtctc

SEQ ID NO: 8792514 - DNA, 22 bp, Homo sapiens
gctgccagcccagcaaggtgtg

SEQ ID NO: 8792515 - DNA, 22 bp, Homo sapiens
gctgccagctgcggcccacgcg

SEQ ID NO: 8792516 - DNA, 22 bp, Homo sapiens
gctgccagctcactctcctgag

SEQ ID NO: 8792517 - DNA, 22 bp, Homo sapiens
gctgccagcgtcagacctgggg

SEQ ID NO: 8792518 - DNA, 22 bp, Homo sapiens
gctgccagcgtcagacctgggg

SEQ ID NO: 8792519 - DNA, 22 bp, Homo sapiens
gctgccagccctcggggtctga

SEQ ID NO: 8792520 - DNA, 21 bp, Homo sapiens
gctgccaggattttgcaggaa

SEQ ID NO: 8792521 - DNA, 21 bp, Homo sapiens
gctgccaggattttgcaggaa

SEQ ID NO: 8792522 - DNA, 22 bp, Homo sapiens
gctgccagctttccttggctga

SEQ ID NO: 8792523 - DNA, 19 bp, Homo sapiens
gctgccaggacagttactg

SEQ ID NO: 8792524 - DNA, 19 bp, Homo sapiens
gctgccaggacagttactg

SEQ ID NO: 8792525 - DNA, 19 bp, Homo sapiens
gctgccaggacagttactg

SEQ ID NO: 8792526 - DNA, 22 bp, Homo sapiens
gctgccagtagttggagctcca

SEQ ID NO: 8792527 - DNA, 22 bp, Homo sapiens
gctgccagtagttggagctcca

SEQ ID NO: 8792528 - DNA, 22 bp, Homo sapiens
gctgccaggggcagctgtctca

SEQ ID NO: 8792529 - DNA, 20 bp, Homo sapiens
gctgccagggcggagacatc

SEQ ID NO: 8792530 - DNA, 22 bp, Homo sapiens
gctgccaggggcagctgtctca

SEQ ID NO: 8792531 - DNA, 20 bp, Homo sapiens
gctgccagtgcctgatgctt

SEQ ID NO: 8792532 - DNA, 22 bp, Homo sapiens
gctgccagtgtggcatgatgca

SEQ ID NO: 8792533 - DNA, 22 bp, Homo sapiens
gctgccagttccttcttactcc

SEQ ID NO: 8792534 - DNA, 22 bp, Homo sapiens
gctgccatcccctgctgggctg

SEQ ID NO: 8792535 - DNA, 22 bp, Homo sapiens
gctgcagacctcatgcaggtgg

SEQ ID NO: 8792536 - DNA, 22 bp, Homo sapiens
gctgcagctcgccttccggcct

SEQ ID NO: 8792537 - DNA, 22 bp, Homo sapiens
gctgcagctgtaggacacaatt

SEQ ID NO: 8792538 - DNA, 22 bp, Homo sapiens
gctgcaggagctggagctgtgg

SEQ ID NO: 8792539 - DNA, 22 bp, Homo sapiens
gctgcaggagattttgagagtc

SEQ ID NO: 8792540 - DNA, 22 bp, Homo sapiens
gctgcaggagctggagctgtgg

SEQ ID NO: 8792541 - DNA, 23 bp, Homo sapiens
gctgcagctgtggatgttctcag

SEQ ID NO: 8792542 - DNA, 22 bp, Homo sapiens
gctgcagctttaggatccagtg

SEQ ID NO: 8792543 - DNA, 22 bp, Homo sapiens
gctgcaggagctggagctgtgg

SEQ ID NO: 8792544 - DNA, 22 bp, Homo sapiens
gctgcagggggtgggcgtctcc

SEQ ID NO: 8792545 - DNA, 22 bp, Homo sapiens
gctgcaggatgaggctctgctc

SEQ ID NO: 8792546 - DNA, 22 bp, Homo sapiens
gctgcaggatgaggctctgctc

SEQ ID NO: 8792547 - DNA, 22 bp, Homo sapiens
gctgcaggttgggcaacagagt

SEQ ID NO: 8792548 - DNA, 22 bp, Homo sapiens
gctgcagggggtgggcgtctcc

SEQ ID NO: 8792549 - DNA, 22 bp, Homo sapiens
gctgcagggggtgggcgtctcc

SEQ ID NO: 8792550 - DNA, 22 bp, Homo sapiens
gctgccagcacagttcagctgt

SEQ ID NO: 8792551 - DNA, 22 bp, Homo sapiens
gctgccagccaacttgctgtgc

SEQ ID NO: 8792552 - DNA, 22 bp, Homo sapiens
gcctggggggcatgtcataata

SEQ ID NO: 8792553 - DNA, 22 bp, Homo sapiens
gcctggggtcccttgttggcac

SEQ ID NO: 8792554 - DNA, 22 bp, Homo sapiens
gcctggggtcccttgttggcac

SEQ ID NO: 8792555 - DNA, 22 bp, Homo sapiens
gcctggggtcccttgttggcac

SEQ ID NO: 8792556 - DNA, 22 bp, Homo sapiens
gcctggggtctctgactcacag

SEQ ID NO: 8792557 - DNA, 22 bp, Homo sapiens
gcctggggtctctgactcacag

SEQ ID NO: 8792558 - DNA, 22 bp, Homo sapiens
gcctggggtctctgactcacag

SEQ ID NO: 8792559 - DNA, 22 bp, Homo sapiens
gcctggggtctctgactcacag

SEQ ID NO: 8792560 - DNA, 22 bp, Homo sapiens
gcctgggtaggagacaaaaggt

SEQ ID NO: 8792561 - DNA, 22 bp, Homo sapiens
gcctggggcatgcagctgatac

SEQ ID NO: 8792562 - DNA, 22 bp, Homo sapiens
gcctggggggcatgtcataata

SEQ ID NO: 8792563 - DNA, 22 bp, Homo sapiens
gcctggggccagcttgggctga

SEQ ID NO: 8792564 - DNA, 22 bp, Homo sapiens
gcctggggcatgcagctgatac

SEQ ID NO: 8792565 - DNA, 22 bp, Homo sapiens
gcctggggcatgcagctgatac

SEQ ID NO: 8792566 - DNA, 22 bp, Homo sapiens
gcctggtgaaaggcagagagcg

SEQ ID NO: 8792567 - DNA, 22 bp, Homo sapiens
gcctggtgaaaggcagagagcg

SEQ ID NO: 8792568 - DNA, 22 bp, Homo sapiens
gcctggtgataagcagtgacct

SEQ ID NO: 8792569 - DNA, 22 bp, Homo sapiens
gcctggtgataagcagtgacct

SEQ ID NO: 8792570 - DNA, 22 bp, Homo sapiens
gcctggtgataagcagtgacct

SEQ ID NO: 8792571 - DNA, 23 bp, Homo sapiens
gcctgggttgtaactagtgcatc

SEQ ID NO: 8792572 - DNA, 22 bp, Homo sapiens
gcctgggttccatgatctccag

SEQ ID NO: 8792573 - DNA, 22 bp, Homo sapiens
gcctgggttccatgatctccag

SEQ ID NO: 8792574 - DNA, 23 bp, Homo sapiens
gcctgggttgtaactagtgcatc

SEQ ID NO: 8792575 - DNA, 22 bp, Homo sapiens
gcctgggttcctgcttttgtga

SEQ ID NO: 8792576 - DNA, 22 bp, Homo sapiens
gcctggtgaaaggcagagagcg

SEQ ID NO: 8792577 - DNA, 22 bp, Homo sapiens
gcctgggtctcctccgcttccc

SEQ ID NO: 8792578 - DNA, 22 bp, Homo sapiens
gcctgggtctcctccgcttccc

SEQ ID NO: 8792579 - DNA, 22 bp, Homo sapiens
gcctgggtccactgatcatgct

SEQ ID NO: 8792580 - DNA, 23 bp, Homo sapiens
gcctgggtctagagataagagcc

SEQ ID NO: 8792581 - DNA, 22 bp, Homo sapiens
gcctgggtgtcgatcactagtg

SEQ ID NO: 8792582 - DNA, 22 bp, Homo sapiens
gcctgggtgtcgatcactagtg

SEQ ID NO: 8792583 - DNA, 22 bp, Homo sapiens
gcctgggtgagggtctccttca

SEQ ID NO: 8792584 - DNA, 22 bp, Homo sapiens
gcctgggtggagaggggtgaca

SEQ ID NO: 8792585 - DNA, 22 bp, Homo sapiens
gcctgggtgctctgtgtaaggg

SEQ ID NO: 8792586 - DNA, 22 bp, Homo sapiens
gcctgggtggagaggggtgaca

SEQ ID NO: 8792587 - DNA, 23 bp, Homo sapiens
gccttcagctcgggaaggctccc

SEQ ID NO: 8792588 - DNA, 23 bp, Homo sapiens
gccttcagctcgggaaggctccc

SEQ ID NO: 8792589 - DNA, 22 bp, Homo sapiens
gccttcagcggccgctcgctgc

SEQ ID NO: 8792590 - DNA, 22 bp, Homo sapiens
gccttcagcggccgctcgctgc

SEQ ID NO: 8792591 - DNA, 22 bp, Homo sapiens
gccttcaggaaatcagtccttg

SEQ ID NO: 8792592 - DNA, 22 bp, Homo sapiens
gccttcaggagggttccagaca

SEQ ID NO: 8792593 - DNA, 22 bp, Homo sapiens
gccttccacctaggcctctgct

SEQ ID NO: 8792594 - DNA, 22 bp, Homo sapiens
gccttcagtagtgtcagctgta

SEQ ID NO: 8792595 - DNA, 22 bp, Homo sapiens
gccttcaggtgctgccaggcta

SEQ ID NO: 8792596 - DNA, 22 bp, Homo sapiens
gccttcaggtgtccctgtgggc

SEQ ID NO: 8792597 - DNA, 22 bp, Homo sapiens
gccttcagtaactgagacggaa

SEQ ID NO: 8792598 - DNA, 22 bp, Homo sapiens
gccttcagtaactgagacggaa

SEQ ID NO: 8792599 - DNA, 22 bp, Homo sapiens
gccttcagtagtatcctcatga

SEQ ID NO: 8792600 - DNA, 22 bp, Homo sapiens
gccttcagtagtatcctcatga

SEQ ID NO: 8792601 - DNA, 22 bp, Homo sapiens
gcctggtggtgtgctcaagtgg

SEQ ID NO: 8792602 - DNA, 22 bp, Homo sapiens
gcctggtgtccagaggcgagtg

SEQ ID NO: 8792603 - DNA, 22 bp, Homo sapiens
gcctggtggtgtgctcaagtgg

SEQ ID NO: 8792604 - DNA, 22 bp, Homo sapiens
gcctggtggacactgggcatca

SEQ ID NO: 8792605 - DNA, 22 bp, Homo sapiens
gcctggtgtccagaggcgagtg

SEQ ID NO: 8792606 - DNA, 22 bp, Homo sapiens
gcctggtgctatgagggccagc

SEQ ID NO: 8792607 - DNA, 22 bp, Homo sapiens
gcctggtgctatgagggccagc

SEQ ID NO: 8792608 - DNA, 22 bp, Homo sapiens
gccttcagccctgactggccag

SEQ ID NO: 8792609 - DNA, 22 bp, Homo sapiens
gcctggctgggcaccaggggag

SEQ ID NO: 8792610 - DNA, 22 bp, Homo sapiens
gcctggctggtagagggggctc

SEQ ID NO: 8792611 - DNA, 22 bp, Homo sapiens
gcctggctgtctggcaaggttc

SEQ ID NO: 8792612 - DNA, 22 bp, Homo sapiens
gcctggctggtcactgcctggc

SEQ ID NO: 8792613 - DNA, 22 bp, Homo sapiens
gcctggctgtcaaacccagaag

SEQ ID NO: 8792614 - DNA, 19 bp, Homo sapiens
gcctggctgggatgagccc

SEQ ID NO: 8792615 - DNA, 22 bp, Homo sapiens
gcctggctgggctgaatgctta

SEQ ID NO: 8792616 - DNA, 22 bp, Homo sapiens
gcctggctgggctgaatgctta

SEQ ID NO: 8792617 - DNA, 22 bp, Homo sapiens
gcctggctgggcaccaggggag

SEQ ID NO: 8792618 - DNA, 22 bp, Homo sapiens
gcctggcttggggctcagtggt

SEQ ID NO: 8792619 - DNA, 22 bp, Homo sapiens
gcctggggaacttgatcctgtc

SEQ ID NO: 8792620 - DNA, 22 bp, Homo sapiens
gcctggggaacttgatcctgtc

SEQ ID NO: 8792621 - DNA, 22 bp, Homo sapiens
gcctggggaacttgatcctgtc

SEQ ID NO: 8792622 - DNA, 22 bp, Homo sapiens
gcctggcttgccagccctggcg

SEQ ID NO: 8792623 - DNA, 22 bp, Homo sapiens
gcctggcttgccagccctggcg

SEQ ID NO: 8792624 - DNA, 22 bp, Homo sapiens
gcctggcttgccagccctggcg

SEQ ID NO: 8792625 - DNA, 22 bp, Homo sapiens
gcctggcttcccttggagcatt

SEQ ID NO: 8792626 - DNA, 22 bp, Homo sapiens
gcctggctgtctggcaaggttc

SEQ ID NO: 8792627 - DNA, 18 bp, Homo sapiens
gcctggcttcggagccgc

SEQ ID NO: 8792628 - DNA, 23 bp, Homo sapiens
gcctggcttccaaggtaggggag

SEQ ID NO: 8792629 - DNA, 21 bp, Homo sapiens
gcctggcttcacaggcactga

SEQ ID NO: 8792630 - DNA, 22 bp, Homo sapiens
gcctggcttcccttggagcatt

SEQ ID NO: 8792631 - DNA, 21 bp, Homo sapiens
gcctggcttcacaggcactga

SEQ ID NO: 8792632 - DNA, 22 bp, Homo sapiens
gcctggctatggcctcccccat

SEQ ID NO: 8792633 - DNA, 22 bp, Homo sapiens
gcctggctagttagtgtcaggt

SEQ ID NO: 8792634 - DNA, 21 bp, Homo sapiens
gcctggctagaagctcctagc

SEQ ID NO: 8792635 - DNA, 18 bp, Homo sapiens
gcctggctgccaacccag

SEQ ID NO: 8792636 - DNA, 22 bp, Homo sapiens
gcctggctgccggccttggcaa

SEQ ID NO: 8792637 - DNA, 22 bp, Homo sapiens
gcctggctgctcagccactcac

SEQ ID NO: 8792638 - DNA, 22 bp, Homo sapiens
gcctggctgctggttctgagga

SEQ ID NO: 8792639 - DNA, 22 bp, Homo sapiens
gcctggctgcttagcctacttc

SEQ ID NO: 8792640 - DNA, 22 bp, Homo sapiens
gcctggctgctggttctgagga

SEQ ID NO: 8792641 - DNA, 22 bp, Homo sapiens
gcctggctgaggtggggaggca

SEQ ID NO: 8792642 - DNA, 22 bp, Homo sapiens
gcctggctgctagccagaggca

SEQ ID NO: 8792643 - DNA, 22 bp, Homo sapiens
gcctggctgctagccagaggca

SEQ ID NO: 8792644 - DNA, 22 bp, Homo sapiens
gcctggctgctagccagaggca

SEQ ID NO: 8792645 - DNA, 22 bp, Homo sapiens
gcctggctaagcagaaggaccc

SEQ ID NO: 8792646 - DNA, 22 bp, Homo sapiens
gcctggctaagcagaaggaccc

SEQ ID NO: 8792647 - DNA, 22 bp, Homo sapiens
gcctcagggataggatgagcat

SEQ ID NO: 8792648 - DNA, 22 bp, Homo sapiens
gcctggctacccactgaaatat

SEQ ID NO: 8792649 - DNA, 22 bp, Homo sapiens
gcctggctaattttggtatttt

SEQ ID NO: 8792650 - DNA, 21 bp, Homo sapiens
gcctggctagaagctcctagc

SEQ ID NO: 8792651 - DNA, 22 bp, Homo sapiens
gcctcagggataggatgagcat

SEQ ID NO: 8792652 - DNA, 22 bp, Homo sapiens
gcctcaggccgccctgctgctc

SEQ ID NO: 8792653 - DNA, 22 bp, Homo sapiens
gcctcaggccgccctgctgctc

SEQ ID NO: 8792654 - DNA, 22 bp, Homo sapiens
gcctcaggccgccctgctgctc

SEQ ID NO: 8792655 - DNA, 22 bp, Homo sapiens
gcctcaggccgccctgctgctc

SEQ ID NO: 8792656 - DNA, 22 bp, Homo sapiens
gcctcaggcctatagctgctgt

SEQ ID NO: 8792657 - DNA, 22 bp, Homo sapiens
gcctcaggcctatagctgctgt

SEQ ID NO: 8792658 - DNA, 22 bp, Homo sapiens
gcctcaggcctatagctgctgt

SEQ ID NO: 8792659 - DNA, 22 bp, Homo sapiens
gcgggccaccttggagagcgct

SEQ ID NO: 8792660 - DNA, 22 bp, Homo sapiens
gcggggcacagtgatggagcac

SEQ ID NO: 8792661 - DNA, 22 bp, Homo sapiens
gcgggcgggggttcccaggtct

SEQ ID NO: 8792662 - DNA, 22 bp, Homo sapiens
gcggcggagacagcaggaagcc

SEQ ID NO: 8792663 - DNA, 22 bp, Homo sapiens
gcggcgcctaagccccgacctc

SEQ ID NO: 8792664 - DNA, 22 bp, Homo sapiens
gcgggcagggcactggtcccct

SEQ ID NO: 8792665 - DNA, 22 bp, Homo sapiens
gcggcccgagcaggacgggtgg

SEQ ID NO: 8792666 - DNA, 22 bp, Homo sapiens
gcggcccgagcaggacgggtgg

SEQ ID NO: 8792667 - DNA, 22 bp, Homo sapiens
gcggccttgtggcggagcaggc

SEQ ID NO: 8792668 - DNA, 22 bp, Homo sapiens
gcggccttgtggcggagcaggc

SEQ ID NO: 8792669 - DNA, 22 bp, Homo sapiens
gcggcctgcgctgctcccgacg

SEQ ID NO: 8792670 - DNA, 22 bp, Homo sapiens
gcgctcaggtgccaggcctgcg

SEQ ID NO: 8792671 - DNA, 22 bp, Homo sapiens
gcgctcctcccggccctggtgg

SEQ ID NO: 8792672 - DNA, 22 bp, Homo sapiens
gcgctcaggtgccaggcctgcg

SEQ ID NO: 8792673 - DNA, 22 bp, Homo sapiens
gcgctgcgcctcctcttccgca

SEQ ID NO: 8792674 - DNA, 22 bp, Homo sapiens
gcgctgcgcctcctcttccgca

SEQ ID NO: 8792675 - DNA, 22 bp, Homo sapiens
gcgcttccaccgaaggcagctc

SEQ ID NO: 8792676 - DNA, 22 bp, Homo sapiens
gcgctcctgagggttctgcatc

SEQ ID NO: 8792677 - DNA, 22 bp, Homo sapiens
gcgctctcttctcctggcccgc

SEQ ID NO: 8792678 - DNA, 22 bp, Homo sapiens
gcgctgaggctggaggcgcacg

SEQ ID NO: 8792679 - DNA, 22 bp, Homo sapiens
gcgctgcctctgctctccccac

SEQ ID NO: 8792680 - DNA, 22 bp, Homo sapiens
gcggaggacaggaatgcgggcg

SEQ ID NO: 8792681 - DNA, 22 bp, Homo sapiens
gcggaggaaactgaggcaagag

SEQ ID NO: 8792682 - DNA, 22 bp, Homo sapiens
gcggaaggctgcctggcttgag

SEQ ID NO: 8792683 - DNA, 22 bp, Homo sapiens
gcggcagaggtgttgcgagcga

SEQ ID NO: 8792684 - DNA, 22 bp, Homo sapiens
gcggcaggaagagcgcagcccc

SEQ ID NO: 8792685 - DNA, 22 bp, Homo sapiens
gcggcaggagtaaaggaggaag

SEQ ID NO: 8792686 - DNA, 22 bp, Homo sapiens
gcggcaggaagagcgcagcccc

SEQ ID NO: 8792687 - DNA, 22 bp, Homo sapiens
gcggagggcgagcccgcggagc

SEQ ID NO: 8792688 - DNA, 22 bp, Homo sapiens
gcggagggcgagcccgcggagc

SEQ ID NO: 8792689 - DNA, 18 bp, Homo sapiens
gcgaattcctccatggca

SEQ ID NO: 8792690 - DNA, 22 bp, Homo sapiens
gcgaagggtcctcactagatgc

SEQ ID NO: 8792691 - DNA, 22 bp, Homo sapiens
gccttttttgttgctctgtcac

SEQ ID NO: 8792692 - DNA, 22 bp, Homo sapiens
gccttttttaaactccaagtct

SEQ ID NO: 8792693 - DNA, 22 bp, Homo sapiens
gccttgcaggaaggagggacag

SEQ ID NO: 8792694 - DNA, 22 bp, Homo sapiens
gccttgccaaggggcagcagag

SEQ ID NO: 8792695 - DNA, 22 bp, Homo sapiens
gccttgccaaggggcagcagag

SEQ ID NO: 8792696 - DNA, 22 bp, Homo sapiens
gcgccccatctacagtactttt

SEQ ID NO: 8792697 - DNA, 22 bp, Homo sapiens
gcgcctggcacacagcaagggc

SEQ ID NO: 8792698 - DNA, 22 bp, Homo sapiens
gcgcgctctctccagcctcccc

SEQ ID NO: 8792699 - DNA, 22 bp, Homo sapiens
gcgcctgccaccatgccaggct

SEQ ID NO: 8792700 - DNA, 22 bp, Homo sapiens
gccttctctgtgagctcctagg

SEQ ID NO: 8792701 - DNA, 22 bp, Homo sapiens
gccttctctgtgagctcctagg

SEQ ID NO: 8792702 - DNA, 22 bp, Homo sapiens
gccttctgatatctcttggcat

SEQ ID NO: 8792703 - DNA, 22 bp, Homo sapiens
gccttctgatcgctggactgac

SEQ ID NO: 8792704 - DNA, 22 bp, Homo sapiens
gccttctgatatctcttggcat

SEQ ID NO: 8792705 - DNA, 17 bp, Homo sapiens
gccttctctgccctcac

SEQ ID NO: 8792706 - DNA, 17 bp, Homo sapiens
gccttctctgccctcac

SEQ ID NO: 8792707 - DNA, 17 bp, Homo sapiens
gccttctctgccctcac

SEQ ID NO: 8792708 - DNA, 22 bp, Homo sapiens
gccttccacgtcaggggaaata

SEQ ID NO: 8792709 - DNA, 22 bp, Homo sapiens
gccttccacctaggcctctgct

SEQ ID NO: 8792710 - DNA, 22 bp, Homo sapiens
gccttctgtgctcctggccttt

SEQ ID NO: 8792711 - DNA, 22 bp, Homo sapiens
gccttctgcgctcgtgtctccg

SEQ ID NO: 8792712 - DNA, 22 bp, Homo sapiens
gccttctgtccaaccccacgat

SEQ ID NO: 8792713 - DNA, 22 bp, Homo sapiens
gccttctgtgctcctggccttt

SEQ ID NO: 8792714 - DNA, 22 bp, Homo sapiens
gccttctgtgctcctggccttt

SEQ ID NO: 8792715 - DNA, 22 bp, Homo sapiens
gccttctgattgctggactgac

SEQ ID NO: 8792716 - DNA, 22 bp, Homo sapiens
gccttctgatcgctggactgac

SEQ ID NO: 8792717 - DNA, 22 bp, Homo sapiens
gccttctgattgctggactgac

SEQ ID NO: 8792718 - DNA, 22 bp, Homo sapiens
gctatagaatttcatagagacc

SEQ ID NO: 8792719 - DNA, 22 bp, Homo sapiens
gcggggggcagcagtcgctcag

SEQ ID NO: 8792720 - DNA, 22 bp, Homo sapiens
gcggggggaggaacatcttgca

SEQ ID NO: 8792721 - DNA, 22 bp, Homo sapiens
gcgggggcggcgcagacctcag

SEQ ID NO: 8792722 - DNA, 22 bp, Homo sapiens
gcggggcccggacccagcctct

SEQ ID NO: 8792723 - DNA, 22 bp, Homo sapiens
gcggggcccggacccagcctct

SEQ ID NO: 8792724 - DNA, 22 bp, Homo sapiens
gcggggcccccggccgagctct

SEQ ID NO: 8792725 - DNA, 22 bp, Homo sapiens
gcggggcccccggccgagctct

SEQ ID NO: 8792726 - DNA, 22 bp, Homo sapiens
gctcaagaccagacaaagcctg

SEQ ID NO: 8792727 - DNA, 22 bp, Homo sapiens
gctcaaatttcagactcatgaa

SEQ ID NO: 8792728 - DNA, 19 bp, Homo sapiens
gctcaacagctcgggtcct

SEQ ID NO: 8792729 - DNA, 22 bp, Homo sapiens
gctcaagccttctgcccacctc

SEQ ID NO: 8792730 - DNA, 22 bp, Homo sapiens
gctcaagccttctgcccacctc

SEQ ID NO: 8792731 - DNA, 22 bp, Homo sapiens
gctcaatcctagaggctcaggg

SEQ ID NO: 8792732 - DNA, 22 bp, Homo sapiens
gctatctttctgcaccataatt

SEQ ID NO: 8792733 - DNA, 22 bp, Homo sapiens
gctcacagtctgctgagtgcag

SEQ ID NO: 8792734 - DNA, 22 bp, Homo sapiens
gctcacagtctgctgagtgcag

SEQ ID NO: 8792735 - DNA, 22 bp, Homo sapiens
gctcacagtacagtgctggctc

SEQ ID NO: 8792736 - DNA, 22 bp, Homo sapiens
gctcacagtacagtgctggctc

SEQ ID NO: 8792737 - DNA, 22 bp, Homo sapiens
gctcacaggtctgtggctattg

SEQ ID NO: 8792738 - DNA, 23 bp, Homo sapiens
gctcacagggtgtaactcctagt

SEQ ID NO: 8792739 - DNA, 23 bp, Homo sapiens
gctcacagggtgtaactcctagt

SEQ ID NO: 8792740 - DNA, 22 bp, Homo sapiens
gctcacagcccaggccagcgtg

SEQ ID NO: 8792741 - DNA, 22 bp, Homo sapiens
gctcaatcctagaggctcaggg

SEQ ID NO: 8792742 - DNA, 22 bp, Homo sapiens
gctcacagaacttctcttccca

SEQ ID NO: 8792743 - DNA, 23 bp, Homo sapiens
gctcacagaatgttgaagggaat

SEQ ID NO: 8792744 - DNA, 22 bp, Homo sapiens
gctcacagagggtgcttaatac

SEQ ID NO: 8792745 - DNA, 22 bp, Homo sapiens
gctcacagagggtgcttaatac

SEQ ID NO: 8792746 - DNA, 22 bp, Homo sapiens
gctcacagccggctggcagggg

SEQ ID NO: 8792747 - DNA, 22 bp, Homo sapiens
gctcacagccggctggcagggg

SEQ ID NO: 8792748 - DNA, 22 bp, Homo sapiens
gctcaggcccagcggctggtgt

SEQ ID NO: 8792749 - DNA, 22 bp, Homo sapiens
gctcaggcccagcggctggtgt

SEQ ID NO: 8792750 - DNA, 22 bp, Homo sapiens
gctcaggcatgtatgtggttgc

SEQ ID NO: 8792751 - DNA, 22 bp, Homo sapiens
gctcagctgggaccaatgtgtt

SEQ ID NO: 8792752 - DNA, 22 bp, Homo sapiens
gctcagctggagagggacgggt

SEQ ID NO: 8792753 - DNA, 21 bp, Homo sapiens
gctcagctgcttggttcctgt

SEQ ID NO: 8792754 - DNA, 22 bp, Homo sapiens
gctcagctggaccatcgtgttt

SEQ ID NO: 8792755 - DNA, 22 bp, Homo sapiens
gctcagctggaccatcgtgttt

SEQ ID NO: 8792756 - DNA, 22 bp, Homo sapiens
gctcagctgcacctggagagcc

SEQ ID NO: 8792757 - DNA, 22 bp, Homo sapiens
gctcaccttcgtccagcagccg

SEQ ID NO: 8792758 - DNA, 22 bp, Homo sapiens
gctcacagtctggcatagtctc

SEQ ID NO: 8792759 - DNA, 22 bp, Homo sapiens
gggagggaggtgatgcttggct

SEQ ID NO: 8792760 - DNA, 22 bp, Homo sapiens
gggagggagaggacagttctat

SEQ ID NO: 8792761 - DNA, 22 bp, Homo sapiens
gggagggagaggacagttctat

SEQ ID NO: 8792762 - DNA, 22 bp, Homo sapiens
gggagggaggtgctggttcacg

SEQ ID NO: 8792763 - DNA, 22 bp, Homo sapiens
gggagggagaggacagttctat

SEQ ID NO: 8792764 - DNA, 22 bp, Homo sapiens
gggagggaggtgatgcttggct

SEQ ID NO: 8792765 - DNA, 22 bp, Homo sapiens
gggagggaggtgatgcttggct

SEQ ID NO: 8792766 - DNA, 22 bp, Homo sapiens
gggagggaggtgatgcttggct

SEQ ID NO: 8792767 - DNA, 22 bp, Homo sapiens
gggagggatctgctaggcaatg

SEQ ID NO: 8792768 - DNA, 22 bp, Homo sapiens
gggagggatctgctaggcaatg

SEQ ID NO: 8792769 - DNA, 22 bp, Homo sapiens
gggagggatctgctaggcaatg

SEQ ID NO: 8792770 - DNA, 22 bp, Homo sapiens
gggagggatctgctaggcaatg

SEQ ID NO: 8792771 - DNA, 22 bp, Homo sapiens
gggagggatctgctaggcaatg

SEQ ID NO: 8792772 - DNA, 16 bp, Homo sapiens
gggagggagttggtgg

SEQ ID NO: 8792773 - DNA, 22 bp, Homo sapiens
gggagggaggtgctggttcacg

SEQ ID NO: 8792774 - DNA, 22 bp, Homo sapiens
gggagggaggtgctggttcacg

SEQ ID NO: 8792775 - DNA, 22 bp, Homo sapiens
gggagctggagttgtgttgcct

SEQ ID NO: 8792776 - DNA, 22 bp, Homo sapiens
gggagctggagctggaagactc

SEQ ID NO: 8792777 - DNA, 22 bp, Homo sapiens
gggagctggagctggaagactc

SEQ ID NO: 8792778 - DNA, 22 bp, Homo sapiens
gggagctggagctggaagactc

SEQ ID NO: 8792779 - DNA, 22 bp, Homo sapiens
gggagggagaggacagttctat

SEQ ID NO: 8792780 - DNA, 21 bp, Homo sapiens
gggagggatggaaatgatgtt

SEQ ID NO: 8792781 - DNA, 21 bp, Homo sapiens
gggagggatggaaatgatgtt

SEQ ID NO: 8792782 - DNA, 21 bp, Homo sapiens
gggagggatggaaatgatgtt

SEQ ID NO: 8792783 - DNA, 22 bp, Homo sapiens
gggagggattagttctgcctgg

SEQ ID NO: 8792784 - DNA, 22 bp, Homo sapiens
gggagggattagttctgcctgg

SEQ ID NO: 8792785 - DNA, 22 bp, Homo sapiens
gggagggattagttctgcctgg

SEQ ID NO: 8792786 - DNA, 22 bp, Homo sapiens
gggaggtgattaggaccatgta

SEQ ID NO: 8792787 - DNA, 22 bp, Homo sapiens
gggaggtgatggcaagcagcgg

SEQ ID NO: 8792788 - DNA, 22 bp, Homo sapiens
gggaggtgatggcaagcagcgg

SEQ ID NO: 8792789 - DNA, 22 bp, Homo sapiens
gggagggccaggctcacccagg

SEQ ID NO: 8792790 - DNA, 22 bp, Homo sapiens
gggagggattagttctgcctgg

SEQ ID NO: 8792791 - DNA, 22 bp, Homo sapiens
gggaggtgatggcaagcagcgg

SEQ ID NO: 8792792 - DNA, 22 bp, Homo sapiens
gggagggccaggctcacccagg

SEQ ID NO: 8792793 - DNA, 22 bp, Homo sapiens
gggaggtgatggcaagcagcgg

SEQ ID NO: 8792794 - DNA, 22 bp, Homo sapiens
gggaggtgattaggaccatgta

SEQ ID NO: 8792795 - DNA, 22 bp, Homo sapiens
gggaggtgattaggaccatgta

SEQ ID NO: 8792796 - DNA, 22 bp, Homo sapiens
gggaggtgattaggaccatgta

SEQ ID NO: 8792797 - DNA, 22 bp, Homo sapiens
gggaggtgattaggaccatgta

SEQ ID NO: 8792798 - DNA, 22 bp, Homo sapiens
gggaggtgttctgccaacgcgg

SEQ ID NO: 8792799 - DNA, 22 bp, Homo sapiens
gggaggtgttctgccaacgcgg

SEQ ID NO: 8792800 - DNA, 22 bp, Homo sapiens
gggaggtgttccagtgttggta

SEQ ID NO: 8792801 - DNA, 22 bp, Homo sapiens
gggcacagtactccaatcaact

SEQ ID NO: 8792802 - DNA, 22 bp, Homo sapiens
gggcacaggagaaggatctggc

SEQ ID NO: 8792803 - DNA, 22 bp, Homo sapiens
gggcacaggagaaggatctggc

SEQ ID NO: 8792804 - DNA, 22 bp, Homo sapiens
gggcacaggagaaggatctggc

SEQ ID NO: 8792805 - DNA, 22 bp, Homo sapiens
gggcacaggagaaggatctggc

SEQ ID NO: 8792806 - DNA, 22 bp, Homo sapiens
gggcacaggagaaggatctggc

SEQ ID NO: 8792807 - DNA, 22 bp, Homo sapiens
gggaggttgaggctgcagtgag

SEQ ID NO: 8792808 - DNA, 22 bp, Homo sapiens
gggcactgaacaccctcttcgc

SEQ ID NO: 8792809 - DNA, 22 bp, Homo sapiens
gggcactgaacaccctcttcgc

SEQ ID NO: 8792810 - DNA, 21 bp, Homo sapiens
gggcactgaaagggaatagca

SEQ ID NO: 8792811 - DNA, 21 bp, Homo sapiens
gggcactgaaagggaatagca

SEQ ID NO: 8792812 - DNA, 22 bp, Homo sapiens
gggcacctggctagtgacagtg

SEQ ID NO: 8792813 - DNA, 22 bp, Homo sapiens
gggcacctggctagtgacagtg

SEQ ID NO: 8792814 - DNA, 22 bp, Homo sapiens
gggcaccttgggtctcaggcaa

SEQ ID NO: 8792815 - DNA, 22 bp, Homo sapiens
gggcacagtctaaagttgggcc

SEQ ID NO: 8792816 - DNA, 22 bp, Homo sapiens
gggcacagtactccaatcaact

SEQ ID NO: 8792817 - DNA, 22 bp, Homo sapiens
gggcacagtctaaagttgggcc

SEQ ID NO: 8792818 - DNA, 22 bp, Homo sapiens
gggcacaggagaaggatctggc

SEQ ID NO: 8792819 - DNA, 22 bp, Homo sapiens
gggcacagtctaaagttgggcc

SEQ ID NO: 8792820 - DNA, 22 bp, Homo sapiens
gggcacagtctaaagttgggcc

SEQ ID NO: 8792821 - DNA, 22 bp, Homo sapiens
gggcacagtctgcagcccccca

SEQ ID NO: 8792822 - DNA, 22 bp, Homo sapiens
gggcacagtctgcagcccccca

SEQ ID NO: 8792823 - DNA, 22 bp, Homo sapiens
gggcacagtctgcagcccccca

SEQ ID NO: 8792824 - DNA, 22 bp, Homo sapiens
gggcactggaggccaaggagct

SEQ ID NO: 8792825 - DNA, 22 bp, Homo sapiens
gggcactggcagtcggggacgc

SEQ ID NO: 8792826 - DNA, 22 bp, Homo sapiens
gggcactggcaccaaagacttg

SEQ ID NO: 8792827 - DNA, 22 bp, Homo sapiens
gggcactggaggccaaggagct

SEQ ID NO: 8792828 - DNA, 22 bp, Homo sapiens
gggcactggaaggctctcaggc

SEQ ID NO: 8792829 - DNA, 22 bp, Homo sapiens
gggcactggaaggctctcaggc

SEQ ID NO: 8792830 - DNA, 22 bp, Homo sapiens
gggcactggaaggctctcaggc

SEQ ID NO: 8792831 - DNA, 22 bp, Homo sapiens
gggcactgctttgctctgtcac

SEQ ID NO: 8792832 - DNA, 22 bp, Homo sapiens
gggcactgctttgctctgtcac

SEQ ID NO: 8792833 - DNA, 22 bp, Homo sapiens
gggcactgagtggatgatgcag

SEQ ID NO: 8792834 - DNA, 22 bp, Homo sapiens
gggcactgctggaggctccctg

SEQ ID NO: 8792835 - DNA, 22 bp, Homo sapiens
gggcactgagtggatgatgcag

SEQ ID NO: 8792836 - DNA, 22 bp, Homo sapiens
gggcactgctggaggctccctg

SEQ ID NO: 8792837 - DNA, 22 bp, Homo sapiens
gggcactgagggcccacaggat

SEQ ID NO: 8792838 - DNA, 22 bp, Homo sapiens
gggcactgctggaggctccctg

SEQ ID NO: 8792839 - DNA, 22 bp, Homo sapiens
gggcactgctggaggctccctg

SEQ ID NO: 8792840 - DNA, 22 bp, Homo sapiens
gggcactgagggcccacaggat

SEQ ID NO: 8792841 - DNA, 22 bp, Homo sapiens
gggcactgagaattttccactt

SEQ ID NO: 8792842 - DNA, 22 bp, Homo sapiens
gggcactgacagggtcccaact

SEQ ID NO: 8792843 - DNA, 22 bp, Homo sapiens
gggcactgagggcccacaggat

SEQ ID NO: 8792844 - DNA, 22 bp, Homo sapiens
gggcactgagaattttccactt

SEQ ID NO: 8792845 - DNA, 22 bp, Homo sapiens
gggcactgagggcccacaggat

SEQ ID NO: 8792846 - DNA, 22 bp, Homo sapiens
gggcactgacagggtcccaact

SEQ ID NO: 8792847 - DNA, 22 bp, Homo sapiens
gggcactgaatgccaagctagg

SEQ ID NO: 8792848 - DNA, 18 bp, Homo sapiens
gggcactggggactggag

SEQ ID NO: 8792849 - DNA, 22 bp, Homo sapiens
gggcactgggtcttctccacgc

SEQ ID NO: 8792850 - DNA, 22 bp, Homo sapiens
gggcaggttattggagtaggga

SEQ ID NO: 8792851 - DNA, 22 bp, Homo sapiens
gggcaggttattggagtaggga

SEQ ID NO: 8792852 - DNA, 18 bp, Homo sapiens
gggcactggggactggag

SEQ ID NO: 8792853 - DNA, 22 bp, Homo sapiens
gggcactggcgttttgttaaac

SEQ ID NO: 8792854 - DNA, 22 bp, Homo sapiens
gggcactggccgcccatccctg

SEQ ID NO: 8792855 - DNA, 22 bp, Homo sapiens
gggcactggccgcccatccctg

SEQ ID NO: 8792856 - DNA, 22 bp, Homo sapiens
gggcactggcagtcggggacgc

SEQ ID NO: 8792857 - DNA, 23 bp, Homo sapiens
gggcaggtttttataggcttcag

SEQ ID NO: 8792858 - DNA, 22 bp, Homo sapiens
gggcaggttattggagtaggga

SEQ ID NO: 8792859 - DNA, 22 bp, Homo sapiens
gggcaggttggcatcccgggca

SEQ ID NO: 8792860 - DNA, 22 bp, Homo sapiens
gggcaggttattggagtaggga

SEQ ID NO: 8792861 - DNA, 23 bp, Homo sapiens
gggcaggtttttataggcttcag

SEQ ID NO: 8792862 - DNA, 23 bp, Homo sapiens
gggcaggtttttataggcttcag

SEQ ID NO: 8792863 - DNA, 23 bp, Homo sapiens
gggcaggtttttataggcttcag

SEQ ID NO: 8792864 - DNA, 22 bp, Homo sapiens
gggcagtgaatattggtgggaa

SEQ ID NO: 8792865 - DNA, 22 bp, Homo sapiens
gggcagtcacagtgctggagca

SEQ ID NO: 8792866 - DNA, 22 bp, Homo sapiens
gggcagtcacagtgctggagca

SEQ ID NO: 8792867 - DNA, 22 bp, Homo sapiens
gggcagtcacagtgctggagca

SEQ ID NO: 8792868 - DNA, 22 bp, Homo sapiens
gggcagtcacagtgctggagca

SEQ ID NO: 8792869 - DNA, 21 bp, Homo sapiens
gggcagtctggtggctatggc

SEQ ID NO: 8792870 - DNA, 22 bp, Homo sapiens
gggcagtgaatattggtgggaa

SEQ ID NO: 8792871 - DNA, 22 bp, Homo sapiens
gggcagtgaatattggtgggaa

SEQ ID NO: 8792872 - DNA, 22 bp, Homo sapiens
gggcagtgaatattggtgggaa

SEQ ID NO: 8792873 - DNA, 22 bp, Homo sapiens
gggcagtgacaaaggggatgaa

SEQ ID NO: 8792874 - DNA, 22 bp, Homo sapiens
gggcagtgacaaaggggatgaa

SEQ ID NO: 8792875 - DNA, 22 bp, Homo sapiens
gggcagtgacaaaggggatgaa

SEQ ID NO: 8792876 - DNA, 19 bp, Homo sapiens
gggcagtggcactagggag

SEQ ID NO: 8792877 - DNA, 19 bp, Homo sapiens
gggcagtggcactagggag

SEQ ID NO: 8792878 - DNA, 22 bp, Homo sapiens
gggcagtgacaaaggggatgaa

SEQ ID NO: 8792879 - DNA, 19 bp, Homo sapiens
gggcagtggcactagggag

SEQ ID NO: 8792880 - DNA, 22 bp, Homo sapiens
gggaagggacttgtttaaggtc

SEQ ID NO: 8792881 - DNA, 22 bp, Homo sapiens
gggaagggacttgtttaaggtc

SEQ ID NO: 8792882 - DNA, 22 bp, Homo sapiens
gggaagggacttgtttaaggtc

SEQ ID NO: 8792883 - DNA, 22 bp, Homo sapiens
gggaaggctgcctgagggatgg

SEQ ID NO: 8792884 - DNA, 22 bp, Homo sapiens
gggaaggctgcctgagggatgg

SEQ ID NO: 8792885 - DNA, 22 bp, Homo sapiens
gggaaggctgcctgagggatgg

SEQ ID NO: 8792886 - DNA, 22 bp, Homo sapiens
gggaagggagggacctcagtct

SEQ ID NO: 8792887 - DNA, 22 bp, Homo sapiens
gggaagggagggacctcagtct

SEQ ID NO: 8792888 - DNA, 22 bp, Homo sapiens
gggaagggagggcctccagtca

SEQ ID NO: 8792889 - DNA, 22 bp, Homo sapiens
gggaagggagggacctcagtct

SEQ ID NO: 8792890 - DNA, 22 bp, Homo sapiens
gggaagggagctgggtatttag

SEQ ID NO: 8792891 - DNA, 22 bp, Homo sapiens
gggaagggacttgtttaaggtc

SEQ ID NO: 8792892 - DNA, 22 bp, Homo sapiens
ggctttgacatgctgaattaaa

SEQ ID NO: 8792893 - DNA, 22 bp, Homo sapiens
ggctttgcattttgatggaggt

SEQ ID NO: 8792894 - DNA, 22 bp, Homo sapiens
ggctttgcattttgatggaggt

SEQ ID NO: 8792895 - DNA, 22 bp, Homo sapiens
ggctttctgagtcaaacactga

SEQ ID NO: 8792896 - DNA, 22 bp, Homo sapiens
ggctttctgagtcaaacactga

SEQ ID NO: 8792897 - DNA, 20 bp, Homo sapiens
ggctttctgtgatcctcagt

SEQ ID NO: 8792898 - DNA, 22 bp, Homo sapiens
ggctttcagccaaaggacaacc

SEQ ID NO: 8792899 - DNA, 22 bp, Homo sapiens
ggctttattttgcatgaatgct

SEQ ID NO: 8792900 - DNA, 22 bp, Homo sapiens
ggctttatttgcagccattgtt

SEQ ID NO: 8792901 - DNA, 22 bp, Homo sapiens
ggctttattatgtggccatgtg

SEQ ID NO: 8792902 - DNA, 22 bp, Homo sapiens
ggctttatttcactgtaccata

SEQ ID NO: 8792903 - DNA, 22 bp, Homo sapiens
ggctttattaactcatccgtaa

SEQ ID NO: 8792904 - DNA, 22 bp, Homo sapiens
ggctttattaagcagggtaagt

SEQ ID NO: 8792905 - DNA, 22 bp, Homo sapiens
ggctttatgtttttcatgtggt

SEQ ID NO: 8792906 - DNA, 21 bp, Homo sapiens
ggctttatgctcacccagcct

SEQ ID NO: 8792907 - DNA, 22 bp, Homo sapiens
ggctgtgcctcaaggctactca

SEQ ID NO: 8792908 - DNA, 22 bp, Homo sapiens
ggctttatagggtagaggatca

SEQ ID NO: 8792909 - DNA, 22 bp, Homo sapiens
ggctttatagggtagaggatca

SEQ ID NO: 8792910 - DNA, 22 bp, Homo sapiens
ggctgtgcctctggcagcacat

SEQ ID NO: 8792911 - DNA, 22 bp, Homo sapiens
ggctttatattgtttgagcaga

SEQ ID NO: 8792912 - DNA, 22 bp, Homo sapiens
ggctttatcaaatgagaccctg

SEQ ID NO: 8792913 - DNA, 22 bp, Homo sapiens
ggctttatattgtttgagcaga

SEQ ID NO: 8792914 - DNA, 22 bp, Homo sapiens
ggctttatgcacagcagatggt

SEQ ID NO: 8792915 - DNA, 22 bp, Homo sapiens
ggctttatgcagggatagaaat

SEQ ID NO: 8792916 - DNA, 22 bp, Homo sapiens
gggaatgagagtcagcccagga

SEQ ID NO: 8792917 - DNA, 22 bp, Homo sapiens
gggaatatggaagtggacactt

SEQ ID NO: 8792918 - DNA, 22 bp, Homo sapiens
gggaatcttccttttttgtaag

SEQ ID NO: 8792919 - DNA, 21 bp, Homo sapiens
gggaatgagattcttggagat

SEQ ID NO: 8792920 - DNA, 19 bp, Homo sapiens
gggaatgatggaagacttc

SEQ ID NO: 8792921 - DNA, 17 bp, Homo sapiens
gggaagtggagaaagct

SEQ ID NO: 8792922 - DNA, 17 bp, Homo sapiens
gggaagtggagaaagct

SEQ ID NO: 8792923 - DNA, 23 bp, Homo sapiens
gggaagtggggatttgaagtcat

SEQ ID NO: 8792924 - DNA, 22 bp, Homo sapiens
gggaagtgaggagcccctctgc

SEQ ID NO: 8792925 - DNA, 23 bp, Homo sapiens
gggaagtggggatttgaagtcat

SEQ ID NO: 8792926 - DNA, 22 bp, Homo sapiens
gggaagtgccctcttcaggaga

SEQ ID NO: 8792927 - DNA, 22 bp, Homo sapiens
gggaagtgatggagccaggatt

SEQ ID NO: 8792928 - DNA, 22 bp, Homo sapiens
gggaagtgccctcttcaggaga

SEQ ID NO: 8792929 - DNA, 22 bp, Homo sapiens
gggaagtgtgcagagttctctt

SEQ ID NO: 8792930 - DNA, 22 bp, Homo sapiens
gggaagtgtgcagagttctctt

SEQ ID NO: 8792931 - DNA, 22 bp, Homo sapiens
gggaagtttgtgggaggaatat

SEQ ID NO: 8792932 - DNA, 22 bp, Homo sapiens
gggaagtgtgcagagttctctt

SEQ ID NO: 8792933 - DNA, 22 bp, Homo sapiens
gggaagtgtggtttctttacag

SEQ ID NO: 8792934 - DNA, 22 bp, Homo sapiens
gggaagtgtggtttctttacag

SEQ ID NO: 8792935 - DNA, 22 bp, Homo sapiens
gggaagggagggcctccagtca

SEQ ID NO: 8792936 - DNA, 22 bp, Homo sapiens
gggaagggagggcctccagtca

SEQ ID NO: 8792937 - DNA, 22 bp, Homo sapiens
gggaagggctccttttattgca

SEQ ID NO: 8792938 - DNA, 23 bp, Homo sapiens
gggaagtgaggagcccctcagcc

SEQ ID NO: 8792939 - DNA, 23 bp, Homo sapiens
gggaagtgaggagcccctcagcc

SEQ ID NO: 8792940 - DNA, 22 bp, Homo sapiens
gggaagtgaagtgtagctgtct

SEQ ID NO: 8792941 - DNA, 22 bp, Homo sapiens
gggaagtgaagtgtagctgtct

SEQ ID NO: 8792942 - DNA, 22 bp, Homo sapiens
gggaagtgagctggaatcaagg

SEQ ID NO: 8792943 - DNA, 22 bp, Homo sapiens
gggaagtgagctggaatcaagg

SEQ ID NO: 8792944 - DNA, 22 bp, Homo sapiens
gggaagtgaggagcccctctgc

SEQ ID NO: 8792945 - DNA, 23 bp, Homo sapiens
gggaagtgaggagcccctctgcc

SEQ ID NO: 8792946 - DNA, 23 bp, Homo sapiens
gggaagtgaggagcccctctgcc

SEQ ID NO: 8792947 - DNA, 22 bp, Homo sapiens
gggaagtgatggagccaggatt

SEQ ID NO: 8792948 - DNA, 22 bp, Homo sapiens
gggaagtgatggagccaggatt

SEQ ID NO: 8792949 - DNA, 22 bp, Homo sapiens
gggaagtgatggagccaggatt

SEQ ID NO: 8792950 - DNA, 22 bp, Homo sapiens
gggaagtgatggagccaggatt

SEQ ID NO: 8792951 - DNA, 22 bp, Homo sapiens
gggagctgagctggaagagaat

SEQ ID NO: 8792952 - DNA, 22 bp, Homo sapiens
gggagctgagctggaagagaat

SEQ ID NO: 8792953 - DNA, 22 bp, Homo sapiens
gggagctgagctggaagagaat

SEQ ID NO: 8792954 - DNA, 22 bp, Homo sapiens
gggagctgagctctgagccacg

SEQ ID NO: 8792955 - DNA, 22 bp, Homo sapiens
gggagctgagctctgagccacg

SEQ ID NO: 8792956 - DNA, 22 bp, Homo sapiens
gggagctgagaaacaacattct

SEQ ID NO: 8792957 - DNA, 22 bp, Homo sapiens
gggagctgacctgcaggttccc

SEQ ID NO: 8792958 - DNA, 22 bp, Homo sapiens
gggagctgacctgcaggttccc

SEQ ID NO: 8792959 - DNA, 21 bp, Homo sapiens
gggagctgacagcagcacggc

SEQ ID NO: 8792960 - DNA, 22 bp, Homo sapiens
gggagctgagggacctctgtgg

SEQ ID NO: 8792961 - DNA, 22 bp, Homo sapiens
gggagctgagctggaagagaat

SEQ ID NO: 8792962 - DNA, 22 bp, Homo sapiens
gggagctgagctggaagagaat

SEQ ID NO: 8792963 - DNA, 22 bp, Homo sapiens
gggagctgagctggaagagaat

SEQ ID NO: 8792964 - DNA, 19 bp, Homo sapiens
gggagctgaggtctttggt

SEQ ID NO: 8792965 - DNA, 23 bp, Homo sapiens
ggctagagtggaggggaactgca

SEQ ID NO: 8792966 - DNA, 22 bp, Homo sapiens
ggctagaaactcaggcaagaaa

SEQ ID NO: 8792967 - DNA, 21 bp, Homo sapiens
ggctaggatgctggggtttcc

SEQ ID NO: 8792968 - DNA, 22 bp, Homo sapiens
ggctaggcaggctcagagccta

SEQ ID NO: 8792969 - DNA, 22 bp, Homo sapiens
ggctagcaaggtagcagaatgc

SEQ ID NO: 8792970 - DNA, 22 bp, Homo sapiens
ggctagagtggaactggagcgg

SEQ ID NO: 8792971 - DNA, 22 bp, Homo sapiens
ggctagaagtcagaggtcaaga

SEQ ID NO: 8792972 - DNA, 22 bp, Homo sapiens
ggctagaaatttttacttaagt

SEQ ID NO: 8792973 - DNA, 22 bp, Homo sapiens
ggctagaaagctactacaggag

SEQ ID NO: 8792974 - DNA, 22 bp, Homo sapiens
ggctaccagataaattacagag

SEQ ID NO: 8792975 - DNA, 22 bp, Homo sapiens
ggctacctgatttaggaaacaa

SEQ ID NO: 8792976 - DNA, 22 bp, Homo sapiens
ggctacagtggctcagtgctgg

SEQ ID NO: 8792977 - DNA, 22 bp, Homo sapiens
ggctacagaggccgtgagcctg

SEQ ID NO: 8792978 - DNA, 22 bp, Homo sapiens
ggctaagggttatacatgaacc

SEQ ID NO: 8792979 - DNA, 14 bp, Homo sapiens
ggctaaggggacag

SEQ ID NO: 8792980 - DNA, 23 bp, Homo sapiens
ggctaaggccgccggccctgctc

SEQ ID NO: 8792981 - DNA, 22 bp, Homo sapiens
ggctaaggaacgcaggcttctc

SEQ ID NO: 8792982 - DNA, 22 bp, Homo sapiens
ggctaaggaagaaggatcgtta

SEQ ID NO: 8792983 - DNA, 22 bp, Homo sapiens
ggctaaggacgggcaagtccca

SEQ ID NO: 8792984 - DNA, 22 bp, Homo sapiens
ggcgtggggccttctgcccgct

SEQ ID NO: 8792985 - DNA, 22 bp, Homo sapiens
ggctaaagatgtgttctttgga

SEQ ID NO: 8792986 - DNA, 22 bp, Homo sapiens
ggctaacagtggaagctgacca

SEQ ID NO: 8792987 - DNA, 22 bp, Homo sapiens
ggctacagcggggtggagacgg

SEQ ID NO: 8792988 - DNA, 22 bp, Homo sapiens
ggctaatatacccagctctgta

SEQ ID NO: 8792989 - DNA, 22 bp, Homo sapiens
ggcgtgggaagtggggcttctg

SEQ ID NO: 8792990 - DNA, 22 bp, Homo sapiens
ggcgtgggcgaggtgctctatc

SEQ ID NO: 8792991 - DNA, 22 bp, Homo sapiens
ggcggtggcgtgaaggtggctg

SEQ ID NO: 8792992 - DNA, 22 bp, Homo sapiens
ggcggtggcgtgaaggtggctg

SEQ ID NO: 8792993 - DNA, 22 bp, Homo sapiens
ggcggtggcgtgaaggtggctg

SEQ ID NO: 8792994 - DNA, 22 bp, Homo sapiens
ggcggtggttgagaggacggcg

SEQ ID NO: 8792995 - DNA, 22 bp, Homo sapiens
ggctccagggagtggagagaag

SEQ ID NO: 8792996 - DNA, 22 bp, Homo sapiens
ggctccatccaaggccttctag

SEQ ID NO: 8792997 - DNA, 22 bp, Homo sapiens
ggctaggcctcaggcctgcctg

SEQ ID NO: 8792998 - DNA, 22 bp, Homo sapiens
ggctaggcctcaggcctgcctg

SEQ ID NO: 8792999 - DNA, 22 bp, Homo sapiens
ggctccagggagtggagagaag

SEQ ID NO: 8793000 - DNA, 22 bp, Homo sapiens
ggctccagggagtggagagaag

SEQ ID NO: 8793001 - DNA, 22 bp, Homo sapiens
ggctccagggagtggagagaag

SEQ ID NO: 8793002 - DNA, 22 bp, Homo sapiens
ggctccctagggagagtgggag

SEQ ID NO: 8793003 - DNA, 22 bp, Homo sapiens
ggctccctagggagagtgggag

SEQ ID NO: 8793004 - DNA, 22 bp, Homo sapiens
ggctccccaggtccaggagctg

SEQ ID NO: 8793005 - DNA, 22 bp, Homo sapiens
ggctccctagggagagtgggag

SEQ ID NO: 8793006 - DNA, 22 bp, Homo sapiens
ggctccctcaccaccatcacat

SEQ ID NO: 8793007 - DNA, 22 bp, Homo sapiens
ggctccctgcaacctccgcctc

SEQ ID NO: 8793008 - DNA, 22 bp, Homo sapiens
ggctccctgcaacctccgcctc

SEQ ID NO: 8793009 - DNA, 17 bp, Homo sapiens
ggctccctgactatgga

SEQ ID NO: 8793010 - DNA, 22 bp, Homo sapiens
ggctccctggccctggggacac

SEQ ID NO: 8793011 - DNA, 22 bp, Homo sapiens
ggctccctggaaatcccgaggc

SEQ ID NO: 8793012 - DNA, 22 bp, Homo sapiens
ggctccctggccctggggacac

SEQ ID NO: 8793013 - DNA, 22 bp, Homo sapiens
ggctccctggaaatcccgaggc

SEQ ID NO: 8793014 - DNA, 22 bp, Homo sapiens
ggctccctgcctgtcctcagtc

SEQ ID NO: 8793015 - DNA, 22 bp, Homo sapiens
ggctccctgcctgtcctcagtc

SEQ ID NO: 8793016 - DNA, 22 bp, Homo sapiens
ggctccctgcctgtcctcagtc

SEQ ID NO: 8793017 - DNA, 22 bp, Homo sapiens
ggctctgtggctggccatgatg

SEQ ID NO: 8793018 - DNA, 23 bp, Homo sapiens
ggctctgtgctgggcctgcagga

SEQ ID NO: 8793019 - DNA, 23 bp, Homo sapiens
ggctctgtgctaattgctgaaaa

SEQ ID NO: 8793020 - DNA, 22 bp, Homo sapiens
ggctctggttgaccatgatggc

SEQ ID NO: 8793021 - DNA, 22 bp, Homo sapiens
ggctcttctacttcagatgggg

SEQ ID NO: 8793022 - DNA, 22 bp, Homo sapiens
ggctgagcactttaggcaggag

SEQ ID NO: 8793023 - DNA, 22 bp, Homo sapiens
ggctcttcacacagtgatgtca

SEQ ID NO: 8793024 - DNA, 22 bp, Homo sapiens
ggctgagccatgggcactgcag

SEQ ID NO: 8793025 - DNA, 22 bp, Homo sapiens
ggctgagccactgcgcctggct

SEQ ID NO: 8793026 - DNA, 22 bp, Homo sapiens
ggctctgggtctgtggggagcg

SEQ ID NO: 8793027 - DNA, 17 bp, Homo sapiens
ggctctgggtgtcacat

SEQ ID NO: 8793028 - DNA, 22 bp, Homo sapiens
ggctctgggtgtgaccttgggt

SEQ ID NO: 8793029 - DNA, 17 bp, Homo sapiens
ggctctgggtgtcacat

SEQ ID NO: 8793030 - DNA, 22 bp, Homo sapiens
ggctctggtgtgaagcagcctc

SEQ ID NO: 8793031 - DNA, 22 bp, Homo sapiens
ggctctggttgaccatgatggc

SEQ ID NO: 8793032 - DNA, 22 bp, Homo sapiens
ggctctggttgaccatgatggc

SEQ ID NO: 8793033 - DNA, 22 bp, Homo sapiens
ggctctggttgaccatgatggc

SEQ ID NO: 8793034 - DNA, 22 bp, Homo sapiens
ggctctggttgaccatgatggc

SEQ ID NO: 8793035 - DNA, 22 bp, Homo sapiens
ggctctgggttctgcaatgcgt

SEQ ID NO: 8793036 - DNA, 22 bp, Homo sapiens
ggctctggtgtgaagcagcctc

SEQ ID NO: 8793037 - DNA, 22 bp, Homo sapiens
ggctctggtgtgaagcagcctc

SEQ ID NO: 8793038 - DNA, 22 bp, Homo sapiens
ggctcctgataggagaatgcgg

SEQ ID NO: 8793039 - DNA, 22 bp, Homo sapiens
ggctcctgataggagaatgcgg

SEQ ID NO: 8793040 - DNA, 22 bp, Homo sapiens
ggctcctgaggaccaggcacag

SEQ ID NO: 8793041 - DNA, 22 bp, Homo sapiens
ggctcctgaggaccaggcacag

SEQ ID NO: 8793042 - DNA, 22 bp, Homo sapiens
ggctccctgggtgctcctgctc

SEQ ID NO: 8793043 - DNA, 22 bp, Homo sapiens
ggctccctgggtgctcctgctc

SEQ ID NO: 8793044 - DNA, 22 bp, Homo sapiens
ggctccctgttctattccctgg

SEQ ID NO: 8793045 - DNA, 22 bp, Homo sapiens
ggctccctgttctattccctgg

SEQ ID NO: 8793046 - DNA, 22 bp, Homo sapiens
ggctcctctctggccgctcccg

SEQ ID NO: 8793047 - DNA, 22 bp, Homo sapiens
ggctcctgagaatgggccatca

SEQ ID NO: 8793048 - DNA, 22 bp, Homo sapiens
ggctcctgagaatgggccatca

SEQ ID NO: 8793049 - DNA, 22 bp, Homo sapiens
ggctcctgaaagactatgggaa

SEQ ID NO: 8793050 - DNA, 22 bp, Homo sapiens
ggctctgggcctccaaggtctg

SEQ ID NO: 8793051 - DNA, 22 bp, Homo sapiens
ggctctgggcctccaaggtctg

SEQ ID NO: 8793052 - DNA, 22 bp, Homo sapiens
ggctctgggcctccaaggtctg

SEQ ID NO: 8793053 - DNA, 22 bp, Homo sapiens
ggctctggggaagctctcttca

SEQ ID NO: 8793054 - DNA, 22 bp, Homo sapiens
ggctctggggcctcctcccttg

SEQ ID NO: 8793055 - DNA, 22 bp, Homo sapiens
ggctctggggttggcccatctc

SEQ ID NO: 8793056 - DNA, 22 bp, Homo sapiens
ggctctggggcctcctcccttg

SEQ ID NO: 8793057 - DNA, 22 bp, Homo sapiens
ggctctggggggaagtctgttg

SEQ ID NO: 8793058 - DNA, 22 bp, Homo sapiens
ggctctggggggaagtctgttg

SEQ ID NO: 8793059 - DNA, 22 bp, Homo sapiens
ggctctggggggaagtctgttg

SEQ ID NO: 8793060 - DNA, 22 bp, Homo sapiens
ggctctgggtctgtggggagcg

SEQ ID NO: 8793061 - DNA, 22 bp, Homo sapiens
ggctctgggtctgtggggagcg

SEQ ID NO: 8793062 - DNA, 22 bp, Homo sapiens
ggctctgggtctgtggggagcg

SEQ ID NO: 8793063 - DNA, 22 bp, Homo sapiens
ggctctggggttggcccatctc

SEQ ID NO: 8793064 - DNA, 22 bp, Homo sapiens
ggctggactttctgctgggctc

SEQ ID NO: 8793065 - DNA, 22 bp, Homo sapiens
ggctggactttctgctgggctc

SEQ ID NO: 8793066 - DNA, 22 bp, Homo sapiens
ggctggacatgagcttggcagt

SEQ ID NO: 8793067 - DNA, 22 bp, Homo sapiens
ggctggacatgagcttggcagt

SEQ ID NO: 8793068 - DNA, 21 bp, Homo sapiens
ggctggacatcccaggagact

SEQ ID NO: 8793069 - DNA, 22 bp, Homo sapiens
ggctggagaagggtggttgaca

SEQ ID NO: 8793070 - DNA, 19 bp, Homo sapiens
ggctggagaaaggaatcag

SEQ ID NO: 8793071 - DNA, 19 bp, Homo sapiens
ggctggagaaaggaatcag

SEQ ID NO: 8793072 - DNA, 19 bp, Homo sapiens
ggctggagaaaggaatcag

SEQ ID NO: 8793073 - DNA, 19 bp, Homo sapiens
ggctggagaaaggaatcag

SEQ ID NO: 8793074 - DNA, 19 bp, Homo sapiens
ggctggagaaaggaatcag

SEQ ID NO: 8793075 - DNA, 22 bp, Homo sapiens
ggctgggtacagggcagtgtgc

SEQ ID NO: 8793076 - DNA, 22 bp, Homo sapiens
ggctgggtacagggcagtgtgc

SEQ ID NO: 8793077 - DNA, 22 bp, Homo sapiens
ggctgggctgctgggtcagagc

SEQ ID NO: 8793078 - DNA, 22 bp, Homo sapiens
ggctggagaagggtggttgaca

SEQ ID NO: 8793079 - DNA, 22 bp, Homo sapiens
ggctggagacaacgtcctgccc

SEQ ID NO: 8793080 - DNA, 19 bp, Homo sapiens
ggctgggtctggcaggttc

SEQ ID NO: 8793081 - DNA, 19 bp, Homo sapiens
ggctgggtctggcaggttc

SEQ ID NO: 8793082 - DNA, 22 bp, Homo sapiens
ggctgggtcccagctgggagga

SEQ ID NO: 8793083 - DNA, 22 bp, Homo sapiens
ggctgggtcccagctgggagga

SEQ ID NO: 8793084 - DNA, 22 bp, Homo sapiens
ggctgtgacccccacaggggtg

SEQ ID NO: 8793085 - DNA, 21 bp, Homo sapiens
ggctgtgacgctgctccacag

SEQ ID NO: 8793086 - DNA, 22 bp, Homo sapiens
ggctgtgattggtggatgtgaa

SEQ ID NO: 8793087 - DNA, 22 bp, Homo sapiens
ggctgtgagcaggcagaatgct

SEQ ID NO: 8793088 - DNA, 17 bp, Homo sapiens
ggctgtgccaggtgaga

SEQ ID NO: 8793089 - DNA, 17 bp, Homo sapiens
ggctgtgccaggtgaga

SEQ ID NO: 8793090 - DNA, 20 bp, Homo sapiens
ggctgtgcccttccgtggcc

SEQ ID NO: 8793091 - DNA, 22 bp, Homo sapiens
ggctgtgcagggcagagtctca

SEQ ID NO: 8793092 - DNA, 22 bp, Homo sapiens
ggctgtgcaccatccacctccc

SEQ ID NO: 8793093 - DNA, 22 bp, Homo sapiens
ggctgggttctgagaaagagta

SEQ ID NO: 8793094 - DNA, 22 bp, Homo sapiens
ggctgggttctgagaaagagta

SEQ ID NO: 8793095 - DNA, 22 bp, Homo sapiens
ggctggtcacaccactgcaggg

SEQ ID NO: 8793096 - DNA, 22 bp, Homo sapiens
ggctggtcacaccactgcaggg

SEQ ID NO: 8793097 - DNA, 22 bp, Homo sapiens
ggctggtcaggaaactaggctc

SEQ ID NO: 8793098 - DNA, 22 bp, Homo sapiens
ggctggtcctttctctgtccta

SEQ ID NO: 8793099 - DNA, 22 bp, Homo sapiens
ggctggtcctttctctgtccta

SEQ ID NO: 8793100 - DNA, 22 bp, Homo sapiens
ggctggtggggaaagaggacca

SEQ ID NO: 8793101 - DNA, 23 bp, Homo sapiens
ggctggtgcccttggccagtcgg

SEQ ID NO: 8793102 - DNA, 23 bp, Homo sapiens
ggctggtgcccttggccagtcgg

SEQ ID NO: 8793103 - DNA, 23 bp, Homo sapiens
ggctggtgcccttggccagtcgg

SEQ ID NO: 8793104 - DNA, 21 bp, Homo sapiens
ggctggtcgcgtgcatgtctc

SEQ ID NO: 8793105 - DNA, 22 bp, Homo sapiens
ggctggtgagttcagagaaccc

SEQ ID NO: 8793106 - DNA, 21 bp, Homo sapiens
ggctggacatcccaggagact

SEQ ID NO: 8793107 - DNA, 22 bp, Homo sapiens
ggctgcttgtcagcagctggcc

SEQ ID NO: 8793108 - DNA, 22 bp, Homo sapiens
ggctgctttatcggctgctgaa

SEQ ID NO: 8793109 - DNA, 22 bp, Homo sapiens
ggctgcttggacaccttaaatc

SEQ ID NO: 8793110 - DNA, 22 bp, Homo sapiens
ggctgcttgctgtttcttggat

SEQ ID NO: 8793111 - DNA, 20 bp, Homo sapiens
ggctgctttatagggcccct

SEQ ID NO: 8793112 - DNA, 22 bp, Homo sapiens
ggctgctttatcggctgctgaa

SEQ ID NO: 8793113 - DNA, 22 bp, Homo sapiens
ggctgctttggctggggcccta

SEQ ID NO: 8793114 - DNA, 22 bp, Homo sapiens
ggctgctttgggatggtccgga

SEQ ID NO: 8793115 - DNA, 22 bp, Homo sapiens
ggctgcttttcttgtatctact

SEQ ID NO: 8793116 - DNA, 22 bp, Homo sapiens
ggctgctttgtagcttttgcca

SEQ ID NO: 8793117 - DNA, 22 bp, Homo sapiens
ggctgcttttgctgtaagccag

SEQ ID NO: 8793118 - DNA, 22 bp, Homo sapiens
ggctggaaaagacaaagctatt

SEQ ID NO: 8793119 - DNA, 22 bp, Homo sapiens
ggctggaaaggatattttaggt

SEQ ID NO: 8793120 - DNA, 22 bp, Homo sapiens
ggctggaaccagagtgaggcag

SEQ ID NO: 8793121 - DNA, 22 bp, Homo sapiens
ggctggaaggccctttgttgat

SEQ ID NO: 8793122 - DNA, 22 bp, Homo sapiens
ggctggaagagactgaggacac

SEQ ID NO: 8793123 - DNA, 18 bp, Homo sapiens
ggctggaagctgttgctg

SEQ ID NO: 8793124 - DNA, 20 bp, Homo sapiens
ggctgctgtgggcagagagg

SEQ ID NO: 8793125 - DNA, 22 bp, Homo sapiens
ggctgctgtttcagagactgtt

SEQ ID NO: 8793126 - DNA, 22 bp, Homo sapiens
ggctgctgtttcagagactgtt

SEQ ID NO: 8793127 - DNA, 22 bp, Homo sapiens
ggctgcttaaacagatgtgctg

SEQ ID NO: 8793128 - DNA, 14 bp, Homo sapiens
ggctgcttcccttt

SEQ ID NO: 8793129 - DNA, 22 bp, Homo sapiens
ggctgcttcacttttttgagcc

SEQ ID NO: 8793130 - DNA, 19 bp, Homo sapiens
ggctgcttccaccaatatg

SEQ ID NO: 8793131 - DNA, 18 bp, Homo sapiens
ggctgcttaaggagatcc

SEQ ID NO: 8793132 - DNA, 22 bp, Homo sapiens
ggctgcttctgatttctaatgt

SEQ ID NO: 8793133 - DNA, 22 bp, Homo sapiens
ggctgcttgctgtttcttggat

SEQ ID NO: 8793134 - DNA, 22 bp, Homo sapiens
ggctgcttctcactcatttgca

SEQ ID NO: 8793135 - DNA, 22 bp, Homo sapiens
ggctgcttgatggaaggggacg

SEQ ID NO: 8793136 - DNA, 22 bp, Homo sapiens
ggctgctggggacgtgggagag

SEQ ID NO: 8793137 - DNA, 22 bp, Homo sapiens
ggctgctggggacgtgggagag

SEQ ID NO: 8793138 - DNA, 22 bp, Homo sapiens
ggctgagttctcttgctgaatc

SEQ ID NO: 8793139 - DNA, 22 bp, Homo sapiens
ggctgagttctcttgctgaatc

SEQ ID NO: 8793140 - DNA, 22 bp, Homo sapiens
ggctgctggggacgtgggagag

SEQ ID NO: 8793141 - DNA, 22 bp, Homo sapiens
ggctgagttctcttgctgaatc

SEQ ID NO: 8793142 - DNA, 22 bp, Homo sapiens
ggctgctggggacgtgggagag

SEQ ID NO: 8793143 - DNA, 21 bp, Homo sapiens
ggctgctgggggttggcacag

SEQ ID NO: 8793144 - DNA, 22 bp, Homo sapiens
ggctgctgggtcatgatgcaga

SEQ ID NO: 8793145 - DNA, 22 bp, Homo sapiens
ggctgctgggtcatgatgcaga

SEQ ID NO: 8793146 - DNA, 22 bp, Homo sapiens
ggctgagtggaggtagccctgt

SEQ ID NO: 8793147 - DNA, 22 bp, Homo sapiens
ggctgagtctgtgacccatgcg

SEQ ID NO: 8793148 - DNA, 18 bp, Homo sapiens
ggctgaggttgactagaa

SEQ ID NO: 8793149 - DNA, 22 bp, Homo sapiens
ggctgagtggctgggtctagtt

SEQ ID NO: 8793150 - DNA, 18 bp, Homo sapiens
ggctgaggttgactagaa

SEQ ID NO: 8793151 - DNA, 18 bp, Homo sapiens
ggctgaggttgactagaa

SEQ ID NO: 8793152 - DNA, 18 bp, Homo sapiens
ggctgaggttgactagaa

SEQ ID NO: 8793153 - DNA, 22 bp, Homo sapiens
ggctgagggttaagatcagaca

SEQ ID NO: 8793154 - DNA, 22 bp, Homo sapiens
ggctgagggttaagatcagaca

SEQ ID NO: 8793155 - DNA, 22 bp, Homo sapiens
ggctgagggttaagatcagaca

SEQ ID NO: 8793156 - DNA, 22 bp, Homo sapiens
ggctgagggttaagatcagaca

SEQ ID NO: 8793157 - DNA, 18 bp, Homo sapiens
ggctgaggttgactagaa

SEQ ID NO: 8793158 - DNA, 22 bp, Homo sapiens
ggctgaggtgtggggaactata

SEQ ID NO: 8793159 - DNA, 22 bp, Homo sapiens
ggctgagggttaagatcagaca

SEQ ID NO: 8793160 - DNA, 22 bp, Homo sapiens
ggctgagggccagggctagtct

SEQ ID NO: 8793161 - DNA, 22 bp, Homo sapiens
ggctgagggccagggctagtct

SEQ ID NO: 8793162 - DNA, 22 bp, Homo sapiens
ggctgagggccagggctagtct

SEQ ID NO: 8793163 - DNA, 22 bp, Homo sapiens
ggctgagggccagggctagtct

SEQ ID NO: 8793164 - DNA, 22 bp, Homo sapiens
ggctgaggggcccagaggaaca

SEQ ID NO: 8793165 - DNA, 22 bp, Homo sapiens
ggctgaggggcccagaggaaca

SEQ ID NO: 8793166 - DNA, 22 bp, Homo sapiens
ggctgaggggcccagaggaaca

SEQ ID NO: 8793167 - DNA, 22 bp, Homo sapiens
ggctgagggtatagctgtccca

SEQ ID NO: 8793168 - DNA, 22 bp, Homo sapiens
ggctgaggggcccagaggaaca

SEQ ID NO: 8793169 - DNA, 22 bp, Homo sapiens
ggctgagggtcccagaccctaa

SEQ ID NO: 8793170 - DNA, 22 bp, Homo sapiens
ggctgagggtcccagaccctaa

SEQ ID NO: 8793171 - DNA, 22 bp, Homo sapiens
ggctgagggtcccagaccctaa

SEQ ID NO: 8793172 - DNA, 22 bp, Homo sapiens
ggctgagggtatagctgtccca

SEQ ID NO: 8793173 - DNA, 22 bp, Homo sapiens
ggctgagggtatagctgtccca

SEQ ID NO: 8793174 - DNA, 22 bp, Homo sapiens
ggctgagggtatagctgtccca

SEQ ID NO: 8793175 - DNA, 22 bp, Homo sapiens
ggctgagggtatagctgtccca

SEQ ID NO: 8793176 - DNA, 22 bp, Homo sapiens
ggcctagggagtggccatgcct

SEQ ID NO: 8793177 - DNA, 22 bp, Homo sapiens
ggcctagggagtggccatgcct

SEQ ID NO: 8793178 - DNA, 22 bp, Homo sapiens
ggcctagcctctcctgagagag

SEQ ID NO: 8793179 - DNA, 21 bp, Homo sapiens
ggccctggttacgcctcctct

SEQ ID NO: 8793180 - DNA, 22 bp, Homo sapiens
ggcctacgccagtatccccagg

SEQ ID NO: 8793181 - DNA, 21 bp, Homo sapiens
ggccctggttacgcctcctct

SEQ ID NO: 8793182 - DNA, 22 bp, Homo sapiens
ggcctacgccagtatccccagg

SEQ ID NO: 8793183 - DNA, 22 bp, Homo sapiens
ggcctaagtggttaaatggctt

SEQ ID NO: 8793184 - DNA, 22 bp, Homo sapiens
ggccgtgctccaaagtcatcgt

SEQ ID NO: 8793185 - DNA, 22 bp, Homo sapiens
ggcctagttttttctggtaggt

SEQ ID NO: 8793186 - DNA, 22 bp, Homo sapiens
ggcctcacccatcggtgccttt

SEQ ID NO: 8793187 - DNA, 22 bp, Homo sapiens
ggcctcactgtgcatcccttgg

SEQ ID NO: 8793188 - DNA, 22 bp, Homo sapiens
ggcctagggcttggtcatggca

SEQ ID NO: 8793189 - DNA, 22 bp, Homo sapiens
ggcctatgttcctgggctaggg

SEQ ID NO: 8793190 - DNA, 22 bp, Homo sapiens
ggcctagggagtggccatgcct

SEQ ID NO: 8793191 - DNA, 22 bp, Homo sapiens
ggcctagggcttggtcatggca

SEQ ID NO: 8793192 - DNA, 21 bp, Homo sapiens
ggcctaggggcagatggtgct

SEQ ID NO: 8793193 - DNA, 22 bp, Homo sapiens
ggccctgggacacaacaccgaa

SEQ ID NO: 8793194 - DNA, 22 bp, Homo sapiens
ggccctgggatgctcagcagtg

SEQ ID NO: 8793195 - DNA, 22 bp, Homo sapiens
ggccctgggcagaggagtgggc

SEQ ID NO: 8793196 - DNA, 22 bp, Homo sapiens
ggccctgggatgctcagcagtg

SEQ ID NO: 8793197 - DNA, 22 bp, Homo sapiens
ggccctgggccctctagcttgt

SEQ ID NO: 8793198 - DNA, 22 bp, Homo sapiens
ggccctgggccctctagcttgt

SEQ ID NO: 8793199 - DNA, 22 bp, Homo sapiens
ggccctgggcagaggagtgggc

SEQ ID NO: 8793200 - DNA, 22 bp, Homo sapiens
ggccctgggcagaggagtgggc

SEQ ID NO: 8793201 - DNA, 22 bp, Homo sapiens
ggccctgggccctctagcttgt

SEQ ID NO: 8793202 - DNA, 22 bp, Homo sapiens
ggccctgggccctctagcttgt

SEQ ID NO: 8793203 - DNA, 22 bp, Homo sapiens
ggccctgggccctctagcttgt

SEQ ID NO: 8793204 - DNA, 21 bp, Homo sapiens
ggccctggttacgcctcctct

SEQ ID NO: 8793205 - DNA, 21 bp, Homo sapiens
ggccctggttacgcctcctct

SEQ ID NO: 8793206 - DNA, 22 bp, Homo sapiens
ggccctggtcctaggggtggaa

SEQ ID NO: 8793207 - DNA, 22 bp, Homo sapiens
ggccaggccaagagggttggaa

SEQ ID NO: 8793208 - DNA, 22 bp, Homo sapiens
ggccaggcactgtgtgagatat

SEQ ID NO: 8793209 - DNA, 22 bp, Homo sapiens
ggccaggccaagagggttggaa

SEQ ID NO: 8793210 - DNA, 22 bp, Homo sapiens
ggccaggcactgtgtgagatat

SEQ ID NO: 8793211 - DNA, 22 bp, Homo sapiens
ggccaggcactgtgtgagatat

SEQ ID NO: 8793212 - DNA, 22 bp, Homo sapiens
ggccaggatctgtttgtccacc

SEQ ID NO: 8793213 - DNA, 22 bp, Homo sapiens
ggccaggaggcaggggctcaat

SEQ ID NO: 8793214 - DNA, 22 bp, Homo sapiens
ggccaggccaagagggttggaa

SEQ ID NO: 8793215 - DNA, 22 bp, Homo sapiens
ggccctgctcaggctgcgatga

SEQ ID NO: 8793216 - DNA, 22 bp, Homo sapiens
ggccaggcgatgacccctccac

SEQ ID NO: 8793217 - DNA, 22 bp, Homo sapiens
ggccaggcgatgacccctccac

SEQ ID NO: 8793218 - DNA, 22 bp, Homo sapiens
ggccctgctgagtggagtggag

SEQ ID NO: 8793219 - DNA, 22 bp, Homo sapiens
ggccctggcagccacgaaagcc

SEQ ID NO: 8793220 - DNA, 22 bp, Homo sapiens
ggccctggcagccacgaaagcc

SEQ ID NO: 8793221 - DNA, 22 bp, Homo sapiens
ggccctggcagccacgaaagcc

SEQ ID NO: 8793222 - DNA, 22 bp, Homo sapiens
ggccaggaagggaagatcagca

SEQ ID NO: 8793223 - DNA, 22 bp, Homo sapiens
ggccaggagcaagccaggctct

SEQ ID NO: 8793224 - DNA, 22 bp, Homo sapiens
ggccaggagatggacaccacat

SEQ ID NO: 8793225 - DNA, 22 bp, Homo sapiens
ggccaggagctgcacagggctc

SEQ ID NO: 8793226 - DNA, 22 bp, Homo sapiens
ggccaggagctgcacagggctc

SEQ ID NO: 8793227 - DNA, 22 bp, Homo sapiens
ggccaggagctgcacagggctc

SEQ ID NO: 8793228 - DNA, 22 bp, Homo sapiens
ggccaggaggcaggggctcaat

SEQ ID NO: 8793229 - DNA, 22 bp, Homo sapiens
ggccaggaggcaggggctcaat

SEQ ID NO: 8793230 - DNA, 19 bp, Homo sapiens
ggcgggtggactggagccc

SEQ ID NO: 8793231 - DNA, 22 bp, Homo sapiens
ggcgggtggcgaggcttctcgg

SEQ ID NO: 8793232 - DNA, 22 bp, Homo sapiens
ggcctggctcttgcccagcctg

SEQ ID NO: 8793233 - DNA, 22 bp, Homo sapiens
ggcgggtgtaagtaggacagcg

SEQ ID NO: 8793234 - DNA, 22 bp, Homo sapiens
ggcggtctcagcaccctcttgg

SEQ ID NO: 8793235 - DNA, 22 bp, Homo sapiens
ggcgggtgcacagacccttccc

SEQ ID NO: 8793236 - DNA, 22 bp, Homo sapiens
ggcggggtctgagcgccgcgcc

SEQ ID NO: 8793237 - DNA, 22 bp, Homo sapiens
ggcctggctcttgcccagcctg

SEQ ID NO: 8793238 - DNA, 22 bp, Homo sapiens
ggcctggctcttgcccagcctg

SEQ ID NO: 8793239 - DNA, 19 bp, Homo sapiens
ggcctggctatccctgctg

SEQ ID NO: 8793240 - DNA, 19 bp, Homo sapiens
ggcctggctatccctgctg

SEQ ID NO: 8793241 - DNA, 19 bp, Homo sapiens
ggcctggctatccctgctg

SEQ ID NO: 8793242 - DNA, 22 bp, Homo sapiens
ggcctggcctcccttcctagcg

SEQ ID NO: 8793243 - DNA, 22 bp, Homo sapiens
ggcctggcctcccttcctagcg

SEQ ID NO: 8793244 - DNA, 19 bp, Homo sapiens
ggcctggctatccctgctg

SEQ ID NO: 8793245 - DNA, 19 bp, Homo sapiens
ggcctggctatccctgctg

SEQ ID NO: 8793246 - DNA, 22 bp, Homo sapiens
ggcctggagtcagggaaagcaa

SEQ ID NO: 8793247 - DNA, 22 bp, Homo sapiens
ggcctggagaaggcccagggag

SEQ ID NO: 8793248 - DNA, 22 bp, Homo sapiens
ggcctggagcagagactaggga

SEQ ID NO: 8793249 - DNA, 22 bp, Homo sapiens
ggcctggagcagagactaggga

SEQ ID NO: 8793250 - DNA, 22 bp, Homo sapiens
ggcctggcagagcgcgcggctg

SEQ ID NO: 8793251 - DNA, 22 bp, Homo sapiens
ggcctggcatggggactaaggg

SEQ ID NO: 8793252 - DNA, 22 bp, Homo sapiens
ggcctggcatggggactaaggg

SEQ ID NO: 8793253 - DNA, 23 bp, Homo sapiens
ggcctggcccagggccctgatga

SEQ ID NO: 8793254 - DNA, 22 bp, Homo sapiens
ggcctggcagagcgcgcggctg

SEQ ID NO: 8793255 - DNA, 19 bp, Homo sapiens
ggcctggatttagggctcc

SEQ ID NO: 8793256 - DNA, 22 bp, Homo sapiens
ggcctggcctccagatgtgggc

SEQ ID NO: 8793257 - DNA, 22 bp, Homo sapiens
ggcctggccctcccgggttcaa

SEQ ID NO: 8793258 - DNA, 22 bp, Homo sapiens
ggcctggcctccagatgtgggc

SEQ ID NO: 8793259 - DNA, 22 bp, Homo sapiens
ggcctggcctccagatgtgggc

SEQ ID NO: 8793260 - DNA, 22 bp, Homo sapiens
ggcctggcctccagatgtgggc

SEQ ID NO: 8793261 - DNA, 23 bp, Homo sapiens
ggcctggcccagggccctgatga

SEQ ID NO: 8793262 - DNA, 22 bp, Homo sapiens
ggcctggccctcccgggttcaa

SEQ ID NO: 8793263 - DNA, 19 bp, Homo sapiens
ggcctgcccaatgtctgct

SEQ ID NO: 8793264 - DNA, 19 bp, Homo sapiens
ggcctgcccaatgtctgct

SEQ ID NO: 8793265 - DNA, 22 bp, Homo sapiens
ggcctgcctcacagtcagcacc

SEQ ID NO: 8793266 - DNA, 22 bp, Homo sapiens
ggcctgcctcacagtcagcacc

SEQ ID NO: 8793267 - DNA, 22 bp, Homo sapiens
ggcctgcctcacagtcagcacc

SEQ ID NO: 8793268 - DNA, 22 bp, Homo sapiens
ggcctgctccgggggctgagct

SEQ ID NO: 8793269 - DNA, 22 bp, Homo sapiens
ggcctgctattggtgggcagac

SEQ ID NO: 8793270 - DNA, 22 bp, Homo sapiens
ggcctgcctcacagtcagcacc

SEQ ID NO: 8793271 - DNA, 22 bp, Homo sapiens
ggcctgctctgcagcctctaca

SEQ ID NO: 8793272 - DNA, 22 bp, Homo sapiens
ggcctgctctgcagcctctaca

SEQ ID NO: 8793273 - DNA, 22 bp, Homo sapiens
ggcctgctgacccaagtcctgt

SEQ ID NO: 8793274 - DNA, 22 bp, Homo sapiens
ggcctggacacctgaggtctta

SEQ ID NO: 8793275 - DNA, 22 bp, Homo sapiens
ggcctggaaggacagcgtgatg

SEQ ID NO: 8793276 - DNA, 22 bp, Homo sapiens
ggcctggaagaggacagagaaa

SEQ ID NO: 8793277 - DNA, 22 bp, Homo sapiens
ggcctgctttccgagcctgcag

SEQ ID NO: 8793278 - DNA, 22 bp, Homo sapiens
ggcctgctttccgagcctgcag

SEQ ID NO: 8793279 - DNA, 22 bp, Homo sapiens
ggcctgctttacaggatcaact

SEQ ID NO: 8793280 - DNA, 22 bp, Homo sapiens
ggcctgctggctccagcgcccg

SEQ ID NO: 8793281 - DNA, 22 bp, Homo sapiens
ggcctgctggctccagcgcccg

SEQ ID NO: 8793282 - DNA, 22 bp, Homo sapiens
ggcctgctggggcctcagacac

SEQ ID NO: 8793283 - DNA, 22 bp, Homo sapiens
ggcatcgtcctgggcataggga

SEQ ID NO: 8793284 - DNA, 22 bp, Homo sapiens
ggcatcgtcctgggcataggga

SEQ ID NO: 8793285 - DNA, 22 bp, Homo sapiens
ggcatctccaaaacatgaactc

SEQ ID NO: 8793286 - DNA, 22 bp, Homo sapiens
ggcatctcgcattcttgtttct

SEQ ID NO: 8793287 - DNA, 22 bp, Homo sapiens
ggcatcctccatataggtgaat

SEQ ID NO: 8793288 - DNA, 22 bp, Homo sapiens
ggcatcagtatggccatagggt

SEQ ID NO: 8793289 - DNA, 22 bp, Homo sapiens
ggcatcagtatggccatagggt

SEQ ID NO: 8793290 - DNA, 22 bp, Homo sapiens
ggcatccaaataccaagatgta

SEQ ID NO: 8793291 - DNA, 22 bp, Homo sapiens
ggcagtggtgggaggctcgctc

SEQ ID NO: 8793292 - DNA, 22 bp, Homo sapiens
ggcatcagggtaggaaggtatc

SEQ ID NO: 8793293 - DNA, 22 bp, Homo sapiens
ggcagtggtgggaggctcgctc

SEQ ID NO: 8793294 - DNA, 22 bp, Homo sapiens
ggcagtggtgggaggctcgctc

SEQ ID NO: 8793295 - DNA, 22 bp, Homo sapiens
ggcatgagaggtcctggggatt

SEQ ID NO: 8793296 - DNA, 22 bp, Homo sapiens
ggcatgagaggtcctggggatt

SEQ ID NO: 8793297 - DNA, 22 bp, Homo sapiens
ggcatcttgttgctcaaatcta

SEQ ID NO: 8793298 - DNA, 22 bp, Homo sapiens
ggcatcttgttgctcaaatcta

SEQ ID NO: 8793299 - DNA, 22 bp, Homo sapiens
ggcatcttcaaaattgccaaat

SEQ ID NO: 8793300 - DNA, 21 bp, Homo sapiens
ggcatgagggcagtgagcaga

SEQ ID NO: 8793301 - DNA, 21 bp, Homo sapiens
ggcatgagggcagtgagcaga

SEQ ID NO: 8793302 - DNA, 22 bp, Homo sapiens
ggcatgagtaacgtgagtgagg

SEQ ID NO: 8793303 - DNA, 20 bp, Homo sapiens
ggcatgagatgtgagggagg

SEQ ID NO: 8793304 - DNA, 20 bp, Homo sapiens
ggcatgagatgtgagggagg

SEQ ID NO: 8793305 - DNA, 19 bp, Homo sapiens
ggccagctgtctcctgcta

SEQ ID NO: 8793306 - DNA, 22 bp, Homo sapiens
ggccagcttattagctcagagg

SEQ ID NO: 8793307 - DNA, 22 bp, Homo sapiens
ggccagcttattagctcagagg

SEQ ID NO: 8793308 - DNA, 22 bp, Homo sapiens
ggccagcttctggacaaagtcc

SEQ ID NO: 8793309 - DNA, 22 bp, Homo sapiens
ggccagcttctctgctgcctgt

SEQ ID NO: 8793310 - DNA, 22 bp, Homo sapiens
ggccagcttctctgctgcctgt

SEQ ID NO: 8793311 - DNA, 22 bp, Homo sapiens
ggccagctttctgtcttctagg

SEQ ID NO: 8793312 - DNA, 22 bp, Homo sapiens
ggccagctttctgtcttctagg

SEQ ID NO: 8793313 - DNA, 22 bp, Homo sapiens
ggccagctttgagctgcaggaa

SEQ ID NO: 8793314 - DNA, 22 bp, Homo sapiens
ggccagctttgagctgcaggaa

SEQ ID NO: 8793315 - DNA, 22 bp, Homo sapiens
ggccagctttgagctgcaggaa

SEQ ID NO: 8793316 - DNA, 22 bp, Homo sapiens
ggccagctttgagctgcaggaa

SEQ ID NO: 8793317 - DNA, 22 bp, Homo sapiens
ggccaggaacttttgggatggg

SEQ ID NO: 8793318 - DNA, 22 bp, Homo sapiens
ggccaggaacttttgggatggg

SEQ ID NO: 8793319 - DNA, 22 bp, Homo sapiens
ggccaggaagggaagatcagca

SEQ ID NO: 8793320 - DNA, 22 bp, Homo sapiens
ggccaggaagggaagatcagca

SEQ ID NO: 8793321 - DNA, 22 bp, Homo sapiens
ggcatgcatcaccacgccacgc

SEQ ID NO: 8793322 - DNA, 22 bp, Homo sapiens
ggcatgagtggcagtgggcagt

SEQ ID NO: 8793323 - DNA, 22 bp, Homo sapiens
ggcatgagtggcagtgggcagt

SEQ ID NO: 8793324 - DNA, 22 bp, Homo sapiens
ggcatgagtggcagtgggcagt

SEQ ID NO: 8793325 - DNA, 22 bp, Homo sapiens
ggcatgctctttgtccacagta

SEQ ID NO: 8793326 - DNA, 22 bp, Homo sapiens
ggccagctgtaagctgctgaat

SEQ ID NO: 8793327 - DNA, 19 bp, Homo sapiens
ggccagctgtctcctgcta

SEQ ID NO: 8793328 - DNA, 22 bp, Homo sapiens
ggccagctgtaagctgctgaat

SEQ ID NO: 8793329 - DNA, 22 bp, Homo sapiens
ggcatgcttgccatgggccagt

SEQ ID NO: 8793330 - DNA, 22 bp, Homo sapiens
ggccagctgggccaccaggtgc

SEQ ID NO: 8793331 - DNA, 17 bp, Homo sapiens
ggcaggtgacagacacc

SEQ ID NO: 8793332 - DNA, 22 bp, Homo sapiens
ggcaggtagcctagaggaggtt

SEQ ID NO: 8793333 - DNA, 22 bp, Homo sapiens
ggcaggtcatcaactgtaattt

SEQ ID NO: 8793334 - DNA, 22 bp, Homo sapiens
ggcaggtgacctggcctcccag

SEQ ID NO: 8793335 - DNA, 17 bp, Homo sapiens
ggcaggtgacagacacc

SEQ ID NO: 8793336 - DNA, 22 bp, Homo sapiens
ggcaggtgacctggcctcccag

SEQ ID NO: 8793337 - DNA, 22 bp, Homo sapiens
ggcaggtgacggggatgagtat

SEQ ID NO: 8793338 - DNA, 22 bp, Homo sapiens
ggcaggtgacctggcctcccag

SEQ ID NO: 8793339 - DNA, 22 bp, Homo sapiens
ggcaggtgacctggcctcccag

SEQ ID NO: 8793340 - DNA, 22 bp, Homo sapiens
ggcaggtgacggggatgagtat

SEQ ID NO: 8793341 - DNA, 22 bp, Homo sapiens
ggcaggtgacggggatgagtat

SEQ ID NO: 8793342 - DNA, 22 bp, Homo sapiens
ggcagtgggttccccaaggcac

SEQ ID NO: 8793343 - DNA, 22 bp, Homo sapiens
ggcagtgggttccccaaggcac

SEQ ID NO: 8793344 - DNA, 22 bp, Homo sapiens
ggcagtgggttccccaaggcac

SEQ ID NO: 8793345 - DNA, 22 bp, Homo sapiens
ggcaggtgagagctctttgaaa

SEQ ID NO: 8793346 - DNA, 22 bp, Homo sapiens
ggcagtgggttccccaaggcac

SEQ ID NO: 8793347 - DNA, 22 bp, Homo sapiens
ggcaggtgaggcatgtgcctgg

SEQ ID NO: 8793348 - DNA, 22 bp, Homo sapiens
ggcaggtgagagctctttgaaa

SEQ ID NO: 8793349 - DNA, 22 bp, Homo sapiens
ggcagtgggtggatctcaggga

SEQ ID NO: 8793350 - DNA, 22 bp, Homo sapiens
ggcagtgggtggatctcaggga

SEQ ID NO: 8793351 - DNA, 22 bp, Homo sapiens
ggcagggtggcagaggctcaga

SEQ ID NO: 8793352 - DNA, 22 bp, Homo sapiens
ggcagggtgcctggctcctgtt

SEQ ID NO: 8793353 - DNA, 22 bp, Homo sapiens
ggcaggtacagcaagaggacaa

SEQ ID NO: 8793354 - DNA, 22 bp, Homo sapiens
ggcagggtttctccattctgcc

SEQ ID NO: 8793355 - DNA, 22 bp, Homo sapiens
ggcaggtacagcaagaggacaa

SEQ ID NO: 8793356 - DNA, 22 bp, Homo sapiens
ggcaggtagcctagaggaggtt

SEQ ID NO: 8793357 - DNA, 22 bp, Homo sapiens
ggcagggtaaaccgaggtaagt

SEQ ID NO: 8793358 - DNA, 22 bp, Homo sapiens
ggcaggggttcattttgtctta

SEQ ID NO: 8793359 - DNA, 22 bp, Homo sapiens
ggcagggtaaaccgaggtaagt

SEQ ID NO: 8793360 - DNA, 22 bp, Homo sapiens
ggcaggggtggccttcctttgg

SEQ ID NO: 8793361 - DNA, 22 bp, Homo sapiens
ggcaggggtgaggccactctga

SEQ ID NO: 8793362 - DNA, 22 bp, Homo sapiens
ggcaggggtgaggccactctga

SEQ ID NO: 8793363 - DNA, 22 bp, Homo sapiens
ggcaggagataaaatattagtt

SEQ ID NO: 8793364 - DNA, 22 bp, Homo sapiens
ggcaggagaatggcgtgaactc

SEQ ID NO: 8793365 - DNA, 18 bp, Homo sapiens
ggcaggagcaagaatagg

SEQ ID NO: 8793366 - DNA, 22 bp, Homo sapiens
ggcaggagctcaggttggttcc

SEQ ID NO: 8793367 - DNA, 22 bp, Homo sapiens
ggcaggagctcaggttggttcc

SEQ ID NO: 8793368 - DNA, 22 bp, Homo sapiens
ggcaggaggaagagttagcacc

SEQ ID NO: 8793369 - DNA, 22 bp, Homo sapiens
ggcaggagctctccagtttgcc

SEQ ID NO: 8793370 - DNA, 18 bp, Homo sapiens
ggcaggggtgaaccacag

SEQ ID NO: 8793371 - DNA, 22 bp, Homo sapiens
ggcaggagctctccagtttgcc

SEQ ID NO: 8793372 - DNA, 22 bp, Homo sapiens
ggcaggagctcaggttggttcc

SEQ ID NO: 8793373 - DNA, 22 bp, Homo sapiens
ggcaggagctctccagtttgcc

SEQ ID NO: 8793374 - DNA, 19 bp, Homo sapiens
ggcagaaggtgtaggggga

SEQ ID NO: 8793375 - DNA, 22 bp, Homo sapiens
ggcagaaggcaattagagactg

SEQ ID NO: 8793376 - DNA, 22 bp, Homo sapiens
ggcagaaggcaattagagactg

SEQ ID NO: 8793377 - DNA, 22 bp, Homo sapiens
ggcagaaggcctcccagctcct

SEQ ID NO: 8793378 - DNA, 22 bp, Homo sapiens
ggcagaagataggacagggaat

SEQ ID NO: 8793379 - DNA, 22 bp, Homo sapiens
ggcagaaggcaattagagactg

SEQ ID NO: 8793380 - DNA, 22 bp, Homo sapiens
ggcagaagataggacagggaat

SEQ ID NO: 8793381 - DNA, 22 bp, Homo sapiens
ggcagaagataggacagggaat

SEQ ID NO: 8793382 - DNA, 22 bp, Homo sapiens
ggcagaagacaggcaaatcatg

SEQ ID NO: 8793383 - DNA, 22 bp, Homo sapiens
ggcagcagacccctaagtctac

SEQ ID NO: 8793384 - DNA, 22 bp, Homo sapiens
ggcagcagacccctaagtctac

SEQ ID NO: 8793385 - DNA, 22 bp, Homo sapiens
ggcagaatgagagggaaacatg

SEQ ID NO: 8793386 - DNA, 22 bp, Homo sapiens
ggcagcagcaaggttggagctg

SEQ ID NO: 8793387 - DNA, 21 bp, Homo sapiens
ggcagaagtagcatggacggg

SEQ ID NO: 8793388 - DNA, 22 bp, Homo sapiens
ggcagcaggagccatctggtag

SEQ ID NO: 8793389 - DNA, 22 bp, Homo sapiens
ggcagcaggagccatctggtag

SEQ ID NO: 8793390 - DNA, 22 bp, Homo sapiens
ggcagcaggagccatctggtag

SEQ ID NO: 8793391 - DNA, 22 bp, Homo sapiens
ggcagcagcaaggttggagctg

SEQ ID NO: 8793392 - DNA, 22 bp, Homo sapiens
ggcagcagcaaggttggagctg

SEQ ID NO: 8793393 - DNA, 22 bp, Homo sapiens
ggcagcaggagccatctggtag

SEQ ID NO: 8793394 - DNA, 16 bp, Homo sapiens
ggcagcagctccgtgc

SEQ ID NO: 8793395 - DNA, 22 bp, Homo sapiens
ggattgagagcactggtagctg

SEQ ID NO: 8793396 - DNA, 17 bp, Homo sapiens
ggattgcatatacagtg

SEQ ID NO: 8793397 - DNA, 22 bp, Homo sapiens
ggatttacaagtttaactctca

SEQ ID NO: 8793398 - DNA, 22 bp, Homo sapiens
ggatttcttccttcctcagaag

SEQ ID NO: 8793399 - DNA, 21 bp, Homo sapiens
ggcactgctgggccatctgct

SEQ ID NO: 8793400 - DNA, 21 bp, Homo sapiens
ggcactgctgggccatctgct

SEQ ID NO: 8793401 - DNA, 22 bp, Homo sapiens
ggcactgccccctgcccaggac

SEQ ID NO: 8793402 - DNA, 21 bp, Homo sapiens
ggcactgctgggccatctgct

SEQ ID NO: 8793403 - DNA, 19 bp, Homo sapiens
ggcactggggccaggacca

SEQ ID NO: 8793404 - DNA, 22 bp, Homo sapiens
ggcactgggcaccggctgaggg

SEQ ID NO: 8793405 - DNA, 19 bp, Homo sapiens
ggcactggggccaggacca

SEQ ID NO: 8793406 - DNA, 22 bp, Homo sapiens
ggcactgcaggtaagtgctgtc

SEQ ID NO: 8793407 - DNA, 22 bp, Homo sapiens
ggcactgcaggtaagtgctgtc

SEQ ID NO: 8793408 - DNA, 22 bp, Homo sapiens
ggcactgccccctgcccaggac

SEQ ID NO: 8793409 - DNA, 22 bp, Homo sapiens
ggcactgcccaccctcacaggg

SEQ ID NO: 8793410 - DNA, 20 bp, Homo sapiens
ggcactgcaccagttagtag

SEQ ID NO: 8793411 - DNA, 20 bp, Homo sapiens
ggcactgcaccagttagtag

SEQ ID NO: 8793412 - DNA, 22 bp, Homo sapiens
ggcactgattccattcatgaag

SEQ ID NO: 8793413 - DNA, 18 bp, Homo sapiens
ggcactggtgatgcagag

SEQ ID NO: 8793414 - DNA, 18 bp, Homo sapiens
ggcactggtgatgcagag

SEQ ID NO: 8793415 - DNA, 18 bp, Homo sapiens
ggcactggtgatgcagag

SEQ ID NO: 8793416 - DNA, 18 bp, Homo sapiens
ggcactggtgatgcagag

SEQ ID NO: 8793417 - DNA, 18 bp, Homo sapiens
ggcactggtgatgcagag

SEQ ID NO: 8793418 - DNA, 22 bp, Homo sapiens
ggcactttgattttgagatgca

SEQ ID NO: 8793419 - DNA, 18 bp, Homo sapiens
ggcactggtgatgcagag

SEQ ID NO: 8793420 - DNA, 22 bp, Homo sapiens
ggcactgggttgtaggaattaa

SEQ ID NO: 8793421 - DNA, 18 bp, Homo sapiens
ggcactggtgatgcagag

SEQ ID NO: 8793422 - DNA, 22 bp, Homo sapiens
ggcactgggttgtaggaattaa

SEQ ID NO: 8793423 - DNA, 22 bp, Homo sapiens
ggcactgggtgagggtcactgg

SEQ ID NO: 8793424 - DNA, 19 bp, Homo sapiens
ggcactggggccaggacca

SEQ ID NO: 8793425 - DNA, 19 bp, Homo sapiens
ggcactggggccaggacca

SEQ ID NO: 8793426 - DNA, 22 bp, Homo sapiens
ggcagcagtaggagctaatctt

SEQ ID NO: 8793427 - DNA, 22 bp, Homo sapiens
ggcagcagtaggagctaatctt

SEQ ID NO: 8793428 - DNA, 22 bp, Homo sapiens
ggcagcagtaggagctaatctt

SEQ ID NO: 8793429 - DNA, 22 bp, Homo sapiens
ggcagcagggtctagattgatg

SEQ ID NO: 8793430 - DNA, 22 bp, Homo sapiens
ggcagcagggtctagattgatg

SEQ ID NO: 8793431 - DNA, 22 bp, Homo sapiens
ggcagcagggctgtctccctac

SEQ ID NO: 8793432 - DNA, 22 bp, Homo sapiens
ggcagcaggcgacttccctatt

SEQ ID NO: 8793433 - DNA, 22 bp, Homo sapiens
ggcagcaggcgacttccctatt

SEQ ID NO: 8793434 - DNA, 22 bp, Homo sapiens
ggcagcagggtagccatttctc

SEQ ID NO: 8793435 - DNA, 22 bp, Homo sapiens
ggcagcagggctgtctccctac

SEQ ID NO: 8793436 - DNA, 22 bp, Homo sapiens
ggcagccagtagggccagcctg

SEQ ID NO: 8793437 - DNA, 22 bp, Homo sapiens
ggcagccagcgggtggacgcgc

SEQ ID NO: 8793438 - DNA, 22 bp, Homo sapiens
ggcagccagcgggtggacgcgc

SEQ ID NO: 8793439 - DNA, 22 bp, Homo sapiens
ggcagccagcacgcagttgatg

SEQ ID NO: 8793440 - DNA, 22 bp, Homo sapiens
ggcagccagcaatgagaagttt

SEQ ID NO: 8793441 - DNA, 22 bp, Homo sapiens
ggcagccagcacgcagttgatg

SEQ ID NO: 8793442 - DNA, 22 bp, Homo sapiens
ggcagcagtccatggcccaagg

SEQ ID NO: 8793443 - DNA, 22 bp, Homo sapiens
ggcagccagcaatgagaagttt

SEQ ID NO: 8793444 - DNA, 22 bp, Homo sapiens
ggcagccagcaatgagaagttt

SEQ ID NO: 8793445 - DNA, 22 bp, Homo sapiens
ggcagccagagggcagctggat

SEQ ID NO: 8793446 - DNA, 22 bp, Homo sapiens
ggcagccatggacactggctag

SEQ ID NO: 8793447 - DNA, 22 bp, Homo sapiens
ggcagccatgctccaggtgcag

SEQ ID NO: 8793448 - DNA, 22 bp, Homo sapiens
ggcagccatgctccaggtgcag

SEQ ID NO: 8793449 - DNA, 22 bp, Homo sapiens
ggcagccatgctccaggtgcag

SEQ ID NO: 8793450 - DNA, 22 bp, Homo sapiens
ggcagccatgcacgctgcctgg

SEQ ID NO: 8793451 - DNA, 22 bp, Homo sapiens
ggcagccatactcagacctggg

SEQ ID NO: 8793452 - DNA, 22 bp, Homo sapiens
ggcagccatactcagacctggg

SEQ ID NO: 8793453 - DNA, 22 bp, Homo sapiens
ggcagccatactcagacctggg

SEQ ID NO: 8793454 - DNA, 23 bp, Homo sapiens
ggcagcttgttcctttgcttcca

SEQ ID NO: 8793455 - DNA, 22 bp, Homo sapiens
ggcagcttgtccttcaggagag

SEQ ID NO: 8793456 - DNA, 22 bp, Homo sapiens
ggcaggagaatggcgtgaactc

SEQ ID NO: 8793457 - DNA, 22 bp, Homo sapiens
ggcagctttcacctgtcttcct

SEQ ID NO: 8793458 - DNA, 22 bp, Homo sapiens
ggcagctttcacctgtcttcct

SEQ ID NO: 8793459 - DNA, 22 bp, Homo sapiens
ggcagctgttggctctctagga

SEQ ID NO: 8793460 - DNA, 22 bp, Homo sapiens
ggcagctgttggctctctagga

SEQ ID NO: 8793461 - DNA, 22 bp, Homo sapiens
ggcagctgtttgtcctcctgtt

SEQ ID NO: 8793462 - DNA, 22 bp, Homo sapiens
ggcagctgtttgtcctcctgtt

SEQ ID NO: 8793463 - DNA, 22 bp, Homo sapiens
ggcagctgtttgtcctcctgtt

SEQ ID NO: 8793464 - DNA, 22 bp, Homo sapiens
ggcagctgtttgtcctcctgtt

SEQ ID NO: 8793465 - DNA, 22 bp, Homo sapiens
ggcagctgttggctctctagga

SEQ ID NO: 8793466 - DNA, 22 bp, Homo sapiens
ggcagctgttggctctctagga

SEQ ID NO: 8793467 - DNA, 17 bp, Homo sapiens
ggcagctgtgtgcatgc

SEQ ID NO: 8793468 - DNA, 21 bp, Homo sapiens
ggcagctgtggttaattgaac

SEQ ID NO: 8793469 - DNA, 17 bp, Homo sapiens
ggcagctgtgtgcatgc

SEQ ID NO: 8793470 - DNA, 17 bp, Homo sapiens
ggcagctgtgtgcatgc

SEQ ID NO: 8793471 - DNA, 22 bp, Homo sapiens
ggcagctgtggacgtcgtcatt

SEQ ID NO: 8793472 - DNA, 22 bp, Homo sapiens
ggcagccatggacactggctag

SEQ ID NO: 8793473 - DNA, 22 bp, Homo sapiens
ggcagctgtgaagtgcctcaca

SEQ ID NO: 8793474 - DNA, 22 bp, Homo sapiens
ggatgggaacttggtagggcat

SEQ ID NO: 8793475 - DNA, 22 bp, Homo sapiens
ggatgttgattgaatggccatt

SEQ ID NO: 8793476 - DNA, 22 bp, Homo sapiens
ggatgggaacttggtagggcat

SEQ ID NO: 8793477 - DNA, 20 bp, Homo sapiens
ggatggccggaccagagcct

SEQ ID NO: 8793478 - DNA, 22 bp, Homo sapiens
ggatggccttcttgctcaggaa

SEQ ID NO: 8793479 - DNA, 22 bp, Homo sapiens
ggattaagacctgtcagtacac

SEQ ID NO: 8793480 - DNA, 22 bp, Homo sapiens
ggattaacagctcctgggtggt

SEQ ID NO: 8793481 - DNA, 22 bp, Homo sapiens
ggatgttgattgaatggccatt

SEQ ID NO: 8793482 - DNA, 22 bp, Homo sapiens
ggattctaactgaacagaatat

SEQ ID NO: 8793483 - DNA, 22 bp, Homo sapiens
ggattctgccttgttgcttcaa

SEQ ID NO: 8793484 - DNA, 19 bp, Homo sapiens
ggattctgcagttttcaca

SEQ ID NO: 8793485 - DNA, 22 bp, Homo sapiens
ggatggagatgaccatggtgac

SEQ ID NO: 8793486 - DNA, 22 bp, Homo sapiens
ggatggagatgaccatggtgac

SEQ ID NO: 8793487 - DNA, 22 bp, Homo sapiens
ggatggagatgaccatggtgac

SEQ ID NO: 8793488 - DNA, 22 bp, Homo sapiens
ggatggaggttctcagatgctc

SEQ ID NO: 8793489 - DNA, 22 bp, Homo sapiens
ggatggaggttctcagatgctc

SEQ ID NO: 8793490 - DNA, 22 bp, Homo sapiens
ggatggaggttctcagatgctc

SEQ ID NO: 8793491 - DNA, 22 bp, Homo sapiens
ggatggaggttctcagatgctc

SEQ ID NO: 8793492 - DNA, 22 bp, Homo sapiens
ggatggcatgttgggctctgtt

SEQ ID NO: 8793493 - DNA, 22 bp, Homo sapiens
ggatggcatgttgggctctgtt

SEQ ID NO: 8793494 - DNA, 21 bp, Homo sapiens
ggatggatagggaagagattt

SEQ ID NO: 8793495 - DNA, 22 bp, Homo sapiens
ggatggcagacagtgagtggct

SEQ ID NO: 8793496 - DNA, 22 bp, Homo sapiens
ggatggcaggacaaggacccag

SEQ ID NO: 8793497 - DNA, 19 bp, Homo sapiens
ggatgagggtcaggcatag

SEQ ID NO: 8793498 - DNA, 19 bp, Homo sapiens
ggatgagggtcaggcatag

SEQ ID NO: 8793499 - DNA, 22 bp, Homo sapiens
ggatgaggtagatgaacaaggg

SEQ ID NO: 8793500 - DNA, 22 bp, Homo sapiens
ggatgaggtagatgaacaaggg

SEQ ID NO: 8793501 - DNA, 22 bp, Homo sapiens
ggatgcacgaaggcgcctcgga

SEQ ID NO: 8793502 - DNA, 22 bp, Homo sapiens
ggatgcaggaacacagcgacct

SEQ ID NO: 8793503 - DNA, 22 bp, Homo sapiens
ggatgcaggaacacagcgacct

SEQ ID NO: 8793504 - DNA, 22 bp, Homo sapiens
ggatgcaggaacacagcgacct

SEQ ID NO: 8793505 - DNA, 22 bp, Homo sapiens
ggatgccatcagagtgtctgtg

SEQ ID NO: 8793506 - DNA, 22 bp, Homo sapiens
ggatgccatttgggtctggctt

SEQ ID NO: 8793507 - DNA, 22 bp, Homo sapiens
ggatgccatttgggtctggctt

SEQ ID NO: 8793508 - DNA, 22 bp, Homo sapiens
ggatgcaggggcagcagagcct

SEQ ID NO: 8793509 - DNA, 22 bp, Homo sapiens
ggatgccaactctgtttctgtg

SEQ ID NO: 8793510 - DNA, 22 bp, Homo sapiens
ggatgcagtgaggagcccgcgc

SEQ ID NO: 8793511 - DNA, 22 bp, Homo sapiens
ggatgcaggggcagcagagcct

SEQ ID NO: 8793512 - DNA, 22 bp, Homo sapiens
ggatgctggggaccaatctctg

SEQ ID NO: 8793513 - DNA, 22 bp, Homo sapiens
ggatgctggggaccaatctctg

SEQ ID NO: 8793514 - DNA, 22 bp, Homo sapiens
ggatggagatgaccatggtgac

SEQ ID NO: 8793515 - DNA, 23 bp, Homo sapiens
ggatggacgtgatgccttagcca

SEQ ID NO: 8793516 - DNA, 23 bp, Homo sapiens
ggatggacgtgatgccttagcca

SEQ ID NO: 8793517 - DNA, 22 bp, Homo sapiens
ggatgctgggagacagcaggca

SEQ ID NO: 8793518 - DNA, 22 bp, Homo sapiens
ggatgaggaaaccacagtgtcc

SEQ ID NO: 8793519 - DNA, 22 bp, Homo sapiens
ggatgaggaaaccacagtgtcc

SEQ ID NO: 8793520 - DNA, 22 bp, Homo sapiens
ggatgacagctcttccatgtgg

SEQ ID NO: 8793521 - DNA, 22 bp, Homo sapiens
ggatgaggaagattactgagaa

SEQ ID NO: 8793522 - DNA, 22 bp, Homo sapiens
ggatgaggaagattactgagaa

SEQ ID NO: 8793523 - DNA, 19 bp, Homo sapiens
ggatgagggtcaggcatag

SEQ ID NO: 8793524 - DNA, 19 bp, Homo sapiens
ggatgagggtcaggcatag

SEQ ID NO: 8793525 - DNA, 22 bp, Homo sapiens
ggatgacacagttagaaagaga

SEQ ID NO: 8793526 - DNA, 22 bp, Homo sapiens
ggatgacaaggaaagcaaacca

SEQ ID NO: 8793527 - DNA, 22 bp, Homo sapiens
ggatctgttttgcctctgaggg

SEQ ID NO: 8793528 - DNA, 22 bp, Homo sapiens
ggatctggggtagagcagtggg

SEQ ID NO: 8793529 - DNA, 22 bp, Homo sapiens
ggatctggggtagagcagtggg

SEQ ID NO: 8793530 - DNA, 22 bp, Homo sapiens
ggatctggggctctgctgctca

SEQ ID NO: 8793531 - DNA, 22 bp, Homo sapiens
ggagttggtggcccggaatctc

SEQ ID NO: 8793532 - DNA, 22 bp, Homo sapiens
ggagcagagcatttcacagcct

SEQ ID NO: 8793533 - DNA, 17 bp, Homo sapiens
ggagcagatccaccatt

SEQ ID NO: 8793534 - DNA, 22 bp, Homo sapiens
ggagatggtggaagctggtgca

SEQ ID NO: 8793535 - DNA, 22 bp, Homo sapiens
ggagcacagccttgccagtacc

SEQ ID NO: 8793536 - DNA, 22 bp, Homo sapiens
ggagcaagtcccaggcactagt

SEQ ID NO: 8793537 - DNA, 22 bp, Homo sapiens
ggagcaagtcccaggcactagt

SEQ ID NO: 8793538 - DNA, 22 bp, Homo sapiens
ggagcacaccgggagcttgcct

SEQ ID NO: 8793539 - DNA, 22 bp, Homo sapiens
ggagaggcttggcccagcctgg

SEQ ID NO: 8793540 - DNA, 22 bp, Homo sapiens
ggagatggagtggattcagcag

SEQ ID NO: 8793541 - DNA, 22 bp, Homo sapiens
ggagatggccaaaaacacaaat

SEQ ID NO: 8793542 - DNA, 22 bp, Homo sapiens
ggagatggctggcaggtagatg

SEQ ID NO: 8793543 - DNA, 22 bp, Homo sapiens
ggagatggctggcaggtagatg

SEQ ID NO: 8793544 - DNA, 22 bp, Homo sapiens
ggagatggctggcaggtagatg

SEQ ID NO: 8793545 - DNA, 21 bp, Homo sapiens
ggagatgggtatcgcctgggc

SEQ ID NO: 8793546 - DNA, 21 bp, Homo sapiens
ggagatgggtatcgcctgggc

SEQ ID NO: 8793547 - DNA, 22 bp, Homo sapiens
gggctccagccactggctgagg

SEQ ID NO: 8793548 - DNA, 22 bp, Homo sapiens
gggctccagcagaggcagccgg

SEQ ID NO: 8793549 - DNA, 22 bp, Homo sapiens
gggctccagcagaggcagccgg

SEQ ID NO: 8793550 - DNA, 22 bp, Homo sapiens
gggctccagcccgggaccaggt

SEQ ID NO: 8793551 - DNA, 22 bp, Homo sapiens
gggctccagcccgggaccaggt

SEQ ID NO: 8793552 - DNA, 22 bp, Homo sapiens
gggctccagcccgggaccaggt

SEQ ID NO: 8793553 - DNA, 22 bp, Homo sapiens
gggctccagccagctccttgtg

SEQ ID NO: 8793554 - DNA, 22 bp, Homo sapiens
gggctccagccagctccttgtg

SEQ ID NO: 8793555 - DNA, 22 bp, Homo sapiens
gggctccagccaggtgtcccca

SEQ ID NO: 8793556 - DNA, 22 bp, Homo sapiens
gggctccagccaggtgtcccca

SEQ ID NO: 8793557 - DNA, 22 bp, Homo sapiens
gggctccacagcagtgagtgga

SEQ ID NO: 8793558 - DNA, 22 bp, Homo sapiens
gggctccacagcagtgagtgga

SEQ ID NO: 8793559 - DNA, 22 bp, Homo sapiens
gggctccacagcagtgagtgga

SEQ ID NO: 8793560 - DNA, 22 bp, Homo sapiens
gggctccacgcacgcgagaggt

SEQ ID NO: 8793561 - DNA, 22 bp, Homo sapiens
gggctccacgcacgcgagaggt

SEQ ID NO: 8793562 - DNA, 22 bp, Homo sapiens
gggctccacgcacgcgagaggt

SEQ ID NO: 8793563 - DNA, 22 bp, Homo sapiens
gggctccacctagggacactgg

SEQ ID NO: 8793564 - DNA, 22 bp, Homo sapiens
gggctccacctagggacactgg

SEQ ID NO: 8793565 - DNA, 22 bp, Homo sapiens
gggctccagagtccatgttctt

SEQ ID NO: 8793566 - DNA, 22 bp, Homo sapiens
gggctccagagtccatgttctt

SEQ ID NO: 8793567 - DNA, 22 bp, Homo sapiens
gggctccagattgcagcgatca

SEQ ID NO: 8793568 - DNA, 22 bp, Homo sapiens
gggctccagattgcagcgatca

SEQ ID NO: 8793569 - DNA, 22 bp, Homo sapiens
gggctccagaggctcaccctgg

SEQ ID NO: 8793570 - DNA, 21 bp, Homo sapiens
gggctccagagatgtagcttc

SEQ ID NO: 8793571 - DNA, 21 bp, Homo sapiens
gggctccagagatgtagcttc

SEQ ID NO: 8793572 - DNA, 22 bp, Homo sapiens
gggctccagaggctcaccctgg

SEQ ID NO: 8793573 - DNA, 22 bp, Homo sapiens
gggctccagaggctcaccctgg

SEQ ID NO: 8793574 - DNA, 23 bp, Homo sapiens
gggctccagtctctgctcagttg

SEQ ID NO: 8793575 - DNA, 22 bp, Homo sapiens
gggctccagggcccgagtcgtc

SEQ ID NO: 8793576 - DNA, 22 bp, Homo sapiens
gggctccagggcccgagtcgtc

SEQ ID NO: 8793577 - DNA, 22 bp, Homo sapiens
gggctccagttgtccccaggat

SEQ ID NO: 8793578 - DNA, 22 bp, Homo sapiens
gggctccagttgtccccaggat

SEQ ID NO: 8793579 - DNA, 23 bp, Homo sapiens
gggctccagtctctgctcagttg

SEQ ID NO: 8793580 - DNA, 22 bp, Homo sapiens
gggctccaggcaggcaggaaat

SEQ ID NO: 8793581 - DNA, 22 bp, Homo sapiens
gggctccaggcaggcaggaaat

SEQ ID NO: 8793582 - DNA, 22 bp, Homo sapiens
gggctccaggagccctaagaga

SEQ ID NO: 8793583 - DNA, 22 bp, Homo sapiens
gggctccaggagccctaagaga

SEQ ID NO: 8793584 - DNA, 20 bp, Homo sapiens
gggctccagctgtgattctt

SEQ ID NO: 8793585 - DNA, 20 bp, Homo sapiens
gggctccagctgtgattctt

SEQ ID NO: 8793586 - DNA, 22 bp, Homo sapiens
gggctccagctgtttgccatga

SEQ ID NO: 8793587 - DNA, 22 bp, Homo sapiens
gggctccagtttggccaggaag

SEQ ID NO: 8793588 - DNA, 22 bp, Homo sapiens
gggctccagtttggccaggaag

SEQ ID NO: 8793589 - DNA, 22 bp, Homo sapiens
gggctccagtttggccaggaag

SEQ ID NO: 8793590 - DNA, 22 bp, Homo sapiens
gggctccagtttggccaggaag

SEQ ID NO: 8793591 - DNA, 22 bp, Homo sapiens
gggctccatcacaggctccatc

SEQ ID NO: 8793592 - DNA, 22 bp, Homo sapiens
gggctccatcacaggctccatc

SEQ ID NO: 8793593 - DNA, 22 bp, Homo sapiens
gggctccatcacaggctccatc

SEQ ID NO: 8793594 - DNA, 22 bp, Homo sapiens
gggctccatcggacttgggttt

SEQ ID NO: 8793595 - DNA, 17 bp, Homo sapiens
gggctcctcccctgggg

SEQ ID NO: 8793596 - DNA, 17 bp, Homo sapiens
gggctcctcccctgggg

SEQ ID NO: 8793597 - DNA, 17 bp, Homo sapiens
gggctcctcccctgggg

SEQ ID NO: 8793598 - DNA, 22 bp, Homo sapiens
gggctggctcccaggtgttgaa

SEQ ID NO: 8793599 - DNA, 22 bp, Homo sapiens
gggctggctaagacttttctgt

SEQ ID NO: 8793600 - DNA, 22 bp, Homo sapiens
gggctggctaagacttttctgt

SEQ ID NO: 8793601 - DNA, 22 bp, Homo sapiens
gggctggcgggaaaggcaattc

SEQ ID NO: 8793602 - DNA, 22 bp, Homo sapiens
gggctggcatcggttgctgaga

SEQ ID NO: 8793603 - DNA, 20 bp, Homo sapiens
gggctggcgcatggggaaag

SEQ ID NO: 8793604 - DNA, 20 bp, Homo sapiens
gggctggcgcatggggaaag

SEQ ID NO: 8793605 - DNA, 22 bp, Homo sapiens
gggctggcgggaaaggcaattc

SEQ ID NO: 8793606 - DNA, 22 bp, Homo sapiens
gggctggcatcggttgctgaga

SEQ ID NO: 8793607 - DNA, 22 bp, Homo sapiens
gggctcctggcagtcatgctca

SEQ ID NO: 8793608 - DNA, 22 bp, Homo sapiens
gggctcctggcagtcatgctca

SEQ ID NO: 8793609 - DNA, 19 bp, Homo sapiens
gggctccttgggcctctct

SEQ ID NO: 8793610 - DNA, 19 bp, Homo sapiens
gggctccttgggcctctct

SEQ ID NO: 8793611 - DNA, 22 bp, Homo sapiens
gggctcctgcctcctggcacct

SEQ ID NO: 8793612 - DNA, 22 bp, Homo sapiens
gggctcctgcctcctggcacct

SEQ ID NO: 8793613 - DNA, 22 bp, Homo sapiens
gggctcctgcctcctggcacct

SEQ ID NO: 8793614 - DNA, 22 bp, Homo sapiens
gggctcctcctctgactgtggc

SEQ ID NO: 8793615 - DNA, 22 bp, Homo sapiens
gggctctcaaggcagggcccca

SEQ ID NO: 8793616 - DNA, 22 bp, Homo sapiens
gggctctagaggacagcctgct

SEQ ID NO: 8793617 - DNA, 22 bp, Homo sapiens
gggctctaggatggctccagcc

SEQ ID NO: 8793618 - DNA, 21 bp, Homo sapiens
gggctctcctgaggccatgaa

SEQ ID NO: 8793619 - DNA, 22 bp, Homo sapiens
gggctctcatgagtgtgtggta

SEQ ID NO: 8793620 - DNA, 22 bp, Homo sapiens
gggctctcgattagaccctggg

SEQ ID NO: 8793621 - DNA, 21 bp, Homo sapiens
gggctctcctgaggccatgaa

SEQ ID NO: 8793622 - DNA, 22 bp, Homo sapiens
gggcagttgctacaatatggct

SEQ ID NO: 8793623 - DNA, 20 bp, Homo sapiens
gggcagttcaatgccactct

SEQ ID NO: 8793624 - DNA, 22 bp, Homo sapiens
gggcagtgttgtggttctctat

SEQ ID NO: 8793625 - DNA, 22 bp, Homo sapiens
gggcagtttattctagatggtt

SEQ ID NO: 8793626 - DNA, 22 bp, Homo sapiens
gggcatgacttttggagtggga

SEQ ID NO: 8793627 - DNA, 22 bp, Homo sapiens
gggcatgacttttggagtggga

SEQ ID NO: 8793628 - DNA, 22 bp, Homo sapiens
gggcatgacttttggagtggga

SEQ ID NO: 8793629 - DNA, 22 bp, Homo sapiens
gggcatgcaggactgtggcaga

SEQ ID NO: 8793630 - DNA, 22 bp, Homo sapiens
gggcatgagcacatagtgtcta

SEQ ID NO: 8793631 - DNA, 22 bp, Homo sapiens
gggcatgcaggactgtggcaga

SEQ ID NO: 8793632 - DNA, 22 bp, Homo sapiens
gggcatgcctgagcctgccact

SEQ ID NO: 8793633 - DNA, 22 bp, Homo sapiens
gggcctccgtgtgctggtgctc

SEQ ID NO: 8793634 - DNA, 22 bp, Homo sapiens
gggcctccgtgtgctggtgctc

SEQ ID NO: 8793635 - DNA, 22 bp, Homo sapiens
gggcctcagctctgctctgcaa

SEQ ID NO: 8793636 - DNA, 22 bp, Homo sapiens
gggcctcaggccttgctctgtg

SEQ ID NO: 8793637 - DNA, 22 bp, Homo sapiens
gggcctgcaggttctgagaggc

SEQ ID NO: 8793638 - DNA, 22 bp, Homo sapiens
gggcctgccattgctgccccag

SEQ ID NO: 8793639 - DNA, 22 bp, Homo sapiens
gggcctgattagcaggctagct

SEQ ID NO: 8793640 - DNA, 22 bp, Homo sapiens
gggcctgattagcaggctagct

SEQ ID NO: 8793641 - DNA, 22 bp, Homo sapiens
gggcctgaggcttccctaatgc

SEQ ID NO: 8793642 - DNA, 22 bp, Homo sapiens
gggcctgagactgagggtgagg

SEQ ID NO: 8793643 - DNA, 22 bp, Homo sapiens
gggcctgactgagagctcctca

SEQ ID NO: 8793644 - DNA, 22 bp, Homo sapiens
gggcctgaggcccagacactgg

SEQ ID NO: 8793645 - DNA, 22 bp, Homo sapiens
gggcctgagctactaggtaggt

SEQ ID NO: 8793646 - DNA, 22 bp, Homo sapiens
gggcctgctccccatcgctgct

SEQ ID NO: 8793647 - DNA, 22 bp, Homo sapiens
gggcctgctgcaggttcaggat

SEQ ID NO: 8793648 - DNA, 22 bp, Homo sapiens
gggcctgccattgctgccccag

SEQ ID NO: 8793649 - DNA, 22 bp, Homo sapiens
gggcctgccattgctgccccag

SEQ ID NO: 8793650 - DNA, 22 bp, Homo sapiens
gggcctggcatgcagccccgtt

SEQ ID NO: 8793651 - DNA, 21 bp, Homo sapiens
gggcctggctgcgcaggacgg

SEQ ID NO: 8793652 - DNA, 21 bp, Homo sapiens
gggcctggctgcgcaggacgg

SEQ ID NO: 8793653 - DNA, 22 bp, Homo sapiens
gggcctggcatgcagccccgtt

SEQ ID NO: 8793654 - DNA, 22 bp, Homo sapiens
gggctccaaggaggccagcctg

SEQ ID NO: 8793655 - DNA, 22 bp, Homo sapiens
gggcctggtgcttctgactcct

SEQ ID NO: 8793656 - DNA, 22 bp, Homo sapiens
gggcctggggtgacgtacccct

SEQ ID NO: 8793657 - DNA, 22 bp, Homo sapiens
gggcctggggacaccaccatga

SEQ ID NO: 8793658 - DNA, 22 bp, Homo sapiens
gggcctggggacaccaccatga

SEQ ID NO: 8793659 - DNA, 22 bp, Homo sapiens
gggcctggggtgacgtacccct

SEQ ID NO: 8793660 - DNA, 22 bp, Homo sapiens
gggcctggggacaccaccatga

SEQ ID NO: 8793661 - DNA, 22 bp, Homo sapiens
gggcctgggaacttgcatttag

SEQ ID NO: 8793662 - DNA, 22 bp, Homo sapiens
gggcctggggacaccaccatga

SEQ ID NO: 8793663 - DNA, 22 bp, Homo sapiens
gggcctgggaacttgcatttag

SEQ ID NO: 8793664 - DNA, 22 bp, Homo sapiens
gggcctgggaacttgcatttag

SEQ ID NO: 8793665 - DNA, 21 bp, Homo sapiens
gggcctggctgcgcaggacgg

SEQ ID NO: 8793666 - DNA, 22 bp, Homo sapiens
gggcctgctgcaggttcaggat

SEQ ID NO: 8793667 - DNA, 21 bp, Homo sapiens
gggcctggctgcgcaggacgg

SEQ ID NO: 8793668 - DNA, 21 bp, Homo sapiens
gggcctggctgcgcaggacgg

SEQ ID NO: 8793669 - DNA, 21 bp, Homo sapiens
gggcctggctgcgcaggacgg

SEQ ID NO: 8793670 - DNA, 21 bp, Homo sapiens
gggcctggctgcgcaggacgg

SEQ ID NO: 8793671 - DNA, 21 bp, Homo sapiens
gggcctggctgcgcaggacgg

SEQ ID NO: 8793672 - DNA, 22 bp, Homo sapiens
gggctgggcatggtgttccctc

SEQ ID NO: 8793673 - DNA, 16 bp, Homo sapiens
gggctgggggattctg

SEQ ID NO: 8793674 - DNA, 22 bp, Homo sapiens
gggctggggctcaataatttgt

SEQ ID NO: 8793675 - DNA, 22 bp, Homo sapiens
gggctgggcatggtgttccctc

SEQ ID NO: 8793676 - DNA, 22 bp, Homo sapiens
gggctgggattgcttgctgtga

SEQ ID NO: 8793677 - DNA, 22 bp, Homo sapiens
gggctgggattgcttgctgtga

SEQ ID NO: 8793678 - DNA, 22 bp, Homo sapiens
gggctgggattgcttgctgtga

SEQ ID NO: 8793679 - DNA, 22 bp, Homo sapiens
gggctgggatggcttgaagatt

SEQ ID NO: 8793680 - DNA, 22 bp, Homo sapiens
gggctgggatggcttgaagatt

SEQ ID NO: 8793681 - DNA, 22 bp, Homo sapiens
gggctgggatggcttgaagatt

SEQ ID NO: 8793682 - DNA, 22 bp, Homo sapiens
gggctgggatggcttgaagatt

SEQ ID NO: 8793683 - DNA, 22 bp, Homo sapiens
gggctgggaatggctaagtatg

SEQ ID NO: 8793684 - DNA, 22 bp, Homo sapiens
gggctgggaatggctaagtatg

SEQ ID NO: 8793685 - DNA, 22 bp, Homo sapiens
gggctggctctgtctagaaagg

SEQ ID NO: 8793686 - DNA, 22 bp, Homo sapiens
gggctggctcccaggtgttgaa

SEQ ID NO: 8793687 - DNA, 22 bp, Homo sapiens
gggctgggaatggctaagtatg

SEQ ID NO: 8793688 - DNA, 22 bp, Homo sapiens
gggctggctgattttcctctct

SEQ ID NO: 8793689 - DNA, 22 bp, Homo sapiens
gggctggctgattttcctctct

SEQ ID NO: 8793690 - DNA, 22 bp, Homo sapiens
gggctggctgattttcctctct

SEQ ID NO: 8793691 - DNA, 22 bp, Homo sapiens
ggggatggattccgggtccctg

SEQ ID NO: 8793692 - DNA, 22 bp, Homo sapiens
ggggatggtagaccggtgacgt

SEQ ID NO: 8793693 - DNA, 22 bp, Homo sapiens
ggggatggaatgtagtagtgat

SEQ ID NO: 8793694 - DNA, 22 bp, Homo sapiens
ggggatggaggcgtgtggtcct

SEQ ID NO: 8793695 - DNA, 22 bp, Homo sapiens
ggggcacacttttggtagatat

SEQ ID NO: 8793696 - DNA, 22 bp, Homo sapiens
ggggcacacttttggtagatat

SEQ ID NO: 8793697 - DNA, 22 bp, Homo sapiens
ggggcagctcccgagggcagga

SEQ ID NO: 8793698 - DNA, 22 bp, Homo sapiens
ggggcagaaagcccacagagtg

SEQ ID NO: 8793699 - DNA, 22 bp, Homo sapiens
gggggaaagctcaggagcctgt

SEQ ID NO: 8793700 - DNA, 22 bp, Homo sapiens
ggggcaggaggtgttctctttt

SEQ ID NO: 8793701 - DNA, 22 bp, Homo sapiens
ggggcaggaggtgttctctttt

SEQ ID NO: 8793702 - DNA, 22 bp, Homo sapiens
ggggctgtttttggaatggctg

SEQ ID NO: 8793703 - DNA, 22 bp, Homo sapiens
ggggctgttgaagttagttgag

SEQ ID NO: 8793704 - DNA, 22 bp, Homo sapiens
ggggcagctcccgagggcagga

SEQ ID NO: 8793705 - DNA, 22 bp, Homo sapiens
ggggcagctcccgagggcagga

SEQ ID NO: 8793706 - DNA, 22 bp, Homo sapiens
ggggcagctcccgagggcagga

SEQ ID NO: 8793707 - DNA, 22 bp, Homo sapiens
ggggcagctcccgagggcagga

SEQ ID NO: 8793708 - DNA, 22 bp, Homo sapiens
ggggcaggagcccttcttcagc

SEQ ID NO: 8793709 - DNA, 22 bp, Homo sapiens
ggggcaggagcccttcttcagc

SEQ ID NO: 8793710 - DNA, 22 bp, Homo sapiens
ggggcaggagcccttcttcagc

SEQ ID NO: 8793711 - DNA, 21 bp, Homo sapiens
gggggaagaggagttgctagt

SEQ ID NO: 8793712 - DNA, 22 bp, Homo sapiens
gggggactaactggatcctgga

SEQ ID NO: 8793713 - DNA, 22 bp, Homo sapiens
gggggacaggatgaatatctgt

SEQ ID NO: 8793714 - DNA, 22 bp, Homo sapiens
gggggaagtaattataaaccaa

SEQ ID NO: 8793715 - DNA, 22 bp, Homo sapiens
gggggagaagattctgctgctt

SEQ ID NO: 8793716 - DNA, 22 bp, Homo sapiens
gggggagaagattctgctgctt

SEQ ID NO: 8793717 - DNA, 22 bp, Homo sapiens
gggggaaagtggaggttcgtga

SEQ ID NO: 8793718 - DNA, 22 bp, Homo sapiens
gggggaaagtggaggttcgtga

SEQ ID NO: 8793719 - DNA, 22 bp, Homo sapiens
gggggaaagctcaggagcctgt

SEQ ID NO: 8793720 - DNA, 22 bp, Homo sapiens
gggggaaatagaaatgcttaga

SEQ ID NO: 8793721 - DNA, 22 bp, Homo sapiens
gggggaagactgggctagtgat

SEQ ID NO: 8793722 - DNA, 22 bp, Homo sapiens
gggggaagactgggctagtgat

SEQ ID NO: 8793723 - DNA, 22 bp, Homo sapiens
gggtcactgtaaggcaataagt

SEQ ID NO: 8793724 - DNA, 22 bp, Homo sapiens
gggtcaaggctacatggagacc

SEQ ID NO: 8793725 - DNA, 22 bp, Homo sapiens
gggtcaaggctacatggagacc

SEQ ID NO: 8793726 - DNA, 22 bp, Homo sapiens
gggtcagagcaagactggggtc

SEQ ID NO: 8793727 - DNA, 22 bp, Homo sapiens
gggtcaaggctacatggagacc

SEQ ID NO: 8793728 - DNA, 22 bp, Homo sapiens
gggtcagagtaagcaaggacaa

SEQ ID NO: 8793729 - DNA, 22 bp, Homo sapiens
gggtcagagttcaggtcgaggg

SEQ ID NO: 8793730 - DNA, 22 bp, Homo sapiens
gggtcagagccgtaacaggact

SEQ ID NO: 8793731 - DNA, 22 bp, Homo sapiens
gggtcagctgctgggggctgac

SEQ ID NO: 8793732 - DNA, 22 bp, Homo sapiens
gggtcagctgctgggggctgac

SEQ ID NO: 8793733 - DNA, 23 bp, Homo sapiens
gggggcgtgtcatggagggccac

SEQ ID NO: 8793734 - DNA, 22 bp, Homo sapiens
gggggctaccgtctctggagct

SEQ ID NO: 8793735 - DNA, 22 bp, Homo sapiens
gggtagtttaattaggaagaaa

SEQ ID NO: 8793736 - DNA, 22 bp, Homo sapiens
gggtagtttaattaggaagaaa

SEQ ID NO: 8793737 - DNA, 22 bp, Homo sapiens
gggggcgggagacagcagtgac

SEQ ID NO: 8793738 - DNA, 22 bp, Homo sapiens
gggggcggagcacgtgaccacg

SEQ ID NO: 8793739 - DNA, 22 bp, Homo sapiens
gggggcggagcacgtgaccacg

SEQ ID NO: 8793740 - DNA, 23 bp, Homo sapiens
gggggccgtcctggggattatag

SEQ ID NO: 8793741 - DNA, 23 bp, Homo sapiens
gggggccgtcctggggattatag

SEQ ID NO: 8793742 - DNA, 22 bp, Homo sapiens
gggggccttattcatctgccag

SEQ ID NO: 8793743 - DNA, 22 bp, Homo sapiens
gggggccttgttagtggatgga

SEQ ID NO: 8793744 - DNA, 20 bp, Homo sapiens
gggggccagcagcagacgcc

SEQ ID NO: 8793745 - DNA, 22 bp, Homo sapiens
gggggagagacgagcggctctg

SEQ ID NO: 8793746 - DNA, 21 bp, Homo sapiens
ggtgcaggtaatgatgatata

SEQ ID NO: 8793747 - DNA, 20 bp, Homo sapiens
ggtgcaggtaacgctgtgct

SEQ ID NO: 8793748 - DNA, 22 bp, Homo sapiens
ggtgcatgtgagaaagactggg

SEQ ID NO: 8793749 - DNA, 22 bp, Homo sapiens
ggtgcatggaaagagtaagtaa

SEQ ID NO: 8793750 - DNA, 22 bp, Homo sapiens
ggtgcagtgcagggtaattata

SEQ ID NO: 8793751 - DNA, 22 bp, Homo sapiens
ggtgaattaatgatggtaaggc

SEQ ID NO: 8793752 - DNA, 22 bp, Homo sapiens
ggtgaattctcagcttttacaa

SEQ ID NO: 8793753 - DNA, 20 bp, Homo sapiens
ggtgcaggtaacgctgtgct

SEQ ID NO: 8793754 - DNA, 22 bp, Homo sapiens
ggtgcagggagaggcaggcccc

SEQ ID NO: 8793755 - DNA, 22 bp, Homo sapiens
ggtgcagggagaggcaggcccc

SEQ ID NO: 8793756 - DNA, 22 bp, Homo sapiens
ggtgcagggagaggcaggcccc

SEQ ID NO: 8793757 - DNA, 22 bp, Homo sapiens
ggtgcagggagaggcaggcccc

SEQ ID NO: 8793758 - DNA, 22 bp, Homo sapiens
ggtgaaggcacaagagggcaag

SEQ ID NO: 8793759 - DNA, 22 bp, Homo sapiens
ggtgaaggcacaagagggcaag

SEQ ID NO: 8793760 - DNA, 22 bp, Homo sapiens
ggtgaagggtgtcatggcattt

SEQ ID NO: 8793761 - DNA, 22 bp, Homo sapiens
ggtgaagggccttaggagacag

SEQ ID NO: 8793762 - DNA, 22 bp, Homo sapiens
ggtgaaggtctactgtgtgcca

SEQ ID NO: 8793763 - DNA, 22 bp, Homo sapiens
ggtgaaggtggaacgcagagca

SEQ ID NO: 8793764 - DNA, 22 bp, Homo sapiens
ggtcccaaggaggatgaggcta

SEQ ID NO: 8793765 - DNA, 22 bp, Homo sapiens
ggtctggcctcgggcaccccca

SEQ ID NO: 8793766 - DNA, 22 bp, Homo sapiens
ggtcccagaattggttagcaca

SEQ ID NO: 8793767 - DNA, 22 bp, Homo sapiens
ggtcccaagtgcttttcctgca

SEQ ID NO: 8793768 - DNA, 22 bp, Homo sapiens
ggtctggcctggcattctatgg

SEQ ID NO: 8793769 - DNA, 22 bp, Homo sapiens
ggtctgtgctctggagcctctg

SEQ ID NO: 8793770 - DNA, 22 bp, Homo sapiens
ggtctgtgtcataggctgagtt

SEQ ID NO: 8793771 - DNA, 22 bp, Homo sapiens
ggtctgtgctctggagcctctg

SEQ ID NO: 8793772 - DNA, 22 bp, Homo sapiens
ggtctggggcaggcatctgaca

SEQ ID NO: 8793773 - DNA, 17 bp, Homo sapiens
ggtctggggccattggc

SEQ ID NO: 8793774 - DNA, 22 bp, Homo sapiens
ggtctggggcaggcatctgaca

SEQ ID NO: 8793775 - DNA, 22 bp, Homo sapiens
ggtcttctggaaagcagactgt

SEQ ID NO: 8793776 - DNA, 21 bp, Homo sapiens
ggtcttccaaataaggagaaa

SEQ ID NO: 8793777 - DNA, 17 bp, Homo sapiens
ggtctgtgtctagggaa

SEQ ID NO: 8793778 - DNA, 22 bp, Homo sapiens
ggtctgtgtgctttgggaagtg

SEQ ID NO: 8793779 - DNA, 22 bp, Homo sapiens
ggtctgtgctctggagcctctg

SEQ ID NO: 8793780 - DNA, 22 bp, Homo sapiens
ggtctgtgtcataggctgagtt

SEQ ID NO: 8793781 - DNA, 21 bp, Homo sapiens
ggtcttgggaggtgccctggg

SEQ ID NO: 8793782 - DNA, 22 bp, Homo sapiens
ggtgaagcgtatttgtggagct

SEQ ID NO: 8793783 - DNA, 22 bp, Homo sapiens
ggtgccagagtggcccaggggc

SEQ ID NO: 8793784 - DNA, 22 bp, Homo sapiens
ggtgccacataaatggagagag

SEQ ID NO: 8793785 - DNA, 22 bp, Homo sapiens
ggtgccagagtggcccaggggc

SEQ ID NO: 8793786 - DNA, 22 bp, Homo sapiens
ggtgccagtgggtctcaggata

SEQ ID NO: 8793787 - DNA, 22 bp, Homo sapiens
ggtgccaggctgtagtcagggt

SEQ ID NO: 8793788 - DNA, 22 bp, Homo sapiens
ggtgccagcctagtgcagtggt

SEQ ID NO: 8793789 - DNA, 22 bp, Homo sapiens
ggtgcccagagccaggaatgag

SEQ ID NO: 8793790 - DNA, 22 bp, Homo sapiens
ggtgcccagagccaggaatgag

SEQ ID NO: 8793791 - DNA, 22 bp, Homo sapiens
ggtgcccacctgtcttcctgga

SEQ ID NO: 8793792 - DNA, 22 bp, Homo sapiens
ggtgcccaaggaaggttgccgt

SEQ ID NO: 8793793 - DNA, 22 bp, Homo sapiens
ggtgcccagcgaagtggctgtg

SEQ ID NO: 8793794 - DNA, 22 bp, Homo sapiens
ggtgcccagcgaagtggctgtg

SEQ ID NO: 8793795 - DNA, 22 bp, Homo sapiens
ggtgcccagcaagctttcaatg

SEQ ID NO: 8793796 - DNA, 22 bp, Homo sapiens
ggtgccctgtaaaagccatgca

SEQ ID NO: 8793797 - DNA, 22 bp, Homo sapiens
ggtgccctggaagctgctgcat

SEQ ID NO: 8793798 - DNA, 22 bp, Homo sapiens
ggtgccctggaagctgctgcat

SEQ ID NO: 8793799 - DNA, 22 bp, Homo sapiens
ggtgcccgccggcaaccctcgg

SEQ ID NO: 8793800 - DNA, 22 bp, Homo sapiens
ggtgccctgtaaaagccatgca

SEQ ID NO: 8793801 - DNA, 22 bp, Homo sapiens
ggtgcctgatggtgatgaggtc

SEQ ID NO: 8793802 - DNA, 22 bp, Homo sapiens
ggtgcctgtatttggggcacag

SEQ ID NO: 8793803 - DNA, 22 bp, Homo sapiens
ggtgcctgtatttggggcacag

SEQ ID NO: 8793804 - DNA, 22 bp, Homo sapiens
ggtgcctgtatttggggcacag

SEQ ID NO: 8793805 - DNA, 22 bp, Homo sapiens
ggtgctattcctatacagcatt

SEQ ID NO: 8793806 - DNA, 22 bp, Homo sapiens
ggtggctgaagcagtcttcggg

SEQ ID NO: 8793807 - DNA, 22 bp, Homo sapiens
ggtgggagtggaacgtggaaga

SEQ ID NO: 8793808 - DNA, 16 bp, Homo sapiens
ggtgggaggtgaggtg

SEQ ID NO: 8793809 - DNA, 16 bp, Homo sapiens
ggtgggaggtgaggtg

SEQ ID NO: 8793810 - DNA, 22 bp, Homo sapiens
ggtgggagggctgcgttcctct

SEQ ID NO: 8793811 - DNA, 22 bp, Homo sapiens
ggtgggcaacatttggcctgag

SEQ ID NO: 8793812 - DNA, 21 bp, Homo sapiens
ggtgggcacaggagagcagag

SEQ ID NO: 8793813 - DNA, 21 bp, Homo sapiens
ggtgggcacaggagagcagag

SEQ ID NO: 8793814 - DNA, 21 bp, Homo sapiens
ggtgggcacaggagagcagag

SEQ ID NO: 8793815 - DNA, 22 bp, Homo sapiens
ggtgggagtgggcacagttacg

SEQ ID NO: 8793816 - DNA, 22 bp, Homo sapiens
ggtgggatcaaagagtcattcg

SEQ ID NO: 8793817 - DNA, 22 bp, Homo sapiens
ggtgggagagctctgtctccag

SEQ ID NO: 8793818 - DNA, 22 bp, Homo sapiens
ggtgggagagcttgctttgatg

SEQ ID NO: 8793819 - DNA, 22 bp, Homo sapiens
ggtgggagagcttgctttgatg

SEQ ID NO: 8793820 - DNA, 23 bp, Homo sapiens
ggtgggagattatccagaattat

SEQ ID NO: 8793821 - DNA, 22 bp, Homo sapiens
ggtggctgcaatggctaacttc

SEQ ID NO: 8793822 - DNA, 22 bp, Homo sapiens
ggtgggagagctctgtctccag

SEQ ID NO: 8793823 - DNA, 22 bp, Homo sapiens
ggtggctgcaccctggctaact

SEQ ID NO: 8793824 - DNA, 22 bp, Homo sapiens
ggtggctgaatcaaatcaggcc

SEQ ID NO: 8793825 - DNA, 22 bp, Homo sapiens
ggtggctgcaatggctaacttc

SEQ ID NO: 8793826 - DNA, 22 bp, Homo sapiens
ggtggctgaagcagtcttcggg

SEQ ID NO: 8793827 - DNA, 22 bp, Homo sapiens
ggtggctgaatcaaatcaggcc

SEQ ID NO: 8793828 - DNA, 22 bp, Homo sapiens
ggtgggaggcaggctgctccca

SEQ ID NO: 8793829 - DNA, 22 bp, Homo sapiens
ggtgggaggactgtttgaggca

SEQ ID NO: 8793830 - DNA, 22 bp, Homo sapiens
ggtgggagccaacacccttctg

SEQ ID NO: 8793831 - DNA, 22 bp, Homo sapiens
ggtgggagccaacacccttctg

SEQ ID NO: 8793832 - DNA, 22 bp, Homo sapiens
ggtgggaggcaggctgctccca

SEQ ID NO: 8793833 - DNA, 22 bp, Homo sapiens
ggtgggaggcaggctgctccca

SEQ ID NO: 8793834 - DNA, 22 bp, Homo sapiens
ggtgggaggcaggctgctccca

SEQ ID NO: 8793835 - DNA, 22 bp, Homo sapiens
gggtcaggcctcaaggtgggct

SEQ ID NO: 8793836 - DNA, 22 bp, Homo sapiens
gggtcaggcctcaaggtgggct

SEQ ID NO: 8793837 - DNA, 22 bp, Homo sapiens
gggtcaggaagaattctgccaa

SEQ ID NO: 8793838 - DNA, 22 bp, Homo sapiens
gggtcagggctgcctgggctca

SEQ ID NO: 8793839 - DNA, 22 bp, Homo sapiens
gggtcagggaggccccaccatg

SEQ ID NO: 8793840 - DNA, 22 bp, Homo sapiens
gggtcaggctcagcagggcagc

SEQ ID NO: 8793841 - DNA, 22 bp, Homo sapiens
gggtcagggctgcctgggctca

SEQ ID NO: 8793842 - DNA, 22 bp, Homo sapiens
gggtcaggctcagcagggcagc

SEQ ID NO: 8793843 - DNA, 22 bp, Homo sapiens
gggtcaggctcagcagggcagc

SEQ ID NO: 8793844 - DNA, 22 bp, Homo sapiens
gggtcaggctcagcagggcagc

SEQ ID NO: 8793845 - DNA, 22 bp, Homo sapiens
gggtcaggctagcccagacttc

SEQ ID NO: 8793846 - DNA, 22 bp, Homo sapiens
gggtcaggctcagcagggcagc

SEQ ID NO: 8793847 - DNA, 22 bp, Homo sapiens
gggtcagggctggctgtcgtca

SEQ ID NO: 8793848 - DNA, 22 bp, Homo sapiens
gggtcagggctggctgtcgtca

SEQ ID NO: 8793849 - DNA, 22 bp, Homo sapiens
gggtccagaatgagaatgggct

SEQ ID NO: 8793850 - DNA, 22 bp, Homo sapiens
gggtccagacactccagaggaa

SEQ ID NO: 8793851 - DNA, 23 bp, Homo sapiens
gggtccagagaagccattagggc

SEQ ID NO: 8793852 - DNA, 23 bp, Homo sapiens
gggtccagagacaggcatgggtg

SEQ ID NO: 8793853 - DNA, 22 bp, Homo sapiens
gggtccagagcctcagcccaga

SEQ ID NO: 8793854 - DNA, 22 bp, Homo sapiens
gggtccagagcctcagcccaga

SEQ ID NO: 8793855 - DNA, 22 bp, Homo sapiens
gggtccagagttttcccgccct

SEQ ID NO: 8793856 - DNA, 22 bp, Homo sapiens
gggtccagagttttcccgccct

SEQ ID NO: 8793857 - DNA, 22 bp, Homo sapiens
gggtccagagttgaagaggtta

SEQ ID NO: 8793858 - DNA, 22 bp, Homo sapiens
gggtccagagttgaagaggtta

SEQ ID NO: 8793859 - DNA, 22 bp, Homo sapiens
ggtaagattcttcaaacaagag

SEQ ID NO: 8793860 - DNA, 22 bp, Homo sapiens
ggtaactgcacctttggcctga

SEQ ID NO: 8793861 - DNA, 22 bp, Homo sapiens
ggtaactgaggccatattctga

SEQ ID NO: 8793862 - DNA, 22 bp, Homo sapiens
ggtaactgcagaatgtgcctca

SEQ ID NO: 8793863 - DNA, 22 bp, Homo sapiens
ggtaacacaggtgcagttttaa

SEQ ID NO: 8793864 - DNA, 22 bp, Homo sapiens
ggtaacaaggccgatagaaaca

SEQ ID NO: 8793865 - DNA, 22 bp, Homo sapiens
ggtaacacatggaacatttaca

SEQ ID NO: 8793866 - DNA, 22 bp, Homo sapiens
ggtaacacaggtgcagttttaa

SEQ ID NO: 8793867 - DNA, 22 bp, Homo sapiens
gggtccagcgacagcaggctca

SEQ ID NO: 8793868 - DNA, 22 bp, Homo sapiens
gggtccagcgacagcaggctca

SEQ ID NO: 8793869 - DNA, 22 bp, Homo sapiens
gggtccagatggtgagagttaa

SEQ ID NO: 8793870 - DNA, 19 bp, Homo sapiens
ggtaaatgatacatgctga

SEQ ID NO: 8793871 - DNA, 19 bp, Homo sapiens
ggtaaatgatacatgctga

SEQ ID NO: 8793872 - DNA, 22 bp, Homo sapiens
ggtaaattttatgtgatgaaac

SEQ ID NO: 8793873 - DNA, 22 bp, Homo sapiens
ggtactttatacatgcatctgc

SEQ ID NO: 8793874 - DNA, 22 bp, Homo sapiens
ggtacatttttctgtcactttg

SEQ ID NO: 8793875 - DNA, 22 bp, Homo sapiens
ggtaccaccaattcagctgcca

SEQ ID NO: 8793876 - DNA, 22 bp, Homo sapiens
ggtacagggcttcctggacaag

SEQ ID NO: 8793877 - DNA, 22 bp, Homo sapiens
ggtacaattctggggtatgctc

SEQ ID NO: 8793878 - DNA, 22 bp, Homo sapiens
ggtacaatggttcattttatgt

SEQ ID NO: 8793879 - DNA, 22 bp, Homo sapiens
ggtacaatgtcttacagaccca

SEQ ID NO: 8793880 - DNA, 22 bp, Homo sapiens
ggtacaatccactgtgggttag

SEQ ID NO: 8793881 - DNA, 22 bp, Homo sapiens
ggtacaatggaccataaaagct

SEQ ID NO: 8793882 - DNA, 22 bp, Homo sapiens
ggtacaaagttagatttaactt

SEQ ID NO: 8793883 - DNA, 22 bp, Homo sapiens
ggtacaaagttagatttaactt

SEQ ID NO: 8793884 - DNA, 17 bp, Homo sapiens
ggtacaaacccattttt

SEQ ID NO: 8793885 - DNA, 22 bp, Homo sapiens
ggtaaggagctccggcttctgc

SEQ ID NO: 8793886 - DNA, 22 bp, Homo sapiens
ggtaataagatctgttacatgg

SEQ ID NO: 8793887 - DNA, 22 bp, Homo sapiens
ggtaggagtattttgcagcagt

SEQ ID NO: 8793888 - DNA, 22 bp, Homo sapiens
ggtaggcactggtgggaagaga

SEQ ID NO: 8793889 - DNA, 22 bp, Homo sapiens
ggtaggcagatcactgtctatg

SEQ ID NO: 8793890 - DNA, 22 bp, Homo sapiens
ggtaggagtattttgcagcagt

SEQ ID NO: 8793891 - DNA, 22 bp, Homo sapiens
ggtagaattcacattcagttct

SEQ ID NO: 8793892 - DNA, 22 bp, Homo sapiens
ggtagactgagctccttgagga

SEQ ID NO: 8793893 - DNA, 20 bp, Homo sapiens
ggtagcagctgctgtcatcc

SEQ ID NO: 8793894 - DNA, 22 bp, Homo sapiens
ggtagcagggctgtgagtcaga

SEQ ID NO: 8793895 - DNA, 22 bp, Homo sapiens
ggtagctgcagcaggctggcaa

SEQ ID NO: 8793896 - DNA, 22 bp, Homo sapiens
ggtagctgcagcaggctggcaa

SEQ ID NO: 8793897 - DNA, 22 bp, Homo sapiens
ggtcagcatctggttgagggca

SEQ ID NO: 8793898 - DNA, 19 bp, Homo sapiens
ggtcaggaatttgacaata

SEQ ID NO: 8793899 - DNA, 22 bp, Homo sapiens
ggtcaggaaaagactccccaga

SEQ ID NO: 8793900 - DNA, 19 bp, Homo sapiens
ggtcaggaatttgacaata

SEQ ID NO: 8793901 - DNA, 22 bp, Homo sapiens
ggtcaggagcccttggccccct

SEQ ID NO: 8793902 - DNA, 22 bp, Homo sapiens
ggtcaggatccaagtctgtgct

SEQ ID NO: 8793903 - DNA, 21 bp, Homo sapiens
ggtcaggcatgtgccctgagc

SEQ ID NO: 8793904 - DNA, 22 bp, Homo sapiens
ggtcaggatccaagtctgtgct

SEQ ID NO: 8793905 - DNA, 22 bp, Homo sapiens
ggtcagccttggatttggtagc

SEQ ID NO: 8793906 - DNA, 22 bp, Homo sapiens
ggtcagccttggatttggtagc

SEQ ID NO: 8793907 - DNA, 19 bp, Homo sapiens
ggtcagctgggctagaggc

SEQ ID NO: 8793908 - DNA, 22 bp, Homo sapiens
ggtccagagtccttgctagaga

SEQ ID NO: 8793909 - DNA, 22 bp, Homo sapiens
ggtccaggatcaaggcatcacc

SEQ ID NO: 8793910 - DNA, 22 bp, Homo sapiens
ggtccaggtcctgtgacagcag

SEQ ID NO: 8793911 - DNA, 22 bp, Homo sapiens
ggtccaggtatgtggtgtgaat

SEQ ID NO: 8793912 - DNA, 22 bp, Homo sapiens
ggtccaggtatgtggtgtgaat

SEQ ID NO: 8793913 - DNA, 22 bp, Homo sapiens
ggtccagtcctgctcaccactt

SEQ ID NO: 8793914 - DNA, 22 bp, Homo sapiens
ggtccaggtcctgtgacagcag

SEQ ID NO: 8793915 - DNA, 22 bp, Homo sapiens
ggtccaggatcaaggcatcacc

SEQ ID NO: 8793916 - DNA, 22 bp, Homo sapiens
ggtccagggggtagatatgtga

SEQ ID NO: 8793917 - DNA, 22 bp, Homo sapiens
ggtccaggtatgtggtgtgaat

SEQ ID NO: 8793918 - DNA, 22 bp, Homo sapiens
ggtcagggctcttccagtggct

SEQ ID NO: 8793919 - DNA, 21 bp, Homo sapiens
ggtcaggcatgtgccctgagc

SEQ ID NO: 8793920 - DNA, 22 bp, Homo sapiens
ggtcaggccactcaacccttat

SEQ ID NO: 8793921 - DNA, 22 bp, Homo sapiens
ggtcaggggctgctctacagag

SEQ ID NO: 8793922 - DNA, 22 bp, Homo sapiens
ggtcaggggctgctctacagag

SEQ ID NO: 8793923 - DNA, 22 bp, Homo sapiens
gtgaggtccagtaacttgtcca

SEQ ID NO: 8793924 - DNA, 22 bp, Homo sapiens
gtgaggcagggaaagaggataa

SEQ ID NO: 8793925 - DNA, 22 bp, Homo sapiens
gtgaggccgcacgccccggagt

SEQ ID NO: 8793926 - DNA, 22 bp, Homo sapiens
gtgaggcattgaagaccggaat

SEQ ID NO: 8793927 - DNA, 22 bp, Homo sapiens
gtgaggtgactagcaggtgggg

SEQ ID NO: 8793928 - DNA, 22 bp, Homo sapiens
gtgaggtcctaatagacatcga

SEQ ID NO: 8793929 - DNA, 22 bp, Homo sapiens
gtgaggtgagtagtgagaagcc

SEQ ID NO: 8793930 - DNA, 22 bp, Homo sapiens
gtgaggtgagtagtgagaagcc

SEQ ID NO: 8793931 - DNA, 22 bp, Homo sapiens
gtcttctggggccaggcccgct

SEQ ID NO: 8793932 - DNA, 22 bp, Homo sapiens
gtcttctggaagagagccagct

SEQ ID NO: 8793933 - DNA, 22 bp, Homo sapiens
gtcttctgcctccattagagtt

SEQ ID NO: 8793934 - DNA, 22 bp, Homo sapiens
gtcttctggaagagagccagct

SEQ ID NO: 8793935 - DNA, 22 bp, Homo sapiens
gtcttctgtctgtctggcatgt

SEQ ID NO: 8793936 - DNA, 22 bp, Homo sapiens
gtcttctgttctgtgaggcttc

SEQ ID NO: 8793937 - DNA, 20 bp, Homo sapiens
gtcttctattcccagaaagt

SEQ ID NO: 8793938 - DNA, 22 bp, Homo sapiens
gtcttcttgtgttgcctgtctt

SEQ ID NO: 8793939 - DNA, 22 bp, Homo sapiens
gtcttcttgttttgaaggaaat

SEQ ID NO: 8793940 - DNA, 22 bp, Homo sapiens
gtcttctttgtcatcttaggtt

SEQ ID NO: 8793941 - DNA, 22 bp, Homo sapiens
gtcttgaaattctgttaaagga

SEQ ID NO: 8793942 - DNA, 22 bp, Homo sapiens
gtcttcttttcagtctgcttgt

SEQ ID NO: 8793943 - DNA, 22 bp, Homo sapiens
gtcttcttttcagtctgcttgt

SEQ ID NO: 8793944 - DNA, 22 bp, Homo sapiens
gtcttcttttcagtctgcttgt

SEQ ID NO: 8793945 - DNA, 22 bp, Homo sapiens
gtgagtcaagcagaaacgtgga

SEQ ID NO: 8793946 - DNA, 22 bp, Homo sapiens
gtgagtgttaacccactgcttc

SEQ ID NO: 8793947 - DNA, 22 bp, Homo sapiens
gtgataaaattcaaatagctct

SEQ ID NO: 8793948 - DNA, 22 bp, Homo sapiens
gtgataaaatagaaacagtggt

SEQ ID NO: 8793949 - DNA, 22 bp, Homo sapiens
gtgataaaattcaaatagctct

SEQ ID NO: 8793950 - DNA, 22 bp, Homo sapiens
gtgataaaggggaggaagtgtg

SEQ ID NO: 8793951 - DNA, 22 bp, Homo sapiens
gtgataaaggggaggaagtgtg

SEQ ID NO: 8793952 - DNA, 22 bp, Homo sapiens
gtgataaagacgtgtcataatt

SEQ ID NO: 8793953 - DNA, 22 bp, Homo sapiens
gtgagtaaaggttcattgaatt

SEQ ID NO: 8793954 - DNA, 22 bp, Homo sapiens
gtgagtctgcctagcacatcac

SEQ ID NO: 8793955 - DNA, 22 bp, Homo sapiens
gtgaggtggtacaatattaact

SEQ ID NO: 8793956 - DNA, 22 bp, Homo sapiens
gtgaggtggtacaatattaact

SEQ ID NO: 8793957 - DNA, 22 bp, Homo sapiens
gtgagtcttaagcaccaccttt

SEQ ID NO: 8793958 - DNA, 23 bp, Homo sapiens
gtgagtcttgcctttgctgtgga

SEQ ID NO: 8793959 - DNA, 22 bp, Homo sapiens
gtgagtctttggagacagttca

SEQ ID NO: 8793960 - DNA, 22 bp, Homo sapiens
gtgagtctgtggaccgggcact

SEQ ID NO: 8793961 - DNA, 22 bp, Homo sapiens
gtgagtctgtgggtgggaactg

SEQ ID NO: 8793962 - DNA, 22 bp, Homo sapiens
gtgagtcttaagcaccaccttt

SEQ ID NO: 8793963 - DNA, 22 bp, Homo sapiens
gtgataactcaggcagagaata

SEQ ID NO: 8793964 - DNA, 22 bp, Homo sapiens
gtgataagacagtaggcacaag

SEQ ID NO: 8793965 - DNA, 22 bp, Homo sapiens
gtgataagacagtaggcacaag

SEQ ID NO: 8793966 - DNA, 22 bp, Homo sapiens
gtgataggtttacacctgagca

SEQ ID NO: 8793967 - DNA, 22 bp, Homo sapiens
gtgataggcatttaactctaag

SEQ ID NO: 8793968 - DNA, 22 bp, Homo sapiens
gtgatcctataaagtgagcaca

SEQ ID NO: 8793969 - DNA, 22 bp, Homo sapiens
gtgatatttcaagagtggggca

SEQ ID NO: 8793970 - DNA, 22 bp, Homo sapiens
gtgatgtcacagaataagtgat

SEQ ID NO: 8793971 - DNA, 22 bp, Homo sapiens
gtgattaactgcagttagagct

SEQ ID NO: 8793972 - DNA, 22 bp, Homo sapiens
gtgattaactgcagttagagct

SEQ ID NO: 8793973 - DNA, 22 bp, Homo sapiens
gtgatgggtaactgtttaggga

SEQ ID NO: 8793974 - DNA, 22 bp, Homo sapiens
gtgatgaagtaaatgttattta

SEQ ID NO: 8793975 - DNA, 22 bp, Homo sapiens
gtctcctgagccttgactgcaa

SEQ ID NO: 8793976 - DNA, 22 bp, Homo sapiens
gtctcctgccacactcagtccc

SEQ ID NO: 8793977 - DNA, 22 bp, Homo sapiens
gtctcctggctgcagctaagac

SEQ ID NO: 8793978 - DNA, 22 bp, Homo sapiens
gtctcgctgagcccccattcta

SEQ ID NO: 8793979 - DNA, 22 bp, Homo sapiens
gtctctctgctaggcctccagt

SEQ ID NO: 8793980 - DNA, 22 bp, Homo sapiens
gtctctctgctaggcctccagt

SEQ ID NO: 8793981 - DNA, 22 bp, Homo sapiens
gtctctctcccaagattggcta

SEQ ID NO: 8793982 - DNA, 22 bp, Homo sapiens
gtctctctgactggtccacacc

SEQ ID NO: 8793983 - DNA, 22 bp, Homo sapiens
gtctctatcatagctgaaccct

SEQ ID NO: 8793984 - DNA, 22 bp, Homo sapiens
gtctctatcatagctgaaccct

SEQ ID NO: 8793985 - DNA, 22 bp, Homo sapiens
gtctctgaagtcagtttttcta

SEQ ID NO: 8793986 - DNA, 22 bp, Homo sapiens
gtctggggtactttcatctgat

SEQ ID NO: 8793987 - DNA, 22 bp, Homo sapiens
gtcttattatgaggttagactt

SEQ ID NO: 8793988 - DNA, 22 bp, Homo sapiens
gtcttattaaaatgcagtttct

SEQ ID NO: 8793989 - DNA, 22 bp, Homo sapiens
gtcttattgcgtatgtatacaa

SEQ ID NO: 8793990 - DNA, 22 bp, Homo sapiens
gtctgggtctccacagtcagca

SEQ ID NO: 8793991 - DNA, 22 bp, Homo sapiens
gtctgggtctccacagtcagca

SEQ ID NO: 8793992 - DNA, 22 bp, Homo sapiens
gtctgggttaagtcctgataat

SEQ ID NO: 8793993 - DNA, 22 bp, Homo sapiens
gtctgggtttcatgggcactgg

SEQ ID NO: 8793994 - DNA, 22 bp, Homo sapiens
gtctgggtttcatgggcactgg

SEQ ID NO: 8793995 - DNA, 22 bp, Homo sapiens
gtcttatagtacaatttgaagt

SEQ ID NO: 8793996 - DNA, 22 bp, Homo sapiens
gtcttagatttcaccgataatg

SEQ ID NO: 8793997 - DNA, 19 bp, Homo sapiens
gtcttctgaatgtggctgc

SEQ ID NO: 8793998 - DNA, 22 bp, Homo sapiens
gtcttctgatctggttagccat

SEQ ID NO: 8793999 - DNA, 22 bp, Homo sapiens
gtcttctgcaactgcacctgcc

SEQ ID NO: 8794000 - DNA, 22 bp, Homo sapiens
gtcttctgcccaggcagacgga

SEQ ID NO: 8794001 - DNA, 22 bp, Homo sapiens
gtcttcaattgcatttgatggg

SEQ ID NO: 8794002 - DNA, 22 bp, Homo sapiens
gtcttcctaatttgctattagg

SEQ ID NO: 8794003 - DNA, 22 bp, Homo sapiens
gtcttcctaatttgctattagg

SEQ ID NO: 8794004 - DNA, 22 bp, Homo sapiens
gtcttccacatttcaagaggct

SEQ ID NO: 8794005 - DNA, 20 bp, Homo sapiens
gtcttatttaacacatgact

SEQ ID NO: 8794006 - DNA, 22 bp, Homo sapiens
gtcttcaacaataactaccact

SEQ ID NO: 8794007 - DNA, 22 bp, Homo sapiens
gtcttcaactggactccaggga

SEQ ID NO: 8794008 - DNA, 22 bp, Homo sapiens
gtcttcaattgcatttgatggg

SEQ ID NO: 8794009 - DNA, 22 bp, Homo sapiens
gtcttcaatagagcctcaattt

SEQ ID NO: 8794010 - DNA, 22 bp, Homo sapiens
gtcttcaacaaatggtagggtc

SEQ ID NO: 8794011 - DNA, 21 bp, Homo sapiens
gtcttcaaaggcagtgggcag

SEQ ID NO: 8794012 - DNA, 22 bp, Homo sapiens
gtgctggggagataggaagaga

SEQ ID NO: 8794013 - DNA, 22 bp, Homo sapiens
gtgctggggagataggaagaga

SEQ ID NO: 8794014 - DNA, 22 bp, Homo sapiens
gtgctggggagataggaagaga

SEQ ID NO: 8794015 - DNA, 22 bp, Homo sapiens
gtgctggggagataggaagaga

SEQ ID NO: 8794016 - DNA, 22 bp, Homo sapiens
gtgctgggggtttctgtaggtc

SEQ ID NO: 8794017 - DNA, 22 bp, Homo sapiens
gtgctgggattacaggtgtgag

SEQ ID NO: 8794018 - DNA, 22 bp, Homo sapiens
gtgctgggctccaccccagagg

SEQ ID NO: 8794019 - DNA, 22 bp, Homo sapiens
gtgctgggggtttctgtaggtc

SEQ ID NO: 8794020 - DNA, 22 bp, Homo sapiens
gtgctgggggtttctgtaggtc

SEQ ID NO: 8794021 - DNA, 22 bp, Homo sapiens
gtgctgggtgctgcagacaggt

SEQ ID NO: 8794022 - DNA, 22 bp, Homo sapiens
gtgctgggtgctgcagacaggt

SEQ ID NO: 8794023 - DNA, 22 bp, Homo sapiens
gtgctgggtgctgcagacaggt

SEQ ID NO: 8794024 - DNA, 22 bp, Homo sapiens
gtgctgtacttctgtgttgaag

SEQ ID NO: 8794025 - DNA, 22 bp, Homo sapiens
gtgctgtaacaacagagtgtct

SEQ ID NO: 8794026 - DNA, 22 bp, Homo sapiens
gtgcttctttctcctcaagcct

SEQ ID NO: 8794027 - DNA, 23 bp, Homo sapiens
gtgctgtgagccccttggcctcc

SEQ ID NO: 8794028 - DNA, 23 bp, Homo sapiens
gtgctgtgagccccttggcctcc

SEQ ID NO: 8794029 - DNA, 22 bp, Homo sapiens
gtgcttggaccaggtcatcttc

SEQ ID NO: 8794030 - DNA, 22 bp, Homo sapiens
gtgctgtatcagaatctgctct

SEQ ID NO: 8794031 - DNA, 22 bp, Homo sapiens
gtgctggtatatgactgagttt

SEQ ID NO: 8794032 - DNA, 22 bp, Homo sapiens
gtgccctggctcacagtgtctc

SEQ ID NO: 8794033 - DNA, 22 bp, Homo sapiens
gtgccctgggccttcagggcca

SEQ ID NO: 8794034 - DNA, 22 bp, Homo sapiens
gtgccctgggccttcagggcca

SEQ ID NO: 8794035 - DNA, 22 bp, Homo sapiens
gtgccctggtccccagcatata

SEQ ID NO: 8794036 - DNA, 22 bp, Homo sapiens
gtgccctggggtgaacccctgg

SEQ ID NO: 8794037 - DNA, 22 bp, Homo sapiens
gtgccctgtctcttgtctccag

SEQ ID NO: 8794038 - DNA, 22 bp, Homo sapiens
gtgccctgtgaactgtaaggaa

SEQ ID NO: 8794039 - DNA, 22 bp, Homo sapiens
gtgccctgttcatttctctccc

SEQ ID NO: 8794040 - DNA, 20 bp, Homo sapiens
gtgccctgtgggctattttc

SEQ ID NO: 8794041 - DNA, 20 bp, Homo sapiens
gtgccctgtgggctattttc

SEQ ID NO: 8794042 - DNA, 22 bp, Homo sapiens
gtgccctgttgcacacttgagg

SEQ ID NO: 8794043 - DNA, 22 bp, Homo sapiens
gtgcccttataatagagaccca

SEQ ID NO: 8794044 - DNA, 21 bp, Homo sapiens
gtgccctgttcccacatgccc

SEQ ID NO: 8794045 - DNA, 21 bp, Homo sapiens
gtgccctgttcccacatgccc

SEQ ID NO: 8794046 - DNA, 22 bp, Homo sapiens
gtgctgggattacaggtgtgag

SEQ ID NO: 8794047 - DNA, 22 bp, Homo sapiens
gtgcctgaaagccatgctcact

SEQ ID NO: 8794048 - DNA, 22 bp, Homo sapiens
gtgcctctgagctctgctacag

SEQ ID NO: 8794049 - DNA, 22 bp, Homo sapiens
gtgcctctcattggctgagccc

SEQ ID NO: 8794050 - DNA, 22 bp, Homo sapiens
gtgcctctcattggctgagccc

SEQ ID NO: 8794051 - DNA, 22 bp, Homo sapiens
gtgcctcccggggctcttcctt

SEQ ID NO: 8794052 - DNA, 22 bp, Homo sapiens
gtgccgcgacgcagtcggtgcc

SEQ ID NO: 8794053 - DNA, 22 bp, Homo sapiens
gtgccgtgggccttagtgatct

SEQ ID NO: 8794054 - DNA, 22 bp, Homo sapiens
gtgattttgagacctatatagt

SEQ ID NO: 8794055 - DNA, 22 bp, Homo sapiens
gtgcaaaaataattgtggtttt

SEQ ID NO: 8794056 - DNA, 22 bp, Homo sapiens
gtgcaaaaggcattgtggtttt

SEQ ID NO: 8794057 - DNA, 22 bp, Homo sapiens
gtgcaaaagcagttgtggtttt

SEQ ID NO: 8794058 - DNA, 22 bp, Homo sapiens
gtgcaaaagcaattgcagtttt

SEQ ID NO: 8794059 - DNA, 22 bp, Homo sapiens
gtgcaaaagtaactgtggtttt

SEQ ID NO: 8794060 - DNA, 22 bp, Homo sapiens
gtgcaaatgtaattgtgatttt

SEQ ID NO: 8794061 - DNA, 22 bp, Homo sapiens
gtgcaaaagtaaatgtggtttt

SEQ ID NO: 8794062 - DNA, 22 bp, Homo sapiens
gtgatttctaatcatctgaatg

SEQ ID NO: 8794063 - DNA, 22 bp, Homo sapiens
gtgattctgatatagctaaagt

SEQ ID NO: 8794064 - DNA, 22 bp, Homo sapiens
gtgattaagcatttcagaattt

SEQ ID NO: 8794065 - DNA, 22 bp, Homo sapiens
gtgattaagcatttcagaattt

SEQ ID NO: 8794066 - DNA, 22 bp, Homo sapiens
gtgattaatgccaatgggcctt

SEQ ID NO: 8794067 - DNA, 22 bp, Homo sapiens
gtgattatagaatgctacaaag

SEQ ID NO: 8794068 - DNA, 22 bp, Homo sapiens
gtgattaataatggccatgcat

SEQ ID NO: 8794069 - DNA, 22 bp, Homo sapiens
gtgattaatgctgttggagata

SEQ ID NO: 8794070 - DNA, 22 bp, Homo sapiens
gtgattatatttctatgtgaat

SEQ ID NO: 8794071 - DNA, 22 bp, Homo sapiens
gtgattatgttatattaaggca

SEQ ID NO: 8794072 - DNA, 22 bp, Homo sapiens
gtgattcacatctcagatgggc

SEQ ID NO: 8794073 - DNA, 22 bp, Homo sapiens
gtgattatttgtgattaaggag

SEQ ID NO: 8794074 - DNA, 22 bp, Homo sapiens
gtgcacagaaacatacaatgtg

SEQ ID NO: 8794075 - DNA, 22 bp, Homo sapiens
gtgcacagaaacatacaatgtg

SEQ ID NO: 8794076 - DNA, 22 bp, Homo sapiens
gtgcacagaaacatacaatgtg

SEQ ID NO: 8794077 - DNA, 22 bp, Homo sapiens
gtgcccaggggccagctgccgg

SEQ ID NO: 8794078 - DNA, 22 bp, Homo sapiens
gtgcccaggggccagctgccgg

SEQ ID NO: 8794079 - DNA, 22 bp, Homo sapiens
gtgccctgagcttatgcattct

SEQ ID NO: 8794080 - DNA, 22 bp, Homo sapiens
gtgccctgaggtcttcactttg

SEQ ID NO: 8794081 - DNA, 22 bp, Homo sapiens
gtgccctgagcttatgcattct

SEQ ID NO: 8794082 - DNA, 22 bp, Homo sapiens
gtgccctgacacacctggtgtg

SEQ ID NO: 8794083 - DNA, 22 bp, Homo sapiens
gtgcccaggtgtccctgagaag

SEQ ID NO: 8794084 - DNA, 22 bp, Homo sapiens
gtgccctgagtgggtaggagag

SEQ ID NO: 8794085 - DNA, 22 bp, Homo sapiens
gtgccctgatcgctaggctccc

SEQ ID NO: 8794086 - DNA, 22 bp, Homo sapiens
gtgccctgatcgctaggctccc

SEQ ID NO: 8794087 - DNA, 22 bp, Homo sapiens
gtgccctggatgactttggtct

SEQ ID NO: 8794088 - DNA, 22 bp, Homo sapiens
gtgccctgcatgccccgggtat

SEQ ID NO: 8794089 - DNA, 22 bp, Homo sapiens
gtgccctggaggggttgaaggg

SEQ ID NO: 8794090 - DNA, 22 bp, Homo sapiens
gtgccctgatgcaattgtctca

SEQ ID NO: 8794091 - DNA, 22 bp, Homo sapiens
gtgccctgatgcaattgtctca

SEQ ID NO: 8794092 - DNA, 22 bp, Homo sapiens
gtgccctgatgcaattgtctca

SEQ ID NO: 8794093 - DNA, 22 bp, Homo sapiens
gtgcaatagactgtggtattaa

SEQ ID NO: 8794094 - DNA, 20 bp, Homo sapiens
gtgcaatggcaccatctcag

SEQ ID NO: 8794095 - DNA, 20 bp, Homo sapiens
gtgcaatggcgcaatctcgg

SEQ ID NO: 8794096 - DNA, 22 bp, Homo sapiens
gtgcaattcactgttatgtctg

SEQ ID NO: 8794097 - DNA, 22 bp, Homo sapiens
gtgcaattctagtgtccctaaa

SEQ ID NO: 8794098 - DNA, 22 bp, Homo sapiens
gtgcaattttgcatctgtatgc

SEQ ID NO: 8794099 - DNA, 22 bp, Homo sapiens
gtgcaattttgcatctgtatgc

SEQ ID NO: 8794100 - DNA, 22 bp, Homo sapiens
gtgcacacaagcaatgcactta

SEQ ID NO: 8794101 - DNA, 22 bp, Homo sapiens
gtgcaaccatcaccactgactc

SEQ ID NO: 8794102 - DNA, 22 bp, Homo sapiens
gtgcaaatgtaattgtggtttt

SEQ ID NO: 8794103 - DNA, 22 bp, Homo sapiens
gtgcaaattccactggaaagct

SEQ ID NO: 8794104 - DNA, 22 bp, Homo sapiens
gtgcaatattgccatgttcttg

SEQ ID NO: 8794105 - DNA, 22 bp, Homo sapiens
gtgcaagtccagaaagaactct

SEQ ID NO: 8794106 - DNA, 22 bp, Homo sapiens
gtgcaataaataaatagattgt

SEQ ID NO: 8794107 - DNA, 22 bp, Homo sapiens
gtgcaaggtacatccttgatgt

SEQ ID NO: 8794108 - DNA, 22 bp, Homo sapiens
gtgcaagacttcctaagcaata

SEQ ID NO: 8794109 - DNA, 19 bp, Homo sapiens
gtcctcatgttgttctcca

SEQ ID NO: 8794110 - DNA, 22 bp, Homo sapiens
gtcctccatggtcttgaagtaa

SEQ ID NO: 8794111 - DNA, 22 bp, Homo sapiens
gtcctcgcggcgcgaagccagt

SEQ ID NO: 8794112 - DNA, 19 bp, Homo sapiens
gtcctctcaacaacccggg

SEQ ID NO: 8794113 - DNA, 22 bp, Homo sapiens
gtcctctgaaagatgaaccatg

SEQ ID NO: 8794114 - DNA, 22 bp, Homo sapiens
gtcctctgaagttgtgcaatgc

SEQ ID NO: 8794115 - DNA, 22 bp, Homo sapiens
gtcctctccaggaggctctgat

SEQ ID NO: 8794116 - DNA, 22 bp, Homo sapiens
gtcctctgagggggctgcacgc

SEQ ID NO: 8794117 - DNA, 22 bp, Homo sapiens
gtcctctgagggggctgcacgc

SEQ ID NO: 8794118 - DNA, 22 bp, Homo sapiens
gtcctctgagggggctgcacgc

SEQ ID NO: 8794119 - DNA, 22 bp, Homo sapiens
gtcctctgactcagccttggga

SEQ ID NO: 8794120 - DNA, 22 bp, Homo sapiens
gtcctctgatttctaggtatat

SEQ ID NO: 8794121 - DNA, 22 bp, Homo sapiens
gtcctctgcccaggtcaaggtt

SEQ ID NO: 8794122 - DNA, 22 bp, Homo sapiens
gtctcctccctttcattcacct

SEQ ID NO: 8794123 - DNA, 20 bp, Homo sapiens
gtctcctctttgcattccta

SEQ ID NO: 8794124 - DNA, 22 bp, Homo sapiens
gtctcctaaaccatcctggtac

SEQ ID NO: 8794125 - DNA, 22 bp, Homo sapiens
gtctccccagggccctcttcat

SEQ ID NO: 8794126 - DNA, 22 bp, Homo sapiens
gtctcccatcgtttgtgaggaa

SEQ ID NO: 8794127 - DNA, 22 bp, Homo sapiens
gtcctctgcccaggtcaaggtt

SEQ ID NO: 8794128 - DNA, 22 bp, Homo sapiens
gtcctctgcttcatgccctgat

SEQ ID NO: 8794129 - DNA, 22 bp, Homo sapiens
gtccctggagctgagcagtgct

SEQ ID NO: 8794130 - DNA, 22 bp, Homo sapiens
gtccctggagctgagcagtgct

SEQ ID NO: 8794131 - DNA, 22 bp, Homo sapiens
gtccctggagctgagcagtgct

SEQ ID NO: 8794132 - DNA, 22 bp, Homo sapiens
gtccctggatctgggacagctg

SEQ ID NO: 8794133 - DNA, 22 bp, Homo sapiens
gtccctggagctgagcagtgct

SEQ ID NO: 8794134 - DNA, 22 bp, Homo sapiens
gtccctggatctgggacagctg

SEQ ID NO: 8794135 - DNA, 22 bp, Homo sapiens
gtccctggatctgggacagctg

SEQ ID NO: 8794136 - DNA, 22 bp, Homo sapiens
gtccctggatctgggacagctg

SEQ ID NO: 8794137 - DNA, 22 bp, Homo sapiens
gtccctggatctgggacagctg

SEQ ID NO: 8794138 - DNA, 22 bp, Homo sapiens
gtcatttctgtttcttcagtgc

SEQ ID NO: 8794139 - DNA, 22 bp, Homo sapiens
gtcattttatgggaacagattt

SEQ ID NO: 8794140 - DNA, 22 bp, Homo sapiens
gtccctggagctgagcagtgct

SEQ ID NO: 8794141 - DNA, 22 bp, Homo sapiens
gtcattgagtcgtcagagtctt

SEQ ID NO: 8794142 - DNA, 22 bp, Homo sapiens
gtcctcaggcttgagtgtttat

SEQ ID NO: 8794143 - DNA, 22 bp, Homo sapiens
gtcctcaggcttgagtgtttat

SEQ ID NO: 8794144 - DNA, 22 bp, Homo sapiens
gtcctcagggagtcccagtcat

SEQ ID NO: 8794145 - DNA, 22 bp, Homo sapiens
gtcctcagagtgggcaggtcct

SEQ ID NO: 8794146 - DNA, 22 bp, Homo sapiens
gtcaatatattctgtctctttg

SEQ ID NO: 8794147 - DNA, 22 bp, Homo sapiens
gtcaatatattctgtctctttg

SEQ ID NO: 8794148 - DNA, 22 bp, Homo sapiens
gtcacaaagcgcggtggtcggt

SEQ ID NO: 8794149 - DNA, 22 bp, Homo sapiens
gtcaattagtggcaatttcata

SEQ ID NO: 8794150 - DNA, 22 bp, Homo sapiens
gtcaatcagaaatcatgttaca

SEQ ID NO: 8794151 - DNA, 22 bp, Homo sapiens
gtcaatgctttagtttctggta

SEQ ID NO: 8794152 - DNA, 22 bp, Homo sapiens
gtcaattagctaaaatttggta

SEQ ID NO: 8794153 - DNA, 22 bp, Homo sapiens
gtcaatatcttggttgtactat

SEQ ID NO: 8794154 - DNA, 22 bp, Homo sapiens
gtcacaaaggtgagggacatga

SEQ ID NO: 8794155 - DNA, 22 bp, Homo sapiens
gtcacaaaggtgagggacatga

SEQ ID NO: 8794156 - DNA, 22 bp, Homo sapiens
gtcacaaagcgcggtggtcggt

SEQ ID NO: 8794157 - DNA, 22 bp, Homo sapiens
gtcacaaatcccctcagcaact

SEQ ID NO: 8794158 - DNA, 22 bp, Homo sapiens
gtcacaggtgtggaggtgctgg

SEQ ID NO: 8794159 - DNA, 22 bp, Homo sapiens
gtcacaggtgtggaggtgctgg

SEQ ID NO: 8794160 - DNA, 22 bp, Homo sapiens
gtcacagtatcatgtttgaatg

SEQ ID NO: 8794161 - DNA, 22 bp, Homo sapiens
gtcacatggaattgactagagt

SEQ ID NO: 8794162 - DNA, 22 bp, Homo sapiens
gtcacatgccagtgcacacagg

SEQ ID NO: 8794163 - DNA, 22 bp, Homo sapiens
gtcacattcatgcagaatcaaa

SEQ ID NO: 8794164 - DNA, 22 bp, Homo sapiens
gtcaccaggtctgatgcagcca

SEQ ID NO: 8794165 - DNA, 22 bp, Homo sapiens
gtcaccagtcccagctcctgaa

SEQ ID NO: 8794166 - DNA, 22 bp, Homo sapiens
gtcagtgtcttaacagagatta

SEQ ID NO: 8794167 - DNA, 20 bp, Homo sapiens
gtcagtgtcttcagtagtga

SEQ ID NO: 8794168 - DNA, 22 bp, Homo sapiens
gtcagtgtgagttgattccata

SEQ ID NO: 8794169 - DNA, 22 bp, Homo sapiens
gtcattcaactgcacattaggt

SEQ ID NO: 8794170 - DNA, 22 bp, Homo sapiens
gtcattcagagatgcaggtaga

SEQ ID NO: 8794171 - DNA, 22 bp, Homo sapiens
gtcataaaatttgtggattaga

SEQ ID NO: 8794172 - DNA, 22 bp, Homo sapiens
gtcattcaactgcacattaggt

SEQ ID NO: 8794173 - DNA, 22 bp, Homo sapiens
gtcattcagagatgcaggtaga

SEQ ID NO: 8794174 - DNA, 22 bp, Homo sapiens
gtcagtaggaacctagggtcaa

SEQ ID NO: 8794175 - DNA, 22 bp, Homo sapiens
gtcaggggatgtgctggtggcc

SEQ ID NO: 8794176 - DNA, 22 bp, Homo sapiens
gtcaggggccatgggccaagga

SEQ ID NO: 8794177 - DNA, 23 bp, Homo sapiens
gtcagggctggggtcagagtgac

SEQ ID NO: 8794178 - DNA, 22 bp, Homo sapiens
gtcaggggatgtgctggtggcc

SEQ ID NO: 8794179 - DNA, 23 bp, Homo sapiens
gtcagggctggggtcagagtgac

SEQ ID NO: 8794180 - DNA, 22 bp, Homo sapiens
gtcagtgtaggttcatcagtgg

SEQ ID NO: 8794181 - DNA, 22 bp, Homo sapiens
gtcagtaggaacctagggtcaa

SEQ ID NO: 8794182 - DNA, 22 bp, Homo sapiens
gtcagtgcttgaagggcagaga

SEQ ID NO: 8794183 - DNA, 22 bp, Homo sapiens
gtagaggacatttgacatgatg

SEQ ID NO: 8794184 - DNA, 22 bp, Homo sapiens
gtagaggacatttgacatgatg

SEQ ID NO: 8794185 - DNA, 22 bp, Homo sapiens
gtagacagcaaccaaaccaggt

SEQ ID NO: 8794186 - DNA, 22 bp, Homo sapiens
gtagacaggttataaatcagtg

SEQ ID NO: 8794187 - DNA, 22 bp, Homo sapiens
gtagattccagtggtctgtgtc

SEQ ID NO: 8794188 - DNA, 22 bp, Homo sapiens
gtagatatggctcaaaggcatg

SEQ ID NO: 8794189 - DNA, 22 bp, Homo sapiens
gtagaggggtgattctgtgaga

SEQ ID NO: 8794190 - DNA, 22 bp, Homo sapiens
gtagcagcagagcaggtcctcc

SEQ ID NO: 8794191 - DNA, 22 bp, Homo sapiens
gtagcaatgttgaacactgcgt

SEQ ID NO: 8794192 - DNA, 22 bp, Homo sapiens
gtagatgagctcacatgacctt

SEQ ID NO: 8794193 - DNA, 22 bp, Homo sapiens
gtagattccagtggtctgtgtc

SEQ ID NO: 8794194 - DNA, 22 bp, Homo sapiens
gtagcaaagggacggctctaga

SEQ ID NO: 8794195 - DNA, 18 bp, Homo sapiens
gtagcaaaggagttactt

SEQ ID NO: 8794196 - DNA, 22 bp, Homo sapiens
gtagcatctgttggctgctcct

SEQ ID NO: 8794197 - DNA, 22 bp, Homo sapiens
gtagccattggcaatgaagcct

SEQ ID NO: 8794198 - DNA, 22 bp, Homo sapiens
gtagcccacctggggagggcga

SEQ ID NO: 8794199 - DNA, 22 bp, Homo sapiens
gtagcccacctggggagggcga

SEQ ID NO: 8794200 - DNA, 22 bp, Homo sapiens
gtagctagtagttcagagaaca

SEQ ID NO: 8794201 - DNA, 22 bp, Homo sapiens
gtcaacagtattaggacatttg

SEQ ID NO: 8794202 - DNA, 22 bp, Homo sapiens
gtcaacatcggaaagcgtgtaa

SEQ ID NO: 8794203 - DNA, 22 bp, Homo sapiens
gtcaactgtacctaaagaaagt

SEQ ID NO: 8794204 - DNA, 22 bp, Homo sapiens
gtcaacatttactgccctggcc

SEQ ID NO: 8794205 - DNA, 22 bp, Homo sapiens
gtcaacatgttctgggtgaatg

SEQ ID NO: 8794206 - DNA, 22 bp, Homo sapiens
gtcaagatgagaattcttttta

SEQ ID NO: 8794207 - DNA, 22 bp, Homo sapiens
gtcaaggcagcagggcctgtgg

SEQ ID NO: 8794208 - DNA, 22 bp, Homo sapiens
gtcaaggcactgacagcctgag

SEQ ID NO: 8794209 - DNA, 22 bp, Homo sapiens
gtcaaggcactgacagcctgag

SEQ ID NO: 8794210 - DNA, 22 bp, Homo sapiens
gtcaaggctactgagtgccctg

SEQ ID NO: 8794211 - DNA, 22 bp, Homo sapiens
gtcaagtttatccgctcattca

SEQ ID NO: 8794212 - DNA, 22 bp, Homo sapiens
gtcaagttaagataaggtcatg

SEQ ID NO: 8794213 - DNA, 19 bp, Homo sapiens
gtcaataaaagttaggggt

SEQ ID NO: 8794214 - DNA, 22 bp, Homo sapiens
gtagctctgtttaaagttcttt

SEQ ID NO: 8794215 - DNA, 22 bp, Homo sapiens
gtagctctgtttaaagttcttt

SEQ ID NO: 8794216 - DNA, 22 bp, Homo sapiens
gtagctctgtttaaagttcttt

SEQ ID NO: 8794217 - DNA, 22 bp, Homo sapiens
gtagctgtctcggtcaggagtt

SEQ ID NO: 8794218 - DNA, 22 bp, Homo sapiens
gtagcttcaagtactctccctg

SEQ ID NO: 8794219 - DNA, 22 bp, Homo sapiens
gtagctgatattagcaatgagt

SEQ ID NO: 8794220 - DNA, 22 bp, Homo sapiens
gtagctgatcctgaggacaggg

SEQ ID NO: 8794221 - DNA, 22 bp, Homo sapiens
gtagctgcatattttcttagaa

SEQ ID NO: 8794222 - DNA, 22 bp, Homo sapiens
gtaggaaatcaggggtttaagc

SEQ ID NO: 8794223 - DNA, 22 bp, Homo sapiens
gtaggaaagggagtgaagggaa

SEQ ID NO: 8794224 - DNA, 22 bp, Homo sapiens
gtaggaaagggagtgaagggaa

SEQ ID NO: 8794225 - DNA, 22 bp, Homo sapiens
gtaggaaagtaaatgaaataca

SEQ ID NO: 8794226 - DNA, 22 bp, Homo sapiens
gtagcttccagaaagtgtcttt

SEQ ID NO: 8794227 - DNA, 22 bp, Homo sapiens
gtagcttattagggataatagt

SEQ ID NO: 8794228 - DNA, 22 bp, Homo sapiens
gtagctttatagtgaataaacc

SEQ ID NO: 8794229 - DNA, 22 bp, Homo sapiens
gtaacagcgtgtatgttatcag

SEQ ID NO: 8794230 - DNA, 19 bp, Homo sapiens
gtaacagctctgggttcac

SEQ ID NO: 8794231 - DNA, 22 bp, Homo sapiens
gtaacagagggtttgcagatat

SEQ ID NO: 8794232 - DNA, 22 bp, Homo sapiens
gtaacactagctctgtcacttt

SEQ ID NO: 8794233 - DNA, 22 bp, Homo sapiens
gtaacactggcaccgtctcaca

SEQ ID NO: 8794234 - DNA, 22 bp, Homo sapiens
gtaacacatgatgggttccagt

SEQ ID NO: 8794235 - DNA, 22 bp, Homo sapiens
gtaacacatgatgggttccagt

SEQ ID NO: 8794236 - DNA, 22 bp, Homo sapiens
gtaacactagctctgtcacttt

SEQ ID NO: 8794237 - DNA, 22 bp, Homo sapiens
gtaacacagaaatgaaattcca

SEQ ID NO: 8794238 - DNA, 17 bp, Homo sapiens
gtaaggcttgcagatgc

SEQ ID NO: 8794239 - DNA, 17 bp, Homo sapiens
gtaaggcttgcagatgc

SEQ ID NO: 8794240 - DNA, 22 bp, Homo sapiens
gtaacagaaagtcatgctcatt

SEQ ID NO: 8794241 - DNA, 17 bp, Homo sapiens
gtaaggcttgcagatgc

SEQ ID NO: 8794242 - DNA, 22 bp, Homo sapiens
gtaacattattcatgagataca

SEQ ID NO: 8794243 - DNA, 22 bp, Homo sapiens
gtaacatagtttgtgcttcatc

SEQ ID NO: 8794244 - DNA, 22 bp, Homo sapiens
gtaaggttaccaggttttgaga

SEQ ID NO: 8794245 - DNA, 22 bp, Homo sapiens
gtaagggcctaataggacgcag

SEQ ID NO: 8794246 - DNA, 22 bp, Homo sapiens
gtaagtaataagtgctcaataa

SEQ ID NO: 8794247 - DNA, 22 bp, Homo sapiens
gtaatctcagctacttgggagg

SEQ ID NO: 8794248 - DNA, 22 bp, Homo sapiens
gtaatctcagctacttgggagg

SEQ ID NO: 8794249 - DNA, 22 bp, Homo sapiens
gtaatctcagctacttgggagg

SEQ ID NO: 8794250 - DNA, 22 bp, Homo sapiens
gtaatctcagctacttgggagg

SEQ ID NO: 8794251 - DNA, 22 bp, Homo sapiens
gtaatctcagctacttgggagg

SEQ ID NO: 8794252 - DNA, 22 bp, Homo sapiens
gtaatagtctcaaactcctgga

SEQ ID NO: 8794253 - DNA, 22 bp, Homo sapiens
gtaatagtctcaaactcctgga

SEQ ID NO: 8794254 - DNA, 22 bp, Homo sapiens
gtaatagtctcaaactcctgga

SEQ ID NO: 8794255 - DNA, 17 bp, Homo sapiens
gtaatataataagcctt

SEQ ID NO: 8794256 - DNA, 22 bp, Homo sapiens
gtaacaaaggataacttggttt

SEQ ID NO: 8794257 - DNA, 22 bp, Homo sapiens
gtaacaaaggataacttggttt

SEQ ID NO: 8794258 - DNA, 22 bp, Homo sapiens
gtaaattatttcaagatcatct

SEQ ID NO: 8794259 - DNA, 22 bp, Homo sapiens
gtaaatgtttgctgatgattct

SEQ ID NO: 8794260 - DNA, 22 bp, Homo sapiens
gtaaatgccacttaatgtaaag

SEQ ID NO: 8794261 - DNA, 22 bp, Homo sapiens
gtaaatcatggtcagaataaat

SEQ ID NO: 8794262 - DNA, 22 bp, Homo sapiens
gtaaatcatggtcagaataaat

SEQ ID NO: 8794263 - DNA, 22 bp, Homo sapiens
gtaaatcatggtcagaataaat

SEQ ID NO: 8794264 - DNA, 22 bp, Homo sapiens
gtaaatcataaaatttgagctc

SEQ ID NO: 8794265 - DNA, 22 bp, Homo sapiens
gtaaatgtgactccacctgagt

SEQ ID NO: 8794266 - DNA, 22 bp, Homo sapiens
gtaaatgtgctaaaatgtgtcg

SEQ ID NO: 8794267 - DNA, 22 bp, Homo sapiens
gtaaatgtgcttcttttaactt

SEQ ID NO: 8794268 - DNA, 22 bp, Homo sapiens
gtaaatgttgcatttatgggta

SEQ ID NO: 8794269 - DNA, 22 bp, Homo sapiens
gtaaatgtgttttatggtcgcc

SEQ ID NO: 8794270 - DNA, 22 bp, Homo sapiens
gtaaatgtgaatgtcatttagc

SEQ ID NO: 8794271 - DNA, 22 bp, Homo sapiens
gtaaatgtgaatgtcatttagc

SEQ ID NO: 8794272 - DNA, 22 bp, Homo sapiens
gtaaatgcgattgactgatgga

SEQ ID NO: 8794273 - DNA, 22 bp, Homo sapiens
gtaaatgtcctgctacagagtg

SEQ ID NO: 8794274 - DNA, 22 bp, Homo sapiens
ggtgggcagctcttggcaggca

SEQ ID NO: 8794275 - DNA, 22 bp, Homo sapiens
ggtgggcagctcttggcaggca

SEQ ID NO: 8794276 - DNA, 22 bp, Homo sapiens
ggtgggcacattcagtctctgt

SEQ ID NO: 8794277 - DNA, 22 bp, Homo sapiens
ggtgggcacattcagtctctgt

SEQ ID NO: 8794278 - DNA, 22 bp, Homo sapiens
ggtgggcacattcagtctctgt

SEQ ID NO: 8794279 - DNA, 22 bp, Homo sapiens
ggtgggcacccgagactggatc

SEQ ID NO: 8794280 - DNA, 22 bp, Homo sapiens
ggtgggcacattcagtctctgt

SEQ ID NO: 8794281 - DNA, 22 bp, Homo sapiens
ggtgggcacccgagactggatc

SEQ ID NO: 8794282 - DNA, 22 bp, Homo sapiens
ggtgggcacccgagactggatc

SEQ ID NO: 8794283 - DNA, 22 bp, Homo sapiens
ggtgggcacccgagactggatc

SEQ ID NO: 8794284 - DNA, 22 bp, Homo sapiens
ggtgggcagctcttggcaggca

SEQ ID NO: 8794285 - DNA, 22 bp, Homo sapiens
tcataaaacacaccaggtagtt

SEQ ID NO: 8794286 - DNA, 22 bp, Homo sapiens
tcataaaacacaccaggtagtt

SEQ ID NO: 8794287 - DNA, 19 bp, Homo sapiens
tcataaaaatggtaaccca

SEQ ID NO: 8794288 - DNA, 22 bp, Homo sapiens
tcataaaaatagactctaaagt

SEQ ID NO: 8794289 - DNA, 22 bp, Homo sapiens
tcataaaaatagactctaaagt

SEQ ID NO: 8794290 - DNA, 22 bp, Homo sapiens
tcagtttttctatactttgtag

SEQ ID NO: 8794291 - DNA, 22 bp, Homo sapiens
tcataaaaatagactctaaagt

SEQ ID NO: 8794292 - DNA, 22 bp, Homo sapiens
tcagtttttaagagttatgcga

SEQ ID NO: 8794293 - DNA, 22 bp, Homo sapiens
tcagttttgtatgttgtaagtc

SEQ ID NO: 8794294 - DNA, 22 bp, Homo sapiens
tcagttttgtatgttgtaagtc

SEQ ID NO: 8794295 - DNA, 23 bp, Homo sapiens
tcagttttggctgttcagtgttg

SEQ ID NO: 8794296 - DNA, 22 bp, Homo sapiens
tcagttttctcatctgtaattt

SEQ ID NO: 8794297 - DNA, 22 bp, Homo sapiens
tcagttttctcatttatgagat

SEQ ID NO: 8794298 - DNA, 22 bp, Homo sapiens
tcagttttgaaaacattgaatg

SEQ ID NO: 8794299 - DNA, 22 bp, Homo sapiens
tcagttcagtatacactattct

SEQ ID NO: 8794300 - DNA, 22 bp, Homo sapiens
tcagttcctgttgcacagcatc

SEQ ID NO: 8794301 - DNA, 22 bp, Homo sapiens
tcagtttcctggttttgacatt

SEQ ID NO: 8794302 - DNA, 22 bp, Homo sapiens
tcagtttctaaatcttaccaat

SEQ ID NO: 8794303 - DNA, 22 bp, Homo sapiens
tcagtttctttactcatagaat

SEQ ID NO: 8794304 - DNA, 22 bp, Homo sapiens
tcagtttctccatcgctccagt

SEQ ID NO: 8794305 - DNA, 22 bp, Homo sapiens
tcagtttcttcatctccctaac

SEQ ID NO: 8794306 - DNA, 22 bp, Homo sapiens
tcagttacctgacagtggttat

SEQ ID NO: 8794307 - DNA, 22 bp, Homo sapiens
tcagttactcctttccttaggt

SEQ ID NO: 8794308 - DNA, 22 bp, Homo sapiens
tcagttatcattgctgtaaatt

SEQ ID NO: 8794309 - DNA, 23 bp, Homo sapiens
tcagttattggtgataaagctgg

SEQ ID NO: 8794310 - DNA, 22 bp, Homo sapiens
tcagttagattgcctccttaga

SEQ ID NO: 8794311 - DNA, 22 bp, Homo sapiens
tcagttagcgtaatcactgggg

SEQ ID NO: 8794312 - DNA, 22 bp, Homo sapiens
tcagtgggagcaggagagtgac

SEQ ID NO: 8794313 - DNA, 22 bp, Homo sapiens
tcagtggattgtagaaggctta

SEQ ID NO: 8794314 - DNA, 22 bp, Homo sapiens
tcagtggattgacatgaaaaag

SEQ ID NO: 8794315 - DNA, 22 bp, Homo sapiens
tcagtgcttgcctctggaggag

SEQ ID NO: 8794316 - DNA, 22 bp, Homo sapiens
tcagtgcttgcctctggaggag

SEQ ID NO: 8794317 - DNA, 22 bp, Homo sapiens
tcagtgcttgacagctctggga

SEQ ID NO: 8794318 - DNA, 22 bp, Homo sapiens
tcagtgcttatattctgagcct

SEQ ID NO: 8794319 - DNA, 22 bp, Homo sapiens
tcagtgcttttgagaagctcct

SEQ ID NO: 8794320 - DNA, 22 bp, Homo sapiens
tcagtggaactgtctgggtgag

SEQ ID NO: 8794321 - DNA, 22 bp, Homo sapiens
tcataaaatgctcctgatattg

SEQ ID NO: 8794322 - DNA, 22 bp, Homo sapiens
tcataaaatgctcctgatattg

SEQ ID NO: 8794323 - DNA, 22 bp, Homo sapiens
tcataaaatgctcctgatattg

SEQ ID NO: 8794324 - DNA, 22 bp, Homo sapiens
tcataaaatgctcctgatattg

SEQ ID NO: 8794325 - DNA, 22 bp, Homo sapiens
tcataaaagtactcatgttcat

SEQ ID NO: 8794326 - DNA, 22 bp, Homo sapiens
tcataaaagtactcatgttcat

SEQ ID NO: 8794327 - DNA, 22 bp, Homo sapiens
tcataaactcactagtttatgt

SEQ ID NO: 8794328 - DNA, 22 bp, Homo sapiens
tcataaacaaaacagtttatgc

SEQ ID NO: 8794329 - DNA, 22 bp, Homo sapiens
tcataaacacactagtatgatt

SEQ ID NO: 8794330 - DNA, 20 bp, Homo sapiens
tcataaagaggaaataaata

SEQ ID NO: 8794331 - DNA, 22 bp, Homo sapiens
tcatatttgggggtgtgtgttt

SEQ ID NO: 8794332 - DNA, 22 bp, Homo sapiens
tcatatttgggggtgtgtgttt

SEQ ID NO: 8794333 - DNA, 22 bp, Homo sapiens
tcatatttgggggtgtgtgttt

SEQ ID NO: 8794334 - DNA, 22 bp, Homo sapiens
tcataaagagtgctgttgtttt

SEQ ID NO: 8794335 - DNA, 22 bp, Homo sapiens
tcataaagagtgctgttgtttt

SEQ ID NO: 8794336 - DNA, 22 bp, Homo sapiens
tcataaagagtgctgttgtttt

SEQ ID NO: 8794337 - DNA, 22 bp, Homo sapiens
tcataaagcatttcagcttttg

SEQ ID NO: 8794338 - DNA, 22 bp, Homo sapiens
tcataaagatactaagtgagtt

SEQ ID NO: 8794339 - DNA, 20 bp, Homo sapiens
tcatccaggacaggagtggc

SEQ ID NO: 8794340 - DNA, 20 bp, Homo sapiens
tcatccaggacaggagtggc

SEQ ID NO: 8794341 - DNA, 22 bp, Homo sapiens
tcatccaaggattttattgcat

SEQ ID NO: 8794342 - DNA, 22 bp, Homo sapiens
tcatccagcctcatcaggagct

SEQ ID NO: 8794343 - DNA, 22 bp, Homo sapiens
tcatccaaggagaccttgcaga

SEQ ID NO: 8794344 - DNA, 22 bp, Homo sapiens
tcatcattctgacaagtctaca

SEQ ID NO: 8794345 - DNA, 22 bp, Homo sapiens
tcatcatctgcaagctcatgtc

SEQ ID NO: 8794346 - DNA, 23 bp, Homo sapiens
tcatcaaaggaagtacgtgtcac

SEQ ID NO: 8794347 - DNA, 22 bp, Homo sapiens
tcatcatccttttttgaagagt

SEQ ID NO: 8794348 - DNA, 20 bp, Homo sapiens
tcatatttttgccctgggcc

SEQ ID NO: 8794349 - DNA, 22 bp, Homo sapiens
tcatattttgcaaggtcagcta

SEQ ID NO: 8794350 - DNA, 22 bp, Homo sapiens
tcatcaaagcgcttggagtagg

SEQ ID NO: 8794351 - DNA, 22 bp, Homo sapiens
tcatcaaagcgcttggagtagg

SEQ ID NO: 8794352 - DNA, 22 bp, Homo sapiens
tcatcaaaagccttctgggtta

SEQ ID NO: 8794353 - DNA, 22 bp, Homo sapiens
tcatctaagagtcttacattta

SEQ ID NO: 8794354 - DNA, 22 bp, Homo sapiens
tcatctaagagtcttacattta

SEQ ID NO: 8794355 - DNA, 22 bp, Homo sapiens
tcatctaagagtcttacattta

SEQ ID NO: 8794356 - DNA, 22 bp, Homo sapiens
tcatctaagagtcttacattta

SEQ ID NO: 8794357 - DNA, 20 bp, Homo sapiens
tcatccttggcctctaccca

SEQ ID NO: 8794358 - DNA, 20 bp, Homo sapiens
tcatccttggcctctaccca

SEQ ID NO: 8794359 - DNA, 20 bp, Homo sapiens
tcatccttggcctctaccca

SEQ ID NO: 8794360 - DNA, 22 bp, Homo sapiens
tcatctctagacaggaggctgg

SEQ ID NO: 8794361 - DNA, 22 bp, Homo sapiens
tcatctctcaggataccagcag

SEQ ID NO: 8794362 - DNA, 20 bp, Homo sapiens
tcatggctgctgagaggttc

SEQ ID NO: 8794363 - DNA, 22 bp, Homo sapiens
tcatctctccccagtgtcttta

SEQ ID NO: 8794364 - DNA, 22 bp, Homo sapiens
tcatctcagagaggtatgttag

SEQ ID NO: 8794365 - DNA, 22 bp, Homo sapiens
tcatctcagggcgacatcatgt

SEQ ID NO: 8794366 - DNA, 22 bp, Homo sapiens
tcatctatttatgtagaacaag

SEQ ID NO: 8794367 - DNA, 22 bp, Homo sapiens
tcatctaagagtcttacattta

SEQ ID NO: 8794368 - DNA, 22 bp, Homo sapiens
tcatctaattttggaacagaga

SEQ ID NO: 8794369 - DNA, 22 bp, Homo sapiens
tcatccatatagaaagatgatt

SEQ ID NO: 8794370 - DNA, 20 bp, Homo sapiens
tcatccagttggtttatggt

SEQ ID NO: 8794371 - DNA, 22 bp, Homo sapiens
tcatccatgtcagagcatgtat

SEQ ID NO: 8794372 - DNA, 22 bp, Homo sapiens
tcatccctaaggacagctctgc

SEQ ID NO: 8794373 - DNA, 22 bp, Homo sapiens
tcatccctctgccaggcccagg

SEQ ID NO: 8794374 - DNA, 22 bp, Homo sapiens
tcatccctaaggacagctctgc

SEQ ID NO: 8794375 - DNA, 22 bp, Homo sapiens
tcaggcctttcttcagagcttc

SEQ ID NO: 8794376 - DNA, 22 bp, Homo sapiens
tcaggcctttcttcagagcttc

SEQ ID NO: 8794377 - DNA, 22 bp, Homo sapiens
tcaggctcaaagggccggatga

SEQ ID NO: 8794378 - DNA, 22 bp, Homo sapiens
tcaggctagaagtaattgtgtt

SEQ ID NO: 8794379 - DNA, 22 bp, Homo sapiens
tcaggctacttgctttaaagta

SEQ ID NO: 8794380 - DNA, 22 bp, Homo sapiens
tcaggctcaggaatgtgtttat

SEQ ID NO: 8794381 - DNA, 21 bp, Homo sapiens
tcaggctaattccaaggtagg

SEQ ID NO: 8794382 - DNA, 22 bp, Homo sapiens
tcaggctaacggcatattgcct

SEQ ID NO: 8794383 - DNA, 22 bp, Homo sapiens
tcaggctccctgctgggctctg

SEQ ID NO: 8794384 - DNA, 22 bp, Homo sapiens
tcaggctccctgctgggctctg

SEQ ID NO: 8794385 - DNA, 22 bp, Homo sapiens
tcaggctcaggttaggggccaa

SEQ ID NO: 8794386 - DNA, 20 bp, Homo sapiens
tcaggctccgcattaactta

SEQ ID NO: 8794387 - DNA, 22 bp, Homo sapiens
tcaggctctacacttgacacac

SEQ ID NO: 8794388 - DNA, 22 bp, Homo sapiens
tcaggctctcagaccaacagca

SEQ ID NO: 8794389 - DNA, 22 bp, Homo sapiens
tcaggctctcagaccaacagca

SEQ ID NO: 8794390 - DNA, 22 bp, Homo sapiens
tcaggctgaatcatcctagctt

SEQ ID NO: 8794391 - DNA, 22 bp, Homo sapiens
tcaggctgaaggaggcctatct

SEQ ID NO: 8794392 - DNA, 22 bp, Homo sapiens
tcaggctgaaggaggcctatct

SEQ ID NO: 8794393 - DNA, 18 bp, Homo sapiens
tcaggctctctggctaga

SEQ ID NO: 8794394 - DNA, 22 bp, Homo sapiens
tcaggctctgccacctagatta

SEQ ID NO: 8794395 - DNA, 22 bp, Homo sapiens
tcaggctctgagctgatgctaa

SEQ ID NO: 8794396 - DNA, 22 bp, Homo sapiens
tcaggctctgagctgatgctaa

SEQ ID NO: 8794397 - DNA, 22 bp, Homo sapiens
tcaggctctgggtacacctgac

SEQ ID NO: 8794398 - DNA, 22 bp, Homo sapiens
tcaggctgaaaggactccagtt

SEQ ID NO: 8794399 - DNA, 22 bp, Homo sapiens
tcaggctgaaaggactccagtt

SEQ ID NO: 8794400 - DNA, 22 bp, Homo sapiens
tcaggctgaaaggactccagtt

SEQ ID NO: 8794401 - DNA, 22 bp, Homo sapiens
tcaggctctgggtacacctgac

SEQ ID NO: 8794402 - DNA, 22 bp, Homo sapiens
tcaggctctgccacctagatta

SEQ ID NO: 8794403 - DNA, 22 bp, Homo sapiens
tcaggctgagaaaatctggacc

SEQ ID NO: 8794404 - DNA, 22 bp, Homo sapiens
tcaggctgagaaaatctggacc

SEQ ID NO: 8794405 - DNA, 22 bp, Homo sapiens
tcaggctgaccaggttttgctc

SEQ ID NO: 8794406 - DNA, 21 bp, Homo sapiens
tcagggactaggtactgggga

SEQ ID NO: 8794407 - DNA, 22 bp, Homo sapiens
tcaggctgaggtcatctgcatc

SEQ ID NO: 8794408 - DNA, 22 bp, Homo sapiens
tcagggactaggtgctgcctga

SEQ ID NO: 8794409 - DNA, 22 bp, Homo sapiens
tcaggctgaggtcatctgcatc

SEQ ID NO: 8794410 - DNA, 22 bp, Homo sapiens
tcagggacttacaaaccagaag

SEQ ID NO: 8794411 - DNA, 22 bp, Homo sapiens
tcagggacttacaaaccagaag

SEQ ID NO: 8794412 - DNA, 22 bp, Homo sapiens
tcagggactgttactgcctttg

SEQ ID NO: 8794413 - DNA, 22 bp, Homo sapiens
tcagggactgcagagggaagct

SEQ ID NO: 8794414 - DNA, 22 bp, Homo sapiens
tcagggcaaaagggaaaccatt

SEQ ID NO: 8794415 - DNA, 22 bp, Homo sapiens
tcagggcaaagggcagagtttg

SEQ ID NO: 8794416 - DNA, 22 bp, Homo sapiens
tcagggcaagtctcagaaggtt

SEQ ID NO: 8794417 - DNA, 22 bp, Homo sapiens
tcagggcaatgtccctcagaag

SEQ ID NO: 8794418 - DNA, 22 bp, Homo sapiens
tcagggttgctgtgatcagtcc

SEQ ID NO: 8794419 - DNA, 20 bp, Homo sapiens
tcaggtagatctttgaggtc

SEQ ID NO: 8794420 - DNA, 21 bp, Homo sapiens
tcaggtagttgctttgttgaa

SEQ ID NO: 8794421 - DNA, 20 bp, Homo sapiens
tcaggtagatctttgaggtc

SEQ ID NO: 8794422 - DNA, 22 bp, Homo sapiens
tcagggtaaaccttcactgtga

SEQ ID NO: 8794423 - DNA, 21 bp, Homo sapiens
tcagggttcaaaggaactgat

SEQ ID NO: 8794424 - DNA, 22 bp, Homo sapiens
tcaggtcccactgctagtaagt

SEQ ID NO: 8794425 - DNA, 22 bp, Homo sapiens
tcaggtctatactatgagaggc

SEQ ID NO: 8794426 - DNA, 22 bp, Homo sapiens
tcaggtctatactatgagaggc

SEQ ID NO: 8794427 - DNA, 22 bp, Homo sapiens
tcaggtctatagaagaggaggg

SEQ ID NO: 8794428 - DNA, 22 bp, Homo sapiens
tcaggtctatagaagaggaggg

SEQ ID NO: 8794429 - DNA, 22 bp, Homo sapiens
tcaggtcttgagccatcaggat

SEQ ID NO: 8794430 - DNA, 22 bp, Homo sapiens
tcaggtctgtactattgtcttg

SEQ ID NO: 8794431 - DNA, 22 bp, Homo sapiens
tcaggtctgtactattgtcttg

SEQ ID NO: 8794432 - DNA, 22 bp, Homo sapiens
tcaggtctgatgcctcatccat

SEQ ID NO: 8794433 - DNA, 22 bp, Homo sapiens
tcaggtctgggcacatggtaca

SEQ ID NO: 8794434 - DNA, 20 bp, Homo sapiens
tcaggtgacacacgtggcac

SEQ ID NO: 8794435 - DNA, 22 bp, Homo sapiens
tcaggtcttttgtctcctagaa

SEQ ID NO: 8794436 - DNA, 22 bp, Homo sapiens
tcaggtcttgagccatcaggat

SEQ ID NO: 8794437 - DNA, 22 bp, Homo sapiens
tcaggtcttttgtctcctagaa

SEQ ID NO: 8794438 - DNA, 22 bp, Homo sapiens
tcagtgcagtgaaaggtttact

SEQ ID NO: 8794439 - DNA, 22 bp, Homo sapiens
tcaggtgacctgagccactatg

SEQ ID NO: 8794440 - DNA, 22 bp, Homo sapiens
tcagtgcattaataatatcagt

SEQ ID NO: 8794441 - DNA, 22 bp, Homo sapiens
tcagtgcattcatgggtggctg

SEQ ID NO: 8794442 - DNA, 22 bp, Homo sapiens
tcagtgcatcacagaactttgt

SEQ ID NO: 8794443 - DNA, 22 bp, Homo sapiens
tcagtgcatggacagatttaga

SEQ ID NO: 8794444 - DNA, 22 bp, Homo sapiens
tcagggctggcttttgcagagc

SEQ ID NO: 8794445 - DNA, 22 bp, Homo sapiens
tcagggctgtggttccttttct

SEQ ID NO: 8794446 - DNA, 22 bp, Homo sapiens
tcagggctggcttttgcagagc

SEQ ID NO: 8794447 - DNA, 22 bp, Homo sapiens
tcaggggaaatctctcagcgaa

SEQ ID NO: 8794448 - DNA, 22 bp, Homo sapiens
tcagggcagcctaaggcacctc

SEQ ID NO: 8794449 - DNA, 22 bp, Homo sapiens
tcagggcagaatccaaagaatt

SEQ ID NO: 8794450 - DNA, 22 bp, Homo sapiens
tcagggcagaatccaaagaatt

SEQ ID NO: 8794451 - DNA, 22 bp, Homo sapiens
tcagggcactgtcacctgatat

SEQ ID NO: 8794452 - DNA, 21 bp, Homo sapiens
tcaggggctgtgttttccatc

SEQ ID NO: 8794453 - DNA, 22 bp, Homo sapiens
tcaggggctgtgcatttcccag

SEQ ID NO: 8794454 - DNA, 22 bp, Homo sapiens
tcaggggcttgaggtgcatgtc

SEQ ID NO: 8794455 - DNA, 22 bp, Homo sapiens
tcaggggcttgaggtgcatgtc

SEQ ID NO: 8794456 - DNA, 22 bp, Homo sapiens
tcaggggcttgaggtgcatgtc

SEQ ID NO: 8794457 - DNA, 22 bp, Homo sapiens
tcaggggcttgaggtgcatgtc

SEQ ID NO: 8794458 - DNA, 22 bp, Homo sapiens
tcaggggcagccggggaagcca

SEQ ID NO: 8794459 - DNA, 22 bp, Homo sapiens
tcaggggaggttgaatcgtctc

SEQ ID NO: 8794460 - DNA, 22 bp, Homo sapiens
tcaggggcccttccctcagcag

SEQ ID NO: 8794461 - DNA, 22 bp, Homo sapiens
tcaggggcagctgtgctttgtg

SEQ ID NO: 8794462 - DNA, 22 bp, Homo sapiens
tcaggggcagccggggaagcca

SEQ ID NO: 8794463 - DNA, 22 bp, Homo sapiens
tcaggggaaatctctcagcgaa

SEQ ID NO: 8794464 - DNA, 22 bp, Homo sapiens
tcagggctggcttttgcagagc

SEQ ID NO: 8794465 - DNA, 22 bp, Homo sapiens
tcaggggacagccagctggagg

SEQ ID NO: 8794466 - DNA, 22 bp, Homo sapiens
tcaggggacttaggagagaagt

SEQ ID NO: 8794467 - DNA, 22 bp, Homo sapiens
tcaggaggtctgctgcggggtg

SEQ ID NO: 8794468 - DNA, 22 bp, Homo sapiens
tcaggattatttcagtggcttt

SEQ ID NO: 8794469 - DNA, 22 bp, Homo sapiens
tcaggcaaggcccttagagtgt

SEQ ID NO: 8794470 - DNA, 22 bp, Homo sapiens
tcaggcaccccttgagtagggg

SEQ ID NO: 8794471 - DNA, 22 bp, Homo sapiens
tcaggcaccctctattttcatc

SEQ ID NO: 8794472 - DNA, 22 bp, Homo sapiens
tcaggcaccccttgagtagggg

SEQ ID NO: 8794473 - DNA, 22 bp, Homo sapiens
tcaggcaccccttgagtagggg

SEQ ID NO: 8794474 - DNA, 22 bp, Homo sapiens
tcaggagggtgacaggccctgg

SEQ ID NO: 8794475 - DNA, 22 bp, Homo sapiens
tcaggaggtccgcccgggaggg

SEQ ID NO: 8794476 - DNA, 22 bp, Homo sapiens
tcaggcagagttaatttgctcc

SEQ ID NO: 8794477 - DNA, 22 bp, Homo sapiens
tcaggcagagttaatttgctcc

SEQ ID NO: 8794478 - DNA, 22 bp, Homo sapiens
tcaggcagaaaaatcactaatt

SEQ ID NO: 8794479 - DNA, 22 bp, Homo sapiens
tcaggcactggctgagtgatgg

SEQ ID NO: 8794480 - DNA, 22 bp, Homo sapiens
tcaggcagatgcagggatggat

SEQ ID NO: 8794481 - DNA, 22 bp, Homo sapiens
tcaggcagcattaaacttcagc

SEQ ID NO: 8794482 - DNA, 22 bp, Homo sapiens
tcaggcagctccaggaatggta

SEQ ID NO: 8794483 - DNA, 23 bp, Homo sapiens
tcaggcagctggggtagttggag

SEQ ID NO: 8794484 - DNA, 23 bp, Homo sapiens
tcaggcagctggggtagttggag

SEQ ID NO: 8794485 - DNA, 22 bp, Homo sapiens
tcaggcaggaagcccctgcaca

SEQ ID NO: 8794486 - DNA, 22 bp, Homo sapiens
tcaggcaggacaattatttagg

SEQ ID NO: 8794487 - DNA, 22 bp, Homo sapiens
tcaggcaggacaattatttagg

SEQ ID NO: 8794488 - DNA, 22 bp, Homo sapiens
tcaggcaggatcccagggaagg

SEQ ID NO: 8794489 - DNA, 22 bp, Homo sapiens
tcaggcaggatcccagggaagg

SEQ ID NO: 8794490 - DNA, 22 bp, Homo sapiens
tcaggcaggaagggaggacttg

SEQ ID NO: 8794491 - DNA, 22 bp, Homo sapiens
tcaggcaggaagggaggacttg

SEQ ID NO: 8794492 - DNA, 22 bp, Homo sapiens
tcaggcaggaagggaggacttg

SEQ ID NO: 8794493 - DNA, 22 bp, Homo sapiens
tcaggcaggaagcccctgcaca

SEQ ID NO: 8794494 - DNA, 22 bp, Homo sapiens
tcaggcaggcagagggcaaatg

SEQ ID NO: 8794495 - DNA, 21 bp, Homo sapiens
tcaggcaggcgcagagggaag

SEQ ID NO: 8794496 - DNA, 22 bp, Homo sapiens
tcaggcaggcagagggcaaatg

SEQ ID NO: 8794497 - DNA, 21 bp, Homo sapiens
tcaggcaggcgcagagggaag

SEQ ID NO: 8794498 - DNA, 21 bp, Homo sapiens
tcaggcaggcgcagagggaag

SEQ ID NO: 8794499 - DNA, 21 bp, Homo sapiens
tcaggcaggcgcagagggaag

SEQ ID NO: 8794500 - DNA, 21 bp, Homo sapiens
tcaggcaggcgcagagggaag

SEQ ID NO: 8794501 - DNA, 21 bp, Homo sapiens
tcaggcaggcgcagagggaag

SEQ ID NO: 8794502 - DNA, 22 bp, Homo sapiens
tcaggcagtagaattgcttgaa

SEQ ID NO: 8794503 - DNA, 22 bp, Homo sapiens
tcaggcaggttggctgcaggtc

SEQ ID NO: 8794504 - DNA, 22 bp, Homo sapiens
tcaggcaggttggctgcaggtc

SEQ ID NO: 8794505 - DNA, 22 bp, Homo sapiens
tcaggcaggctcagaggaaaac

SEQ ID NO: 8794506 - DNA, 22 bp, Homo sapiens
tcaggcaggctcagaggaaaac

SEQ ID NO: 8794507 - DNA, 22 bp, Homo sapiens
tcaggcaggctcagaggaaaac

SEQ ID NO: 8794508 - DNA, 21 bp, Homo sapiens
tcaggcaggtcccactgaaca

SEQ ID NO: 8794509 - DNA, 21 bp, Homo sapiens
tcaggcaggtcccactgaaca

SEQ ID NO: 8794510 - DNA, 22 bp, Homo sapiens
tcaggcaggtggctggctatgg

SEQ ID NO: 8794511 - DNA, 22 bp, Homo sapiens
tcaggaaagagttagatgatta

SEQ ID NO: 8794512 - DNA, 22 bp, Homo sapiens
tcaggaaagcctagaagagaac

SEQ ID NO: 8794513 - DNA, 22 bp, Homo sapiens
tcaggaaagctgcggtcacctg

SEQ ID NO: 8794514 - DNA, 22 bp, Homo sapiens
tcaggaaaggcagagtgtctgt

SEQ ID NO: 8794515 - DNA, 22 bp, Homo sapiens
tcaggaaaggcagagtgtctgt

SEQ ID NO: 8794516 - DNA, 22 bp, Homo sapiens
tcaggaaatacaagtgacatca

SEQ ID NO: 8794517 - DNA, 22 bp, Homo sapiens
tcaggaaaggtttgttgaatgg

SEQ ID NO: 8794518 - DNA, 22 bp, Homo sapiens
tcaggaaatggaattcttgtgt

SEQ ID NO: 8794519 - DNA, 22 bp, Homo sapiens
tcaggaaagtgttctcagagga

SEQ ID NO: 8794520 - DNA, 22 bp, Homo sapiens
tcaggaaagtgttctcagagga

SEQ ID NO: 8794521 - DNA, 22 bp, Homo sapiens
tcaggaaagagtaatgtataca

SEQ ID NO: 8794522 - DNA, 22 bp, Homo sapiens
tcaggaaagagtgtatccatca

SEQ ID NO: 8794523 - DNA, 22 bp, Homo sapiens
tcaggaaagagtgtatccatca

SEQ ID NO: 8794524 - DNA, 22 bp, Homo sapiens
tcaggaaagagttagatgatta

SEQ ID NO: 8794525 - DNA, 22 bp, Homo sapiens
tcaggaaagagttagatgatta

SEQ ID NO: 8794526 - DNA, 22 bp, Homo sapiens
tcaggaaagagttagatgatta

SEQ ID NO: 8794527 - DNA, 22 bp, Homo sapiens
tcaggagatggtctttataggc

SEQ ID NO: 8794528 - DNA, 22 bp, Homo sapiens
tcaggagatgtaaccttagctg

SEQ ID NO: 8794529 - DNA, 22 bp, Homo sapiens
tcaggaaattaaacacttgaaa

SEQ ID NO: 8794530 - DNA, 22 bp, Homo sapiens
tcaggagagtgttcagtggagg

SEQ ID NO: 8794531 - DNA, 22 bp, Homo sapiens
tcaggaaatgtcccaggttgtg

SEQ ID NO: 8794532 - DNA, 22 bp, Homo sapiens
tcaggaaatggcttcatggttt

SEQ ID NO: 8794533 - DNA, 22 bp, Homo sapiens
tcaggaaatggtgatttggttg

SEQ ID NO: 8794534 - DNA, 22 bp, Homo sapiens
tcaggaaatgtcccaggttgtg

SEQ ID NO: 8794535 - DNA, 22 bp, Homo sapiens
tcaggaaatggacatctttgct

SEQ ID NO: 8794536 - DNA, 22 bp, Homo sapiens
tcaggaaatggacatctttgct

SEQ ID NO: 8794537 - DNA, 22 bp, Homo sapiens
tcaggaaatggcttcatggttt

SEQ ID NO: 8794538 - DNA, 22 bp, Homo sapiens
tcaggagctatggactgtcaaa

SEQ ID NO: 8794539 - DNA, 22 bp, Homo sapiens
tcaggagctcttccctggtgtg

SEQ ID NO: 8794540 - DNA, 22 bp, Homo sapiens
tcaggagctgcattatcctgtg

SEQ ID NO: 8794541 - DNA, 22 bp, Homo sapiens
tcaggagcagggggaagctctg

SEQ ID NO: 8794542 - DNA, 20 bp, Homo sapiens
tcaggagcctaggacatgat

SEQ ID NO: 8794543 - DNA, 22 bp, Homo sapiens
tcaggagggctaagactgtagc

SEQ ID NO: 8794544 - DNA, 22 bp, Homo sapiens
tcaggagggctaagactgtagc

SEQ ID NO: 8794545 - DNA, 22 bp, Homo sapiens
tcaggagggagtgtggatagag

SEQ ID NO: 8794546 - DNA, 22 bp, Homo sapiens
tcaggaggatgtcggcaaattt

SEQ ID NO: 8794547 - DNA, 22 bp, Homo sapiens
tcaggaggcaagtaggtattga

SEQ ID NO: 8794548 - DNA, 23 bp, Homo sapiens
tcagctgttcttttccctgggac

SEQ ID NO: 8794549 - DNA, 23 bp, Homo sapiens
tcagcttcattgtcttctatggc

SEQ ID NO: 8794550 - DNA, 18 bp, Homo sapiens
tcagcttccagcatgttt

SEQ ID NO: 8794551 - DNA, 23 bp, Homo sapiens
tcagcttcattgtcttctatggc

SEQ ID NO: 8794552 - DNA, 22 bp, Homo sapiens
tcagcttcagatcagctagaga

SEQ ID NO: 8794553 - DNA, 22 bp, Homo sapiens
tcagcttcaaatttggtgaagt

SEQ ID NO: 8794554 - DNA, 22 bp, Homo sapiens
tcagcttcaaatttggtgaagt

SEQ ID NO: 8794555 - DNA, 23 bp, Homo sapiens
tcagcctcttaggacttctcacc

SEQ ID NO: 8794556 - DNA, 23 bp, Homo sapiens
tcagcctcttaggacttctcacc

SEQ ID NO: 8794557 - DNA, 22 bp, Homo sapiens
tcagctttctcaaagaagctgg

SEQ ID NO: 8794558 - DNA, 22 bp, Homo sapiens
tcagcttggacagcttggttga

SEQ ID NO: 8794559 - DNA, 22 bp, Homo sapiens
tcagcttgctaaaagggcatct

SEQ ID NO: 8794560 - DNA, 22 bp, Homo sapiens
tcagcttggacagcttggttga

SEQ ID NO: 8794561 - DNA, 22 bp, Homo sapiens
tcagcttgggaaattgagcaag

SEQ ID NO: 8794562 - DNA, 21 bp, Homo sapiens
tcagcttgcttcattattatg

SEQ ID NO: 8794563 - DNA, 22 bp, Homo sapiens
tcagcttgggggtggcttctca

SEQ ID NO: 8794564 - DNA, 20 bp, Homo sapiens
tcagcttgggtgaagttcat

SEQ ID NO: 8794565 - DNA, 22 bp, Homo sapiens
tcagcttgtgggtcagcctctg

SEQ ID NO: 8794566 - DNA, 22 bp, Homo sapiens
tcagcttgtttatgataagcag

SEQ ID NO: 8794567 - DNA, 22 bp, Homo sapiens
tcagcttgcgttctgggattta

SEQ ID NO: 8794568 - DNA, 21 bp, Homo sapiens
tcagcttgaatctagagatag

SEQ ID NO: 8794569 - DNA, 22 bp, Homo sapiens
tcagcttgatccatccaactat
